United States Patent 9,782,462 (MODIFIED POLYNUCLEOTIDES FOR THE PRODUCTION OF PROTEINS ASSOCIATED WITH HUMAN DISEASE) - sequence listing, part 128

SEQ ID NO: 247853 - DNA, 2418 bp, Artificial Sequence
  Description of Artificial Sequence: Synthetic coding sequence
atggatgaagacggactggagctgcagcaagagcccaactcattttttgatgctaccggtgcagacggtacccacatggacggcgaccagattgtggtggaggttcaagagactgtcttcgtctccgatgtagttgacagtgatatcacagtgcataactttgtgcctgatgatccagactccgtggtcatccaagacgtcatcgaggacgtggtgattgaagacgtccagtgtcccgacattatggaagaagctgatgtaagcgaaacggtgatcatacctgaacaggtgctggattctgatgtcaccgaggaagtctctcttgctcactgcaccgtcccagacgacgtcctggcctcagatattacctccgccagtatgtcaatgcctgaacacgtcctgacaggtgacagcatccatgtaagcgatgtgggacatgtaggccacgtcggtcacgtcgaacatgtcgtccatgatagcgtagtggaggcagagatagtgactgatccattgactactgacgtggtgtctgaggaggtattagttgctgactgtgcttccgaagccgtgatagatgccaacggcatccccgttgatcagcaggacgatgataaagggaactgcgaggactacctgatgatatcgctggacgacgcaggcaaaatcgaacatgatggctcatcggggatgaccatggacacggaatccgaaattgatccatgtaaggtagatggtacttgtcccgaagttataaaggtgtatatcttcaaggccgatcccggagaggacgatctcggcggaacagtggacatcgtcgaatcagagccagaaaatgaccacggagtcgagctgctagatcagaatagtagcatcagggtaccgagggagaagatggtgtatatgactgtgaacgacagtcagcctgaggacgaagacttaaatgtcgccgaaatagccgatgaggtatatatggaggtgattgtgggtgaagaagatgccgcagctgccgctgcggcagcagccgttcatgaacagcagatggacgataatgagataaaaacgtttatgcctattgcgtgggccgcagcctatggcaacaacagtgacgggatagagaacagaaatggcacagcctccgcactcctgcatatagatgagtcagccggtctcggacggctcgcgaagcagaaaccaaaaaaaaggcgcaggcctgactctagacagtatcagacagccattataattggaccagacggtcaccctctcactgtgtacccttgcatgatttgcggcaaaaaatttaaatctcgcggttttcttaagaggcatatgaaaaaccatccggaacacctggcaaaaaagaaataccgctgcacagattgcgattacacaaccaacaagaagattagccttcataatcacctagagtcccacaaactgacatccaaagccgagaaggctatcgagtgcgatgaatgtgggaagcactttagccacgctggtgctttatttacacataagatggtccataaggaaaagggtgcgaataaaatgcataagtgtaagttttgtgaatatgagaccgcggagcagggtctgctcaataggcatctcctggcggtgcattctaagaatttccctcatatctgcgttgaatgtggtaagggctttcgccaccccagcgaactgaagaaacatatgcgcatccatactggagaaaaaccttaccaatgccagtactgcgaatatagaagtgccgactcttccaatctgaagactcatgttaagactaagcattctaaagaaatgccttttaagtgcgatatctgcctgctgacgttctcggataccaaggaggttcagcagcatgcgctgatccatcaggaatcaaagactcatcaatgtctccactgtgaccataaatccagcaatagttctgatctgaaaagacatattattagcgtgcacactaaggattatccgcataagtgcgatatgtgcgacaaaggattccacagaccatccgaacttaagaagcatgttgcagcacataagggcaaaaaaatgcaccaatgccgccactgtgactttaaaatcgctgatccctttgtgctatcacgtcacatcctgtccgtccataccaaagatctcccatttagatgcaaacgctgtagaaagggctttcgccagcaaagtgagttgaagaaacatatgaagactcacagcggccgaaaggtgtaccaatgcgaatactgtgaatactctacgactgatgcgtctggcttcaagcgacatgttatatccattcataccaaagattacccccaccgatgcgaatactgtaaaaagggtttcagacgtccctctgagaaaaaccaacacataatgaggcatcacaaggaggtggggctgccttag

SEQ ID NO: 247854 - DNA, 99 bp, Artificial Sequence
  Description of Artificial Sequence: Synthetic coding sequence
atggacgaggatggtctggaattacagcaggaacccaactctttctttgatgcaactggcgcagacgggactcacatggatggggaccaaattgtttag

SEQ ID NO: 247855 - DNA, 408 bp, Artificial Sequence
  Description of Artificial Sequence: Synthetic coding sequence
atggatgaggacggcctcgagcttcagcaggaacctaacagtttctttgacgccaccggtgccgacggcacccacatggacggggatcagatcgtagtggaggtgcaggagacagtcttcgtgtccgatgttgtggatagtgatatcacagttcataattttgttccagacgacccggactccgtcgttatacaggacgtaattgaagatgtcgttatcgaagacgtccagtgtcccgatattatggaggaggccgatgtcagcgagactgtgattattccggagcaagtgctggactcagatgttaccgaggaagtaagtctggcacattgtacggtgcccgatgatgtcttggcaagtgacatcacatccgcttccatgagtatgccagagcatgtccttacatag

SEQ ID NO: 247856 - DNA, 1584 bp, Artificial Sequence
  Description of Artificial Sequence: Synthetic coding sequence
atggacacagaaagtgaaatcgacccctgtaaagtggatggcacctgcccagaagtgatcaaagtgtatatttttaaggccgaccctggtgaggacgatcttgggggaaccgttgatatcgtcgagtctgaaccggaaaacgaccacggtgttgagctgctcgatcagaactcttccatcagggtgccacgagagaaaatggtatatatgacagtgaacgacagccagccagaggatgaggatctcaatgtcgcagaaattgccgacgaggtatacatggaggtcatagtcggcgaggaggatgctgcagccgctgccgcagcagcggcagtgcatgagcagcagatggatgataatgagattaagactttcatgcccatcgcttgggccgctgcctacgcgatcataatagggcctgacgggcatccgctgactgtgtatccttgcatgatatgcgggaagaagttcaagtcacgcggttttttgaagcgccatatgaaaaaccaccccgagcacctggcaaagaagaagtacagatgcacagactgcgactacacgacaaataagaagatcagtttgcacaaccatttagaaagccataagttgactagtaaggccgaaaaggccattgaatgtgatgaatgcggtaagcacttttcacatgctggagccctgtttacccacaaaatggtacacaaagaaaagggagcgaacaagatgcataagtgcaaattttgcgagtacgaaacggccgagcagggcctgcttaatcgccacctgctggcagtgcacagtaagaacttccctcatatatgcgtagagtgcggaaagggctttcggcatccttctgaactcaagaaacacatgaggatccacaccggggaaaaaccgtaccagtgtcaatattgtgagtaccgcagcgccgactctagtaatcttaagactcatgtcaaaacaaagcacagcaaggagatgccctttaaatgtgacatttgtcttctcactttttcagatacaaaagaggtgcagcagcacgcccttatccatcaagagtccaagactcaccaatgcctccattgtgatcacaaaagttccaactcctccgacctgaagagacacatcatatccgtccacacaaaggactacccgcacaaatgcgacatgtgcgataagggtttccaccggcctagcgagcttaaaaagcacgtagcagcacataaaggcaagaaaatgcaccagtgccgccactgcgactttaaaatagcagacccctttgtgctgtcacgacatatactgtccgtgcatacaaaagatctgcccttcagatgtaagaggtgtcgcaaggggtttcgacagcagtctgagcttaaaaagcacatgaagacccactctgggaggaaggtgtaccagtgtgagtactgtgaatacagtacaacggacgcatcagggttcaagaggcacgtgatttccatccacaccaaggactatcctcaccggtgtgagtattgcaagaagggattcagaagaccaagtgagaagaaccagcacatcatgcgtcaccacaaagaagtgggccttccttag

SEQ ID NO: 247857 - DNA, 789 bp, Artificial Sequence
  Description of Artificial Sequence: Synthetic coding sequence
atggacgaggatgggcttgaactacaacaggagcctaacagctttttcgatgcgaccggagcagacggcactcatatggacggtgaccagatcgtggtggaggtgcaggagaccgtgtttgtttctgacgttgtagatagcgatattaccgtgcataactttgtgccagatgatcccgatagtgtcgttattcaggacgtcattgaggacgttgtcatcgaagacgttcaatgcccagacataatggaagaggccgacgttagtgaaacagttatcatcccagaacaggttctggatagcgacgttaccgaggaagttagtctagcccactgtaccgtccctgatgatgtcctcgctagtgatataactagtgccagcatgtcaatgcctgagcacgtgctcacaggtgatagtatacacgtatcagatgttggtcatgtggggcacgttggccatgtcgagcacgtagtccacgactccgtggtcgaagccgagatcgtgactgatcctttgacgaccgacgtcgtgagcgaggaagtgttggtcgccgactgtgcatcagaagccgtgatagacgcaaacggtatcccagtggaccaacaggacgatgataaagggaattgtgaggactatttgatgatttcatgcaacaattcagatgggatcgaaaatcgcaatggaacggccagcgcccttctgcacattgatgaatcggcagggctgggacgtctagcaaaacagaaacccaagaagcgcagacgccctgacagccggcaataccaaacctag

SEQ ID NO: 247858 - DNA, 1731 bp, Artificial Sequence
  Description of Artificial Sequence: Synthetic coding sequence
atgaccatggataccgaatccgaaatagatccttgtaaagtggacgggacctgtccagaagttatcaaagtgtatattttcaaagctgacccgggtgaggatgatctaggtggcaccgtcgacatagtggagtcggagcctgagaacgaccacggagtcgaacttttagatcagaactcttccatacgtgttccacgggagaaaatggtttacatgactgtcaacgattcccaacctgaggatgaggatctcaatgtggctgaaattgccgatgaggtgtacatggaagtgatagtaggcgaggaggatgctgccgcagccgctgcagccgctgctgtgcacgaacagcaaatggatgacaacgagatcaagactttcatgcctatagcatgggctgcagcatacggtaacaatagcgatggaatagagaaccggaacgggacagcaagcgctctcctgcatatcgatgagagtgctggacttggcaggctcgccaaacaaaaacctaagaaacgcagacgaccagattcccggcagtatcaaactgccataatcattggtcctgatggtcacccacttactgtgtacccatgtatgatttgtggaaagaagttcaagtcacgaggatttttaaagaggcacatgaaaaatcaccccgaacacttagccaagaaaaagtatagatgtactgattgtgactacaccaccaacaaaaaaatttctcttcataaccacctggagagccacaagttgacaagtaaggcagaaaaagctattgagtgtgacgagtgtgggaaacacttcagccacgccggagcactgttcactcacaagatggtgcacaaggagaaaggggcaaacaagatgcataagtgtaagttttgtgaatacgaaacagctgaacaaggacttctcaacaggcacctgctggcagtgcactcgaagaatttccctcacatttgcgttgagtgtggtaaagggttcaggcaccccagtgagctaaaaaagcacatgaggattcatacaggcgagaagccttaccaatgtcagtactgcgagtaccggtccgccgacagtagtaacttaaaaacccacgttaagacaaaacatagcaaagaaatgcctttcaaatgcgatatctgtctcctcaccttcagcgacactaaagaagtgcagcagcacgcactgattcatcaggagtccaagacacaccagtgtctccactgcgatcataagtccagcaacagttctgacctgaagagacacattatcagcgtgcatacaaaggactacccccataaatgtgacatgtgcgataagggattccatagaccttctgaattgaaaaagcacgttgccgcacacaaaggcaagaagatgcatcaatgccgacattgcgatttcaaaatcgcagatcccttcgtgctctcacgacatattcttagtgtgcatacgaaagatctcccttttcggtgcaagcgctgcagaaaggggttccgtcaacagtcagagctgaaaaaacatatgaaaacccattctggacgcaaagtctaccagtgcgagtattgtgagtacagcaccaccgacgcttctggatttaaacgacatgtgatttccatccacaccaaggattatccccatagatgtgaatattgtaagaaagggtttaggcgtccgagcgaaaagaaccagcacataatgcggcatcataaagaggtgggcctgccgtag

SEQ ID NO: 247859 - DNA, 2535 bp, Artificial Sequence
  Description of Artificial Sequence: Synthetic coding sequence
atggacgaggacggtctggagttgcaacaggagccaaactcgttcttcgatgctaccgatagggtgtctttttgtcatccaggctggagcacggtcgcaccttctggtagtacagcaacatctgccagtcaggcccaggtaatttgcagtgccagccgcgtgaccggggctacgggggctgatggaacacatatggacggggaccagatcgtggttgaggttcaggaaaccgttttcgtctcggatgtcgtggactctgacatcacagtccataactttgtgcccgatgaccctgactcagttgtgatccaggatgtaatcgaggatgtcgtgatcgaggatgtccagtgtcccgacatcatggaagaggccgatgtttctgagacagtgataatacccgagcaggtcttggactcagatgtaactgaagaagtcagtcttgcccattgtacagtacctgacgacgttttagctagcgacatcactagcgcaagcatgtcaatgcccgagcatgttctgaccggagatagcattcacgtctctgacgtgggacacgtcggccatgtcgggcacgtggagcacgtcgtgcatgattctgtggttgaagctgaaattgtgaccgatcccttgactaccgacgtcgtgtctgaggaggttcttgtagcggattgcgcttctgaagctgtgatcgatgcaaatgggattccggtggaccaacaggatgacgacaagggaaattgtgaagactatctgatgatttcactcgatgatgccggaaagatcgagcatgacgggagcagcgggatgacaatggacactgagtcagaaatcgacccctgcaaagtggacggcacttgtccagaggtcattaaggtctatatattcaaggcggatccgggagaggacgacctcgggggaactgtagacatcgtggaaagtgagcccgagaatgaccacggcgttgagttgctcgaccaaaattcctcaattcgcgtcccccgagaaaaaatggtgtatatgaccgttaatgacagccagccagaagatgaagatctgaacgtggcggagatcgccgacgaggtatatatggaggtgattgtgggagaggaggacgccgctgccgctgcagccgcagctgctgtccatgaacagcaaatggacgacaacgagattaaaacctttatgcctatagcatgggccgcagcatatgggaataattccgatggtatcgaaaataggaacggaactgcttccgctcttttgcatatagatgagagcgcaggcttgggacgtttggccaaacagaaaccaaagaagcggcgacgccctgatagcagacaataccagacagcgattataatcggcccagacgggcatccccttacagtatacccgtgtatgatctgtggtaagaagttcaagagccggggattcttgaagcgacacatgaaaaaccaccccgaacatcttgctaagaagaaataccgctgcacagactgcgactacactacgaataagaaaatttcactgcacaaccacctggagtctcataaacttactagtaaggctgagaaggcgattgaatgtgacgagtgtggaaaacacttcagtcacgctggggcactctttacccacaaaatggtccacaaggagaagggcgctaataagatgcacaaatgcaagttctgcgagtacgagaccgccgagcaggggctgcttaataggcacttacttgctgtacacagcaagaactttccacatatctgtgtcgaatgcggtaaaggattcaggcaccccagcgagttgaagaagcacatgcggatacacacaggtgagaaaccataccagtgccagtactgtgaatataggtctgctgatagcagcaatctcaaaacacatgtaaaaactaagcattcaaaggagatgccgttcaagtgcgacatctgtctgctgactttcagcgacacaaaagaggttcagcagcacgcgctgattcatcaggaatcaaagacacaccagtgtttacactgcgaccacaagagctcaaactcatcagatttaaagcgacatataatttcagtccacaccaaggattatccccataagtgcgatatgtgtgacaagggcttccataggccttcagagctgaaaaagcatgttgcagctcacaaaggcaaaaagatgcatcagtgtcgccactgcgacttcaaaattgctgatccattcgtgctcagcagacacattctgtctgtgcataccaaggacctgccattccggtgtaagaggtgccgcaaaggattcagacagcaatctgaactaaaaaaacatatgaagacccactccggacgcaaagtataccaatgtgaatattgcgagtattcaacgacggacgcgtctggatttaagaggcacgtcattagcatacacactaaagattacccccatcgttgtgaatactgcaaaaagggattcagaagacccagcgaaaaaaatcagcatattatgagacaccataaagaggtgggtctgccatag

SEQ ID NO: 247860 - DNA, 522 bp, Artificial Sequence
  Description of Artificial Sequence: Synthetic coding sequence
gggggatgcagtcaatacctgctactgttcgtggatgacgcgggaaagatcgaacacgatggctcatccggaatgactatggatacagaatctgagatagatccatgcaaagtggatggtacatgccctgaggtgatcaaggtgtacatctttaaagctgatccaggcgaagatgatctgggcggtacagtggatatagttgagagcgaacctgaaaacgatcacggcgtggaattactggaccagaatagttccatccgcgttcccagagaaaagatggtctacatgactgtcaacgatagtcaacctgaagacgaggacctcaatgtcgccgaaattgccgatgaggtttatatggaagtcatagtcggtgaggaggatgctgcagcagcagccgctgccgctgccgttcacgaacaacagatggatgataacgaaatcaaaactttcatgccgattgcgtgggctgctgcttacggcaacaatagcgacgggattgagaaccgaaatgggaccgcgtag

SEQ ID NO: 247861 - DNA, 2406 bp, Artificial Sequence
  Description of Artificial Sequence: Synthetic coding sequence
atggacgaggatgagttcgagttgcagcctcaggagcctaactccttctttgatggaatcggtgccgacgctacacatatggacggagatcagatagttgtcgaaattcaggaagcggtgttcgtctccaacatcgtggactcggatattaccgtgcacaatttcgtgcctgatgaccctgattctgtggtgatacaggacgtcgtggaagacgttgtaatagaagaggatgtgcagtgctccgacatactggaggaagccgacgttagcgagaatgtgatcattccggaacaagttttggacagcgacgtgactgaggaggttagcctgcctcattgtacagtgcccgacgatgtgcttgcatccgatatcacttctacaagtatgtcaatgcccgaacatgtcctgacatccgaatcaatgcatgtgtgtgacatcgggcacgtggaacatatggtgcacgactcagtagtcgaggctgaaatcatcacagacccactcacctccgatattgtcagtgaggaagtcttagttgccgactgcgccccagaggccgttattgacgctagtggcatttccgttgaccagcaggacaacgataaagcatcttgtgaggattacctgatgatttccctggacgatgcagggaagatcgaacatgacgggagcactggcgtaacgattgatgccgaatccgaaatggatccatgcaaagtagattcgacttgccctgaggttatcaaggtctatatattcaaagccgacccaggggaagatgatctcgggggaaccgtggatatcgtggagtctgaacccgaaaacgatcatggtgtggagttactcgaccagaatagctccattcgggttccacgggagaagatggtgtatatgaccgttaatgactcacagcaagaagacgaggacctcaacgtagccgaaatagcagatgaagtatacatggaagtcatcgtgggagaagaagatgcggctgtggctgccgctgcggcagccgttcacgaacagcagatcgacgaagatgaaatgaaaacattcgtgcctattgcttgggccgctgcgtacggcaataattctgatgggattgaaaacagaaatggaacagcttccgccctcctccatatcgatgaaagcgccggtttgggtcggctggccaagcagaagccgaaaaagaagcgccgacccgattcccgccagtaccagaccgctatcatcatcggccctgatggtcacccgctcactgtgtacccgtgcatgatctgtggaaaaaagttcaagtcgcgtggatttctcaaacgacatatgaagaatcatcctgagcatctagcaaagaaaaaataccattgcaccgactgcgattatacgaccaataaaaagataagcctccacaatcacctggaatctcacaaactgactagtaaggctgagaaagcgatcgaatgcgacgagtgtgggaaacattttagtcacgccggagccctattcacccataaaatggtacacaaggaaaaaggagctaacaagatgcacaagtgcaaattttgcgaatatgaaaccgcagagcagggcctcttgaataggcatctgctggccgtgcacagtaagaactttcctcacatctgtgtcgagtgcggaaaggggtttcgccacccctcagagctgaggaagcatatgcggattcacaccggcgagaaaccttaccagtgccagtattgcgaatacagatcagctgacagcagtaacctcaaaacccatatcaaaaccaagcacagtaaagagatgccttttaaatgtgacatctgcctgctgaccttcagcgacacaaaggaagttcaacagcacacactggtgcatcaagagtctaagactcaccagtgtctgcattgcgaccataaatcttccaactcgtccgacttaaaacggcacgtgatttccgtgcacacaaaggactacccacataagtgtgagatgtgcgagaaaggctttcatcggccatctgagctcaaaaaacatgtcgccgtgcataagggcaagaagatgcaccaatgtaggcattgcgattttaaaatagcagaccccttcgtgctgtcacgacatatcctgagtgtgcataccaaagacctccccttccggtgcaaaaggtgtagaaaagggtttcggcagcagaacgaactgaaaaaacacatgaaaacacattccggtaggaaggtctaccagtgcgagtattgcgagtatagtacgactgacgcctctgggtttaagcgccacgtcatatcaatacacactaaagactacccccacaggtgtgagtactgcaagaaggggttcagaaggccatctgagaaaaatcaacacatcatgagacaccacaaagaggtggggctgccttag

SEQ ID NO: 247862 - DNA, 2406 bp, Artificial Sequence
  Description of Artificial Sequence: Synthetic coding sequence
atggatgaggacgaattcgagttgcagccccaagagccaaacagcttctttgatgggattggagcagatgcaacgcacatggacggggatcagattgtcgtcgagatccaagaggctgtctttgtgtcaaatatcgtggattcggatataaccgtgcacaattttgttcccgacgaccctgatagcgtggttatccaggacgttgtggaagatgtggtcatcgaggaggacgtacagtgttctgacatcctagaggaagctgacgtgtcagaaaacgtgataatccccgagcaggtgcttgactcagatgtgaccgaagaggtctcactgccacattgtaccgtcccagatgatgttttagccagtgatatcacgagcacctcaatgtctatgcccgagcacgtactgacttcggagtccatgcacgtgtgtgacattggacacgtggaacacatggtgcatgactctgtagtggaagccgagattatcacggacccgttgacatcggacatcgtttcggaagaagtcctcgtcgctgactgtgcaccagaagccgtgatagatgccagcgggatatcagtggatcagcaggacaacgataaggcatcgtgcgaggactatcttatgatctcacttgatgatgcgggaaaaatcgaacatgatggctcgacaggcgtcaccatcgacgccgagagcgagatggatccctgcaaagtggactccacatgcccggaggtgatcaaagtgtacattttcaaagccgatcctggagaggacgatttagggggtacggtggatatagtcgagtcagagcccgaaaatgaccatggcgtggagctactggaccaaaacagctctattagggtaccacgggaaaagatggtttacatgacagtgaacgattcacagcaggaggatgaggacctgaacgtggctgaaattgctgatgaagtgtacatggaagtaattgtcggggaggaggacgccgctgtagcggctgccgctgccgctgtgcatgaacagcagatagacgaagatgagatgaagacattcgtgcccattgcttgggcagccgcatacgggaacaattcggacgggatagagaatagaaatggaactgcttctgcactgctccacattgacgagtcggccggactggggagacttgctaaacagaagcccaaaaaaaagcgtcgacctgacagtcgacagtaccagacggcgattattatcggaccggacggacatccccttaccgtctatccatgcatgatctgtggcaaaaaatttaagtccagaggatttctgaagcgacacatgaagaatcacccagaacatcttgctaagaagaagtaccattgcacagactgtgattacacgactaacaagaaaatctcgctccacaaccacttagagtctcacaagctgacaagtaaggccgaaaaggcgattgagtgcgatgaatgcggcaaacattttagccacgccggtgcccttttcacacataagatggtccataaggagaaaggtgcaaataaaatgcacaagtgcaaattttgtgagtatgagaccgccgagcagggcctgctgaaccgacacctgctggcagtgcatagtaaaaatttcccccacatttgcgtggaatgcggaaagggcttcagacacccatccgagctgcggaaacacatgagaatacacactggtgagaaaccataccagtgtcagtattgcgagtatagaagcgccgattcttccaacctcaagacacacattaagacaaaacatagcaaggaaatgcctttcaaatgcgatatctgtttgttgacattcagcgatactaaagaagtccagcagcacacccttgttcatcaggaatctaagacgcaccagtgcttgcattgcgaccataaatcaagcaacagcagtgatcttaagagacacgttatcagtgtgcatacaaaggactacccccataagtgcgagatgtgcgagaaagggttccaccggccaagcgagctcaaaaagcatgtagcagttcataaaggcaagaagatgcaccagtgccggcactgcgattttaaaattgccgatcccttcgtcttaagcagacacatcctgtcggtccataccaaagacctgccatttaggtgcaagcgctgtcgcaagggttttcggcaacaaaatgaactgaagaaacacatgaagacacattctggcaggaaagtttatcaatgcgaatattgcgagtacagtactaccgatgcctctgggttcaagcggcacgtaatcagcatccacaccaaagactatccccatcgatgcgaatactgcaagaaggggttccgtcgcccttcagagaagaaccaacatatcatgagacatcacaaggaagtgggccttccttag

SEQ ID NO: 247863 - DNA, 1833 bp, Artificial Sequence
  Description of Artificial Sequence: Synthetic coding sequence
atggacgaagacgaattcgaattgcaaccgcaggaacctaactccttcttcgatggaatcgtcgacgatgctgggaagatcgagcacgatgggagcactggggtcacaattgacgcagagtccgagatggatccttgcaaggtagactcaacctgtcccgaggtgattaaggtatacatctttaaggcagatcctggggaggacgatcttggagggactgtcgatatcgtcgaatctgagcctgagaacgaccatggagtggaactgttggatcagaattccagcatccgggtgccgagagaaaaaatggtgtacatgaccgttaatgacagccaacaagaagacgaagacctcaatgttgctgagatcgctgatgaagtgtatatggaggtcattgtgggcgaggaagatgctgccgtggcggctgctgctgctgctgtgcacgagcaacaaatcgatgaagatgagatgaagacattcgtgccaattgcgtgggcagcggcttatggtaacaattcagatggcatagaaaacaggaacggaactgctagtgccctgttgcacatagatgaaagcgccggattaggaaggctcgcaaaacagaagccaaaaaaaaagaggcgcccagattcaaggcaatatcagacagcaattatcattggccctgacggacatccgcttacagtgtacccatgtatgatttgtggaaaaaaattcaaaagccgagggttcctcaagcgtcacatgaaaaatcacccagagcatctggcaaagaaaaagtatcactgcacggattgtgattataccacaaataagaaaattagcttgcataaccacctcgagtcccataagctgactagtaaagccgagaaggctattgaatgcgatgaatgtggaaagcactttagtcatgccggtgcgttattcacacataaaatggtacacaaggaaaagggcgcaaacaagatgcacaaatgcaaattttgtgaatacgagaccgccgaacagggactgctgaaccggcacctgctagctgtccacagtaaaaattttccccatatctgcgtggagtgtgggaaggggtttaggcacccatccgaattacggaagcatatgcgcatccatactggcgaaaaaccatatcagtgtcagtattgcgagtacaggtctgccgactcttctaatctaaaaacccacattaaaactaagcatagcaaggagatgccctttaaatgtgacatctgcctcctcactttctctgataccaaggaggttcagcaacacactctggtgcatcaagagagcaagacccaccagtgcctccattgcgaccacaaaagctcgaatagttcggatctgaaaaggcatgttattagcgtgcacacaaaagattatccacacaaatgtgagatgtgtgaaaaagggttccacagaccgtcagaactgaaaaagcacgttgccgtgcataaaggtaagaagatgcaccagtgccggcactgtgacttcaaaattgctgacccatttgtcttatcccgacacatattgtccgtgcatacaaaggacctcccttttaggtgcaagcggtgtcgcaagggctttagacagcagaatgagctaaaaaagcacatgaaaacacactctggtcggaaagtgtatcagtgtgaatattgcgaatactcgacgacagacgcaagcggttttaaacggcacgttatttccattcatacaaaggactacccccaccggtgtgagtactgtaaaaagggatttaggaggccaagcgagaagaaccaacacattatgcgccatcacaaggaggttgggctgccttag

SEQ ID NO: 247864 - DNA, 276 bp, Artificial Sequence
  Description of Artificial Sequence: Synthetic coding sequence
atggatgaggacgagttcgagttgcaaccccaggagccgaacagctttttcgatggcattggcgcagacgccacacacatggacggcgatcagatcgtggtggaaatccaagaagccgtgttcgtctccaacatcgtagacagcgacataacagttcacaacttcgttcctgacgacccggacagtgtcgttattcaggacgtggtggaggacgtcgtcattgaggaagacgtgcagtgctccgatatcctggaagaggcagacgttagtgagtag

SEQ ID NO: 247865 - DNA, 2175 bp, Artificial Sequence
  Description of Artificial Sequence: Synthetic coding sequence
atggacggggaccagatcgtcgtagagattcaggaggccgtatttgtgtcgaatattgtcgatagcgacatcaccgtccataatttcgtgcctgacgatcctgactcagtggtgattcaggacgttgtggaagatgttgtcattgaagaggatgtccagtgttctgacattctggaagaggccgatgtgtccgaaaatgtcattattcccgaacaggtgctggactctgatgtgaccgaggaagtgtctcttccccattgtaccgtacccgatgatgtgctagcgtccgatatcacttccaccagcatgtcaatgccagagcacgtgctgacctctgaatcaatgcacgtgtgcgatattgggcacgttgagcacatggttcacgatagtgtggtagaagctgaaatcattactgatccgcttaccagtgacatagttagcgaagaagtgctagtggccgattgtgccccagaagctgtgatcgatgcatcagggattagcgtggatcagcaggataacgacaaggcttcttgcgaagattatctaatgatctcactcgacgatgccggaaaaatcgagcatgacgggtccactggcgtcaccattgatgcagagagcgaaatggacccatgcaaggtagactcaacctgtccggaagtcataaaagtctacattttcaaggcagaccctggagaagatgatctgggtgggacggtggatatcgtggagagtgaacccgagaatgatcacggggttgagctcttagatcaaaattcctcaattagagtgcccagagagaaaatggtgtacatgacagtaaatgatagccaacaggaggatgaagacctgagcaacaactccgatggcatcgagaacagaaatggaaccgcctccgcattgctgcatattgatgagtctgcaggcctgggaaggctggcaaaacagaagccaaagaaaaagcgccgtcccgactcccgtcaataccagactgcgatcataattgggcctgacggacacccactgacagtgtatccttgtatgatttgtggcaagaaatttaagtctaggggatttctgaagagacatatgaagaaccacccggaacacctggccaaaaagaaatatcattgcactgactgtgattatacaactaataagaaaatcagtctgcacaaccatctagagagtcataaattaacctcgaaagcggagaaggccatcgagtgcgatgagtgcggcaaacacttcagtcacgcaggagccctgttcacacataagatggtccataaggagaaaggcgcaaataagatgcataagtgcaaattttgtgaatacgagacagccgagcaaggccttctgaaccggcatctgctggcggtgcattctaagaattttccccacatctgcgtagagtgtggcaagggcttcaggcatccgtccgagctgaggaagcatatgagaatccatacaggagaaaagccctaccagtgccagtattgcgagtatcggtccgcggatagtagcaatctgaagacacacatcaagaccaaacattcaaaagagatgcccttcaagtgtgatatttgtttactgacttttagtgacacgaaggaagttcaacagcacactctggtccaccaggaaagtaagacacatcagtgtctgcactgtgaccataaatcctctaacagtagtgacttaaaacgccacgtgatttcagtgcatactaaagactatccccacaagtgcgagatgtgtgagaaggggttccacaggccctcagagctcaagaagcatgttgcggtccacaagggcaagaagatgcatcagtgccgacactgcgattttaagatcgccgacccattcgtattgagcagacatatcctgtcggtccacaccaaggacctaccatttaggtgcaaaaggtgccgcaagggattccggcagcagaatgaactgaagaaacacatgaaaacacatagtggccgtaaagtgtaccaatgcgagtactgcgaatacagtactacggacgcttccggatttaagcggcatgtcatcagtatccacactaaggattatccacatcgctgcgagtactgtaagaagggctttcgccgaccttctgaaaagaatcagcacattatgcggcatcacaaagaagtgggactaccgtag

SEQ ID NO: 247866 - DNA, 1617 bp, Artificial Sequence
  Description of Artificial Sequence: Synthetic coding sequence
atggcgagggaactgtccgagtcgactgccctagacgcccagagcactgaagaccaaatggaactgttggtgattaaggtggaagaggaggaagccggttttccctcatctcctgatttaggatccgagggatcgagagaaagatttcgaggctttagatatcccgaagctgccggtccacgggaggctctgtctagactccgtgaactgtgccgacagtggttgcaaccggagatgcattccaaggaacaaattcttgagttgctcgtcctggaacagttcctaacaatactgcctggaaaccttcagagttgggtgcgcgagcaacatcccgagagcggggaggaggttgtcgtgttactggaatacctcgaacgtcagctggatgagcccgctcctcaggtctctggagtggatcaggggcaagagctcttgtgttgtaaaatggcgctactcacacctgcacccggttctcaaagttctcagtttcagcttatgaaagctctgctgaaacacgagtctgtcggcagccaacccctacaggaccgcgtgttgcaagtcccggtgttagctcacggtgggtgctgccgggaagacaaagtggtggcctcaagattaacaccggagagccagggactcttgaaagtggaggacgtggctttgactctaactccagagtggacacagcaggattcctcccagggtaacctctgccgcgacgagaagcaggaaaatcacggttctctggtgagcctaggtgatgagaaacaaacaaaatcccgggatctacccccagcagaggagctgcccgaaaaagagcacgggaaaattagttgccaccttagagaagacatcgctcagatacctacatgtgctgaggcaggagagcaggaagggaggctgcagcggaagcagaaaaatgccactggaggcaggagacacatatgtcatgagtgcgggaagtcatttgctcagtcttctggactgtccaagcacaggcgaatccataccggagagaaaccctacgaatgcgaagagtgcggcaaggcgtttatcgggtctagtgctctcgttatccaccagagggttcatacaggcgaaaaaccatacgaatgcgaagagtgtggaaaggccttttcacacagtagtgatctcattaaacaccagagaactcataccggcgagaagccctacgaatgcgatgattgtggtaaaacgttctcacagagttgctcattattggagcatcacagaatccataccggggaaaaaccctaccagtgttccatgtgcggaaaggccttcagaagaagtagccacttgttgagacatcagcggatccataccggcgataaaaatgtacaggagcctgagcagggcgaggcctggaaaagcaggatggaatcccagcttgagaacgtggagactccaatgtcatataagtgtaacgaatgcgagaggtcgttcactcaaaataccggcttaatagagcaccaaaaaatccacacaggggagaaaccctatcaatgcaatgcttgtggcaaaggtttcacccgaatttcatatctcgtccagcaccagagatctcacgtgggcaagaacatcctaagccagtag

SEQ ID NO: 247867 - DNA, 1173 bp, Artificial Sequence
  Description of Artificial Sequence: Synthetic coding sequence
atggcactgctgacacccgctcccggttctcagtcctcccagttccagctcatgaaagcactgctgaagcatgaatcagtcgggagccagcccctgcaagaccgtgtgcttcaggtgccagtgctggctcacggaggttgttgcagggaagacaaagtggtggccagcagactcaccccagagagtcaaggtctcctcaaggtcgaggacgtggccttaacactgacccccgagtggactcagcaggatagctctcagggcaatttatgtagagacgaaaagcaggagaaccacggatccttggtcagcctgggggacgaaaagcagacgaagtctcgcgacttaccccctgctgaggaactgcccgagaaggaacatggaaagatctcatgtcatctgcgggaggacattgcacagattccgacttgcgccgaagcgggtgagcaggaaggaagattgcaacgaaagcagaagaatgcgaccggcggaaggcggcacatctgtcatgaatgcgggaagtcgtttgcgcaatcctcagggctgagcaagcatcgaaggatccatacaggcgaaaagccctacgagtgcgaggagtgtggtaaagcattcattgggtcttccgcacttgtgatacaccagcgtgtgcatactggtgagaaaccttacgagtgcgaggagtgcgggaaagctttttcccatagctctgatttgataaaacatcagcgcacgcacacgggcgaaaagccttatgaatgcgatgactgtggcaaaaccttctcacagtcctgcagcttactcgagcaccaccgtattcatactggggagaaaccataccagtgttccatgtgcgggaaagcatttcgacggagtagtcatctgttgcgacaccagcggatccatacaggcgataagaatgttcaggaaccggagcagggcgaggcctggaaaagccgaatggagtcacaacttgaaaacgttgagacccctatgtcttacaaatgtaacgaatgtgaacgcagcttcacccagaatactggactgatagaacatcagaagattcatactggagaaaagccttaccagtgcaatgcgtgcggcaagggatttacccgaatatcatacttggtacagcatcagcgtagtcacgtcggaaaaaacatcttgagccagtag

SEQ ID NO: 247868 - DNA, 1617 bp, Artificial Sequence
  Description of Artificial Sequence: Synthetic coding sequence
atggcgcgagaactatcagaatccaccgctctcgatgcccagagtacagaagatcagatggaactacttgtcattaaggtggaagaggaagaggctggattcccttcctcccccgatcttgggagcgagggcagccgggaacggttccggggttttcgatatccggaggctgccggacccagagaggccctgagccgcctccgcgaactctgtcggcagtggttacagccagaaatgcacagtaaggagcagattttagagctcttagtgcttgagcaatttctgaccatactgcctggcaacctgcaatcttgggtccgggagcagcatcccgagtcgggcgaggaggttgtggtgctgctcgagtacctggaacggcaacttgacgagcctgctccacaggtttcgggcgtggaccagggtcaggagctgctgtgttgcaagatggccttactgaccccagccccaggatcccagagttcacagttccaactgatgaaggctcttttaaagcacgagtctgttggatctcaaccgctgcaggacagggtgttgcaggtcccagttcttgcgcatgggggatgttgtcgcgaggataaggtggttgcctcacgcctgaccccggagtctcagggcctgttgaaagtagaagacgtcgccttaaccttgaccccagagtggactcaacaggactccagccagggaaatctgtgcagagatgaaaaacaagaaaaccacggtagcctcgtgtccttgggtgatgagaaacagacaaagagcagggacctgcccccagcagaggaactccccgaaaaagaacacggtaagataagctgtcacttgagagaggacatcgctcagatacccacctgcgctgaagcgggtgagcaggaagggagactccagaggaaacagaaaaatgctactgggggacgcagacacatctgccatgaatgcggaaagagcttcgcccagagcagtgggttgagcaagcatcggcgtatccatactggtgaaaaaccatatgaatgtgaggagtgcggtaaggcattcatagggagcagtgcccttgtgatccaccagcgggttcacaccggcgagaagccttacgagtgtgaggagtgtggcaaggctttttctcactcctccgatttgatcaagcatcagagaacgcacactggggagaagccatatgaatgtgacgattgcggtaagaccttttctcagtcctgttccctcttagagcaccacaggatacacacaggagaaaaaccttatcagtgttccatgtgcggtaaagcctttaggcgttcatcacacctccttcgccaccagcgaatccacactggagataagaatgtgcaggaacctgagcagggtgaagcctggaagtcgaggatggagtctcaactcgagaacgtggagacccccatgtcctacaaatgtaacgagtgcgagcggtcctttactcagaataccgggctcatcgaacaccagaaaattcacactggcgaaaagccatatcaatgtaatgcatgcgggaaaggctttactaggatttcctatctcgtgcagcatcagcggagccacgtaggaaaaaacatcttgagtcagtag

SEQ ID NO: 247869 - DNA, 537 bp, Artificial Sequence
  Description of Artificial Sequence: Synthetic coding sequence
atggcgcgagaactcagcgaaagcaccgccctggacgctcagtccacggaggatcagatggagttgctggtaatcaaagtagaggaggaagaagcagggttcccgagctcccccgatttgggttccgaagggtctcgagaacgctttcgcggattccggtaccctgaggccgctggacccagagaggcgctgagcaggcttagagaactgtgtcggcagtggctgcagcccgagatgcacagcaaagaacagattctggagttgctggtcctcgagcagtttttgaccattctgcccggaaatctccaatcttgggtgagggaacagcatcccgagtcaggagaggaggtggtggtactactggagtacctcgaacgtcagcttgatgagcccgctccacaggttgaacggaccggcctggtgtccgaacgatgcggcttattcccgcctgaaatcccagaccagagcgagggccactcctttaatattcaggaattcttcatctcattcctctaccgggagcctccttggcagtag

SEQ ID NO: 247870 - DNA, 993 bp, Artificial Sequence
  Description of Artificial Sequence: Synthetic coding sequence
cggcagagattcagagggtttcgttatcccgaagccgctgggcctcgggaagccctttctcgtcttcgcgaactttgtggtcagtggctgcagcccgaaatgcactccaaggagcagattctcgaactgctagtgctcgagcagtttttgacgattctgccaggcaatctacagtcctgggtgagggaacagcatccagaatccggcgaggaagtggtggtcttgttagaatatctagaaagacaactcgacgagccggctcctcaagtcgagcgcacagggctggtaagcgaacgttgtgctagaggtatcccgctaaggtccaggtcttcttccagcctgttcgttctggcttttctgccgtggcaggggataactcacagctgtagaccatttgtggtatctggtggtgagatccagacaaagtccagagatcttccaccagtgaaaaagctgcctgagaaagaacatggcaagatttgccatctccgcgaagacatcgcccagattcctactcacgcagaagccggagaacaggagggtaggctgcagcgaaaacaaaaaaatgctatcgggtcccgacgacactactgccatgaatgtgggaaatcatttgctcagagctccggtcttaccaagcaccgtagaatacacacaggcgagaagccctatgaatgcgaagactgcggaaagacctttatcggctcctctgcactcgtgatccatcagcgtgtgcatacaggggaaaaaccgtacgaatgtgaagagtgcggcaaggtcttctcacatagttccaatctcatcaaacaccaaagaacgcacaccggcgaaaaaccctatgagtgcgacgactgcggcaaaaccttctcccagagctgttccctcctcgaacaccacaagattcatacaggggagaagccgtaccagtgcaatatgtgcggtaaggcttttcgtcgcaactcccacctgctgcggcatcaacgcatacattag

SEQ ID NO: 247871 - DNA, 1638 bp, Artificial Sequence
  Description of Artificial Sequence: Synthetic coding sequence
atggccagagagccgagaaagaatgctgctctggatgctcagagcgccgaggaccagacaggtctacttaccgtcaaggtggagaaggaagaagcatccgctctgaccgctgaggttcgggcaccctgttctcctgctcgtgggccagagcgcagtcgccagagatttcgcggtttccgatatccagaggctgccggacctcgtgaggcactgtctcgcttgcgggagttgtgcggccagtggttgcaacccgagatgcacagtaaagagcaaatcctggagctgctagttttggagcagtttttgacgatccttcctgggaacctccagtcttgggttagggaacagcaccccgagagcggcgaggaggtcgtagtcttactggaatatttggagagacagctggatgagcctgctccgcaggtgcctgtcggggaccagggccaagagttgctgtgctgcaagatggccttgttgacccaaacccaaggatcgcagagctcccagtgccaacccatgaaggcactgttcaagcatgaatccttgggctctcagccattacacgatcgtgtcttgcaggttcctggtctcgcccagggtggctgttgccgcgaggacgcgatggtcgccagtcgcctgactccaggtagtcagggtttactcaaaatggaggatgtggccctgacacttacccctggatggacacagctggattcgagccaggtgaacctgtaccgagacgagaaacaggagaatcattcatctttggtgtccctgggcggagagatccagactaaatcaagggacctcccccctgtcaagaagcttcccgagaaggagcacgggaaaatatgccatctgcgagaggatatcgcccaaattcccacacatgcagaggcaggtgagcaggagggaagattacagcggaagcagaagaacgcaatcggcagccgacgccactattgtcatgaatgcggtaagtcgttcgcccaatcctccggactgacaaagcaccgacgtattcatacaggggagaagccatacgaatgtgaggactgcggcaagactttcatcgggtccagcgcgctggttatccatcagcgggtccacactggtgagaaaccttatgagtgcgaggagtgtggtaaagtgtttagccatagtagcaacctgattaagcatcagcggacccacaccggggaaaagccatacgaatgcgatgactgtggcaaaactttcagtcaatcctgttctctgttggaacatcataagatccacacaggtgagaagccttaccagtgcaacatgtgcggaaaagcgtttagacggaactcacacctgctgcgccaccaaagaattcacggcgataagaacgtgcagaacccagagcacggagaatcatgggagagccagggtcgcaccgagtctcagtgggaaaacacagaagcaccagtttcctacaaatgcaacgagtgtgagcggtcatttactagaaacaggtctctcatcgaacatcaaaaaattcatacaggtgagaaaccttatcagtgtgatacatgtgggaagggctttacaaggacatcctacctggtgcagcaccagcggagtcacgtggggaagaagacgctcagtcagtag

SEQ ID NO: 247872 - DNA, 1173 bp, Artificial Sequence
  Description of Artificial Sequence: Synthetic coding sequence
atggccctgttgactcagacccagggctcgcaatcctcccagtgtcagccaatgaaggcccttttcaaacacgagtcgctgggaagccaaccgctgcacgacagagtgctgcaggtgccaggcctggcgcagggcggttgctgtcgagaagatgcaatggtcgcatctcggctgaccccaggctcccaaggcttacttaaaatggaggatgtggccctgactttgacccctggttggactcagttagacagtagtcaagtcaacctttaccgcgatgagaagcaggaaaaccattccagcctggtctctcttgggggtgagattcaaacaaagagccgagacttgccccctgtgaaaaagctgcccgaaaaagagcacggaaagatctgtcacttgcgcgaggacatcgctcagatacctacccatgccgaggccggtgagcaggagggcagactgcagcggaagcagaaaaatgccattgggtccaggaggcattactgccacgaatgcggcaaatctttcgcccagagttctggcctcaccaagcaccgcagaattcacacaggtgagaagccttacgagtgtgaagactgcggcaagaccttcatcggatcatccgctctagtaatccatcagcgcgtgcacacaggggagaagccttacgaatgcgaggaatgtggcaaagtgtttagtcattccagtaatctcattaagcaccagcgcacccataccggcgagaaaccttatgaatgtgatgattgtggaaaaacgtttagtcagtcttgcagcctgctcgagcatcacaagatccacacaggcgaaaagccttaccagtgtaatatgtgtgggaaagcttttcgaagaaacagtcacttacttaggcaccagcgcatccacggggataagaatgtgcagaacccagaacacggtgagtcgtgggagagccagggcagaacagaaagtcaatgggagaatacggaggcccctgtcagctacaaatgtaacgagtgtgaacgtagctttacccgtaaccggtccctgattgaacatcagaagatccataccggtgagaaaccttatcaatgcgacacgtgcggtaagggctttacccgtacttcttatctcgttcaacatcagcgatcacacgtgggcaaaaagactctgtcgcagtag

SEQ ID NO: 247873 - DNA, 501 bp, Artificial Sequence
  Description of Artificial Sequence: Synthetic coding sequence
cccactcacgcagaagccggagaacaggaaggacgactgcaaagaaaacaaaagaatgcaattggtagcaggagacactattgtcatgagtgcgggaagtcatttgcacagagttcagggctcacaaaacaccgcaggatccacactggtgaaaaaccatacgagtgtgaggattgtgggaaaaccttcatagggtcttcagctctagtaatccatcagagagtacatacaggagaaaaaccctatgaatgtgaagaatgtgggaaagtgttctcacacagcagcaaccttattaagcaccagcgtactcacaccggtgaaaagccctatgaatgcgatgattgcgggaaaacattctctcagagttgcagcctgctcgaacaccacaaaattcacaccggtgagaaaccttatcagtgcaacatgtgtgggaaagcttttagaagaaatagccatttactgagacatcagagaattcatgtggtgaccgaaatagtttag

SEQ ID NO: 247874 - DNA, 438 bp, Artificial Sequence
  Description of Artificial Sequence: Synthetic coding sequence
atggagtttcctgatcttgggaagcactgtagtgaaaaaacttgcaagcaactggactttctgccagtgaaatgcgatgcctgcaaacaggacttctgcaaagatcactttccttacgccgctcacaagtgccctttcgctttccagaaggatgttcacgtgcctgtttgcccgctgtgcaatacacccatacctgtgaagaagggccagatccctgacgtggtcgttggtgaccatatcgacagggactgcgattcgcaccccggtaaaaagaaggaaaaaatttttacatatagatgcagtaaggagggatgcaaaaaaaaagagatgctccagatggtgtgcgcccagtgtcatggaaacttctgtatacaacatcgccaccctcttgaccatagctgtcgccatgggtcacgtccaacaattaaagccggatag

SEQ ID NO: 247875 - DNA, 543 bp, Artificial Sequence
  Description of Artificial Sequence: Synthetic coding sequence
atggaattccccgatttgggcaagcactgttccgaaaagacgtgtaagcagctcgactttctgccggtgaaatgtgatgcttgtaagcaggacttctgcaaagaccacttcccttatgctgcccataagtgtccgttcgcatttcaaaaagacgtccatgttcctgtttgtccactttgcaatactcctattccggtaaagaaggggcagatccccgatgtggtggtgggtgatcacatagaccgagactgtgatagccacccaggaaagaaaaaggagaaaatcttcacttaccgctgttccaaagagggctgtaaaaaaaaagaaatgcttcagatggtctgcgctcagtgtcacggtaatttttgtattcagcaccggcaccccctcgatcactcttgtcgccacggatccagacctaccattaaagccggatgcagcccaatgactgtgagcgagtctagacctctcggagactttctgacgctcgccccaggtggcctagctcagcggttgggttactggtttaccaggctcatgtag

SEQ ID NO: 247876 - DNA, 774 bp, Artificial Sequence
  Description of Artificial Sequence: Synthetic coding sequence
atggaattccctgatctcggggctcactgctcagaaccatcttgccagagactcgactttctcccattgaagtgtgacgcctgctcagggatattctgtgctgaccatgtggcctacgcccagcaccattgtggatctgcataccagaaggacatccaagtccccgtttgtcccctttgcaatgtgcccgtgccagtcgccaggggcgaacctccagaccgagcagtgggcgagcacatcgatcgcgattgcaggtccgatcctgcacaacaaaaaagaaaaattttcaccaataagtgcgaacgtgctggttgcagacagcgagagatgatgaagcttacttgcgaacggtgctccaggaacttttgcatcaagcaccggcatccattagatcacgattgtagcggggaagggcatccaacaagtagagccggacttgccgcaatcagcagggctcaagccgtggccagcacatctaccgtgccctccccatctcagaccatgccgtcatgcacctctccctcacgcgctactacaagatcaccctcttggacggctcccccagtaatcgccctgcagaatggcctcagcgaagacgaagccctgcagcgcgcactcgaaatgtccctggctgaaaccaaaccgcaagttccttcctgtcaagaagaggaggacttagccctggcccaggccctttcagcttccgaggccgagtatcagcggcaacaggcgcagagccggagcagcaaaccgagcaactgttcactctgctag

SEQ ID NO: 247877 - DNA, 531 bp, Artificial Sequence
  Description of Artificial Sequence: Synthetic coding sequence
atggagtttcctgatctcggtgctcattgctctgagcctagctgtcaacgactcgattttctgcctctcaaatgtgacgcctgctccggaatcttctgtgcagaccacgtggcgtatgcacagcaccactgcggcagcgcctatcaaaaggacatccaagtgccagtgtgcccattgtgcaatgtgccggtgcccgttgcgaggggggagccgccagacagggctgtgggtgaacatattgatagggactgccgcagcgaccccgcacagcagaagaggaaaatcttcaccaataagtgtgagagggctggctgtcgacaacgagagatgatgaaactcacctgcgagcgttgctcgaggaacttttgcataaagcaccgccacccattggaccacgactgctcaggggagggacatccaaccagtagagccggactggctgctatttcaagggcccaggcggtggcttccacgagtaccgtcccgtcccctagccaaacaatgccatcatgtacaagcccttcccggtag

SEQ ID NO: 247878 - DNA, 774 bp, Artificial Sequence
  Description of Artificial Sequence: Synthetic coding sequence
atggagtttcccgacctgggggcacattgcagtgaaccatcttgtcaaagactggacttcttgcctttaaagtgcgatgcttgcagcggaatattttgtgcagatcacgttgcctacgcgcaacaccattgcggcagtgcatatcaaaaagacattcaagtgccagtgtgcccgctttgcaatgttcctgtcccagtggcacgcggagagcctcccgatcgggcagttggagagcacatcgatcgcgactgtcggagcgatccagcacagcagaagcgcaagatcttcactaacaaatgcgagcgtgccggttgccggcaacgagaaatgatgaaactcacatgtgagcggtgctctcgcaacttctgcattaaacaccggcaccccctagaccacgattgttccggagagggtcatccaacctctagagctggcctggcagcaatatcccgcgcacaagccgtcgcatctacaagcactgtcccatctccctctcagaccatgccctcttgtacgtccccgtcaagggccacaacaagaagcccatcatggaccgcaccccctgtcattgcactccagaatggtctgagcgaggatgaggctttgcagcgggcactcgagatgagcctggctgaaacgaaaccgcaagttccaagttgtcaggaagaggaggacctagctctcgctcaagcactgtccgccagcgaagcagagtaccaaaggcaacaggcccagtcacggagcagtaagcctagcaattgctctctgtgttag

SEQ ID NO: 247879 - DNA, 531 bp, Artificial Sequence
  Description of Artificial Sequence: Synthetic coding sequence
atggagttccccgatctaggggctcattgctccgagcctagctgccaacggctggatttcctgccgttgaaatgtgacgcttgttccggaattttctgtgcggaccacgtggcgtatgctcagcatcattgtggaagtgcgtatcagaaagacatacaggtgcccgtctgtcccctatgcaatgtccctgtgccagtcgctaggggggagcccccagaccgtgccgtgggagagcatatcgaccgcgactgtcggtcagatcctgcccagcagaaaagaaagatcttcaccaataaatgtgagcgcgctgggtgtagacagagagaaatgatgaaactgacatgtgagagatgtagccgaaatttttgtattaaacatcgccaccctcttgaccatgactgcagtggtgaaggtcaccccacaagccgggctggccttgcagccatttcgcgggcacaggcggtagcctccacgtctacggtccctagtccatcccagacaatgcccagctgcacatcgccctcccgatag

SEQ ID NO: 247880 - DNA, 153 bp, Artificial Sequence
  Description of Artificial Sequence: Synthetic coding sequence
atggaatttcctgatctgggagcccactgctccgaaccctcgtgtcagcgcttagatttcctgcccctcaagtgtgatgcctgttctggaattttctgtgccgatcatgtggcatacgcacaacatcactgcgggtccgcttaccagaagtag

SEQ ID NO: 247881 - DNA, 678 bp, Artificial Sequence
  Description of Artificial Sequence: Synthetic coding sequence
atggagttcccagacctcggtgcccattgcagcgaaccttcgtgccaacggctggattttctccccctaaaatgcgacgcatgcagcgggattttttgcgcagaccacgttgcctacgcccagcatcactgcggaagcgcataccagaaagacatccaggttcctgtgtgccctctttgcaacgtaccggtccctgtggcacgcggagaaccacccgatcgagccgtgggggagcacattgacagggattgcaggtctgacccggcacagcagaaaaggaagatcttcacaaacaaatgtgagagggccggttgcaggcaacgggagatgatgaagctgacctgcgagagatgctccaggaatttctgcatcaagcacagacaccctctcgatcacgactgctccggtgaaggacacccaaccagcagagcgggtttggccgcaataagtcgtgcccaggccgtggcctcaacatccactgtgccctcaccatcgcaaaccatgcctagttgcacttctccatcccgcgctacaactaggagcccttcctggaccgcccctccggtgatcgcactgcagaatggtctggtttcatgggcagaggtaggctggacggagaccaacactcagcgcgttaagtccaaggatgcaggcctattaagtcccttcgtcgagtag

SEQ ID NO: 247882 - DNA, 684 bp, Artificial Sequence
  Description of Artificial Sequence: Synthetic coding sequence
atgggagacgcagggagcgaaaggtctaaggcccctagcctgcccccaaggtgcccatgcggcttttggggctcatccaagacaatgaatctctgttccaaatgcttcgcagatttccagaagaagcagcctgacgacgattcagccccttccacctcaaactcccaaagcgacctcttcagcgaggagacaaccagcgataataacaacacttccattacaaccccaaccttatcaccctcacagcagcccctgccaactgagctgaatgttacatcaccatcaaaggaagagtgcggcccttgcaccgatacagcacacgtgtctctcatcacacctaccaagagatcttgcggtaccgacagtcagagtgagaatgaggcctctcccgtgaaacgcccacggctcttggaaaacaccgaaagatcagaagaaacgtcccgcagtaaacagaagtccaggaggagatgtttccagtgtcagacaaagctggaactggtgcaacaggaactggggtcttgtaggtgtgggtacgtgttttgcatgctgcatcgcctgcccgaacagcatgattgcacatttgatcacatgggaaggggcagggaagaagcgatcatgaaaatggtcaagcttgacaggaaagtggggagatcttgtcagagaatcggcgaaggctgcagctag

SEQ ID NO: 247883 - DNA, 642 bp, Artificial Sequence
  Description of Artificial Sequence: Synthetic coding sequence
atggcacaggagactaaccagacaccagggcctatgttatgcagtaccgggtgcggcttctacggcaatccccgtaccaatggtatgtgcagcgtatgttacaaagagcacctgcagaggcagcagaactcaggtcggatgtcccctatggggactgccagtggatctaactcacctactagtgacagcgcctccgtgcagagggctgacacatctttgaacaattgcgaaggcgcagctggcagcacctccgagaagtctaggaatgtacccgttgccgcactacccgttacacagcaaatgacagagatgagcatttcacgtgaggacaagattacaacccccaagaccgaagtatccgagcccgtggttacacagccctcccctagtgtgagccagccgtccacttctcagtccgaggagaaagcccctgagctcccaaaaccaaaaaagaatcgttgtttcatgtgcaggaagaaggtcgggctgacgggcttcgattgtagatgtggaaatctcttctgcgggttgcatcggtactccgataaacacaactgcccctatgattacaaggcggaagcagcagccaaaatcagaaaggaaaatcctgtggtggtagcagaaaagatccaacgaatctag

SEQ ID NO: 247884 - DNA, 642 bp, Artificial Sequence
  Description of Artificial Sequence: Synthetic coding sequence
atggcccaggagacaaaccagacccctggccctatgctctgttcaactggatgtggcttctatgggaatccccgtactaacggaatgtgcagcgtctgttataaggagcacttacaaaggcagcaaaactccggccgtatgagccccatggggacggcctccggctcgaactcgccaacgtccgacagtgccagcgtgcagagggcagacacctcattgaacaattgcgagggcgctgccggatcaaccagcgaaaaaagtagaaacgtacccgtggcggcactacctgttactcagcagatgaccgagatgtcgatctcccgcgaagacaagatcactacaccaaaaactgaggtgagtgagcccgtcgtgacccagccctcccctagcgtttctcaaccatcaacatctcagagcgaggaaaaagccccagagctccctaagcccaagaagaatcgttgtttcatgtgccggaagaaggtgggcctaactggctttgattgcagatgcgggaacctcttctgtggcctacaccgatactccgataagcacaattgcccatatgattataaggctgaagccgcagcaaaaatacgcaaggagaatccagtcgtcgtggcggaaaagatccagcgaatctag

SEQ ID NO: 247885 - DNA, 636 bp, Artificial Sequence
  Description of Artificial Sequence: Synthetic coding sequence
atggctaagcctgagcaagctgcagacggaggcgttcggggacgcggagccaggccgcctgcccaagaggcccagaggcgacgaaggcacccagtggtcgtggcccgagatctggcccctggtgtgccaggaagcctgcatagtacccagaagaacatggcccaagaaactaatcagacccccggaccaatgctctgctctaccgggtgtgggttttatggaaacccccgaacgaatggaatgtgttccgtctgctataaggaacacctgcagagacagcagaactcaggccgaatgagccctatgggcaccgcaagtggatctaattcccctacttccgattctgcttctgtacaacgcgcagacactagcctgaacaactgtgaaggcgctgcaggatccaccagcgaaaaatcaagaaatgttcctgtcgcagcgcttcctgtcactcagcagatgacggaaatgtccattagcagggaggataaaatcacaacacccaaaacggaagtgagcgagcctgtcgtcacccaaccgagtccttcagtctctcaaccatctacttctcagtcagaagaaaaagccccagagctgcctaagcccaagaagaatcggtgtttcatgtgcaggaagtag

SEQ ID NO: 247886 - DNA, 642 bp, Artificial Sequence
  Description of Artificial Sequence: Synthetic coding sequence
atggcccaggaaactaaccagacccccggacccatgctgtgtagtactgggtgtggcttctatgggaatcccaggacaaacgggatgtgtagcgtgtgctataaggagcacttgcagagacagcagaactcggggagaatgtcccccatgggaacggcttctggatctaattcacctacaagtgattccgccagcgttcagagggccgacacgtcccttaataactgcgaaggggctgcagggagcaccagtgaaaaatccaggaacgtaccggtggccgctctgccagtgacccaacagatgacagagatgagtatcagccgcgaagacaagattacgactcctaagaccgaggtttctgagccagtggtgactcagccttccccttccgtctctcagccaagcacctcccagtcagaagagaaggcacccgaactccccaaaccaaaaaagaatagatgttttatgtgccggaagaaggtcggtctgaccggatttgactgtcgatgcgggaatctgttctgtgggctgcacagatacagtgataaacacaattgtccatacgactacaaggctgaagctgccgcaaagattagaaaggagaatcctgtagtggtggcggagaaaatacaaaggatctag

SEQ ID NO: 247887 - DNA, 642 bp, Artificial Sequence
  Description of Artificial Sequence: Synthetic coding sequence
atggcgcaggaaaccaatcagacacctgggcctatgctgtgcagcaccggctgtggcttttacggtaaccctaggactaacggcatgtgttccgtgtgctataaggaacatctgcagaggcagcaaaacagtgggcgaatgtcccccatgggtacagcatccggctccaacagtcctacatcagattccgccagcgtacagcgggctgatacctccctgaataattgtgaaggagcagctggcagcacgagtgaaaagagccgaaatgttcctgtggccgcacttcctgtcacccagcagatgacagagatgtcaatcagtagagaggataaaatcacaacaccgaaaaccgaggttagtgagcccgttgtgacccagccctccccctcggtcagccagccctcaacttctcagtctgaggaaaaggctccagaattaccaaaacccaaaaagaaccgctgtttcatgtgccgcaagaaggtgggactgaccggctttgattgtcggtgcggcaacctcttctgtggcctgcatcgctatagcgacaaacataactgcccctacgattacaaggctgaggccgctgcgaagatccgcaaggagaaccccgtggtggtcgccgagaaaatccagcgcatttag

SEQ ID NO: 247888 - DNA, 627 bp, Artificial Sequence
  Description of Artificial Sequence: Synthetic coding sequence
atggcacaggaaaccaaccattcccaagtccctatgctttgcagtacggggtgcggtttctacggcaatcccagaaccaacggcatgtgcagcgtctgttataaagaacacctgcaaagacaaaatagttcaaatggcagaatcagtcctcccgcaaccagcgtttctagccttagtgagtccctgcccgtgcagtgcaccgatgggagtgttcctgaggcacagtctgccctggattccacgtctagttctatgcaaccgagccctgttagtaaccagagcctgctgtcagagtccgtagcatctagccagctcgacagtacgagcgtggataaggccgtcccagagacagaagacgtgcaggcctccgtcagcgacacggcccagcagccctcagaagagcagtcaaagtcactggagaaacctaaacagaagaagaaccgctgctttatgtgtcgtaaaaaggttggtctaaccgggttcgagtgcagatgcgggaatgtgtattgcggcgtgcaccgttacagcgacgtgcacaactgttcttacaattataaggccgacgccgcagaaaaaatccgcaaggaaaatcctgtggtggtgggcgaaaaaatccaaaagatttag

SEQ ID NO: 247889 - DNA, 627 bp, Artificial Sequence
  Description of Artificial Sequence: Synthetic coding sequence
atggcgcaagagacaaaccatagccaggtgccaatgctgtgctctactggctgcggcttttatggtaatccaagaactaatggcatgtgctccgtttgctacaaggaacacctccagaggcagaatagctctaacggcagaatatcccctccggctaccagtgttagttcattgagtgagtcacttcccgttcagtgtacggatgggtccgtgcccgaggcccagtctgctttggattccactagcagctccatgcagccatcccccgtgagtaaccagagcctgctgagtgaatctgtggcttcgtctcagctcgattctaccagtgtggacaaggccgtgccagagaccgaagacgtgcaagctagcgtgtcagatacagcacaacagccaagcgaggaacagagcaaaagcctggagaagccgaaacagaagaagaatcgttgcttcatgtgtcggaaaaaagtgggattaaccggtttcgagtgtcggtgtgggaatgtatattgcggtgtgcatcgttattccgacgtgcacaactgcagctataactacaaggctgatgccgctgagaagatcaggaaagaaaatcccgtcgttgttggagaaaagattcaaaaaatttag

SEQ ID NO: 247890 - DNA, 591 bp, Artificial Sequence
  Description of Artificial Sequence: Synthetic coding sequence
atggcccaggagaccaatcattctcaggtcccaatgctctgcagcactgggtgtgggttttacgggaacccacgaaccaacggcatgtgctctgtttgttataaggagcatttgcaacggcagaactcttccaatggcagaatctccccaccagtccaatgcacagatgggagcgtgcccgaagcacagtctgcactcgacagcaccagttcatccatgcaaccgagccctgtctcaaatcagagcctgctgtcagagtccgttgcgtcctcccagcttgacagtacctctgtcgataaagccgtccccgaaacagaggacgtccaagccagtgtctctgacacagcccaacaaccatctgaggagcaaagtaagagcttggagaaaccgaagcagaagaagaatagatgctttatgtgtaggaagaaggttggactcacagggtttgagtgccggtgcggcaacgtttactgtggcgttcaccgctactctgacgtacataattgctcgtataactataaggcagatgctgccgagaagatcagaaaggagaaccccgtcgtggttggtgagaagattcagaaaatctag

SEQ ID NO: 247891 - DNA, 627 bp, Artificial Sequence
  Description of Artificial Sequence: Synthetic coding sequence
atggctcaagagactaaccattctcaggttcccatgctttgctcaacagggtgcggcttttacgggaaccccagaactaacgggatgtgttccgtctgttacaaggagcatcttcaaagacagaactcaagcaacggcaggatctccccacctgccaccagcgtttcttccctgagtgagagcctgcccgtccagtgcaccgacggatctgtgcccgaggcacagtctgcactcgatagtacaagttcctccatgcaaccgtcccctgtgagtaaccagtctttgctgtctgaaagcgttgctagcagccaactggattcaacgtcagtcgacaaggcagttccagagacagaggacgtccaagcctccgtgagcgacaccgcccagcaacctagcgaagagcagagcaagtccttggaaaagccaaaacagaagaaaaatcgttgcttcatgtgtcggaagaaggtggggttgaccggctttgagtgcaggtgtggaaacgtgtactgtggagttcaccgctatagcgacgtacacaattgctcctataattataaagccgacgctgccgagaagataaggaaagaaaatcctgtagtggtcggagagaagatacaaaagatctag

SEQ ID NO: 247892 - DNA, 627 bp, Artificial Sequence
  Description of Artificial Sequence: Synthetic coding sequence
atggcgcaagaaaccaatcactctcaggtgccaatgctgtgttcgaccggctgcgggttctacggtaaccctcggaccaacggcatgtgctccgtgtgttacaaggaacatctgcagcggcagaattcttctaatggcaggatcagtcccccagctacatccgtcagttctctcagtgaaagcctcccagtacagtgtacggacgggtccgtccccgaagcgcagtccgcactcgatagcactagctctagcatgcagccttctccagtgagcaaccagtcattgctgtctgaatctgttgcctcttcacaactggattcaacttcagtggacaaggctgtccctgaaactgaagacgtccaagccagcgtttccgatactgcgcagcagccttcagaagaacagtcaaagtctctcgaaaagcccaagcagaagaagaacagatgtttcatgtgtagaaagaaagtggggttgacaggattcgaatgtcgctgtggtaacgtgtactgcggtgtgcacaggtatagcgacgtccacaactgctcctacaattataaagcagatgcagccgagaagatccgcaaggagaatcccgtggtggtgggggagaagatccagaaaatatag

SEQ ID NO: 247893 - DNA, 627 bp, Artificial Sequence
  Description of Artificial Sequence: Synthetic coding sequence
atggcccaagagacaaatcattcccaggttccaatgctgtgttcaacaggctgtggcttctacggaaaccctagaaccaacggtatgtgctctgtttgttataaggagcatctccaacgccagaattcctcgaacgggagaatctcacccccagctacatcagtcagttccctgtccgaatcccttcctgtccagtgtaccgacggctcagtcccggaggctcagtctgcccttgattctacatccagcagcatgcagccttcccctgtatctaatcagagtctgttgtccgagagtgtggcgagctctcagctggattctacctccgtagataaagcagtgccagagacagaggatgtgcaggcttccgtgagtgacaccgcacagcaaccaagcgaagagcagtctaagtccctcgagaagcccaagcagaagaaaaatagatgcttcatgtgccgcaaaaaagtaggtctgactggcttcgagtgtcgatgcggcaatgtgtattgcggggtacacagatacagtgatgtgcacaattgttcatataattacaaagccgacgcggcagagaagatccggaaagaaaatcccgtggtggtgggcgagaagatacagaaaatttag

SEQ ID NO: 247894 - DNA, 2085 bp, Artificial Sequence
  Description of Artificial Sequence: Synthetic coding sequence
atggagaataagagtttggaaagctcccagactgacctgaaactcgttgcacatccgagagccaagagtaaagtctggaaatatttcgggttcgatactaacgcggaagggtgtattctgcagtggaaaaaaatctactgccggatttgtatggctcagatcgcatactccggaaataccagcaatttgtcctatcatctcgagaaaaaccatcctgaggaattctgcgagtttgtgaagagcaacaccgaacagatgcgagaagcatttgcgactgcattctccaagttaaagcccgaaagctctcaacagccgggtcaggacgctttggctgtgaaggcgggacacggatacgactcaaaaaaacagcaggagttgacggccgcagtcttgggcttgatatgcgaaggactgtatcctgcgtcaatcgttgatgagccaacgtttaaggtgttactcaaaactgccgacccaagatacgaactgccgagccgtaagtacatctccaccaaggcaatccctgagaaatatggcgctgtccgcgaggtcattcttaaagagctcgcggaggccacatggtgcgggatttcaacagatatgtggcggagcgagaatcaaaatcgcgcatacgtgacactggcggctcattttctgggcctcggcgcacctaattgcctgagcatgggcagcaggtgtttgaaaactttcgaagtgcctgaggagaatactgcagagacaattacccgggtgctgtatgaggtgtttatcgaatggggtatctcagcgaaagtttttggcgcaaccacaaattacggcaaggatatcgtgaaggcctgtagcctacttgatgtcgccgtgcatatgccatgtttggggcatacttttaatgccggaatccagcaggccttccagctgcctaagcttggcgcattgctgtctagatgtcgaaaactggtggaatattttcagcagagcgcagtcgccatgtatatgctgtacgagaaacagaaacagcaaaacgtggcccactgcatgttagtgtccaatcgggtctcgtggtggggttccactcttgcgatgcttcagcggctgaaagaacagcagtttgttatagctggtgtacttgtggaagactccaacaaccaccatctcatgttggaggcttccgaatgggccaccatagaagggctggtcgagcttctgcagccattcaagcaagttgcagagatgctctcagcatctaggtatccgaccatcagcatggtgaagccgctgctacacatgctgctgaatactactctcaatatcaaagagaccgacagcaaagagctctctatggccaaggaagtgatcgcaaaggaactcagtaagacctaccaggaaacgccagaaatagatatgttcctgaacgtggccacatttctggaccctcgatacaaaaggctgcccttcctgtctgccttcgaaaggcagcaggtggagaatcgagtggtggaggaggcgaaaggcttacttgacaaggtgaaagacgggggttacagacctgcggaggataaaatttttcctgtgcctgaagagccacccgtcaaaaagttgatgcgcacgtcgacgcctcctccggcatctgtgatcaacaatatgctggctgaaatattctgtcaaaccggtggcgttgaggatcaggaagagtggcacgcacaggtggtggaggagctcagcaatttcaaaagccagaaggtgctgggccttaatgaggatcctctgaaatggtggtccgaccgactcgctcttttcccactgctgcccaaagtgctgcagaagtactggtgcgtcacagccacgagggtggccccagagagactgtttgggagcgcggcaaatgttgtcagcgcaaaaaggaaccgactggcccctgcgcacgtggatgagcaggtctttttgtacgagaacgcgaggtccggcgctgaggcagagcccgaggaccaggacgagggtgaatggggattagaccaggaacaggtcttttctctgggcgatggagtctccggaggcttctttggtatcagggacagctcctttctttag

SEQ ID NO: 247895 - DNA, 2085 bp, Artificial Sequence
  Description of Artificial Sequence: Synthetic coding sequence
atggagaacaagtcgctggagtcatcacagacagacctgaagctggtagctcaccctcgcgcaaaatcaaaggtgtggaagtattttggctttgacacaaatgcagagggctgtatcttgcagtggaaaaagatttactgccgcatctgtatggcccagatcgcttacagcggcaatacatccaatctaagttatcacctcgaaaagaatcaccccgaagagttctgtgaattcgtcaagtccaacaccgagcagatgagggaagccttcgccacggctttctcgaagctgaaaccggagtctagccaacagcctggccaggacgccctggccgtcaaggccggacacggctacgactccaaaaagcagcaggaactgactgccgctgtgctgggactgatttgcgagggactttaccccgcatccatagtggacgagcctacattcaaggtgcttctgaaaaccgcagatccacgctatgaactaccaagtcgtaagtacattagtactaaagcaattcctgagaaatacggggctgttcgcgaggtgatactcaaggaactggctgaagctacttggtgcggaatttcaacggatatgtggagaagcgagaaccagaacagggcctatgtaactctggccgctcactttttaggactcggcgctcccaactgtctgagtatgggaagtcggtgcttaaagaccttcgaagtgccggaggaaaacacagcagaaacaattactagagtgctgtacgaggttttcatagaatggggaatttcagccaaggtcttcggtgccacaaccaattacgggaaagatatcgtgaaggcgtgctcactgctcgacgtggccgtccacatgccttgtttgggccatacattcaacgcagggatccagcaggctttccagcttcccaagctgggcgcacttctgtcaagatgtcggaaactggtcgagtattttcagcagtcggccgttgctatgtatatgctgtacgagaagcaaaagcagcaaaacgtggcgcactgcatgctggtgagcaatagagtgtcttggtggggttcgacactagcaatgctccagcgtctcaaagaacagcagtttgtgatcgcgggagtcctggtggaagactccaacaatcaccacctgatgctggaggccagtgagtgggcgactattgaaggattggtggagttattacagcccttcaagcaagtcgccgagatgttgtcggcctctcgctaccctacaatatctatggtaaagcctctcctccatatgctccttaacacgactctgaacatcaaggaaaccgatagtaaagaactgagtatggccaaggaggttatagccaaggaactatctaagacttaccaggagaccccagagattgatatgtttctcaacgtcgctacgtttttagatccaaggtataaacggctgccattcttgtcggcttttgagaggcaacaggtagaaaatcgcgtggtcgaggaagctaagggtcttctagataaagtgaaggacggcggatataggcccgctgaggataaaatcttccctgttccagaggagccacctgtgaagaaacttatgaggacttccacacctccacctgcctcggtgatcaataacatgctggcagagattttttgtcagacggggggagtcgaagaccaggaggaatggcatgcccaagtggtcgaggaactcagcaattttaaatcccagaaagtgcttggtctgaatgaggatcccctgaaatggtggtcggacagactagcactgtttcccttgttgcccaaagtgctgcagaaatactggtgcgtgacagctacgcgggtcgcccctgagcgactttttgggagcgccgcaaatgttgtgtccgcaaaaaggaacagactagcccctgctcacgttgacgagcaggtctttttatatgagaatgctcggagtggagccgaggcagaacccgaggaccaagatgaaggggagtggggccttgatcaggagcaggttttttccttgggtgacggagtatctggaggattttttggaatccgagattcatccttcctgtag

SEQ ID NO: 247896 - DNA, 2085 bp, Artificial Sequence
  Description of Artificial Sequence: Synthetic coding sequence
atggagaataaatccctcgagtcatcccagacagacttaaagctggttgctcacccgagagccaagagcaaggtgtggaagtacttcggctttgataccaacgcagaggggtgcatcttgcagtggaaaaaaatctattgtcgcatctgcatggcacagatcgcatactctggcaatacttccaatctgagctatcaccttgaaaaaaatcatccagaggaattttgtgagttcgtgaagtctaatactgagcagatgcgggaggcgttcgcaacagctttttctaaactgaagcctgaaagctcccagcagccagggcaggacgcactggcagtcaaggctggccatgggtacgattcaaagaaacagcaggaactgacagccgctgtgctggggcttatctgcgaaggcctttaccccgcttctatcgtggacgagccaaccttcaaagttttgctcaagaccgctgacccaaggtatgagttgccttcacgtaaatatattagcacgaaagcaattcccgagaagtacggcgcagtgagagaggtgatcttaaaggaacttgcagaggctacgtggtgtggaatttctactgacatgtggaggagcgagaaccagaatagggcctacgtaaccctagcagcacatttcctggggttgggggctcccaattgtttgagcatgggttctcgctgtttaaagacctttgaagtgcctgaagagaataccgcagaaaccatcaccagggttctctatgaggtgtttattgagtggggtataagtgcgaaggtgtttggggctacgacaaactacggtaaggacatcgtgaaggcttgctctctgctcgatgtggcagttcacatgccatgccttggccacacctttaacgcgggtatccagcaggcctttcagcttcctaaactcggagccttgctctcaagatgtagaaaactggtcgagtactttcagcagtccgctgtggcaatgtatatgctgtacgaaaaacagaaacagcagaacgttgcccactgtatgttagtgtcgaacagagttagttggtggggctccactcttgcaatgctgcagcgtctcaaggaacagcagtttgtgatcgctggggttctggtcgaggattcaaacaaccaccatctcatgctggaggcctccgaatgggcgaccatagaaggactggtagaactcctccagccttttaaacaagtcgcggagatgctgtctgcgagcagataccccaccatcagtatggtaaaaccactgctacacatgcttctcaacactacgcttaatataaaagagaccgacagcaaagagctttctatggctaaagaagtaatcgccaaagagttatctaaaacctatcaagagaccccagagatagacatgttcctaaacgtggcgacattcctcgacccaaggtacaaacgtttacccttcctcagcgctttcgaaagacagcaggttgaaaacagggtggttgaagaagccaagggactgttggataaggtgaaagatgggggatatcggccagctgaggacaaaatatttcccgtgccagaagagcctcctgttaagaaattaatgaggacttcgactccgcctcccgcttcagtaattaataacatgctagccgagattttttgccagaccggcggagtggaagaccaggaggagtggcacgcacaagtggtagaggagctgtcaaattttaaaagtcagaaggtgcttggcctcaacgaggatccattgaaatggtggtccgacaggctggctctgttccccctgcttcccaaggttttgcaaaagtactggtgcgtgacagcaaccagagttgccccagaaaggttattcgggtcagctgccaacgttgtctccgccaaacgcaatcgcctcgcccctgcccatgtggatgagcaggttttcctctacgaaaacgccagatcgggcgctgaagccgagcctgaagatcaggatgaaggagagtggggcctcgaccaggaacaggtgtttagtttgggcgacggcgtgagcgggggattctttggtatcagggacagcagttttctatag

SEQ ID NO: 247897 - DNA, 819 bp, Artificial Sequence
  Description of Artificial Sequence: Synthetic coding sequence
atggagaacaagagccttgaatcaagccagacagacctgaaactggtggcccatcccagagccaagtccaaggtgtggaagtacttcggatttgacacgaatgcagagggctgcattctacaatggaaaaaaatatattgccgtatctgtatggctcagatagcgtattccggcaacacaagtaatctaagctaccaccttgagaagaatcaccccgaggagttttgtgagttcgtgaaatctaatactgagcagatgcgagaagccttcgccactgcattctcgaaactgaagccagagtcttctcaacagcccggtcaggacgctttagccgtgaaggctggacacgggtacgattcgaagaagcagcaggagcttactgccgctgtgctgggactgatctgtgagggactgtacccagcatctatcgtggacgagcccacttttaaggtattgttgaaaaccgcggacccaaggtacgagctgccctccaggaagtacatttccactaaggcaattcctgagaagtacggtgcagtgagggaggtgatcctcaaggaattggccgaagccacttggtgcggaatctcgacggacatgtggcggtccgaaaatcagaaccgcgcatatgtcactctggctgcccactttctcggactcggtgcgcctaactgcctgagcatgggctccaggtgcctgaaaacattcgaggtgcctgaggagaatactgccgaaactatcaccagagtattgtacgaggtgtttattgaatggggcatatcggctaaggtgtttggcgcaacgactaactatggttag

SEQ ID NO: 247898 - DNA, 3177 bp, Artificial Sequence
  Description of Artificial Sequence: Synthetic coding sequence
atgaggcgaaagggccgttgtcatcgcggatcagctgctaggcaccccagctccccttgctcggtaaagcactcgccaacgagagaaactctgacttatgcccaagcacagcggatggtcgagatcgaaatcgagggtaggttgcatagaattagcatttttgacccactggaaataattttagaggatgatctgacagcacaagagatgagtgagtgtaacagtaacaaggagaatagcgaacgaccccctgtttgtctccgcaccaagcgtcataaaaacaaccgagtcaagaagaaaaacgaagctctgccatccgcgcacggcacccccgcttccgcttctgccctgccagaacctaaagtccgaatcgtcgagtattcccctccttcggctccaaggcggcctcccgtttactataagttcatcgaaaagagcgcagaggaacttgataacgaagtggagtatgacatggatgaagaggactacgcttggctcgaaattgtgaacgagaagagaaaaggtgactgcgtgcccgctgtgtcacagtctatgttcgaatttctgatggatcgattcgagaaggagtcccactgtgaaaaccagaaacagggcgagcagcaatcattaatcgacgaagatgctgtgtgttgtatctgcatggacggcgagtgtcaaaactccaacgttattcttttttgtgatatgtgtaatctcgccgttcaccaggagtgctacggggtgccctatatccccgaggggcagtggctgtgtaggcactgtctccagtctagagcacggcctgccgactgcgtcctttgtcctaataaaggaggggcattcaagaaaacggatgacgaccggtggggacacgttgtgtgtgccctgtggatccctgaggtgggatttgctaacaccgtgtttattgagccaattgatggggttaggaacatccctccagctaggtggaaactgacctgctacctctgtaaacagaaaggcgtgggggcatgtattcagtgtcataaagccaactgttacaccgcatttcacgtgacttgcgcacagaaagctggcttatatatgaaaatggaacctgtcaaagaactgactgggggaggcaccaccttttccgtcaggaaaaccgcttattgtgatgtccacacccctcctgggtgcactcgccgaccccttaatatttatggcgatgtggaaatgaaaaatggcgtgtgtcgcaaagaatcttcagtcaaaacagtccggagcacttcaaaggtgaggaagaaggctaagaaagccaagaaagctctggccgaaccttgcgcggtcctcccaacggtgtgtgcaccttacattcccccacaacggcttaatagaatagccaatcaagtagccatacaacgcaaaaagcaattcgttgaacgggctcatagctattggttgttgaagcgcctaagcaggaatggagcccctctcctcagaagactccagtcctcgcttcagtctcagcgatcctctcagcaaagggagaacgatgaagagatgaaggccgctaaggagaaacttaagtattggcagcggttgaggcatgatctggaaagagcacggctcctgatcgagctcctgcgtaaaagagaaaaactcaagcgggagcaagtgaaagttgaacaggtcgcaatggagcttcgattaacaccgctgacggtgttgctgcgctctgtgctggaccaacttcaagataaagaccctgcgagaattttcgcccagcccgtctccttaaaggaagtgccagattacttagatcatattaaacaccctatggacttcgcgaccatgcggaaacgtctcgaagctcaggggtataagaatctgcacgaattcgaggaggatttcgatctgatcatagacaactgcatgaagtacaatgctcgagacacagtgttttaccgagccgctgttagactccgggatcaagggggagtggtactgcggcaggccaggcgcgaagtggactccatcggcctcgaagaagcgtccggtatgcatcttccggaacgacccgctgcagccccacggcgacccttctcctgggaggatgtcgatagactgctcgatcccgcaaatcgagcccacctcggtcttgaagagcagcttcgcgaactgctggatatgctggatctaacgtgtgccatgaagagttccggtagtcggagcaaaagagctaagttactgaagaaggagattgctctgctgcgcaataagctgtcacaacagcacagtcagcctctccccaccggaccaggtttggaggggttcgaggaggacggcgcagcactgggcccagaggctggagaggaagttctgcctaggctggagactttgcttcagccacgcaaacgttcgcgttccacttgcggagactccgaggtagaagaagagagccctggcaaacgcctggacgccggactgacaaacgggtttggaggggctaggtccgagcaggaaccagggggaggactaggtcgaaaagctactccacgcaggcgttgtgcttctgagtccagtatttcatcgagcaacagccccctgtgtgacagctctttcaatgccccaaagtgtggccgtgggaagcctgctctggtgagacggcatactctcgaggaccgctcagagctaattagctgcatcgagaacgggaattacgcgaaagccgctagaatcgccgcagaagtcggacaaagctcaatgtggatctcgacagacgctgccgcttcggtccttgaaccactcaaggtggtctgggccaagtgcagcggatacccctcataccccgcactgattatcgatccgaaaatgccaagggtgccgggacatcataatggggtgaccattcctgccccaccgctggacgtgctgaagatcggtgagcacatgcagaccaaatctgatgagaaactgtttctggtgctcttctttgataacaagagaagttggcagtggctgcccaagtctaaaatggtcccactgggcattgatgagacaatcgataagttgaaaatgatggaaggccgtaacagttcaatcagaaaggccgtacggatcgcatttgaccgggctatgaatcatttgagtcgtgtccacggcgagccaacctctgacctgtccgacatcgattag

SEQ ID NO: 247899 - DNA, 2940 bp, Artificial Sequence
  Description of Artificial Sequence: Synthetic coding sequence
atgtctgtgtgtaccctatctgtcccagtcagctcactgtctccaggacgcagatgcaacacctttagcgattctggaattctgggctgcgtccccataaattccaacaccgacgaagaggacgtagtggaggagaagatggtggcagaaggcgtcaataaagaagctaagcaacccgctaagaaaaagaggaagaagggtctgcgaatcaaaggcaagagaagacgtaagaaattgattctcgcaaaaaaattttccaaagatctgggctccggcaggcccgtggcggatgctcccgcattacttgccagtaatgatcccgagcaggacgaggagagcttgtttgaaagcaatattgagaagcagatttacctgccaagtactcgagcaaaaacctccattgtttggcactttttccacgtggatcctcagtatacctggagagctatttgcaatctttgtgagaaatccgtgtcccggggaaaacctgggtcacacctcggcacttccacattacaacgccacctgcaagcacggcactccccccactggaccagggccaacaagtttggcgtagcttccggcgaggaggattttaccttggatgtgagtttgtcacccagtagcggttctaatggttcgtttgagtatattccgaccgaccctctcgacgacaaccggatgggcaaaaagcacgataaatccgcaagtgacgctctccgcgctgaaaggggtagattcctaattaaatcaaatatagtgaagcacgccctcatacccggtaccagggcaaagacttccgctgtttggaattttttttatactgacccgcaacacatctcccgggcagtgtgtaatatttgtaagaggagcgtatcacggggtcgaccgggatcacacctgggcactagcacgctccagcggcatcttcaggcgacacatccaatccactgggcagtcgcaaacaaggattctggtgcggttgctaatggactagacgaggctgagaccgagcgctctgatctgctctcggataccctacatggcgaaaaaagcaccggcagccaagacctcaccgcagaagacctgagtgacagtgactctgacgaacctatgctggaggtagagaatcgctccgaatctccaatacctgtggctgaacagggtacccttatgcgggctcaagaacgcgagactacatgttgcgggaaccccgtgtcttctcatatatcccaagcaatcatccagatgatcgttgaggatatgcatccatataactatttcagcacccctgcatttcagcggtttatgcagatcgtagctcctgactacaggctgcctagcgaaacctattttttcactaaagcagtcccccaattgtacgactgcgtgagagaaaagatttttctaaccttggagaacgtccagtcccagaaaatacacctcactgttgacatttggacccacgatccatctacagattacttcatcgtaaccgtgcactgggtctcactggagaccgcctctttcctcaacaacggccgaattcctgactttaggaaatgggctgtgctctgcgttaccggccttgccaaggactgcctgatcacaaatatactgcaggaactgaacgatcagatcggcctctggttaagtcctaattttctgataccatcatttatcgtatccgataattcctccaacgttgtgcacgcaataaaggacggtggcttcacacacgtgccctgtttcctgcattgccttaacatggtgattcaggactttttctgcgagcacaagagtatcgaaaacatgttggtcgccgcaagaaaaacctgccaccatttctcgcacagcgtgaaggcgaggcaaattttgcaggaatttcagaatgaccaccaactgccttggaagaacttgaaacaggatgagacaggtcattggatctccaccttttacatgctgaagtggctgcttgaacactgttattctgtgcaccacagtctcggcagagcctcaggggtcgtgctgacgtctctgcagtggactttaatgacatatgtgtgcgatattctgaagccgttcgaggaagccactcagaaggtcagcgtcaaaactgccggtttaaatcaagtgctcccactgattcatcacttgcttttgtctttgcaaaaactcagagaggattttcaagtcagaggcattacccaggcactcaatctggttgactcgctctctctcaaactggaaacagataccctgctgtcagccatgctgaagagcaagccgtgtatcctggctacactgctggacccgtgtttcaaaaacagtctggaggacttcttccctcaaggtgcagacctggagacctataagcagttcttggccgaggaggtgtgcaattatatggagtccagtccagaaatctgccagattcccacctctgaagcctcttgcccgtctgttaccgtcggagccgattcctttacttcctccctgaaggaggggacaagctcatccgggtcagtggatagtagcgctgttgataacgtggcgctcggatccaaaagtttcatgttcccgagcgcagtggctgttgtggatgaatacttcaaagagaagtatagcgaattctctgggggtgatgatcctctaatctactggcagaggaaaatctccatctggccagcccttacccaagtggcgatccagtacctgtcttgtcctatgtgctcatggcagtctgagtgcatcttcactaaaaactctcacttccaccctaagcaaatcatgtcattggatttcgataacatagagcagttgatgtttctgaaaatgaatctaaagaatgttaattatgactacagtacactcgttttgagctgggatccagagcagaatgaagtggtgcaaagcagcgagaaggagatattaccatag

SEQ ID NO: 247900 - DNA, 4938 bp, Artificial Sequence
  Description of Artificial Sequence: Synthetic coding sequence
atggaagaaagcaaaaccctcaagtctgagaaccatgagccaaagaaaaacgtgatatgtgaagagagcaaagcagtccaggtgattggaaaccagacactgaaagccagaaatgataaatccgttaaggagattgagaatagttcaccaaacagaaactcatccaagaagaataaacagaacgacatctgcatcgagaagaccgaggtgaagtcctgtaaggtgaacgctgccaacctcccgggaccgaaagacttgggactcgttcttagggaccaatcacactgcaaggctaagaaattccccaattcacccgtaaaagctgagaaggctactatttctcaagccaaaagcgagaaggcgacctctctccaggcgaaagcggaaaagtcccctaagagcccaaacagtgtcaaggccgaaaaagcttcctcataccaaatgaagagcgaaaaggtgccttcaagtcctgccgaggcagaaaaaggacctagtctgctgctaaaggacatgcgccaaaaaaccgaattgcaacagattgggaagaaaatcccctcaagtttcacttccgtggataaggtgaatattgaagccgtgggcggagagaaatgtgcgttgcagaactctcccaggtcccagaagcaacagacgtgcaccgacaacaccggtgactctgacgacagcgcttctggaattgaggacgtttcagacgacctgtccaagatgaaaaatgacgaaagcaacaaagagaattcatcagaaatggactacctggaaaacgccacggttattgacgagtccgcccttacccccgaacagaggctgggactcaaacaggccgaggaaaggcttgagagggatcacatttttcgactggagaaaaggtcccccgagtataccaactgtcgctacctgtgcaaactctgtctgatccatatcgagaatattcagggggctcacaagcatatcaaggagaagagacacaaaaaaaatattctggaaaaacaggaggaatccgagctgagaagtctgcctcccccttcgccggcacatctggccgctctttccgtggccgtaatagagctggctaaggaacacgggattaccgacgatgacctccgtgttagacaggagattgtggaggagatgagcaaggtcatcaccaccttcctacccgagtgctctctgcgcctatatgggagcagtttaacacgtttcgccctgaaatcatcagacgttaacattgacattaagttcccacctaaaatgaaccaccctgatctcttaatcaaagtcctcggtattcttaagaagaacgtcttgtatgtggacgttgaatctgacttccacgctaaagtcccggtggtggtctgtcgggaccgtaaatccggcctgctttgcagggtgagcgcaggcaacgacatggcctgcctcacaacagatctcctgacagctcttggcaaaatcgagccggtgttcattccactcgtacttgctttcaggtactgggcaaaactttgttacatcgactcccaaactgatggagggatcccatcatactgcttcgccctcatggtcatgttctttctgcaacagaggaaacctccgctgttgccttgcctgctagggtcttggattgagggtttcgacccaaaaaggatggatgacttccagctcaaggggatagttgaggagaagtttgtgaagtgggaatgcaatagcagtagtgccacggagaagaatagcattgctgaggagaataaggccaaggccgatcagccgaaggatgacaccaagaagacagaaacagacaatcagtctaacgcaatgaaagaaaaacatgggaagagccccttagccttagaaacacccaatcgcgtgagtctgggtcagctgtggctggagctgctcaagttttatacactcgactttgcattagaggaatacgttatctgcgttcgcatacaggatattctgacacgagaaaacaagaattggcctaagcggaggattgccatcgaggatccatttagtgtcaagcggaatgtggccagaagccttaactcccagctcgtgtacgagtacgtagtagaacgatttcgggctgcctacaggtattttgcctgtcctcagacaaagggtggcaacaaatctactgttgattttaagaaacgagagaagggcaaaatcagcaataaaaagccggtcaagtctaataatatggccacaaacgggtgtatcctgctcggggaaactactgaaaagataaatgctgagcgagagcaacctgttcagtgtgacgagatggattgtaccagccagcgatgcatcattgacaataataatctcctggtcaacgaactggactttgcggatcacgggcaggattctagctctttgtctacctctaagtcctcagaaatcgagcccaaactcgacaagaaacaggacgacctggccccttccgaaacctgccttaagaaggagctgtctcagtgcaattgcatcgatctgtcaaaatctcccgaccctgacaagagcacagggacagactgtagatccaaccttgagacagaatcatctcaccaatcagtgtgtaccgatacttcagctaccagttgcaattgcaaagcaacggaagacgcttcagacctgaacgacgatgacaacctgcctacccaggagctgtactatgtgttcgacaagttcatccttacgagtggaaagccaccgaccatagtttgcagtatttgcaagaaggacgggcattcaaagaacgactgccctgaagatttccgcaagatagatctcaagcctttgccccctatgacaaatagattccgcgagattctcgatctagtgtgcaagaggtgcttcgacgaactatccccgccatgtagcgaacaacataatagggagcagatacttattggcctcgaaaagttcatccaaaaggaatacgatgaaaaagctaggctgtgcttatttggcagctctaaaaacggcttcgggttcagggacagcgacctggacatctgtatgacactcgagggacatgaaaacgcggagaagctcaactgcaaagaaatcatcgaaaacctggcaaagattctgaagcgtcatcccggactcagaaatatcctgcctattaccaccgccaaggtgcccattgtgaaatttgaacatcgtagaagcgggcttgagggcgacatcagtttgtacaacacactagcccagcacaacacccgaatgctggcgacctacgccgctatcgaccctcgggtgcagtacctggggtacactatgaaggtctttgccaagagatgtgacataggcgacgcaagtagggggagcttaagcagctatgcctacattttgatggtcctctactttctacagcagagaaaaccacctgtcatccccgtgttacaggagatctttgacgggaaacagattcctcaacgcatggttgacggttggaacgcattcttcttcgataagaccgaggagcttaaaaagcggctgccgtctctgggtaaaaacaccgagagcctgggcgagttgtggttgggcctcttgaggttctacactgaagaattcgattttaaggaatacgtgataagtattcgtcagaaaaagctactgactacctttgagaaacagtggacttctaaatgcattgccatcgaggatccattcgaccttaatcacaatctgggggctggcgtgtccaggaaaatgacaaactttattatgaaggcctttataaatggccgtaaactgtttggtaccccattctaccccctcattggacgagaggcagaatacttctttgactctcgagtgctgactgatggcgagctggcacctaatgatcggtgttgtcgggtgtgcggaaagatagggcattacatgaaagactgccctaaaaggaaatccagtctacttttccggctcaaaaagaaagatagcgaagaggagaaggaagggaatgaggaggagaaggattcacgggatgtgctcgaccctcgggatctgcatgacacccgtgactttcgcgatccgcgagatttaaggtgctttatctgtggagatgccggtcacgtgagacgcgagtgccctgaggtcaagctggccagacagcgaaactcttccgtcgcagccgcacagctcgtaaggaatctcgttaatgcacaacaggtggcaggatctgcccagcagcagggtgaccagtcaatccgaactcgccagtcctccgagtgttcagaaagcccgtcatatagtccccagccacaacccttccctcaaaattccagccagtcagctgccatcacccagccctcatcccaacctggttcccagccaaaactgggtccccctcagcaaggcgcacagcctccacatcaggtgcagatgcccctgtataatttccctcaatcaccacctgcccagtatagtcccatgcacaacatgggacttctgcccatgcaccctctgcagatccctgcaccctcttggcctatacacggacccgtgattcacagcgccccagggtcagcacctagcaacatcggcctgaacgacccttctataatctttgcacaacccgcagcaaggcccgtcgcaattcctaacacctcccacgacggccactggcccaggaccgtggccccaaattccttagtcaattctggagctgtgggcaattccgaacctggcttcaggggcctcacccctcccataccttgggagcacgctcctagaccccactttcctctcgtgccggctagttggccttatggtctgcaccagaactttatgcatcagggaaatgccagatttcagcccaacaaacctttttacactcaggaccgctgtgcaactaggagatgccgtgagcggtgcccccaccctccacggggtaatgtgagtgaatag

SEQ ID NO: 247901 - DNA, 4935 bp, Artificial Sequence
  Description of Artificial Sequence: Synthetic coding sequence
atggaggagtccaagaccttaaaaagtgagaatcacgagcctaagaagaatgtcatttgtgaggaatcgaaagcggtccaggtgatcggcaaccagacccttaaggcccgaaatgataagtccgtcaaggaaattgaaaactcttcacctaatcggaattcttcaaaaaagaataaacagaatgacatttgcattgagaagactgaggtgaagtcatgtaaggtgaatgctgctaacttgcccggacccaaggacttaggcctcgtccttcgggatcagtctcactgcaaggccaaaaaattcccgaatagcccagtgaaggccgagaaagcaacaatttcacaggctaagtccgagaaggccacctctctgcaggccaaggctgaaaaatcacccaaatcgccgaattccgtcaaggcagaaaaggccagcagttatcaaatgaagtcagagaaggtaccatcctctccggcagaagccgagaagggtccatctctgttgctcaaagatatgcgccagaaaaccgaattgcaacagatcggaaaaaagattccctctagtttcacaagcgtcgacaaagtgaacattgaagctgtgggaggagagaaatgcgcgcttcagaattcccctcgctcccagaaacagcagacctgtacagacaatacaggtgattccgacgattccgcttctggaatagaggacgtgagtgacgacctgtctaagatgaagaatgatgagtctaataaagagaattctagcgaaatggattaccttgagaatgcgacggtgattgatgaaagcgcactgacacctgagcagcgccttggtctgaagcaggcagaggagcggctcgagcgagaccacatcttcagattagagaagaggtcaccagagtacacgaattgtcgctacctgtgcaagctgtgtttgattcatattgagaatatacaaggagcccacaaacacattaaagaaaaacgccataaaaagaacatcttagagaaacaagaggaatcagagctgcgaagtcttccgcctccatctcctgcccacctggccgctttaagcgtggccgtcatcgagctcgctaaggaacacggaattaccgatgacgacctcagggtcaggcaagagattgtagaagaaatgagtaaggtgattactactttcctacccgagtgtagtctgagattatatggcagcagcctgacacgcttcgcactcaaaagctcagacgtgaacatcgacattaagttcccgcctaagatgaaccaccctgacttgttaattaaagttcttggcatcctgaaaaaaaacgttctgtacgtggacgttgagagcgatttccacgctaaggtgccagtcgttgtttgccgagatcgcaagagcggcctgctgtgcagagtctcagccggtaatgatatggcttgtctgacaaccgaccttttaactgctctggggaagattgagccggtctttatcccacttgtgcttgctttccgttattgggctaaactctgctatatcgactcacagaccgatggcggaatcccatcttattgctttgcacttatggtcatgtttttcctccagcaacggaaaccccctctcctcccctgcctgctagggagttggatcgagggttttgacccaaaaaggatggacgacttccagctgaaaggcatagtcgaggagaagttcgttaagtgggagtgcaattctagtagcgccaccgaaaagaattcaatcgctgaggagaataaagctaaggccgaccagcccaaggatgacaccaaaaaaacggaaactgacaaccaaagcaacgccatgaaggagaagcacggcaagagcccactcgctctcgagactcccaaccgcgtttcactgggacagttgtggctggagctcctgaaattttataccttagattttgcacttgaggagtacgtgatatgtgtgcggatacaggatatactgacacgtgaaaacaagaactggcctaagaggcggattgctatcgaggacccatttagtgttaagcgaaacgtggccaggtcgctaaactctcaattggtgtacgaatacgtggtagaaaggtttagagccgcatacaggtattttgcttgcccacaaaccaaaggcggaaataagtcaacagtggactttaagaaacgtgagaagggcaagatttctaacaaaaagccagtgaagagtaataatatggccaccaacgggtgcatcttgctcggagagactaccgagaaaatcaatgccgagcgagagcagcccgtccagtgcgatgaaatggattgcacctcacagcggtgtattatagacaacaacaatctgctggttaacgagctcgatttcgcagaccacgggcaagattccagtagtctgtctacctctaagtcctccgaaatagagcccaaacttgataagaagcaggacgacctggcgccaagtgaaacctgtctcaagaaggagctatcgcagtgtaactgcatcgacctctccaagtctccagaccccgataagtcaaccggcaccgattgccgttccaatctcgagactgagtcaagtcaccagtccgtgtgtacagatacctctgccacttcttgcaattgtaaggccactgaggatgcatctgatcttaacgatgatgataacctgccaactcaggaattatattatgtgttcgataagttcatcctgacctcggggaagcccccaaccatcgtttgctcgatctgtaagaaggacggccacagtaagaatgactgtcccgaggattttcgcaagatcgacctgaaaccactcccaccgatgaccaacaggtttagggaaatattggacctggtttgtaagcggtgtttcgatgagctatctcctccttgctctgaacagcacaatcgggaacagattctcattgggctggaaaaattcattcagaaagagtatgatgaaaaagcccgtctctgtttgttcgggagttcgaaaaacggatttggttttagggactctgacttggacatttgtatgacattggaagggcatgagaacgccgagaagttaaattgtaaggagattatagagaaccttgccaagatattgaaaaggcacccagggctccgaaatattctgcccatcacgaccgctaaggtccccatcgtgaagttcgagcacaggcgcagcgggctggaaggagacatctccttatacaatacactggctcagcataatactcgtatgttagccacatacgctgctattgatccaagagtccagtacttggggtacactatgaaggtttttgcaaaacgctgtgatataggcgacgcttctcgaggcagcctgagcagctacgcatatattctgatggtcttatattttctgcaacagcggaagccaccagttattcctgtgttgcaagagatcttcgacggaaaacagatcccgcagagaatggtggacgggtggaacgcattcttcttcgacaagactgaagaattaaagaaacggctgccgtctctgggcaaaaatacggagagtctcggggaactttggctcggtctgctgcggttctacactgaggagtttgacttcaaagaatatgttatttccatccggcagaagaaactgttgacgaccttcgagaagcaatggacgagcaagtgtatcgcaatagaggaccccttcgacctgaatcataatctgggtgcaggcgtatcacgcaagatgaccaatttcataatgaaagccttcatcaacggcaggaaactcttcggaactccattttaccccctgattggcagagaggctgaatacttctttgattcccgggtcctcaccgacggagaactggcacctaatgatcggtgctgccgggtatgcgggaaaatcgggcactacatgaaggactgtccgaaacgcaaatccctgctctttaggttgaaaaagaaagacagcgaggaagagaaggagggcaatgaggaggaaaaggattctcgcgacgtgctggatccgcgtgacctgcacgatacccgggatttccgcgatccccgagacctaagatgcttcatttgtggagatgctgggcacgtgcgaagggaatgccctgaagtgaagctggcccgacaacgcaactcatctgtggcggcagcccagttggtaagaaatctagtgaacgcgcagcaggtggccggatccgcgcagcaacagggcgatcagtcaattagaaccaggcagtcatcagagtgctcggaatcgcccagctacagccctcaaccccaaccttttcctcagaacagctcccagtctgccgcaatcacccagccctcgagccaaccaggaagccagccaaagctgggcccacctcagcagggtgcacagcctccccaccaagtgcagatgcctctatacaacttcccgcaaagccccccagctcagtatagtcctatgcacaatatgggcctgttaccaatgcaccccctgcaaattcccgctcccagctggccaatacacggaccagttattcattcggcccctggcagcgccccatcgaatataggcctgaatgacccatcgattatcttcgctcagccagctgctaggcctgttgcaatcccaaatacaagccatgatggccattggcctagaacagtcgcgcctaattctctggtaaactcgggagcggttggaaactcagaacccggattccgcggactcacccctcccatcccttgggagcacgcccctcggcctcactttccgctggtcccagccagctggccttacgggttacaccagaacttcatgcaccaagggaacgctagattccagcctaacaagcccttttacactcaggaccggtgtgccacaaggcgctgcagggaaaggtgtccacatccccctagggggaacgtttctgagtag

SEQ ID NO: 247902 - DNA, 264 bp, Artificial Sequence
  Description of Artificial Sequence: Synthetic coding sequence
atggaagagtctaaaaccctcaaatctgaaaaccacgagccaaagaagaatgtcatctgcgaagagagtaaggccgtccaagttatcgggaatcaaaccttgaaggcaaggaacgacaaatctgtgaaggaaattgaaaattcttccccaaacaggaactcctccaaaaagaataaacaaaacgatatttgcatcgagaagaccgaagtaaagtcttgcaaggtgaacgctgctaacctgcctgggcctaaggaccttgggtag

SEQ ID NO: 247903 - DNA, 234 bp, Artificial Sequence
  Description of Artificial Sequence: Synthetic coding sequence
atggaagagtccaagaccctgaaatctgagaaccacgagcccaaaaagaacgtgatttgtgaagagtctaaggccgttcaggtcattggtaaccagactctcaaggcacggaacgacaagagtgtcaaagaaatagagaatagctcccccaatcggaactctagtaaaaagaacaagcagaacgatatatgcatcgaaaaaacagaggtcaagtcctgtaaagtcaacgcctag

SEQ ID NO: 247904 - DNA, 1209 bp, Artificial Sequence
  Description of Artificial Sequence: Synthetic coding sequence
atggcatccatcatcgcgcgagttgggaacagtaggcgactaaacgcacctctgcctccctgggcgcatagcatgctgagatcactgggtaggtccctcggaccaatcatggccagcatggctgatcggaacatgaagcttttctccggccgagtggtccctgcccagggggaagagacgtttgagaattggctgacacaggttaatggagttctgcccgactggaacatgtcagaagaggagaaacttaaacggctcatgaagacgcttcggggaccagcacgggaggttatgcgggtgctccaggcaacgaaccccaatctcagtgtagccgattttttgcgcgcaatgaaattagtgttcggtgagtccgagtccagcgtcaccgcccacggcaaattcttcaacacattgcaagctcaaggcgaaaaagctagcctctacgtaatccggctggaagtccaattgcagaacgccatacaagcaggtataattgctgagaaagacgccaacagaacccgacttcagcagctgctgctggggggagagctgagcagggatctccggttgcgcctgaaagattttctcagaatgtatgctaacgagcaagagcgcctcccaaactttttagagcttatccgcatggttcgcgaggaagaagattgggatgatgccttcataaagcggaaaaggcctaaaaggagcgaaagtatggtggaaagagctgtatcacccgttgcttttcaaggctcccctccgatcgtcataggctccgccgactgtaacgtaatcgagatcgacgacacactcgacgactccgatgaggacgtcattctggtggaatcccaagatccacctcttccatcctggggggctcctcccctacgtgatagggccagaccccaggatgaagtcttagtgattgactcacctcacaattctagagcccaatttcccagcactagcggagggtccggatacaagaataacgggcctggagagatgagaagggctagaaagcggaagcacactattcggtgtagctactgcggcgaggagggtcactcaaaagagacatgcgacaatgagtcagacaaggcccaagtcttcgaaaatctgataatcactctgcaggagctcacgcataccgagatggagagatccagggtggcacccggagagtacaatgatttttctgaaccactgtag

SEQ ID NO: 247905 - DNA, 1542 bp, Artificial Sequence
  Description of Artificial Sequence: Synthetic coding sequence
atggctgcttccagaaacggcttcgaggctgtagaagctgagggatctgcaggctgtaggggtagcagcggaatggaggtggtgctccccctggatccagctgtccccgcacccctctgcccccatggacccacactgcttttcgtgaaggtgactcagggtaaggaagaaactaggcgcttctatgcctgctccgcttgtagagaccggaaggactgcaacttcttccagtgggaagatgagaagctgtcaggcgcaaggcttgccgctcgcgaagcgcacaataggcgttgccagcctcccttaagcaggacccaatgtgttgagagatatcttaaattcattgagcttccactgactcagcgaaagttctgccaaacatgtcagcagttgctgctgccggatgattggggccagcatagcgagcatcaagtgctggggaatgtgtcaatcacccagctgcgcagaccttctcagctgctgtatcccctggagaacaaaaaaacaaacgctcagtatctcttcgctgaccgatcttgtcagttcctagtggatctactctctgcacttggctttcggcgtgtgctttgtgtaggcaccccgaggctgcacgaacttatcaaattgactgcctcgggcgataagaagtccaacattaaaagtctgcttctggacatcgactttagatacagccagttttacatggaagactccttttgccattacaatatgtttaaccaccatttcttcgacgggaagactgccctggaagtgtgccgggctttcctccaagaggacaaaggagaagggattattatggtaaccgaccccccattcggaggtttagtggagccgctcgctatcacattcaagaagctcatagccatgtggaaagaagggcagtctcaggatgattcgcacaaagaactgcccattttttggatttttccctacttcttcgaaagccgtatctgccagttttttccctcttttcagatgctggattaccaggttgactacgacaatcacgcactctacaagcacggaaagaccggcagaaagcagagcccagtaagaatattcacaaatatccctcctaataagatcatcctgcccaccgaagagggttataggttctgttccccttgtcaaaggtacgtgagccttgaaaaccagcattgtgaattgtgtaacagctgcacaagtaaagatgggagaaagtggaatcattgcttcttgtgcaaaaagtgtgttaaaccttcctggattcactgttcgatctgcaatcactgcgccgttcccgatcactcgtgcgaagggcctaaacacggctgctttatttgcggagaactagatcataaaagatccacttgccctaatatcgccacatccaagagggctaacaaggctgttaggaaacagaaacaaagaaagtccaacaagatgaagatggagaccaccaaaggtcaatctatgaaccacacctcggcaacccgacgtaagaagaggcgggagcgcgctcaccagtatctcggtagctag

SEQ ID NO: 247906 - DNA, 384 bp, Artificial Sequence
  Description of Artificial Sequence: Synthetic coding sequence
atggaagtcgtcctcccactggacccggctgttccggctccactctgtccacacggaccgaccctgctgtttgtgaaggtgacacaaggcaaggaggaaactcgacggttctacgcatgcagtgcctgtcgtgatcgaaaagactgtaatttctttcagtgggaagatgagaagctctcaggagcaaggctggcggctcgtgaagcacacaaccgtcggtgccagcccccacttagtcgcacccagtgtggccgttacctgaaatttattgagttgccgctgacacaacggaaattttgccaaacatgtcagcaactgctgcttccggacgactggggccagcattctgagcatcagttttgggtatgcgtgataacatcatag

SEQ ID NO: 247907 - DNA, 1479 bp, Artificial Sequence
  Description of Artificial Sequence: Synthetic coding sequence
atggttattcttttgctgcagcatggtgccgatccaaccttgatcgatggcgaaggcttcagcagcattcacttagctgtgctgttccagcacatgcctatcattgcctacctgatttctaaaggccagtcagtgaacatgaccgatgtgaacggacaaaccccactgatgttgagtgcacacaaagtgattggccctgagcctacaggctttttactgaaattcaacccaagtctcaatgtggtagacaaaatacatcagaatacccccctgcactgggcagtcgccgcaggaaacgtgaacgccgtggacaagctcctggaggccggatctagtctcgatattcagaatgtgaaaggcgagactcccctcgatatggcacttcagaataagaaccagttaataatacatatgctgaaaacggaggcaaagatgcgcgcaaaccagaaatttagattatggagatggctccaaaagtgcgagctgtttctcctgctgatgctgtctgttataacaatgtgggcaattggctacatcctggacttcaactccgactcctggcttctcaagggatgcctcctcgtgacactgttcttccttaccagtctgttccctcggtttttggtaggttacaagaacttggtctatcttccgacagcttttttgctgagttccgtgttctggatcttcatgacatggtttatactgtttttccctgacctcgccggagcgccattttacttctcctttatcttcagtatagtagcttttttgtatttcttctacaaaacatgggccacagatcctgggttcacaaaagcaagcgaagaggaaaagaaggtcaacatcatcactctggctgagactgggtccttggattttaggacattttgcacgtcctgtctgatccgaaagccactcagatctctgcactgccacgtgtgcaattgttgtgtggctcgatatgaccagcattgcctgtggacgggtcggtgcatcggattcgggaatcatcactactatatcttttttctctttttcctttccatggtgtgtggttggattatttacggatcatttatctacctctcctcacactgcgcgactacttttaaggaggatgggctgtggacgtatcttaaccagatcgtagcatgttccccctgggtcctttacattttaatgctggccacttttcatttctcttggtccacgttcttactcctgaatcaactcttccagatagcttttctgggcttgacttcacacgagaggatcagtctgcagaagcagagcaagcatatgaagcagaccctgagcttgcgtaagaccccttataatttgggatttatgcaaaatctcgccgatttcttccaatgcgggtgctttggactcgtgaaaccatgcgtcgtggattggacgagccaatataccatggtgttccatcctgctcgagagaaagtactgagatctgtgtag

SEQ ID NO: 247908 - DNA, 1869 bp, Artificial Sequence
  Description of Artificial Sequence: Synthetic coding sequence
atggagggtcccggactaggcagtcaatgtaggaaccattcccacgggccacacccaccaggctttggcaggtatggcatttgtgcccacgaaaacaaagagctggccaatgccagggaggcactgcctctcatcgaggactcctcaaactgtgacatagtgaaggctactcagtacgggatatttgaaagatgtaaagaactcgtcgaggctggatatgacgtacgccaacctgataaggaaaacgtatctctgctgcattgggctgccatcaataaccggctggatctggttaagttttacataagcaaaggcgctgtggtggaccaactgggtggggatttaaatagtaccccgctgcattgggccatcagacagggccatctcccaatggtgattctcctgcttcagcacggagcggaccctaccttgatcgatggagagggattttcaagcattcatcttgccgttcttttccagcatatgccaatcatcgcctacctcatatcaaagggccaatcggtgaatatgacagatgttaacgggcaaactcccctcatgctgagtgcgcacaaggtgataggtcctgagccgacaggatttctcctgaaattcaacccttctttgaatgtggtggacaagattcatcaaaacacaccattgcactgggctgtagcagccggaaacgtgaacgctgtggacaaactgctggaagccggaagctccctagacattcaaaatgtgaagggagagacgcctctggacatggctttgcaaaataagaaccaactcattatacacatgctgaaaactgaggctaaaatgcgggcaaatcagaaatttcgcctctggcgttggttgcaaaagtgcgagctgtttttgctgttgatgttatccgtgataacaatgtgggcaattgggtacatcctggatttcaacagcgattcttggctcttgaaaggatgcttgctggtgaccctgtttttcctgacctctctcttcccaagatttcttgtgggatacaaaaacctcgtctatctgccaacagccttccttctgtcatccgtgttttggatatttatgacttggtttattcttttcttcccagatctagccggtgcacccttctattttagcttcatttttagcattgtggcatttctgtacttcttctataagacttgggctaccgaccccggttttacgaaggcaagcgaagaagaaaagaaggtcaatattattacactggccgaaaccggttccttggactttaggaccttctgtactagctgcttaatacgaaagcccttaagaagccttcactgccatgtgtgtaattgttgtgtggcccgatacgaccagcactgcctatggaccggccgatgcatcggcttcggcaatcaccactactacatattcttcctgttctttctgtccatggtgtgtggttggatcatttacggctcatttatttatctgtcatcccattgtgccaccacttttaaagaggatggactttggacgtatcttaaccaaattgtggcatgcagtccctgggtactgtatatacttatgctggccacattccattttagttggagcacattcctgttgctgaatcaactatttcagatcgcctttctgggtctgacgtcgcatgagcggatctctctccaaaagcagtcaaaacatatgaagcagaccttgagcctgaggaagacaccctacaacctgggcttcatgcagaacttggctgatttttttcagtgcggctgtttcgggctagtgaaaccctgcgtggtggattggacatctcagtatacaatggtgttccaccctgccagagagaaagtcttgaggtccgtgtag

SEQ ID NO: 247909 - DNA, 564 bp, Artificial Sequence
  Description of Artificial Sequence: Synthetic coding sequence
atgcgaaggggttggaagatggcgctgagcggtgggctgcggtgttgccggagagttctgagctgggtgccagttttggtaattgtactcgtggtgctgtggtcttactatgcttatgtgtttgagctgtgtcttgtgacagtactcagtcccgctgagaaggtcatatatctgatactgtatcacgccatcttcgtgttttttacttggacgtactggaagtctatctttaccctcccgcagcagccaaatcaaaagttccacctgtcttacaccgataaagaacgctatgaaaacgaagagcgcccagaggtccaaaaacaaatgctcgtggacatggccaagaaactacccgtgtacaccaggacagggtccggggcagtgaggttctgtgacaggtgccatttgatcaaacctgaccggtgtcaccattgtagtgtgtgcgctatgtgcgtgctgaagatggaccaccattgtccctggggaaattacccagtcttcgctctgagttctatgtcattctttttctcactgtggccagcatgcttcctaagcgcactgtag

SEQ ID NO: 247910 - DNA, 1014 bp, Artificial Sequence
  Description of Artificial Sequence: Synthetic coding sequence
atgaggcgcggatggaaaatggccctgagtggcggattgagatgctgtagaagagtgctgagctgggtacctgttctcgtgatagttctcgtcgtactctggagctattatgcttacgtcttcgagctctgtttagtcaccgttctatccccagctgaaaaggttatctatctcattctctatcatgccattttcgtattttttacctggacgtactggaaaagtatctttactctcccccagcagccaaaccagaaatttcacctgtcttatacagataaggagaggtacgaaaatgaagaacggcctgaggtccagaagcaaatgctagtggatatggcgaagaaactgcccgtgtatacccgtacaggaagcggcgcagtccgcttctgcgacaggtgtcacctaattaaacctgaccgctgtcatcattgcagcgtgtgcgctatgtgcgtgctgaaaatggaccaccactgcccatgggtgaacaattgcattgggttctcaaattataaatttttcctgcagttcctcgcctactcagtgctgtattgtctgtacatcgccaccaccgttttcagctactttatcaagtactggagaggcgaactgccctcagtgagaagtaagtttcatgtcctgttcctactcttcgtcgcttgcatgttttttgtgtcattggtgatcctttttggctaccactgctggctggtgtcacggaataaaacaaccctggaggcgttttgcacccccgtgtttactagcggaccagagaaaaacggctttaacttgggtttcattaaaaacattcagcaagtttttggcgacaaaaaaaaattttggctgatcccaattggcagttccccgggagacgggcattcctttcctatgaggagcatgaacgaaagtcagaaccctcttttggccaacgaagagacctgggaagataacgaagacgataatcaggattacccagaggggagcagctccctggcggtcgagacagagacttag

SEQ ID NO: 247911 - DNA, 987 bp, Artificial Sequence
  Description of Artificial Sequence: Synthetic coding sequence
atgcggcgagggtggaagatggctctttctggaggtctccgatgctgccgccgagtgctgagttgggtccccgttctagtgatagtacttgtggtactctggtcttattacgcctatgtattcgagctctgcctggttatttacttgattctctaccacgcgatttttgtgttcttcacttggacttactggaagagcatctttacactgccacagcagcccaaccagaagtttcatctatcttacactgataaggagcgatatgaaaatgaagagagacctgaggtccagaagcagatgctagtggacatggcgaagaaactgcccgtttacaccagaactggcagtggggctgtgcggttttgtgacaggtgccatctgatcaagccggaccggtgccaccattgctctgtgtgcgccatgtgcgtgctgaagatggatcaccactgtccatgggtgaataattgtatcggattctccaattataaatttttcctacagtttctggcctattcggttctttactgtctctacatcgccactaccgtcttttcctattttatcaaatattggagaggcgagcttccatctgtgcggtcgaagttccacgtactcttcctcctcttcgttgcctgcatgttcttcgtgtccctcgttatcctctttggataccattgctggcttgtgagcaggaataaaaccacattggaggcattttgtactcccgtgttcacctcagggcctgagaagaatgggtttaatcttggttttattaagaacatccagcaggtatttggcgataagaaaaaattttggctcatcccaatcgggtcctctcctggcgacggacactcttttcccatgcggtcaatgaatgagtcacagaatcccttactggctaatgaagagacgtgggaagataatgaggacgacaaccaggactatccagagggctctagtagcctggcagtagaaacagagacttag

SEQ ID NO: 247912 - DNA, 2022 bp, Artificial Sequence
  Description of Artificial Sequence: Synthetic coding sequence
atgcctaggtctcccggaacacgactcaagcctgcgaaatatattcccgtcgcaacggccgcagcattgttagtgggcagttccacactgttctttgttttcacctgcccttggctgacgagagccgtctctcccgctgtccctgtttataatggaattatttttctctttgtcctggcgaatttctccatggctacctttatggatcccggagtcttccccagggccgatgaagatgaggacaaggaagatgatttcagagcacccctgtataaaaatgtggatgtgcggggaatccaggttcgcatgaagtggtgcgccacttgtcatttctatcgccctccccgatgtagtcactgtagtgtgtgcgataactgtgtggaagtcaccgggaagttccggggtggggtgaaccctttcaccaggggatgttgtggcaatgttgagcacgtgttatgttccccccttgcccctagatatgtagtggagccccctagactcccactcgccgttagcttgaagccacctttcctgcgaccagaactgcttgatagagccgcaccactgaaagtgaaacttagcgacaacggtctgaaagccggattgggccgaagcaaaagcaagggttccttggaccggttggatgagaagcccctcgacctgggaccgcctctgccaccaaagatagaagcgggtacattttctagcgatcttcagacaccacgcccagggtctgccgaatcagctctgtccgttcaaaggacatctccgcctaccccagccatgtataaattccgccctgcattcccgaccgggcctaaggtcccattttgtgggccaggagaacaggtgccaggcccagatagtttaacactaggcgatgactccataaggtctctagatttcgtcagcgaaccctcactggatctcccagattacggacctggaggactgcacgcagcctaccctcccagcccccctctcagcgcatccgatgctttttcaggcgctctgcgatccctatctctgaaggcatctagtcgccgaggtggcgatcatgtagccctccaaccgctcagaagtgagggtgggcctccgacaccccacaggtctatctttgcccctcacgccttgcctaatcggaatgggtccctgtcatacgacagtctgctaaatcctggctcccctggcggtcacgcctgtccagcacaccccgcagttggggtagctgggtaccattcaccatacctgcatcctggtgccaccggggatcctcccagaccactgcccaggagcttttcaccagtactggggcctcgtccccgtgagccttcaccagtgcggtacgacaatttatcaagaacaattatggctagcatacaggagaggaaggatcgtgaggagagagaacgcctcttaaggtcccaagcagattcactgttcggagactccggcgtgtacgatgccccatcctcatattctctgcagcaggcctcggtgctgagcgagggcccaagaggccctgcgcttcgctacggatctcgcgacgacctcgtcgccggacctgggtttgggggtgccagaaatcccgctctgcaaacatcattatctagcctctcttctagtgtgtctagagctcctcgtacctcctcaagctcattacaagccgatcaggctagctcgaatgcacctggaccacggccaagttccggatcccacagatcacctgcgagacaggggttgccttctcctcccggaaccccccacagtcccagctatgccggaccgaaagctgtggcgttcatacacacagacttgccagaaccacccccaagcttgactgtacaaagggaccatccccagctgaaaaccccacccagcaagcttaatgggcaatcacctgggctggccaggctgggccctgccaccggtcccccaggacccagcgcatcgcccacacggcacacattagtgaaaaaagtgagtggcgtgggtggcaccacctacgaaatatcagtttag

SEQ ID NO: 247913 - DNA, 2298 bp, Artificial Sequence
  Description of Artificial Sequence: Synthetic coding sequence
atgcctagatcccccggtacgcgcctaaagcccgctaagtacatccccgtggctacggccgctgccttattggtggggagttctaccctgttttttgtatttacttgcccctggctgacccgcgctgtttcccctgcggtccctgtgtataacggcatcatatttctgtttgtgctggcgaatttttcaatggctactttcatggatcccggagtatttccacgggcagacgaggacgaggataaggaggatgactttcgcgctccactctacaaaaatgtcgacgtcaggggcattcaggttagaatgaaatggtgcgccacatgccacttttaccggccaccgagatgttcccattgttctgtgtgcgataactgtgtggaggactttgatcaccattgcccctgggtcaataactgtatcggcaggcgcaactaccggtattttttcttattcctcctgagtctatcagcccacatggttggcgtagtggcgttcggcctggtttatgtgctgaatcacgcagaaggcctcggagccgctcataccacaatcacaatggcagtgatgtgcgtggctgggctgttttttattcctgtgataggtctcaccgggttccatgtggtgctggtgacgaggggtagaaccacaaatgagcaggtgacaggtaaatttcggggaggagttaacccattcactcggggttgctgcggtaacgtagaacacgtcctctgcagtcctctcgctcctcgctacgtggtcgaacctcccaggttgcctctggcggtcagcctgaaacctccgttcttaagacctgagctgctggatagagcggctccactgaaagttaagctctccgataatggactgaaggcaggcctcgggcgttctaagtccaaagggtcattggaccgccttgatgagaagcctttggacctgggcccaccactcccacctaagatagaggctggcacatttagtagcgatctgcagaccccccgtccaggtagcgctgagagtgccctcagtgtgcagcggacgagcccaccaacaccagccatgtacaaatttcgcccagcgtttcccaccggccctaaagtcccattctgcggcccaggggaacaagtccccggtcctgactcactgactttgggtgatgattctattcggtccttggatttcgtcagcgaaccctctcttgacctgcccgattacgggcctgggggacttcacgccgcataccccccttctccccctctgtctgctagcgatgcatttagcggggctctgaggtcacttagtctaaaggcttcatctaggcgaggcggtgaccacgtcgccctacagcctctgaggagcgaggggggacctccgactccacaccgtagtatcttcgctccacacgcacttccgaatcgcaatggaagtctgtcctatgactccctgttaaaccccggatctcctggaggacatgcttgtcccgcacatccagccgtgggggtcgccggttatcatagtccctatttgcaccctggagcgaccggagaccccccacgcccactcccacgctcattttcgcctgtgctcgggcctagaccccgagagccctcccccgtgcgttacgacaacctgtccagaactattatggcgagtatccaggagcggaaggatagagaagagagagaaaggctacttcgttcacaggctgattccctgttcggagactccggggtgtacgacgcacccagttcctatagtctgcaacaagcatctgtactctccgaaggacctcgaggtcctgctttacggtacggctctcgggatgatttggtggcaggcccaggattcggaggcgctcgcaatccagcactgcagacctccctctcatccctgtcaagttcggtctcccgcgcacccagaacttccagctcctccctacaagccgaccaggcctctagtaatgcaccaggcccaagaccgtcctccggcagccataggtcccccgctcgacaggggctcccttcccccccaggcacgccacactctcctagctatgctgggcctaaggccgttgcattcattcatacagacctgcccgagccacctccgtcgctgactgtacagagagaccatcctcagctgaaaacccccccatccaagctcaatggtcagtcccccggtttagcgaggctgggccctgcgactgggccacccggtcctagcgcttctcccaccagacacactctggtcaagaaggtgagtggcgttgggggaaccacttacgaaattagcgtgtag

SEQ ID NO: 247914 - DNA, 2337 bp, Artificial Sequence
  Description of Artificial Sequence: Synthetic coding sequence
atgcccagatctccaggcaccaggctgaagcctgctaaatacatcccggtcgccaccgcggctgccctcctcgtggggtcatcaaccctgtttttcgtctttacttgcccatggttgactagggcagtatcccctgccgtgcctgtgtataatgggatcattttcctgtttgtgctggctaactttagtatggcgactttcatggaccctggagttttcccaagggcagacgaagacgaagataaagaggacgattttagggcgccactgtataagaacgtggatgtcagagggatacaagtgagaatgaagtggtgtgctacatgccacttttatcgcccaccacgatgcagccactgtagcgtgtgtgataactgtgtggaagacttcgaccatcactgtccgtgggtgaacaactgcataggtcgcaggaactatcgttatttttttctcttccttctgtccctgtccgctcacatggtcggggtggttgctttcgggcttgtctatgtgctcaaccacgccgagggccttggagcagcccacaccacgataacgatggctgtgatgtgtgtagccggactctttttcatcccggtgattggactaaccggcttccacgtggtgttagtgaccagaggtaggacgaccaacgaacaggtgactggcaaattccgcggaggagttaatccgtttaccaggggatgctgcggcaacgtggaacatgtgctatgttcgccccttgcgccaaggtatgtcgtcgaaccccctaggcttcctctggccgtatctctcaagcctccctttctgaggcctgaactgctcgatcgagccgctcctcttaaggtgaaactgagtgacaacggtctcaaagccggactgggccgttccaagtccaaaggcagtctggacagactagacgagaaacctctcgacctggggccacccctgccaccaaaaatcgaagccggtacattcagttctgaccttcagactcctaggcccggtagtgcagagtcagcgctgagcgtgcagcggacctccccaccgacacctgccatgtataagttcaggccagcctttccaacaggcccaaaggtcccattttgcggaccaggagaacaggtaccgggaccagatagtttaacactgggggatgattccattcgcagccttgacttcgtgagcgagccctccctcgatctgcccgattatggcccaggcggactgcatgcagcctacccaccatcacccccactttctgctagtgacgcgtttagcggcgctctccgttcactcagtctgaaagccagctcacggaggggcggtgaccatgtcgctttgcaaccactgcggtccgagggaggtccacccacaccacaccgatctatctttgccccacatgcattaccgaatcggaacggctcacttagttacgattccttgttgaatccaggctcccccggtggacatgcctgcccagcacaccctgctgtgggagtggcaggctatcatagcccttacttgcaccccggagctaccggcgatccccctcgccctctccccagaagctttagcccagtgttaggacctcggcctagggagccatcgccagtgcgctatgataatctgagccggactatcatggcttctattcaggagaggaaggaccgggaggagcgcgagcgactcctgcggtcacaggctgatagcttgtttggcgactcaggggtctatgacgctccctcttcttactcattacagcaagcctctgttctcagcgaagggcctcgcggtccagccctacgatacgggtcaagagatgatctggttgccggaccaggcttcggaggcgcaagaaatccagccctccaaacctcactatcctctctttcctcttcggtctctcgcgctccacgtacctcctcttccagtttgcaggcagatcaggcttccagtaacgcacctgggcctcgcccatcttctggcagtcatagatcacctgccaggcagggactgccaagtccacccggaaccccgcactcccccagttacgctggccctaaggctgtcgcatttatccatacggacctgcctgagccaccaccctccctcaccgtgcagagggggagaattggcacttgcacacgaggttgggggcgaagaggacagccttgggtacctcctggcttgcatttatgccaccttgggcgaccggaggacagaccgcctctaagggctccttggtcgcaagctgcgggtgcccctcctcgaggagctatgtgccggttacacctggccgctagttccctgtttccgtcattgagtggaccttag

SEQ ID NO: 247915 - DNA, 1095 bp, Artificial Sequence
  Description of Artificial Sequence: Synthetic coding sequence
atgtcagttatggttgtgcggaaaaaggttacccggaaatgggagaagttgcccggaagaaatactttttgctgcgatggaagggtgatgatggcgagacagaaaggcatattctacctaacactgtttctcatcctgggaacctgcactttgttcttcgcctttgagtgtaggtatctcgccgtccagttgtcaccagccattcctgtgttcgcggctatgctgttcttgttctcaatggcaacgcttctgaggacttcattctctgaccccggagtgatccccagggcactcccagatgaggctgcctttatcgagatggaaattgaagcaaccaatggagcggtacctcaaggtcaacggccaccaccacgaatcaaaaatttccagatcaacaaccagattgtcaaactcaagtactgttatacttgtaagatctttcgtcctccccgagcatctcattgtagtatctgtgacaattgtgttgagcgcttcgaccatcattgcccctgggtaggtaactgtgtggggaagaggaattataggtatttctaccttttcatcctgtcgctgagccttctcacaatttatgtttttgcgttcaatatcgtgtatgttgctctgaaatctctgaagatcggcttcctcgaaaccttgaaagagacacccggaactgtgcttgaggtactgatctgcttttttaccctgtggtctgtagtggggctgaccgggttccacacattcttggtggcactcaatcagaccaccaatgaagacatcaagggtagttggacaggaaaaaatcgagtgcaaaacccgtacagccacggaaatatcgtcaagaattgctgcgaggttctctgtggaccattaccaccatcagttctggatcgtaggggcattctgcccctggaggaaagcggaagcagacctccttcaacacaagagactagcagctcactgcttcctcagtctcctgcaccaacggaacatttgaactccaatgaaatgccggaagacagctctacgcctgaggaaatgccaccacctgaaccccctgagccaccccaggaggcggctgaagctgaaaagtag

SEQ ID NO: 247916 - DNA, 1095 bp, Artificial Sequence
  Description of Artificial Sequence: Synthetic coding sequence
atgagcgtaatggtggtccgcaagaaggtgacgcgcaagtgggagaagctgcccggtcggaacaccttttgctgcgatggtagagtaatgatggcgcgacaaaaggggattttttacctgacgctatttttgatcctgggcacgtgcactctgttcttcgctttcgagtgtcgctacttggccgtgcagctctcacccgcaattccagtgtttgccgcaatgttgttccttttctctatggccaccctgctgagaacttcttttagcgacccaggtgtgatccctcgagccctccctgatgaagcggcatttattgagatggagatagaagcaacgaatggtgcagtccctcaaggccagcggcctcccccaaggatcaaaaattttcagattaacaatcagattgtcaagctgaagtactgctacacgtgcaagatttttcggccacccagagcatcccactgttctatctgtgataactgtgttgagcgttttgatcaccactgcccgtgggtcgggaactgcgtgggcaagcgcaattacagatatttctacctgttcatactgagcctttcccttctgacaatctacgtgtttgccttcaacattgtgtatgtggcactcaagagcttaaaaataggatttcttgagacacttaaggaaacgccgggaacagtcctggaagtcctgatttgcttctttactttgtggtccgtggttggactcacaggattccacacattccttgtggccctaaaccagacaactaacgaagatattaagggctcgtggaccggcaagaacagagtccaaaatccctattcccacgggaatattgtgaagaattgctgcgaggtgctgtgtggtccccttccaccatctgtgttggatagaagaggaattctaccactggaggagtcaggctcacggcctcctagcacccaggagacttcctcatctctgcttccacaatctccagctcctactgagcatttaaacagtaacgaaatgcccgaggactcgtctacaccagaggaaatgcctcccccagagccccctgaacccccacaagaggcggctgaggcggaaaaatag

SEQ ID NO: 247917 - DNA, 513 bp, Artificial Sequence
  Description of Artificial Sequence: Synthetic coding sequence
atgtctgtgatggttgtgagaaaaaaggttacaaggaaatgggaaaaactccctggtcgtaataccttttgttgcgacggtagagtgatgatggctcgccagaagggcattttttatcttactctatttcttatcctcggaacatgtactctcttcttcgccttcgagtgcaggtacctagctgtgcagctctctcccgctatccctgtctttgccgctatgttatttctttttagcatggccactcttctccgtaccagcttttctgatcctggtgtgataccccgagccctgcccgacgaagctgccttcatcgagatggaaattgaagccaccaatggtgccgtcccacaggggcagagaccccctcctcggattaaaaacttccagattaacaatcagatagtgaaactgaagtattgctacacctgcaaaatctttagaccaccgagggcttcccactgcagcatctgcgataattgtgtggagcgattcgaccaccactgcccttag

SEQ ID NO: 247918 - DNA, 585 bp, Artificial Sequence
  Description of Artificial Sequence: Synthetic coding sequence
tagctgtttttgatcctcggtacctgcaccttattctttgccttcgaatgcaggtatctggcagtacagctgtcacccgcaatacctgtgtttgccgctatgttatttctattttcaatggccaccctccttaggacatccttttctgacccaggcgtgatccctagggctttgcctgatgaagccgctttcattgaaatggaaatcgaggcaaccaatggagctgtgccccaaggccagaggcctcctcctcgcatcaagaattttcagatcaataaccaaatagtcaaactgaaatactgctatacctgtaaaatttttcgaccacctagggcgagccattgctccatctgtgataactgtgttgagtcactcaagataggctttcttgagacactgaaagaaacccctggcactgtgctggaagtacttatttgtttcttcaccttgtggtctgtggtaggcctaaccggattccacacttttctcgttgctctgaaccaaacaaccaacgaagacattaaggggtcctggactggaaagaatcgtgtgcagaatccctactctcacggtaatatagtctag

SEQ ID NO: 247919 - DNA, 897 bp, Artificial Sequence
  Description of Artificial Sequence: Synthetic coding sequence
atggaaagaggcatttctgatgtcacggataggaaactaactatggaagaggaggaggctaaacggatagcagagatgggtaagccagtattgggagaacacccaaagttggaggtgatcatcgaggagtcatacgaattcaagacgactgtagacaaactgatcaaaaaaacgaacttagccctcgtagtgggaacccattcctggcgagaccagtttatggaggccatcaccgtgagtgcagctggggatgaggatgaagacgaaagcggagaggaacggctcccctcttgttttgattatgtgatgcattttctgaccgtgttctggaaagtcctcttcgcatgcgtccctcccacagagtattgtcatggctgggcctgtttcgccgtgagtatcctgattatcgggatgctgactgcaattatcggcgatctggcctctcacttcgggtgcaccatcggacttaaggactcagtgacagctgtggttttcgttgcatttggtacgagcgtcccggacacattcgcctcgaaagccgcagccctacaggatgtgtacgccgatgcttcaatcggcaacgttactggctctaacgccgttaatgtattcttaggcattgggctcgcctggtccgtggccgcaatttactgggccctgcaggggcaggaatttcatgtttctgcaggcaccttagctttttcggtcactctctttacaatatttgcattcgtttgtattagtgtcctactctacagacgcagaccccaccttggcggagaattgggaggcccaagaggatgcaagctggccacaacttggctcttcgtatccctgtggcttctctatatcctctttgccactctggaggcctattgttacatcaagggcttctag

SEQ ID NO: 247920 - DNA, 705 bp, Artificial Sequence
  Description of Artificial Sequence: Synthetic coding sequence
atgagctctgaagtgtctgcccgtcgagacgccaagaaacttgtgagaagtcctagtggcctcagaatggtgcctgagcatcgagcatttggctctccgttcggactggaggaacctcagtgggtgccagataaggagtgccgtagatgcatgcaatgtgacgccaaatttgatttcctgacccgaaagcatcattgtaggagatgcggaaaatgcttttgtgacagatgctgctctcagaaggtccccttgagacggatgtgtttcgtggaccccgtaagacagtgtgctgagtgtgcattggtttctttaaaggaggccgaattttatgataaacagcttaaggtgctcctctcaggcgcaacctttctcgtcacctttggcaacagtgagaaacccgaaacaatgacctgtagattgtccaataatcagcgatacctgtttctggacggcgattcgcattacgagatagaaattgtacacattagcaccgtgcaaatcctgaccgagggattcccccctggaggtggtaacgctagggccaccggaatgttcctgcaatatacagtgccgggaacagagggagttacacagctcaaactgactgtggtggaagacgtgacagtggggaggcggcaggccgtggcctggctggtggcgatgcacaaggccgcaaagctcctgtacgagagcagagatcagtag

SEQ ID NO: 247921 - DNA, 7619 bp, Artificial Sequence
  Description of Artificial Sequence: Synthetic coding sequence
atgaaccaccccttcggaaaggaagaggcagcgtcccagaagcagctgtttgggtttttctgtgagtgtctcagacgtggggagtgggaattggcgcaggcttgtgttccccagctgcaagaaggtcagggcgatatccccaagcgagtcgaagacattctgcaggctctggtcgtatgcccaaatctgctacgctgtggccaggacattaaccctcagagagttgcatgggtgtggttactggtgctggaaaagtggctggccagagaaaagaagctactgccggtcgtgttcagaaggaagctggagttccttctcctctcggaggacctacagggggacatcccagagaacatactcgaggaactatacgaaacacttacccagggcgcagtaggacatgttccagacggcaatccccgtcgggagtcctggacaccacgactctcttcggaagcagtctccgttctgtgggacctcctcaggcagagccctcagcccgcacaagccctgctggagctacttttggaggaagacgatggaactggactgtgtcactggccacttcaaaacgcgttggtggaccttatccggaaagcccttcgggctctacagggcccagattcggtacccccaggtgtggtcgacgcaatatacggtgccttaaggacgttgcgttgcccagctgagcccctgggcgtggagctgcacttgctgtgtgaggagctgctggaggcctgcaggacagagggctctcccctgcgtgaggagaggctactgtcctgtctgctacataaagctagtagagggctgctgtccttgtacggccatacatacgctgagaaagttactgaaaaacctccaagggccacagcttccgggaaggtgtcaccagaccacctggaccccgagagggccatgcttgcactgttcagcaaccctaaccccgcagaggcttggaaagtcgcatatttctattgtctgagtaataataaacatttcctagagcagatcctcgtgaccgccttgaccctcttgaaggaggaggacttccccaatctgggatgcctgctagacagagagttcagaccgctctcctgtctgcttgtgctgctggggtggacgcattgtcagagtctggaatcagccaagcgcctgctgcagactctccatcgcacacagggcccagggtgcgatgaactgctgagagatgcctgcgacgggctttgggctcacctcgaagtcctcgagtggtgtatccagcagtcctctaatccaatccccaagcgcgatcttttgtaccacttgcacggaggagacagccacagtgtcctctacactctgcatcaccttacaaacctccccgcacttcgagaagaggacgtgttgaagctcctgcagaaggtgcctgcgaaagatccacagcaggagccagacgctgttgacgcccctgtccccgaacatctgagtcagtgccagaatctaacactttaccaggggttttgtgcgatgaagtacgcaatctacgccttatgcgtaaatagtcaccagcatagtcagtgtcaggattgcaaggactctctgagtgaagacctggcctcagctaccgaacccgctaacgactccctgtctagcccgggagcagctaacctcttcagcacctacttagctagatgccagcagtatctgtgttctatcccagacagcctttgtctcgagctgctggagaatatctttagcctgctccttattacttctgccgacctgcacccagagccgcacctgcctgaagattatgccgaagatgatgatattgaaggcaaatcaccatctggacttaggtctccaagcgagtcaccacaacacatcgcccaccccgagcgtaaatccgagagaggaagtcttggcgtgccaaagacacttgcatatacaatgccctctcacgtcaaggcagaacctaaagactcctaccctggcccacataggcattctttcctagatctgaagcattttactagcggcataagcgggttcctggcggacgaatttgcgatcggcgcattcctgcgcttacttcaggaacagttagatgagatctcatctaggtccccccctgagaaaccaaagcaggaaagccagtcttgctccggctcacgagacggacttcagagtcgcctgcatcggctctccaaagtcgtgagcgaggcccagtggcgccataaggtcgttacatcgaaccatagatctgaggagcaaccatcacggagataccagcctgctacaagacatcctagcctcaggcggggaagaagaacacgtaggtctcaagctgacggaagagaccgtggttcaaatccctccctggagagtacatcgtctgaattgtccacctctaccagtgagggatccctgagtgccatgagtgggagaaacgagctccactcaagacttcacccacatccacagtcttctctcatccctatgatgttttccccacccgaatcgttactggcatcatgtatactccggggaaacttcgctgaagcccaccaggtgctttttacattcaacctcaagtccagtccaagctctggcgagctgatgttcatggagcggtatcaggaggtcattcaagaactggctcaggttgagcataagatcgagaaccagaatagcgacgccggaagcagcaccatccgacgaacaggttcaggacgctccaccttacaggctatcggcagcgccgcagctgccggaatggtgttctatagtatatcagacgttacagacaaactgcttaacaccagcggcgatcctatacctatgctccaggaggacttttggatcagcacagcgctggtcgagccaaccgctccgttacgggaggtgttagaggacttatctccacctgccatggcagcattcgatctggcctgttcccaatgtcagctatggaaaacctgcaagcagttgctcgagactgctgagagacgcctgaactcctctctggaacgtcgtgggcgacggattgatcacgtgctgcttaacgctgacgggattcgaggctttcctgtagtgctgcaacaaattagcaaatcacttaactatctcctgatgagtgcatcacaaactaagtcagaatccgtcgaagaaaagggcggaggcccacctcggtgctcaattaccgagttgctgcagatgtgttggccgagtttatctgaggactgcgtggcctctcacacaacactcagtcagcagctggatcaggtgctgcaaagtctacgagaggcgctagagcttcctgagccacgaactccccctcttagctcccttgttgaacaggccgctcagaaggcacccgaagccgaggctcatccagtgcagattcaaactcaactcttgcaaaaaaaccttgggaaacagaccccttccggaagcaggcagatggactatctggggaccttcttctcttactgttcaaccctggcagccgtattactgcaaagtctatcctccgaacctgaccatgtagaggtcaaggtcggtaatccgtttgtgctgttacaacagtcctcttctcaactggtgagccacctgctgtttgaaagacaggtacccccagagcgcctcgctgccctgcttgcgcaggaaaacctgagccttagcgtccctcaagtgattgtgagctgctgttgcgagcccctggctctctgtagctcaaggcaaagccaacagacaagttcactgctcacccgcctgggtacactggcccagctgcatgccagccattgcctggacgatttgcccttgagtaccccatcatccccgaggacaaccgagaatcccactctcgaacgaaaaccgtatagcagtcccagagactcgagcctgcctgccctcacctctagcgccttggctttcctgaaaagccgatccaaacttcttgctaccgtggcttgtttaggtgcctctcccagactgaaagtctctaaaccgtccctgagttggaaggaactgagagggagaagggaggttccgcttgcggctgaacaggttgcgagagagtgtgagcggcttctggagcagtttcctctgtttgaggccttcctgctggctgcctgggagcccctgagagggagcctgcagcagggtcagtcattagcagtgaacctgtgtggttgggccagcctatcgacggtgctgctaggcctgcatagccccatcgccttggacgtgctatcagaggcctttgaagagagcctagtagccagagattggagccgggcactccagctcaccgaggtgtatggacgggacgtggatgacttgagcagcatcaaagatgctgtgttgtcatgtgcagtggcatgcgataaggagggctggcagtacttgttcccggtcaaagatgcatcactccggtcccgactcgcactgcagttcgttgatagatggcccctggagagctgccttgagatactggcctactgtatcagtgataccgccgtccaagagggccttaagtgcgaactacagcgcaagctagccgaattgcaggtctaccagaaaatcctgggacttcagtcccctccagtgtggtgtgactggcagacccttaggtcctgctgcgtcgaggacccaagcacggttatgaatatgatactggaggcccaggaatatgaactttgtgaagaatggggttgtttgtatccgatcccacgcgagcacctgatttcattacaccagaagcatcttctgcatctgttggagcggagagatcacgacaaggcattacagttgttgaggcgtattccagaccctacaatgtgcctcgaggtgacagagcagtctctggatcaacacacctctttggccacatctcactttctggccaactacctgacaacccatttttacggccaacttacggctgtgagacaccgggagatccaggccctctatgtggggtctaagatcttgctcacgttaccggagcagcatcgcgcttcttactcgcatttgtcaagtaaccctctctttatgctggaacagctgttgatgaatatgaaagtcgactgggccaccgttgcagtccagacccttcagcagttattggtgggccaggagattgggttcaccatggacgaggtggactcacttctttctcgttatgcagagaaggccctggatttcccctacccacagagagagaagagatccgacagcgtcatacacttgcaggagatcgtgcaccaggctgccgacccggagacattacccagatccccaagcgccgagttttcaccggctgcaccacccggaatatcctctatccattcacccagcctgcgggagcgaagcttccctcctactcagcctagccaagagtttgtgcccccagccacacctcctgctagacatcagtgggttcccgacgagaccgagtctatatgcatggtctgttgtagagagcacttcaccatgttcaataggaggcatcactgcaggaggtgtggcagattagtgtgcagctcttgttcaacgaaaaagatggttgttgagggatgtcgagagaaccccgcaagggtctgcgaccagtgctactcctattgtaataaggatgtccccgaagagccgtctgaaaagcctgaggcactggatagcagtaaaaatgagtcgcccccatacagttttgtggtccgggttcccaaggccgacgaggtagagtggattctggacctcaaggaggaagagaacgagctcgtgagaagcgaattctactatgagcaggcaccttccgccagtctgtgcatcgcaatccttaatctccacagagatagtattgcatgcggacaccagctgattgaacactgttgtcgtttaagcaaagggctgacaaaccccgaagtggatgcagggctcctgactgatataatgaaacagttactgttctctgccaaaatgatgttcgttaaagccggacaaagccaggatctcgcgctgtgcgactcctacataagtaaagtcgatgtcctgaatattctggtggcagcagcttacagacatgtccctagtttggatcagattctgcagcccgctgccgtcacacgcctgcgtaaccagttgctggaagctgaatactatcaactgggggtagaagtttcgacaaaaactgggctcgatacgacaggggcatggcatgcgtgggggatggcgtgcttgaaggctggcaacctcaccgcagcgcgagaaaagttcagcaggtgtctgaagccccctttcgatctcaatcaactgaatcacggctcccgcttagtccaggatgtggtggagtacctggagagcacagtaagaccttttgtgtctttgcaagacgacgattacttcgcaacccttcgcgaactcgaggcgaccctgaggacacagtctctctcccttgcagtcatcccagaaggtaaaatcatgaataacacctactatcaggaatgcctcttctacttgcacaactatagcacgaatctggctattatttcgttttacgtccgccactcctgtctcagagaagcactgctacatctgctgaacaaggaatctcccccagaagtctttattgaaggtatctttcaaccttcatacaagtcaggtaagctccacaccctggagaacctgctggaatcgatagacccaactctggagagctgggggaagtatctcatagctgcctgccaacaccttcagaagaagaattattaccatatactctacgaactgcagcagttcatgaaggaccaggtgagagccgcaatgacatgtatccgcttttttagtcataaagctaaatcatacactgaattgggcgagaagctgtcctggttgctgaaggctaaggatcacttgaagatctatttgcaggagacctcccggtctagcggacgaaaaaaaaccacattttttcggaaaaaaatgaccgcggctgacgtctcgcgccacatgaataccctgcaactccagatggaggtaactcgcttccttcatagatgcgaatccgccggtaccagccagatcacaactcttccattgcctacgctgttcgggaataatcacatgaagatggatgtcgcctgtaaggtgatgctgggaggcaagaatgtggaagatgggtttggaatcgccttcagagtgctgcaagattttcaactcgatgccgcaatgacctactgtagagctgccagacagctggttgagaaagagaagtatagtgagatccaacaactgctgaagtgcgtgagcgaaagcggcatggcggcaaagagcgatggtgacacgatacttctgaactgtctcgaggcgttcaagcgaatacctcctcaggaactggaagggctcatccaggccatacacaacgatgataataaggtgagagcatatctgatatgttgtaagctccgcagtgcctacctaattgctgtgaagcaagaacactcacgcgcaactgcactggtacagcaggtacaacaggccgctaagtccagcggagacgccgtagtacaggacatctgcgcccagtggctcttgacctcccacccacgtggcgcacacgggcctggttcccggaagta

SEQ ID NO: 247922 - DNA, 7556 bp, Artificial Sequence
  Description of Artificial Sequence: Synthetic coding sequence
atgaaccacccgtttgggaaagaggaagcggcatcccagaagcaactgtttgggttcttttgtgagtgcctgaggcgcggtgaatgggaactcgctcaggcttgtgttccccagctgcaggaaggacagggcgacattccaaagcgagttgaggatattcttcaggccttagttgtatgccctaacttgctcagatgtggacaagatataaacccccagcgtgtggcctgggtctggctgcttgttctcgaaaagtggctcgctcgtgagaaaaagctgttgccggtggtgtttcgtcggaaattggagtttctactcctgtccgaggaccttcagggcgatatcccggaaaacatcctagaggaactgtacgagaccttgacgcagggggctgtcggacatgtccctgatgggaacccgcgacgggaatcctggacacccagactctcaagtgaagccgtaagtgtgctctgggatctgttgaggcagagtcctcaacccgctcaggccctcctggagctgctgttggaggaggatgatggcacagggctgtgccactggcctctgcaaaacgcgttggtcgacctgatacgtaaggcactgaggaccctgcgatgtccagctgagcctttgggagtggagctgcacctgttatgtgaggagctgctggaggcatgtcggacagaagggtcacccttgcgagaagaaaggctgctttcatgcctgttacacaaggctagcagaggactactatccctgtacggccacacatacgcagagaaggtgacagaaaaaccccctagagcaacagcttcaggaaaagtgtcgcccgatcatctggatcctgaaagggcgatgctggcactcttcagcaacccaaatcccgcagaagcctggaaagtggcatatttctattgcctgagcaacaacaagcacttccttgagcaaattctggtgacagcacttaccctgcttaaggaggaagactttcccaatctcggctgcctgctggaccgcgagtttcgtcccttgtcctgtttgctggtactgttgggttggacacattgtcagtcacttgaaagcgctaagcgtctgcttcagacacttcatcgaacacagggtcccggttgtgacgagcttctgcgggacgcttgcgatggcctatgggcgcacctggaagtattggaatggtgcatacagcagtcttcaaatcccattccaaagcgggacctgttgtatcatttacacggcggagattctcactctgtcttatacaccctgcaccacttgacaaacctcccagcacttagggaggaggacgttctgaagctcttacaaaaggtgccagccaaagacccacaacaggagccggacgccgtggatgctccagtcccagagcacctctcacagtgccaaaatttaaccctttatcaaggcttttgcgccatgaagtacgctatctacgcgctgtgcgtgaacagccaccagcattcccaatgccaggattgcaaagactcgctgtcagaggacctggcttccgccacagaaccagcaaatgactctcttagtagccctggcgctgcgaatcttttttctacgtatctggcacggtgccagcagtacttgtgtagcatcccagattctctctgtctggaacttctggagaacatcttctccctccttctcatcacctccgcagatcttcatcctgagcctcatctgcctgaagattacgcagaagatgacgacatcgaagggaagagcccttccggcctgcgaagcccatcagaatcaccgcagcacatagcacacccagagagaaaaagcgagcggggatccctcggagtgcccaaaaccttggcctacaccatgccttcacatgttaaagccgagcccaaggatagttaccctggaccccacagacattccttcctcgacctcaaacactttaccagtggaatctccgggttcctggcagatgagttcgctattggcgcattcctgagattgctccaggagcagttggatgaaatttccagccggtcacctccagagaagcctaaacaggagagtcagagttgttccgggtcccgggacggcctccagtcacggctccatcggcttagcaaagtagtaagcgaggcacagtggagacataaggtcgtcacctcgaaccacagatctgaggaacagccctcgaggcgatatcagcctgcaacaaggcacccttctttgcggaggggcagaagaacccggagaagccaagcagacggccgagataggggctctaatccttcgctggagtccacctcttccgaactcagcacatctacatccgagggaagcctgagtgcgatgtctggcaggaacgaactgcatagccgcctgcacccacatccacagagcagcttaatcccgatgatgtttagcccccctgaatcactgttagcaagctgtatactgcggggaaactttgcagaggctcatcaggtgctctttacatttaacctaaagtcttccccgtccagtggagagctcatgtttatggagcgctatcaggaggtgatacaagaacttgcacaggtagagcataagattgagaaccagaatagcgatgccggatcatcgacaatccggaggaccggtagcgggaggagtaccctgcaggccatcggtagcgctgccgcagctggcatggtgttctacagtatctccgatgtcaccgacaagttactgaacacaagcggggaccctatccctatgctacaagaagacttttggatctcaaccgccctggtcgaacctaccgcacccctccgagaagtacttgaagaccttagtccccctgcgatggccgcatttgacctggcttgtagtcaatgccagctgtggaagacttgcaaacagttactcgagaccgcggaaagacggttgaactctagtctggaaaggagaggcaggagaatcgaccatgtcttgctcaatgccgatggcattagggggtttccagtcgttctgcagcagatttcaaaatccctgaattacctgctaatgtcagctagccagacgaaatccgagtcagtggaagagaaaggaggaggccctcctcggtgttctattactgagctgctgcagatgtgttggccttcactgtccgaagattgtgtcgcatcccacaccactctgagccagcagctggaccaggttttacagtctctcagggaagctttagagttgcctgaaccacgtacacctccacttagcagtctggtcgagcaggctgctcagaaggcccctgaggctgaagcccaccctgtccaaattcagacccaactgctgcagaagaacctcggcaaacagacaccatccggaagccgtcagatggattatctcggcacatttttttcgtactgcagtactcttgccgctgtgctgctgcaatccctaagttcagagccagatcatgtggaggtgaaggtgggcaatccctttgtcctattgcagcaatctagtagtcagctggtgagtcatctgctgttcgagaggcaggtgcccccagagcgacttgcggctctgctagcacaggaaaacctcagcctgagcgtcccacaggttatcgtgtcgtgttgctgtgagcctctcgccctctgtagcagcaggcaaagccaacagacctctagtctcctgacccgcctgggcaccctggcccagctacatgcttcacactgtcttgacgatctgccgttgtcaacaccctccagccccaggaccactgagaacccgactctggagagaaagccgtactcctcccccagagactccagtttaccagccctgacctcgtcggcactggcatttttaaaatcaaggtctaaacttctggcgacggtcgcctgcctgggcgcatcaccaagactgaaagtttcgaaaccctcgctgagctggaaggagctgcgtggtcggagagaggttccgcttgccgcagagcaggtcgcaagagagtgcgagagacttctcgagcaattccctcttttcgaggcgtttttactggccgcatgggaaccactacgcggaagcctccaacagggacaatccttagcagttaacttgtgcggctgggcctccctgtctacggtgctgctggggctgcattcacccatagccctggacgtgctgagtgaagcctttgaggagagtctggtcgctagggattggagtagggcgctgcaattgaccgaagtgtacggaagagatgttgatgacctgagctctatcaaagatgcagttctgagctgcgccgtggcgtgcgacaaggaggggtggcagtatctgtttcccgtgaaagacgcctcccttcgcagtcgtctggccctccaatttgtggacaggtggcctctcgagagctgtctggaaattttagcatactgcatctcggatactgcagtgcaggaaggcctcaagtgtgagctccagcgaaagctggcagagctacaggtataccagaagatcctcggactccagtctcccccagtgtggtgcgactggcagaccttaaggtcatgttgcgtggaggacccaagcactgttatgaacatgatactggaggcccaggaatacgagctgtgcgaagaatggggttgcctgtacccgatccccagagagcatctgattagcttacaccagaaacacttactgcacctgcttgaacggagggaccatgataaagcactgcagcttctgaggcgaataccggatcccactatgtgtttggaggtgacagaacagtcactggaccagcacacctcgcttgctacgagccacttcctggcaaactacttgaccacccacttttacggacaacttaccgctgtccgccacagggagatccaagccctctacgtgggaagcaaaatactgctgacgctgcccgaacagcacagagctagctacagtcacctctcatccaaccccctgttcatgctggaacagctgcttatgaacatgaaggtcgattgggcaacagtcgcagtccagacactgcagcagctgcttgtgggacaggagatcgggttcacaatggacgaagtggactcactcttatcccgatacgcagagaaggccttggactttccctacccgcaacgcgaaaagcgaagcgactcagtcatccacttgcaggaaatcgtgcatcaggctgcagaccctgagaccctccccaggtctccatccgctgaattcagcccggctgctccccctggcattagtagcattcattctccttctttgcgggagaggagctttcctcccactcaaccttcacaggagtttgtgccgcctgctaccccacctgcgagacatcagtgggtgccagacgagacagagagtatatgtatggtttgttgtcgggagcactttaccatgttcaatcgtagacatcattgccgcagatgcggcagattagtgtgcagctcctgctcgacaaagaagatggtggtggagggctgtcgggaaaaccccgctagggtgtgtgatcagtgctacagttactgcaataaggatgtccccgaagaaccgtccgaaaaacccgaggccttagactcttccaaaaatgagtcacccccttattcctttgttgtccgcgtgcctaaggcagatgaagttgaatggattctggacttaaaggaagaggagaatgaactcgttcggtcggaattctattatgaacaggccccaagcgcatccctgtgcatcgctatacttaatcttcacagagattctattgcctgcgggcatcaacttattgagcactgctgcagattatcaaagggactcactaatcctgaggttgacgccggtttactgactgatatcatgaagcaactcctcttttcagctaaaatgatgttcgtgaaggctggtcagagtcaggatctggccctgtgcgactcttatattagcaaggtggacgtcctgaatatactcgtcgccgcagcctaccgccatgtgccctcccttgatcagatactccaaccagccgcagtgacccgtctgcggaaccaacttcttgaagccgagtactatcaacttggggtcgaggtcagtacaaagacgggcctggacactacgggggcttggcatgcttggggaatggcctgtctgaaagccggaaatttaaccgctgccagggagaagttttctcgatgtctgaaaccccctttcgacctgaatcagttaaatcacggttcccggctggttcaggacgttgttgagtacctggaatctactgtgaggccattcgtatctctgcaggacgacgactattttgccactttgagagaactcgaagccaccttaaggactcagagtttatctttggcagtcatccctgagggcaagattatgaataacacatactaccaggagtgcctattctacctccataattattctactaacctcgcgatcatcagcttctatgtgcgtcacagctgccttagagaagccctcctccaccttctgaacaaagagagtccccctgaagtttttatcgaagggattttccaaccaagctacaagagcggaaagttgcacactctggaaaatttactggagtctatcgaccctactcttgagtcctggggcaagtacctcattgccgcttgtcagcatttgcagaaaaagaattattatcacattctgtacgaactgcagcagttcatgaaggatcaggtcagagccgctatgacctgcatccggttctttagtcacaaggcaaagtcttacacggagctcggcgagaagctcagctggttgctgaaagctaaagatcacctgaagatttacttgcaggagacctcccgttccagtggccgaaagaaaaccactttcttccgcaagaagatgacggcagctgacgtgagtaggcatatgaatacattgcaacttcagatggaggtgacccggtttctccacagatgcgagagcgctggaacatcacagataaccaccctgccactaccaaccctcttcggtaataatcacatgaaaatggatgttgcctgtaaggttatgctgggcggtaagaacgtggaggacggctttggtatcgctttccgcgtgctgcaggacttccagttagacgcggcaatgacatactgtcgggcagccaggcagctagtcgagaaagagaaatacagcgagattcagcagctgctaaaatgcgtctcggaaagcggcatggcggctaagagtgacggcgatacgatcctcctcaactgcctcgaagcctttaagcgcattcccccacaggaattggaagggctgatacaggcgatacacaacgacgacaataaagtccgagcttacctgatctgctgcaaactgcgctctgcatatcttatcgcagttaaacaggaacactcgcgggcaactgcgcttgtgcagcaggtacaacaggctgctaagagctctggagacgctgtggtacaggatatttgcgctcagtggctgctaaccagtcatcccagaggagcccatggcccaggatctcgaaagta

SEQ ID NO: 247923 - DNA, 1119 bp, Artificial Sequence
  Description of Artificial Sequence: Synthetic coding sequence
atgcagacgtctgaacgcgaagggtcagggccagagctctcccctagtgttatgcctgaggcaccgctggagtctccgccattccccaccaagtcccccgctttcgacctgtttaacttggttttgtcgtataagagactagagatatacctggagccgctgaaagacgccggagcctggtattcagtcggcgcattgatgatctcagtccctgctttgctgggttacttgcaggaagtttgcagagctcggctacctgactctgaactgatgagacggaagtaccattccgtaaggcaagaggatctgcagagagggcgactgtctcggccagaagcagttgccgaagtaaaatcctttctgatccagctggaggctttcctgagcagactgtgctgcacctgtgaagctgcgtatcgggtgctgcactgggaaaaccctgttgtgagttcacagttttatggcgctttgctcggaaccgtgtgcatgctgtatcttctccctctatgttgggtgttaaccctgttaaactcgacgctgtttcttggaaacgttgaatttttcagagtggtgtccgagtaccgagccagtctccagcagcgtatgaatcctaagcaggaggaacacgcatttgagagcccgccacctccggacgtgggaggtaaagacggcctcatggacagcacccccgctttaactcctacagaggacttaacgccgggaagtgtggaagaagcagaagaggccgaacccgacgaagagtttaaagacgctatcgaggaggacgacgagggcgcaccttgcccggctgaagatgaattagccctccaagacaatggttttctctcaaagaatgaggtccttcggtccaaggtctcaaggctgactgagcggcttagaaagaggtaccccacgaataattttgggaattgcactggctgtagcgctacatttagcgtcctcaaaaaacgcagaagctgctccaactgcggcaattccttctgctcccggtgttgttcatttaaggtgccaaaatctagcatgggcgcaacagctccagaagctcagcgcgagactgtgtttgtttgcgcctcctgcaaccaaacgctatccaaatag

SEQ ID NO: 247924 - DNA, 1251 bp, Artificial Sequence
  Description of Artificial Sequence: Synthetic coding sequence
atgcaaacctctgagagggagggatcaggaccagaactgtctcctagcgtgatgccagaggccccactcgaatcccctcctttccccactaagagcccagctttcgacctgttcaacctggtgttgtcctacaaaagactcgagatctatctcgagcccctgaaggacgccggagacggggtgagatatttgctgaggtggcagatgccattatgctctctgttgacgtgcctcggactgaatgttctgttcctgaccctaaatgaaggtgcgtggtattcagtcggcgcacttatgatatcagtacccgcactgctgggatatcttcaagaagtttgccgggctagactgcccgactccgaattgatgcgcaggaagtaccattccgtgcgccaagaggacctgcagagaggtcggttgtcccgccctgaggctgtggccgaagtgaagtccttcctgattcagttggaagcattcctgagcaggctgtgttgtacttgtgaggccgcttatcgggtgttgcactgggaaaaccctgtggtgagctctcagttctacggggcactgcttgggaccgtgtgcatgctctatctcctcccactgtgctgggtgctgacccttctcaatagtacactgttcttgggcaacgtggaattctttcgggtggtgagcgagtatcgggcaagcttgcagcaacgaatgaaccccaaacaagaagagcacgcttttgagtctccgccaccccctgatgtgggcggtaaggatggcttgatggactctacccccgcattgacccccacagagtcgttgtcgagccaggacttgacacctggaagcgtggaggaggcagaggaagcagagcccgacgaggagttcaaagatgctattgaagagacccatctagttgttctggaggatgacgaaggtgcaccttgccccgctgaagatgagctggccctgcaggacaatggattcctgtctaaaaatgaggtactacgcagcaaagtgtctcgactgacggagcggcttcggaaaagatatccaactaacaatttcgggaattgcaccgggtgcagcgcaacatttagcgttttgaaaaagcggagaagctgcagcaactgcggaaattcattttgctccaggtgttgctcgttcaaagtgcctaagagctccatgggggcaactgctcctgaggcgcagcgggagaccgtgttcgtctgcgccagttgtaatcagacactgtctaagtag

SEQ ID NO: 247925 - DNA, 957 bp, Artificial Sequence
  Description of Artificial Sequence: Synthetic coding sequence
atgcagacttccgaaagagagggctccggcccagagttaagcccctctgtaatgcccgaggcccctctggagtcacccccatttccgacgaaaagcccagcatttgatctctttaaccttgtcttgagctacaagcgtctggaaatctatctggagcccctcaaggacgccggagatggggtaaggtatctgctttccttgattcagctggaggctttcttatccagactatgctgtacatgcgaggccgcatacagagtgctacactgggagaacccagtcgtctcctcccagttttacggagctctgctcggaacggtttgcatgctgtacctgctcccactttgttgggtgctgaccctcctgaatagcacgctgttcctgggtaatgtagaattttttcgcgtagtgtcagagtaccgagccagcctgcagcaacgcatgaatcccaagcaagaggagcacgcgttcgagtccccgccacctccggacgttgggggaaaggacggcctgatggactctacccccgctttgaccccaacggaggatcttacccccggaagcgtggaagaagctgaggaggctgagcccgacgaggagtttaaggatgcaattgaagaggatgatgaaggagctccctgcccagctgaggacgaactcgctcttcaggataacggattcctgagcaaaaacgaagtgctcaggtctaaggtaagcaggcttacagagcgtctgagaaagcggtatcccacaaacaacttcggtaactgtaccggctgcagtgccaccttcagtgttctcaagaaaagaaggagttgctctaactgcggcaattccttctgttcaaggtgttgctctttcaaagtgcccaagagtagcatgggcgctactgcccctgaagctcagcgagagacagtgtttgtgtgtgcctcctgcaaccaaacgctatccaaatag

SEQ ID NO: 247926 - DNA, 1215 bp, Artificial Sequence
  Description of Artificial Sequence: Synthetic coding sequence
atgcaaacctcagagagagagggcagtggccctgaactctccccatccgtaatgcctgaagcacccctagaatcccccccatttcccaccaagagtccagctttcgacttgttcaatcttgtcctgagttataaaagactggaaatatacctggaaccgctcaaggatgccggtgacggggtccgttacctgttgcgctggcagatgcctctctgcagtctcctgacgtgtctagggctgaatgtcttgttcctgacactgaacgagggcgcatggtactccgtcggtgctcttatgatctccgtgccagcactgctgggatatctgcaggaagtttgtagggcccgtctcccagattcggagctcatgcgcaggaagtaccactcggtcagacaggaagatctccagagaggcagactgtcacgccctgaggccgtggctgaggtgaagagctttctgatccagctagaggcattcctgagtcgactctgttgtacatgtgaggctgcgtaccgggtactgcactgggagaaccccgttgtaagttcgcaattttacggtgctctgcttggaacagtttgtatgctgtacctgctgcccctgtgctgggttctgacccttctgaatagcaccctgtttctcggaaatgtggagttttttagggtcgtatctgagtacagggcctcattacaacaacgaatgaatcccaaacaagaggagcatgcatttgaatctcctcccccacccgacgtcggagggaaggatggcctcatggacagcacccctgccctgactcccacggaagacttgacccctgggagtgtggaagaggctgaagaggctgaacccgatgaagagtttaaggacgcgatcgaagaagatgacgaaggggcaccttgcccagccgaggatgagctggcgctgcaggataacgggtttctgtctaagaacgaggtgctgaggagcaaagtttctcggcttactgaaagattgcggaagaggtaccccaccaacaattttgggaactgtacaggctgttcagccacattttccgttctgaagaagagaaggtcatgttctaattgcggcaactccttctgtagccgatgctgcagctttaaggtgcccaaaagcagtatgggggcaacagcgccagaagcccagcgagaaactgtgtttgtttgcgcttcttgcaaccaaaccctgagtaagtag

SEQ ID NO: 247927 - DNA, 936 bp, Artificial Sequence
  Description of Artificial Sequence: Synthetic coding sequence
atgatcagcgttcctgcactgttgggttatctgcaggaggtgtgtagggcaagactccctgatagtgaactcatgaggaggaaataccactcggtgaggcaggaagacctgcagcgcggtcgcctgtcccgcccagaggccgtagcggaggtgaagtcctttttgattcaattggaggcattcctgagccgattatgctgcacctgcgaagcagcgtaccgggtcctccattgggagaaccccgtggtctccagtcagttctatggtgcacttctcggcactgtttgcatgctctatctgttgcctctctgttgggtgctgaccctgctcaactccactttgttcttgggaaatgtcgaattttttcgagtggtctcagagtacagggcctccctgcagcagcggatgaacccgaagcaagaagagcacgccttcgagagtccaccaccacccgatgtgggaggaaaagatggtctgatggactctacaccggctttgacacccacggaatccttgagctcacaagatctgacgccgggatcagtggaggaggcagaagaggctgaaccggacgaggagttcaaggatgcgattgaggaggacgatgagggcgctccgtgtcctgctgaggacgaactggcactgcaagataatggcttcttaagtaagaatgaggtgttgaggtccaaggtaagccgacttactgagagattaaggaagagataccccaccaacaattttggcaattgcacaggatgctccgcaaccttctctgtcctgaagaaaagacggtcttgctcaaactgtggcaattcattctgcagtcggtgttgcagcttcaaagtgcccaaaagttccatgggagcaactgctcccgaggctcaacgggaaactgtgttcgtgtgcgctagttgtaatcagaccctttctaaatag

SEQ ID NO: 247928 - DNA, 861 bp, Artificial Sequence
  Description of Artificial Sequence: Synthetic coding sequence
atgcaaacatccgagcgggaaggaagcggccctgagctttcaccttcagtgatgccagaggcgccattagaaagtcctccgtttcctaccaaatctcccgcatttgatctattcaacctggtcctgtcctacaaacgtctggagatctacttagaacccctcaaggacgcgggagatggcgtccggtatctgctcagattttatggagccttgttgggcacagtgtgcatgctgtacctcctaccgctttgctgggttctcaccctattaaattctactctgtttttgggaaatgttgaattcttccgggtagtttcggaataccgcgcttcactgcagcagcggatgaaccctaagcaggaagaacatgcatttgagtcgccacctccccctgatgtgggtgggaaagacggtctgatggattccacccccgcattgacgcctactgaagatctgacgccaggtagtgtggaggaggctgaggaggcagaacccgacgaggagtttaaggacgctatcgaggaagatgatgagggcgcaccatgtcccgctgaggatgaactggccctgcaagacaatggtttcctgtctaaaaatgaggttctccgctctaaagtgtcaaggctcactgagcgccttaggaagagatacccaacaaataactttggcaactgcacaggatgctcagccactttctccgtactgaagaaacgcagaagttgttccaactgtgggaattccttttgtagccgctgttgcagcttcaaggtcccgaaaagcagcatgggcgctactgcacctgaggcccaacgcgaaaccgtgttcgtatgcgcctcttgtaatcagaccttgagtaaatag

SEQ ID NO: 247929 - DNA, 1236 bp, Artificial Sequence
  Description of Artificial Sequence: Synthetic coding sequence
atgcagacatccgagcgcgaggggtcaggacccgagctgtccccaagcgtaatgccagaggcaccccttgagagcccaccgttcccaacgaagtctccggcttttgatctgtttaatctggtcttgtcttataaaaggctagaaatctacttggagccattgaaggatgcaggcgacggggtgcggtaccttttaagatggcagatgcctctttgctccctgctgacttgtctggggttgaatgtgctgttcttgaccttgaatgagggtgcttggtattcggtcggggcactaatgatttctgttcccgcactgttagggtatctccaagaagtgtgccgggctcgcctgcccgactcggaactgatgcgcaggaaataccactcggtccggcaggaagacctacagcggggaagactctcccgcccagaggcggtggcggaggttaaaagcttcctgattcagcttgaggctttccttagcaggctctgctgtacgtgtgaggccgcataccgggtgctgcactgggaaaaccccgttgtgtctagtcagttctacggtgcccttctagggacggtgtgtatgctttacttactgccgctgtgctgggtgctcacactccttaacagtactctgttcctagggaacgtcgagttttttagggtggtcagcgagtaccgggcaagcctgcagcagcggatgaatcccaagcaggaggagcatgcctttgaatcacctcctcctcctgatgtcggcggtaaggacggccttatggatagcacccccgctttgactcctactgaagatcttacccccggttctgtggaggaggccgaagaggctgaacccgatgaggagtttaaagatgccattgaggagacacatctggtcgtgttggaggacgacgaaggggcaccctgtcctgctgaggacgaactagccttgcaggataatgggttcctgtcgaagaatgaggtgctgcgttccaaggtgtccaggctgacagaaagactgcgtaaacgatatccgaccaataacttcggaaattgtaccggttgcagtgcgaccttttctgtgttaaagaagagacggtcctgctcaaactgtggtaactctttctgctcaagatgttgttcttttaaggttcccaagtcaagcatgggcgcaaccgcccctgaagcccaaagggaaacagtgttcgtgtgcgcatcctgtaatcagaccctgagcaagtag

SEQ ID NO: 247930 - DNA, 1185 bp, Artificial Sequence
  Description of Artificial Sequence: Synthetic coding sequence
ttagagagcccacctttcccgaccaagtcccccgctttcgacctgtttaatctcgtgctatcatacaagcgcctggaaatctacctggagcccctgaaagatgccggagacggggtaaggtatcttctacggtggcagatgccgctgtgctccttattaacctgtcttggtctcaacgtgctgtttttaaccctgaacgagggcgcttggtatagtgtaggcgcattaatgataagcgtaccggcattgctcggataccttcaagaggtatgccgggcacggcttccggactcagagttaatgcgcaggaagtaccattctgtaagacaggaagatttgcagcggggaagattgtcccgaccagaggcagtggcagaagtgaaaagcttcctgatccagctcgaggcattcttatctcggctgtgttgtacttgtgaggctgcttaccgagtcctccactgggaaaacccggttgtgtctagccagttctacggggcattgcttggaaccgtttgtatgctgtaccttctgccactttgctgggtcttaacactacttaattcaacactattcctcgggaacgtagaatttttccgagttgtttctgaatatcgtgcatctctgcagcagcgcatgaaccctaagcaggaggagcatgcctttgagagccctccccctcccgatgttggaggcaaggatgggctgatggactcaactcctgccttaacccctacagaatccctgtcaagccaagacctgactccagggagcgtggaagaggccgaagaggccgaacccgatgaagagttcaaggatgcaatcgaagagactcacctggtggttctggaggacgacgaaggggcaccttgccccgctgaggacgaacttgccctccaggataacggctttctgagtaaaaatgaggtgctgaggagcaaagtgtctaggctgacggaaaggctgagaaagcgttatcctactaataactttggcaactgcaccggctgttcggccacattctccgtgctcaaaaagagaagatcttgctctaattgtggcaattcattttgcagtaggtgttgctctttcaaagtgcctaagagttccatgggagctacagcccctgaagctcagcgagagactgtgttcgtctgcgctagctgcaaccaaactctgtctaagtag

SEQ ID NO: 247931 - DNA, 1047 bp, Artificial Sequence
  Description of Artificial Sequence: Synthetic coding sequence
atgcagacaagtgaaagagagggaagcggcccagagctgtctcccagtgtgatgccagaagctcccctcgaatccccgccatttcccactaaatctccggcatttgacctgtttaacttggtcttaagttacaagcggctggaaatctacctcgagcccctgaaggacgccggtgacggcgtccgctacctccttcggtggcaaatgcctctttgtagcctactcacatgcctgggcttgaatgtgctgttcctgactctaaacgagggagcctggtactccgtcggagcacttatgatctctgtaccagctctgcttgggtatctgcaggaggtgtgccgagcccgacttccagactcggaattgatgcgcaggaagtaccatagcgtccggcaggaggacctccagaggggaagactctctcggcctgaagccgtggcagaggtcaagtcgtttttgatccagttagaagccttcctctcccgcctgtgttgtacatgcgaagcagcttacagagtcctgcactgggaaaaccctgtcgtgtcgtcccagttctacggggctttgctgggaacagtttgcatgttgtatttgctcccactgtgctgggttcttaccttactaaactccacattattcctgggtaacgtggaattcttcagagtggttagtgagtatcgggcttccctgcaacagagaatgaacccgaagcaggaagaacacgcttttgagagccctcctccccctgatgtgggaggtaaggacggcctgatggactctactcccgctctcacccctaccgaggatctgacgccaggctctgtcgaggaagcagaggaagctgaaccagatgaggagttcaaagacgccattgaggaagatgacgagggagctccctgccccgcagaagacgagctggccctgcaagacaacggattcctttcgaaaaacgaggtgctgcggtccaaggtgtcacgtttaaccgagcggttgcgaaaacgctatcctactaacaatttcggggtcaccggtgccggtagttcatag

SEQ ID NO: 247932 - DNA, 2664 bp, Artificial Sequence
  Description of Artificial Sequence: Synthetic coding sequence
atgatgaatagattccgaaaatggctgtataaaccaaaaagatctgacccacaactgcttgcacggttttactatgccgatgaggagctgaaccaggtggccgctgaattggactctctcgacgggagaaaggatccacagcggtgcaccctgctcgtgtcccaattccgttcatgccaggataacgtgctgaatatcatcaaccagatcatggatgaatgtattcctcaagatcgtgccccacgcgatttctgcgtgaaatttcctgaggagatacggcacgacaacctcgccggacaactgtggttcggtgcagagtgcctggctgctggctccataatcatgaatcgagaattggagtccatggccatgaggcccctggcaaaagagttaaccagaagtttggaggacgtgcgcggagccttacgggaccaggcccttagagacctgaatacgtacaccgagaagatgagggaggccttgaggcatttcgatgtgctgtttgcagaatttgaactgagctatgtgtccgccatggttcctgtgaagtccccaagagagtattacgtacagcaggaggtgatcgtgctgttctgcgaaaccgtcgagcgcgctctcgacttcgggtatttgacccaagatatgattgatgattatgagcccgcactgatgttttccatccctcgcctggccattgtctgcgggcttgtggtgtatgcagatggcccacttaatctcgatcggaaagttgaggatatgtccgagctgttccggccattccacaccttgttaaggaagataagagatctgctgcagacactcactgaggaagagctgcacacgctcgagcggaacttgtgtatctcacaggacgtggagtttcccatcagggcagacgtacagggccctgcggctctcgctcctgcactatccgccccactcccacccgaaggtccacttagcgccaaggccaaagatcccgacgctgagttggcctgctctatgcagtatgacgatcaggaactagagcagcttagccggatggtgcatagagcgggtgatgagatgagctctttgctctccccacctatagcctgtcaaagccctgcccaccgcccaggagctgaagggtcccccggaggcgaggccagccctggcagacctagactgagatcaggtagcgatgaggaggaacgggttttttttatggacgacgtggagggcacggccgaggctcttgcacgccctgagtcccccgcaggtcccttcggctgggctggttctacttgggcagacccacaggagaaaggccagggtggaccaggcggagctgctggcatcagcctgcctgcctccgagaaggaagaggacctgtctaacaataatcttgaagccgaaggcacagacggtgcctccttggctggtacaagcagttgtagctgccttgactcgcgattgcacctggacggatgggaggtaggggctgacgacgcggagaccgccgaaatgattgctcaccgcactggtggaatgaagctgagcgcaacggtcatctttaatcccaagtctcctacttcgttggattccgccgtggccacacaagaggcagcaagcgagcccgtcgccgaaggcatggacggcggacctcataaacttagtaccggtgcgaccaactgcttgcttcatagttgcgtgtgttgcggcagctgcggagattctcgagaagacgtggtcgaacgcctgagggagaagtgctcccccggaggagtgatcggcgcttcatatgcagcaggcctggccaaagcgagtgatagggccccagaaaggcaggaagaggctcctccgccttccgaagacgcgtccaacggacgtgagcccaaggctccaacatccgataagtgtctcccccataccagcggcagccaggtggacacagctagtgggttacagggagaggctggtgtggcaggccagcaggaacctgaagcgcgagagctgcatgcgggttccccatccgcccatgaggcaccccaggcgctgtctggcagttcctcctcaaccgcagggtcctgttcttccgacaagatgggtcccgaggccgcaccagccgcaactcatgcagcaccacaggcaactcgagaaaaaattagatcgagatttcatggttcgcatgaccttattcatcggcttttcgtgtgcattagcggcgttgctgatcagctacagacaaattacgctagcgatctccggtccatcttgaaaacattgtttgaggtgatggccacgaagccggaaaccgacgataaggaaaagctccgcaaggtcacccagactctgagaagcgccgctctggaggactgtgcactttgccaggagactttgagctcctctgagctggctgccaagaccagggacggcgacttcgaggaccctccagaatgggtccctgatgaggcctgcgggttctgcactgcatgcaaggcaccctttactgtcattaggcgtaaacaccactgccgcagttgcggcaagatcttttgttctcgctgctcctctcacagcgccccattgccacggtatggccaagtgaaacctgtgcgtgtatgcactcactgctatatgtttcatgtgacaccattctattccgacaaggctgggctatag

SEQ ID NO: 247933 - DNA, 2574 bp, Artificial Sequence
  Description of Artificial Sequence: Synthetic coding sequence
atgatgaatcgctttaggaagtggctgtacaagcctaaaaggtcggacccacagcttttggccaggttctactacgccgatgaggagcttaatcaggtggccgcagagctggattccttggacgggaggaaagatcctcagcgatgtaccctgctggtgtctcagttccgctcatgccaggacaacgtccttaatatcatcaatcagataatggacgagtgtatcccacaggaccgggcaccgcgagatttttgcgtcaagttccctgaagagatcagacatgacaatctggccggacagttatggttcggagccgagtgcctcgccgctggctccattattatgaatcgagagctggagtccatggctatgcggcctttggccaaagagttgactcggagcctggaagatgttcgtggagcactaagagaccaggccctccgcgaccttaacacatataccgaaaaaatgagggaggccctccgccatttcgacgtgctttttgccgagttcgagctatcttacgtatcggcaatggtcccagtcaagtcccctagggaatactacgtccagcaggaggtgattgttctcttttgtgaaacggtggaatccggcctggtggtctatgccgacggccctctcaacttggatcgtaaggtggaagacatgagcgaactgttccgtccttttcacaccctcctgcgcaagattagggatctgctgcagacactgaccgaggaggaactgcacaccctggagcgcaacttgtgtattagccaagacgtggagttcccgattagggccgacgtgcaggggcctgccgctcttgcccctgcccttagcgcgcctctgcctcctgagggaccactgtccgctaaggctaaggacccggacgctgagctcgcctgctctatgcagtatgacgaccaagagctggagcagttgagtcgtatggttcatcgtgccggtgatgagatgtcttctctccttagcccaccaatagcatgccagagtcccgctcataggcctggggcagagggtagccctggaggtgaagctagccccggaagaccccgtctaaggtccggctcagacgaggaggagcgagtcttcttcatggatgatgtggaggggacggccgaggcactggccagaccagaatctccagccggaccttttggttgggccggttcaacttgggctgatccacaggagaagggtcaggggggacccggtggcgctgcaggcatcagcctccccgctagcgaaaaggaggaggatctgtcgaataacaacctagaggccgagggcaccgatggcgctagccttgccggaacgtccagctgttcatgcctagactccagattgcacttagacgggtgggaagtgggggctgacgacgccgaaaccgcagagatgatcgctcacagaacagggggtatgaagctcagtgctacagtgatcttcaacccaaaatccccaacttccctggactccgccgtggcaactcaagaggctgcctccgagcccgttgcggaaggcatggatggtggtccacataagctgtctactggagcaacaaactgtctgctccattcctgcgtgtgttgtggtagttgtggggacagtagagaggatgtagtggagaggctgcgggagaagtgttcaccgggaggggtcattggggcatcctacgccgcaggactggccaaagcatccgaccgcgcaccagaacgacaggaggaggcaccccctccttccgaggacgcctccaacggacgagaaccaaaggctccaaccagcgataagtgcctgccacatacatctggcagtcaggtagatacagcctccgggctacagggcgaagcaggtgtcgctgggcaacaggaaccggaggccagagagctacatgcaggtagcccaagtgcgcatgaagcaccacaggctctgagcgggtccagctcttccactgccggttcatgctcaagcgataagatgggacccgaggcagctcccgcagcgacacatgcagccccacaggcaacaagagaaaaaattagatccagatttcatggatcacatgatcttatccaccgtctctttgtgtgcatcagcggcgtggccgaccagctccaaactaactacgcttcagacctccgttctattctgaagacactctttgaggtaatggccacgaagccagaaacggatgataaagagaaactgcgcaaggtcacacaaactcttaggtccgctgctcttgaagactgcgcactgtgccaggagaccctatcgagcagcgagttagccgctaaaacacgggacggcgatttcgaggacccgccagaatgggtgcccgacgaagcgtgcggattttgcaccgcgtgcaaggccccattcactgtgatacgcagaaaacaccattgccggtcttgtgggaaaatcttttgctcccgttgttcaagccattccgctccattgcctagatacgggcaggttaagcccgtgagagtctgcactcattgctacatgttccatgttacacctttttacagcgacaaggccggtctctag

SEQ ID NO: 247934 - DNA, 2454 bp, Artificial Sequence
  Description of Artificial Sequence: Synthetic coding sequence
atggacgagtgcatcccccaggatagggcgcctcgcgacttctgcgtgaaattccctgaagagataagacatgataacctggctgggcagctgtggttcggggctgagtgtctggccgctggttccattatcatgaaccgtgaactggagagtatggctatgcgcccactggcgaaggagctcactcgcagtctagaagacgtacgtggcgcattgcgtgatcaagcccttcgcgatctgaatacttacactgagaagatgagagaagcactgcggcatttcgatgtgctgtttgccgaatttgaattgagctacgtaagcgctatggtccctgtaaaatccccaagagagtattatgttcagcaggaagttattgtcttattctgtgaaaccgtggagagagctttagactttggttacctgactcaagacatgatcgacgattatgagcccgctctgatgttttcaattcctcgtctcgccattgtgtgcgggctggtggtgtacgccgacgggcctttgaacctggaccgcaaggtagaggacatgagtgaactgttccgtcctttccatacactgctcagaaagattcgtgatttactgcagacccttactgaagaagaactgcatacattggagaggaatctgtgcatctctcaagatgttgagttccccataagggcagatgtacaggggccagctgcactagcgcctgcactgtccgcaccgctgccacctgaaggccctctctcagccaaggccaaggacccagacgccgagctcgcttgcagtatgcaatatgatgatcaagagttggagcagctgagtcgtatggtccacagagctggagacgaaatgtcttccctgttatcaccgccaattgcttgtcagagccccgctcacaggcccggtgctgagggatcacctggcggagaagcaagccccggtcgaccgcgattgcggagtggatcagatgaagaggagagggtctttttcatggatgacgtcgagggaaccgccgaagccctcgcccgacctgaatctcctgccggtccatttggttgggctggctccacgtgggcagatcctcaggaaaaaggtcagggaggaccaggaggcgcagccggtatttctctgcccgcttcagagaaggaagaagatctgagcaataacaacctggaagcagaagggacagacggggcaagcctggctggtaccagttcctgttcatgtctcgattctagactccacctggacggctgggaagttggggctgacgatgctgaaacagctgaaatgatcgctcatcgaaccgggggaatgaaactctcagcaaccgtcatatttaaccccaagagtcctacgagcctcgacagcgccgtggcaacgcaagaggctgcgtccgaacctgtcgccgaggggatggatgggggtccccataaactcagtaccggcgcaactaattgtctactccactcatgtgtgtgttgcgggtcttgtggcgacagcagagaggacgtcgtcgagcgtttgagagagaagtgctcccctgggggagtgatcggagcttcatacgccgcaggactggcaaaggcgtccgatagagcccctgaacggcaagaagaggctcccccaccgagtgaggatgccagcaatggaagagagcctaaggctcctactagcgacaaatgtttaccccatacctccggctcgcaggttgataccgcgtccggactgcagggagaagcaggggtggcaggccagcaggaacccgaagccagggaactccacgcgggttcacccagcgctcacgaagcccctcaggccctgtccggtagcagcagcagtaccgcgggaagctgttctagcgataagatggggcctgaggcggcacctgccgcaactcatgcggctccacaggctactcgggagaagatccgatcacgattccacgggtcccacgacttaattcacaggctgttcgtttgcatttcaggcgtggccgaccagttacagactaattacgcgtcggatttgaggtcaatccttaagaccctgtttgaggtcatggcgaccaagcctgagacagatgacaaggaaaaactacgcaaggtgacccagacactaagaagtgctgcattagaggactgtgccctgtgtcaggaaactctctcttctagcgaacttgcagccaaaacacgagatggagatttcgaggacccccctgagtgggttcccgacgaggcttgtggattttgtacggcgtgcaaggctccttttacagtcatccgcaggaagcaccattgcaggagttgtggcaaaatcttctgcagccgttgcagtagccactccgcccctctcccccgatatgggcaggtgaagcccgtccgggtctgtacccactgttacatgtttcacgtcacccccttctattccgataaggcgggtctatag

SEQ ID NO: 247935 - DNA, 1212 bp, Artificial Sequence
  Description of Artificial Sequence: Synthetic coding sequence
atggaacctgcagggccttgtgggttctgtccagctggtgaggtgcaaccggctcggtacacatgcccacgctgtaatgcgccttactgttcactccgctgctacagaacacacggcacctgcgccgagaatttctacagagatcaggtgctaggcgagttgcggggttgctctgcccctcccagcaggttggcttctgcgctgaggagacttaggcaacagagagaaactgaggacgagcctggcgaggctggcctgagtagcggcccagctccgggtggcctgtcgggtctatgggaaagactggctcctggtgagaaagcggcttttgagagactgcttagcagaggggaagccggtagactgctaccaccatggaggccctggtggtggaaccgcggagctggcccacagcttctcgaggaattggataatgctccaggatctgatgcagcagaactggagctcgcccctgcaaggacccctcccgactccgtgaaagacgcctccgccgctgagcccgcagctgccgaaagggtccttggcgacgttccgggtgcttgcacacctgtggtgcctacccgtattccagctatagtgagcctgagcaggggcccagtttcgccgttagtacgctttcagctgcctaacgtcctatttgcctatgcccatacactggcactctaccatggaggggacgacgcgttactaagtgatttttgcgctacacttctgggtgtttctggggcactgggcgctcagcaggtgtttgcatctgccgaggaagcattacaggctgccgctcacgtccttgaggcaggtgagcacccaccagggcctctgggaacacggggagctatgcacgaggtggcgaggatcctgctcggcgaaggccctacaaaccagaagggttataccttggcggcacttggtgatctggcacagacactcggcagggcccgaaagcaggccgttgcccgagaggagcgggatcacctatatcgagccagaaaaaaatgccagttcctgctcgcgtggacaaatgagaatgaggccgctctcacgcctctggccctggattgcgctagagcccatcaggctcacgccgtggttgcggaggaagttgcagcactcactggcgaactggagcgcctgtgggggggaccggtgccaccagcccctagaactttaatagaagaactgccctcatag

SEQ ID NO: 247936 - DNA, 1683 bp, Artificial Sequence
  Description of Artificial Sequence: Synthetic coding sequence
atggcaggtccacagcctttggccttgcagttggagcaacttctcaatcctcgtccctccgaggcagatcccgaggcagacccagaagaggccaccgctgctagggtcatcgacaggttcgacgaaggtgaggacggcgagggcgactttttagttgtgggctctatcagaaagctggccagcgcctcactcctcgacacagataagcggtattgtggaaaaactacatctaggaaggcctggaatgaagatcactgggagcagaccctacctggatcttctgatgaagagatatccgatgaagagggaagtggagatgaggatagcgaaggacttggcctggaggagtatgatgaggacgacctaggcgctgctgaggaacaagagtgtggggaccacagagagtccaagaaatcccgatcacattcagcgaagaccccaggtttctctgtgcagagtatttccgactttgagaagttcactaagggcatggacgatctggggagttccgaagaggaggaggatgaagaatctggtatggaggaaggcgacgatgcagaggattctcagggagagagcgaggaagatagagcaggtgaccgaaactcggaggatgatggcgtggtcatgacattttccagcgttaaggtcagcgaagaggtggagaaaggaagggccgtcaaaaaccagattgccttgtgggatcagctgcttgaagggagaataaagctgcagaaagccctcctcaccactaaccagttaccacagcccgatgtgttccctttgttcaaggacaaagggggaccagagttctcttccgccctgaagaatagtcataaagcccttaaagcactattgcgtagcttggttgggctccaggaggaactgttgttccagtaccctgacactcgttacttagtagatggaacgaaacccaatgctggcagtgaggaaataagttctgaggatgacgagctcgtggaagagaaaaaacagcagcgcagacgggtgcccgctaaaaggaaattggaaatggaagattacccgtcatttatggccaagcggtttgctgatttcacggtctaccggaacaggacactccagaagtggcatgataaaaccaaactcgctagcggaaaactgggaaaaggattcggagccttcgaacggtccatactgactcagattgaccatattctgatggataaagagcgtcttctgcgcagaacccaaactaagaggagcgtctatcgtgtgctgggaaagcctgagcccgcagcacagcccgttcctgaaagtttacccggagagcccgaaattttgccccaggccccagctaatgcgcatctgaaggacttagatgaagagatatttgatgatgacgatttttaccatcagctcttgcgtgagttgatcgagcggaagacttctagcctggatcctaatgatcaagtggccatggggcgacaatggctggcgattcagaaactgcgttccaagattcacaaaaaagtagaccgaaaggcctctaagggcaggaagctccgctttcacgtgctgtccaaattgttgtcgttcatggccccaatcgaccacacgactatgaatgacgatgccaggacagaattatatagaagtctgttcgggcagctgcacccgcctgacgagggtcatggcgactag

SEQ ID NO: 247937 - DNA, 4134 bp, Artificial Sequence
  Description of Artificial Sequence: Synthetic coding sequence
atggatacatccagcgtcgggggactagaactgactgatcagacgccagtactcctgggcagtactgcaatggcaacaagcctcacgaacgtgggcaactcattcagtgggccagccaatccattggtgtcacggtctaataagttccagaattcatcagtagaagacgatgatgacgtagtcttcatcgagcctgtgcagccccctcccccatccgtccctgtggtggcagatcagcgcacaataaccttcacttctagtaagaatgaagagctgcaaggtaatgactccaagataacgccttcgagcaaggagttagcttcccagaaaggaagcgtgtccgagaccatagtgatcgacgatgaggaggacatggagaccaatcagggtcaggagaaaaatagcagtaacttcatcgagaggcgccctcctgaaaccaagaacaggacgaacgacgttgacttcagcaccagcagtttcagcagatcgaaagtgaatgcaggcatgggaaattccggcatcactaccgagcccgattctgaaatacaaattgcaaacgttaccacacttgagacaggagtctcatctgtgaatgatggccagctcgagaatacagacggcagagatatgaatctgatgattacgcacgtcactagcctgcagaatacaaatctaggcgacgtctcgaatggactgcagtctagcaattttggcgtcaacattcagacctacactccctcactcacctcccaaactaagacaggtgttggaccctttaaccctggccgtatgaatgtggctggcgacgtctttcagaatggtgagtcggccacccaccacaatccagactcatggatttcccagtccgcttctttccctcgcaaccagaagcaacctggagtggactccctgtctccagtagcgagtttacctaagcagatcttccagccatccgtgcaacagcagcccactaagcccgtcaaagtgacctgcgctaattgcaagaaacctctgcagaaaggccagaccgcataccagcgcaagggctcagcccacttgttctgtagtaccacatgcctgagctctttcagccacaagcctgctcctaagaagttatgcgtgatgtgtaaaaaggacatcacaacaatgaagggtaccatcgtggcacaggtagatagtagtgaatcttttcaggagttttgctccactagctgcctttctctgtatgaggacaaacagaatcccaccaagggcgctttgaataagtcacgctgcaccatctgtgggaaactgacagaaatacgacatgaggtgagcttcaagaacatgacacataaattatgtagtgaccactgcttcaatcggtacagaatggctaatgggttgatcatgaattgttgtgaacagtgcggggaatatttgcccagtaagggcgcagggaacaatgtcttggtgattgatggccaacagaaacgcttctgttgccaatcgtgcgtgagcgagtataagcaggtcggatcccacccttccttccttaaggaagtgagggatcacatgcaggactcttttcttatgcagcctgaaaagtatgggaaactcactacctgtaccggttgcagaacacagtgccgtttctttgatatgactcagtgcatcggcccaaacggatacatggagccctactgttcaacggcctgtatgaattctcacaaaacaaagtatgctaaaagtcagagtctgggcataatctgccacttctgcaagcgtaactctttaccccagtatcaggccaccatgcccgatgggaagctgtacaacttctgtaactctagctgcgtcgctaagttccaagctttgtcaatgcagtcttctcctaatggccaatttgttgcaccttccgacattcaattgaagtgtaactactgtaagaactccttttgttctaaacccgagattctggaatgggagaacaaagtgcaccagttttgctccaaaacatgcagtgatgattataagaaattacattgtatcgtgacttactgcgagtactgtcaggaggaaaagacactgcatgaaaccgttaacttcagcggagtcaagcgcccattttgtagcgaagggtgcaaactgctatataaacaggattttgcacgacgtttaggcttgaggtgcgtgacgtgcaattactgttcgcagctgtgtaagaagggcgcaaccaaggaattagatggggtcgttcgcgatttttgtagcgaggactgctgtaagaagttccaggactggtactataaggcggctagatgcgactgttgtaagagtcaggggaccctgaaagagcgcgtgcaatggaggggcgagatgaaacatttttgtgatcagcattgcctccttaggttctattgccagcagaacgagcctaatatgaccacccaaaagggtcctgagaacctccactacgaccagggctgtcagacctcccgcacaaagatgacggggtccgctcctccacctagccccacccctaataaagaaatgaaaaacaaagccgtattatgtaagccgctcacaatgactaaggcgacctactgcaaacctcacatgcaaaccaaatcctgtcagactgacgacacttggcggacagagtacgtgccagtgccaatccctgtaccagtgtatatccccgtaccaatgcatatgtattctcagaacatcccggtgcccactacagtgcctgtgcctgtgccagtgcctgtgtttctgccagctcctctggatagctcagaaaagatcccagcagcaatcgaagaactgaaatccaaggtgagctccgatgctctcgacactgagctgctgaccatgaccgatatgatgagcgaggatgaaggtaagaccgagaccaccaacatcaattccgtgataatcgagacagacatcatcgggtccgacctactcaagaactctgaccccgagactcagtctagtatgcctgatgtgccctacgagcctgatctcgatatcgagattgattttcctcgggcagcggaggagctcgatatggaaaacgagttcttgctcccccctgtatttggtgaagaatatgaagagcaacctcggcctcgctccaagaaaaaaggcgctaagaggaaggcagtaagcgggtatcagagccacgacgatagttccgataattcagagtgctcatttccttttaaatacacatacggggttaatgcttggaaacattgggtgaaaaccagacagctggatgaagacctgctggtgctggacgaactcaagagctccaaaagtgttaaactcaaggaggatctgctcagtcacaccacggcggaactgaactatgggctggcccattttgtgaacgagattcggcgtcctaatggtgagaattacgctcccgattctatctattacctctgtctcggcatccaggaatatttgtgtgggagtaatcgaaaagacaatatcttcatcgatcccggatatcagacattcgagcaggaactgaacaaaattttacgctcatggcagccaagtattctgccagacggaagcatcttcagccgcgtggaagaggattacctgtggagaattaagcagctgggatcccattcaccagtggccctcctgaataccctcttctactttaacaccaaatacttcggcctaaagaccgtggaacaacatctgcgcttatcgttcgggaccgtgttcaggcattggaagaagaatccactcacgatggaaaataaggcctgtcttcggtaccaggtcagctcactttgtgggacggataatgaggataaaataaccacaggaaagagaaaacacgaggatgacgagcctgtttttgagcagattgagaacacagccaatccctcaaggtgccctgttaagatgtttgagtgctatctgtccaaatctccccagaacttaaatcagagaatggatgtgttttacttacaacccgagtgtagcagtagtaccgatagtccagtgtggtacacttccacctccctcgataggaatactctcgaaaatatgctggtccgagtcttgctagttaaagatatctacgacaaagataactacgagctcgatgaagatacggattag

SEQ ID NO: 247938 - DNA, 4128 bp, Artificial Sequence
  Description of Artificial Sequence: Synthetic coding sequence
atggatacctccagcgtcggagggctggaactcacggatcagacgccggtgctcctaggatctactgcaatggccacaagcctgactaacgtggggaatagcttctctggcccagccaatcccctggtgtccagatccaataaattccaaaactcatcagttgaggatgatgatgatgtggtgtttatagagcctgttcaacctccgccaccttccgtacccgtagtggccgaccaacggaccatcacctttactagcagtaaaaacgaggaattacaaggaaatgacagtaaaatcaccccttctagcaaggaactcgccagccagaagggaagtgtcagtgagacaatcgtcatcgatgacgaggaagacatggagaccaaccaagggcaggagaaaaattcaagtaactttattgaacgcagacctcccgaaactaaaaaccggactaacgatgttgactttagcacatcttctttttccagatcgaaagttaatgctggaatgggaaattcaggtattacaactgaacccgatagcgagattcagattgctaacgtcaccacgctcgagacaggtgtgtccagcgtcaatgatggccagctggaaaatactgatggacgagacatgaatttaatgattactcacgtgacaagcctgcaaaacaccaatctgggtgacgtgtctaatggccttcagagcagtaattttggcgtgaatatacagacttacacaccctcacttacatcacagacgaagaccggggttggccctttcaaccccggaagaatgaatgtggctggtgacgtattccaaaatggtgagtccgctacccaccataaccccgactcctggatcagccagtctgcctcatttcccagaaatcagaaacagccaggagttgacagtctttctcctgtcgcgagcctacccaaacagatctttcagcccagtgtacaacagcaacccacaaagcctgttaaggtcacctgtgctaactgtaagaaacccctgcagaaaggtcagacagcctaccagcgtaaaggtagtgcacatctcttttgctctacaacttgcctatcctcattcagtcacaaacccgctcctaagaagttatgtgtaatgtgcaagaaagacatcactacgatgaaaggcacaatagttgcccaggtagactcctccgagtctttccaggagttctgcagtacgagttgcctgtcactgtatgaggataaacaaaaccctaccaagggggcattgaataaatctagatgcaccatctgtggcaagctgacagagattcgccacgaagtctcttttaaaaacatgactcacaagctttgcagtgaccattgcttcaatagatatagaatggcaaacggtctaattatgaactgttgcgagcaatgtggggagtaccttccctccaagggcgcagggaacaacgtactcgtgattgacggacagcaaaaacgcttttgctgccaatcctgcgtgtcagagtataagcaggtcggcagtcacccctcctttctgaaggaggtgagagaccacatgcaggactcgttccttatgcaaccagaaaagtacggcaagctcactacatgcaccgggtgtagaacccagtgcagatttttcgatatgacacaatgtatcggtccaaatggctacatggaaccatactgctccacagcttgtatgaattctcacaaaacaaaatacgcaaagtcgcagtcactgggcatcatttgtcatttctgcaaacggaattccctaccccagtatcaggctacgatgccagatgggaaactttataatttctgcaatagcagttgcgtggccaagtttcaggccttgagcatgcagagctccccaaacggtcagttcgtggccccttctgatatccagctgaaatgtaattactgcaagaatagtttttgcagcaaaccggagattctggagtgggaagcttccttacatcaattctgcagtaagacgtgctcggacgattacaagaaactccattgcattgttacttactgtgaatattgccaggaggagaaaacgctccacgagactgtcaacttttccggagttaaacgaccattctgctccgaaggctgcaagctgctctacaagcaggattttgctagaagactgggtcttcgttgtgttacttgtaattattgcagccagttatgcaaaaagggcgctactaaggaactggatggcgtagtaagggatttctgcagcgaggactgttgtaagaagtttcaggactggtactataaagcttgcgactgttgtaagagtcagggcacactgaaggagcgagttcaatggcgcggagaaatgaaacacttttgcgaccagcattgcctgctaagattctactgtcagcaaaatgaaccaaacatgacaactcagaagggacccgagaaccttcactacgatcagggctgtcaaacaagccgaaccaagatgacgggtagcgcgcctcccccttctccgacgccgaacaaggagatgaagaacaaggcggtgctgtgtaaaccgctgacaatgaccaaggccacatactgcaaaccacacatgcagacaaaatcctgccaaacagacgacacctggaggacagaatacgtcccagtaccgatcccagtgccagtttacattccagtacctatgcatatgtatagtcagaacatcccagtgcccacaacagtgcctgtcccagtgcccgttcctgtgttcctgcctgcccctctggacagttctgagaagatacccgcagccatcgaagaactcaagtctaaagtcagctctgacgcactcgacacagagttgctcacaatgaccgatatgatgtccgaggacgaaggaaaaactgaaactacgaacataaactcagtgattatcgagaccgatataatcggaagtgacctcttaaaaaattctgatcctgaaactcagagctcaatgcctgatgtgccctacgaacctgatcttgacatagagatagacttcccacgtgcagcagaggaattagacatggagaacgaatttcttttgccccctgtattcggagaggagtacgaagaacagccgcgtcccaggtcaaaaaaaaagggagcaaagagaaaagccgtgtcgggctaccagtcacacgatgactccagcgataattctgaatgcagctttccattcaaatacacatacggcgtaaacgcctggaaacattgggtgaaaacgaggcagctggatgaagacctattggtgctcgatgagctgaagagttcaaagagcgttaaactcaaggaggatctgctcagccacacaacggccgagttaaattacgggttggctcattttgtcaatgagattaggcgaccaaatggcgaaaactatgcacccgattcgatttactatctgtgtctggggattcaggaatacctgtgcggaagtaacagaaaggataatatttttatcgacccaggctaccagaccttcgaacaagaactgaacaaaatcctaagaagctggcaaccgagtatcctgcctgacggctccatcttcagccgagtggaggaagattatctctggcgtatcaagcagttagggtcccacagtcctgtggccctcttgaacaccctgttttacttcaacacaaagtactttgggttaaaaaccgttgaacagcacctccgcctctcctttggcactgtgtttaggcactggaagaagaacccactgactatggagaacaaagcctgcttgagatatcaagtgtcaagtctctgcggaactgacaacgaggacaagataaccaccggtaaaaggaaacacgaggatgatgagcccgttttcgagcagatagaaaacactgccaatccctccagatgccctgtcaagatgttcgagtgctacctctccaagtcccctcagaatttgaaccagaggatggatgtgttttacttgcagcccgaatgctcgtctagtacagattctccggtgtggtacaccagtaccagcttggaccgcaacactctggaaaacatgcttgttcgggtattgctggtgaaagacatttacgacaaagataactacgagctcgatgaagataccgactag

SEQ ID NO: 247939 - DNA, 4128 bp, Artificial Sequence
  Description of Artificial Sequence: Synthetic coding sequence
atggacacgtcttctgtcgggggactcgagctcacagatcagacaccagtattgcttggcagtaccgcgatggctacctctctgaccaacgtcggcaattcctttagcggtcccgcaaatcctctggtgagcagatcaaataagttccagaactcatccgttgaggatgatgacgacgttgtgttcatcgaacccgtccagccacctcctcctagcgttcccgtggtcgcagaccagagaacaattacttttactagttccaagaatgaggagctgcagggcaacgacagcaagattactccttccagcaaggagcttgcgtcccagaaagggagtgtgtccgagactattgtgatcgacgatgaggaggatatggagacaaaccaagggcaggagaaaaacagctccaatttcatcgagcgcaggccacctgagacaaagaacagaaccaatgatgttgactttagtacctcttcattctcgagaagcaaagttaacgccggaatggggaattcagggatcaccacagaaccagactccgagatccagatcgctaatgtcaccacgctggaaactggtgtttcttccgtaaacgacggccaactggaaaatacagatggcagggatatgaatcttatgattactcacgtaacgtcgctacagaataccaacttgggcgatgtaagcaacggtctgcagtctagtaactttggggtaaacattcagacctatacacctagcctaacatcacagaccaagaccggtgtgggcccttttaatcccggacggatgaacgtggccggagatgtttttcagaatggtgagagtgcaacgcaccacaatccagatagctggatttcacaatcagcgtcttttccacgtaatcaaaagcagcccggtgtggatagcttgagccctgtggctagtttgccgaagcagatcttccagccttcagtgcagcagcagccaaccaagccagtgaaggtgacttgcgctaattgtaagaaaccactccagaaaggacagacagcctatcagaggaaaggctccgctcacctattctgctccaccacgtgtttatcctcattctcccacaaacctgcgcctaagaagctgtgtgtgatgtgcaaaaaggatatcacaactatgaaagggacaatcgtggcccaggtcgatagctccgaaagctttcaggaattttgctctacgagctgtctctccctctacgaagacaaacagaatcctaccaagggcgcactgaataagtctagatgtacaatttgcggcaaacttactgaaatccgccatgaagtgagttttaagaatatgactcacaaactgtgttctgatcactgcttcaaccggtacagaatggcaaatggtctgattatgaactgctgcgagcagtgcggcgaatatttaccaagcaagggcgctgggaataacgtgcttgtgatagatggccagcagaagaggttttgctgccagtcctgcgtgtcggagtacaaacaggtgggctcgcacccttcgttcctgaaggaggtgcgcgaccatatgcaggatagcttcctcatgcagcctgaaaagtatgggaagctgaccacatgcacggggtgccggacacagtgcagattttttgatatgacgcagtgcatcggccctaacggttacatggagccatattgttccacagcttgcatgaattcccataagacgaaatacgctaagtcacagagcttagggatcatctgccatttttgtaagagaaattccctgccgcagtatcaagccaccatgcccgacggtaagctctataacttttgcaactcctcttgcgtggctaagtttcaggcattgtccatgcaatcttcacccaacggccagttcgttgctcctagtgacattcagctcaagtgtaactactgcaagaacagtttttgctccaaacccgaaatccttgagtgggaagccagtttgcaccagttctgtagtaaaacatgtagcgacgattacaaaaagttgcattgcattgtcacgtattgcgaatattgccaggaggaaaagacactgcacgagaccgtcaacttctccggggtgaaacgcccattttgctctgaggggtgcaagctgttgtacaagcaggattttgctcgccgattgggactgcgttgtgttacatgtaattactgctcccagttatgcaagaaaggggcaacgaaagagctggacggcgtggtgagggacttctgcagtgaggactgctgtaagaaatttcaggattggtattacaaggcttgcgattgttgcaagtcccaggggacactgaaagagcgcgttcagtggagaggtgaaatgaagcacttctgcgaccagcactgcctgctacgcttctactgccaacaaaacgagccaaacatgacaacacaaaaaggtccagagaatctccactacgatcagggctgccagacctctagaacaaaaatgaccgggtctgctccccctcccagcccaacacctaataaggagatgaagaataaggccgtgctgtgcaaaccattgaccatgaccaaggccacttactgtaaaccccacatgcagacaaaatcctgtcagactgacgacacttggagaactgaatatgtgcccgttccaatcccggtgcccgtctatatcccagtgcctatgcatatgtatagtcaaaacattccagtgcctactacagttcccgtccccgtgcccgtacctgtcttcctgccagcacctctcgatagttccgagaagattcccgctgctatcgaggaattgaaatccaaggtgagctccgacgctttggataccgagcttctgaccatgactgacatgatgtcggaggatgagggaaagacagaaaccaccaatattaacagcgtgatcatagaaactgatataatcggctccgatcttctgaaaaactcggaccccgaaacccagtcatccatgccggacgttccatacgagccagatcttgatatagagatcgattttcctagggcggctgaggaactggatatggaaaacgaattcctcttgcctccagtgttcggcgaggaatacgaggagcagcccaggccgagatcgaagaagaagggcgctaaacggaaggcagtcagcgggtaccagtcccacgacgactcttcagacaatagtgagtgtagtttcccattcaaatacacctacggcgtgaatgcctggaagcactgggtcaaaactagacagttggacgaggacttgcttgttttggatgagctgaaatcctccaagtctgtgaaactcaaagaggatctgctgagtcacactacggcggagctgaactacggcctcgcgcactttgttaatgaaatccggcgaccaaacggcgagaattatgcgccagattcgatctactacctgtgtttgggaatccaagaatacttgtgtggtagcaaccgaaaagacaacatcttcatagacccaggctatcagacattcgaacaggagttgaacaaaatactccgttcctggcagccctccatcctacccgatggcagcatattttcgcgtgtggaagaagattatctgtggcggattaaacagctggggtctcattcaccggtcgctctgctgaacacgctgttttactttaacactaaatacttcggcctaaagacagtggagcagcacctccgtctgagtttcggcacagtgtttaggcactggaagaaaaatcccctgaccatggaaaataaggcctgcctgcgttatcaggtgtcctccctgtgtggtaccgataacgaggataagatcactactggcaagcggaagcatgaggacgacgagcccgtgtttgagcagatcgagaataccgccaaccccagtagatgcccagtgaagatgtttgaatgctacctctctaagagccctcagaacctcaaccagcggatggacgtcttttatctgcagcctgaatgtagcagttccaccgactctcctgtttggtatacctcaacctcgctggatagaaacaccctggaaaatatgctcgttagggtgctactcgtcaaggacatctacgacaaggacaactatgagcttgacgaggacacggattag

SEQ ID NO: 247940 - DNA, 1134 bp, Artificial Sequence
  Description of Artificial Sequence: Synthetic coding sequence
atgcaggatagtttcctaatgcagccagaaaaatacggaaaattgacaacatgcaccggttgcaggactcaatgccgttttttcgatatgacacaatgcattgggcctaacggctatatggaaccctactgttctactgcctgcatgaacagccataaaaccaaatacgccaagtcccagtctctgggtattatctgccacttctgtaagcggaattctcttcctcagtaccaggccacgatgcccgacggtaagctctacaatttttgtaatagttcctgcgttgccaaattccaggccctgtcaatgcagtcttccccaaacggccaattcgtcgctccctcggatatccagttaaagtgcaattattgtaagaactccttctgctccaagccagagatccttgaatgggagaacaaggtccaccaattttgctcaaagacatgtagtgatgactataaaaaactgcactgtatagtaacatactgtgaatactgtcaggaagaaaaaactctgcacgaaactgtgaatttctccggtgttaagcgcccattctgtagcgagggctgcaaactcctgtacaaacaggatttcgccaggaggcttgggttgagatgcgtgacctgtaactactgctcccagctctgcaaaaaaggagcaaccaaggagctcgatggtgtggtccgtgatttttgttccgaggattgctgtaagaaattccaggattggtattacaaggccgcacgatgtgactgctgtaaatcccagggtactctcaaagagagggtacagtggcgtggcgaaatgaagcacttctgtgatcaacactgtctgctccgattctactgtcagcagaatgagccgaatatgacaacccaaaagggcccagaaaatctgcattatgaccaggggtgtcagacaagcagaactaaaatgaccggaagcgcaccacctccatccccaacccctaacaaggaaatgaagaacaaggccgtgctgtgtaaaccccttacaatgacgaaggctacctactgtaagcctcatatgcaaacgaagtcttgccagacagatataacatggagaatccagcatctgatcttgaaccattacgaccagagcctgatcaaagcgtag

SEQ ID NO: 247941 - DNA, 4134 bp, Artificial Sequence
  Description of Artificial Sequence: Synthetic coding sequence
atggatacatcctctgtaggcggtttggagctgaccgatcagacaccagtgctgcttggttcgacagcgatggctactagtctcactaatgttgggaactccttctcaggtccagctaacccgttagtctcccggagcaataagtttcagaacagctccgtggaggatgacgacgacgtggttttcattgagcccgtgcagccaccccctccatccgtacccgtggttgcggaccagcggacaatcacatttacatcctccaaaaatgaagaattacaaggaaatgactctaagattactcccagttcaaaggagctggcaagccaaaagggctcggtgtccgaaaccattgtcatcgacgacgaggaagacatggaaacgaatcagggtcaggagaaaaattcttccaattttatcgagaggcgtcctccagagactaagaatcgcaccaacgacgtggatttcagtaccagcagcttctcccgttcgaaggtgaatgccggaatgggcaacagcgggatcacgacagaaccagacagcgaaatccaaatcgcaaacgttaccaccctcgagacaggcgtgtcttctgtcaacgatggtcagctggaaaataccgacggccgagacatgaatctgatgattacacatgttacgtctctgcagaatacgaaccttggagacgtatcaaacggtctacagtcgtccaattttggagttaatatacagacttatacaccttctcttacctcacagactaagaccggagttggtccgtttaatcctggccgtatgaacgtggctggcgacgtatttcagaatggcgagtcagccacccatcataaccccgacagctggatctcccagagcgcttcgtttccaagaaaccagaaacagcctggtgtggacagcttgtccccagtcgcctctctcccaaagcagattttccaaccctcagttcagcagcagcctacaaaacctgtaaaggtgacgtgtgcgaattgcaagaaacccctacagaagggtcagacagcgtatcagaggaagggatctgcccatctgttttgctcgaccacttgcctgtctagcttctctcacaagcctgctcctaagaaactctgcgttatgtgtaagaaggacatcacgacaatgaaggggactattgtggcgcaagtggatagtagtgagagttttcaggagttctgctctacatcctgcctgtcattgtacgaggataaacagaatcctactaagggcgctctgaacaagtcccgctgcactatttgtgggaaactgaccgagatccggcatgaggtcagcttcaagaatatgacccacaagctgtgctcagaccattgttttaaccgttatcggatggcaaacgggctgattatgaactgctgcgagcaatgtggcgaataccttccctctaaaggagcgggtaacaacgtgctcgtgattgacgggcagcagaagcgattctgctgccagtcatgtgtgtcagagtacaaacaagtggggtctcatccatccttccttaaagaagtaagggatcatatgcaagattcttttctgatgcaacccgagaaatacggtaagttgactacatgtactggctgcagaacccagtgccgcttctttgacatgacccagtgtatcggcccaaacggatacatggaaccctattgctctacagcgtgcatgaattcacacaagaccaaatacgcaaaaagccaatccctgggaataatttgtcacttttgcaagcggaactccctcccccagtaccaagctacaatgccagatggcaagctctataatttttgcaattcttcttgtgtggccaaatttcaggctctgtctatgcagagctctccaaatggtcagttcgttgccccatctgacattcagctgaaatgtaattactgtaagaatagtttttgtagcaagccggaaatattggagtgggaaaataaggttcaccagttctgttccaagacctgcagcgacgattacaaaaagctccactgcatcgtgacctactgtgagtattgtcaggaagagaagacgttgcacgaaacagtgaatttcagtggagtgaagagaccattctgtagcgagggctgtaaacttctgtataagcaggatttcgccagacgcctgggcttgagatgtgtgacatgcaattattgctcccaactgtgcaagaagggcgcaactaaagaactcgatggagtcgtacgcgacttctgttctgaagattgttgcaaaaagtttcaagactggtattataaagcggctaggtgcgattgttgcaagtcacaggggaccctgaaggaacgagttcagtggagaggcgagatgaagcatttttgcgaccaacattgtctgctccgtttctactgccagcagaatgagcccaatatgacaacccagaaagggccagagaacttgcactacgatcagggctgtcagacatctcgaactaagatgacgggcagcgcaccaccaccatctccaactcccaacaaagaaatgaagaataaggccgtgctgtgcaaaccccttaccatgactaaagctacttactgtaagccccacatgcagacaaaatcctgccaaaccgacgatacttggcgcacagagtatgtccccgtgccaattccggttcctgtgtatatcccagtgcccatgcatatgtatagccagaatatcccagttcctaccaccgtgccagtgcccgttcctgtcccagtcttcctgccggcacccttggactcctctgagaaaattcctgcagctatcgaggagcttaagtccaaggtcagctccgacgcccttgacacagagctgctgacaatgacagacatgatgtcagaggacgagggaaaaacggaaaccaccaacatcaatagtgtgatcatagagactgacatcatcggatccgacctgttaaaaaactcggaccccgagactcagagttctatgcccgatgtaccttacgagcctgacctggatatcgagatcgactttcctcgtgccgcagaggagctggacatggagaacgaattcctactgcccccagtctttggtgaggagtacgaggagcagccaaggcctagaagtaagaagaaaggtgcaaaacggaaggctgtctcagggtaccagtcacatgatgacagcagcgacaatagtgaatgctcctttcctttcaagtacacatacggcgttaatgcctggaaacactgggtgaagacgagacagctcgacgaagatctgctggtgttagatgaactgaagtcctcgaagtccgtcaaactgaaggaggacctgctctctcacactacggcggagttaaactatggtcttgcccacttcgtgaacgaaatcagaaggccaaatggagagaattacgctcccgactctatttactacctgtgcctaggcatccaggagtacctgtgcggcagcaaccgaaaggataatatattcatagatccaggttatcagacgtttgaacaggaactcaacaagattttgcggtcctggcagcctagcatcctcccagatgggtcgatcttctcgagagtggaggaagattatctgtggcggatcaaacaactgggctcccactctccggtcgccttactgaataccctcttttacttcaacaccaaatattttgggctgaagaccgtcgaacagcatctgaggctgtcttttggcaccgttttcaggcattggaaaaagaatccactgacgatggaaaacaaagcttgcctgaggtaccaggtatcctctctttgcggaacggacaatgaggacaagattaccacgggcaagcggaaacatgaagatgatgagcccgtcttcgagcaaatcgagaatactgccaacccctcacggtgccctgtgaagatgtttgagtgttatctgtcgaaaagtccgcaaaatcttaaccaacggatggatgtattctatcttcaacccgagtgttcttcaagcacggattctccagtatggtacacatccacctccctcgacagaaatactctggagaacatgctggtgcgcgtgctgctagtgaaggacatatacgacaaagacaactatgagctggacgaagacaccgattag

SEQ ID NO: 247942 - DNA, 4113 bp, Artificial Sequence
  Description of Artificial Sequence: Synthetic coding sequence
atggacccaagtgatttccctagccccttcgatcctctcacattacctgagaagccccttgcaggggacctgccagtggacatggagtttggagaggatctcttagagagccagacggcgccaacccgcggttgggcccctccaggaccatcaccttcctctggcgctctggacctcctcgacacccctgccggactggagaaggaccctggggtgctggatggggcaacagaattgctgggattgggaggcttgctgtataaagcccctagcccacctgaagtcgaccatggtcctgagggaaccctcgcttgggatgccggagaccaaacacttgaacccggtcctggaggacagactccggaggtcgtgccacccgatccgggagccggagcgaattcttgttcccccgagggcctactggaaccccttgcgccagactctcctattacactgcaatctccccacatagaggaggaagaaacaaccagtattgccaccgctagaagaggatctcccggtcaagaggaagagctgccacagggtcagccccagtctcccaatgcaccaccgagccccagtgtcggagagacactgggagacggtattaactcaagccagactaagcccggagggagtagcccccctgcacatccatcattacccggagacggcctgacagctaaagcttcggagaagcccccagaaagaaagaggtctgagagagtgcggagagcagagcccccaaagccagaagtcgtggatagcactgaaagcatccctgttagtgatgaggactctgatgctatggtggacgaccctaatgacgaggacttcgtgcccttccgaccccgtcgcagtcccaggatgtccctgcggagtagtgtaagtcagcgtgctggcagaagcgcagttggaactaagatgacgtgcgctcattgcaggacaccactgcagaagggccagaccgcttatcagcgcaaggggttgccccaactgttctgctcgagttcttgcctgactactttctcaaagaagcccagtggtaaaaaaacatgcaccttttgcaagaaagaaatctggaataccaaggatagcgtggtggctcaaactggatctgggggatcatttcacgagttttgcacatccgtgtgtttgtccttatatgaggcccaacagcagaggcctattccccagtccggggatcccgcagacgccacgcgctgttcaatatgtcagaaaaccggcgaggtgctgcatgaggtgtcaaatggctccgtcgtccacagactatgcagtgattcttgcttctccaagttccgggctaataaggggctgaaaaccaattgttgtgaccagtgcggagcttatatttacaccaagaccggctcacctgggcctgaattactatttcacgagggccagcagaaacggttctgtaataccacctgtttaggcgcatataaaaagaagaatacccgggtctacccgtgcgtgtggtgtaaaacactgtgcaagaatttcgagatgctgtctcatgtagaccggaacggaaaaacaagcctgttctgctctctgtgctgcaccacatcatataaagtgaagcaagcaggcctgaccggccctcccaggccttgttctttttgtcggcgaagcttgagcgatccctgctactacaacaaggtagacaggacagtttatcagttttgtagcccttcctgttggaccaaattccaacggacttctcctgaggggggaatccacctgtcatgccattactgtcacagcctgttctctggaaaaccagaagtgctggattggcaagatcaagtgttccagttctgctgtagagattgttgtgaagactttaagcggctgcgcggagtggtgtctcagtgtgagcactgcagacaagagaagcttctgcacgagaagcttcgtttctcgggagtggagaagagcttctgctcagaagggtgtgttctcctctacaagcaggatttcactaaaaaactgggactctgctgtatcacctgcacttactgtagtcagacatgtcagagaggtgtgacagaacaactggatgggagcacatgggatttctgctcagaagattgtaaatcaaagtacctgttgtggtactgtaaggccgctcgctgccacgcctgtaagcgtcagggtaaactgttagagactattcactggcggggacagattcgtcacttctgtaatcagcagtgcctcttaaggttctactcacaacagaaccagcccaatctcgacactcaatccggcccagagagcctactcaacagtcagtcacctgagtcaaagccccagacaccttcgcagaccaaggtggagaacagcaacacggtgagaacccctgaggaaaatgggaacctgggcaaaatccccgtcaagacaaggagcgcacctactgcccctactcccccaccacctccccctccagcgacccccaggaagaacaaggcagccatgtgtaaacccctgatgcagaaccggggagtttcctgcaaggtggagatgaagtcaaaaggatcacagaccgaggagtggaagccccaggtgatcgttctccctattccagttcccatattcgtacctgtacccatgcatctgtattgccagaaagtcccggtgccatttagtatgcccattcctgtgcctgtcccaatgtttcttcctactacgcttgagagcactgataagattgttgagactattgaagagctcaaggtcaagatcccttctaacccgctggaagcagacatcctcgctatggcggagatgatcgcagaggcagaggagctggacaaggcatcctcagacctgtgtgacctcgtctcaaaccaatccgcagaaggtctcttggaagattgcgacctgttcggaccggctcgggacgatgtccttgctatggctgtgaaaatggccaatgtgctggacgaacctggtcaggatctcgaggctgattttcctaaaaatcccttagatattaacccatcggtggattttctgttcgattgcggactggtgggtcccgaggacgtaagtactgagcaggacctgccaagaacaatgcgtaagggtcagaaaagactcgtgttgtcagaaagttgtagccgggactcaatgtccagccagccaagctgtactggcctcaactactcctacggcgtgaacgcatggaagtgctgggtccagtcaaagtacgccaatggagagaccagcaaaggcgatgagttacggttcggccctaagcctatgagaattaaagaggatatcctagcctgctcagcagcagagcttaattacggcctcgcgcagttcgtgagagagataacccgccctaacggcgagaggtatgagcccgattcgatttactacctgtgcctgggcatccagcagtacttgctggaaaataaccgaatggtaaatatctttaccgacctgtattacttgacgtttgtgcaggaactgaacaagagcctatcaacctggcagcccacgctcttacccaacaatactgtgttctctcgcgtagaagaggagcatctttgggagtgtaagcagctgggcgtgtactcaccctttgtgctgctcaacactctgatgttttttaacacgaaattctttggtctgcagactgctgaagaacacatgcagctctcgttcactaatgtggtgaggcaatctcggaagtgtacgactcctcgaggcacgacaaaggtcgtgtcaattaggtattatgcccctgttaggcagcggaaaggacgcgacaccgggcctggaaaacggaaacgagaggacgaagcacctatcctagagcagagagaaaatcgaatgaacccattgcgctgcccagtgaagttttatgaattttacctgtccaaatgcccagagtcccttcgcactcgcaacgatgtcttctatctgcaaccggaaaggtcctgcattgccgagtcccccctctggtattcggtcattcctatggatcggtccatgctggagagcatgctgaacagaattctagctgtccgagaaatttatgaggagctcggccgaccaggagaagaggacttagactag

SEQ ID NO: 247943 - DNA, 4113 bp, Artificial Sequence
  Description of Artificial Sequence: Synthetic coding sequence
atggatccatcagattttccttctcccttcgaccctctgacactgccagaaaagccactggcaggcgatctccccgtagacatggaatttggagaagacctgcttgagtctcagaccgctcctacccggggatgggccccacctgggccaagtcctagctcaggcgcactcgatctgcttgatacccctgcgggactggagaaggatccaggggtgttagatggcgctacggagctcctggggcttgggggactactgtacaaggcaccaagccctccggaagttgatcacgggccagaaggcaccctcgcatgggacgccggtgaccagacattagagccaggtccagggggacagactcccgaggtcgttccccctgacccaggggctggcgctaacagctgctccccagaggggcttctggaacccttggccccagatagcccaataacgttacaatccccacatattgaagaagaggagaccactagtatcgccacagcgagacgcggttccccaggacaggaagaggagttgccgcaagggcaacctcagtcgccaaacgcaccgccatccccttcggttggagagactttaggagacggtatcaatagctcgcagacaaaaccgggtggtagcagccctcctgcccatccatcactgcctggggatggcttgactgcgaaagccagtgaaaagcctcccgagcgaaaaagaagcgaaagagtacggagggccgaacccccaaaaccagaggttgtagattcaactgaatccatcccggtatcggacgaggattccgacgccatggtggatgaccctaacgatgaggactttgtcccgttccggccaagacgctctccacgtatgtctctgagaagtagcgtctcacagcgcgctggaagatccgccgtgggaaccaagatgacttgtgcacactgtcggactcctcttcaaaaagggcagactgcctatcaacgaaaggggcttccacaattgttctgcagttcttcttgcctgacaaccttctccaagaagccttctggcaaaaagacctgcaccttttgcaaaaaggaaatctggaacacaaaagactcagtggtagctcagacaggatcgggcggatcattccacgagttctgcactagtgtatgtctgtctctctatgaggcacagcagcagagaccaatccctcagtctggcgatcctgcggatgcaacccgctgcagcatttgtcaaaagacgggcgaggtgctgcacgaagtctcaaacgggtctgtggtgcatcggctctgcagcgactcctgcttttctaagtttcgagcgaataaggggttaaaaaccaattgctgcgaccagtgcggcgcttatatctatacgaaaacaggaagtccaggccctgagctcctgttccatgaagggcaacagaagcggttctgcaatactacgtgccttggggcttataaaaaaaaaaacacgcgggtatacccttgcgtgtggtgtaaaactctctgtaagaacttcgagatgctctcccatgtggaccggaatggaaaaacctcccttttctgcagcctgtgctgcacaacatcgtacaaagtgaagcaggcaggactcaccggcccaccgagaccctgcagtttctgtcggagatcactgtccgatccatgttattacaataaggtagatcggaccgtgtatcagttctgtagtcccagctgctggacaaaatttcaacgaactagcccggaagggggaattcatctttcctgccattattgccactcgcttttttcagggaagccagaggttcttgattggcaggaccaagtcttccagttctgttgccgggactgctgtgaggacttcaaacgattgcggggagtggtcagccagtgcgaacactgccgacaagagaaattgcttcacgagaaacttagattcagcggggtggaaaagtccttctgctccgaaggctgtgttctgctttataaacaagattttaccaaaaagctaggtctatgctgtattacctgtacgtactgcagtcagacttgccagagaggagtgacggaacagctggacggaagtacatgggatttttgctcagaggattgtaagtccaagtatctcctttggtattgcaaagcagcgaggtgccacgcctgcaagagacaggggaaactcctggaaaccattcactggaggggacaaataaggcatttttgcaaccagcagtgtctccttcgattctattcccagcaaaatcaacctaacctcgatacccagagtggacccgagtcacttttaaattctcagtcaccagaaagtaagccgcagaccccctcccagacgaaagtggaaaatagcaacaccgtgcgtactcccgaggagaacggaaacctgggaaaaatacctgtcaagactcggagtgctcccactgcccctaccccacccccaccgcctcccccagccacccccaggaagaataaagcagccatgtgcaagcccttaatgcagaataggggggtgagctgcaaggttgagatgaaatcaaaaggctcccagacagaagaatggaagccccaggtcattgtgctgcctatccccgttccaatttttgttcctgttccgatgcacctttactgccaaaaggtcccggtccctttctcaatgccaattcctgtacccgtgcccatgttcctgcccactactctagaatctactgataagatcgtcgagacaattgaggaactgaaagtgaaaatacctagtaaccctttggaagcagacatattggcaatggccgaaatgattgccgaagccgaggagctggacaaagccagctccgacctctgcgaccttgtctcaaaccagagcgcagagggtttgctcgaggactgtgacttgttcggcccagctcgggatgacgtcttggctatggccgtgaagatggctaatgtgctggacgaacccggacaggatctcgaggctgatttcccaaagaatcctctagacattaacccctcggtggatttcctcttcgattgtggccttgttggtcctgaggacgtatccactgaacaggacctacccaggacaatgcggaagggacagaagcgacttgtgctgtcagagtcttgttcccgagactcaatgagctcacagcctagctgtacaggactgaactattcttacggagtgaatgcctggaagtgttgggtgcaatccaagtatgctaacggggaaacatctaagggcgacgaactgcggtttggtcctaagcccatgaggataaaagaggatatactcgcctgttccgccgctgagctgaattacggactggctcagtttgtgagagagatcacccgtccgaacggggagagatacgagccagattcaatttactacctttgcctgggcatccagcaatacttgctggagaataacaggatggtaaacatttttactgacctgtactatctgacctttgtccaggagctcaataaaagcctctctacctggcagccaaccttgctgccgaacaatacggtcttttctcgcgttgaggaggagcacctgtgggagtgcaagcagctcggagtgtatagcccttttgttctgttaaatactctcatgttcttcaatacaaagttcttcggactccagacggcggaagaacacatgcagctgtcctttactaatgtggtacgacaatcccgaaagtgcaccacaccaaggggtacaactaaggtggtgtctatcaggtactacgcaccggtgaggcagagaaagggtagggacactggacctggaaaacggaaacgagaagacgaggccccaattctagagcagcgagagaatcgcatgaatcctctgcgatgtcctgtcaagttctatgagttttatttaagtaagtgcccagagtctcttaggaccagaaacgacgtcttttatctgcagccagaacggtcatgtattgcggagtcccccttgtggtacagtgtcatccctatggatagaagtatgctggagtcaatgctgaacagaatcctggcagtgagggagatctatgaagaactgggacgcccaggggaggaagatcttgattag

SEQ ID NO: 247944 - DNA, 1050 bp, Artificial Sequence
  Description of Artificial Sequence: Synthetic coding sequence
atggatccatctgattttcccagcccctttgacccgctgacactgccggagaagcccctggccggtgacctgcccgtggacatggagtttggcgaagatttgctggaatcccagacggctccaactcggggatgggctccacccggtccgagtccttcctctggcgcattagacttgctggacacccctgccggacttgagaaggatccaggcgtgctggacggagctacagagcttctaggactgggcggactgctctataaggcaccttcaccacctgaggtggatcacggcccagaaggcaccctggcttgggatgccggagatcaaacacttgagcccggacccggtggacagacacccgaagtggtcccgccagaccccggagcaggggctaatagctgctccccagagggactcctggagccgttggccccagattcacctattacactgcagagtccccacatcgaggaagaagaaactacatccatcgctaccgctcgccgtggcagccccggtcaggaagaggagcttccccaggggcagccacaatcacctaatgcaccgccaagccctagtgtgggcgaaacactgggagacggcatcaatagtagccaaacaaaacccggtggctcgtcgccccctgcacacccaagccttcctggagatggcctgaccgccaaggctagtgagaagccgccagagcgcgtacagaagagatctgagagagtccgccgtgccgagccgcctaagcctgaggtcgttgatagtacagagagtcgccgttctggcacgcccaggacaagattgtggcgacggcttgtcctcgaggctccttcaatgtcttctgcacatccatcggtgtcaccgtgcatgaggccaagctccagcgctcgttctcctagcctggggatcccccctaccctactagccgcagcgtacgccagacgccttgagcggtcctgtacacgctctgctatggcagcgtggtacaccgggtccgcagccattttggcttcccctaactcaggacccactagagactag

SEQ ID NO: 247945 - DNA, 1488 bp, Artificial Sequence
  Description of Artificial Sequence: Synthetic coding sequence
atggatccttcagatttcccaagcccattcgatccccttaccctccccgaaaaacccctcgccggtgacctgcctgtggacatggaattcggagaggatctgctggaaagtcaaactgctcctacccgcggatgggcaccgcctggaccctccccaagttctggtgcattggacctgctggatacacctgcaggattggagaaggatccgggtgtcctcgatggggcaaccgagttactgggtctcggcggacttttatacaaagcccctagccccccagaggtggatcacggtcctgaagggacgctggcttgggatgcgggtgatcagacactggagccaggcccagggggtcagacccctgaggttgtacccccagacccaggagcaggtgccaattcatgctctcccgagggactgttagagcctctggcgcctgactcccctatcaccctgcagtcaccccacatcgaggaggaggagaccacttccatcgccactgcccgtagaggcagcccgggacaagaggaggaactcccccagggtcagccccaatctccaaatgcacctccttcgcccagcgtgggagagactctgggagacggcatcaactcatcgcagactaaacccggaggctcttctccacctgcccacccctcactgccaggggacgggctaacagccaaagcgtcagagaagccccctgagaggaagcgtagcgaacgggtgcgaagagccgaaccacccaaaccagaagtggttgactccactgaatcaatcccagtgtctgatgaagacagcgacgcgatggtggatgacccgaacgatgaggacttcgtgccttttaggcccagacggagtccacggatgagcctaaggagctccgtgtcacagcgagcgggaaggagtgcagtgggtaccaaaatgacatgcgctcactgtcggacgcctctccagaaaggacaaaccgcctaccagaggaaggggcttcctcagctcttctgttccagcagttgtctgactacctttagtaaaaaacctagtggtaaaaagacctgtaccttctgtaagaaggagatctggaataccaaggattccgtggttgcccagaccgggtccggtggatcgtttcatgagttttgtacatcagtctgtctcagcctctacgaagcccaacagcagcgaccaattccccaatccggcgatccagccgatgcgacccgttgctctatctgccagaagaccggagaggtgctgcatgaggtgtccaacggttctgtggtccacaggctatgcagtgactcttgcttctctaaatttagggccaataaaggccttaagactaactgctgtgaccagtgtggtgcctatatctataccaagaccgggtcccctggacccgagctactgtttcacgaaggacagcagaaacgattttgcaacacaacatgcctcggggcttataaaaaggtgggtcccagggaatag

SEQ ID NO: 247946 - DNA, 1494 bp, Artificial Sequence
  Description of Artificial Sequence: Synthetic coding sequence
atggacccctccgactttccctctccatttgatcctctgacactgcccgaaaagccgctggctggtgatctgccggtggacatggaatttggggaagaccttctggagagccagactgctcccactcgaggttgggctcccccaggaccttccccttcaagtggggctttggacctgcttgatacgcctgcaggactggagaaggaccctggcgtgttagacggggcaactgaactgcttggattaggcggactcctatacaaggccccaagtccccctgaggtggaccacggccctgagggcaccctggcgtgggatgccggagatcaaactctagaacctggcccaggagggcagacgcctgaagtcgtgccacccgacccaggcgctggcgctaactcctgctcacctgagggactgctggagcctctggctcctgactcacctataacgctgcaaagcccacacatagaggaagaggagaccaccagcatagccacagcgaggcgaggatctcctggccaggaggaggagctaccccaggggcagccacaatctcccaacgctccaccctcgccttctgtgggggaaacgttgggcgacggaataaattcttcccagaccaaacccggtggctcatcaccacccgcacaccccagtctaccaggggatggcttgaccgcaaaggcatctgaaaaaccccctgaacgggtgcagaagaggtcggagagagtgcgcagggctgagccaccaaagccagaagtggtggacagcacagagtcaatcccggtgtccgacgaagattcagacgctatggtcgacgatcctaacgatgaggacttcgtaccgtttaggcctaggagaagcccccgaatgtcgctccgctctagcgtgtcccagcgggctgggcgatccgccgtgggcaccaaaatgacctgcgcgcattgtaggacacctctacagaaaggtcagacagcgtaccagcgtaaggggttgcctcagctcttctgttcatcttcctgcctgactacattctctaaaaagcccagtggtaagaaaacctgtacattctgcaagaaggaaatctggaacacgaaggatagcgttgtggcccaaaccgggagcggaggctcattccacgaattctgtacctccgtatgcctgtctttatacgaggcacagcaacagcgcccaatcccgcaaagtggagacccagcagacgcaacacgctgctcgatctgccagaagactggagaggttctgcacgaagtgtcgaacgggagtgtggttcaccgcctgtgctctgattcttgttttagcaaattccgcgctaataaaggtttgaaaaccaactgttgcgaccagtgcggtgcctacatttacacaaagactgggagccccggacccgagttgctcttccacgagggacagcagaaacggttttgcaacactacatgcctgggggcatacaagaaggtaggccctagggagtag

SEQ ID NO: 247947 - DNA, 3843 bp, Artificial Sequence
  Description of Artificial Sequence: Synthetic coding sequence
atggacccaagcgacttcccatctccctttgaccccctgaccctgcccgaaaaacccctggctggcgacctgcctgtggacatggaatttggagaggacctcctcgagtcacagaccgctcctacaagaggatgggctccaccaggcccttcgccctcgtcaggtgcactggatctccttgacacaccagccggactggaaaaggaccccggagtgttagatggagccaccgaactgctcggattaggagggcttctgtataaggccccttcaccacctgaggtggatcacggacctgaaggaaccctggcttgggacgccggagatcagacactcgaaccaggcccagggggtcagaccccagaggtagtccccccagatcctggggctggcgcaaattcatgctcccctgaaggcctgttagaaccactggcaccagattctcctattactttacagtcacctcacattgaggaggaggagactacctctattgcaaccgccagacggggaagccccggtcaggaagaagagctgccacaagggcagccccagagccccaatgctcccccaagcccgtctgtgggagagactctgggtgacgggatcaattccagtcaaactaaaccagggggaagctcacccccagcccacccttcactgccgggtgacggactcaccgccaaggccagcgaaaagcccccagaacgggtgcaaaagcggtccgagagggtcaggagggctgagccgccaaaacctgaagttgtcgatagcaccgagagcatcccagtctccgatgaagattccgacgcaatggtcgatgaccccaatgacgaggatttcgtgccatttcggcctcggcgatcacctaggatgtccttgcggagctcagtgagtcagagggctggccgatccgcggtgggtactaagatgacctgcgctcattgcaggactcctctgcagaagggccaaaccgcttaccagaggaagggcctgccacagttgttttgttcctcctcctgccttactaccttttccaagaaacctagtggtaagaaaacatgcactttctgcaaaaaagagatatggaacacaaaggacagcgtggtggcccaaaccgggtcaggagggagtttccatgaattctgcaccagtgtgtgcttaagtctgtatgaagctcagcagcagaggccaatacctcagtccggcgatcccgctgatgcaacccgatgctccatttgtcagaagaccggggaggtcttgcatgaagtaagcaatggctcggtggttcacaggctctgtagcgattcttgcttctccaagtttcgcgcaaacaaagggctcaaaacaaattgctgcgatcagtgtggcgcatatatatacaccaagacaggcagtcccggacccgagctgcttttccacgagggacaacaaaagagattttgcaatactacctgcttaggtgcctataaaaaaaagaacactagggtgtatccttgtgtgtggtgcaagactctctgtaagaacttcgagatgctcagccacgtggatcgcaacggaaagacttctctcttttgctccctctgttgtacaacctcatataaagtcaagcaagcaggtctgaccggcccaccacggccttgctctttctgtcgccgatccctctcagatccgtgttactataataaggtcgacaggaccgtctaccagttttgcagcccctcctgttggacgaagtttcagcgtaccagccccgaagggggaatccatctgtcctgccactattgtcacagtctcttcagcggaaagcccgaggtgctggattggcaggatcaggttttccagttctgctgcagggattgctgcgaggatttcaaacgactcagaggggtagtatctcaatgtgaacactgtcggcaggagaagcttctacatgagaagttgagattctccggtgtcgaaaaatctttctgttccgagggatgtgtgttgctgtacaaacaggatttcacgaaaaagttggggctgtgttgcatcacatgcacatattgtagccagacgtgtcagcgaggcgtgaccgaacagctggacggcagtacttgggatttttgttctgaagattgcaagtccaagtatcttctctggtattgcaaggccgcaagatgccatgcctgtaagcggcaaggtaaactcctggagacaatccactggagaggacagatccgacatttctgcaatcaacagtgcttgctccgcttctattctcagcagaaccagccgaacctggacactcagtctggtcccgaatctctgcttaactcccagtctcctgaaagcaaaccacagacgccttcccagacaaaagtggagaacagtaacaccgttcgcacccctgaagaaaacggaaaccttggtaagatcccggttaagaccagatctgcccctacagcgccaaccccacctccaccacctcctcctgctactcctaggaaaaacaaagctgcgatgtgcaagcccctcatgcagaatcgcggagtaagctgcaaagtggagatgaaatccaaaggaagccagaccgaggagtggaaaccccaggtcattgtgctcccaattccagtccctatcttcgtccctgtgccaatgcacttgtattgtcagaaggtcccggtccctttttctatgccaattcccgtacccgtaccaatgttcctccctacgactttagaatctaccgataaaatcgtagagaccatcgaggaactaaaagttaaaatcccttcgaacccattggaggcagatattctggcaatggccgagatgatagctgaggctgaagagcttgacaaagcttcaagcgacttgtgtgacctggtatccaaccaaagtgctgagggactgctggaggattgcgatttgttcgggcctgcccgagacgacgtcctggccatggccgtgaagatggcgaacgttttagacgaacccggacaggatttggaagccgacttccctaaaaatccactcgatataaaccccagtgtggattttctgtttgattgtggtctggtggggccagaagacgtgtccacagagcaggatctaccacgtacaatgcgcaagggacaaaagagacttgtcctgtcggagagctgctctcgggattcaatgagctcccagccctcctgcactggattgaattactcatacggcgtcaacgcctggaagtgttgggtacaatcaaagtatgctaatggagagacgagtaaagctaaacctatgcggatcaaggaggacattctggcctgttctgccgctgagctgaactacgggctggcccagttcgtaagagagataacacgacctaatggcgaaaggtatgaacctgacagcatttattacctttgtctgggtattcagcagtacctgctcgagaacaacagaatggtaaacatcttcacagatctctactacctcaccttcgtccaagagctgaacaaatcactgtccacctggcagccgacactgctgccaaacaacactggtccgggtaaacgaaagcgtgaggacgaggcaccaatccttgagcagcgagagaaccgtatgaaccccctgaggtgcccagtcaaattttacgagttttacctctctaaatgccccgaaagtctccgcacccgcaatgatgtgttttatttacagcctgaaaggagctgtattgccgagtctcccctctggtacagcgtaatccctatggatcgctcaatgttagagagtatgctaaataggatcttggctgtgcgggagatctacgaagaactggggcgtcccggagaggaagacttggactag

SEQ ID NO: 247948 - DNA, 4119 bp, Artificial Sequence
  Description of Artificial Sequence: Synthetic coding sequence
atggacccaagtgattttccgtccccctttgacccactgacattgcccgaaaagccactggccggtgatcttcctgtggacatggaatttggagaggatcttttggagagtcagaccgctcctacacggggatgggcaccaccagggccaagcccctcatccggcgctctggatctcctcgacacccccgctggccttgagaaggaccctggagtgttggacggggctactgaacttctcggtctcggcggtcttctatataaagcaccctcgccacccgaagttgaccatggccctgaaggtacattagcttgggatgccggagatcagactcttgaaccagggcctggaggtcaaactccggaagtagtccccccagatcccggtgcgggtgcgaatagttgttctcctgagggcctgctggaaccacttgctcctgatagccccatcaccctgcagtcccctcacattgaggaagaagagacgacatctatcgcaacggcacgacgaggcagcccaggacaagaggaagagttaccgcagggtcagccacagtctccaaacgctcctccgagtcctagtgtaggtgagactttaggtgatgggatcaactccagccagactaagcccggaggctcatcaccacctgcacacccctccctgccaggcgacggcctgacagcgaaggcttctgagaagcctcctgagcgagtccagaaacggagcgaacgggtccgaagggccgaacctccgaagccagaagtcgtggatagcacggagtctatccccgtgtctgacgaggatagcgatgccatggtggacgatcctaatgatgaggacttcgtgccctttaggcccagacgaagtcctcggatgtctttgcgttcctccgtctctcaaagggccggaagatctgctgttggcacaaagatgacatgtgcacattgcagaacgcctttgcagaaaggccagaccgcataccagcgcaagggtcttccacaactcttctgtagcagcagctgtctcacaactttctccaaaaagcccagcggaaaaaagacctgcacattttgcaagaaggagatttggaataccaaggactctgtggtcgcacaaactggaagtgggggatcgttccacgaattctgcactagcgtctgtctgtccttgtacgaagcccaacagcagcgccctataccccagtccggagaccctgccgatgccacccggtgttcgatctgtcagaagactggagaagtccttcatgaagtctctaatggttccgtcgtccatcggctatgctccgatagttgcttctccaagttccgcgcaaacaagggcctaaaaaccaactgctgtgatcaatgtggagcatacatatacaccaaaactggttcacccggaccagagctcctcttccatgaggggcaacaaaaaaggttttgtaacactacttgcttgggcgcttataagaaaaaaaacaccagagtatacccatgcgtctggtgcaagacactctgtaaaaacttcgagatgctgtcccacgtggacaggaacggtaaaacttcactgttctgttctctgtgctgcacaacttcctataaagtaaagcaggcaggcctcacaggtcccccacgaccttgtagcttttgcagacgttccttgtctgacccttgttactacaacaaagttgatcgcaccgtgtatcagttttgctctccctcatgttggaccaagtttcagcgcactagtcccgagggaggcatccacctgtcctgccactactgccactccctctttagcggcaagccggaagtcttggactggcaagaccaggttttccaattttgctgccgcgattgttgtgaggattttaaaaggctgcggggtgttgttagtcagtgcgagcattgccgacaggagaaattactgcatgagaagctgagattctcaggcgtggagaaatcattttgctccgaaggttgtgtcctgttgtataagcaggacttcacaaaaaaactcggcctgtgttgcatcacctgcacttactgctcacagacatgtcaacggggagtaacagagcagctggacggctcaacctgggacttttgctctgaggattgcaaaagtaaatatcttctctggtactgtaaggcagctcgatgccatgcctgcaaacggcagggcaaattgctagagacaattcactggagaggtcagatccggcacttctgtaatcaacagtgtctgctgcgcttctactcgcaacagaaccaaccaaacctggacactcaatcaggacccgagtccctcttaaattcccaatcccctgagtccaagccacaaaccccttcccaaactaaggtcgaaaacagcaatacggtgagaactcctgaggaaaatggcaatttgggcaaaatccccgtgaagactcggtcagctcccacggcccctacaccgccaccgccaccgcctcccgctactcccaggaagaataaggcggctatgtgtaaacctttaatgcagaatcgcggtgtcagctgcaaggtcgaaatgaagtccaagggctctcaaaccgaagaatggaagccacaagtgatagtcctgccaatccccgtgcccattttcgtcccggtacccatgcacctctattgccaaaaggtcccagtgcctttttctatgccaatccccgttcctgtgcccatgttcttgcccaccactttagaaagcaccgacaagattgtagaaactatcgaggagcttaaagtgaaaataccctcgaatcctcttgaagccgatattctcgcaatggctgaaatgattgccgaggccgaggaacttgacaaagcctcttccgatctgtgcgacttggtctctaaccagtccgctgagggcctgctcgaggactgtgaccttttcggaccagccagagatgacgtgctggctatggctgtaaagatggctaacgtgcttgacgagccaggccaggacctcgaagctgattttccgaaaaaccctcttgatatcaacccatcggtggactttctgtttgactgcggactcgtggggcctgaagacgttagtacagagcaggatttacccaggactatgcgaaaaggacaaaaacggttagtgctcagcgagtcctgctctcgagacagcatgagcagccagccatcctgcacaggcctcaactatagctatggtgtgaatgcatggaagtgctgggtccaatctaagtatgcgaatggggaaacttcaaagggcgacgagctgagattcgggccaaagccaatgagaataaaggaagacatcctagcgtgctccgccgctgagctgaactatggcctggcccagtttgtgagggagatcaccagacctaatggcgagcgctacgagcccgacagtatttactacctgtgcctcgggatccagcagtatctattggagaataaccgtatggtcaatatctttaccgatctctattatcttacttttgtccaggaacttaataaatctctctccacctggcaacccactctgctaccaaacaacacagtctttagtcgagtcgaagaagaacatctgtgggagtgtaagcagttgggcgtctacagccccttcgtcctcctgaatactctcatgttctttaacactaaattctttgggctccagacggcagaggagcacatgcagctcagtttcaccaatgtggtgaggcagtcccggaagtgcacaacaccacggggaacgacaaaagtagtctcaatacgttactacgctccagtgcgacagagaaaaggacgggatactggtcctggcaagagaaagagagaagacgaggcacctatcctggaacagcgggagaaccggatgaatcccctgaggtgtcccgtcaagttctacgaattttatctgagcaaatgtccagagtccctaaggacgcgcaacgacgtattctacctgcaaccagaacggtcctgtatagccgagtcccctttatggtatagtgtcatacccatggaccgctcaatgctggaatcaatgctaaataggatactcgccgttcgggaaatttatgaggagctggggaggcctggggaagaggatctggattag

SEQ ID NO: 247949 - DNA, 4077 bp, Artificial Sequence
  Description of Artificial Sequence: Synthetic coding sequence
atggatccttctgatttcccttctccatttgaccctctcactctccctgagaagccgcttgctggagatttgcctgttgacatggagttcggtgaagacctgctggagtcacagaccgccccaacgcgaggttgggcccctcctggcccaagtccgagctcgggggcattggatcttctggatactccggcaggcttggaaaaagacccgggagtcttagatggagccacagagctgctaggattgggaggcttattgtacaaagccccatctccgccagaggttgaccacgggccagagggtacacttgcttgggacgccggagaccaaacactggagcctgggccagggggacaaacccctgaagtagtgcctccagatcctggggctggggcaaacagctgctcacctgagggacttctggaacctctggctccagactcccccatcacgctccagtctcctcacatcgaggaagaagaaactacatctatagccactgcccgtcgcggaagtcccggacaggaggaggagctgccccagggacagccgcagagcccaaatgccccaccctccccatcagtgggagagacactgggtgacggaataaactcttcacagactaagccagggggaagctcccccccagcccacccttcactcccaggcgacggcctgaccgcaaaagcctctgagaaacccccagaaaggaaaaggagcgaaagggtgagaagagctgagccacccaaaccggaggtggtagattccactgagagtattcctgtatctgatgaggattcggacgctatggtggacgacccaaacgacgaggacttcgtccccttcagacccagaaggagtccgaggatgagcctgcgctcgtctgtcagtcaacgcgcagggagatcagcagtgggaaccaagatgacctgcgctcattgccgcacccccctgcagaaaggtcaaactgcttaccagcgtaaagggttaccccagctgttctgtagtagctcctgcctgaccaccttttccaaaaagccatctggaaaaaaaacttgcactttctgtaaaaaagagatttggaataccaaggactctgtggtggcccaaacgggcagtggcggtagtttccatgaattctgtacaagcgtttgcctgagcctttatgaagcccagcagcaacgcccaattcctcagtctggagatcccgcagatgccactaggtgttccatctgtcagaagacaggggaggtgttacacgaagtgagcaatgggagcgtggtgcaccggctctgcagtgatagctgtttctccaagtttagagcaaacaagggcctcaaaactaactgctgcgatcaatgtggagcatacatctataccaagaccggatcccccggtcccgaactccttttccacgaagggcagcagaaaagattctgcaataccacttgtcttggcgcatacaagaagaaaaacaccagggtgtacccatgtgtctggtgcaagaccctgtgcaagaatttcgaaatgctgtcccatgtcgaccggaacggtaagactagccttttttgttcactttgctgtacaaccagctacaaggtgaagcaggccggactgacggggcctccaaggccgtgttcattctgcaggaggagtctttccgatccatgctattataacaaagtagatcgcacagtataccaattctgctctccatcctgctggacaaaatttcagcgcacctcccctgaaggcggtattcacttaagctgccattattgtcatagcctgttctcaggcaaaccagaggtattggactggcaggaccaagtgtttcaattttgttgtcgagactgctgtgaggattttaaacgactgaggggggtggtgtcacagtgtgaacattgccgccaggaaaagctgttgcatgaaaaactcagattctctggggtggaaaagtcgttttgctccgaagggtgtgtccttctgtataaacaggattttacaaaaaaattgggattgtgttgcataacatgtacgtactgtagtcagacttgtcaaaggggagtcacggaacagttagacggcagcacctgggacttctgcagcgaagactgtaaatctaaatacctactctggtactgcaaggctgcacgctgccatgcctgtaagaggcagggaaagcttctggagactatccactggaggggccagattagacatttttgcaaccaacagtgtctcctccggttctatagccagcagaaccagcctaatttggacacccagtcagggccagaaagcctcttgaactctcagtcccctgagtcgaagccccagacaccttcacagaccaaagtggaaaattcgaacaccattcccgttaagactagatccgcgccaactgcgcctacacctcctcctcctccacctccagccactcccagaaaaaataaggccgcaatgtgtaaaccgctgatgcagaatcgtggggtgagctgcaaggtggaaatgaaatcaaagggtagccaaaccgaggagtggaaaccccaggtgatcgtccttcctatccctgtgcccattttcgttccagtccccatgcatctgtattgtcagaaagttcccgtgccctttagtatgccaatccctgtgcctgtgcccatgttcttacctaccaccctggagagtactgacaagatcgtagagaccattgaggagctcaaagtgaagattccttccaatccattagaggcagatatcttagccatggcagagatgattgccgaagctgaagagctcgataaggccagttccgacctctgtgacctcgtttccaaccaatcggccgagggcctgctggaagactgtgacctttttggacccgcacgcgacgatgtactggcaatggcggtaaaaatggcaaatgtactcgatgaacccggtcaggatctggaagctgatttccctaagaatccgttggacattaacccctcagtggacttcctttttgattgcggtcttgtgggacctgaggacgtgtccactgaacaggaccttcccaggaccatgaggaagggacagaaaaggttggtgctgagtgaaagttgcagtcgcgattccatgtctagccagccatcttgtaccggactgaactacagctatggcgtgaacgcctggaagtgctgggttcaaagcaagtacgccaacggcgagacgagtaaaggcgacgaactccggtttggcccaaagccaatgagaataaaagaggacatcctagcttgttctgcggcagagttaaattacggtctggctcaattcgtgcgagaaattacaagacctaatggagaaaggtacgagcctgactctatctactacctgtgcttaggaattcaacagtatctcctggaaaacaaccgtatggtgaacatttttacagatctttactatctcactttcgtccaggaactgaataaaagtctgtcaacgtggcagccaacattactgcctaacaacaccgtgttctcaagggtggaggaagaacacctgtgggaatgtaaacaacttggggtatactccccctttgtgctgctcaacacgttaatgtttttcaatactaaattcttcgggctgcagactgctgaggaacacatgcaactctcgttcacaaacgtcgtcagacagagcaggaaatgtactacgccccgaggcaccaccaaggtggtctctattagatattacgctcctgtgcggcaaagaaaaggaagagacacgggtccaggcaagagaaagagggaagacgaggccccaattctggagcagcgggaaaataggatgaacccccttcgttgcccagtcaaattttatgagttctacctgtcaaagtgtccggaaagtttgcggacgaggaacgatgtgttttacctgcagcccgagcgatcgtgtattgcggaaagccccttatggtattccgtgatacccatggacaggtctatgctggagagcatgctgaaccgaattctggccgtgcgcgaaatttacgaggagcttgggcgaccaggagaggaggaccttgactag

SEQ ID NO: 247950 - DNA, 2112 bp, Artificial Sequence
  Description of Artificial Sequence: Synthetic coding sequence
atggaattcgtgagcggctacagggatgagttccttgactttaccgctctcctgttcgggtggttccggaaattcgtagctgaaaggggcgctgtgggaacctccctagaggggagatgccggcaactggaagcccagataagacgcctgccacaggacccagcgctatgggttttacacgtactgccaaaccattctgtcgggatatcactggggcaaggcgctgaaccagggcctgggcctggcctggggactgcatggctgctgggcgataatcctccgcttcatctccgtgacctgtcaccctatatatcctttgtctctctggaagatggtgaagaaggcgaagaggaggaggaggaggacgaagaggaggaaaaacgcgaggacggtggtgccggatctacggagaaagttgaaccagaggaagaccgtgagctggcccctaccagcagagagagtccgcaggagaccaatcccccaggcgagagtgaagaggcagcaagagaagcagggggaggcaaagatggctgcagggaggatagagtcgaaaacgaaaccagaccccagaaaagaaagggccagagatccgaggctgccccactccatgtgtcttgtctcctcctcgtgacagacgagcatggtactatattgggtattgatctgttggttgacggtgcccagggaaccgcctcatgggggtctggcactaaagatctggccccttgggcctatgccctcctgtgccattccatggcctgcccaatgggctccggagatcctaggaaacccagacaactcacagtgggcgacgcccgactgcacagggaattggagagtttagtgccccgactcggcgtgaaattagcaaagacaccaatgaggacatggggaccacgtccagggttcacatttgcctctctacgcgcaagaacttgtcatgtgtgtcaccggcattcattcgaggcaaagctgacaccttgtcctcagtgtagcgccgttctgtactgcggcgaggcctgcctaagggccgattggcagcggtgcccagacgacgtctctcacagattttggtgtccccgactcgccgctttcatggaaagagcaggcgagttggcaaccctcccattcacatacacagctgaggtcacaagcgaaacgttcaataaggaagcttttctggcgagtcggggtttgacgcggggatactggactcagctgagtatgctcattcccggtcctggcttctctaggcatcccagaggtaataccccctccctctcactgcttagagggggagatccttatcagctgctgcaaggcgacgggactgccttaatgccaccagtgcccccacatccgcctcgcggagtttttgtgcccgagctaaacattcagaataagcagtccctgaagattcatgtcgttgaggcgggtaaagaatttgatttggtgatggtgttctgggagcttctcgtgctgctccctcatgtggctttggaactgcagttcgtgggtgatggtctacctccagaaagtgacgagcaacatttcacccttcaaagagacagcctggaggtcagtgtcagacccggatcgggtattagcgcacggccatcttccggcacaaaagagaaggggggtagacgcgacttacagatcaaagtcagtgcaagaccgtatcacctgttccaaggcccaaaaccggatctggtgatcggctttaatagtggcttcgctttaaaggatacatggctgaggagtttaccacgtttgcagagcctcagagttcctgccttctttactgagtcctccgaatacagttgcgtgatggacgggcagaccatggctgtagcaactggcggtggaacctctccaccccagcctaatccctttcggagtccgttccggcttagagctgcagacaattgtatgtcctggtattgcaacgcattcatttttcatctggtgtacaaacccgctcagggctcgggagctcggcctgcacccggacctccccctcctagtcctacccccagcgctccacctgccccaaccagacgtaggcgcggagaaaagaaacctgggaggggagcgagaagacgtaagtag

SEQ ID NO: 247951 - DNA, 2229 bp, Artificial Sequence
  Description of Artificial Sequence: Synthetic coding sequence
atggagttcgtgtccgggtacagagacgagttcctcgacttcaccgcgctgctgtttggctggtttcgaaaattcgtggctgagagaggagctgttggcacaagcctcgaaggtcggtgtaggcagctcgaagcacagattcgcagactcccgcaggaccccgctttgtgggtcctgcacgtactccctaatcatagcgtggggatttccttgggccaaggagctgaacctggtcccggtccaggcctgggcacagcgtggttgctgggtgataacccacccctgcacctaagagatcttagtccttatataagtttcgtgtccctggaggatggcgaagaaggagaagaggaggaggaagaggatgaggaggaggagaagcgagaggatggcggagcaggtagtactgagaaagtggaaccagaggaagacagggaattagcacccacaagtagagagtcccctcaggagactaatccaccgggagagtcggaggaagcggctagagaggccggaggcggaaaggacggctgtagagaggacagagttgagaacgaaaccagaccacagaaacgaaaaggccaaaggtccgaagccgctcccctgcacgttagctgtctgctgctcgtcacggacgaacatggtactattttggggattgatctgctagtggacggcgcacaggggaccgcctcctggggttctgggactaaagacctggcaccgtgggcgtatgccctgctttgccactctatggcatgcccaatggggtccggcgatcccaggaaacccaggcagctgacggtgggagacgccagactgcaccgcgagctcgaatcgctcgtaccccgactcggagtaaaattggctaagaccccaatgcggacatggggccctcgaccaggctttacctttgcgtccctgcgagcccgtacatgccacgtttgccataggcattcatttgaagctaagctcacaccttgtccccaatgcagcgccgttctctattgtggagaagcatgcctcagagccgattggcagaggtgtcccgacgacgtttcccacagattttggtgtccgaggcttgctgcttttatggagcgcgctggagagcttgctacccttccatttacttacacagcggaggtgacgagtgagaccttcaacaaggaagccttcttagcatctagaggtctcacccggggatactggacacagttatctatgctgattcccggtccaggcttctctagacatccgcgtggaaacacaccgagtctcagtctgctgagaggaggagacccctatcagcttcttcagggggatggcaccgcacttatgcccccagttccgcctcaccctcctcgaggggtcttcgggtcctggcaggattattatacctggagaggtctgagcctggattcacctatagctgtcctactcacataccctctaacagtgtactacgtgatcacacacttggtcccacagtccttccctgagctgaatatccaaaacaaacagtctctgaaaattcatgtagtcgaagccggaaaggagtttgacctcgtgatggtcttttgggaactcctggtgttgctgccccacgtggcgctggaacttcagttcgtgggagatggcctccccccagagagcgacgagcagcacttcaccctacagcgtgactccctcgaggtgtcagtccgcccagggtccggcattagcgcaaggccaagttcaggaacaaaagagaagggtggccgtagagaccttcaaataaaagtcagcgccaggccttatcatctgtttcagggccctaagcccgacttggtgatcggctttaatagcggcttcgcgcttaaagacacttggctgagatctcttcctcgactgcagtcactgagggttcctgcattcttcacagagagtagcgagtacagttgtgtgatggatggccagaccatggccgtggcgaccgggggtgggacctcgcctcctcagccaaaccctttcagaagccccttccgcctgcgggctgctgacaactgtatgagctggtactgcaacgcctttatatttcacctggtttataaaccagctcaaggctctggagctcggccagcgcctggccctccgcctccatctcccacaccatcagctcctcccgcaccgacacggaggcggagaggtgaaaagaaacccggtcgaggggctcgccgaagaaagtag

SEQ ID NO: 247952 - DNA, 684 bp, Artificial Sequence
  Description of Artificial Sequence: Synthetic coding sequence
atgactgatttcaagctgggaatcgtgcgactggggcgtgtagccggtaagacgaaatataccctgatagacgaacaggatattccactagtggagagttactcttttgaagcaaggatggaagttgacgccgatggcaacggagcgaaaatctttgcgtacgcgtttgacaagaaccgtggccgaggttccggtcgactcttgcacgagttactgtgggaaagacatcgtggaggcgtggcacccggatttcaagtcgtgcacctgaatgctgtgacagtagacaatagattggataatcttcagctggtcccgtggggttggcgccctaaggccgaggaaaccagcagtaagcagagggaacagagtctgtattggttggccatccagcagctgcctaccgatcccatagaggaacaattcccagtgctcaatgtgactcgctactacaatgcgaacggcgacgtagtcgaagaggaagaaaattcatgcacatactacgaatgtcactaccccccatgtacagttattgaaaaacagctaagagaatttaacatatgcgggcgttgccaagtcgcaaggtactgtggcagccagtgccagcagaaggactggcctgcccacaaaaagcactgtagagaacgcaaacgtccttttcagcatgaactcgaaccggaaaggtag

SEQ ID NO: 247953 - DNA, 2127 bp, Artificial Sequence
  Description of Artificial Sequence: Synthetic coding sequence
atgtccgagcgcggtatcaaatgggcatgtgagtactgcacatatgagaattggcctagtgccataaagtgtacaatgtgccgggcacagcgtcccagcggtactatcatcactgaggatcccttcaagtccgggtcaagtgacgtgggacgagattgggacccttcctcaactgaaggcggaagctctccactaatctgtccagatagcagcgccaggcccagggtgaaaagctcatactccatggaaaacgccaacaaatggagttgccacatgtgcacgtatctgaattggcccagggcaatccgctgtactcaatgcctgtcgcagcggagaactagaagtccgaccgagtctcctcaatctagcggaagcggaagcaggcctgtggccttctcagtggacccatgcgaagagtacaatgaccggaataagttgaacacacggacgcagcactggacctgctcagtctgcacctacgagaattgggcaaaagctaaaaggtgtgtggtgtgcgatcatccccgtccaaacaatatagaagccattgaactggcagagacggaagaggccagctcaattattaacgagcaggacagggccagatggcgtgggagttgtagctcaggaaactcccagagacgctcccccccagccactaagcgcgattctgaggtcaaaatggacttccagcgaatcgagctcgccggtgcagtgggatccaaagaggagttggaggtcgattttaagaaattgaaacagatcaagaataggatgaagaaaaccgattggctttttctaaatgcatgtgtgggcgtcgtcgagggagatttggccgctatcgaggcctacaaatccagcggcggagacatcgctagacagctgacagccgatgaagtaaggcttttaaataggccttctgcatttgatgtcgggtatacccttgttcacttagcgattcggttccagaggcaggacatgttggccattcttctcactgaagtctcccaacaggcagccaagtgtattccagctatggtgtgcccagagctgacagagcaaatccgaagggaaattgcagcttctctgcaccagcgcaaaggagatttcgcttgctatttccttacagacctggtgaccttcacactcccggctgacatagaagatctgcctcccaccgtccaggagaagctgttcgatgaggtcctagaccgcgatgtccagaaggaactcgaagaagagagcccaatcatcaactggtccctggagcttgccacgcgtcttgatagccggctgtacgcgctgtggaataggacggccggtgattgcctgcttgactctgtcctgcaggcgacttggggcatatatgacaaggactcggtgctgaggaaagccctgcacgatagcctgcatgattgcagccattggttctacacgcgttggaaggattgggagtcatggtactcccaatccttcggcttgcacttcagcttaagagaagaacaatggcaggaagactgggccttcattctctccctggcctctcaaccaggagcgtctctcgagcaaacgcacatattcgtgctggcccatatcctgcgcagacctataattgtatacggggtgaagtattataagtcttttaggggcgagacactgggatacactcgcttccaaggcgtttacctccccctcctgtgggagcagagcttttgctggaaatcacccatcgctttaggctacaccagaggacattttagtgcactcgtagctatggaaaacgatgggtatggtaacagaggcgctggcgcaaatctaaatactgacgatgacgtgaccattacgtttctccctttagtggattctgagcgaaaattgctgcacgtgcactttctgtcagctcaggaactgggaaatgaagaacagcaagagaaactcttacgcgagtggctggactgctgtgtgaccgaagggggtgtgcttgtggccatgcagaagagttcgagaaggagaaaccatcccttggtgacgcaaatggtggaaaaatggctggacaggtacagacaaatccgcccttgcacatctttgtccgacggggaggaagacgaagacgatgaggatgagtag

SEQ ID NO: 247954 - DNA, 2400 bp, Artificial Sequence
  Description of Artificial Sequence: Synthetic coding sequence
atggagataccgaagctgctgcccgctcggggaaccttgcaagggggaggtggagggggtataccagcaggtgggggacgggtccatcgtggcccagattctcccgcaggccaggtcccaactcggagacttctgctccccagaggacctcaggatgggggacctgggagacggagagaggaggcttccacggcatcacgcggacctggcccttccctgttcgctcctcggccacatcagcctagcggcggtggagacgatttcttccttgtgctgttagaccccgtgggaggcgacgtcgaaacagcaggatctggccaagctgcaggcccagtactacgagaggaagcaaaggccggacccggactgcaaggcgatgagagcggcgctaatcctgcaggatgcagcgcccaggggccacactgtctttctgccgttcctacaccagcaccaataagtgcacctggccctgccgctgccttcgccggaaccgtgaccattcataaccaggacctattactacgcttcgagaatggtgtgctgaccctcgctactcctcccccacatgcatgggaacctggcgcagcacccgcacagcagccgagatgtttaatagcaccacaggccggattcccccaagccgctcatcctggcgattgccccgagctcagatcagacttgctcctcgctgagcccgcagagcccgcacccgctcccgctccgcaggaagaagctgagggccttgcagcagctctggggcctaggggactccttggttctggacctggtgtggtattgtatctgtgtccagaagccttatgtgggcagacctttgctaagaaacatcagctaaagatgcacctattgactcacagctcttcccaggggcaacgccctttcaaatgccccctgggaggctgtggatggactttcactacctcttacaagctaaagagacacctgcagagccacgataagttaaggccttttggctgcccagcagaaggatgtgggaagagtttcactacagtttataatctaaaggcacacatgaaaggacacgagcaagagaactctttcaagtgcgaagtatgcgaggagtcatttccgacccaggcaaaactgggcgctcaccagaggtcgcacttcgagcccgaacgcccttaccaatgtgctttctccggctgcaaaaaaacctttatcaccgtaagcgccctgttcagccacaacagggcgcattttcgggagcaagagttattctcctgctcatttcccggttgtagcaagcaatacgacaaagcttgcagactgaagatacatctccgttctcatacaggtgagcgcccttttctgtgcgattttgacggatgcgggtggaactttacatctatgagcaagctactgcggcacaagcgtaaacacgatgatgacagaaggttcatgtgtcccgtggagggttgtggtaagtcctttacccgcgctgagcacctgaaggggcacagtatcacacatctgggcaccaagcccttcgtatgccccgtcgctggatgttgtgctcggttttcggctaggtcaagtttgtacatccactcaaagaaacacctccaagatgtggatacctggaaaagcagatgtccgatatcctcctgcaacaagcttttcactagcaagcacagtatgaaaacccacatggttaaacggcacaaagttggtcaagacttgctggcccagctcgaagccgcaaacagtctgaccccctcctctgaactaaccagccagcgacagaacgacctgtccgacgcggaaattgtgagcctcttctcggacgtcccagattctacgtccgcagccctcctggatacggccctagttaactctggtatattgaccatagatgttgcaagcgtgtcttcaacgttggcgggtcatctgcctgccaataataataactccgtgggtcaggcagtggatcctccctccctgatggccacttctgacccaccccagtcactcgatacctccctgttcttcggcacagcagcgactggcttccagcagtcttcactcaacatggacgaagtttctagcgtttcagtgggtcctcttggctctctggacagcctcgctatgaagaatagcagccctgaaccacaggccctaacgccctcgtcgaaactgaccgtcgataccgatacactgaccccatcctccaccttgtgcgagaatagcgtctccgagcttctcacccccgcaaaagctgagtggagtgttcaccccaactccgattttttcggccaagagggagagacccagtttggctttccaaatgccgcaggtaatcacggttcacagaaagagaggaatctcatcactgttactggctcttcttttctcgtgtag

SEQ ID NO: 247955 - DNA, 2412 bp, Artificial Sequence
  Description of Artificial Sequence: Synthetic coding sequence
atggagattccgaaactccttcccgcacgaggaactctccaggggggaggcggtggtggcattcctgctgggggaggcagggtacataggggtcctgatagtcccgctgggcaggttcctaccagacgactgctgctactaagagggcctcaggatggcggacccggtaggcgcagagaggaggctagtacagcctcccgtggtccaggcccttctcttttggctccaaggactgaccaacctagcgggggtggaggaggcggaggggatgacttcttcctggtgctcctggaccctgtcggcggagatgtagagaccgcagggtcaggccaagccgcaggacctgtcctccgagaggaagccgaagaaggacctggtctgcagggaggggaatccggtgctaaccccgcaggccctactgctttaggtccccgttgtctgtccgcagtcccaacacctgcccctatctcggctcctggcccagcagccgcattcgcaggcaccgttactatccacaatcaggatctcctgctgagatttgagaacggagtgctcaccctggccacgccaccaccacatgcatgggaacctggtgccgctccagcccagcagcctggatgcttgatagcccctcaggctggctttcctcatgctgcccaccctggcgactgcccggaattgccacccgatctcttactggctgagcctgccgagccagccccagcaccagccccagaagaagaagccgaaggcccagcagccgctctgggccctagaggacctctggggagcgggcctggagtggtgctctatctatgccccgaagcacagtgtggacagacgtttgcaaagaagcatcagctgaaggttcaccttctcactcacagcagcagccaaggtcagagaccattcaaatgcccactcgggggttgcggctggacattcacaacatcctataagcttaaaagacatctccaatcccatgataaactgcgcccatttggatgccccgctgagggctgcgggaagtcctttacgacggtctacaacctgaaggcgcacatgaaaggacacgaacaggagaattcgtttaagtgcgaagtttgtgaagagtcttttccaacacaagccaagttatctgcccatcagagatctcacttcgaaccggagaggccttatcagtgcgccttctccggttgcaaaaagacattcatcactgtatccgctttgttcagccacaaccgagcccattttagggagcaggagcttttctcctgttcattcccaggttgttcaaaacagtatgataaagcctgtcgactaaagatccatctccggagccacactggtgagcgacctttcctgtgcgatttcgatgggtgcggctggaatttcacctctatgtcaaaactcctccgccataagcggaagcacgacgatgacagacgcttcatgtgtccagtcgaaggctgtggtaagtcatttacccgtgccgaacacctgaaggggcactctataactcatctgggcaccaagccattcgtttgccctgtggctgggtgctgtgccagattctctgcaaggtcttccctgtacatacatagtaaaaagcatctccaggacgtcgacacgtggaagtcccggtgtcctatctctagctgcaataagctgtttacaagtaagcactcaatgaagactcatatggtgaagaggcacaaggttgggcaggacctgctggcacagctggaggccgctaatagcctcacaccatcatcagaactgactagtcagagacaaaatgacttgtctgacgccgagatcgtatccctgttttcagatgtgccagattcaacctccgctgctctgctcgacaccgccttagtgaattccgggattctgacgattgacgtggccagtgtgagttcaacactggcaggacatctacccgcaaataacaataattcggtcgggcaggccgtcgacccaccttcattaatggccactagcgacccccctcaaagtttagacactagtctattttttggtactgcggctaccggctttcagcagagttcactgaacatggatgaggtttcatcggtgtctgttggtcccctggggtccttggactctctggcaatgaagaactcctcgccagagccccaagcattgacacccagcagcaagttgaccgtggacaccgatgcgctaactccttcttctacactgtgcgagaactccgtgtccgaactgttgacccctaccaaggcagagtggaatgtgcaccctgactcagatttctttggacaggaaggggaaacacagtttgggttccctaatgccgctggcaatcacggttctcagaaagaaactgacctgatcactgtcactggatcctcctttctggtctag

SEQ ID NO: 247956 - DNA, 2622 bp, Artificial Sequence
  Description of Artificial Sequence: Synthetic coding sequence
atggccagccggagaaagagcaccactccctgtatggtgctagcaagcgaacaagatcccgatttagaattgatctcagatttagatgagggcccaccagtacttacgccagtagaaaacactcgggctgagtctattagcagtgatgaagaggtgcacgagtccgttgacagcgacaatcagcagaacaagaaggtggaggggggttacgagtgtaaatattgtacttttcaaacgccagatttgaacatgtttacttttcacgtggatagtgaacatcccaatgttgtgttaaactcctcctatgtatgcgtggaatgcaatttcttgacgaaacggtacgacgcactcagtgagcacaacctgaaatatcaccccggagaagaaaatttcaaactgacgatggtgaagcgcaataaccaaactattttcgagcagacgatcaatgaccttacatttgatggttccttcgtaaaagaggaaaatgcagagcaggccgagtccactgaggtgtcaagcagcgggattagtatcagcaagacgcccatcatgaaaatgatgaagaacaaagtggagaataaacggatcgccgtgcatcataactcagtagaagacgtcccggaagagaaggaaaacgaaattaagccagacagggaagagattgtggagaatccctcctcctccgcaagcgagagtaacacctcgacatccattgtgaacagaatccatcccagtactgcaagtacggtcgtcaccccagccgctgttctgcccggactcgcccaggtcattactgcagtctctgcacagcaaaacagcaaccttatccccaaagttctgataccggtgaacagcattccgacatataacgctgctctggataacaatccactgctacttaatacgtacaacaagttcccgtacccaaccatgtctgaaattaccgtactgtctgctcaagctaaatacaccgaggaacagattaagatctggttctctgcccagagactaaaacacggcgtgagctggacgcccgaagaggtcgaagaagccaggcgaaagcaatttaacgggacagtgcacacagtgcctcaaactattaccgtcatccccacacacatttcgaccgggtctaatggcctgccatcaattctgcagacctgccagatcgttggccagccaggcctcgttctcacccaggttgcaggcacaaatacactcccagttacggcacctattgctctaactgtagctggcgtgccgtcacagaataatatccaaaaatcgcaggtcccagccgctcagcccacagccgagaccaagcccgcaaccgcagccgtaccgacctcccagtccgttaaacatgagaccgcgcttgtgaatcctgattcttttgggatccgcgcaaaaaaaactaaagaacaactcgctgagcttaaggtatcatacttaaaaaaccagttcccgcatgattcagaaatcatcagattaatgaaaattacgggcctgacgaaaggggagatcaaaaagtggttctcagatacgcgttacaaccagcgaaacagcaagtccaatcagtgcctgcatctcaataacgactctagcaccacaattattatcgacagcagcgatgaaacgaccgagagccccaccgtgggaacagcgcagccaaagcagagctggaatcctttcccggatttcacccctcaaaaatttaaggagaaaaccgcagaacagttgagggttcttcaggcctcctttctcaactccagcgtgctgacggacgaggaactgaatcgactgcgcgcacagacaaaactgaccagaagagagattgacgcctggttcaccgagaaaaaaaaatccaaagcgctaaaagaggagaaaatggagatagacgaatccaacgctgggtcaagcaaagaggaggccggtgagacctcgcccgctgacgagagcggagcgccaaaatctggtagtacgggaaaaatttgtaaaaagactcccgagcagcttcatatgctcaaatcagccttcgttcgcacacaatggccttctccagaggaatacgataagctggcgaaggaatctggcctcgcgaggacagacatagtgtcttggtttggggacacacgctacgcgtggaagaacggtaacctcaagtggtattattactatcaaagcgccaattcctccagcatgaatggcctgagcagtctgagaaaacgcggacggggacgtcctaagggccgtggccgtggaaggcctagaggtcggcctagaggctccaagagaattaacaactgggacaggggacccagtttgataaaattcaagaccggaacagccatcctaaaagattattatttgaaacacaagtttcttaacgagcaggatctggacgaactggtgaacaagagccacatggggtacgaacaggtaagagaatggtttgctgagcgtcagaggcgatctgagctgggcattgaactctttgaggaaaacgaggaggaggacgaggtgattgacgaccaagaggaagacgaggaggaaaccgatgactctgatacctgggagccaccgaggcatgtgaaaaggaaattatcgaagtcagatgactag

SEQ ID NO: 247957 - DNA, 2622 bp, Artificial Sequence
  Description of Artificial Sequence: Synthetic coding sequence
atggcttctaggcgaaagtccacaacgccctgtatggttctggcttcagaacaggacccagacctggagttgatcagcgatttggatgaaggccctcctgttcttaccccggtagaaaataccagggctgaaagtatttcctccgatgaggaagtccatgaatcggtggatagcgataatcagcagaacaaaaaggttgaaggcggatatgagtgtaagtactgcacattccagactcccgatttgaacatgttcacattccacgtggattccgaacatcccaacgtagtactgaactcctcatatgtttgcgttgagtgcaatttcttaactaagcggtatgatgccttatccgagcacaacttaaagtaccaccccggtgaggaaaacttcaagctgacaatggtcaagagaaacaatcaaactatcttcgagcagacgatcaatgatttaacttttgacggcagcttcgtgaaggaagaaaacgcagaacaggccgagagtaccgaagtgagctcttcgggcatctcaatatctaagacccctatcatgaaaatgatgaagaacaaagtggagaacaagcgaatcgccgttcatcataacagtgtggaggacgtgcccgaagagaaagaaaacgaaatcaagcctgaccgcgaagagattgtcgaaaatccgtcatccagtgcctcggagtcaaacacctccacaagcatagtgaaccgcatacaccccagcactgctagtactgtggtcaccccagccgctgtattgcccggtttagcacaggttataacagctgtttccgcgcaacagaactccaacctgatccctaaggtcctgatccccgtaaactccattcccacttacaacgcggctctggacaacaaccccttgctcctcaatacctacaataaatttccatatcctacgatgtcagaaattaccgtgctcagcgcccaggcaaaatacacagaggagcagatcaaaatttggttttctgcccagcgattgaagcatggggtgagctggacacccgaagaggtggaagaagcaagacggaagcagttcaatggaacagttcatacagtgccccagacaattaccgtcatccctacccacatcagcactggcagcaacggcctgccttctattttacagacgtgtcaaatcgtaggtcagcccggactggtcctgacacaagtcgctggcaccaacaccctgcctgtcacggcgccaattgcactgacggtagccggagtgcccagtcagaataacattcagaagagccaggtaccagctgcccaacctacagctgagactaagcctgcaacagctgcagttcctacctcccagtctgtcaagcatgaaacagccctggtaaaccctgattccttcggcatccgggcaaagaaaaccaaggagcagctcgccgagttgaaagtttcctacctgaaaaatcaatttccacatgactccgaaattatccggcttatgaagattacgggacttacaaagggagaaattaaaaagtggttttccgatacccgatacaaccaacgcaacagtaaatctaatcagtgtcttcacctgaacaatgattccagcacgaccatcattatcgactccagtgatgagacaaccgaaagcccaacagtcggaacagcacagccaaaacagtcatggaacccctttcctgacttcactcctcagaagttcaaggagaagactgccgagcagctcagagtgctacaggcttcctttcttaattctagcgtcttaacagatgaagaactgaaccgacttagagctcaaaccaaactgactagacgcgagatagacgcttggtttaccgaaaaaaaaaagagtaaagcactgaaagaagagaagatggagattgacgaatccaatgccggaagctctaaggaagaggccggagaaacttcacctgctgacgagagtggcgctcctaagagcggctccacaggcaagatctgcaagaagaccccggaacagctccatatgctgaagagtgcatttgtcaggactcagtggcccagcccggaagagtacgataaactcgctaaagagagtggtcttgcaaggaccgacatcgtgtcttggtttggggacacccgctatgcatggaagaacggaaacctgaagtggtactattattaccagagcgcaaactcctcttccatgaatggcttatcttctctacggaagcgcggacgcggtcgccctaagggtcgtggtagaggccgtcccaggggtcggcctcgcggtagcaagaggatcaataactgggataggggccctagtctcataaagtttaaaaccgggaccgccatccttaaggattactatcttaaacacaaatttctcaatgagcaagacctggacgagctcgtcaacaaatctcacatgggctacgagcaggtccgagagtggtttgcagaacgtcagaggcgctcggaactgggcatagagttgttcgaagagaacgaggaagaagatgaggtcatcgacgatcaggaggaggatgaggaggaaaccgacgacagcgatacctgggagccccctcgacatgttaagcggaagttatcgaagtccgatgattag

SEQ ID NO: 247958 - DNA, 2622 bp, Artificial Sequence
  Description of Artificial Sequence: Synthetic coding sequence
atggcgtccaggaggaagagcaccacaccgtgcatggtgttggcgagtgagcaggacccggatctcgagttaatttccgatctagatgaaggaccgcctgtccttactcccgtggagaacactagggcagagtcgatctcctcagacgaggaagtccacgaaagtgtggattctgataaccaacagaataaaaaggtggaaggcggatatgagtgcaagtattgtactttccagactcctgatttgaatatgtttacgttccacgtagactccgagcatccaaacgtggtactgaactctagttatgtctgtgtggagtgcaacttcctgacaaagagatatgacgcattgagcgagcataatctgaagtaccatcccggagaggaaaactttaagctgacaatggtaaaacgaaacaaccaaactatcttcgaacaaacaatcaatgatctaacttttgatggctcttttgttaaggaggaaaatgccgaacaggccgagagtaccgaggtaagcagctccggcatctcaatttccaaaacccccattatgaagatgatgaaaaataaagtggagaataaaaggatagctgttcatcacaactctgtggaggacgtcccggaagagaaagagaatgagatcaaacccgacagagaggagatcgtggagaaccccagttcctccgcctccgagtcaaacacctccacttctattgtgaaccgtatacaccctagcaccgcttccacagtggtcaccccagcagctgtgttacccggactggctcaggtgatcactgccgtatctgcccagcaaaactctaacttgattcccaaggtcctgattccagtcaattcaatccctacttataatgcagcactggataataaccctctgcttctcaatacatataataaatttccctaccctacaatgtccgaaatcactgtgctctctgcacaagcaaagtatactgaagaacagatcaaaatttggttttctgcccaacgcctgaaacatggagtgagttggactcctgaagaggtcgaggaagcacgaagaaaacagttcaatgggactgtccacaccgtgccccaaacaatcactgtcattccgactcacatctcaacgggatccaacgggctcccttcaattttacagacatgccagattgtgggacaacctggcttagttctcacacaagtagctggtacaaatacactgccagttacggcccctatcgctctgaccgttgctggcgtgccaagccagaacaacatacagaaatcacaggttccggcagcccaacccacggcagaaacgaagccagccacggccgcagtaccaacttcccagtcagtaaagcatgaaaccgcgctagtgaacccagattcattcggcattagagccaagaagacaaaggagcaactggctgaactcaaagtctcttatttaaaaaaccagttcccccacgacagcgagataatccggctcatgaagatcactggactgaccaaaggagagattaagaagtggttctctgacacccggtataatcaacgtaactcaaaatctaaccagtgtctgcacctgaacaacgacagctccaccaccatcatcattgattcctccgacgagacaaccgaaagcccaacggtggggactgcgcagcccaagcagagctggaatccctttccagatttcacaccacagaagttcaaggagaaaaccgcagaacaactgcgcgtgttgcaggcttcctttctgaactcctccgttttaactgacgaggagctcaaccgacttcgggctcagaccaagctgaccagacgagagatcgatgcgtggttcactgagaaaaaaaagtcaaaggccctgaaagaggagaagatggaaatagacgaatccaacgcagggagctccaaagaggaagccggagaaacatctccagcagatgaatctggggctcccaagagtgggtccaccggcaagatttgcaaaaagacccctgagcagcttcatatgctgaagtcggcctttgtgcgcacacagtggcccagcccggaggaatacgataaacttgcaaaagaaagcgggctggctcggacagatatagtatcctggtttggagacactcgttatgcatggaaaaatggcaatctgaaatggtactattactatcaatccgccaacagcagctccatgaatggattaagctcacttagaaagagaggcaggggccgacccaagggacggggtagggggagaccaaggggcaggcccagaggatccaagcggatcaacaactgggaccggggaccaagtttgatcaagttcaagacgggcaccgctattctgaaggattattatttaaagcataagtttctgaacgagcaagatctggatgagttggtgaataagtcacacatgggatatgaacaggttcgtgaatggtttgcagaaagacagagacgatcggaactagggattgaactgttcgaagagaacgaggaggaagatgaagttatcgacgaccaggaggaggacgaagaagaaactgacgactccgacacctgggaacccccacggcatgtgaagagaaaattaagcaagtccgacgattag

SEQ ID NO: 247959 - DNA, 1497 bp, Artificial Sequence
  Description of Artificial Sequence: Synthetic coding sequence
atggctagtaagcgcaagtccacaacaccttgcatgattccagtgaaaacagtggtcctgcaagacgctagtatggaagcccagcctgccgagacactgccagagggaccccaacaagatctccctcccgaggctagcgcagccagttccgaagctgctcagaacccttcctccacagatgggagtaccctggcgaatggacatcggagtacgctagatggatacttatactcttgcaagtactgtgacttccgaagccatgacatgacccagtttgtcggccacatgaattccgagcacacagatttcaacaaagatcctacatttgtctgttccggatgttcgttcctggctaagactcctgaagggctctcactacataatgcgacctgccattctggagaggctagcttcgtgtggaatgtcgccaagcctgacaaccatgtagtggtggaacagtccatacctgaaagtacttccacaccggacctggcgggtgagccaagcgccgaaggcgctgatggccaggcagaaattatcatcacgaaaactcccatcatgaaaatcatgaaaggcaaggccgaggctaagaagatacatactctcaaggaaaatgtgcccagccagcccgtgggcgaggctctgccgaagcttagcaccggagaaatggaagttcgagaaggcgatcattcatttatcaatggcgctgtgcccgtcagccaggcttcggccagcagtgccaagaacccacatgcggcaaatggaccacttattggcacagtacctgtcctgcccgctggtattgcccagtttctgtctctgcagcagcagccgcctgtgcacgcccaacaccacgtgcaccaaccactccccactgcaaaagcgctgcccaaggtaatgattcccctctcctccattccaacttacaatgccgcaatggatagcaactcctttctgaaaaacagctttcataaattcccctaccccacgaaagctgaactgtgctaccttaccgtggttacaaaataccctgaagaacagctcaaaatttggtttaccgcccaacgcttgaagcaggggatctcttggagtcccgaggaaatagaggacgctaggaagaaaatgttcaatacagtgatccagagtgtaccgcagccaacaattactgttctcaatacacctctcgtggcctccgctggaaatgtccagcacttaatccaggccgcactgcctggccacgtcgtcggacagcccgagggcactgggggtggtctgctcgtgacccagcctcttatggccaacggcctgcaggccaccagctctcctcttcccttaacagtcaccagcgtgcccaaacagcccggagtggccccaataaacacagtgtgcagcaatacaacatctgccgttaaggtcgtcaatgcagcccagtcactcctgactgcttgccccagtataacctcacaggcctttttagacgcttccatatacaaatag

SEQ ID NO: 247960 - DNA, 291 bp, Artificial Sequence
  Description of Artificial Sequence: Synthetic coding sequence
atggcttccaagcgaaaatccacaaccccttgtatgatccctgtaaagacagttgtgttgcaggatgccagcatggaagctcagcctgctgaaacccttcctgaaggccctcagcaagacctcccaccagaggcttctgcagccagttccgaggctgctcagaatcctagtagcactgacggaagcactcttgctaatggacacaggtcaactctggacgggtatctatactcatgtaaatactgcgacttccgctcacatgacatgacccagttcgtggggcatatgtag

SEQ ID NO: 247961 - DNA, 2244 bp, Artificial Sequence
  Description of Artificial Sequence: Synthetic coding sequence
atggaagtgcgtgaaggggatcacagctttatcaacggggctgtcccggtgtcccaggcctcagcgagtagcgctaagaacccccacgcagccaacggacctctcatcggcaccgtgcctgttctgcctgctggcatcgcccagttcctgagtcttcaacagcaaccccctgtccacgctcagcatcacgtgcaccagcccctaccaactgctaaagccctcccgaaagtgatgattcctctgtcatctatcccaacgtataacgctgctatggatagtaattcatttttgaagaattccttccataaattcccttatccaacgaaggcagagttgtgttacttaacggtggtaaccaagtatcccgaggagcagctcaagatctggtttacagcccaaagactgaaacaaggaatatcctggagtcctgaggagatagaggacgcccgaaagaagatgtttaacaccgtcatccagagcgtaccccagccaacaattacggtcctgaacacacctctggtggcaagcgctggtaatgtccagcatctgatccaggctgcactgcctggtcatgtagttggacaacctgaagggacaggcggagggttgctggtaacccagcccctgatggctaacgggcttcaggccactagttcgccactaccactgacagtgacgtcggttcccaaacagcccggtgttgctcccatcaatacagtttgcagtaacacaactagtgctgtgaaggtagttaatgctgcccagagcctcctgacagcatgtccttcaatcacaagccaggcctttcttgatgccagcatatacaaaaataaaaaaagccatgaacagctaagcgccttaaaagggtctttctgtaggaatcagttccctggccagagtgaggttgagcaccttacaaaggtcacggggctgtctacacgcgaggtccgaaaatggttttccgatcgcagataccactgtcggaatttgaagggttcaagggccatgattccaggggaccactctagcattatcatagacagcgtgcccgaggtgtcctttagccctagctccaaagtgcccgaggtgacctgtatccctactactgctaccctggccactcaccctagcgcaaaaaggcagagttggcaccagaccccagatttcactccgactaagtataaggagcgcgcacccgagcagctgcgcgctctggagtcatcttttgctcagaatccccttccgcttgacgaagaattagaccgactcaggagtgagaccaaaatgacccgacgggaaatcgactcttggttcagcgaaaggcgtaagaaagtgaatgctgaagaaactaaaaaagccgaagaaaacgcttcacaggaggaagaagaagcggcagaggacgaaggtggcgaggaggaccttgcttccgaattaagggtgtctggagagaatgggagtctggaaatgccctcttcccacattttggctgagagaaaagtgtctcctattaagatcaatctgaagaacttaagagtcaccgaagccaacgggagaaatgagattccgggactcggagcatgtgatcctgaggacgatgagagtaacaagctggcagagcagctgcccggaaaggtgtcctgcaaaaagacagctcagcaacgccacttgcttaggcaactcttcgtgcagacacagtggccgtccaaccaagactatgattctattatggcgcaaacaggtctaccgaggccagaagtggtgcggtggttcggggattctcgttatgccctcaagaacgggcaactgaagtggtacgaggattacaagagagggaattttccccctggcctccttgttattgctcctgggaacagagagctcctgcaggactactacatgacccacaaaatgttgtacgaagaggacctccagaatttgtgtgataaaacccagatgtcatcacaacaggtcaagcagtggttcgcagagaagatgggtgaggagaccagggctgtggcagacacaggatctgaggaccagggcccaggcaccggtgagctaaccgcagtgcacaagggcatgggggatacttatagcgaggtgagtgaaaatagtgaatcttgggagccacgcgtgccagaggcatcaagcgagccattcgatacgtcaagtcctcaggccggtagacagctggggtcatggtccctgagctcacagcccctccccagcctgctcacactatag

SEQ ID NO: 247962 - DNA, 2871 bp, Artificial Sequence
  Description of Artificial Sequence: Synthetic coding sequence
atggcctctaagcgcaagtcgaccactccatgcatgattccagtcaagactgtggtcctgcaggatgcctctatggaggcccaaccggctgaaaccttaccagaggggcctcaacaggatctgccacctgaggcgtctgccgcttcaagcgaggcagcacagaatccctcgtccactgacggctccaccctggccaatgggcaccgatcaaccctcgatggttacctatactcatgcaaatactgcgacttccgctcacacgatatgacacagttcgtggggcacatgaacagtgagcatacagattttaacaaagaccctacattcgtctgttccggctgttcttttctcgctaaaacccctgagggcctcagcctccataatgcaacctgtcactcaggcgaagcctccttcgtgtggaatgttgctaagcccgataatcacgtcgtggtggaacaatctattcccgaaagcacaagtacccctgatctggctggagagccttctgcggaaggagcggatggacaggccgagatcatcatcacgaagacaccaataatgaaaatcatgaagggtaaggctgaagctaaaaagattcatacattgaaggagaatgtgccaagccagcctgttggtgaggcattgccaaaactgtctactggggaaatggaagtgcgcgagggcgaccacagctttatcaacggagcagtaccggtgtctcaggcctccgcctcgtccgccaaaaatccccacgccgctaatggacctctgattggcactgtgcctgtcctgcctgccggaatcgcacaattcctatccttgcaacagcaaccaccagtccatgcccagcaccatgtgcatcagccactccccacagctaaggcacttccaaaggtcatgattccactgtcatccataccgacttataatgccgcaatggatagcaacagctttcttaagaatagcttccataaattcccctaccctacaaaggctgagttatgttacctaacggtggttacaaaatatcctgaggagcagctaaagatttggttcacggctcagcgtctcaagcagggcatcagctggtccccagaggagattgaagacgccaggaagaaaatgttcaacactgtcatccagtctgtgcctcagcctactattacagtgttgaacacacctctagtggcctctgcgggtaacgtacaacatctcatccaggcagccttgcccggacacgtggtcggccagcccgaagggaccggcggtgggctcctggtgacgcagcctctgatggccaatgggcttcaggcaacatcaagtccactgcctctgactgttacttctgttccaaagcaacctggggtggctcctatcaatacggtgtgttcaaatactacctctgccgttaaggtggtgaatgctgcccagtctttactgactgcctgtccctcgattacatctcaggccttcctggatgccagcatctataaaaataagaagtcccatgaacaactgagtgccctgaaaggttccttttgcagaaaccagttccctggtcaatccgaagtggagcatctcacgaaagttaccggattaagcacaagggaagtgcgaaagtggttctccgatagaagataccactgtcggaacttaaagggctcaagggcaatgattcctggggaccattcatctattattattgactcagtgccagaagtgagcttcagcccgtctagtaaggtgccagaggtgacctgcattccaaccactgctaccctggccacacacccctcggcaaaacgtcagagctggcaccagacgcctgactttacacccacaaagtacaaagagcgagctccagagcaacttcgcgcactggagtcttccttcgcacagaacccactgcccctggatgaggagctcgatagactgcggtctgagaccaaaatgactcggagggaaatagattcctggttttccgaacgaaggaagaaagtgaacgccgaggagacgaagaaggctgaagagaacgcctcccaggaggaagaggaagccgctgaagatgaagggggagaagaggacctcgcgtctgagctccgcgtctctggggagaacgggtctttggagatgccatcctcccatatactcgcagagagaaaggtaagtcccattaagatcaatttgaagaatcttcgcgtgacggaagccaacgggagaaatgaaattccaggcctgggagcatgtgatccagaggatgacgaatctaacaaacttgccgagcagcttccgggaaaagtgagctgcaagaagaccgctcagcagcgccatctgttacggcaactcttcgtgcagacacagtggcccagtaaccaagactacgatagcattatggcccagactgggttgccaaggcctgaggtggtgagatggtttggagactccagatatgctctgaagaatgggcagctaaaatggtacgaagattataaaaggggaaacttccccccagggctcctggtcatagcgcctgggaacagagagttgctccaggactattatatgacgcataagatgttatatgaagaggatctccagaatctctgcgataaaacacagatgagttcacagcaggtgaaacagtggtttgccgaaaagatgggggaagaaaccagagcggtggccgacacaggttcagaggatcaggggcctggaactggcgagctgacagcggtgcacaagggaatgggcgatacttactccgaggtgagcgagaattcagagagttgggagcctcgggtgccagaagcaagttctgaacctttcgatacctcttctccccaagccggtcgtcagctcgagactgactag

SEQ ID NO: 247963 - DNA, 141 bp, Artificial Sequence
  Description of Artificial Sequence: Synthetic coding sequence
atggcctcaaaacggaaatctacaactccttgcatgatcccagtgaaaacagtggtcctgcaggacgcgtccatggaagcccagcctgccgaaacactgcctgaaggaccccagcaagacttgccacctgaagcatcttag

SEQ ID NO: 247964 - DNA, 1497 bp, Artificial Sequence
  Description of Artificial Sequence: Synthetic coding sequence
atggcatccaaacgcaaaagcactaccccttgcatgatcccagttaagacggttgtcctgcaagacgccagcatggaggcccagccagctgaaacgctccccgagggtcctcagcaggatctgccccctgaagcatctgctgctagttcagaagctgcacagaacccttcctctaccgacggctccacgttagctaatgggcacaggtctacattggatggctacctgtatagctgtaagtattgtgacttcagatcgcatgatatgactcaattcgttggccacatgaattcggagcatacagacttcaacaaggatcccactttcgtgtgctctggatgttctttccttgccaagacgccagaagggcttagtctgcataacgccacctgccactcgggcgaagcgtcattcgtttggaatgtcgccaagcccgataaccacgttgtggtggagcagtccatccctgaatccacatctacacccgacctggccggtgaaccctcagctgaaggagctgacggtcaggcggagataatcattacaaaaacccccatcatgaagatcatgaagggaaaagcggaagcaaaaaaaatccatactctgaaggagaatgtgcccagccagcccgtgggtgaagcgctgcctaaattgtcaacaggagaaatggaagtcagagagggggaccacagtttcattaatggtgcagttccggtgtcacaggctagtgcttcaagcgccaagaacccccacgccgctaatggtccgctaattgggactgtccctgtgttaccagcaggaattgcccagttcctgtccctgcagcagcagccccctgtacacgctcagcaccacgttcatcagcctctacctacagcaaaagcattaccaaaggttatgatccctctctcctccatccctacctacaacgccgctatggatagtaactcattccttaaaaactctttccacaagtttccataccccacgaaagcggagctgtgctatttgacagtggtcacgaaataccccgaggaacagctcaaaatctggttcaccgcgcaacggcttaagcagggcatcagctggagtccagaagagattgaagacgctcgcaagaagatgttcaataccgttatccaaagtgttcctcaacccactataactgtgctcaacacccccctcgttgcttcagctgggaacgtacagcatctgatccaggccgcactacccggtcatgtagtggggcagcctgaagggacaggaggcggactcctcgtgacacagcctctcatggccaatggcctccaggcaacaagcagccccctgccactcactgtaaccagtgttcccaagcagcctggggtggcccctattaacaccgtctgctccaatacaacttcagctgtcaaagtggttaatgctgcccagagccttctcaccgcctgcccttctattacctctcaggcctttttagacgcatctatttacaagtag

SEQ ID NO: 247965 - DNA, 147 bp, Artificial Sequence
  Description of Artificial Sequence: Synthetic coding sequence
atggcaagtaagaggaagagcaccactccttgcatgatccccgtgaaaacagtagtactgcaggacgcttctatggaagcccaacctgctgagaccttaccagagggccctcaacaggacttacctcccgaggcatctgctgcctag

SEQ ID NO: 247966 - DNA, 273 bp, Artificial Sequence
  Description of Artificial Sequence: Synthetic coding sequence
atggcctccaaacgcaaaagcaccacaccgtgtatgatacccgtgaagactgtggttctgcaagatgcctcgatggaagcacagcctgcagagaccttgcctgaaggccctcagcaagatctgcccccagaagctagtgcagcgtcatctgaagcggcacagaacccgtccagcacagacgggtctaccctggccaatggtcatcgatctacactggatggctacctgtactcttgtaagtattgtgattttcgatcccatgacatgacgtag

SEQ ID NO: 247967 - DNA, 357 bp, Artificial Sequence
  Description of Artificial Sequence: Synthetic coding sequence
atggcgagcaaacgaaagtcaacaaccccctgtatgatcccggttaaaacggttgttcttcaagatgcttcaatggaggctcaaccagctgagacccttcccgaaggaccacaacaggatttgccacccgaggcatctgccgcttccagcgaggcggctcagaaccccagcagcaccgacgggtcaactctcgccaacggtcacagaagtacactcgacggctatctttacagctgcaaatattgtgactttcgaagccacgatatgacacaatttgtggggcatatgaactctgagcatacagattttaacaaagatcccacctttgtgtgctccggatgcagctttctcgcttag

SEQ ID NO: 247968 - DNA, 2871 bp, Artificial Sequence
  Description of Artificial Sequence: Synthetic coding sequence
atggcttctaaaagaaagtccaccacaccatgtatgatacccgtgaagacggtcgtcttgcaggacgcctccatggaggcacagcccgcagagacgcttcctgagggaccccaacaggatctgcccccagaggctagcgcggctagcagtgaggccgcacagaatccatcaagtacggatgggtctacactcgccaacggccatcgaagtacattggatgggtatctgtacagctgcaaatactgcgatttccgttcccatgacatgactcaattcgtaggccacatgaacagtgagcacaccgacttcaataaggacccaacctttgtgtgtagcgggtgtagcttcctggcgaagacaccagaaggtttatccttgcacaacgcaacatgccacagcggagaggccagcttcgtatggaatgtggcaaagcccgacaatcatgtggtcgtggagcagtccatccccgaatccacctctacaccggatcttgcaggcgagccctctgcagagggtgccgatgggcaggcagagatcatcattactaaaacacccatcatgaaaattatgaaagggaaagcagaggctaaaaaaatacatacgctcaaggaaaacgtaccctcacagccagtaggagaggccctcccaaaactgtctacaggcgagatggaagtgcgcgagggcgatcactctttcatcaatggcgctgttcccgtgtctcaggcatccgctagctccgctaagaatccgcacgccgctaatggacctcttatcggtacagtcccagtgcttcccgcaggcatcgcacaattcctatccctgcagcaacaacccccagtccatgcccagcaccacgttcaccagccactgccaactgccaaggcgttgcctaaggttatgatacctctctcatctattccgacgtacaatgccgctatggactcaaattcctttctgaaaaatagctttcacaagtttccttacccgacaaaagcagaactgtgctatctgaccgtggtgacaaaataccctgaggagcagctgaaaatatggtttacagcgcagcggctgaagcagggtatctcatggagcccagaggaaatcgaagatgcccgaaaaaagatgttcaacactgtgatacagagtgtccctcaacccaccatcaccgtcctcaataccccacttgtggcctctgcaggtaatgtgcagcacctcattcaggccgcactgccaggacatgtggttggacagcctgagggaaccggaggaggcctcctcgtgactcagcccttaatggcaaatgggctgcaagccacaagctctccgctgcccctaacagtcacctcagtgcctaagcagccaggcgttgctccaattaacaccgtgtgcagtaataccacatcagccgtcaaggtcgtcaacgcagcccagtccctcttgaccgcatgcccttcaatcacctctcaggcgtttctcgatgccagcatctacaaaaataagaaatcccacgagcagttaagtgcgctgaagggctcattctgccggaatcagtttcccggacagtctgaggtcgagcaccttaccaaggtcaccggcctctcgactcgagaggtccgcaaatggttcagtgataggcggtaccattgtcggaacttgaaaggaagccgagcaatgattccaggagatcattccagtatcattatcgacagtgtgcccgaggtttccttttctcctagcagtaaggtgcctgaagtgacatgtatccccacaacagctactctggccacccaccctagcgccaaacggcagagttggcatcagaccccagacttcaccccaaccaaatacaaggaaagagcgcctgaacaactgcgagcattggagagcagctttgctcagaacccccttccgctcgacgaggagcttgaccgactcagatcagagaccaagatgactaggagggaaatcgattcatggttcagcgagcgacggaagaaagtgaacgcagaggagacaaaaaaagccgaggagaacgcttcccaggaagaggaagaagctgcagaagatgagggtggtgaggaggatttggcttccgaacttcgcgttagcggtgagaatgggagcctggagatgcccagctcacacatacttgcagaaagaaaagtatcccccatcaagatcaacttgaagaacctgagagttaccgaggccaacggcagaaatgagattccaggcctaggtgcctgcgacccagaggatgatgagtctaacaaattagccgagcagctgcctggaaaagtcagctgcaaaaagaccgcccagcaacgccacttgctgcgccagctgtttgtgcagactcagtggccatctaaccaagattacgacagcataatggctcagaccgggctgcctcgccctgaggtcgtacggtggtttggagacagcaggtatgcactcaagaacggccagcttaagtggtatgaagactacaagcggggaaatttccctcctggcttactggtaattgctccaggcaatagggagctgctgcaagattattacatgacccacaaaatgctgtatgaagaagacctgcagaatctgtgtgacaagactcagatgtctagccagcaggttaaacagtggtttgccgagaagatgggcgaggaaaccagggcagtggctgacaccggcagcgaagaccagggccctggaaccggggaactcaccgccgtccataaggggatgggcgatacatactccgaggtgagcgaaaactcagaaagctgggaacctcgcgtgccagaggcctcatctgagccattcgatacctccagtccgcaggcgggtcgccagttggaaactgattag

SEQ ID NO: 247969 - DNA, 2910 bp, Artificial Sequence
  Description of Artificial Sequence: Synthetic coding sequence
atggctagcaagcggaaaagcactaccccctgcatgatccccgtgaagacggttgtgctccaggacgctagcatggaggcccagcctgccgaaacacttcccgaaggcccacagcaagatctcccccctgaggccagcgcagcctcatctgaagctgcccagaatccctcttcgacagatggatcgacactcgcaaacggccatagatccaccttggacggttacctgtactcctgcaagtattgtgacttccgcagccacgacatgactcaatttgtagggcacatgaacagcgaacataccgactttaataaagaccccaccttcgtctgtagcggttgttccttcctcgccaagactcccgaagggctctctctacataatgctacttgccactctggagaagcttctttcgtttggaatgttgcaaagccagacaatcacgtggtggtcgagcaatccattccagagtccacgtcaactcccgatctggctggggagccatccgccgagggcgctgatgggcaagccgaaatcatcattaccaagacccccataatgaaaattatgaagggcaaagctgaggcaaaaaaaattcacacactgaaagaaaatgtaccgtcccagcctgtcggcgaggcactccctaagctgtctacgggagagatggaagtacgagagggggatcacagctttataaacggtgccgttcctgtgtcacaggcctctgcatcgagtgcaaaaaacccccacgccgctaatggccctcttataggcacagttccagtgctgcccgcagggattgcccagtttctatccctccagcagcagccaccagtccatgcccagcatcacgtgcaccaaccccttcctacagcaaaggctttacccaaagttatgattccgctatctagtatccccacgtacaatgcagcaatggacagtaatagcttcttgaagaacagtttccacaaattcccttaccctacaaaggctgagctgtgctacctgacagtggtaacgaagtatccagaggaacagctgaagatctggtttacagcccagcgtttgaaacagggcatcagttggtcccctgaggagattgaggatgcgaggaaaaaaatgtttaataccgtaatccagagcgtgcctcagcccacaattaccgtactgaacacccctctcgtggcctcagccggaaacgttcagcacctgattcaggcagctctaccagggcacgtggttgggcagcctgaaggcaccgggggaggccttctcgtcacacaaccccttatggccaacggccttcaggccacaagctcccccctacccttgaccgtgacttcagtgcctaaacagcccggtgtggcaccaatcaacaccgtgtgttctaacaccacaagcgctgtcaaggtcgtaaacgcagcccaaagtctccttacggcatgtccctccatcacttcccaggcctttttagatgccagtatttataaaaacaaaaaaagccatgaacaactgagtgctctgaaaggctccttttgccgtaatcagtttcctgggcagtcagaagttgagcatctcacaaaagtaacagggctatctacacgcgaggtgagaaaatggttttccgaccgtagatatcactgtagaaacttgaagggcagcagagctatgatccccggagatcacagctccatcattattgactctgtgcccgaggtttccttcagtccgtccagtaaggtgccggaagtgacttgtattccaaccacggctacgcttgctacacatcccagcgctaaaaggcagtcatggcatcaaactcccgattttacccctacgaaatataaggagagagcaccagaacagttacgtgctctggaaagttcattcgcacaaaatcccttgcctctggatgaggaacttgatcgcctcagaagcgaaaccaaaatgactcgtcgagaaatcgattcctggttttccgagagaaggaagaaagtaaatgccgaggagaccaagaaagcagaagaaaacgcttcccaggaagaggaagaagcggctgaggatgagggcggagaagaagatttagcatctgaacttcgggttagcggcgaaaatggctctctggagatgccgagcagccatatactggctgagaggaaggtgagtccaatcaaaatcaatctcaagaacttaagagtgactgaggctaacgggaggaatgagattcccggactgggggcttgtgaccccgaggacgatgaatcaaataaactggcagagcagctgcctggtaaagtttcttgtaaaaagactgctcagcaacgtcatctcctaaggcagttgtttgtgcagacccagtggccctctaatcaggactatgatagcatcatggcccagacaggactgcctaggcccgaagtggtaaggtggttcggcgatagtaggtatgctctgaagaacggccagcttaagtggtatgaagactacaaaaggggcaactttcctcctggactgctggtgatcgccccagggaacagagagttgctacaggattactatatgactcataaaatgctgtacgaagaggacttacagaacctttgtgataaaacacagatgagcagccagcagaagcagaccgagtttgacctgatcaacgttaaggattggcccgtatgggagactgcgtgccatgtggaagagcccaaccccaccctgtgctgccacatgccattcccttgtcccgcagcaggacacctcggcgagctaccggagtcgagtcagactgcacagagtctgccactgccgtctgcgtgccctcctccctccaagcagcaagcccgatggggaagccaccagtttttcctgcctcagtgccgcacctttccactgccaagcaatggttag

SEQ ID NO: 247970 - DNA, 948 bp, Artificial Sequence
  Description of Artificial Sequence: Synthetic coding sequence
atggccagcaaacgcaagtcgactactccttgcatgatccccgtgaaaacagttgtgctccaggacgcatctatggaagcccaaccagcagagaccttgcccgagggaccacagcaggatcttccaccagaagcgagtgctgcgtcatccgaggccgctcagaatccgagtagtacggacggtagcacacttgcaaatggacacaggagcactctggatgggtacctgtacagctgcaaatattgtgacttcaggtcccacgatatgacccagtttgtgggacacatgaatagtgaacacaccgattttaataaggacccgaccttcgtctgctccggctgttcttttttggctaagacccccgaggggctctctctacacaatgctacctgccactctggggaggccagcttcgtgtggaacgtcgcaaaacccgacaaccacgtggtagtcgaacagtctattcccgaatccacatccactcctgatcttgcaggggagccctccgccgagggggctgatggtcaggccgaaattatcataacaaaaactccaatcatgaagatcatgaaaggaaaggccgaggctaagaagatccatacgctgaaggaaaacgtgccctcccagcctgtaggcgaagccttgcccaagctctctacgggcgagatggagaagcaaacggaatttgacttgataaacgtcaaagactggcctgtatgggagaccgcttgccacgtggaggaacctaatccaactctttgctgccacatgccgttcccctgccccgcagccggacacctgggggaactaccagagagttcccagaccgctcagagcctacccctcccatctgcctgcccccctccctcaaagcagcaggctagatggggcagccatcagttcttcctcccgcagtgcaggacctttccgcttccgtcaaatggatag

SEQ ID NO: 247971 - DNA, 501 bp, Artificial Sequence
  Description of Artificial Sequence: Synthetic coding sequence
atggcatcgaaacgtaaatccaccacaccttgtatgatcccagtgaaaaccgtcgtgctgcaggatgcatcaatggaagcgcagcccgctgagacactcccagaaggtcctcagcaggacctgccccctgaggcctcagcagccagctctgaggccgctcagaatccatccagcacggacggctcgaccctagccaatggccatagaagcactctggatggttatctttacagctgtaagtattgtgacttccgtagccacgatatgacacagttcgtgggacatatgaattccgaacacaccgattttaataaagatccaaccttcgtttgcagtggatgctcattcctggccaaaacaccagaggggctgagcctgcataacgccacttgccattccggggaagcaagcttcgtttggaacgttgctaaaccggacaatcatgttgtggtggaacagtcaatccccgagagtacttccacacccgatctggctgggtag

SEQ ID NO: 247972 - DNA, 2871 bp, Artificial Sequence
  Description of Artificial Sequence: Synthetic coding sequence
atggcatccaaacggaagtctacaactccttgcatgattccagtcaaaactgtggtcttacaagacgccagtatggaggctcagccagccgagacactgccagagggccctcagcaagaccttcccccagaggccagtgccgcttcgtctgaagcagcacagaacccctccagtaccgatgggtccacactagccaacggccacagatctacactggacggctacctgtattcatgtaagtattgtgactttcgatcgcacgatatgacccagtttgttgggcatatgaactcagaacacaccgattttaataaggatccgaccttcgtttgctctggatgctcctttcttgctaaaacccccgaaggactctctctacataatgctacttgccattccggggaggcgtccttcgtctggaatgtcgccaagcccgacaatcatgtggtggtggagcaaagcattcctgaatccacctcgactcccgacttggctggagaaccaagcgctgaaggtgccgatggacaggctgagattatcattacgaaaaccccaattatgaagataatgaaaggcaaggccgaggcaaagaagatccacactctgaaggagaatgtgccttcccaaccagtgggcgaggcccttccaaagctatccacaggcgaaatggaggtgcgagaaggtgaccattcctttatcaacggtgctgtgccagtgtctcaggcgagcgctagcagcgccaaaaatccacatgccgcaaatggtcctctgattggaactgtgcccgtgttgcccgctggaatcgctcagttcctctctttacagcagcagccacctgtccacgcccagcaccacgtgcatcagccactgcctactgcgaaagcactcccaaaagtaatgatcccccttagctctatccccacctacaatgctgcaatggatagcaactcattcctgaaaaattcttttcataagttcccctacccgactaaagcagaactatgttatttgactgtagtcactaaatatcctgaagagcagttaaagatctggttcacagctcagagactgaaacagggaatttcttggtcccccgaggagatagaggacgccagaaaaaaaatgtttaataccgttattcaatccgttccacagccaactataaccgtgcttaacacccctctggtggcctctgccggtaacgtccaacacctaatccaagccgctttgccaggacatgttgtcgggcagccagagggaacggggggaggtttgctcgtgacccagcccctgatggccaacggtctgcaggctacatcctcccctttgcccctgacggttacaagcgtgccaaagcagcccggagttgcgcctattaacacagtatgctcgaacaccacatcggccgtcaaggtcgtcaatgcagcccagtctctgcttactgcttgccccagcatcacttcgcaggctttccttgacgccagcatctataagaataagaaaagtcatgaacagttatctgcactaaagggaagcttttgtcgaaatcaattccctggccagtccgaagtggagcacctaactaaggtaacgggattatcaacaagggaggtcagaaaatggttttctgatcgaagatatcattgccgcaatttgaaaggctcaagggcgatgattccaggtgaccacagtagtattataatcgattccgtcccagaggtcagctttagtccctctagcaaggtgccggaagtcacctgtatccccaccactgccacactcgccacccacccttcagcgaagcggcagagctggcaccagacaccagactttacgcctacaaaatataaggaacgtgcgcctgagcagttacgagcactcgaatcatctttcgctcaaaatcctctcccactagatgaagaactggatcgacttcgcagcgagacaaagatgactcgtagggaaatagatagttggttctcagagagacgaaagaaggtaaacgctgaggagacaaagaaagccgaggagaatgctagccaggaggaggaggaagcggctgaagacgagggcggagaggaagacctggcttccgagctccgggtgtctggggaaaacggatccttagaaatgccctcatcccatattctggcggagaggaaagtgtctcctattaaaataaacctcaagaatcttcgtgtgacggaagcaaacggccgaaatgagatcccgggtctcggagcatgtgatccagaggatgacgagtccaataagctggctgaacaactgccaggaaaggtgtcttgtaagaaaactgcacaacagagacatttgctacgccagctctttgtgcaaacccagtggccgagcaatcaggactacgatagtataatggcacagaccggactgccaaggccggaagtcgtcagatggtttggggattcgagatacgccctgaagaatggtcagctcaaatggtatgaagattataagagaggcaattttcctccaggcctgctcgttattgccccagggaaccgcgagctgttgcaggattattacatgacacataaaatgctgtatgaggaggacctgcagaacctctgcgataaaactcaaatgagctctcagcaggtcaagcagtggtttgccgaaaagatgggagaggaaacccgcgctgtggccgatacagggtcggaagaccagggcccaggtactggagagctgacggcggtccacaagggcatgggggacacatactcggaggtgtctgaaaacagtgaaagctgggaacccagagttcctgaggcctcatcggaacctttcgataccagttcacctcaggccggtcgacagctggagaccgactag

SEQ ID NO: 247973 - DNA, 2871 bp, Artificial Sequence
  Description of Artificial Sequence: Synthetic coding sequence
atggcctccaaaagaaaatcaaccacaccgtgcatgatcccagtgaaaaccgtcgttctccaggacgcctcaatggaggctcagccagcggagacactgccagagggcccacagcaagatctgccacctgaagcaagcgcagcctcatctgaagcagctcagaacccctcttccacagatggatcaacacttgcaaatggacatcgctccactcttgatggatatctgtattcatgtaaatactgcgatttccgcagtcacgatatgactcagtttgtgggacacatgaacagcgagcataccgactttaacaaggatcctacattcgtttgtagcggatgttcatttttggccaagaccccagagggcctgtcactgcataacgccacctgccactctggagaagcgagctttgtgtggaatgtggccaaacctgataatcacgtggtggtcgagcagtcaatccccgagagcacctccacacctgatctcgccggagaaccatctgcagagggggctgatggacaggctgaaataattatcacaaaaacgcctataatgaagattatgaaaggtaaggccgaggctaagaagatacacaccctcaaggaaaatgttccgagccagcctgtaggcgaagccctgcccaagcttagcactggcgaaatggaggtgagagaaggagaccattctttcatcaacggggctgtgccagtgtcccaggcctccgctagctcagctaagaatcctcatgcagcaaatggcccacttatagggacggtccccgttctgcctgcaggcatcgcccagttcctctcattgcagcagcaacccccagtccacgcgcaacaccacgtccatcagccgcttcccacagcaaaagctctgccaaaggtcatgatccctcttagctccatcccaacatacaacgcagccatggatagcaattcatttttaaaaaatagctttcataaatttccgtaccctacaaaagctgaactctgctatcttacagtagttacaaaataccccgaagagcagcttaagatatggtttaccgcccagagattgaaacagggaatttcctggagcccagaggagatcgaggacgcacggaagaagatgttcaataccgttatccaaagcgttccccagcctacgatcactgtgctgaacacacccctcgtcgccagtgctggtaatgtgcagcaccttatccaggcggctcttccagggcacgtggtcggacagcccgaagggaccggcggaggcttgctcgttacccagcccttaatggctaacggactgcaggctaccagctcacccctccctttaacggtcacttctgtgccaaagcagcctggagtcgctccaatcaacactgtgtgttccaacactacgtccgccgttaaagttgtcaatgccgctcagtctttactcaccgcttgcccctcaattacttcccaagccttcctcgacgccagcatatacaagaataaaaagagccatgagcaactgtctgcattaaaaggatccttctgccgcaaccagtttccgggtcagtctgaggtcgagcacctgacaaaggttaccgggctgagcactcgcgaggttcgaaaatggttctctgatagacgataccactgtcgcaacctgaaaggctcacgcgcaatgatcccaggggatcacagctccatcataattgacagtgtccccgaggtgagcttcagcccatcttccaaggttccagaagtgacctgcatacctacaactgcaaccctggccactcacccatccgcaaagcgccagtcgtggcaccaaacacctgacttcaccccaaccaagtataaggagcgcgcacctgaacagcttcgggcattggaaagcagcttcgcgcagaatcctctgccgttggatgaggagctcgatcgattgcgatctgagacaaagatgactagacgagaaattgacagctggttctccgagcgacggaaaaaggtgaacgccgaagagaccaaaaaggctgaagaaaatgcatcgcaggaggaggaggaagcagccgaggacgaagggggagaggaggatctggcctctgagctgcgggtctctggggagaatggcagcttggaaatgccatcatctcacattctagccgagcgcaaggtttcacctatcaaaatcaaccttaagaacctccgcgtcaccgaggccaacgggcgaaatgaaattcctggcctgggagcgtgcgaccccgaggacgacgagtcgaacaagctggcggaacagctgcctgggaaagtgtcctgtaaaaaaactgcacagcaacggcacttgctgagacagcttttcgtgcaaacccagtggccctcaaaccaagactacgacagcatcatggcccagacagggctgcctaggcctgaggtggttagatggttcggcgattctaggtatgccctcaagaatggacagctcaaatggtacgaagattataaacgcggtaactttcctcccggactgttagtgatcgccccagggaacagggagttgctacaagattattacatgacccacaagatgttatacgaggaagaccttcagaatctgtgtgacaagacccagatgagctcacaacaggtgaaacaatggttcgccgagaagatgggggaagagacaagagctgtagccgacaccggctccgaagaccagggcccaggtacaggcgagctgaccgccgtacacaaggggatgggcgacacctattctgaggttagcgagaatagcgaaagctgggagccaagggtacctgaagcctcctctgaaccttttgacacttcaagcccgcaagccggtcggcaactggagaccgattag

SEQ ID NO: 247974 - DNA, 501 bp, Artificial Sequence
  Description of Artificial Sequence: Synthetic coding sequence
atggcttcgaagaggaaaagcactaccccatgcatgattcccgttaagacagtcgtacttcaggacgcttctatggaggcacagcccgcagaaacactgcccgaaggccctcagcaggacttgccccctgaagcctccgcggcttcctcagaggccgctcagaatccatcatcaacggacggcagcaccctggcaaacggccacaggtctacccttgatgggtacctgtatagctgtaagtactgcgactttcggagccatgatatgacacaattcgtcgggcacatgaactcagaacatactgacttcaacaaagatcccacctttgtctgttcgggatgctcttttttggctaaaacacccgagggattgagtctgcataacgccacctgccattcaggcgaggcaagctttgtctggaacgtggccaaacctgataatcatgttgtggtggaacagtccatacccgaatcaacatctactccagacctggctgggtag

SEQ ID NO: 247975 - DNA, 1428 bp, Artificial Sequence
  Description of Artificial Sequence: Synthetic coding sequence
atgggcatgtgggcatccttggatgcattgtgggagatgccggcagagaagcgaatctttggggctgtgcttttattctcttggacagtctacttgtgggagacgtttctggcccaacgccagcggaggatttataaaaccactacacatgtgcctcctgagctgggacagatcatggattctgagacgtttgagaaaagtcggctttaccagctggataagagcaccttctccttttggagtggcttgtactcggaaactgagggcacccttatcttactgtttggcggaattccctatctgtggcgactgtctggtcgattctgcgggtatgccggatttggcccagaatatgagattacgcaaagcctagtgtttctcttgctcgcgactctgttttctgcgttaacaggactgccctggtcactgtataacacattcgtaatagaggagaagcacggctttaatcagcagaccttgggattttttatgaaggacgctattaaaaagttcgtagtcacccagtgtatcctattgccagtcagctctctgctcctctacattatcaagattggcggagactacttctttatatatgcatggctgttcacccttgtggtgtccttggtgctcgtcaccatttatgccgactacattgccccactgtttgacaagttcacccccctcccggaaggaaaactgaaggaagagatcgaagttatggcaaagagtattgatttcccactgaccaaagtgtatgtggtggaaggcagcaaaagaagctcccactccaacgcgtatttctatggcttctttaaaaataaaaggatcgtgcttttcgacaccttgttggaagagtactctgtgctaaataaagatatacaagaggacagcggcatggagccacggaacgaggaggaaggtaacagcgaagagattaaggccaaggtaaaaaacaaaaagcaaggctgcaagaatgaagaggtgctggccgtgctaggtcacgaactgggccactggaaactcggccacactgtgaaaaacataatcatttctcagatgaattcattcttgtgcttctttctgtttgccgtgttgatcggtagaaaagagcttttcgccgcatttggcttttacgatagccagccaaccctgattggcttactgatcatctttcagtttatcttctccccatacaacgaggtactgtccttttgcttaacagtgctgagccgccgtttcgaattccaggccgacgcttttgccaagaagctaggaaaggccaaggatctgtattccgcgttaatcaaactcaataaagacaaccttggattccctgtctcagactggctgttttctatgtggcactattctcatccccctctgctggagagactgcaggccctgaagacaatgaaacagcattag

SEQ ID NO: 247976 - DNA, 1017 bp, Artificial Sequence
  Description of Artificial Sequence: Synthetic coding sequence
atgatgcgtacctgcgttctcctgagcgcggttctgtggtgtctaaccggtgtgcaatgcccacgctttactctgtttaataagaagggcttcatttacggcaagaccggccagcccgacaagatttatgtggagctgcatcagaactcacctgttcttatttgtatggattttaaactttcgaagaaggagattgttgatccaacttacctgtggatcggtcccaatgaaaaaactctgacaggcaacaaccggattaacattacagagaccgggcagttaatggtgaaggactttttagagcctttgagcgggttgtacacttgcactctgtcttacaagacggtcaaagcagagacgcaggaagaaaaaaccgtgaagaagaggtatgatttcatggtgttcgcataccgggagccggattactcataccagatggcagttcggtttacaacacggagctgcattggtcgttacaatgacgtattcttcagggtgctaaaaaagatactcgacagcctcataagcgacctcagctgccacgtgatcgagccgtcatacaagtgccatagtgtggagatccccgagcatggcttaatacatgaattatttatcgcatttcaggtaaacccttttgcgcctggttggaaaggcgcatgtaacggcagcgtcgactgcgaagacacgaccaatcataacatccttcaggcccgtgaccgaatagaagatttttttaggtctcaagcctacatcttttatcacaatttcaacaagacattacccgcaatgcatttcgtggaccacagtctgcaggttgttcgtttagacagctgccggcctgggttcgggaagaacgaacggctacattctaattgcgcctcatgttgtgtggtgtgcagtccagctacattttcgccagacgtaaacgtgacctgccagacttgtgtgtccgtcctgacttacggagcgaaaagctgcccacagacatctaacaagaaccaacaatacgaggattag

SEQ ID NO: 247977 - DNA, 951 bp, Artificial Sequence
  Description of Artificial Sequence: Synthetic coding sequence
atgatgcggacctgcgtccttctgtccgctgtgctgtggtgtctgaccggggataaaatttatgtagagttgcaccagaattcgcctgtgctgatttgtatggatttcaagttaagtaagaaggagattgtagacccaacgtatttgtggattgggccaaacgagaagactctgactggaaataaccgcataaacatcacagaaacgggccagctgatggtcaaagactttctcgaacctttgtcagggctctacacttgtaccctttcctacaaaactgttaaggccgagactcaggaggaaaagaccgtcaagaagaggtatgactttatggtcttcgcctacagagaacccgactatagctatcagatggcagttaggttcacaaccaggtcttgcatcggcaggtataacgacgtcttttttcgggtgctgaaaaaaatccttgattcacttatctcggacctcagttgccacgtgatcgagccaagctacaaatgccattcagtggagattccagagcacggccttatccacgagcttttcatagcatttcaggttaacccgttcgccccaggatggaaaggtgcatgtaacggttccgtggattgtgaggataccactaaccacaatatcctgcaggcccgtgaccggatagaagatttctttcgaagccaagcgtatattttttaccacaatttcaataaaacactgcctgcgatgcattttgtcgaccactcgctccaggtagtaaggctcgactcttgcagacctgggtttggaaagaacgagaggttgcactctaattgcgcctcctgttgtgttgtatgcagccctgctacattctctcctgacgtaaacgtcacttgccaaacatgcgtgtcagtcctcacttatggggcaaagtcctgcccccaaacgtctaataaaaatcagcagtatgaagattag

SEQ ID NO: 247978 - DNA, 1917 bp, Artificial Sequence
  Description of Artificial Sequence: Synthetic coding sequence
atggctggaggtagcgcaactacttgggggtaccctgtggcactgctgttactggtggctacgctggggctcggtcgctggttacaacccgaccctggactgcctggcctgcggcattcatacgattgcggcatcaagggcatgcagctgctggtattccccaggcccggtcagacgttaagattcaaggtcgtggatgagtttggaaatagatttgatgtgaacaattgctccatttgttaccactgggtgacctcccgcccacaggaaccagccgttttttccgcggattatcgcggatgccacgtgcttgaaaaagacggtcggtttcatctcagagtattcatggaagcggtacttcctaacggcagggtggacgtggcccaggacgcaactttgatttgtcctaaaccggacccttccagaaccctggactcccagctggctccccctgccatgttctctgttagcactcctcagacactgagttttctgcccactagcggacacacctctcaaggctccggtcacgccttcccatcgccacttgaccccggacattctagtgtccaccccacaccggctctgcccagccctggcccaggccctacgctggcgaccctggcccaaccgcactggggaacattagaacactgggatgtgaataagagagactacataggcactcacctgagccaggaacagtgtcaggttgcttccggccacctgccatgcatcgtgcggcgaacatccaaagaagcgtgtcaacaggcgggatgctgctacgacaacacccgggaggttccgtgctattacggcaacacagctacggtgcagtgctttagggacggttactttgtgcttgttgttagccaggaaatggccctcactcaccgaatcactttggccaatatccacctggcttatgcccctacttcatgctcccccactcagcacactgaggctttcgtggtcttctacttccccctgacccactgtggcacaacaatgcaagttgccggagaccagctgatttatgagaattggctggtatccgggatccacatccagaaaggcccacagggtagcatcacgcgagactctacttttcaactacatgttaggtgcgtttttaatgccagcgattttcttcccatacaggctagcatctttcctcccccttctccagcacccatgactcagcccggtcccctccgactggagctgcgcatcgctaaggatgagacattttccagttactacggggaggacgactatcccattgtaaggctgcttcgggagcccgtgcatgtggaagtgcggctgcttcagcgaaccgatccaaatctggtcctgctgcttcatcagtgctggggcgctcccagcgcaaatccttttcagcagccccagtggccaattctttccgacggatgtcctttcaaaggcgacagttatagaacccaaatggttgcgctagatggcgcaacccccttccagtctcactatcaaagattcacagtggctaccttcgccttgttagattcagggagccagagggccctccggggactggtgtacctgttctgttctacttcagcatgccacacaagtggcctcgaaacatgttcaaccgcttgcagtaccggcaccacacgacagcggaggtcctccgggcaccgcaatgatactgctaggccgcaggacatcgtttcttctcctggtcccgtgggattcgaggacagctacgggcaggaacccacactgggaccaacagactcgaatggaaacagttccttacggccattgctgtgggctgtgctcctcctcccagccgtggctctggttcttggtttcggcgttttcgttggcctgtctcagacctgggcccagaagctctgggaatcgaacaggcagtag

SEQ ID NO: 247979 - DNA, 993 bp, Artificial Sequence
  Description of Artificial Sequence: Synthetic coding sequence
atggcgttgacacataggatcaccctggctaacattcacctggcctacgctcccacttcgtgtagccccacccagcatacagaagcttttgtggtattttatttccccctcactcattgtggcaccaccatgcaggtggctggtgatcaacttatttatgagaactggcttgtctccggtatccacattcagaagggaccccaaggatctatcacaagagactccacttttcaattgcacgttcgatgtgtgttcaatgcaagtgattttctacccatccaggccagcatatttcccccaccaagtccggcaccgatgacgcagcccggtcctcttaggctagagctccggattgcgaaggatgagacattctcaagctactacggtgaggacgattatcccattgtgcgactgctcagagaaccagttcatgtagaggtgaggctgctgcagcgaacagatcccaacttagtgctattgctgcaccagtgctggggcgctcctagcgcaaacccgttccagcaaccccaatggccaatcctgagcgacggttgcccctttaagggcgactcataccggactcagatggtggcccttgacggagccacaccttttcaaagtcactatcagcggttcacggtggccacatttgcattactggatagcggatcccaacgcgctttacggggacttgtttatctgttctgtagtacgtccgcttgccatacctccgggctcgaaacttgtagtactgcatgcagcaccgggactaccaggcagagaaggtcaagcggacaccggaacgatactgcaaggccccaggatatcgtcagcagtcctggacctgtggggtttgaggactcttatggtcaagagccgaccttgggccctactgactcaaacgggaactccagcttacggcctcttttgtgggcagttctcctgctgccagcggtcgccctggtactcgggttcggggtattcgtcgcatag

SEQ ID NO: 247980 - DNA, 1317 bp, Artificial Sequence
  Description of Artificial Sequence: Synthetic coding sequence
atgggtcgcgtcgaggatggcggtaccacagaggaactagaagactgggacccgggtacaagcgcccttcctgcccctggtattaagcagggtcccagggagcagaccgggacaggaccattgtctcaaaagtgttgggagccagagcccgacgcgcctagtcaacccggacccgctttatggtccagggggagggcacgcacccaggctttagctggaggtagctcacttcagcagctcgatccagagaatacaggcttcatcggcgcagacactttcacaggcttagtgcattcgcatgagctcccattggacccggctaagctggacatgctggtggccctagcccagtcgaatgagcaggggcaagtatgctatcaggaattggtggacctcatcagttctaagaggtcatccagcttcaaaagagctatcgccaacggccagagagcgctcccacgagacggtccattagatgaacccggtctcggagtatataaacgattcgtgcgctacgtggcttatgaaatcttaccatgcgaggtggaccgacgctggtacttctacaggcaccgcagctgcccacctcccgtattcatggcatctgtcacccttgcccagattattgtattcctttgctacggcgctaggctaaacaaatgggtgctgcagacgtaccatccagagtacatgaaatccccactagtgtaccatcccggtcacagggcacgagcctggcggtttctcacatacatgttcatgcacgttggactcgaacagctggggtttaatgcattgctgcaactgatgatcggtgtgccgctggaaatggttcacgggctgctaagaatcagtctcctttatttggctggcgtgcttgcaggctctctcacagtgagtattacagatatgcgggcaccagttgtggggggatctggaggcgtgtacgcactgtgctccgctcatctcgccaacgttgtgatgaactgggcaggtatgagatgtccttacaaactgctgagaatggtgctcgccctcgtgtgtatgagctccgaggtgggcagagctgtgtggctcagatttagccctccgctgcctgcaagtggaccgcagccttcttttatggcccatctggccggagccgtcgtgggtgtttctatggggctgaccatcttacgcagttacgaggagaggttacgggatcagtgcgggtggtgggtggtactcctggcttacgggacctttctactgttcgcggtgttttggaatgtgttcgcctatgacttgctcggtgcgcacatcccaccccctccatag

SEQ ID NO: 247981 - DNA, 1122 bp, Artificial Sequence
  Description of Artificial Sequence: Synthetic coding sequence
atggtgatggtttctaaagacctgtttggcacagggaaactgatacgggctgctgatttgactctgggcccagaggcctgcgaacccctggtgtcaatggacactgaggatgtggtgagatttgaagttggcctgcacgagtgtggaaattctatgcaggtcacagatgacgccttggtatactctacattcttattacacgaccctagacccgttgggaatctgagcatcgttagaacgaaccgggcagagataccaattgaatgtcgctaccccaggcagggaaatgtttcgtctcaggctatccttcctacgtggctgccatttcggacaaccgtgttttccgaagaaaaactgacattctcactccgcctaatggaggaaaattggaacgctgaaaagcgcagcccaaccttccacctgggcgatgcagcgcatcttcaggcagagattcacacgggatctcatgtacccctacggctgttcgttgatcattgtgtcgccactccaacacctgaccaaaacgcaagcccttaccacacaatagtggacttccacgggtgcctggtggacgggttaactgatgcatcctcagcattcaaagtgcctaggcccggaccggatacattgcagttcacagttgacgtgttccacttcgcgaatgattcgcgtaacatgatctacattacttgtcatttgaaagtgacgcttgccgagcaggaccccgacgagctaaacaaagcatgttcctttagcaagccctccaattcctggtttcccgtggaagggtcagcagatatctgtcagtgctgtaacaagggcgactgcggcaccccaagtcacagtcgcagacagccacatgttatgagccagtggtcacggagcgcctcaagaaatcgtcggcacgtgaccgaggaggccgatgtcacggtgggtcccttgatattcttggatcgcagaggtgaccatgaagtggagcaatgggcacttccaagtgacacttcagtcgtgctgttaggcgtcggactcgccgttgtggtgtccctcacactgaccgccgtcatactggtcctgacgcggagatgtcgaaccgcctctcatcctgtgagtgcctccgagtag

SEQ ID NO: 247982 - DNA, 1275 bp, Artificial Sequence
  Description of Artificial Sequence: Synthetic coding sequence
atggagctttcctacaggctgttcatatgccttctcctgtggggcagtaccgagctgtgttatcctcagcccctgtggctgctccagggcggtgcttctcatccagaaacctcagttcaaccagtgctcgtcgagtgtcaggaggctacgctgatggtcatggtgtcaaaagacctgttcggtactggaaaacttatcagagccgcagatctgaccctcggtcctgaggcttgcgagcctctggtcagcatggatacagaggacgtcgtccggttcgaggtcggtttacacgaatgcggcaatagcatgcaggtgactgacgatgccctcgtgtacagcacctttcttctgcatgacccaagacccgtggggaatctttcaatcgtgaggaccaacagagcggagatccctattgagtgccggtatccaagacagggcaacgtgagcagtcaggctatcctgccaacctggctgcccttccggacaacagttttctctgaagagaagctgacctttagcttacgcttaatggaagaaaactggaacgcagagaagcgctcgccaactttccatttgggcgacgccgcacacttacaggctgagatccacacggggtctcacgtccccctcaggctgtttgtggaccattgtgtagctacgccaaccccagaccagaacgcgtcaccatatcacacaattgtggactttcatgggtgtctagttgacggcttgaccgatgcttccagcgccttcaaagtcccgaggcccggtccagacaccttgcagtttactgtagacgtgtttcactttgcaaacgactcccgcaatatgatttacatcacttgtcaccttaaagtgactctggccgaacaagatcccgacgagcttaacaaagcatgcagcttctcaaaaccaagcaactcctggtttccggtggaaggttcagcagatatatgtcagtgctgcaataagggcgactgcggcaccccatcccacagccgtcggcagcctcatgtaatgagccagtggtccaggtccgctagtaggaataggcggcacgtgaccgaggaggcagatgtgaccgtgggacctctgatattcctggaccggcgtggagaccacgaagtggagcagtgggcgctgccaagcgacacatccgttgtgctgttgggtgtcggcctggccgtcgtggtctccctgacactgacagctgtcatacttgtactcacccgccgatgccgtaccgcctcccaccctgtgagtgcttccgaatag

SEQ ID NO: 247983 - DNA, 1116 bp, Artificial Sequence
  Description of Artificial Sequence: Synthetic coding sequence
atggagctgtcctacagactctttatctgcttactgctctggggttctaccgagctttgctatccacagccactgtggctgctccagggaggagcttctcatccagagacctcagtccagcctgttttagtggagtgtcaggaggcaactctgatggtgatggtttcgaaggacctcttcggcactggcaagctcatacgtgccgcagatctgactctcgggccagaggcctgcgagccgctcgtgtcaatggatactgaagatgtcgtccgatttgaagttggcctgcacgaatgcggtaactccatgcaagtgaccgacgacgccctggtgtatagcacattcttactgcatgacccccgaccagtcggaaacctgtcaatcgtacgaaccaatcgcgcagaaatccccatagaatgtcggtacccgcgacagggcaatgtgagtagccaggccatccttcccacctggctgcctttccgtactacagtgttttcggaggaaaaactgacctttagcttgcgcttgatggaagagaactggaatgcagaaaagcggagcccgacgttccacttgggagacgctgcccacctccaagcagaaatacacaccggctctcacgttcccttgaggctttttgtagaccactgtgttgccacccccaccccagatcagaacgctagtccataccacactatcgtggactttcatgggtgcctcgtcgatggcctgacagacgccagctcagcttttaaagtccctcggcctgggccagatacgctgcagttcactgtcgacgtttttcatttcgccaatgattcccggaacatgatttacattacctgtcacttaaaagttacactggccgaacaggatccagatgagctgaataaagcgtgcagcttcagcaagccctctaattcctggtttccagtcgagggctccgctgacatatgccagtgttgcaacaagggtgattgcgggacaccatctcatagtcgtcgccaacctcatgtgatgagtcaatggtctcgctctgccagccgaaatcggaggcatgtcacagaggaagccgatgtgacagtcggaaccgatctgcctggccaggagggatag

SEQ ID NO: 247984 - DNA, 1623 bp, Artificial Sequence
  Description of Artificial Sequence: Synthetic coding sequence
atgtggcttctcaggtgtgtcctgttgtgcgtgagcctcagcctggcagtgagtggccagcataaaccagaagcaccagattactcatcagtcctccattgtggcccttggtcattccaattcgccgtcaatcttaaccaggaggctacctcgccacccgtgctgattgcctgggacaatcaagggctcctgcatgagctgcaaaatgatagcgactgtggcacgtggattcggaaggggcctggttcttcggtggtgctggaggccacttacagctcctgttacgttactgagtgggattcacattacattatgccggtgggggtggaaggcgctggcgcagccgaacataaagtcgtcaccgagaggaaactcctgaaatgccctatggacctgctggccagggacgctccggacaccgattggtgcgactccattcctgccagggatcgcctcccttgcgccccatctcccatttcccggggagactgtgaaggcctcggttgctgctactccagtgaagaagtcaacagctgctactatggcaataccgtgacgcttcactgcaccagggagggccacttttccatcgctgtgtcaaggaacgtaacctccccacccctgttgctggatagcgtgagactggcactgcgtaacgactccgcatgtaaccccgttatggctacgcaggccttcgtcctttttcagtttccatttacttcgtgcggaaccacaagacagataactggcgatcgggctgtgtacgaaaatgagctggtcgctactcgggacgtaaagaacggatcccggggtagcgttacgagggattctatcttccggctgcatgtaagttgttcgtactctgtatcttccaattccctccccatcaacgtgcaggtcttcactctgcccccaccattccccgagacacagccgggaccccttacactcgagttacaaatcgctaaagacaagaactatgggtcatactacggcgtaggcgattaccccgtcgtaaaattactcagggatcccatatatgtagaggtgtcaatattacaccgaactgatccatatctggggctgctcctgcagcagtgctgggccacccccagcactgacccccttagccagccacagtggcccattctggtgaagggctgcccctacatcggagacaattaccagacccagttgattcccgtacagaaggctctggacctgccttttccaagtcaccaccaacggttcagtatttttacattctcctttgttaatccaacagtggagaagcaagctctgaggggccctgtgcatctgcactgctctgtgagcgtctgccagccagccgagacccccagttgcgtcgtcacgtgccccgacctgagtagaaggcggaattttgacaacagctcacaaaacaccacggcctcggtcagcagcaaggggccaatgatcctgctccaggccaccaaagaccctcccgaaaagttacgggttcccgtggacagtaaagtcctctgggttgcgggactgtcaggcacattgatcctgggtgccctacttgtgagctatcttgcggtaaagaaacagaagtcctgcccagaccaaatgtgccagtag

SEQ ID NO: 247985 - DNA, 2340 bp, Artificial Sequence
  Description of Artificial Sequence: Synthetic coding sequence
atggcgtcatttgtgaccgaagtgttagcacatagtggccgtctggaaaaagaggacttggggaccaggatttccagacttacaagaagggtcgaagaaatcaagggcgaggtgtgtaatatgatttcaaaaaaatactccgagtttctcccttctatgcaaagtgcccagggtctgattacacaggttgataaactgagtgaagacattgatcttctaaagtctcggatcgaatccgaggtgcgaagagatctccatgtgagcactggggaattcaccgatctgaagcagcagcttgaacgggattctgtcgtgctcagcttgctcaaacaactacaagagttttctaccgccattgaggagtataactgtgccttgactgaaaaaaagtacgtgactggggctcagcgtctcgaagaggcgcaaaaatgtttaaagcttttaaagtcacgcaaatgctttgatttgaagattttgaagtctctttctatggagcttacaattcagaaacagaacatattgtatcatttaggggaggagtggcaaaaactcatcgtatggaagtttcctcctagtaaggatacatcttccttggaaagctaccttcaaacagagctccacttgtataccgaacagtcacacaaggaggagaaaacccccatgccgccaatttcatctgtgctgttagccttcagcgtcttgggtgaactgcatagtaaattgaagagctttggacagatgctgctgaaatacattttgaggccgcttgcctcttgtccgtcattgcatgccgtgatcgaatcgcagcctaatattgtcataatcagatttgagtcgattatgaccaacttggagtatccatctcccagcgaggtgttcacgaagataagattagtcctggaggttctgcagaagcaactgctagatctaccgctggatactgacttagaaaatgaaaagacttcaaccgttccgctggctgaaatgctaggcgacatgatctgggaggatttatccgaatgtctaatcaaaaattgtctcgtgtatagcatccccactaacagcagtaagcttcagcagtatgaggagatcatacagagcaccgaagaattcgagaatgcccttaaggagatgagattcctcaagggagataccaccgatctacttaaatacgccagaaacattaactcacactttgcaaacaagaagtgtcaggatgttatcgtcgctgcccgtaatctgatgactagcgagattcacaatacagtgaaaattattcccgacagcaaaatcaacgtacccgagctgcctaccccagacgaagataataaactggaagtccaaaaagtgtcaaacacacagtatcacgaggttatgaacctcgagcctgaaaacaccctggaccagcattcatttagcttgcccacttgtaggatcagcgagtccgtgaagaaattgatggaacttgcgtatcaaacgctgctggaagccaccacatcctctgaccagtgtgccgtgcagctcttctattccgtccgcaacatcttccatctgttccatgacgtcgtgccgacctatcacaaagaaaatttgcaaaaactcccccagcttgcagctattcaccacaataactgcatgtacatcgctcatcacttactgaccctcggtcatcagttccgactcaggctagccccaattctgtgtgatggcactgcaaccttcgtcgacttggtgcccggatttcgccgactgggaaccgaatgcttcctcgcccagatgagggcgcaaaagggcgagctgctggaacgcctgtcatcagccagaaatttcagtaatatggatgatgaggagaattactctgccgcttctaaagccgtgagacaagttctgcatcaactgaagcggcttggcatcgtgtggcaggacgtcttgccagtgaatatctactgcaaagcaatgggcactctgctgaacaccgccatttccgaggtaatcgggaagattaccgcacttgaagatataagtacagaggacggcgatagactttattctctttgcaagactgtcatggacgagggaccacaggtcttcgcacccctgtctgaggagtcaaagaataagaaataccaggaggaagttcccgtttatgtcccaaagtggatgccatttaaagagctgatgatgatgctccaagcctctctgcaggaaatcggtgatcgatgggcagatgggaagggtccactggctgctgctttcagcagttccgaagtaaaggcccttattagagccttgttccagaatacagagcggcgtgctgccgctctcgctaaaatcaagtag

SEQ ID NO: 247986 - DNA, 2019 bp, Artificial Sequence
  Description of Artificial Sequence: Synthetic coding sequence
atggcgtcttttgttaccgaggtgctagcacactctgggaggctggagaaagaggacttggggacccgaatcagtcgactaacgcgtcgcgtcgaagagatcaaaggagaggtttgtaacatgatctccaagaagtactcagagttcctgccttctatgcagagcgcgcaaggactgatcacacaggtagataaactatctgaggatatcgacttgttaaagtcccgaatcgagtctgaagtacggcgtgacttacacgtgtcaaccggtgaatttaccgacttaaagcaacagttagagcgggattcagtagtgctatccctgttaaaacagctccaagaattctcaaccgctatcgaggagtacaactgtgccctgaccgaaaaaaaatatgttactggggctcagcggctggaagaagcccagaagtgtctaaagttgctaaagtccagaaaatgtttcgatctcaaaatcctgaagtccttatctatggagttgaccatacagaaacaaaatatattgtaccacctcggcgaggaatggcagaagctgatcgtatggaagttcccacctagcaaggacaccagtagcctcgagtcctacttacagactgaactccacctttacaccgagcagtcccataaggaggagaaaacaccgatgccccctataagctctgtcctgctggcattctcagtactgggcgaattgcacagcaagctgaaaagcttcggacaaatgttactgaagtacatcctgcgtccattagcatcctgtccgtcgctacatgctgtcatcgaatctcaacctaacatcgtgataattcgatttgagagcataatgaccaacctggagtatccatcacccagcgaggttttcactaagatcaggctggttcttgaggtgttgcagaaacagcttttagatctacctctcgataccgatctggagaacgagaagacatccaccgttcccctggctgagatgcttggcgatatgatatgggaagacctcagtgagtgccttatcaagaactgcctagtgtactcaattcccactaattccagcaaactccagcaatatgaggaaatcattcagtcgaccgaggaatttgagaacgccctgaaggaaatgagatttctgaagggggataccactgatctcctgaaatacgcgaggaatatcaactcccatttcgccaataagaaatgccaggatgtcatagtggccgcacgcaatctcatgacgagcgagatccacaacacagtgaaaattataccagattctaagatcaatgttccagagttgcccaccccagatgaagataacaagttggaagtccaaaaggtctccaacacacagtaccatgaagtgatgaacctggaaccagaaaatacactggaccaacatagcttttcattaccaacttgcagaatttccgagtccgtaaagaagctcatggaacttgcgtatcagacattgctggaagctacgactagcagtgaccagtgcgcagtgcaactgttttattccgtgcgcaatattttccatctgttccacgacgtagtgcctacatatcacaaagaaaatctgcagaaactaccccagttagctgccatccaccacaacaactgcatgtacatcgcccaccacctgctgactctcggacatcagttccggcttcgcctggcacccatcctgtgtgatggtacagccaccttcgttgacctcgtaccaggattcagaaggttaggcaccgaatgcttcttagcccagatgcgagcccagaaaggggaattgctggagaggctctcttccgccaggaatttttctaacatggatgacgaagagaactactcagctgctagtaaggccgtgaggcaggtcctccatcaactgaagagactcgggatcgtgtggcaggatgtgttgcctgtcaatatttattgtaaggctatgggtaccttattgaataccgccatttcagaggttatcggaaaaattacagctctggaatag

SEQ ID NO: 247987 - DNA, 1776 bp, Artificial Sequence
  Description of Artificial Sequence: Synthetic coding sequence
atgtgggaaaggctgaattgcgcagccgaagatttttactcccgcctgcttcagaaattcaacgaggaaaagaaaggcatcaggaaagacccattcctctacgaggctgatgtgcaggtgcagctgatctcaaagggacagccaaaccccttaaagaacatcctgaatgaaaacgacattgtctttatcgtcgaaaaggtacccttagagaaggaagaaaccagccatattgaggagctgcagtctgaggaaactgcgatatccgattttagtacaggcgagaatgtgggtcccctggccctgccagtaggaaaagctcggcagctgatcgggttgtacaccatggcacacaatccgaatatgacccatctcaaaatcaacttacctgtgactgctctgcctccactctgggtccgatgtgattcatcagatccagaagggacctgctggctgggcgctgagctgattactactaacaacagcatcacaggaatcgttctttatgtcgtgtcatgcaaagctgacaaaaattactcggtcaacttggaaaacttaaagaacctccacaaaaagaggcatcatctcagtacagtcacgagcaaaggcttcgcgcagtacgagttgttcaagagctccgcactcgatgatacgattaccgcctcccaaacagccatagccctcgatatctcttggtctccggtggacgagattctgcagattccaccattgtcaagcacggccactctcaacattaaggtggaatccggcgagcccagaggcccattaaaccacctgtaccgggagttgaaatttctgctggtgctcgcggacgggctcagaaccggcgttactgagtggttggagcctcttgaagcgaaaagcgcggtcgaactcgttcaggagttcctcaacgacctgaataaactcgatgggttcggggattctactaagaaagacaccgaagtggaaactttaaaacacgatacagctgctgtggaccggtctgtgaaaaggctgttcaaagtccgcagcgatctggactttgccgaacagctgtggtgcaagatgagctcctcagtgatttcctaccaagacctggtgaagtgttttacgctgatcatacaaagcctacagcggggagatatacaaccctggctgcatagcggctctaactctctcctgtctaaacttattcaccagtcctaccatgggaccatggatactgtgagtttgagcggcacaatacccgtccagatgctgcttgagatcggcctggataagttgaagaaggactacatcagtttcttcatcggccaggagctggcttcccttaatcatctggagtactttatagctccttcagtcgacattcaggaacaggtgtaccgagtacaaaagcttcatcacattcttgagatattggtttcatgcatgccattcattaagagtcagcacgagctgctattctctcttacacagatttgcatcaagtattataaacagaatcctctggacgaacagcacatttttcaactcccggtcagaccaacggctgtgaaaaacctgtaccagtctgaaaaaccccagaaatggcgcgtcgagatttactctggccagaagaagattaaaactgtatggcaactgagcgacagtagccccattgaccatctgaacttccacaagcccgacttctctgagctgaccctgaatggctctctagaggaacggatattctttactaatatggtaacttgttctcaggtccacttcaagtag

SEQ ID NO: 247988 - DNA, 1434 bp, Artificial Sequence
  Description of Artificial Sequence: Synthetic coding sequence
atggcccataaccctaacatgacgcatctcaagatcaacctaccagttaccgcgcttcctccactctgggtgcggtgtgacagctctgatcctgagggcacatgctggctgggggcagaactcatcacaaccaataacagcatcacaggaatcgttctatatgtggtgagctgcaaggcggataaaaattactccgtgaacctcgagaatcttaaaaacctgcacaaaaaaaggcaccacctttcaaccgtgaccagcaaggggtttgcccagtacgagctgtttaaatccagcgctctggatgatactatcacagcctcgcagacagccattgccttggatatatcttggtccccagttgacgaaatcttacagattccacctctgagttctactgctacactgaacataaaggtcgagtcaggagaacctcggggacctctgaatcacttgtaccgcgaattaaagtttttactggttcttgcagacggattgaggacaggagtgacagagtggctcgaaccactcgaggcaaaatctgcggtggagcttgtccaggagttccttaatgatcttaacaagcttgatggcttcggggatagcacaaaaaaggacacagaagttgaaaccctgaaacatgatacagcggctgtggacaggtcagtgaagaggctgttcaaggttcgatctgacctagattttgctgaacagctctggtgtaagatgtccagttctgtcataagttatcaggacctggtcaagtgttttactttaataatccagtccttacagagaggtgacatacagccatggctgcatagtggatcaaacagcttactaagcaagctcatccaccagtcctaccacggaaccatggatacagtttccctgtcagggaccatccctgtgcaaatgttgctcgagattgggctagacaagctgaagaaggattatatttcttttttcattggccaggaacttgcctctctcaaccaccttgagtactttatcgcaccatccgtggatatccaagagcaggtgtacagagtgcagaagctacaccatattctggaaattctggtgtcttgcatgccattcataaagagtcagcacgaattgctgttttcactcacccagatttgtatcaagtactacaaacagaatcctttggatgagcagcatatttttcagcttcccgtgaggcccaccgctgttaaaaatctctaccagagcgagaaaccccagaagtggcgtgtcgagatttattctggtcaaaaaaagataaagactgtgtggcaactgtcagattcaagccctattgatcatctgaactttcataagcctgatttttctgaactgaccctgaacggaagtctcgaggagaggatctttttcactaatatggtcacatgttcgcaggtgcatttcaagtag

SEQ ID NO: 247989 - DNA, 1434 bp, Artificial Sequence
  Description of Artificial Sequence: Synthetic coding sequence
atggctcataaccccaacatgacccatttgaagataaatctgcctgtaactgcgctcccacctctgtgggttcgatgcgacagttctgatccagaaggaacttgttggctcggcgctgagctgatcacaactaacaacagcattacgggtatcgtcttatatgtcgtttcttgtaaagccgacaagaattactctgtcaacctagagaaccttaagaatcttcacaagaaaagacaccacctctcaactgtcacgtcaaagggctttgcccagtacgagctgtttaagtcatccgccctagacgataccatcacagcgagccagacagcgatcgcgctggacatcagctggtcccccgtagatgagatcttgcagatccctcctttgagttccacggcaacactcaacataaaagtcgaatcaggagagccccgaggaccacttaatcatttgtacagggagctgaagttccttttagtgcttgccgacggtttgaggacaggggtaactgagtggctagaaccattggaggcaaagtccgccgtagagcttgtgcaggagtttctaaacgacctgaacaaactggatgggttcggagacagtacaaagaaagatactgaagttgaaacgctgaaacacgacaccgccgctgtggaccgtagtgttaagaggctatttaaagtgagaagtgacctcgattttgccgaacagctgtggtgtaagatgtcaagctctgtgatctcttaccaggatcttgtgaagtgttttactttgataatccaatctttacagcggggtgacattcaaccttggcttcactctggttccaatagcctgctgtctaagctgatccatcagtcctatcacggaaccatggacaccgtgtctttgtctggaaccattcctgtgcagatgctgctagagatagggcttgacaagctgaagaaagactacatttcctttttcatcggacaggagctggctagcttaaaccacttggagtattttattgccccttctgtagatattcaggagcaagtgtatagggtccagaaactgcaccacatcctcgagatccttgtctcttgtatgccttttatcaaaagtcagcacgaactcctgttctctctgacacagatctgcatcaaatactataaacagaatcctctggatgaacagcatatattccaactaccagtacgccctaccgcagtgaaaaacctgtaccagtcagaaaaacctcaaaaatggcgcgtggagatatactcgggccagaagaaaattaagaccgtttggcagctgagtgatagttcaccaattgaccacttaaattttcacaagccggacttctccgagctcaccctgaatggctcgctggaggaacggatcttttttacgaacatggttacttgtagtcaggtccatttcaaatag

SEQ ID NO: 247990 - DNA, 1275 bp, Artificial Sequence
  Description of Artificial Sequence: Synthetic coding sequence
atggccgcacttggcgacgaagttctagatggctatgttttccccgcttgtcccccttgctcatatcgctatccataccctgccgctactaaaggcaagggggctgcaggcggatcatggcagcaacgcggaagaggctgcctgcctgcaagctccccctgtagtgccggagccgctagtctgtcattccctgggtgcggacggttgaccgccgcagaatactttgattcttaccaaagggagcgcctaatggccctgttggcacaagttggaccgggtctcggcccacgcgctcgcagagcagggtcctgcgacgtagcagtgcaagtgtcccctaggatcgacgccgcagtacagtgctccctcggtcggaggacgctgcagaggagagctagagacccagagtctccggctgggccaggagcggaagggaccacggggggaggatctttctcacagcagccctcaagacgaggcctggagcagggatcaccgcaaaacggcgcaccccgaccgatgcgcttccccaggaccgtggccgtgtattctcccttggctctgaggaggctcaccgcgttcttggagggtccgggaccagctgccggagaacagagaagtggggcaagcgatggtgagagggggccaccccctgctaggttgcagggccctgaggagggagaggtctggaccaagaaggccccacgacgccctcagagcgacgatgatggagaggcccaggccgcagtgagggcttcgtgggagcagcctgccgacgggcctgaattaccccctcgcgaagcccaggaaggcgaagcagcgcctcggagcgccttgcgatctccgggtcaacccccatctgcaggcagagcaagggacggcggtgatggcagagaggccgcagtcgccggagaaggtccttccccacgttcccccgagctgggcaaggagcggctacgattccagtttctggaacagaaatacggctattaccactgtaaggactgtaatatccgctgggagagtgcatacgtttggtgtgtgcaggggaccaacaaagtgtattttaagcaattttgtcgtacatgccagaagtcttataacccataccgggtggaggatatcacatgtcagtcttgcaaacagactagatgtagctgtcctgtaaagctgcggcacgtcgaccctaaacgccctcaccggcaggatctttgcggcagatgcaaaggcaagcgactgagctgcgattctaccttctcttttaaatatatcatttag

SEQ ID NO: 247991 - DNA, 1719 bp, Artificial Sequence
  Description of Artificial Sequence: Synthetic coding sequence
atggcagcgcctcgcccatcccccgctatttcagtatccgtgagtgcccctgccttctacgccccacagaaaaagttcgggccagtggtggcaccaaagcccaaggttaaccccttccgacctggcgactcagagccaccccctgcaccaggagcgcagcgggcacagatgggtcgcgtgggagagatccctccgccacctcccgaggattttccgcttccaccgcctccgttagccggtgacggagacgacgctgagggggctctgggtggagcgtttcctcctcctcctccaccaatcgaggagagttttcccccagctcctcttgaggaggaaatctttccttccccccctcccccaccagaggaagaaggcggaccagaagctcctatacctccacctccccagccgagagaaaaggtttctagcattgatcttgaaattgacagcctgagttctctacttgacgacatgaccaaaaacgatcctttcaaagcccgtgtatcctctggctatgtgcccccacctgtagctactcctttcagttcaaaatcttccacaaaacccgctgcgggtggcaccgcccctttgccaccctggaagagcccgagttcaagtcaaccgctccctcaggtccccgctcccgcacaatcccagacacaatttcatgtgcagccacaaccccagcctaagccccaggtgcagctgcacgtgcagtcacagacccaacctgtgagtctggccaatacccagccacgcggtcctccagcctcctctcccgctcccgctcccaagttctcacccgtgaccccgaaattcactccagtcgcatccaagttctcacccggagcacccggtgggtcaggctcccagccaaatcagaaactcggccaccctgaggctctgtcagctggaacggggagccctcagcccccaagctttacatatgctcagcaacgggaaaagccccgagtccaggaaaaacagcaccccgtgcccccacccgctcaaaatcaaaaccaagtgaggtcaccgggagctccaggtcccttaactctgaaggaagtggaggagctggaacaactgacccaacagctgatgcaagacatggagcacccccagaggcagaacgtggcggtgaacgagctttgcggccgttgtcatcaacctctggccagggcacagccagctgtccgagctctgggtcagttgttccacatagcgtgctttacgtgccaccagtgcgcgcagcagctgcagggccagcagttttacagccttgagggagctccttactgcgaaggctgctacaccgacaccctggaaaagtgcaacacatgtggagagccaatcactgatcgaatgctgcgtgccacagggaaagcgtaccaccctcattgcttcacttgtgtggtttgtgcccgtcccctggaaggcacttcttttattgtggatcaggccaaccggccacactgcgtgcctgactatcataagcaatacgccccacggtgcagtgtctgcagcgagccaattatgccagaaccaggcagggatgaaaccgtcagagtggttgcattggacaagaatttccatatgaagtgttataagtgtgaggattgcggtaaaccattgtctatcgaagccgatgacaatggatgctttcccttagacggccacgtgctctgcagaaaatgccacacagcacgggcacagacatag

SEQ ID NO: 247992 - DNA, 1623 bp, Artificial Sequence
  Description of Artificial Sequence: Synthetic coding sequence
gccgcaccccgtcctagcccagcaatctccgtgtcggtttcagccccagcattttacgccccacagaaaaaatttggtcccgttgtcgcaccaaagcccaaagtgaatccgtttagacctggcgatagcgagccgccaccagctcccggagcgcaaagggctcagatgggtcgggtaggagaaatcccaccccctccgcctgaagatttccctcttcctcctcccccactcgccggtgacggagacgatgcagagggtgctctaggcggagctttccctcccccaccaccacctatagaggaaagctttcccccagcccctctggaagaagagatttttccctctccacctcctccacctgaggaagaggggggacccgaggcgcctatacctccaccaccccaggtcagctctggctacgtgccgccaccggtggccactcctttctcatccaaatcctctacaaagccagcagccggaggtacggcccctctgcccccatggaaaagccctagtagcagccaaccattgcctcaagttcccgctccagcccagtctcagacccagttccatgttcagccacagccgcagcctaagccgcaggttcagctccacgtccaaagccagacccagcccgtgagtctggccaacacacagcctagggggccacctgcatcgtctccagccccagccccaaagttctcgcctgttacaccaaagttcactcctgttgccagtaagttctccccaggggctcccggaggttctggtagtcagccaaatcagaagctcggtcatcccgaagcactgtctgctggtaccggttctccacaacccccttcttttacatacgcccaacaaagagaaaagccccgtgtccaagaaaagcagcatccagtgccgccacccgcacagaatcagaatcaggtgaggtccccgggtgccccagggccactcaccctgaaagaggtggaagaactcgagcagttgactcagcagctcatgcaggacatggagcacccccaacggcagaacgtggctgtgaatgagctctgcggcagatgtcaccagcccctggctcgtgctcaacccgctgtcagagcactgggacaactgtttcacatagcttgtttcacttgtcatcaatgcgcccaacagctccaggggcagcaattttacagcttagagggagccccatattgcgagggctgttacaccgacactttggaaaagtgcaacacatgcggcgagcccatcactgatcggatgctgcgggcaaccggcaaggcttaccatccccattgctttacttgtgtggtctgtgcacgccctcttgagggcacaagttttatcgtcgaccaagcaaaccggccacactgcgtgcctgattaccacaaacagtatgctcccagatgcagcgtctgtagcgagccaattatgcccgagccgggacgcgatgagactgtgcgcgtggttgcgctcgataagaacttccatatgaaatgttacaagtgtgaagactgtggtaagcctctttccattgaagccgatgacaatggctgttttcctctcgatggccacgtgctctgcagaaagtgtcacacggcaagggcacagacctag

SEQ ID NO: 247993 - DNA, 1248 bp, Artificial Sequence
  Description of Artificial Sequence: Synthetic coding sequence
atgaccaagaacgatcctttcaaagctcgggtgagctcaggctatgttccacctcccgtggccacccctttctcgtctaagagctctaccaagcctgccgctgggggaacagccccactcccgccttggaaatcgccttcatcatctcagcctctaccacaggtccccgctccagcgcagtcccagacacagttccacgtacagccccagccccagccaaaaccccaggttcaactccatgtccaatcacagacccagccagtgagtttggccaacacgcagcctcgaggaccccctgcttctagtccagcccctgctcccaaattctcccctgttactcctaaatttaccccggttgcatccaagttctctccaggggctccaggcggaagtggcagccaacctaatcaaaaactgggtcatccagaagcgctgtcagccggaactggtagcccccagccgccaagctttacctacgcacagcaaagggaaaagccacgcgttcaggaaaaacaacaccccgttccccctcctgcccaaaatcagaaccaagtgcgttcaccaggagcacccggacccctgaccctcaaagaggttgaggaactcgaacagctaacccagcagcttatgcaggacatggagcacccacagcgtcagaacgttgcagtgaatgagttgtgtggcaggtgccatcagcctctggccagagcgcagccagccgtgcgcgctctgggtcagctgtttcacattgcctgttttacatgtcatcagtgtgcccagcagctgcaaggacagcaattctattccctggagggggctccatactgcgagggctgctacaccgatacactcgaaaaatgcaatacttgtggagaacccatcacggacagaatgttaagggccaccgggaaggcataccaccctcattgtttcacctgcgttgtttgtgctcgacccctggaagggacctccttcattgtggaccaggccaaccgacctcactgtgtgcctgactaccacaaacagtatgccccaaggtgctccgtctgcagcgagcctattatgccagagcccggtcgggacgaaactgtacgcgtggttgcactggataagaatttccatatgaaatgttataaatgtgaggattgtggaaagcccctgtcaattgaggctgatgacaatggctgttttcccctggatgggcacgtgctgtgccggaaatgtcatacagcaagggcacagacttag

SEQ ID NO: 247994 - DNA, 1458 bp, Artificial Sequence
  Description of Artificial Sequence: Synthetic coding sequence
atgggccgagtcggagaaattcctccaccccctccggaggacttcccgttgccaccaccacccctcgctggcgatggcgatgacgcagaaggggctctcggtggcgcattccctcctccgcctcctcccatcgaggaatcatttcccccagcccctcttgaggaagagatatttcccagccccccaccccctcccgaggaggagggcggaccggaagcacccataccgccacctcctcaagtgtcatccggctatgttcccccacccgttgcaaccccattctccagcaaatcctctactaagcccgctgcaggaggaacggcgccactgccaccctggaaaagcccttcctcgagccagccacttccccaagttccagcccctgcccagagtcagactcagttccacgtacagccccagccgcagccaaagccccaagtccaactccacgtccagtctcagacccaacccgtgtcgctggctaacacgcagccgagaggacctcctgctagctcgcccgctccagcacctaagttctctcccgtaacgcccaagtttaccccagtggctagcaaattcagtcctggcgcacccggagggtcaggtagtcagccgaaccagaagctaggccatcctgaggccctgagtgcaggcactggcagcccccaacccccaagcttcacctacgcccagcagcgcgagaagcctagggtgcaagagaaacaacacccagttcctccaccggctcagaatcagaaccaggtgcggtctcctggtgcaccagggccactgaccctcaaagaagtcgaagaactggaacagcttacgcagcagctcatgcaggacatggagcacccacagcgacaaaacgtggctgtaaacgaactgtgtgggaggtgtcaccagccactggccagggctcagccggctgtgcgcgctctgggtcagctgtttcatatcgcgtgctttacatgccaccagtgcgcgcagcagctgcagggccagcagttctattccctcgaaggggcaccatattgtgagggatgttatacggacaccctggaaaagtgtaacacgtgcggggagcctatcactgatcgaatgctccgcgcaacaggcaaggcctaccaccctcattgcttcacctgtgtagtctgcgctaggcccctggagggcacttctttcattgtcgatcaggccaaccggcctcattgcgtgccagactatcataaacagtacgcacccaggtgttcagtctgctcagaaccgatcatgcctgagcccggtagagatgagaccgtcagggtggtggccctggacaaaaacttccacatgaagtgctacaagtgtgaggattgcgggaaacctctgtcaattgaagcagacgacaacggctgcttcccgctcgatggccacgtcctctgccgcaagtgtcacaccgcgagggcccagacttag

SEQ ID NO: 247995 - DNA, 495 bp, Artificial Sequence
  Description of Artificial Sequence: Synthetic coding sequence
atggcggctccgcgaccatctccagcaatctccgtatccgtgagcgcgccagccttctatgccccacagaagaagtttgggcctgtggtcgcacccaaacctaaggtgaatcccttccggccaggagatagtgagccaccgccagctcctggggctcagagagcccagatggggagagtgggagaaattccaccaccacctcctgaggacttccctctcccgcctccccctctggcaggcgacggagacgatgctgagggagcgttgggcggagcatttcctccaccaccaccgccaattgaggagagctttccaccagcaccactcgaagaagagatctttcccagccctcctcctccaccggaagaagaaggcggtcccgaggctcctattccaccgccacctcagcccagagaaaaggtaagcagcatcgatctggagatcgacagtctcagcagcctgctggatgacatgaccaaaaatgatcccttctag

SEQ ID NO: 247996 - RNA, 1419 nt, Artificial Sequence
  Description of Artificial Sequence: Synthetic coding sequence
augaaauuccuuaucuucgcauuuuucgggggaguucaccuguuaucacuuuguucaggcaaagcuaucuguaaaaauggcaucagcaaacgaacauuugaggaaauuaaggaggaaauagccagcugcggggauguggccaaagcaaucauuaauuuagcagucuauggaaaagcgcagaaucgcaguuacgagcggcuagcccuuuuaguggauacuguggggccgcgccugucaggcaguaaaaauuuggagaaagccauacagauaauguaccaaaaucugcaacaggauggccuggagaaggugcaucuugagcccgugcggauuccucauugggagaggggagaggaaucugcgguuaugcuggagccccgcauucacaagauugccauacucggacugggcucaucuauaggaacaccccccgagggcauaacagccgaaguacuggucguuaccucauuugaugagcugcaacgaagagcaagugaagcaagaggcaagaucgucguguauaaccagcccuauaucaacuauucccggaccguacaguacagaacccagggugcuguggaagcagccaaggugggagcccucgcuucacugauucgcagcguagcauccuucaguauauauagcccccacacugguauucaggaguaucaggauggagugccuaagaucccaacugccuguauaaccguggaagaugcugagaugaugucgcggauggcaagccacgggauaaaaaucgugauccagcuaaagaugggggcaaagacguauccagacacagauucauuuaacacaguggcugaaauuaccggcucuaaguaccccgagcagguugugcucgugucagggcaucuggacucgugggaugugggacagggcgcaauggacgauggcggaggcgcauucauuagcugggaagcccuuucuuuaauaaaagaucuaggccugcggcccaaaaggacucuaaggcucgugcucuggacagcugaggaacaggguggcguaggggcuuuccaauacuaucagcugcacaaagucaacaucagcaauuacaguuuaguuauggagucagaugcuggaaccuuccugccuacuggacuucaauucaccggaagcgagaaagcccgagcuauuauggaagaagugaugucuuugcuccagccacuuaacaucacccagguucugucgcauggugagggaacggacaucaauuuuuggauucaagcuggcgugcccggcgcuagccuacuggaugaucuuuauaaauauuuuuucuuccaccauucacauggugauacuaugaccgugauggacccuaaacagaugaacgucgcugccgcugugugggcggugguuuccuacgucguggccgacauggaggagaugcugccccggucuuag

SEQ ID NO: 247997 - RNA, 5724 nt, Artificial Sequence
  Description of Artificial Sequence: Synthetic coding sequence
augcaauuugugucuugggccacauuacuuacucuccuugugagggaucucgcugaaaugggauccccagacgcugccgcggcugucagaaaggacaggcugcacccaaggcagguaaaacuccuagagacucugucggaauacgaaauuguaaguccaauucgcgucaacgcuuuaggugagcccuucccgacgaacgugcauuuuaagagaacccgccgcuccaucaauagcgccaccgauccuuggcccgcuuucgcaucgucuucgaguucaucaacuaguucccaagcccauuauagacugagcgcauucggacagcaguuccuguucaauuuaacugcuaacgcuggauuuaucgccccgcucuucacaguaacucugcuggggacaccggggguuaaccagacaaaauuuuacagcgaagaagaggcagagcuaaaacacuguuuuuacaaaggauacgugaauaccaauagcgaacacacggcugugauuuccuuaugcucagggaugcuuggaacuuuucgaucacacgauggggauuacuuuauugagcccuugcaaucaauggacgagcaagaggacgaagaagagcagaacaaaccccauaucauuuacaggaggucugcuccccaacgcgagcccucuacaggucggcacgcaugcgauaccucugaacacaaaaaucggcacucuaaggauaagaaaaaaaccagagcaaggaaguggggcgagaggaucaaucuggcaggcgacgucgcugccuuaaacuccgggcuggcaacugaagccuuuagcgccuacggaaacaagacggacaacacaagggagaagcggacacacagacggacuaaacgguuuuugucuuacccaagauucgucgaagugcuggugguggcggauaaucguauggugucauaucauggggaaaaccugcagcauuauauacugacacuuaugucuaucgacggacccucuauuaguuucaacgcucagacaacucugaagaauuuuugucaguggcagcauagcaagaauucacccggaggcauucaccaugacaccgccguucugcugacuagacaggacauuugcagagcccaugacaagugcgacacgcuaggccucgccgagcuggguacuauuugcgauccguauagaucgugcagcaucucugaggacuccgggcucagcaccgccuuuacgaucgcccacgaacuuggucauguguucaauaugccgcacgaugacaauaauaagugcaaggaggagggagugaaaaguccccagcaugugauggccccaacucugaacuuuuauacaaaccccuggauguggucaaaguguucaagaaaguacaucaccgaauuucucgacaccggcuacggcgaaugccugcuuaacgagccugagagcagaccguacccgcuucccguucagcucccagguauacuguauaacgucaacaagcagugcgaacucauauucggucccgguagccaggucugccccuauaugaugcagugucgccggcucuggugcaacaacgugaaugguguacauaaagggugccgaacgcagcacaccccuugggcagauggcaccgagugugaaccagguaagcauuguaaauacggcuucugcgugccuaaggagauggacgugcccgugacugacgggucauggggcagcuggucucccuucggcaccuguucacguacaugcggaggaggcaucaagacagccauccgugaaugcaaucggcccgagccuaagaacggcgggaaauacugcguuggacgaagaaugaaguucaaauccuguaacacggagcccugucugaagcagaagcgagauuuuagggaugagcagugugcucacuucgacggaaaacacuucaacauuaacggcuugcugccuaacguucgguggguuccuaaauauaguggcauucugaugaaggaucgcuguaagcuuuuuuguagaguggcugggaacacugcuuacuaccaacuacgggacagggugaucgauggcacucccuguggucaggauacuaacgacaucuguguccagggucugugcaggcaggcagggugugaccacgugcuuaacagcaaggcaagacgagacaaguguggaguaugcggaggcgauaauucgucuugcaagaccguggcagguacauuuaacaccgugcacuacggguauaacaccguugucaggaucccugcuggcgcuaccaauaucgauguucgccaacacuccuucucgggugagacagacgaugacaacuaccuggccuuaucaucuagcaagggcgaguuucuccugaauggcaacuucguaguaaccauggcgaaaagagaaauucggauaggaaacgccgugguagaguacucaggaucagaaacagcaguggagaggaucaauuccaccgauaggauagagcaggaacuacuguuacagguucuaucggugggcaaacucuauaacccugacgugcguuauagcuuuaauauuccgaucgaggacaagccacaacaguuuuauuggaacucacacgggccuuggcaggcuuguuccaaaccaugucagggagaacggaagcgcaaguugguuugcacuagagaaagcgaccaacucacuguaucagaucagcggugugaccgacugccccagccuggccauaucaccgagccuugcgguacugauugcgaccuacguuggcacguggcaucaagauccgaaugcucugcgcagugugggcuuggcuauaggacauuggacaucuacugcgccaaguacucacgucuugacggcaagaccgagaaagucgaugacgguuuuuguaguucccacccuaaaccaucaaaccgggaaaaaugcagcggugaauguaacacaggcggcuggcgcuacucagcguggaccgaaugcagcaagagcugugacggagguacacagcggcgcagagccauaugugucaauacucggaacgaugugcuagacgauucaaaaugcacacaccaggagaaggucacuauccagcggugcagugaguuucccugcccacaguggaagagcggcgacuggucugaaugccuggugaccugcggcaagggccauaaacauagacagguguggugccaguucggcgaagacagacucaacgaucgcaugugugaucccgagacaaagccgacuucgaugcagaccugccagcaaccagagugcgcuagcuggcaggcaggacccuggggccaauguucggugacgugcggccaaggcuaucaauugcgggccguuaaaugcauaauaggcacauacaugagugugguugaugauaacgauuguaaugccgcuacaaggccuacggauacucaggauugcgaacucccgagcugccacccaccucccgcagcaccagagacccgacgaucaaccuauagcgcacccagaacccaguggcguuuuggcuccuggacucccugcucugcuaccuguggcaaagguacuagaaugcgcuaugugucgugccgugacgagaaugggagcgucgcagaugaguccgcuugugcaacgcuuccgaggccaguugcaaaggaggaaugcuccguuaccccaugcgggcaguggaaggcguuagauuggaguucauguucugucacaugcggccagggacgggcuacgaggcaggugaugugcgucaauuauagcgaucacguuauagaccggagugagugugaucaggacuacauucccgaaacggaucaggacugcaguauguccccuuguccccagcggaccccugauuccggacuggcucagcaucccuuccaaaacgaagauuaccgcccucggagugcuucaccaucuagaacccacguguugggaggcaaucaguggcggacuggccccuggggggcuuguaguucuaccugcgcuggcggcagccagagacggguggugguaugucaagacgaaaacggauacacagcuaacgacuguguggaaagaaucaaaccggacgaacagagagcgugcgaaucagggcccugcccgcaaugggcauacggcaauuggggggaaugcaccaaacucugcgggggcgggauccggacacgacugguugugugccagcggaguaacggcgaacgcuucccggaucugucaugugaaauucuagauaagccgccagaucgcgagcaaugcaauacccacgcauguccccacgacgcugccuggagcacugguccuuggagcaguugcagcguguccugugggcggggccauaagcagcgaaacguguacugcauggcuaaggauggcucacaccuggaaagugacuacugcaaacaccuggcuaagccucauggacauaggaaaugccgggguggucguuguccaaaguggaaggcaggcgcuuggucacaaugcucuguuaguugcggacguggggugcagcagcgccacguggguugccaaauagggacccacaagaucgcacgcgaaaccgaaugcaauccauauacacgcccugaaucagaacgcgacugucaggguccuagaugcccguuguauacguggagagccgaagaguggcaggaauguaccaagacaugcggagagggaaguagauaccggaagguagucugcguggacgauaauaaaaaugaagugcauggugcuaggugcgaugugucaaagcggcccguggaucgugagucuuguagccugcaaccaugugaguaugucuggaucacgggugaauggucagaauguucggugacuugcggcaagggauacaaacaaagauuagugaguuguuccgaaauuuacaccggcaaagagaacuaugaguauuccuaccagaccacuaucaauuguccaggcacacaaccuccaucugugcauccaugcuaccugagagacuguccugucuccgcuacuuggcgugucggaaacugggggucaugcaguguuuccugcggagugggugucaugcagagguccguacagugccugacuaacgaggaccagcccucucaucuaugccauaccgaccugaagccugaggaaaggaaaaccuguagaaacguguacaacugugaacugccacagaacuguaaggagguuaaaagguugaaaggagccucugaagauggagaguauuuccucaugauacgagggaaguugcuuaaaaucuuuugugccggcaugcacuccgaucacccaaaggaauaugucacguuagugcacggcgacuccgagaacuuuuccgaagucuauggacaccgucugcacaacccaacagaguguccauacaacgggucaaggcgcgacgacugccagugccgaaaagacuacaccgcugcaggguucucuuccuuucagaagaucagaauagaucugaccaguaugcaaaucauuacuacagaccuccaguuugcuaggacaucugaaggccaccccguaccauucgcgacagcaggcgauugcuauagugccgccaagugcccucaggggagauuuuccauuaaucuguaugguaccgggcugucacugacugaaucggccagguggaucucacaaggcaauuacgcagugucggacauuaaaaagucccccgacgguacucgcguuguugguaaaugcggugguuauugcgggaaauguacuccgucaucuggaacuggccuugagguaagaguuuuguag

SEQ ID NO: 247998 - RNA, 2976 nt, Artificial Sequence
  Description of Artificial Sequence: Synthetic coding sequence
uaagagugcuccgcucagugcggccugggcuaccgaacccucgacaucuacugcgcaaaauacaguaggcuggacgggaaaacagaaaaaguagaugacggguucuguucgucucauccaaagccuucuaauagggagaagugcagcggcgagugcaauacagguggauggagguauucugcuuggaccgaauguuccaaaucuugcgaugguggcacucagagaaggagggccauuugcgugaacacgaggaaugacguccucgacgacucgaaauguacccaccaggagaaaguaacuauccagcguuguagugaguuucccugcccccaauggaagaguggagauugguccgagugucucgucaccugcgggaaaggucauaaacaccgccagguguggugccaguucggugaggaucgccugaacgaucgcaugugugaccccgaaaccaaacccacgagcaugcaaacaugucagcagccugaaugcgcuucuuggcaggccggaccuuggggacaguguucugugaccuguggacagggcuaucagcugcgcgcggucaaguguauaaucggaacguacaugucaguggucgaugauaaugacugcaacgcggccaccaggccuacagauacacaggauugugaauugccuucuugucacccaccaccagcagcaccggagacccgcaggagcacguacuccgcaccuaggacacaguggcgguuugguucuuggacuccguguagcgccaccugcgguaaaggaacaaggaugcgauacgugaguugucgagaugagaaugguuccguggccgaugagucugccugcgccacacugccucggcccguggcuaaggaggaguguucugucaccccuugcggccaguggaaagcacuagauuggaguagcuguucaguaacauguggccagggcagagcgaccagacaggugaugugugucaacuauucagaucauguaaucgaccggagugagugugaucaggacuauaucccugaaaccgaucaggauuguucaaugucccccugcccccagcggaccccagacucuggccuggcccagcacccauuccagaaugaggauuauagaccgagguccgcaagcccaagucggacgcacguacugggggguaaucaguggcggacugguccuuggggcgccugcuccagcaccugcgccggcgggucccagcguagagucguggucugccaagaugagaauggcuacacggcuaaugacugcguagaaaggauuaagccugacgagcagcgggcuugcgaaagcggucccuguccccagugggccuaugggaacuggggcgaaugcaccaaacugugcggcggcggaauucgaacucgacuggugguaugccagagaucaaauggggagcguuucccugaucuuucuugugaaauccuugauaaaccuccugacagggaacaguguaauacacaugccuguccucacgaugccgcgugguccaccgguccauggaguucaugcucuguaucuugcggacgcggccacaaacaaagaaacgucuauuguauggcaaaggaugguucacaccuugaguccgauuacugcaagcauuuagcuaaaccucauggacacaggaaaugccggggagggaggugcccgaaauggaaggcuggugcauggagccaguguuccgugaguuguggacgcggcgugcagcagcggcacguagguugucagaucggcacacacaagaucgcuagggagaccgagugcaaccccuauacaaggccugagucggaacgugacugucagggacccagaugccccuuguacacauggcgagcugaagaguggcaggagugcacaaaaaccugcggggagggaucaagauacagaaaggugguaugcguagacgauaacaaaaacgaaguccacggagcccgcugcgaugugucuaagcggccuguggauagggaaucuuguagcuugcagccuugugaauacgucuggaucacgggcgaauggucagaguguagcgucaccugcgguaaagguuacaagcagaggcucgugucaugcagcgaaauauacaccggcaaggagaauuacgaauacucauaucaaacuacuauaaacuguccaggcacucagccaccaucaguccacccuuguuaccuacgcgacuguccagucucggccaccuggcguguggggaacugggggagcugcagugugaguugcggagugggagugaugcagcgcagugugcagugccugaccaacgaggaucagccuagccaucugugccauaccgauuugaagccagaagaacggaagacuugucguaacgucuacaauugcgaacuuccccagaauuguaaagaagugaaaagauugaagggggcaagugaggauggagaauauuuccugaugauucgugguaagcugcucaaaauuuuuugcgccggcaugcacuccgaccaucccaaagaauaugucacucuagugcacggugacucugagaacuucucugaagucuacgggcaccgacuccauaaccccacugaaugccccuauaacggaucuaggcgagaugauugccagugcagaaaagacuauaccgccgccggcuucuccucuuuucaaaagauccgcauugaucuaacuagcaugcagaucauaacaacugaccuccaguuugcccggaccagcgaaggacaccccguuccuuucgcaacugcaggcgauugcuacucggcugccaaguguccucagggucgcuuuagcauuaaucuuuacggaacagguuuaucccuaacugagagcgcgcgcuggauuucccagggaaacuacgcugugucugacauaaagaaaagccccgacggaacucgcgugguuggcaaaugcggaggauauuguggcaaguguacaccaagcagugguacaggauuagaagugcgcgugcuguag

SEQ ID NO: 247999 - RNA, 5808 nt, Artificial Sequence
  Description of Artificial Sequence: Synthetic coding sequence
augcaguuugugucgugggccacacucuugacauuacugguacgggaccuugcagagaugggaagcccggacgcugcggcagcaguaaggaaggauagacuacauccacgacaggugaaauugcuggagacccucagcgaauaugaaauuguuucgccaauacggguaaaugcucugggcgaaccuuuucccacaaaugugcacuucaagcggacacggcguucaaucaauagcgcuaccgacccuuggcccgccuucgccuccucgucaagcuccaguacuucgucucaggcgcauuaucgucuuucugcauuuggacagcaguuuuuauucaaccugacagccaaugccgguuucauugcgccccucuucacugugacacucuugggcaccccuggugugaaccaaacuaaauuuuacagcgaggaagaggcagaacugaaacacugcuucuacaaggguuacguaaacaccaacagcgagcacaccgcagugauuucccuuuguucagguaugcuuggaacuuuucggagccaugauggagacuacuuuauugagccacuacaguccauggacgagcaggaggaugaggaagagcagaauaagccccauauuauuuaccgcagguccgcaccacaacgcgaacccucaacaggaagacacgccugugauacuagcgaacauaagaacaggcacucuaaggacaagaaaaagacaagggcgcgcaaauggggagagcgcauaaaucucgcaggggacguggcugcacuuaacaguggacuggcuacugaggcguucucugccuaugggaauaaaaccgacaauaccagagaaaagcggacccaccgucggacuaagcgcuuuuuaucuuacccacgauucgucgaggugcuagucguagcggacaauaggaugguaagcuaucacggugaaaaccuucagcacuacauccucacucugaugucuaucguugcgucgaucuacaaggaucccuccaucggcaaccuuaucaacauugugauuguuaaccucaucgucauucauaaugaacaggacggacccuccauaucguuuaacgcucagaccacacugaagaacuucugccaguggcagcauagcaagaauucgcccggaggaauccaccacgacacagccgugcuccucacccgacaggacauuugucgggcacacgacaagugugauacccugggacucgcugagcuugggaccaucugcgauccauaucguuccugcuccaucagcgaagauaguggcuugagcaccgcguuuaccauagcacaugagcugggccauguguuuaauaugccacaugacgauaacaauaaauguaaggaagaaggagugaaauccccccagcacguaauggccccuacccucaacuucuacacaaaccccuggauguggucuaagugcucccgaaaguauaucaccgaauuccuggacacggguuauggggagugucuucucaaugagccagaaucccgcccauacccccugccagugcagcuucccgguauucuguauaaugugaacaagcaaugugaacuaauauucggccccggaagccaggucugccccuacaugaugcagugcaggaggcuuugguguaauaauguuaaugguguucauaaggguugucggacgcagcacacgcccugggcugacggcacagagugugaaccuggcaagcauugcaaguacggauuuugcgugccgaaagaaauggacgugcccguuacagacggcagcuggggcucauggagcccuuuuggcacuugcucccggacuugcggagggggaaucaaaaccgccauuagagaauguaaccgcccugaacccaagaauggaggaaaguacugcguaggcaggcgcaugaaauucaaaucauguaauacggagccaugucugaaacagaagcgagacuuccgagacgagcagugcgcccacuucgacggcaagcacuuuaacaucaaugggcugcugccaaacgugcggugggugccuaaguauagcgggauacugaugaaggaucgguguaagcuguucuguagggucgccgggaauacggcauauuaucagcuuagggaucgcgucaucgaugggacacccugcggucaggauaccaacgacauuugcgugcagggccuuuguaggcaagcggggugcgaucacguccugaacagcaaagccaggagggacaaaugcggcgucugugggggugauaacucuuccuguaaaaccguggccggaacuuucaacaccguccacuauggcuacaauacagucguaaggauuccugccggggccaccaacaucgacgugcgacagcacucguuuucaggugagacagacgacgacaacuacuuagcauuguccaguuccaagggagaauuucuacugaauggaaacuucgugguaacaauggccaaaagggaaauccggaucgggaacgcaguaguggaguacagcggcagcgagacagccguugagcgcaucaauucgaccgaucgaauugagcaggaacuguugcugcagguucucucugucgggaagcuuuacaaccccgacguuagguauagcuucaauaucccuaucgaggauaaaccacagcaguucuacuggaauucucacggcccuuggcaggcgugcucuaaaccgugccagggggaacgcaaaagaaaacucguguguacuagagaaucagaccaacugaccguaagcgaucaaaggugugacaggcugccgcaaccgggacauauaacagagccauguggcacugauugugaccuaagauggcacguggccucccgaagcgagugcagcgcccaguguggacucggguauagaacccuagauauuuacugcgcaaaguacucacgccuggacggaaagaccgagaaggucgacgaugguuuuugcuccucccauccuaagccuuccaaccgcgagaaauguucuggagagugcaacacuggaggauggcgcuacucagccuggaccgaauguucaaagucgugugauggaggaacacagcgccggcgagccaucugcgugaacacccggaacgauguccuggaugacagcaaaugcacacaucaggaaaaggucacaauccaacggugcagugaguuuccuuguccccaguggaaauccggugacuggagugagugccuugucaccugugguaagggucacaagcacaggcaaguguggugccaauuuggagaagaucggcugaaugaccgcaugugugacccugagacuaagccuacuucuaugcagacgugccagcaacccgaaugcgccucuuggcaagcuggcccauggggccaaugcaguguuacuuguggccaaggguaccagcuaagagcgguuaaauguauuauuggaaccuauaugucagugguggaugauaaugacuguaaugcggcuacucggccaaccgacacucaggauugcgaguuacccucuugucaccccccgcccgcagcuccugaaacaagaagaagcacuuauagcgcaccacggacacaguggagguuuggcuccuggacaccauguucugccacaugugggaaagggacacggaugagguacgucucuugcagagaugagaauggcagcguugccgacgagagugccugcgccaccuugccaagaccuguggccaaggaagaguguaguguuacgcccuguggucaauggaaagcgcuugauuggucuucuugcucugugaccugcgggcagggccgggcaacccgucagguuaugugcguuaacuauucugaccaugugaucgaccgguccgagugcgaccaggauuauauccccgagacagaucaggacugcaguauguccccaugcccacagagaaccccugauuccggccuugcucagcauccauuucagaacgaggauuaucggccuaggucggcaagccccagccgcacucauguacugggugggaaucaauggcgaaccgguccuuggggggccugcuccuccacaugugcaggggggucucaacgccgggugguggugugucaggacgagaauggguacacggcgaacgacuguguggaacggaucaagccagaugagcaacgugcaugugaguccgggccauguccacagugggcauacgggaacuggggagaaugcacaaaauugugcggaggaggaauacggacccggcugguuguuugucagcgauccaauggugaacgguuccccgaccuguccugcgaaauucuugacaagccccccgaucgcgaacaauguaacacucaugcaugcccccaugacgcugcauggucaaccggcccuuggucuuccuguagugugucgugcggucgcggccacaagcagcguaauguuuacugcauggcuaaagauggaucucacuuggaaagcgacuacuguaagcaccuggcuaaaccccauggccauagaaagugccguggaggucggugcccuaaguggaaagccggugcuuggagccaaugcuccguguccugugggcgaggcgugcagcagaggcacguaggaugucagaucggaacucauaaaauagcucgcgagacggaauguaacccuuacacccgcccggaauccgagcgcgacugucagggcccucggugcccacuguacacauggagggcugaggaguggcaggaguguaccaaaacuuguggagaaggaucuagguaccggaaggucgugugcguggacgauaacaagaacgaaguucauggagccaggugcgacguuaguaagagaccaguugaccgggagucuugcagccugcaacccugcgaguauguguggaucacuggugaguggagcgagugcucggugacauguggcaaaggcuacaagcagcgacuggucuccuguucugagauuuacacuggcaaagagaacuacgaauacuccuaucagaccacuaucaauugucccgguacgcagcccccgucagugcaucccuguuaucugagggacuguccugugagcgcuacuuggcggguaggaaacuggggaucuuguaguguuagcuguggaguaggugugaugcagcgaagcgugcagugucucaccaacgaagaucagccaagccaccucugucacacugaucuuaaaccugaagagagaaagacuugucggaaugucuacaacugugaacugccacagaauugcaaagaggugaagaggcucaaaggggcuagcgaggacggggaguacuuuuugaugauacguggaaagcugcugaaaaucuuuugcgcagggaugcacuccgaucauccuaaagaguacgucacucugguccacggggacagcgagaacuuuagugaggucuauggucaucggcuccacaacccgacugaaugucccuacaauggcucacgucgggaugacugccagugccgcaaagacuauacugccgcaggauucucauccuuccagaaaaucagaaucgaccugacaucaaugcagauuaucaccacggaccuccaguuugcccggaccucugaaggucaucccguacccuuugcgacagccggcgacugcuacuccgcugccaaguguccucaggggagguucuccaucaaccuguauggcaccggcuuaucccucaccgagucagcuagauggaucagccaggguaacuacgcuguuucugacauuaagaaaucaccagauggcacucgcguaguuggcaaaugcgguggcuauuguggcaagugcacaccaagcaguggcacuggucuggagguuaggguauuguag

SEQ ID NO: 248000 - RNA, 2052 nt, Artificial Sequence
  Description of Artificial Sequence: Synthetic coding sequence
auggagugcugccgaagggccacccccgggaccuugcugcuuuuccucgccuuccuacucuuguccucucgcacugcuagaucugaggaggaucgcgauggccugugggaugccugggguccaugguccgaguguagccggacauguggcgggggcgccagcuauagucucaggcguugccucagcagcaagagcugcgaaggacguaacauaagguaccgcaccugcucaaauguggauuguccgccagaagcuggggauuuucgcgcucagcaguguagcgcccacaaugacgugaaacaccacggucaguucuacgagugguugcccgugagcaacgacccagauaauccaugcuccuuaaagugucaggcaaaagggaccacgcugguugucgaguuggccccaaaaguuuuggacgggaccaggugcuauaccgaguccuuagacauguguaucaguggacucugucaaaucguggggugcgaucaucagcuggggaguaccguuaaagaggacaacugcggagugugcaacggggauggaagcacuugcagauuggugcgcgggcaauacaagucccaacucagugcaacuaaaagugacgacaccguuguggccaucccauacggcucacggcacauacgccugguccugaagggaccggaccaucuuuaccucgaaaccaaaacacuucagggcacaaaaggagagaauucacucaguucuacagggacguuccucgucgauaacagcucaguugacuuccaaaaauucccugacaaggaaauuuugaggauggcgggcccucugacugcugauuuuauaguaaaaauuaggaacuccggcagugcagauaguacuguccaguucauauuuuaccaaccaaucauucauagauggagagaaacggacuucuuucccugcagcgccacguguggaggcggcuaccagcugacgagugcagaguguuacgaccucagaagcaaucgcguuguggccgaucaguauugucacuauuauccugagaacauuaaacccaagccuaagcugcaggagugcaaccuggauccaugcccugccagcgauggauauaaacagaucaugccguacgaccuuuaccacccacugccacgaugggaagcuacuccauggaccgcaugcuccaguucauguggaggggguauacagucccgugccgugaguuguguggaggaggacauucaaggacauguaacuuccguagaagaguggaaauguauguauaccccuaaaaugccuaucgcucagccuugcaacaucuucgacugccccaagugguuagcgcaggaguggagucccuguacagugaccugcggucagggcuuaagauaccgcgucguccuaugcauugaccauagaggaaugcauacaggcggcuguucuccuaagaccaagccucacaucaaagaggaaugcaucgucccaacuccauguuauaagcccaaggaaaaauugccaguggaggcuaagcugccaugguuuaagcaggcucaggaacucgaggagggagcggccguguccgaagaaccuaguuucauuccagaagccuggagcgcauguaccguaaccugcggcgugggaacccaaguuaggauugugaggugucaaguucuguuaaguuuuucacagucaguggcagaccugcccauugaugagugugagggccccaagcccgcuagccagagggccuguuacgcuggacccugcucuggagaaauuccggaauuuaaccccgacgaaacggauggccuguucggaggcuugcaagauuuugaugaacuuuacgacugggaauacgagggauucacaaaauguucugagucgugcggcggaggagugcaggaggccgugguuucgugccugaacaagcaaacaagagagccugcugaagagaaucuaugcguaacuagccggcggccuccucagcugcugaagucuugcaaucucgauccgugcccagcucggucaagcauagacagcgccuggaacgccugcaaugugcuuuguuag

SEQ ID NO: 248001 - RNA, 1401 nt, Artificial Sequence
  Description of Artificial Sequence: Synthetic coding sequence
augugccugaccgaugaaugggguuucuucuucuuuuuuuuucucggggucccugaagcugaagucaccugguuucgcaauaaaagcaaacuugggagcccacaccaucuucaugaaggaucauugcuucugacaaacgucucuaguucggaccagggacuguacucaugccgggccgccaacuugcauggugaauugacggaaaguacucaguuacugauuuuagauccuccacagguccccacacaacuggaagauauccgugcccugcuggcugcuaccggccccaaccucccuagcguucuaacaagcccacugggcacacagcucgucuuggacccggguaauucugcccugcucggcugcccuaucaagggccacccuguaccuaacauuacaugguuccacggcggccagccaauagucacugccaccgggcucacucaucacauccuggcagcuggccagauccuucagguggcuaaccugaguggcgguucccagggggaguuuucuugucucgcucagaacgaggcugguguauuaaugcagaaagcuucucugguuauucaggacuauuggugguccguagauagacucgccacaugcagcgcaucauguggaaauaggggcguucagcaaccaagguugaggugcuugcucaacuccacugagguaaauccugcacacugugccgggaagguccgacccgcgguccaaccuauugccuguaaccgccgggauugccccuccagguggauggugaccucauggagcgccugcacuaggagcugcggcggaggcguucagacccgcagagugacuugucaaaaacugaaagcgucuggcaucagcacuccagugucuaaugauaugugcacccaagucgcgaagcguccugucgauacccaggcgugcaaccagcaguugugcguggagugggcuuuuucaaguuggggccaauguaaugguccuugcauugguccccaccucgcuguccagcauagacaggucuuuugucaaacacgagacgguaucacauuaccaucagagcaguguucggcuuuaccacggcccgucuccacacagaacuguugguccgaagcaugcuccguccacuggagggugucucucuggacccuguguaccgccacuuguggcaauuacggauuucagucccgccgcguggaauguguacaugcccgaacuaauaaggccguaccagaacaccugugcucuugggggcccaggcccgccaacuggcagcgcuguaauauuacaccuugcgagaacauggagugccgggacacuacgagauacugcgagaaagugaagcaguugaaacucugccagcugagccaguucaagagcaggugcuguggaaccugugggaaagccuag

SEQ ID NO: 248002 - RNA, 1578 nt, Artificial Sequence
  Description of Artificial Sequence: Synthetic coding sequence
auggaguguuguagacgagcgacccccggaacacuucuucuuuuucucgccuuccuacuccuuucuaguagaacagcgcgcucagaagaggaucgcgauggauuaugggacgcuuggggccccuggucagaguguucgcgaaccuguggaggaggcgcuucauacagccuucguagaugccucuccagcaagucaugcgagggcaggaauauaagauaccggaccuguaguaauguggauugcccaccagaagccggggauuuuagggcccaacaauguagugcucauaacgauguuaaacaccacggacaguucuaugaguggcuucccguguccaaugauccugacaacccaugcucccucaagugccaagccaaggggaccacucuuguugucgaacuggcuccgaaggugcuggaugggacccgaugcuacaccgaaagccuugauauguguauuucuggacugugccagauugugggcugcgaccaccaguuaggcaguacagugaaagaagacaauugcggagugugcaauggcgacggaucaacuugccgucugguucgggggcaguacaagagucaacuauccgcaaccaaauccgacgauaccguggucgccauacccuacggaucucggcauauccggcuugugcugaaagguccagaccaccucuaucucgaaacaaagacccuucaaggcaccaagggcgagaacagucuuagcaguacugggacuuuccugguggacaacucaucuguugacuuucagaaauucccugauaaagaaauccugcguauggcggguccucucacagccgacuucaucguaaaaauuaggaacucggguucagcugacagcaccgugcaguucaucuuuuaucagccgauuauccaccgauggagagaaaccgauuucuuucccugcucugcuacaugcgggggcggcuaucaacuuacgucugcagaguguuacgaucuccggagcaauagagucguggcagaucaguauugucauuauuaucccgagaacauuaagcccaaaccuaaauuacaggaguguaauuuggaucccugcccagcuucugaugguuacaaacagauaaugcccuacgaucuauaucacccccuccccaggugggaagccacaccuuggacugccuguucaucaaguuguggcggugguauacagagcagagcugucagcugcguggaggaagauauccagggccacgugacuagugucgaagaguggaaguguauguauacuccuaagaugcccaucgcacaaccgugcaacauuuucgauugccccaaguggcucgcucaggaauggucaccuuguacuguuaccugcgggcagggccucagauaucgggugguccuguguauugaucacaggggcaugcacaccgguggcuguucuccaaaaaccaagccacauaucaaagaagagugcaucgugccuacucccuguuauaaacccaaggagaagcugcccguggaagcgaagcuuccuugguucaaacaggcccaagagcuugaggagggagccgccgucuccgaagaaccauccuag

SEQ ID NO: 248003 - RNA, 786 nt, Artificial Sequence
  Description of Artificial Sequence: Synthetic coding sequence
augugccucaccgaugaauggggcuucuucuuuuuuuuuuuccucggagugcccgaagccgaagucacuugguucagaaauaaaucuaaacucgguucuccacaucaccuacacgagggaucucuguuauugacaaacgucuccuccucagaccaaggacuguauucaugccgggcggccaaccuucacggagaacugacagagucaacucaacugcuuauucuggaccccccccaaguucccacacaauuggaggacauccgagcgcuauuggcagcaacuggucccaaccuacccuccgugcucacuucuccucucggaacgcagcuaguacuggaccccggcaacagcgcauuacugggcuguccuaucaagggacaucccgugcccaauaucacgugguuccacggggggcagccaauagugacugcaacaggucuuacgcaccacauucuagccgccgggcagaucuugcagguggcuaaccugucugguggaagccagggugaguuuucauguuuagcccagaacgaagcaggcgucuugaugcagaaagcuucucucgugauccaggauuacugguggucgguggaccgccuagcgacaugcuccgccucaugugggaacagaggcguccagcagcccagacugaggugcuugcucaacucuacggaaguuaauccagcccauugugccgggaagguccggcccgcuguacagccaauugcaugcaacaggcgcgauuguccuucgagagccaugggccuggccaguggucuuaccuag

SEQ ID NO: 248004 - RNA, 5289 nt, Artificial Sequence
  Description of Artificial Sequence: Synthetic coding sequence
auggaaugcugucgccgcgcaacaccgggcacauuacugcuauuccuggcuuuccugcugcuguccucuagaaccgcucgaagcgaggaggacagggacggucucugggaugcguggggcccuugguccgaauguucuagaacauguggaggcggcgcaucauacucauugcgucguugcuuguccucuaaaucgugugaaggcagaaacauacgguacagaacauguucuaacguagauugucccccugaagccggugacuuucgugcccagcagugcucggcccacaacgacgucaagcaccaugggcaauuuuaugaguggcucccugucagcaacgauccggacaauccgugcucccugaaaugucaggcgaagggcaccacucuuguggucgaauuggccccgaaggugcuggaugggacacgcuguuacacugaaagucucgacaugugcauuuccggauugugucaaauuguggguugugaucaucaguuggggagcaccguaaaagaggauaauuguggagucugcaacggcgacgguucgacaugcaggcuagugcgcggacaguacaaaucacagcucagugccacaaagagcgaugacacuguuguggccauccccuacggcagccgacauauucggcuuguucucaagggaccggaccaucuauaccuggaaacaaagacccuacagggaaccaagggggagaacagccugucaucgaccggaacguuccucguagacaauagcucggucgauuuucagaaguuccccgauaaggagauacugcgcauggccggcccccucaccgccgacuuuauugugaagaucaggaacagcggaucagccgauagcacugugcaguucauuuucuaccagccaauuauccacagauggagagagacagauuucuucccaugcagcgcaacuuguggcggaggguaccaacugaccagcgccgaaugcuaugaccugaggagcaauagagugguggccgaccaguauugccauuauuacccagaaaacaucaagccuaagcccaaacuccaggaaugcaaucuggacccuuguccugcuuccgaugguuacaaacagaucaugccauacgaccuguaucacccccuaccucgaugggaggcuacccccuggacagcaugcucuaguucuugcgggggcgguauccaaucccgagcagucuccuguguugaagaagacauucagggucacgugacaucuguggaagaauggaaauguauguacacgccgaagaugcccauagcacagccaugcaacaucuucgauuguccuaaaugguuggcccaggaaugguccccuuguaccguuacuugcgggcagggucuccgcuaccgcguuguccuuugcauugaucaccgaggcaugcacaccggaggguguucuccaaagacaaaaccccacauuaaggaggaaugcaucgugccuacuccaugcuacaagccgaaagagaaacugcccguggaagcuaagcugccuugguucaagcaggcccaggaacucgaggaaggagcggccguauccgaagaaccuucuuucauccccgaggcauggucagcuugcacuguuaccugcgggguaggcacccagguucguauugucagaugucaaguucuguugucuuucagccagagcgucgcagaucugccgauagaugagugcgagggaccaaagccagcgucgcagagagcguguuaugccgguccaugcucaggagagauuccagaguuuaaucccgacgaaacugauggucuauucgggggccuucaagacuuugacgagcucuacgacugggaguaugagggauucaccaaaugcucugaaucaugcggagggggcguccaggaagcugugguuucguguuuaaauaaacaaacaagagagcccgcugaagaaaacuugugugugaccagccgucgacccccccaguuguuaaaaagcugcaacuuggacccuuguccugcccggugggagaucggaaaauggucuccauguucucuaacuugcgggguuggacuucagacacgggacguuuuuugcucccaccuccugucuagagagaugaacgaaacagugauccucgcugacgaguugugucggcagccuaaaccaaguaccgugcaggccuguaaccgcuuuaauugcccacccgcgugguaccccgcucaguggcagccuuguucucgaaccuguggcgggggggugcagaagcgagagguauuguguaagcagagaauggccgaugguagcuuccuggaacuccccgaaaccuuuugcagcgcaagcaagccggcaugccaacaggcauguaaaaaggaugacugcccuucugaauggcuacugucugauuggaccgaguguuccacuuccuguggugaaggcacacagacuagaucugcuaucugucggaaaaugcuuaagacaggacuaucaacgguggugaauuccacucuuugccccccacuacccuucuccuccucgaucaggccuuguaugcuggccacaugugcaagaccaggaaggcccuccaccaagcauucgccccacaucgcggcugcucgaaaagucuacauccaaacaaggcgccagagaaagcuucauuucgucgugggcggguucgcauaccucuugccgaaaaccgcagucguacugagaugcccugcacgccgggugcgaaaaccgcucaucaccugggagaaggauggccagcaccuuauuagcucuacacauguaacggucgcgcccuuuggauaccuuaagauucaccgccuuaaaccuuccgaugcaggagucuacacauguagcgcugggcccgcccgcgaacauuuugucauuaagcugaucggaggcaaucgcaaguugguugcccggccuuugucaccuaggucugaggaagaaguacucgccgguaggaaggggggaccaaaagaggcacuccagacgcacaaacaccagaaugggaucuucagcaacgggaguaaagcagagaagaggggauuggcagccaaccccggcagccgcuacgacgaucuggugucucgauuacuggaacagggaggguggccaggcgagcuccucgcgaguugggaggcccaggauagcgcagaacguaauacuacaucagaagaagaucccggugccgagcaggugcuucugcaucuccccuucacgauggucacugaacagcgcagauuggacgauauucugggaaaucugucccagcagccagaggaacucagggaucuguacucaaagcaccuuguggcucagcucgcccaggaaaucuucaggagccauuuggaacaucaggauacacuucuaaagccaagugaacggagaacgagcccugucacgcucuccccucacaagcacgugagcggguucuccucuagccuaagaaccuccucuaccggagaugcgggcggcgggagccggaggccccacaggaaacccaccauucucagaaagauuucggcugcccagcagcugagugccuccgagguggucacgcaccugggccaaaccguugccuuggcgagcgggacacuuucuguucuucuccacugcgaagccauugggcaucccaggccuacaaucucaugggcccgaaauggggaggaaguccaguuuucagaucguauacuucugcaaccugacgauaguuugcagauucuggcacccguagaggccgacgugggcuuuuauacaugcaacgccaccaaugcucuagguuaugacucggugucaaucgcugucacccucgccgguaaaccgcucguaaagaccucuagaaugacagugauuaacacugaaaagcccgcuguuacaguggacaucggcaguacuauuaaaaccgugcagggcguuaacgucacuauuaauugccaagucgccggagugcccgaagccgaagucacuugguuccggaacaagucaaaguugggcagcccgcaccaccugcaugaggggucacugcuacugaccaaugugucuuccuccgaucagggccuguauagcugcagggcagcgaacuuacauggagagcugaccgaauccacucaacuccuuauccuggauccuccucagguucccacgcagcuggaagacauccgggcucuccuggcagcaaccgggcccaaucugccuagcguacugacaucaccccuaggcacucagcuagugcuugauccaggcaacucugcgcuguuggggugcccuaucaagggccaucccgugcccaauauuacaugguuccaugggggacagccuauugugacugcuaccggucugacccaccacauccuggccgcuggacagauccuccagguggcaaacuuaagcggggggucccagggggaguuuucaugcuuagcucagaaugaagcagguguguuaaugcagaaagccucucuggugauacaggacuauuggugguccguggacagguuggcuacuuguagugcauccugugggaauagaggggugcaacagccuagguuacguugucuguuaaacuccacagaggucaauccugcacacugcgcugggaaagucagaccagcagugcagccgauugccugcaaucgaagagacuguccguccagauggaugguaaccaguuggucagcuugcacaagguccuguggaggggggguacagacccgcagggugaccugucagaaacuuaaggcgucuggaauuucgacacccgugucaaacgauauguguacccagguugcaaaaagacccguagacacccaggccugcaaccagcaauuaugcguggaaugggccuuuaguuccuggggccaguguaacggaccguguauuggaccgcaccuggccguccaacaucgucagguauucugccagacucgagacgguauaacucugcccagugaacagugcucugcacuucccaggccuguuuccacacagaacuguugguccgaggcuugcucugugcacuggcgggucuccuuguggacucuguguacagccacauguggaaauuacggcuuucagagucgccguguggaauguguucacgcuaggacgaauaaagcagugccagaacaccuguguucaugggguccacggcccgcuaauuggcaaaggugcaacauaacaccuugcgaaaacauggagugcagagauacaacccgcuacugcgaaaaggugaagcaguuaaagcugugucagcucucccaauucaagucccguugcugcggaacaugcggcaaagcguag

SEQ ID NO: 248005 - RNA, 1320 nt, Artificial Sequence
  Description of Artificial Sequence: Synthetic coding sequence
auggaaugcugccgaagagccaccccugggacauugcuguuauuuuuggccuuccugcuccuuagcucucgaacugcccgauccgaagaggauagagauggcuuaugggaugccuggggcccauggagcgaauguucaagaacaugcggcggaggcgcgucuuacucuuugcgcaggugcuuaagcucaaagucuugugagggcagaaauauuagauaucgaacgugcucgaacguggacuguccaccugaggccggcgacuuuagagcccagcaauguagcgcccauaaugacguuaaacaccacggccaguuuuacgaaugguuacccgugaguaaugacccugacaaucccuguucccugaagugucaggccaagggcacgacccuuguuguggagcuggcccccaaggugcuggacggaacuagauguuauaccgaaucccucgauauguguauaagcggacuuugucaaauuguaggcugugaccaucaacuggggucuacuguuaaggaggacaauuguggcguguguaacggcgacggcagcaccugcaggcugguccgggggcaauauaaaagccaauugagugccacaaaaucugacgacaccgucgucgccauccccuacggaaguaggcacauaagacugguacugaagggacccgaccauuuguaccuggagacaaagacacugcaggguaccaaaggcgagaacucucuuagcaguacgggaaccuuucucgucgauaacaguuccguggacuuccagaaauucccugacaaagagauccugcgcauggcuggcccccugaccgcagauuucaucgugaaaauccggaacagcgggagcgcggauuccacuguucaguucauauuuuaccagcccauaauucaccgauggcgcgagacagacuuuuuucccuguucugccaccugcggcgguggauaccaguuaaccagcgcugagugcuacgacuugcgguccaacaggguugucgcggaucaguacugucacuacuaucccgagaacauuaagccaaagccuaaacuccaagaguguaaucucgacccaugcccagcgcggugggaagcuacaccuuggacugcguguagcuccucguguggaggagggauacagucccgugcgguaagcugcguggaagaagacauucagggacaugucaccagcguggaagaguggaaguguauguauaccccaaagaugccaauugcccagccauguaacaucuuugacugcccuaaauggcuugcccaggaauggagcccugucacugugcccuccuuuuuuguacacuag

SEQ ID NO: 248006 - RNA, 543 nt, Artificial Sequence
  Description of Artificial Sequence: Synthetic coding sequence
augggacucacuguaucagcacuguuuaguagaauuuucgggaaaaaacagaugcggauacuuauggucggacuggaugccgccggcaaaaccaccauucuuuacaaacuaaaauugggcgaaaucgugaccaccauaccuaccaucggguuuaauguggaaacaguggaguacaaaaacauuuguuucacugucugggacgucggcgggcaggauaaaauucgaccucuguggcgccacuauuuccagaauacccaaggacugauauuugugguagacucaaaugauagagagagggugcaagaauccgccgaugagcuccagaagauguugcaagaggacgagcugcgugaugccgugcucuuagucuuugcuaauaaacaggauaugccuaacgcaaugccgguguccgagcucacagacaaacuaggucugcagcauuuaagaagccgaacaugguacgugcaggccacaugcgcuacgcagggaacuggucucuaugaugggcuggauuggcuaagucacgagcugagcaaaagauag

SEQ ID NO: 248007 - RNA, 7251 nt, Artificial Sequence
  Description of Artificial Sequence: Synthetic coding sequence
augacaacacuguuguggguuuucguuacacugcgggugauaaccgcggccguuaccguagaaacuuccgaucacgacaacucacuguccguuucaauuccccagcccagcccccuacgcguucugcugggaacaucccuuacaaucccuugcuacuucauugauccuaugcaccccguaacaacugccccuaguaccgccccccuggcuccacggaucaaaugguccaggguguccaaagaaaaagagguuguguugcugguagcgacagaggguagggucagagugaacagcgcuuaccaggacaaggugucccuucccaauuaccccgcuauuccaagugaugcaaccuuggaaguucagucacuccgaucgaacgacuccgggguuuacaggugcgaagugaugcacggcaucgaggacucagaggcaacucuggaaguugugguuaaaggaauugucuuccauuaucgggccaucucuaccagauauacccuggacuuugaccgagcccagagggcuugccugcaaaacucugcuauuaucgcuacccccgagcagcugcaagcagcauaugaagauggauuucaccaaugugaugccggguggcuggcugaccaaaccgugcgcuauccaauucacacacccagagagggauguuacggggacaaggaugaauuucccggagugcggacuuacgguauucgcgacacgaacgagacguacgacguauauugcuuugccgaggagauggagggcgaaguauuuuaugccacuuccccugagaaguucacauuccaggaagccgccaaugagugucgucgccucggcgcgagacuggccacaacuggucaguuauauuuagccuggcaggccggcauggacaugugcagcgccggcuggcuggccgaccguucggugcgauaucccaucagcaaagcaaggccaaacuguggugggaaccugcuuggcguccggacgguguauguucacgccaaccaaaccggcuaccccgauccgucuagcagguacgacgcuauauguuacacaggagaagauuucguugacauucccgaaaacuuuuucggcguagguggugaagaggauaucacugugcagacagugacuuggccggauauggaacuuccguuaccucggaauaucaccgaaggagaagcuagaggcucuguaauccugacgguuaaacccauauucgaggucagucccuccccacuagagccugaggagcccuucacauucgcucccgaaaucggcgcgaccgcauucgcugaaguugaaaacgagaccggagaagcgacccgcccauggggcuuucccaccccuggcuuaggucccgcuacggcuuuuacaucagaagacuuagugguucaagugacagcgguaccagggcagccacaucuuccagguggagugguauuccacuacagaccagguccaaccagguauucauuaaccuucgaggaggcccagcaggccugucuccgaacgggagcaguaauugccucgccugagcaacugcaggcagccuaugaagccggcuacgaacaaugcgacgcuggcuggcuccgcgaccagacugugcgguauccaaucgucucaccucgcacuccaugugucggugauaaagacagcagcccuggggugagaacuuacggggucagaccaagcacugaaacuuaugauguguauugcuucgucgaucgucucgagggggaaguguuuuucgccacaaggcucgagcaguuuaccuuucaagaagcucucgaauucugcgaaucccauaacgcaacgcucgcgacaacuggccagcucuaugcggccuggagccggggacuggacaagugcuaugcaggauggcucgccgacgguucauugcgcuacccgaucguuacuccucgacccgcaugcgguggggacaaaccuggcguccggacuguguauuuguacccaaaccagaccggauugcccgacccuuugucgaggcaccaugcauucuguuuuagaggaauauccgcagucccgaguccuggcgaggaggaaggcgguaccccuacauccccgucgggcguagaggaguggauuguaacucaaguagugccuggagucgcagcuguccccguagaagaggaaacuacggcugucccuuccggagagacgacagcuauucuggaauuuacaacggaaccagaaaaucagacugaaugggaacccgcuuauacgccgguuggaacaucaccacugccagggauucucccgacuuggccaccuacaggagccgccacugaggaaagcaccgaggguccaucugccaccgaagugccuucugccucugaggagcccagcccguccgaaguccccuucccuagcgaagagcccucaccguccgaggagccuuuucccagugugagaccauuuccgucaguagagcuuuuccccucggaagagcccuuccccagcaaggagccuagcccguccgaggagccuagcgccuccgaagagccauacacacccucucccccggucccgagcuggaccgagcugccaucuuccggugaagaguccggcgcucccgaugugagcggggauuuuacugguagcggcgacgugaguggccaccuggacuuuuccgggcagcucuccggcgacagagcuuccggccugcccaguggcgaccuugacucuucuggccuuaccaguacgguggggagcggacuccccguggagaguggccuucccagcggcgaugaggagaggauugaguggccgaguacgccuaccguaggcgagcuuccaucuggugcugagauucuggaagguucagcuaguggggugggggaccucuccgggcuccccaguggcgaagugcuggagaccuccgcuucgggugucggcgaucuuucuggccuaccgucuggggaagugcucgagaccacggccccuggcguggaggauauaagcggccucccaucaggcgaaguuuuggagacuacagcccccggcguagaggacaucucuggacuccccuccggcgaggucuuggaaacgacagccccagggguggaagauauaaguggucugcccaguggagaggugcucgagaccaccgcuccagggguggaggacauuuccggcuugcccagcggagaggugcuggagaccacagcuccagggguugaagauaucagcgguuuacccucuggggaaguccuggagacagcagcgcccggggucgaggacauuuccgggcuccccagcggagaagugcuggaaaccgcagcgcccggaguagaagauauuuccggccugccuucgggcgaaguuuuggagacugccgcuccuggaguugaggacauaucaggcuugcccaguggagagguccuggagaccgccgcucccggaguugaggacaucucuggccugccaucuggagaagugcuagaaacagccgcgccuggaguggaagauaucucaggccugcccagcggugagguccucgaaaccgcagcaccuggcguugaagacauuagcggccugcccucuggcgaaguguuggagacagccgcuccuggcguggaggauauuucuggacuuccuagcggagaggugcuagagaccgcagcgccugguguggaggacaucucggggcucccgucuggggaaguccuggagacggcagccccagguguugaagauaucuccggccugccgucuggugaggugcuagaaaccgcugcccccgguguugaggauaucaguggcuuaccaucgggugaagugcucgaaacugcagcccccggaguagaagacauuaguggguuaccauccggggaaguacuggagaccaccgcuccaggaguugaggagaucucagggcuuccaaguggugaaguguuggagacuaccgcacccggaguggacgagaucaguggccuaccaaguggagaagugcuggaaacuacagcccccggcguggaagaaaucucaggccugcccucuggagaagugcucgaaacaaguacaucugcuguuggcgaccugagcggccugccuagugggggagagguccuggaaauaagcguaucuggcguggaagacauuucaggccuucccucaggggaagugguugaaacgucagcguccggaauugaagaugucuccgaacugcccuccggugagggacuggaaacaagugccagcggagucgaggaucugagcagacugcccaguggugaggaggugcuggagauuagugccuccggauucggagaucucucuggacugccaucugggggugaaggccuggagacuagugcaagcgagguugggacggaucugucagggcucccaagcggucgggaagggcuugagaccagugcaagcggagccgaagauuuguccggccuacccuccggcaaggaagacuugguuggaucugccagcggcgaccuggaucuaggaaagcucccaagcggaaccuugggguccgggcaggcuccggagacaucaggacucccaagcggcuucucuggugaauacuccggggucgaccuaggcuccgguccucccuccggccuucccgauuucagcggauugcccuccggauuucccaccgugucccucgucgacaguacuuugguugagguagucacugcaaguaccgccucugaauuggaaggacgcgggacgauuggaauauccggggccggcgaaaucagugggcugccuucgagcgagcuugauaucuccgggcgcgccucugggcucccuagcggaaccgagcuaucugggcaggcgucggguaguccagauguaucuggcgagaucccuggguuguucggaguuaguggacagcccucuggcuuucccgacacaucuggcgagacgucuggggugacagaacugaguggguugagcucuggacagccugggauaucuggcgaagcuucaggggugcuguauggaaccucccagccuuuugggaucaccgaucucuccggggagacuagcggcguaccugaucuguccgggcaaccgaguggguugccugguuucagcggugcuacuucuggcgugcccgaccugguuuccggaaccacaucuggcaguggggaaucguccgggauuacauucguagauacaucccuaguggagguggcaccaacuacauuuaaagaggaagaaggcuugggcagugucgagcugucuggccuaccuucaggcgaggcugaccuuucuggaaagucaggaauggucgauguaaguggacaguucucaggcaccguggauagcagcggauucaccagccaaacccccgaauucuccggguuacccucagggaucgcugagguguccggggagaguuccagggccgaaauugggucgagccugccgucaggagcauacuacggauccgggacaccuagcucauucccaacuguuuccuuaguggaucgcacucuggucgagaguguuacccaagcaccuacagcacaggaagccggggaagggccauccgguauccucgagcuguccggggcccacucuggggccccagacauguccggagagcacagcggcuuccuugauuugaguggcuugcagagcgguuugaucgagcccucgggagaaccuccaggcaccccuuacuucucuggagauuucgcaaguaccaccaaugucucuggggagucuucugucgccaugggcacuaguggugaggcgucugggcuaccagaagucacacucauuacaucugaguucguagagggagucacagaaccuaccaucucucaggaacuggggcaacguccucccgucacccauacuccccaacuguuugagucuaguggcaaggucuccacugccggugauaucucuggcgcaacucccguacugcccggaucagguguggagguauccagcgugccggagaguaguucugaaacuagcgcuuacccagaagcaggcuuuggugcaucugcagcucccgaagcgagccgcgaggauucagggucuccagaucugucugaaaccaccagcgccuuccacgaggcuaaucuagagagaaguucuggcuuaggagugagcgguaguacauugacauuucaagagggggaggcaagugcggcgccagaagugucaggggagucuacuacgaccuccgacgugggcacagaagcccccggacugcccucugcaacccccacggcguccggugaccgaaccgagauaucuggagaucuuagcggacauacaucccaacugggcgugguuauaucuacaucuaucccagaaagcgaauggacacagcagacccagagacccgcagagacccaucuggaaauugaaaguuccagccugcucuauucuggcgaggagacccacaccgucgagacagccacauccccaacugaugcaagcauccccgcuucccccgaauggaagagagaaagcgagaguacugccgcagccccagcccgcucaugcgcugaggagcccugcggcgcaggaaccugcaaagaaacagaggggcaugucauuugucuguguccuccaggguauaccggcgagcacuguaauaucgaccaagagguuugugaggaggguuggaauaaauaccagggucacuguuaucgccacuuuccagauagagagaccuggguagacgccgagcggcgguguagagagcagcagucccaccucaguagcaucgugacaccagaagagcaagaauucguuaacaauaacgcucaggacuaccaauggaucggcuugaaugacagaacaauagagggggacuuucgauggucugauggacacccgaugcaauuugagaacuggagaccuaaucaacccgauaauuucuucgcugccggcgaagauugcguugugaugauauggcacgagaaaggagaguggaacgauguucccugcaacuaucaccuuccuuuuaccuguaagaaaggcaccguggcguguggagagccaccggucguggaacacgcucgcacauuugggcagaagaaggacagauacgaaaucaauagcuugguaagauaccaguguacagagggcuucguccagcgccauaugccuacgauuagaugccagccuagcggucacugggaagaaccccaaauuacguguacugauccuacaacuuacaagcgaagacuccagaagcgaucaagccggcacccucgacgcucaagaccuagcacggcccauuag

SEQ ID NO: 248008 - RNA, 7296 nt, Artificial Sequence
  Description of Artificial Sequence: Synthetic coding sequence
augacaacucuccugugggucuucgugaccuugcgugugauuacagccgcugucaccgucgagacgucggaucacgacaauagcuugagcguguccauuccucagccgucuccccuacgcguucugcuggguaccagccugacaauaccguguuauuucauagaucccaugcacccagugaccaccgccccgucaaccgccccgcuugcccccagaauaaaguggagccgcguaagcaaggagaaggaagucguucugcucguggcgacagaaggcaggguaagaguaaauuccgcauaccaagauaaagucagccucccaaauuacccugcuaucccuagcgacgccacccucgagguccagagccuuaggaguaaugauucuggaguguacagaugcgaggugaugcacggaauugaagacagugaggcaacgcuagagguuguugucaaggguaucgucuuccauuauagagcgauuucuacuagauacacacuggauuuugacagggcucagagggcguguuugcagaauucugcuauuaucgccaccccugagcaguugcaagccgcuuacgaggacggcuuccaucaaugcgacgccggguggcuggcugaucagacaguccgguacccaauccauacucccagagaaggcugcuauggugacaaggaugaauuuccaggugugagaaccuacggaauacgcgauaccaacgaaaccuacgauguguauugcuucgccgaagagauggaaggagagguguuuuaugcaacaucucccgagaaguucaccuuucaggaggccgcaaaugagugccgccgucugggcgcuaggcuugcaacuacuggccagcuguauuuggcuuggcaggcuggaauggauauguguuccgccggcuggcuugcugaccguucuguacgguacccaauaucgaaggcaaggccaaacugcggcgguaauuugcuuggagugcgcacaguuuauguacacgccaaucagacuggcuauccagaccccaguucaagauaugacgccauauguuacaccggagaagacuuuguggacauucccgagaacuuuuucggcgugggcggggaagaggauauaaccguucaaaccgugaccuggccagacauggagcuuccacucccacgcaauauuaccgaaggcgaggcaagaggaagcgugauccucaccgugaagccuaucuucgaggugaguccuucaccuuuggaaccggaggaaccuuucacauucgccccggagaucggagcuaccgccuucgccgaaguggaaaaugagacaggagaagcuacccguccuuggggcuuucccacccccggucugggcccugccaccgcauuuacaucagaagaccuugugguucaggucacagccgucccaggacaaccucaccugccaggaggcguuguguuccauuaccguccgggcccaacccgcuauagucugaccuucgaggaagcccagcaagcuugucucaggaccggggcagugauugccagccccgaacaauugcaggccgccuaugaggcugguuacgagcagugcgacgccggguggcuccgugaucagacuguuagauacccgaucgugagcccaaggaccccuuguguaggcgacaaggauucgucuccuggcguacguacauauggcgucaggccgucuaccgagacuuacgacgucuauugcuucguggauagacuugaaggggagguuuuuuucgcuacacgacuagaacaguuuacuuuccaggaagcucuugaauuuugcgagucccacaaugccacacuggcaaccaccgggcaauuauaugcggcuuggucgaggggacuggauaaauguuaugccggauggcuggccgaugggagucugagguaucccaucgugaccccucgacccgcuugcgguggcgauaaaccgggagucagaacugucuaccuguauccuaaucagaccgggcugcccgacccucugagccggcaccacgccuuuugcuuccgaggcaucuccgcagucccuagcccuggagaggaggaaggaggcaccccuacaucaccaagcgggguggaggaauggaucguaacacagguagugccuggcguggccgccguaccaguggaggaggaaacaacagcuguucccagcggugagacuacugcgauccucgaauucacuacugagccagaaaaccagacagagugggaaccugcauauacccccguggggaccagcccucugcccggaauccucccaacauggccuccaaccggggcggcuaccgaggaaucuacggaaggccccuccgcaacggaagugccaagcgccagcgaggagcccucaccuucugaagugcccuuuccgucugaggaaccaucccccuccgaagaacccuuuccuagcguucgaccauucccuagcguggaguuguucccuucggaggaaccguucccauccaaagagccaagucccagcgaggaaccuagcgccagugaagaaccauauacgcccucuccucccgugccaaguuggacugaauugccuuccaguggcgaagaaaguggcgcaccagacguuuccggggacuuuacagguucaggcgaugugucaggccaccuggauuuuuccggccaacugagcggugauagggccuccggcuugccaaguggugaccucgauucguccggauugaccuccacaguuggcagcggccuccccgucgagucuggacucccuagcggcgaugaggagcgaaucgaguggccuucaacaccuacagugggugaacuuccauccggcgccgaaauccuagaagggagcgccagcgguguuggcgaucugaguggacugcccagcggugagguccuggagaccuccgccucuggagugggggacuuaagcggguugccuucgggagaggugcucgagacuacagcccccggcguggaggacauuagcggguuaccauccggcgagguacucgagacuacggccccagggguggaagacaucaguggucuuccaucgggggagguucuggaaacaaccgcuccuggggucgaagacaucuccggucugcccucuggugagguauuggaaacaaccgcccccggugucgaagauaucagcggacucccaucaggagaggugcuggagaccacagccccgggaguggaagauauuaguggucuaccuagcggugaagugcucgaaaccacagccccagggguggaggacaucagcggccugccuagcggggagguacucgagacugccgcgcccggcgucgaggauaucagcggacugcccagcggggaagugcuggaaacggccgcgccuggcguggaagacauuucagggcuccccucgggagaaguucucgagaccgcagcuccugggguugaggauaucagcggauugccaagcggcgagguucuggagaccgccgcacccggcguggaggacauuucuggccuuccgaguggugagguguuggagacagccgccccaggcguugaggacauuagcgggcuucccaguggcgaagugcuugagaccgcugcccccggcgucgaggauauuucuggccugcccucaggcgagguucucgaaaccgcugccccuggaguggaagacauauccgggcugcccucuggugagguucuggagacugcggccccuggcgucgaggacauuuccggacuccccagcggcgaaguucuugagacggcagcacccgguguggaagacaucuccggccugccuuccggagaagucuuggaaacagccgcaccaggaguggaagacauaagcgguuuacccaguggugagguccuggagaccgcagcgccagggguugaagacaucaguggccuacccagcggagaggucuuagagacagcagcucccggcguggaagauaucuccggccugcccagcggggagguccuugaaacagcagccccaggcgucgaggauauuuccggccugccaucuggcgaagugcuggagaccgcagccccugggguugaagacaucucaggacugccauccggggaggugcucgagaccgcagcgccaggcguugaagacauuucaggacugcccuccggagaaguccuggagaccgcugcaccaggugucgaggauauaucaggacuccccagcggagagguacuugaaacaaccgcaccuggcguggaagaaaucagcggccugccguccggcgaagugcuugagacuacggcccccggagucgacgaaaucaguggcuugccauccggcgaaguccuugaaacaacugcgcccggcgucgaagaaaucaguggccugcccaguggagaggugcuggaaacuucuaccagcgcggucggcgaccucagcggacuaccauccggaggagaggugcucgagaucucugugucaggcguugaagauauaucuggcuuacccuccggagaagucguggaaacaucagccuccgguauugaggacgucagcgagcuuccuucuggggaggggcucgaaacauccgcuucuggaguggaagacuugucuaggcugccaagcggcgaggaagugcuugagaucagcgcuuccggguucggagaccugucgggccugcccucaggaggggaaggccuggagacuucagcaucagaagucgguacugaccugagcggguugccgucgggccgugaaggacucgaaacaagugcuucaggcgcugaggaccucuccggacuaccaagugggaaagaagaucuggugggcucugcgucgggugacuuggacuugggcaaacuacccucagggacucugggcuccggccaagcccccgaaacaucuggauugccuagcggcuuuuccggagaguacagugggguggaccuaggaucugggccgcccuccgggcugccagauuucuccggacugccaaguggcuucccuaccgugucccugguggauucuacucuggucgaggugguaacugcgucuacugccuccgagcuagagggaagagguaccaucggaauuucgggggccggugagauuagcggccucccgucuagugaauuagauaucucaggcagggccaguggacuccccucuggcacggaacugucaggacaggcuucuggaagccccgacgugucaggggagaucccagggcuuuucggcgucaguggacagcccucagguuuuccagacacaagcggcgagaccaguggaguaacagagcugaguggccugucuagcggacagcccgguauauccggcgaagcuagcggagugcuuuacggcacgagucaaccuuuuggcauuaccgaccucagcggagagacaagcggugugcccgaccugagcggccaaccuucagggcucccaggcuucucuggggcuacuagcggcgugcccgaucucgucucugguacuacaucuggcucaggcgagagcucagguaucacuuucguggauaccucucuuguugagguagcgccgacaaccuucaaggaggaggagggacuaggcucaguggagcucagcggccucccuucaggggaagccgaccuguccgggaaguccgggaugguugaugucagcggccaguuuucaggcacaguggacucuaguggcuuuacgagccagaccccggaauucaguggccuuccuucuggaaucgcggaagugucaggggagucgaguagggcagaaaucggguccucccuucccuccggagcuuacuacggaucuggcaccccaucaucauucccuacagugucccuaguggaccgcacgcuagucgaaagugugacucaggcacccaccgcacaagaggcaggcgagggcccuucaggcauacuggaauuauccggagcccacagcggagcgccugauaugucaggcgaacacagcggcuuccuagaccucagcggucuacagucagggcuaaucgagccaucgggagagccgcccggaacgccuuacuuuucuggagacuucgcgagcacaacaaacgugucuggcgagagcucuguggccauggggaccucuggcgaagcgagcggucugccagaggucacccuaaucacauccgaguuugucgaaggagugacagaaccgacaauuagccaggagcugggccaacgacccccagugacucacacuccgcagcuguuugagaguucagggaaggugucuacggccggcgauauauccggggccacgcccguucugccagggucaggcguggaagugucuucaguuccugagaguucuucggagaccagugccuaccccgaagcggguuucggugccuccgcagccccugaggcuucaagagaggauuccgggaguccggaucuuagugaaacuaccucugcuuuccacgaggcuaaccuggaaagaucuagcggacugggcgugucgggaaguacacugaccuuccaagagggcgaagccuccgccgcacccgaaguaagcggagagagcacaacaacaagcgacgucggaaccgaggcaccuggccugccguccgccacccccacggcaucaggcgacaggaccgagaucuccggagaucugucuggccacacuagccagcucggagucgugauuucuaccuccaucccugaguccgaguggacccagcagacucagcguccggccgagacgcacuuagaaaucgaaucuucuagccugcuuuauucaggcgaggaaacgcauacaguggagacagcaaccaguccuacagacgcuucgauaccugcaagccccgaauggaaacgagagucagagagcaccgccgcagaucaggaggucugcgaagagggcuggaauaaguaccaggggcacuguuaccggcauuuccccgauagggaaacuuggguggaugccgaaagaagauguagggaacagcagucacaucuuuccucaauugugacccccgaggagcaggaauucgucaacaauaaugcacaggauuaccaauggaucgggcugaacgacagaacuaucgagggagauuuccgaugguccgauggccacccaaugcaauuugagaauuggcggccgaaucaaccugauaauuuuuucgccgccggcgaagacugcguugugaugauuuggcacgagaaaggggaauggaaugaugugcccugcaauuaucaucuuccuuucaccuguaaaaagggaacugcuacaacauauaaaagaagacugcagaaaagaaguucacgccaucccaggcggucacggcccagcacggcccauuag

SEQ ID NO: 248009 - RNA, 7593 nt, Artificial Sequence
  Description of Artificial Sequence: Synthetic coding sequence
augacuacacugcuauggguauucguuacacugcgggugauaacagccgccgugacugucgagacauccgaccacgauaauagucugucugugucuaucccccaacccaguccauuacguguguugcuuggcacaagucuuaccauuccuuguuauuucauagaucccaugcacccugugaccaccgcuccauccacugcuccccuggcaccucgcauuaaauggagucgcgugucgaaggaaaaggagguggugcuccucguugcuaccgagggaagggugagaguuaacucggccuaccaggauaagguaucucuuccuaacuauccugcaaucccgagcgacgcgaccuuggaggugcagucucucaggaguaacgauucgggggucuacagaugugagguuaugcacggcauugaagauuccgaggcgacgcuagaggucguggucaaggguaucguuuuccauuauagggcaaucuccaccagauauacacuggacuuugauagggcccagagggccugccugcagaauuccgccauuaucgccaccccugaacaacuucaggcagcguaugaggauggcuuccaccagugugacgccggguggcucgccgaccaaacugugagguaccccauucauacgccacgcgaagguugcuacggggacaaggaugaauucccuggagugaggacuuaugggauccgggauaccaacgagaccuaugauguguacugcuuugcugaggaaauggaaggcgaaguauuuuaugcgaccucuccugagaaguucacauuccaagaggcugccaacgaaugccgaaggcugggcgccagauuggcuacuacaggacaacuguaccuggcuuggcaggccggcauggauauguguagugcuggguggcuugccgaucguuccguuagguaccccauuucgaaagcccggccuaauuguggaggcaaucuucugggaguacggacuguguauguucacgcaaaccaaaccgguuaccccgauccuucuuccagguacgaugccauuuguuauaccggggaagauuucgucgacauaccugaaaauuucuuuggagucggaggcgaggaggacaucacuguucagacaguuaccuggccugauauggaauugccgcugccgcgaaauauaacggaaggcgaagcccggggaagcgugauacuuacagugaagccaauuuucgagguuucaccaucaccacucgaaccagaggagcccuucaccuuugcgccugagauuggcgcaaccgcguuugccgaaguagagaacgaaacuggggaagcaaccaggccauggggcuuuccuaccccuggacucggaccagccaccgcuuuuacauccgaagacuugguggugcagguaaccgccguuccaggacagccucaucucccaggaggaguuguguuccacuacagacccggcccuacucguuauucgcugaccuuugaggaagcgcagcaggccugccucaggaccggcgcaguaauugccucccccgaacagcuucaagcagcauaugaagcagguuaugaacagugugaugcuggauggcuccgugaccagaccguccgguaccccauagugucaccccgcacuccuugugugggcgacaaagacucuucucccggaguuagaacuuauggcguaaggcccucaacagagaccuacgacgucuacugcuucguugacaggcuagagggagagguguuuuuugcgacccgccuggagcaguuuaccuuucaggaagcucuggaguuuugcgagucacacaacgcaacacucgcaacuaccggacagcuuuacgcugcauggucuaggggacuggauaagugcuaugcgggauggcuggcugacgguucucuucgcuauccaaucgucacacccagacccgccugcgggggggacaaaccgggcguacggaccguguaccucuauccaaaucagacugggcugcccgacccccugagccgucaucaugcuuucuguuuucguggcauuucugcuguuccuucccccggcgaggaggaaggcgguacacccacaagcccguccggaguggaggaauggaucgugacucaagucguucccggggucgcugcuguccccguagaggaagaaaccaccgcugugccuagcggcgagacuaccgccauauuagaauuuaccacagaacccgagaaccaaacugaaugggaaccugcauacacaccugugggcacaaguccgcuccccgguauccugcccaccuggccgccuacaggggccgcaacggaggagagcacagaaggucccuccgcaacagagguccccagcgccagcgaagaaccaucaccauccgagguacccuuuccaucugaggagccaaguccuagcgaagaaccauuuccuagcgugcggcccuuuccuucgguggagcuguuccccucugaggaacccuuuccauccaaagagcccucaccaagcgaggagcccuccgccucugaagagccuuauaccccguccccaccuguacccuccuggacagagcugcccucaagcggagaggagagcggcgccccagaugugucuggugacuucacuggcucaggcgacguguccggacaucuggacuuuagcggccagcuuaguggcgaccgggcuuccgguuuaccuucgggagaucuggacucgagcggguugacuagcacaguuggauccgggcuuccaguggaauccggcuugccgucuggggacgaggaaagaaucgaguggccaagcacuccuaccgugggggagcugccauccggagcagaaauccucgaggguucggccucuggagugggggaucuguccgggcugcccagcggcgagguccuugagacguccgcuagcggggugggcgaucuuuccggucuuccaagcggggaggugcucgagaccacugcuccugggguggaggacauaucaggguugccuuccggcgaaguacuggagaccacugcuccgggcguggaggacaucagcggccuuccaagcggggagguacucgagaccacugcaccgggcgucgaggacauaucuggcuugccguccggagaggugcuggagacuacagcuccgggcguugaagacaucucuggccucccgaguggagaggugcuggaaacgacagccccgggaguugaggacaucuccggcuugcccagcggagaaguucuagaaaccacugccccaggcguagaggauauuucuggauugccauccggugaggugcuggaaaccgcugcccccgguguugaggacauuuccggacuacccagcggagaaguguuagagacagcagcccccgguguggaggauauuuccgggcuuccuucaggagaggugcuggaaaccgcggcccccgggguggaagacauauccggcuugcccagcggagagguucuggaaacagcugccccuggcguggaagauauuucuggccuccccagcggugaaguucucgagacagcugcaccugggguggaggauaucaguggguuaccaucuggcgaggugcuugaaacugccgcaccuggcguggaggacauaagcgggcuuccaucaggcgagguguuggagacugccgccccaggcguggaagacaucagcggccuaccaucaggcgagguacuugagacagcggcccccgguguagaagauauuucuggguugcccucgggcgagguucucgaaaccgccgcuccugggguggaggauaucucaggauuaccuaguggugaagugcuugaaacugcagcacccggugucgaggauauuagcggguuaccauccggugagguccuggagacagcugcgccgggaguggaagauauuucagggcugccguccggcgaagucuuagagacugccgcccccgguguggaagacaucucugggcuuccauccggagaaguacuggaaacugcagcuccaggaguugaagacaucuccggacuacccucuggggaagucuuagaaacagcugccccugggguugaggauaucagcggucugccuagcggcgaggugcuggagaccgcagcccccggaguagaggauauaucuggguuaccauccggcgaaguuuuagagaccgccgcaccuggcguggaggauauaaguggccugcccaguggagagguuuuagaaacaacugcaccaggcgucgaagagauaagcgggcugccuagcggggaggugcuggaaacgacagcaccaggcguggacgaaaucagcggcuugcccagcggagagguguuggagacaaccgccccuggcguggaagagauuucuggcuugccaagcggcgaaguacuugagaccagcacaucugccgugggugaccuguccggguugccaucagggggggagguuuuagagauauccguuucuggaguggaggacaucagcggucugcccucaggugagguuguagaaacuuccgcaucuggcauagaagauguguccgaacuacccucuggggaaggauuagagacuagcgcaucagggguugaggaucuuaguagacucccgucuggagaggagguucuugagauuucggcaagcgguuuuggggauuugaguggccugccuagcggaggagaaggacuggagacaucagcaagcgagguagggacagaucucagcggucugcccucuggccgagaggggcuugaaacguccgcuucuggcgccgaggaucuuaguggcuugccaucaggcaaagaagaucugguugguucugcaagcggugaccuagacuuggguaaauuaccgagcggaaccuuagguuccgggcaggcccccgagacaagcggucugccuaguggcuuuucuggggaguacagugguguggaucugggguccgggcccccaucuggucuccccgauuuuaguggacugccaucgggcuuuccuacagugucauugguggacaguacacucgucgaggucgucaccgcuagcacugccucagaacuagaaggccgcgguaccaucgguaucuccggugcaggcgagaucucuggucuccccucuagcgaacuggacaucuccggccgggccucuggacugccaaguggaaccgaguugucuggccaggcuuccggaucuccagacguuuccggagaaauaccuggauuauucggcguuucagggcagccaagcggcuuucccgauaccaguggggagaccucagggguuaccgaacuaaguggccugucgagcggacaaccggggauuagcggggaggccagcggugugcuuuacggcaccagccaaccauucggcaucacggacuuaucgggagaaacuucuggcguacccgaccugucuggacagccaucaggccucccaggcuuuucaggagcaacuagcggaguucccgaucugguuucaggcacuacgagcggaagcggugaaaguucugggauuaccuucguugauaccucucucguggaaguagccccaaccaccuuuaaggaggaagaggguuuggggucaguggaacucucaggccuacccucuggcgaagcugaccugucaggcaagucuggaaugguggaugugucgggccaguucagugggaccgucgacagcagugguuucacaagucagacuccagaguucaguggguuacccaguggaaucgcugaagucuccggugaaucaucucgggcugaaauuggcucaucccuuccauccggugccuacuacggcuccgggacgccuaguagcuuuccaacugugucccuaguggauagaacccuuguugaguccgucacccaggcuccuacagcacaggaagccggagagggcccauccggcauccucgaacugucuggcgcucauucgggcgcacccgacauguccggcgagcacuccggauuccuggaccuguccggauugcagucuggacugaucgaacccucuggcgagccucccggaacuccguacuuuagcggugacuucgccuccacaacgaacgugaguggagagagcuccguagcgaugggaacaucgggagaggccagcggccugccagaaguaacucucauuacguccgaguuuguggagggcgucacagagcccacgauaagucaggagcugggccagaggccucccgugacccacacaccccagcuguuugaaucaaguggaaagguguccaccgccggcgacaucucuggcgccaccccaguucugcccgguucgggaguugaggugaguagcgucccagagaguagcuccgagacgagugcauacccagaggcagguuucggugcaagugccgcucccgaggcuagccgugaggauucaggaagcccugaucuguccgagacgacuuccgcuuuccacgaggccaaccucgaaagguccuccggacugggggucagugguaguacgcugacuuuccaagaaggcgaggcauccgcugcaccagaaguaagcggcgaaagcaccacuacuagugaugugggaacggaggcucccggauugccaagcgcuacaccgaccgcuucuggggaccgcacugagauuuccggcgaccucuccggucacaccagccaguuaggagugguaaucaguaccagcauaccagagucagaauggacacagcaaacucagaggccagcggagacccaccuagaaaucgaaaguagcucccuccuguauuccggugaggaaacccacacaguugagaccgccacaucaccaaccgacgcuaguaucccugccagucccgaguggaagagggagucagaguccacagcagccgcacccgcuaggucuugugcggaggagcccuguggcgcggguacuuguaaggaaaccgaggggcaugucaucugucuguguccacccggcuacacuggagagcauugcaauaucgaccaggaggugugugaagaggguuggaauaaauaucagggccauugcuaccgccacuucccugacagagagaccuggguggacgccgagcggagguguagggaacagcagagccaucucucuucuaucgucacccccgaggaacaggaguucgugaacaacaacgcccaggacuaucaguggaucggguugaaugauaggaccauugagggcgacuuucgauggucagauggccauccgaugcaguucgagaauuggagaccgaaucagcccgacaauuuuuuugccgccggagaggauugcguggucaugauuuggcaugaaaaaggagaauggaacgacgugcccuguaacuaccaucugccuuuuacuugcaagaaaggaaccguggccuguggugaaccuccgguggucgaacacgccagaacguucggacagaaaaaggacagauacgagauaaauagcuuggugagauaucagugcaccgaaggauuuguucaacgccacaugccuacaauccgcugccagccuaguggccauugggaggagccucagaucacgugcaccgaucccaccaccuacaaacggcgccuucagaaacgaagcucaagacauccacgccgcucccguccgucuacugcgcacuag

SEQ ID NO: 248010 - RNA, 7479 nt, Artificial Sequence
  Description of Artificial Sequence: Synthetic coding sequence
augacgacauugcuuuggguguucguuacccuccgcgucauuaccgccgcggucaccguggaaacuucugaccacgauaauucauugucagugucaauuccucaaccuucuccccuucgcgugcuccucgggacuucuuugacuauacccugcuacuucauagauccaaugcauccagucaccacagcgccguccacugcgccacuggcacccagaauuaaguggucacgcgugagcaaggagaaggaaguaguccuucugguagcaaccgagggacgcgugcgaguuaacuccgccuaccaggauaaggugucccugccuaacuauccagcuaucccuagcgaugcaacacuugagguccaaucucuccggucuaacgacuccggcguuuauaggugugaagugaugcauggaauugaggacuccgaagccacccuggaggugguggucaaaggcaucguguuccacuaccgcgcaauuagcacccgauauacucuggauuuugauagagcacagagggccugcuugcaaaauucugcuauaaucgcaaccccagaacagcuccaggccgcauacgaggauggguuucaucaaugcgacgcggguugguuggccgaccagacuguuagguauccaauacacaccccccgcgagggcugcuacggagacaaagaugaauuuccuggcguacguaccuaugggauccgggauacuaacgagacauaugacguuuacugcuuugccgaagagauggaaggagaggucuuuuaugcaacuucccccgaaaaauucacguuccaggaagcugcuaaugagugccgaaggcugggggcucgacucgcaacuaccgggcaacuguaccuggccuggcaagcagggauggauauguguucugccggcuggcuggcggacagaucugugcgguauccaaucaguaaggcccgccccaacugcgggggcaaccuacugggaguaaggacuguuuacguacacgccaaucagacugguuacccagauccauccucaagauacgaugcaauuugcuacaccggcgaggacuucguggacauaccggagaacuuuuuuggaguugggggggaggaggauaucacaguccagaccgucaccuggcccgacauggagcugccucugcccaggaacaucaccgagggggaggcucgagggagcgugauuuugaccgucaagccuauuuuugaggugagucccucuccucuggaacccgaggagccuuucacauuugccccugaaauuggggccacagcguuugcugagguggagaacgaaaccggcgaagccacaagaccauggggcuuccccaccccagggcuuggcccagccacugcauucacgagugaggacuuaguaguucagguuaccgcuguuccagggcagccgcaccugccaggaggggugguguuucauuaucgcccuggccccaccagguauucacugaccuuugaggaggcccaacaggcaugcuugcgcaccggggccguaaucgcaucuccugagcaacuacaagcugcauaugaagcaggguaugagcagugugacgcuggguggcuccgcgaccagaccguccgguauccaauugucucaccccgcacaccauguguuggugauaaagauucaucuccaggagucagaacauauggugugcggccuaguacagagaccuaugaugucuacugcuucguggaccgucuggaaggggagguuuucuucgcuacaagacuggaacaguucacauuccaggaagcccuagaguucugugagucacauaaugcaacauuggccaccacaggccagcuguaugccgcuuggagcagggggcuggauaaguguuaugccggguggcuggcugaugggagucuuagauacccaauaguuacaccucggccugcaugugggggagauaagccuggcgugcgcacaguguacuuauaccccaaucaaaccggccucccugauccccugucaagacaccacgcuuucugcuuccgcggcaucucagcagucccuucucccggagaggaagagggugguacuccgacaucaccaaguggcguggaagaguggauugucacacaggucgugccuggaguggcagccguuccugucgaggaagagacaacugcugugcccucgggcgaaaccacugccauacuggaguuuaccaccgaacccgagaaccaaacagagugggagcccgcuuauaccccugucgguacuucuccacuuccggguauccuucccaccuggccucccaccggugcagccacagaggaaucuacugaaggccccagcgcaaccgagguuccauccgcuagugaggaaccuagucccagugaaguaccuuuucccucugaggagccaucucccagcgaagagccuuucccuucugugagaccauucccgucuguugaacuguuccccuccgaggaaccauuucccuccaaagagccuaguccuagugaggaaccgucugcauccgaggagccguauaccccaaguccuccaguccccaguuggacugaacugcccucuucuggcgaagagucuggagccccugacgucagcggggauuucacuggguccggcgacguuagcgggcacuuggauuucucuggacaguuguccggcgauagggcuaguggacuucccaguggcgaccuugacagcagcggacugacaucuaccguggggucaggacugcccguagaaucaggccuccccucaggagaugaggagagaauugaauggccuagcacuccaacagucggagaacuuccuagcggcgcugagauauuggagggcucggcaucagggguaggugaucucagcggccugcccucuggggaagugcuugagacgagugcgagcggcgucggcgauuugucagggcugccuagcggcgaagugcuggagacuacugcgccaggcguugaggacaucuccggguugccuucaggagaaguucuagagaccacugcuccaggcguggaagauauuuccgggcuuccaaguggugaagucuuggagacuacagccccaggagucgaagauauuagcgggcucccauccggggagguucuggaaacaacagcaccuggcguggaagauauaaguggccugcccuccggcgaggugcucgagacaacggcaccuggaguugaagauaucucaggcuugccaagcggggaggugcuugagaccacugccccuggaguggaggacauuuccggauugccgagcggcgagguucuggagaccgcggcgccagggguugaggacauuuccggacuacccaguggggaggugcuggaaacagcugcucccggaguagaagauaucuccggccugccauccggagagguuuuagagacagccgcacccggagucgaggauaucucaggacuacccuccggggaggucuuggaaaccgcugcuccaggagucgaggauauaagcgggcugcccagcggggaaguuuuagagaccgccgcucccgguguggaagauaucaguggccugcccucaggcgaggugcuggagacugcagcacccggcguggaagacaucuccgguuugccaucgggggagguucucgagaccgcagcccccgggguggaggauaucucugggcugcccucuggcgaagugcuggaaaccgccgcaccuggaguugaagauauaucuggccugccuuccggcgaaguacucgagaccgcagccccagguguggaggacaucuccgggcugccaucgggugagguauuggagacugcagcucccgggguugaagauaucucuggucucccuucaggggaaguucucgagacugcugcgccuggagucgaagacauuucaggucugcccucaggagaagugcuugagacggcugccccgggcguugaggauauaagcggauugccuucuggggaagugcucgagacagccgccccagguguugaggacaucagugguuugccaucuggcgagguccucgagacggcagcuccgggcguugaggacauuuccggacugccgucuggugaagugcuggagaccgcugccccuggaguggaagacaucuccggucuuccaagcggagaaguacuugagacagcagcacccggcguagaggauaucucuggccugcccuccggggaagugcuagagaccacagcccccggaguggaagagauuucuggucuuccuaguggcgagguccuagaaacuacagccccggggguagaugaaauuagcggacugcccucaggggaaguacucgaaacaacggcaccuggcguggaagagaucuccggacugcccuccggagaggugcucgaaaccucgaccucagccgugggagaucucucgggucugcccaguggaggggagguacuagagauuucuguauccggaguagaggacaucaguggacucccaucuggagaagugguggaaacaagcgcuagcgggauugaggaugucagugagcugcccuccggcgagggacuggagacuucggccucaggaguggaggaucucucucgccugcccucuggagaggaaguucuggaaaucuccgcgaguggauuuggcgacuuaucugggcugcccagugggggcgaaggccuugaaacaucugccucugaaguagggacagaucugaguggacuaccauccggacgugaaggccucgaaacaagcgcuucaggugcugaggaccuuuccggccuccccagcggaaaggaggaccuggugggcagcgcaucuggggaucucgaccuggggaagcucccuuccggcacucucggcaguggucaggcccccgagacaucuggccuaccgucgggguuuucaggggaguauaguggugucgaucuuggaucaggaccgccuagcggacucccagauuucagcgggcuuccaagcggguuuccuaccgucagccuggucgauucuacacuaguggaggugguaaccgcuuccacugccucugaacuggaggggcgagggacaaucgggauaucaggcgcuggugagauuucuggccucccguccucggagcuggacauuucugguagggcaucgggucuucccucugguaccgagcuguccggccaggccagcgguaguccugacgucuccggagagauaccgggacucuuuggcguguccggccagccgaguggcuuucccgacaccucgggcgagacauccggggugaccgaacucagcggccugagcucuggccagcccgggaucuccggcgaagccaguggagugcuguauggcacaagucagccauuugggauaaccgaucucaguggggagaccucuggagugccugacuuaagcggccagccuagcggccugcccgguuucuccggggcuacgucuggggugccugaucuuguuucuggaaccacaucgggaucuggugaguccagugguauuaccuucguggacaccucccugguugagguugcaccuacuaccuuuaaggaagaggagggacugggcucagucgagcucuccggucuaccuucaggugaggccgaccuuucagggaaaagugguauggucgauguguccggucaauucagcgggacuguagacuccagcggcuucacuagccagacccccgaguuuuccggccugccauccggaaucgcggaaguaagcggcgaaucaucacgagcugagaucgggucaucacuacccucaggcgcguacuauggcagcgggacacccaguucauucccuacuguaagccuuguagacaggacucugguugaaagugugacacaggccccaacagcgcaggaggcuggcgagggcccuucuggcauucuagagcucucaggcgcccauucuggggcuccagacauguccggggagcacuccggguuucuggaccucuccggucugcaaaguggguugaucgagccauccggggaaccacccgggacaccuuacuucagcggagacuuugcaaguaccaccaacgucuccggagagagcucugucgccaugggaacaucuggcgaggccaguggccucccugaggucacccucaucacaucagaauucguggaggguguaacagagccaacaaucagccaggagcuuggucagagaccuccugucacccauacgccccaacucuucgagagcagcggaaaggugucgacagcgggcgacauuaguggggcaacaccgguccuaccaggcaguggcgucgaagugaguucagucccggaguccuccagugaaacuagugcauaccccgaggcaggauucggugcaagugcugccccugaagcgagucgagaggauucugguucuccugaccuguccgagaccacauccgccuuucaugaagcgaaccuggagcgguccucaggccucggaguaucagggagcacauuaacauuucaagagggagaagcaucggccgcucccgagguuuccggagagagcacaaccaccuccgacguggguacugaggcacccgggcugccaucugcuacucccacugccagcggugauaggacugaaauuagcggagaucucucagggcacaccucacaacucggcgugguaaucagcacuucuaucccagagucagaguggacccagcagacgcagaggccagcugagacccacuuagaaauagaauccucaucauuacuguauuccggagaggaaacgcacacuguggagaccgccacgucacccacagaugccaguaucccagccucgcccgaauggaagcgggagagcgagucuaccgccgcugaucaggaagugugugaagagggauggaauaaguaucagggacauuguuaucgccacuucccugaccgggaaaccugggucgaugccgagcgccgcugcagagaacagcagucacacuugucuucgaucgucaccccagaagagcaggaguucguuaauaacaacgcacaggauuaccaguggaucggcuuaaacgaccgaacgauagaaggcgacuuuagauggucagacgggcaccccaugcaguucgagaauuggcgucccaaucagccagauaauuucuuugccgcaggggaggauuguguagugaugauauggcacgaaaagggagaauggaaugacgucccuugcaauuaucaucuccccuuuaccugcaagaaagggacagucgccugcggugagccccccguggucgaacaugcacggacuuuugggcagaaaaaggaccgcuacgagauuaacagucucguccgguaccaauguaccgagggguuuguucagcgccacaugcccaccaucagaugucaacccucuggccauugggaagagccucagaucaccuguacugauccaacuacuuacaagcgucgguugcagaagagaucuagcaggcaucccaggagaucuagaccgucgacagcucacuag

SEQ ID NO: 248011 - RNA, 7593 nt, Artificial Sequence
  Description of Artificial Sequence: Synthetic coding sequence
augaccacacuccuguggguauucgugacuuuacgcgucaucaccgcugcuguaaccguugaaaccucugaucaugauaacuccuugagcgugucaauuccccagcccuccccccucagaguucuccucgggacaucccugaccauuccuuguuacuucaucgauccuaugcauccagugacgacggcccccagcacagcccccuuggcuccaaggaucaaauggaguagaguuagcaaagagaaagaggugguccugcuuguagccacugagggcagagugcgcgucaauucagcuuaccaggauaaagugucccucccaaacuaucccgcuaucccuuccgacgcuacccucgaggugcagucccuccggucaaaugauagcgguguguaucgaugcgaaguaaugcacgggaucgaggauagcgaagcaacauuagagguugucgugaaggggauaguuuuccacuaucgggccaucaguacgcguuacacacuagacuucgacagagcacagcgugcuugccugcagaacagugccauuauugccacuccagagcaacugcaggccgcuuacgaggaugguuuucaccaaugugacgccggauggcuggcugaccagacuguacguuaucccauucacacaccacgggaggggugcuacggagacaaggacgaauuccccggcguccguaccuauggcauucgggacacuaacgaaacuuacgauguguacugcuuugcagaggaaauggagggagaaguauuuuacgcgacuuccccugaaaaauucacuuuccaggaggccgccaacgaguguagaagauuaggagcgcgccuggcgacuacuggccagcuauaucuagcauggcaggcagggauggauaugugcagcgcuggguggcuggcugauagaucaguccgcuauccuauuaguaaggcccguccaaacuguggcggaaaccucuuggggguucggacuguuuaugugcacgccaaucagacuggcuacccggauccuagcaguagguaugaugcaauuuguuacacuggcgaagacuucgucgauauaccagaaaacuuuuucggcguggggggagaggaggacaucaccgugcagacugucacuuggccugauauggaauugccccugccaaggaauaucaccgagggagaagcucgaggaagcgugaucuugacagugaagcccaucuucgaggugagucccuccccuuuagaaccugaggagccguucacguuugcucccgaaaucggcgcaacugccuucgccgaaguggaaaacgaaaccggcgaggcuaccaggccguggggcuucccaacucccgggcuggggccggccaccgccuucacaucagaggaccuuguggugcagguuaccgccgucccaggacagccucaucugccaggcggaguggucuuucacuaccguccagguccuaccagguacagucuuacauuugaggaggcacagcaggcuugccugcgaaccggagcagugauugcuucaccagagcagcuacaagccgcguacgaggcaggcuacgagcagugugaugccggauggcuccgugaucagacugugcgcuacccaauaguguccccaagaacuccaugugugggggauaaagacagcucgccuggagugcgaacauacggaguucgcccuucuacggagacuuaugacguguacugcuuuguugaucguuuggaaggcgaaguguucuuugccacgcggcucgagcaguucacuuuccaggaagcacuugaguuuugugagucucacaacgcaacucuggcaacaacuggccagcuguacgcugcguggucucguggccucgacaaguguuacgcuggcuggcucgccgacggaucacugcgguauccgauuguuacaccucgcccggcuugcgggggcgauaagcccggcgugcgcacagucuaucucuaucccaaccagacagggcucccggacccccugagucgacaccacgccuuuugcuucaggggaaucagcgccgugccuuccccaggcgaggaagaggggggcacccccacuagucccagcggcgucgaagaguggaucgucacucaggugguucccgggguggcugcugugccgguggaagaagaaacgacagcggugcccagcggggaaacaacugcaauucuugaauucaccaccgaaccugagaaccaaaccgagugggagcccgccuacacuccugugggaacuuccccacucccagguauccugccaaccuggccuccaacgggugccgcaacggaagagaguaccgagggaccuagcgcuaccgaggugcccucagccagcgaggaaccuucucccucugaggucccuuuuccaagcgaggaaccuagcccaucagaagaacccuucccaucugugagacccuuccccaguguggaacuuuuccccucugaggagcccuuuccuucuaaagagcccuccccaucugaggagcccucagcgagcgaagaacccuacacuccgucaccaccggugccgagcuggacugaacugcccucaagcggugaggagucgggagcaccggaugugagcggggauuuuaccgggagcggggaugugucaggucaucuggacuucagcggccagcucaguggagaucgcgcuaguggccugccuuccggagaccuggauagcaguggacucaccucuacagucggcucagggcugcccguagagucaggauuaccuaguggugacgaggagaggauugaauggccuaguaccccuacagugggcgagcugcccuccggcgccgaaauccuugagggauccgccuccggagugggcgaccugucaggccugccuucuggagaggugcucgagacgucugccagcggagucggugauuugaguggacuacccuccggagagguucuggagacaaccgcaccuggcguagaggacauaaguggucugccgagcggcgaagugcuggaaacaacugcuccaggcguggaagacauaagcgggcugccuucaggggagguccuggaaacaacugcuccaggaguugaagauauuagcgggcugcccucgggcgagguauuggagaccacagcuccgggggucgaagacauaucaggacugccaucuggugaggucuuagagaccacugccccagguguagaagacaucagcgggcucccuagcggagaagugcuggaaacaaccgccccaggugucgaggacaucagcggccugccuucuggugaagugcuagagaccgcugccccuggaguggaagauaucuccggcuugccuaguggggaaguccuagagacggcugcccccgguguugaggauauuucuggacuaccuucuggcgagguacuggaaacagccgcgccgggggucgaggacaucucugguuuaccaucuggggaggugcucgagacugccgcgccagguguggaggacaucucaggucucccuucaggcgagguguuggagacggccgccccugguguggaggauaucaguggccugccuagcggcgaaguauuggagacugcggccccugggguggaagacauauccggacugccauccggugaggugcucgagacagcagccccuggaguugaagauauaucagggcugccauccggggaagucuuggagacugcggcucccggcgucgaagacauuagcggucugcccagcggugagguacuggagaccgccgccccuggcguggaagacaucucaggauuaccuuccggcgagguucuggagacagcugcacccgguguagaagacauuuccggccucccuaguggugagguccucgagacugcagcucccggcgucgaagauaucucuggacuacccuccggugagguguuggagaccgcugccccuggcguagaagauaucucaggacugccauccggcgaaguccuggagaccgcugcuccgggcguggaagauaucuccggucuccccuccggagaagugcuagagacggcugccccaggcguggaggauauuucaggccugcccucaggugaagucuuggagaccgccgcaccuggcguggaagauaucagcgggcugcccuccggagaagugcuggaaaccgcggcgcccgggguggaggacauuucugggcucccaucuggagaagugcucgagacgaccgcgccuggaguggaagagaucuccggacugccaucgggcgagguauuggagacuacagcacccggaguagacgagauuaguggccugcccucaggggaaguucuagagaccacagccccugggguugaagagaucuccggcuuacccuccggugagguccuugagacaagcacuagcgccguuggcgaucugucuggucugccgagcggcggagaaguucuugagauaagugucucuggugucgaagacaucaguggucugccaucuggagaaguuguugagaccuccgccagcggaauugaggaugugagcgaacucccaucuggagagggguuagagaccagugcaagcggaguggaagacuuaucacgcuuacccagcggugaggaaguccuggaaauaagcgcaaguggguucggagaccuaucagguuugcccuccgggggggaaggcuuggagacuucugcauccgagguugggacggaucucucuggacuucccuccggaagagaaggucuagaaacaucugcguccggugcggaggacuugaguggucugcccagcggcaaagaggauuuggugggcagcgcgaguggcgaucucgaucucgggaagcucccuuccggcacauugggaagcgggcaggcacccgagacuaguggccucccuuccggguuuucaggcgaauacuccgguguggaucugggaucagggccacccagcggauuaccagacuucagugggcuuccaucggguuuucccacagugagccuuguggacagcacccuggucgagguugugaccgccucuaccgcuucugaacuggagggacgcggcacaaucgggauaagcggggccggcgaaauuuccggacugccauccuccgagcuugauaucucgggacgcgcuuccggacucccaucuggcaccgagcuuuccggucaagcgagcggcaguccugacgucaguggagaaauucccggccucuuugguguaagcgggcagcccucaggauuuccugacacuaguggagaaaccucaggaguaacggagcuaucagguuugucuagcggacaacccgggaucucuggggaagcaagcggaguguuguacgggacaagccagccuuucgggaucacagacuugucuggcgaaacaagugggguucccgaccuaucugggcaaccuucuggcuuaccaggcuucucuggcgcuacgagugguguaccugaucucguuuccggcacaaccuccgggucaggugagucauccggaauuaccuucguugacaccagcuugguagagguggcaccgacuacuuuuaaggaagaggaaggucucgguucaguagagcucuccggacuuccgagcggcgaagccgaccuuucaggaaaaaguggcauggucgacguguccggucaauuuagugguacugucgacagcagcgguuuuacuucccagaccccugaauucagcggacugcccucugggauugccgaggugagcggggaaagcagucgggcggaaaucgguucuucucuuccuagcggagcguauuacgggucggggaccccuuccucuuuuccgaccgugucucuuguggauagaacccucguggaaagcguuacccaagccccgacugcccaggaagccggcgagggcccuucaggcauccuggaacucucuggagcccauaguggggcaccagauaugagcggcgaacauucuggguuccucgacuugucgggccuucaaucagggcugaucgagccuuccggcgagccaccuggaacucccuauuucuccggggacuuugccagcaccacuaaugugagcggggaaagcucgguugcuaugggcacuucaggcgaagccucagggcuaccagaggugacauuaaucaccagcgaguucgucgaaggagugacugaaccaaccaucagccaggaacuggggcagcgaccaccggugacucauaccccacaacuuuucgaguccaguggaaagguaagcacagcaggugauauuagcggcgccacaccagugcuuccaggcagcggcgucgaagugucuagcguucccgagaguagcucagagacaagcgcauacccagaagcaggguuuggggccagcgcagcucccgaagccucucgugaggacagcggauccccagaucucuccgaaacaacaucugccuuucaugaagcaaaccuggagagauccagcggacucggggugucaggcagcacucugacauuccaggaaggugaagccucugcagccccugagguuucgggcgaguccacuacgacuucagacguaggcacagaggccccagguuugcccagugccacccccaccgccuccggggaccgcacagagaucucaggagaucugucgggacacaccucccaacugggcgucgucauaaguaccagcauuccggaguccgaauggacucagcagacccagcggcccgcagaaacccauuuagagaucgagagcucaagucugcuauauucaggcgaggagacacacacuguggagacugcaacgagcccuaccgacgcuucuaucccugcaucuccagaguggaaaagagaaagugagucaacagcagcagccccugcaagaucaugcgcagaggagcccugcggugcuggcaccugcaaggagaccgaaggccacgugauuugucucugcccuccugguuacacuggcgagcauugcaauaucgaccaggaaguuugcgaagagggcuggaauaaauaucaaggccacugcuaucggcacuuuccggaucgugagacuugggucgacgccgagcgucgauguagagagcagcagucgcaccuuucuagcauagugacccccgaagagcaggaguuuguaaauaauaacgcccaggauuaccaauggaucggacugaacgauaggacgaucgagggggacuuccgguggagcgaugggcaccccaugcaguuugagaauuggcggccaaaccaaccggauaacuuuuuugccgcgggagaggauugcguggugaugauuuggcacgagaaaggagaguggaacgacgucccauguaauuaccaucugccauuuacuuguaagaagggaacugucgcauguggcgaaccgccagucguugagcacgcgaggacuuuuggacaaaagaaggaucgguaugagaucaacuccuuagucagauaccaguguacagagggguucgugcagaggcauaugcccacuauuagaugccagccgagcggucauugggaagagccacagaucacuuguacagacccaaccacuuacaaacggcgucuacagaagcguuccucgcgacacccgaggcgaucccguccaaguacagcccacuag

SEQ ID NO: 248012 - RNA, 1758 nt, Artificial Sequence
  Description of Artificial Sequence: Synthetic coding sequence
auggccgccguggaacucgaguggaucccugaaacucuuuauaacacugccauuagugcggucgucgacaauuauauaagaagcaggcgcgauaucaggagucuuccagaaaauauccaguucgacguuuauuauaaacuuuaccagcaaggaagguuaugucagcuaggaagugaauucugugagcuggaggucuucgcuaaaguacugagagccuuggauaagaggcaucugcuucaccauuguuuccaggccuugauggaccacggagugaaaguugcgucagugcuggccuauucuuucucacguagguguucuuacauugccgaaagugacgccgccguaaaagaaaaagcuauucagguuggauucgugcugggcggguuccuuagcgacgccggaugguauuccgacgccgaaaaaguuuuucugucuugccugcagcuuuguacacugcaugaugagauguuacacugguucagagcuguggaauguugcgugagacucuuacacguucgaaauggaaauuguaaauaucaccuuggcgaagagacguucaaacuugcccaaacuuacauggauaagcugucaaagcacggacagcaagccaauaaggcugcauuguacggagaacuaugcgcacugcuauuugcuaaaagccacuacgacgaggcuuauaaauggugcaucgaggcuaugaaagagaucaccgcuggccugccagugaaaguagucgucgauguccucagacaagccucuaaggccugcgucgucaagcgggaguucaagaaagcagagcagcuaaucaaacacgcuguauaucucgcacgugaccacuucggauccaagcaccccaaguacucugauaccuugcucgacuacggauuuuaucugcucaacguggacaacaucugccagucuguggcaaucuaucaggccgcacucgauaucagacagaguguauuuggcgguaagaacauucacgucgccacggcucaugaggaucuggccuauuccucuuacgugcaccaguacucuagcgggaaguuugacaacgccuuguuccacgcugagagggcuauuggcaucauaacccacauucugccugaggaucaucugcuucuugccaguaguaaacgcguaaaggcccucauacuggaggagauugcuauugacugccauaacaaggagaccgaacaaagacugcugcaagaagcacacgaucugcaccugucuucucuucaacuggcaaaaaaggcuuucggcgaauucaacguacagacugcaaagcacuacgggaacuugggcagacuuuaucagagcaugaggaaauuuaaggaggccgaggaaaugcacauuaaggccauccagauuaaggaacagcuccuaggccaggaggauuaugaggucgcucugagugugggccauuuggccucacuauauaauuacgacaugaaucaauacgaaaaugccgagaaacuguaucuccggucuauagccaucgggaagaagcuguucggcgaggguuauuccggucuugaguacgauuacaggggucugauaaagcucuacaacucuauugguaacuaugagaaagucuuugaguaucauaacguucucuccaacuggaauagauuacgagauaggcaguauuccguuaccgacgcuuuggaggacgugagcacaucuccacagucaacggaggaagucguucaaaguuuccucauuucccaaaacguggaggguccuuccuguuag

SEQ ID NO: 248013 - RNA, 354 nt, Artificial Sequence
  Description of Artificial Sequence: Synthetic coding sequence
augggaaccuggggcgccccacaucggacccugccaugcagaaaucgcggcgcuaugcagccgcgugucuuacuagugguggcccuccucgcccuucuugcuucugcuagggccagugaagcggaggaugcgucccuuuuaucguucaugcagggcuacaugaaacaugcuaccaagaccgccaaggaugcuuugagcuccguccaggagucacaagucgcgcagcaggcuagaggauggguaacagauggcuuuucuucccugaaagauuauuggucuacuguuaaggacaaguucuccgaguucugggaucuggauccugaagucaggcccacuagcgcaguggcugccuag

SEQ ID NO: 248014 - RNA, 168 nt, Artificial Sequence
  Description of Artificial Sequence: Synthetic coding sequence
augcagcccagagucuuacucguagucgcccuacuagcccuguuagcguccgcuagagcgagcgaggcagaagacgccagucuacuguccuuuaugcagggauacaugaagcaugccacuaaaacugcaaaagaugccuuguccucaguccaagaaucacagguguag

SEQ ID NO: 248015 - RNA, 954 nt, Artificial Sequence
  Description of Artificial Sequence: Synthetic coding sequence
augaagguccucugggcagcacugcuggugacauuccuggcuggcugucaggcuaaaguugagcaagcugucgagacagaaccugagcccgagcugaggcagcagaccgaguggcagucaggccagagaugggaguuagcccuggggagguuuugggauuaccugcgguggguacagacacugagugaacagguccaggaggaauugcugucgucacaggugacacaggagcuuagagcacugauggaugaaacgaugaaggagcuaaaggcguacaagagcgagcuugaagagcaacugacccccgucgccgaagagaccagggcccggcuuuccaaggagcuacaagcggcccaggccagacucggagccgauauggaggacgugugcggacgacuggugcaguacaggggcgaagugcaagcgaugcucgggcagucuaccgaggaacugcgggucagacuggcaagucaccugcgaaaacuuagaaaaagauuauugagagaugccgacgaccugcagaagagacucgccguuuaucaggcuggcgcuagggaaggcgcugaaagaggacucagcgcaauucgggagagacuggggccuuugguggagcagggaagaguuagagcagcgaccgugggaucgcucgcgggacagccucuccaggagagagcccaggccuggggugagagauuacgggccaggauggaggagaugggcagccggacaagagaucgcuuggacgaagugaaggagcaggucgcggaagucagagcuaaauuggaagagcaggcucagcagauuaggcuacaggccgaagccuuucaggcgagacugaaaaguugguucgagccccuuguggaggacaugcagagacaaugggcuggauuaguggaaaaagugcaagcugcagugggaaccucagcugcucccguccccucugacaaccacuag

SEQ ID NO: 248016 - RNA, 660 nt, Artificial Sequence
  Description of Artificial Sequence: Synthetic coding sequence
augaagguacuuugggcagcauuauuaguuacguuccuggcgggaugccaggccaaggucgaacaagccguugagacagaaccggagccagaacugcgucagcagacugaauggcagaguggucagcguugggagcuagcacuaggcagauuuugggacuaccugcgcugggugcagacuuuaucggaacagguccaggaggagcucuuauccucacaagucacccaggaacucagggcccugauggacgagacaaugaaggaacugaaggccuauaaauccgaacucgaggagcaacuuacaccaguggcugaggagacgagggccagacuguccaaggaacugcaggcagcccaagcacgucugggagcagauauggaagacguauguggacggcuuguccaauaucgcggggagguccaagccaugcuggggcagucuaccgaggagcuuagggugcgauuagccagccaccugaggaaacugcgaaaaagguuacucagagacgccgacgacuugcagaaaaggcuugccgucuaccaggccggagcacgcgaaggggccgaaaggggccugagcgcaaucagggaacgccuggguccacuaguggagcagggccgcgucagagccgcgaccgucgggucccuggcagggcaguag

SEQ ID NO: 248017 - RNA, 867 nt, Artificial Sequence
  Description of Artificial Sequence: Synthetic coding sequence
gaagucaaagaugugcuaccgcaggagccagugcgauccgcagugggcggcacaggaauguccucaggcgcuagccgcaaaucaugggaucccggcaauccauggccaccggacuggccgauuacgggccgcaaaaugaaagugcuuugggcagcccuacuggucacauuccuggcuggcugccaggccaaggucgagcaggcagucgagacggagcccgaaccagagcugagacaacagaccgaauggcaaucaggacagaggugggaacuagcguuggggcgguuuugggauuauuugcgauggguccagacacucuccgagcagguacaagaggaacuacugucaagucagguaacgcaggaauugcgcgcucugauggaugaaaccaugaaggagcugaaggcauauaaguccgagcuggaggaacaacucacuccggucgcugaagaaacucgcgcgagacugagcaaggagcuucaggcggcccaagccagacuuggugccgauauggaggauguguguggcagacuaguccaauacagaggcgaggugcaggcaaugcugggucagagcacggaagagcuccgcguuaggcuggccucccaucugaggaagcuuagaaagagacuacuacgggaugccgaugaucuucagaaaagguuggccguauaucaggcuggcgcgcgggaaggagccgagagaggacucucugcaauaagagagagauugggcccucugguggaacaggggcgggucagggcugcuaccguggguucuuuggcggggcagcccuuacaagaacgggcacaggcuuggggcgagcguuugcgggccagaauggaagagaugggcucaagaacauag

SEQ ID NO: 248018 - RNA, 651 nt, Artificial Sequence
  Description of Artificial Sequence: Synthetic coding sequence
augaaaguacugugggcagccuugcucgugacguuuuuggcggguugccaagccaaagucgaacaagcagucgagacagagccugaaccugagcuucgacagcagaccgaguggcagaguggccagaggugggaacuugcucucggacguuucugggauuauuugcguuggguucagacgcuaagugaacaaguucaggaagagcuuuuaagcucccaggugacucaggaguugcgugccuugauggaugaaacaaugaaggaacugaaggcauauaagagcgaguuggaagaacaguugaccccaguggcugaggaaacucgggcccgauugucuaaggaacugcaggccgcccaagcaagacucggcgcugacauggaagacgucugcgggcgucuagugcaguauagaggugaggugcaagcuaugcuuggccaguccacugaagaguuaagagugagacuagcaagucacuugaggaaacugagaaaacgccuucugcgcgaugcugacgaucugcaaaaacgauuggcuguguaccaggcaggagcgagagagggcgcugaacgcgggcugucugcaauuagggagagacucggucccuuaguagaacaagggaggguccgggcggcuacgguugguucauuguag

SEQ ID NO: 248019 - RNA, 1245 nt, Artificial Sequence
  Description of Artificial Sequence: Synthetic coding sequence
augcgguucaagucucacacuguugagcuucggaggccauguucugauauggaaggcgccgcacuuuuacgaguauccgugcuaugcaucuggaugagugcguuguuucuaggggugggcgugagagccgaggaggcaggggcacgcgugcagcagaacgugccuucaggaacugacaccggagacccacagucaaagccccuuggggauugggcggcaggaacaauggacccggaaucuaguauuuucauugaggacgccauaaaauauuucaaagaaaagguaagcacccaaaauuugcuacuucuacuaacagauaaugaggcauggaauggauucguugccgcugcagaacuccccagaaacgaggccgacgagcuucgcaaggcucuagauaaucucgcuagacaaaugauuaugaaggacaagaauuggcacgauaaaggucagcaguacagaaauugguuuuuaaaagaauuuccacgccugaagucugagcuagaagacaauauucgucggcugagagcccuugccgauggggugcaaaagguccacaaggggacaaccauugcuaauguugucagcgggucacugucaauuuccucggguauccuuacccuggucgggaugggccucgcaccauucaccgagggcgguagccucguucugcuggagccugguauggaacuggggaucacugcagcccugacagggauaacuucgagcaccauggauuacggaaagaagugguggacacaggcccaggcucacgacuugguuauuaaaagucuugauaaacuuaaggaagugagggaauuucucggugagaacauuucaaauuuccucucucucgccggcaacacuuaccaguuaaccagaggcaucgggaaggauauucgcgcacugcgccgagcucgagcaaaucugcaauccgugccacaugcuagcgcuucccguccucgaguuacggagccaaucucggccgaguccggagaacagguagagagaguaaaugagccaaguaucuuagaaaugagcagaggggugaagcuuacugacguggccccagucaguuuuuuccuggugcucgacgugguuuaccuaguguacgagaguaaacauuugcacgagggagccaagucagagaccgccgaagaacugaaaaaaguagcccaagagcuggaggagaaacucaauaucuuaaauaacaacuauaaaauucugcaggcggaucaggaacuuuag

SEQ ID NO: 248020 - RNA, 834 nt, Artificial Sequence
  Description of Artificial Sequence: Synthetic coding sequence
augauuaugaaggacaagaauuggcacgauaaaggacaacaguacaggaacugguuucugaaggaguucccccgcuuaaaauccgagcuggaggacaacauucgcagauuaagggccuuagcggauggagugcagaaagugcauaaggggaccaccaucgcuaauguggucucaggcucgcucucuaucucaucagggauacucacucuaguaggcaugggccucgcucccuucacugagggggguucacucguacuccucgagccuggcauggagcuggggauuacagcggcccugacaggcauaacuucaagcacaauggauuacggcaaaaaaugguggacccaggcccaagcgcaugaccuugugaucaaaucucuagauaaacugaaagagguacgggaguuccuuggcgaaaauaucuccaacuuucuaucccuggcaggcaauacguaccagcugacaagaggcaucgguaaagacauccgcgcccuccggagagcucgggcuaaccuacaguccgugccgcaugcuagugcgucuagaccacguguuacugaacccaucucagcagaauccggcgaacagguugaacggguaaaugaacccucaauucucgagaugagcagaggagugaagcucacggacguggcuccugugucuuuuuuuuugguucuggauguggucuaccucgucuaugagagcaaacaccugcacgagggcgccaagagcgaaacagccgaggaacugaagaagguggcacaggagcuggaagaaaagcuuaauauucugaacaauaauuauaaaauucuccaggcugaucaggaauuguag

SEQ ID NO: 248021 - RNA, 1197 nt, Artificial Sequence
  Description of Artificial Sequence: Synthetic coding sequence
auggaaggagcagcuuuauuacgggugagcguguuaugcaucuggaugucugcccuuuuucugggcguuggcgugcgcgcagaggaggccggugcccguguucagcaaaacguucccucuggcacugacaccggagacccccaaagcaaaccccuaggagauugggcagcgggaacgauggacccugaaucuagcaucuucauugaagaugccaucaaauacuucaaagagaaagugaguacacaaaaucugcucuuguugcuuaccgacaaugaagcguggaauggauucguagcagcggcagagcugccuaggaacgaggcugacgaacugcggaaggcacucgacaaucuugcacgucagaugaucaugaaggacaaaaacuggcaugacaaggggcagcaguaccgcaauugguuccucaaagaauuuccacgucucaaaagcgagcuugaagauaacauacgcaggcuccgcgcccuggcagauggcguucagaaaguucacaaagggacaaccaucgccaacguaguguccggauccuuaucaauuagcagcggaauacugacacucgucggaauggguuuagccccauucacugagggcggaagccugguucugcucgagccaggcauggaauuaggaauuacggcagcuuugacaggcauuacgagcuccaccauggacuaugggaagaagugguggacacaggcccaggcccacgaccuggugaucaagagcuuggacaaacugaaggaagugagggaguuucuaggggaaaacaucucaaauuuuuugagucuggccgggaauacauaucagcucacaagagggauugggaaagauauucgagcgcuaagacgggccagggcaaacuuacagucugugccacaugcaucagcaagucguccucgcguaaccgaaccuauaagugcagagucaggugagcagguggaaagagucaacgaaccaucuauuuuggagauguccaggggagugaaacucaccgaugucgcucccguuuccuucuuuuugguccuggauguaguauaucugguguacgaaucuaaacaccuccacgaaggggcaaagagugaaacugccgaggagcuuaagaagguagcacaagagcuggaagagaagcugaacauccugaauaauaauuauaaaauccuucaggccgaucaggaguuauag

SEQ ID NO: 248022 - RNA, 1197 nt, Artificial Sequence
  Description of Artificial Sequence: Synthetic coding sequence
auggagggagcagcacuccuuaggguuucagugcuauguauauggaugucugcacuuuuccuuggcgucggcgugcgcgcagaagaggcuggugccaggguacagcaaaaugucccgucagguacagacaccggugauccacagagcaaaccuuuaggagacugggcugccggcacuauggacccagaguccucaauuuuuaucgaagacgcaaucaaguacuuuaaggaaaagguauccacccaaaaucuucuauuauugcugaccgacaaugaggccuggaauggauuuguugccgccgccgaacugccuaggaacgaagcagaugagcucagaaaggcccucgauaauuuagcccggcagaugauuaugaaagacaagaauuggcacgacaaaggacaacaauacagaaacugguuccugaaggaguucccgaggcuuaaaucugaauuggaggacaacauacgcagacuaagagcacuggccgacggaguccaaaaagugcacaagggcacgacuauugcaaacgucgucagcggcagucugucaaucucgucuggaauucugacccucguggggaugggacuggcccccuucaccgaaggugguucccuggugcuucuggaaccaggaauggaguugggcauuacagccgccuugacaggaaucacuucuucaaccauggacuacgggaaaaagugguggacccaagcccaggcccacgaucucgucaucaagucccuggacaagcuuaaagaagucagagaguuucucggagaaaacaucucuaauuuuuuaagucuggccgguaauaccuaccaguuaacacgagggaucggcaaggauauuagggcuuuaaggagggccagggccaaucuucagagcgugccacacgccuccgcgucuaggccucgaguaaccgaaccuauaagugcugaaagcggagagcagguggaaagggugaaugagcccuccauacuggaaaugucacgcggagugaagcugacggacguggcaccagugucuuuuuuucuugugcuggaugucgucuaucugguguacgaaucuaaacaccugcacgaaggcgcaaaaucggagacugcugaggaacugaagaagguugcacaggagcucgaggaaaaacugaacauccugaauaauaauuauaagauuuugcaggccgaccaggagcucuag

SEQ ID NO: 248023 - RNA, 1197 nt, Artificial Sequence
  Description of Artificial Sequence: Synthetic coding sequence
auggagggcgcggcucuguugcgagucucugugcugugcaucuggaugagugcuuuauuccucggggugggcguacgagccgaagaggcuggagcacgcguucagcagaaugugcccuccgggaccgauacuggcgauccacagaguaagccccucggagacugggcugccgguacuauggaucccgaaucaucaauuuuuauagaggaugcuauuaaguacuucaaggaaaagguuuccacccagaaucuauuauugcuccucaccgacaaugaagcuuggaacggguucguagccgccgcagaacucccaaggaacgaagccgaugaacucaggaaagcucuggacaaccuagcgcgucagaugauuaugaaagauaaaaacuggcacgacaaaggacagcaguaucgaaauugguuucugaaagaguuuccgcggcugaaaagcgagcucgaggauaacauaaggcgguuacgagcacuggcagacgguguacagaaggugcauaagggcacaacuauagcuaacgucgucucaggcucacugucaauuuccucaggcauccuuacacugguggguaugggacuugcccccuuuacagaagguggcucucugguccugcuugaaccagggauggaacucggcaucacagccgcccugacaggaaucacgucuuccacuauggauuacgggaagaaaugguggacacaggcccaggcacacgacuuagugauaaaaagcuuagacaaacuuaaggaaguccgggaauucuuaggcgaaaacaucucuaauuuuuuaucccuggcggggaacacauaucagcugacgcgcggaauuggaaaggacaucagagcgcuuagaagagcccgcgcuaaccuccaguccgucccccaugcuagcgcuagccgccccagagucaccgagcccaucuccgcugaauccggagagcaagucgaacgggugaaugaacccaguauccuugaaaugucccguggcguaaaacugaccgauguggcgccuguuuccuuuuuucugguguuggauguuguuuaucucguuuacgagaguaagcaucuccaugaaggugccaaauccgagacugccgaggagcugaagaaaguugcccaggaacuggaggaaaaacucaauauucugaacaauaauuacaagauucugcaagccgaccaggagcuauag

SEQ ID NO: 248024 - RNA, 1197 nt, Artificial Sequence
  Description of Artificial Sequence: Synthetic coding sequence
auggaaggugcggcacugcuuagggucucuguccugugcauauggaugagugcauuauuuuuagguguaggaguaagagcugaagaagccggagccagaguucagcaaaacgugccuucagguacagacaccggagacccgcaguccaaaccucugggcgauugggccgcaggcacuauggacccugagucaagcauuuucauugaagacgcaauuaaguacuucaaagagaaagugucaacccagaaccuccuuuugcugcucacggauaacgaagcauggaacggguucgucgcugcugcugagcugcccagaaaugaagcugacgaauugcguaaagcccuugacaaucuugcucgccaaaugaucaugaaggauaagaauuggcacgacaaaggccagcaauaucgaaacugguuucugaaggaguucccaagauuaaaaucugaguuagaagacaauauucgucgucuuagggccuuggccgacgggguucaaaagguccacaaagggacaacaaucgcuaacgucgucuccggaucacuaucuaucagcagcgguauccugacacuugugggcauggggcuugcacccuuuacagaaggagggucacucguacuucuggaaccaggaauggaacugggcaucacugcugccuugacuggaaucacuaguuccacaauggauuacgggaaaaagugguggacccaggcccaagcucacgacuuggugauuaagagccuggacaagcuaaaggaggugcgcgaguuucucggggagaauauuucuaacuuuuuaucucuggcaggaaauaccuaucagcugacucgcggcauuggcaaagacauuagggcauuacggcgggcccgcgcuaaccuccagagcgucccccaugcaagugcaagccggccgagggugacagagccaaucagugcugagucaggcgaacagguggagcgcgugaacgaacccucaauccucgaaaugucgcgcggcgugaaguuaacagacguugcuccgguguccuucuuccuuguccucgacgugguauaucuggucuacgaaucuaagcaucuccacgaaggggcgaaaagcgagaccgcugaggaguuaaagaaaguggcccaggagcuagaggaaaagcugaacauucugaauaauaacuauaaaauuuugcaagcugaccaagaacucuag

SEQ ID NO: 248025 - RNA, 1143 nt, Artificial Sequence
  Description of Artificial Sequence: Synthetic coding sequence
auggaaggggccgcccuguugcgaguaucaguguuguguauuugggugcagcagaacguuccuagcggcacugauacuggcgacccccaaucuaagccccucggagacugggcagcaggaacuauggacccugaaucuagcauauuuauagaggacgccaucaaauacuuuaaagagaaggugucaacacagaacuuacugcuacuucugacugacaaugaagcauggaacggauuuguggccgccgccgagcucccccguaacgaggcugaugagcugcguaaggcacuggauaaccuugcaaggcaaaugaucaugaaagacaaaaauuggcaugacaaaggccaacaauaucgaaacugguuucucaaggaauucccacggcugaaguccgaacuugaagacaacauucgaagguuaagagccuuggcagaugggguccaaaagguucacaaaggcacaacuaucgccaacguugugagcgggucucugucaaucuccucuggaaucuuaacacucgugggaaugggauuagccccguucacagagggcggaucacugguacugcuggaacccgggauggaacugggaaucacugcagcccucacuggaaucaccagcagcaccauggacuacggcaaaaagugguggacccaagcucaagcucacgaccucguaaucaaaucacuggauaaacucaaagaagucagagaauuccuuggagaaaauauuucgaauuucuuaagccuggcuggaaauaccuaccaacucacacguggaaucggcaaagauauacgagcgcugcgccgagcaagggcaaacuugcaaagcgugccccaugcaagugcuaguaggccaagaguaacggagccaauuucggcggagaguggggaacagguugagagagugaaugagccaaguaucuuagagaugucucgaggcguuaaacucacagauguggcucccgugucauucuuucuggugcucgacgugguuuaccugguguaugagucuaagcaccugcaugagggcgcgaaaagcgagacagcagaggaacucaagaagguggcccaggagcucgaagagaaacucaauauccugaacaauaacuacaagauucuccaagcugaucaagagcuauag

SEQ ID NO: 248026 - RNA, 483 nt, Artificial Sequence
  Description of Artificial Sequence: Synthetic coding sequence
auggagggagcagcccuguugagaguuagcguguuauguauuuggaugucagcccuguuucugggggucggaguuagagcugaagaagcgggagcaaggguucaacagaacguacccucagggacggacaccggagacccucaauccaaaccucugggugauugggccgccggaacuauggaucccgagagcuccaucuuuauugaggacgccaucaaauauuuuaaagagaaaguuuccacccagaaucugcucuugcuacucacagauaacgaggcuuggaauggcuucgucgcugcugcagaguugccaagaaacgaggcugaugagcugaggaaagcccuggacaaucuagcccgccaaaugaucaugaaagauaagaauuggcaugauaagggccagcaguacagaaauugguuucuuaaggaguucccuagacugaagucagagcuggaagacaauauacgacgccugagagcuuag

SEQ ID NO: 248027 - RNA, 426 nt, Artificial Sequence
  Description of Artificial Sequence: Synthetic coding sequence
auggaaggagcugcguuauugcguguuuccgugcugugcauauggaugagcgcucuauuucucggggucggcgugagggcagaagaagcaggggccagagugcagcagaauguucccuccgggaccgauaccggagauccgcagaguaaaccucugggagacugggccgcaggcacaauggaucccggacccgcagggucucgaggugacucaggcgaaccguguacauugaggccugcaugccguggacagagacagcacggcggggcuucgcguaucagugccgaaggaccagccccgaugccacguagacguacgccaucgacugcgcaccuccguguaccaaagacuucaagacgcaaucugcugugcaugagggccgugucauuacucagaaugccccucuccaucagcagaaagaaguag

SEQ ID NO: 248028 - RNA, 357 nt, Artificial Sequence
  Description of Artificial Sequence: Synthetic coding sequence
augcgcuucaaaagucacacugucgaacuccgaaguacguugagccagccacuguucuccugcucaagacgacgcccuugcagugauauggaaggcgcugcgcugcugcgggugucuguucuguguauuuggauguccgcucuguuucugggcgugggagucagggccgaagaggccggugcuaggguucagcagaaugugccaagcgggacagacaccggagauccccagaguaaaccucucggagauugggccgcaggcaccauggaccccgaaucuaguaucuucaucgaagacgccauuaaauacuucaaggagaaaguuuccacacaaaaccugcuguuacuccugaccuag

SEQ ID NO: 248029 - RNA, 426 nt, Artificial Sequence
  Description of Artificial Sequence: Synthetic coding sequence
auggagggcgcugcauugcuccgcgugagcguccuguguauuuggaugagcgcacuauuucuuggagucggaguccgagcagaagaagcuggcgcuagagugcaacagaacguuccaucuggcacugauacuggagacccccaaagcaaaccccuaggugauugggccgccggcaccauggaccccggaccagcgggcucucggggagacaguggugaacccuguacacugcggccagccugccgaggucagcgacagcacggaggcgcaagcagaauuagcgcugaaggccccgcucccaugccacgcagacgaaccccaagcacugcacaccugcggguucccaagacaucccggcguaauuugcuguguaugcgggcggugucacuguuacggaugcccuuaaguauuagccguaagaaguag

SEQ ID NO: 248030 - RNA, 1014 nt, Artificial Sequence
  Description of Artificial Sequence: Synthetic coding sequence
augaacccagaguccucaauuuucaucgaagauuaccuaaaauacuuccaagaccagguuucuagggaaaaccuacuccagcuacuuaccgacgaugaagccuggaacggauucguggcugcagcagagcuuccuagagaugaagcugacgagcugcgcaaagcccucaacaaacuggccucucauauggucaugaaggacaagaaucggcacgacaaagaccaacagcaucgacaaugguuccucaaagaauuccccagacucaagcgggagcuugaggaccacaucagaaaauuacgggccuuagcugaggaggucgaacaggugcaucggggcacaacgauagccaauguagugagcaacagcguagggacaacuagcggcauccuuacauuacuggggcuaggacucgcucccuucacggagggaaucucuuucgugcuccucgacacuggaaugggguugggagccgcagcugcaguggccggaauaacuuguucugugguggaacugguuaauaaguuacgagcccgugcccaggcccgaaaucucgaucagagcggaacuaaugucgccaaagucaugaaggaguuuguggggggaaacacaccuaauguccuuacccucguggacaacugguaccaagugacucagggaauuggcaggaauaucagagccauucgccgggcgcgcgcuaauccccagcugggugccuacgcaccgcccccucacauuauuggcagaaucagcgcggaggggggcgaacagguugagcgugugguggagggccccgcccaggccaugagucggggcacuaugaucgugggggccgcaacagggggcauuuuacuccugcuggacguagucucucuagccuacgagaguaaacaccuguuagaaggagcaaaaucagagagcgcggaagaauuaaaaaaacgggcacaagaacucgaggguaaauugaacuucuugacaaagauucaugagaugcuucaaccuggccaggaucaauag

SEQ ID NO: 248031 - RNA, 1014 nt, Artificial Sequence
  Description of Artificial Sequence: Synthetic coding sequence
augaacccugagaguagcaucuucaucgaggacuacuuaaaauacuuucaggaucaagugagucgcgaaaaccugcuucagcuucugaccgaugacgaggccuggaacgguuuuguugcugcagcugaguuaccgcgcgacgaggcagaugaguuaagaaaggcgcugaauaaacucgccucacacaugguaaugaaggacaaaaaccgccacgauaaggaccagcagcauagacaaugguuucucaaagaguucccccgccugaagcgcgagcucgaagaccauauccgcaaguuacgggcacucgcagaagagguggaacaggugcaccggggcaccacgauagcuaauguggucagcaauucuguugggacgacaucaggcauccuuacacucuuaggucucgggcuagcuccauuuacugaggguaucagcuucguccugcuugacacgggcaugggccuuggugcagccgcugccgucgcuggaaucacaugcucuguuguagagcucguaaauaagcuuagagcuagggcacaggcccgcaaccucgaucagucuggcacaaacgucgcuaagguuaugaaggaauucguugguggaaauacucccaauguacugacacugguggacaauugguaccaggugacccaaggcaucggccggaacaucagagcuauucggagagcuagagcaaacccccagcugggagcuuaugcccccccuccacacauuauagggaggauuagugcugaaggaggagagcaggucgaacgaguaguggagggucccgcccaggcuauguccagaggcaccaugaucguaggcgccgccacuggugguauacuacuccuccuggacguaguaagccuggcuuacgaaagcaagcaucuccuugagggugccaaaagugaaagcgcagaagaacugaagaaaagagcucaggagcucgagggaaaguugaauuuucuaacuaagauucaugagaugcugcagccaggacaggaccaauag

SEQ ID NO: 248032 - RNA, 1350 nt, Artificial Sequence
  Description of Artificial Sequence: Synthetic coding sequence
augcauuccuggacaugggauccacauucaagugaacagcucgaccuggcucagucacugagcgaggaagauccacuaucuagccugcgagguucuauucagccccagccuccagccgaggcuccagacaaaggcgggucccaagcaaacaaugauccuggcggaugggaucccgguuguucuagcucccaggugcuggggcgcaccagggguccuugccuaggggucaggguuagggaagaagaagccggaaccagggugaaggaaaaucuacccguuuggaccgugacaggggaacuacaaggaaaaccucucggaaacccugccgccgggaccaugaauccagaguccuccaucuucauugaggauuaccuuaaguauuuccaggaccaggucucacgagaaaaucuccuacaguugcuuaccgaugaugaggcguggaacgguuuuguggcugccgccgagcuuccacgugacgaggccgacgaauugaggaaagcucugaauaagcuugcgagucacaugguaaugaaggacaaaaaccgacaugauaaggaccagcaacaccggcaaugguuuuugaaagaauucccuagacucaagcgggaacuggaggaccauauccguaagcucagggcauuggcagaggaaguggaacaagugcauagagguacgacaaucgccaacguaguaaguaauuccguggguacaaccucuggcauacucacccugcuugggcuaggucucgcaccuuuuacugaaggaaucucauucguguuguuggauacgggcaugggccucggcgcagcagccgccguggcaggcauuacuuguucaguuguugaguugguuaacaaacugcgcgccagggcacaggcaaggaaccuggaucaguccggcaccaacguugcuaagguaaugaaggaguucgucggugggaacacaccaaacgugcuuacucuuguagacaauugguaucagguuacucaaggaaucggccguaauauucgugccauaagaagggcucgagcgaacccccaacuaggggccuaugcaccacccccccacaucauuggaaggaucagcgcagaaggcggcgaacaggucgaacguguuguagagggcccugcccaggcaaugucacguggaacaaugaucgugggcgccgccaccggugggaucuuacuccuuuuagacgugguuagccuugcauaugagagcaaacaucuccucgagggcgcaaaaagugaguccgcugaagaacugaaaaaaagagcccaagaacuggaggguaagcugaauuuucugacuaaaauucaugaaaugcuacagccaggacaagaucaguag

SEQ ID NO: 248033 - RNA, 225 nt, Artificial Sequence
  Description of Artificial Sequence: Synthetic coding sequence
augaacccugaaagcagcauuuucaucgaagacuaccuuaaauacuuucaagaccaagucaguagagagaaucuucuucaacugcuuacugacgacgaagccuggaacggcuucguggcugcagcugaacuaccaagggacgaggcagaugaacugagaaaggcucuuaacaagcuagcuucccacaugguuaugaaggauaagaaccggcacgacaaagacuag

SEQ ID NO: 248034 - RNA, 387 nt, Artificial Sequence
  Description of Artificial Sequence: Synthetic coding sequence
augaaccccgaaucgucuauuuucauugaggacuaucuuaaauacuuccaggaucagguuagccgggaaaaccuacugcaauugcugaccgacgacgaagcuuggaacggauuuguggcugcugccgagcuaccgagagaugaagcugacgaguugcggaaggcguuaaauaagcuugccagccauaugguuaugaaggauaaaaauagacacgacaaagaccagcagcaccgccagugguuccugaaggaguucccuagacugaaaagagaacuggaagaccauauccggaaacugagggcauuggcugaggagguggaacaagugcaucgcgggacuacuauagcaaacguggugagcaauuccgugggcacaacaucuggauag

SEQ ID NO: 248035 - RNA, 324 nt, Artificial Sequence
  Description of Artificial Sequence: Synthetic coding sequence
augggauccuggguucagcucaucaccucagucggcacgagcgggcucuuucuaggcguacgcguccgggaagaaggcgcgggaaugcgauguucgaaaaccauacaggcgggccaauggcuggacaguaguaaaggcccacuugguccuuccccccccccuguucccaccgcagguuacuccagcuccuuuugcgugcacuacgucaacuugcuccccggcguacuuguccugucaguuaccucucaguacccacaucucucgauggcucuuugccaguuagccgcccacgacuggccccgucugucuuguguguguguuuag

SEQ ID NO: 248036 - RNA, 1044 nt, Artificial Sequence
  Description of Artificial Sequence: Synthetic coding sequence
augggauccugggugcaauuaauaacaagugucggcguucaacaaaaccauccaggcuggaccguugcaggacaauuucaagagaaaaagagauuuaccgaagaggucaucgaauauuuccaaaagaagguaaguccaguucaccuuaaaauucuacugacuucggacgaagccuggaagagauucguucggguggcugagcugcccagagaagaggcugacgcccuuuacgaagcucugaaaaacuuaacaccauacguggcuaucgaggacaaggacaugcagcagaaagagcaacaguuuagagaaugguuccucaaguuuccucagaucagguggaaaauccaagaaaguauugagcggcuaaggguaauugcuaaugaaauagaaaagguacaccgcggaugcguaauugcaaacguuguauccgggucaaccggcauccucuccgugauuggaguuaugcuggcccccuucaccgccgggcuuucacuaagcaucaccgcagcugguguuggacucgguauugcuucggccaccgccggaaucgcuucuuccaucguggagaacacguacaccagaucugcagagcuaacggcaagcagacucaccgcaaccuccacagaucaacucgaagcacuccgagauauccugcgagauaucacaccuaauguacugucuuuugcauuggacuucgaugaggcuaccaaaaugaucgcaaaugacguccauacccugagaagauccaaggcuacagucggcaggccuuugaucgcuuggcgauacgucccaauuaacgucguggaaacccuccgcacuagaggcgcucccacgaggaucgugcguaagguggcaaggaaucuugggaaagcaacuucuggugugcuggucguacuugaugugguuaaucuggugcaggacucucucgaccuucacaagggagccaaaucagaguccgcagaaagucuucggcagugggcacaagagcucgaagagaaccugaacgagcuuacucacauucaccagagccucaaggcaggguag

SEQ ID NO: 248037 - RNA, 1053 nt, Artificial Sequence
  Description of Artificial Sequence: Synthetic coding sequence
auggaaggugcugcauuacugaagaucuuugugguuugcaucugggugcaacagaaucacccuggguggacuguggccgggcaguuccaagaaaaaaaacgcuucacagaagaggucauugaguauuuccaaaagaagguguccccuguucauuuaaagauuuuacugacgagugacgaagccuggaagcgguuugugcgugucgccgaauugccacgcgaagaagccgaugcauuauacgaggcucuuaagaaccugacaccauacguggccauagaagauaaggacaugcagcagaaggaacagcaauuccgggagugguuucuuaaauuuccccagauaagguggaagauccaagaaucuauugaacgauuacgaguuauagccaacgaaauagagaaggugcaccggggcugugucauagcuaauguugucagcggcagcacaggaauucugucugucauuggcguuaugcuggcgccauucacggcaggacugucacuaaguauuacggcagcaggaguggggcucgggauugcauccgcuaccgccgggauugccuccaguauuguggagaauacauacacaaggucugcagagcucaccgccuccagacugaccgccacaaguacugaucagcuggaagcccugagagacauucuucgcgacauaacacccaacguccuguccuuugcccuagacuuugacgaagccaccaagaugauugccaacgacgugcacacccuccggcggucaaaagcgacagucggaagaccguuaaucgccuggcguuaugugccuauuaacguugucgagacccugcgcaccagaggugcgccaacacgaauuguucgcaagguggcacgaaaucugggaaaagccacaucugggguucugguggugcuugacguggugaauuuggugcaggauagucucgaccuccacaaaggcgcaaaaagcgaaucagccgagagcuugcggcagugggcccaggagcuggaagagaaucuaaacgagcugacacacauccaucaaagucugaaagccgguuag

SEQ ID NO: 248038 - RNA, 393 nt, Artificial Sequence
  Description of Artificial Sequence: Synthetic coding sequence
auggaaggcgcugcacuuuugaaaauauucgugguuugcauuugggugcaacaaaaucauccugguuggacagucgcugggcaguuccaagaaaagaaaagguuuaccgaggagguaauugaguacuuccagaagaaagugucuccugugcauuuaaagauauuacugacuagugaugaggcauggaagcgauucguucgcguggcugaguugccccgggaggaagcagacgcccuguacgaggcccuuaaaaaucugacccccuacgucgcuauugaagacaaagacaugcagcagaaggaacaacaguucagggaaugguuucugaagguaucaaguaaucaaauggaagacagcggaguucaccguaaggccucaugccacugcaaguag

SEQ ID NO: 248039 - RNA, 384 nt, Artificial Sequence
  Description of Artificial Sequence: Synthetic coding sequence
auggguaguuggguccagcugauuaccuccgugggugugcagcaaaaucaccccggcuggacaguggccggucaauuccaagagaagaagcgauuuacugaggaggucaucgaauacuuccagaagaagguuagccccgugcaucugaaaauccugcucacaagugaugaggccuggaaaagauuuguccgcguggccgagcuaccacgggaagaagccgacgcauuguaugaggcucugaagaaucuaaccccuuacgucgcaauagaagauaaagacaugcagcaaaaggaacagcaguuucgcgaaugguuucuaaagguuagcucaaaccaaauggaggauuccggcgugcaucguaaagccaguugucacugcaaauag

SEQ ID NO: 248040 - RNA, 198 nt, Artificial Sequence
  Description of Artificial Sequence: Synthetic coding sequence
auggguucuuggguucaacucaucacuagcguaggcguccagcagaaucaccccggauggacuguggcagggcaguuccaagagaaaaagcgcuucaccgaagaagucaucgaauauuuccagaaaaaagucagcccagugcaccugaaaauucuguuaaccucugaugaggccuggaagagguucgucagggucuag

SEQ ID NO: 248041 - RNA, 384 nt, Artificial Sequence
  Description of Artificial Sequence: Synthetic coding sequence
auggggagcugggugcagcugaucaccucuguugggguucagcagaaucauccaggcuggaccguggccggacaauuccaggagaagaaaagauuuacagaagaagugaucgaauacuuccagaagaagguuaguccuguucaccucaaaauacucuugaccuccgacgaggcauggaagagguucguccguguagcagaauugccccgcgaagaagcugacgcacuuuacgaagcucucaagaauuugacaccuuacguugccaucgaggacaaggauaugcagcagaaagaacagcaguuuagagagugguucuuaaaaguuuccaguaaccaaauggaggacucaggagugcaccgcaaggcuucgugucacugcaaguag

SEQ ID NO: 248042 - RNA, 183 nt, Artificial Sequence
  Description of Artificial Sequence: Synthetic coding sequence
augggaagcugggugcaguugauuacuucugucggaguccaacagaaucacccuggauggacagucgccgggcaauuucaggagaagaaaagauuuacagaagaaguuauugaguauuuccagaaaaagguaaguccagugcaucugaaaauucuuuugacuuccgaugaagcauggaaauag

SEQ ID NO: 248043 - RNA, 219 nt, Artificial Sequence
  Description of Artificial Sequence: Synthetic coding sequence
augggcucaugggugcaguuaaucacaagcgugggagugcaacaaaaucacccaggauggacuguggcuggacaauuccaagaaaagaagcgauucacagaggagguuauagaguauuuccagaaaaaggugagccccguucaucugaaaauuuugcuuacuucagaugaggccuggaaaagauuugugcgaguggcugagcuuccaagagaggaguag

SEQ ID NO: 248044 - RNA, 213 nt, Artificial Sequence
  Description of Artificial Sequence: Synthetic coding sequence
augggcucgugggugcagcugauaacuucugugggcguccagcagaaucaucccggguggaccguagcuggccaguuucaagaaaaaaagcguuuuaccgaagaagugaucgaauauuuccaaaagaaagugucacccgugcaucugaagauacuccuuaccagcgaugaggcuuggaaacgguuuguccgcguugccgagcuaccuagauag

SEQ ID NO: 248045 - RNA, 2223 nt, Artificial Sequence
  Description of Artificial Sequence: Synthetic coding sequence
augacagugaaacucgacuucgaggaaugucucaaagacucgccucgcuuccgcgcuagcaucgagcugguugaggcugaggugucagaacucgagacucgccuggagaaacuucuuaaacugggcacaggacugcuggagagcggacgccauuaucuagccgcuaguagagccuuuguaguuggaauuugugauuuggccaggcugggcccgccggaacccaugauggcagaaugcuuggaaaaauucacugucagccugaaccauaagcuggauagccaugcagaacugcucgaugccacccagcacacuuugcaacagcagauccagacacuggugaaggagggccugagaggcuucagggaggcacggcgggauuucuggagaggggccgagucguuggaagcagcuuuaacgcacaacgcagaggugccuagacgaagggcccaggaggcugaggaagccggcgccgcgcugagaacagcacgagcaggauauagagguagagcucuggacuacgcucugcagaucaaugucaucgaggacaaacgcaaguucgacauaauggaauucguacucagacugguagaagcacaggcuacacacuuucagcaggggcaugaagaauuaucaagacugagccaguauagaaaggaauugggcgcccagcugcaccaguugguuuugaauuccgcacgcgagaagcgagauauggaacagcggcacgugcuccugaagcagaaagaauuggguggagaagagccagaaccgucuuugcgcgaaggcccuggaggacucgugauggaagggcaucucuucaaaagagcuaguaaugcuuucaagaccuggucccguagaugguucacgauucagucuaaucaguugguguaucagaagaaguauaaagaucccgugacaguugucguagaugaccuacggcuguguacagucaagcuaugccccgacagcgagcgcagauuuugcuuugaagugguaaguaccucaaaaucuugccuguuacaagcugauucggaacgccuuuugcagcuguggguaucagcagugcaguccucuauugccucggccuucagccaggcaagacuggacgauucucccagaggaccuggccaggguaguggacauuuggcaauugguagcgcggccacucuuggcucaggcgguauggcgcgcgggcgagagccuggcggggugggacacgucguugcgcaagugcagucggucgaugggaacgcccagugcugcgacugccgcgagcccgcucccgaaugggcuucaaucaaccuuggggugacccuuugcauucaguguucuggaauucaucgaagccugggggugcauuuuucuaaggugcgaagucugacgcuagauagcugggagccugaauuggucaagcugaugugugaguuaggaaaugugauaaucaaccagauuuaugaagcccgcguagaggcgauggcugugaaaaaaccugggccaagcugcaguaggcaggagaaggaggcguggauccacgcuaaguaugucgaaaagaaguuccugacaaagcuucccgaaaucaggggaagacgcgguggacguggaagaccacgaggccagccucccguucccccaaagccgaguaucagaccccguccuggcagccugcgcagcaagccugaacccccuagcgaggaucugggaucacuccacccuggagcguuguuguuuagagcuagugggcaccccccaucuuugccuacaauggccgaugcuuuggcucacggugccgauguuaacugggucaaugggggccaggacaaugccaccccucugauucaggcaaccgccgcaaauucccuccuggcuugcgaguucuugcugcagaacggggccaaugugaaucaagccgacagugccggaaggggaccccugcaccacgcuacaauucuuggucauacagggcuagccugcuuguuccucaaacgcggggccgaccuaggcgcaagggauuccgaagguagagauccgcugacaauugccauggagacggcuaaugcugacauugugaccuuacuccgccucgccaagaugcgagaagcagaggccgcccaaggccaggcuggagaugagacauaccucgauauuuuccgggauuucucccugauggcgucagaugaccccgagaagcucagccgccggucucaugaccuucauacucuguag

SEQ ID NO: 248046 - RNA, 1290 nt, Artificial Sequence
  Description of Artificial Sequence: Synthetic coding sequence
augcaacugcggaaccccgagcugcaucugggcugugcacucgccuugcgauuucuggccuuagucucuugggauauucccggcgcccgcgcuuuagacaauggccuagcuaggaccccuacaauggguuggcugcacugggagcgguucaugugcaaccucgacugccaggaggaaccagacucuuguauuucugaaaaauuauucauggaaauggccgaauuaauggucagcgaaggcuggaaggaugcuggguacgaguaucucugcauugacgauugcuggauggcaccgcaaagagacucagaggggagguuacaggccgauccacaacgcuucccacauggcaucaggcaguuggcuaauuacgugcacagcaaaggccugaagcugggcaucuaugccgacgucggaaacaaaacuugugccggcuuccccggcucauucggauacuaugauaucgaugcucaaacauuugccgacuggggaguugacuuacuuaaauucgacgguugcuauugcgacagucucgagaaccucgcagauggcuacaaacacaugucccucgcccucaaucguacuggccggucaauuguuuauagcugugaguggccccucuauauguggccguuucagaaacccaauuauacagagauaagacaguacuguaaucauuggaggaauuuugccgauauugaugauagcuggaaaucgauaaagagcauccuagauuggacaucauucaaccaagagagaauuguggacguugcugguccuggcggauggaaugauccggauaugcugguaauuggcaauuucggccucuccuggaaccagcaggucacccagauggccuugugggccauuauggcagccccccuguuuaugagcaacgaccucagacacauuuccccgcaggcaaaggcauuguugcaggacaaggacguuauagcaaucaaccaagauccacugggaaagcaggguuaccaacugcgucaaggagauaauuucgaagugugggaacgucccuugagugggcucgcaugggcuguugcuaugauuaauagacaggagaucggugguccucgcucauacacuauugcgguugccagccugggcaaagggguugcguguaaucccgcaugcuucauaacacagcuguugccggugaagcgcaaacugggcuucuaugaguggaccagcaggcuccggucucacaucaauccuacaggcaccguucuccugcagcuagagaauacaaugcagaugucacugaaagaccugcuguag

SEQ ID NO: 248047 - RNA, 1386 nt, Artificial Sequence
  Description of Artificial Sequence: Synthetic coding sequence
augcagcgcguuaacaugaucauggcagaaaguccuggccuuaucacaauaugucuucuuggauaccuguugagcgcagaaugcacuguauuucucgaccacgagaaugcaaauaaaauccuuaaucgaccuaagagguauaauuccggcaaacuugaggaguucgugcaaggcaaucuugaacgcgaaugcauggaagagaaaugcaguuucgaggaagccagagagguauuugaaaacaccgaacguacaacugaauuuuggaagcaauacguggauggggaccagugugagucaaacccaugucugaacggagggaguugcaaagaugauaucaacucuuacgagugcuggugcccauuuggguucgagggcaagaacugugaauuagaugugacuugcaauaucaaaaauggccggugugaacaguucuguaaaaacucagccgacaauaaagucgucugcucauguacugaaggguaccgccuggccgaaaaucagaagagcugugaacccgcugugcccuuuccgugcggacgugucucugugucacagaccucgaagcugacgcgagcagagacaguguucccugauguggacuacgugaacagcacagaggcggagacgauacucgauaacaucacacagagcacucagucauuuaacgauuuuacaaggguaguaggaggugaggacgcaaaacccggacaguuuccuuggcagguuguacugaaugggaaaguagaugcguuuugcggugguucaaucgugaacgaaaaauggauugugacagccgcucauuguguggaaacuggagugaaaauaaccguagucgccggagaacacaacauugaagagaccgaacauacagagcaaaagcgcaacguuauacggaucauuccucaccauaacuauaaugccgcaauaaacaaguauaaucacgacauagcacuucuggaacucgacgagccccugguacugaauucuuacgugacaccaauuugcaucgcugacaaagaguacaccaacauauuucuaaaguuugguagcggauacgugucaggcugggguagaguguuucauaagggucguucagcccuaguucugcaguaccucagaguuccacuggucgauagagcuacuugcuuaagaaguacaaaauuuacuaucuacaauaacauguucugugccggcuuucaugaaggagggagagacucaugucagggagauagcggaggcccucacguuaccgaaguggaagggacgaguuuuuugaccggcauaaucagcuggggcgaggaaugugcaaugaaagguaaguacggcaucuacacuaagguuuccagguacguuaacuggaucaaggagaagaccaagcugacauag

SEQ ID NO: 248048 - RNA, 1365 nt, Artificial Sequence
  Description of Artificial Sequence: Synthetic coding sequence
augccucgcugcccagcuggcgccauggacgaagguccgguugaucugcgcaccagaccaaaggcagcggggcugccaggagcugcuuugccccucaggaaacgcccacugcgugccccaucaccugagccugcugccccccggggagcugcgggccuagugguaccacucgacccccuaagaggcggcugcgaucugcccgcuguacccgggccgccgcauggauuggcaagacccgaagcucucuauuaccccggagcacuguuaccccuguacccaacccgggccauggggucccccuucccccuggucaaucucccaacuccacuuuacccuaugaugugccccauggagcauccgcucagugccgauauugccauggcuacacgggcagacgaagacggagacaccccacugcauauugccguugugcaggggaaucugccagcuguacacagauuggugaauuuguuccagcagggagggcgcgaacucgacauuuacaauaauuuaagacaaacuccccuucaccuugcuguaauuaccaccuugcccucaguggugagauuacucgugacagcaggugccagcccaauggcccucgaucgacauggccagacagcugcccaccuggccugcgagcaccgcucuccuaccugccugcgugcacuucuggauagugccgcccccgguacacuggaccuagaagcccggaacuacgacgggcuuaccgcucuucacguggcagugaauacugagugccaagaaacagugcagcucuugcuugaacggggcgcggauauugacgcaguggacaucaaaaguggaagaagcccgcugauccacgcagucgagaauaacucucugagcauggugcaacuguuacugcaacacggugcaaaugugaacgcccaaauguacucagggucaagugcucugcauagcgcgagugguagggggcugcucccccuugugagaacccuuguaaggaguggggcugacaguucucugaaaaacugccauaacgacacaccccucaugguugcacgcagcagacgcgucaucgacauccuaagagggaaagcuacucggccugccagcacaagccagccggacccaucccccgaccggucagcgaacacuuccccagaauccagcaguagacuuucuuccaacggccuucucucagcaagccccagcaguaguccuagucagaguccgccccgggacccuccaggauuucccauggcaccaccaaacuuuuuuuugcccucccccaguccucccgcauuucugccuuucgccgggguucuccgcgggccaggaagaccaguaccgccuucucccgcacccggcggaucuuag

SEQ ID NO: 248049 - RNA, 417 nt, Artificial Sequence
  Description of Artificial Sequence: Synthetic coding sequence
augaaggaauacucagguuuugccggggucaguaggcccagaggaacauucuuucggaucagagggcgggggcgagcucgagguguguucgcgggcacuaauacagguccuaacaauaguaauaccacuuuucaaaaacggccaaaggaagaagagugggauccagaauauacucccaaaucuaaaaaguacuuccuccacgacgaucgagacgacgguguagauuauugggcuaaaagagguagaggcagagggacauuccagcgaggaagggguagauuuaauuucaagaagagcggaucaucaccaaaauggacucacgauaaauaccagggggauggcaucguggaggaugaagaagagacaauggagaauaacgaggagaagaaagaccggcguaaagaagagaaggaauag

SEQ ID NO: 248050 - RNA, 1530 nt, Artificial Sequence
  Description of Artificial Sequence: Synthetic coding sequence
augaccgucaccuacacagcacgcgucgccaacgcacgguucggcggauucagccagcugcuguuguuauggcgugguaguauuuauaagcuacuuuggagggaacuccugugcuuucucgguuucuauauggcccucucugccgccuacagauuuguucuuacagaaggccagaaacgguacuucgagaagcucgucauuuacugugaucaguaugccagucugauuccugugaguuuugugcugggauucuaugugacccucguggucaaucgcugguggucgcaguaccugugcaugccccucccugacgcacuuaugugcgugguggccggcaccgugcaugggcgagaugaccgcggcaggcuguacaggcgcacccugaugcgcuaugcaggucuauccgccgucuugauccugcguagcguguccaccgcuguguucaagcgauuuccuacaauugaucauguuguugaagcaggauuuaugaccagagaagaacgcaaaaaguuugagaaccucaauucaucauauaacaaauauugggucccuugcgugugguucaguaaccuggcagcgcaggcacgucgggaaggacggauccgagauaacagcgcccuuaaguugcugcuugaagagcugaauguguuccguggcaaaugcggcaugcucuuucacuaugacuggaucaguguuccacucguuuacacgcaggucgucaccaucgcccuuuauucuuauuuccuagcuuguuuaaucggccgccaguuccuagauccugcucaggguuauaaagaucacgaccucgauuugugcguuccuaucuucacccuacugcaguuuuucuuuuaugccggauggcugaaaguagcggagcagcugauuaauccguucggagaagacgacgacgauuuugagaccaacuuucucauugaccggaacuuucaaguuuccaugcuugcugucgaugagauguaugaugacuuggcuguuuuggagaaggauuuguacugggacgcagccgaagcccgagcucccuauaccgcugccacuguguuccagcugcgacagccaaguuuccagggguccacuuuugauauuacacuugcgaaagaggauaugcaguuccaaagguuagacggacuggacggccccaugggcgaagcuccaggcgacuuucuccagagacugcuuccugccggggcagguaugguggcuggcggaccacuuggucggagacugucuuuccucuuaaggaaaaauucaugugucagugaagccuccacgggugcauccugcuccugugcugucguuccugagggagcagcuccugaguguucaugcggggacccucuguuggacccaggauugcccgagccagaggcuccccccccugccgguccagaacccuugacucucauccccggaccagucgagccauucuccauagugacgaugcccggcccacggggccccgccccuccaugguugccaucacccaucggcgaagaggaggagaacuuagcguag

SEQ ID NO: 248051 - RNA, 306 nt, Artificial Sequence
  Description of Artificial Sequence: Synthetic coding sequence
augucccgauccguugcccucgcuguccucgcccuuuuaucuuugagcggacuugaagccauucagcgaaccccuaaaauccagguauacucuaggcacccggccgagaacgggaaguccaauuuucugaauugcuaugucagugguuuucacccuucugacauugagguugaccugcugaagaauggcgaacgcaucgagaaggucgagcacucugauuuaagcuuuucaaaagacugguccuuuuaucugcuguacuauacugaguuuacuccaacugaaaaaauguccaugccagcgguguag

SEQ ID NO: 248052 - RNA, 369 nt, Artificial Sequence
  Description of Artificial Sequence: Synthetic coding sequence
auguccagauccguggcacuugccgugcucgcauuacucucccugucaggccucgaggcuauccagagaacgccgaaaauccaggucuacagucgacauccggcggagaacggaaaaucaaacuucuugaacugcuacgucucaggauuucauccaagcgacaucgagguggacuugcuuaagaauggagaacgcauugaaaaagucgaacacagcgaccuaaguuucucuaaagauuggucauucuaucugcuuuauuauacagaauuuacgccaacagaaaaagacgaguacgcauguagaguuaaccacgucacauugagucaaccuaagaucgugaaguggggaaaaagcuacauccuccuguag

SEQ ID NO: 248053 - RNA, 360 nt, Artificial Sequence
  Description of Artificial Sequence: Synthetic coding sequence
augagccgcucuguggcccucgccguacuugcccuccuuucucugagugggcucgaggcgauccagcgaaccccaaagauacaagucuauuccagacaucccgcagagaacgguaaaucuaauuuucuaaacuguuacgucucuggcuuucaccccucugauauugagguagauuugcuuaaaaauggagaacguauugaaaaaguugaacauucagaccuaucguucaguaaagacuggucuuuuuacuuguuauauuauaccgaguuuacaccaacugagaaggacgaguaugcaugucgagucaaccacguaacuuuaagucagccaaaaaucgugaaaugggacagagacauguag

SEQ ID NO: 248054 - RNA, 369 nt, Artificial Sequence
  Description of Artificial Sequence: Synthetic coding sequence
augucgaggucaguggcccuggcugugcuagcccugcugucccuuuccggacuagaagcuauccaaaggacgccaaagauucaggucuauucacgacauccugccgagaacgggaaaucuaacuuuuuaaacuguuaugugaguggauuccauccauccgauaucgaagucgaccuucucaagaauggagaacgcauagagaaagucgagcacuccgaucugaguuuuucuaaggacugguccuucuaucuccucuacuauaccgaguucacccccacugagaaagaugaguacgcaugccggguuaaccaugucacccugucucagccuaaaaucgucaaauggggaaaaucuuacauucuccuauag

SEQ ID NO: 248055 - RNA, 360 nt, Artificial Sequence
  Description of Artificial Sequence: Synthetic coding sequence
augucacggucuguagcacucgcaguguuggcccuucugagcuuaucuggucuugaagcuauucagcgcacgccaaaaauacagguguacagucgacauccugcugagaauggcaaaagcaauuuucugaacugcuacgugucuggcuuccacccaucagauauagaagucgaucuucucaagaacggcgaaagaauagagaagguggagcacagugaucuaucuuuuuccaaggauuggucuuuuuacuugcuuuacuauacagaauuuaccccaacagaaaaggacgaguaugcaugcagaguaaaccaugucacccugagccagccaaagaucgugaaaugggaucgggacauguag

SEQ ID NO: 248056 - RNA, 360 nt, Artificial Sequence
  Description of Artificial Sequence: Synthetic coding sequence
augagccgcuccgucgcacucgccguccuggcccuucuuaguuugucugguuuggaggcuauccaaaggacccccaagauccaaguuuacagucgccacccugcugagaauggaaagagcaauuuccucaauugcuacguuucaggcuuucauccuuccgauaucgaggucgaucuacucaaaaauggggaacggauugaaaagguggagcacagcgaccugucuuuuucaaaggacugguccuuuuaccuguuauacuauaccgaauuuacuccaaccgagaaagaugaguaugcaugucgggucaaccacguaacacugucucagccaaaaaucgucaaaugggaucgggauauguag

SEQ ID NO: 248057 - RNA, 1536 nt, Artificial Sequence
  Description of Artificial Sequence: Synthetic coding sequence
augagcagagguccagaagaagugaaccgcuugacugagucaacuuaccgcaaugugauggagcaauucaauccuggcuugaggaacuuaauuaacuugggaaagaacuacgagaaagcuguuaacgccaugauccucgcugguaaagccuacuacgaugggguggccaaaauuggggagauagcuacagguucacccgugagcacagaacugggccacguuuuaauugaaaucagcuccacccauaaaaagcugaaugagucuuuagaugagaauuucaaaaaauuccacaaagagauuauacacgaguuagagaaaaagauugagcuggacgucaaguauaugaacgcuacuuugaagagguaucagacagaacacaagaauaaguuagagucuuuggagaaaagucaggcugaacugaaaaaaauccgacggaaaagucagggaucucggaacgcccucaaauaugagcauaaggagauagaauacguggagacugucaccucucgacaauccgagauacagaaguucaucgccgaugggugcaaggaggcccuucuugaggagaaacgucguuuuugcuuucugguggacaaacacuguggcuucgcuaaccacauacacuacuaccaucugcaaucugcugagcugcugaauuccaaauugcccagauggcaggaaacaugcguagacgcgaucaaggugccugagaaaauaaugaacaugauagaagagauaaagaccccugccucuaccccagugagcggcacaccccaagcuucuccuaugauugagagaaguaacgucgugaggaaagauuaugauacucuguccaaguguuccccaaaaaugcccccagcccccuccggacgagccuauacuucaccucugaucgacauguuuaacaaccccgcuacagccgccccaaacucccagcguguuaacaacucaacugguacauccgaagaccccucucuacagaggagcgugagugucgcuacaggccugaauaugaugaaaaaacagaaagugaaaaccaucuucccccacaccgcagguucaaauaaaacacugcugucuuucgcgcaaggcgacgucaucacccugcugaucccugaggagaaggauggaugguuguacggcgaacacgacguguccaaggcucgcggcugguucccaucuagcuauacaaagcuccuggaagagaacgagaccgaagccgugacaguaccuacucccagccccacucccgugagaagcauaagcacagucaacuuaagcgaaaauucaagcguggugaucccaccccccgacuaucuggagugucuuaguaugggcgccgccgccgacaggagagcugacagugccagaaccacaaguaccuucaaggccccagcaucuaagccagagacagcagcuccuaacgacgcgaacggaacggcuaagccacccuuucucucuggggaaaaucccuucgcaaccgugaagcugcguccuacagucacaaaugaucgcagcgccccgauuauccgauag

SEQ ID NO: 248058 - RNA, 1809 nt, Artificial Sequence
  Description of Artificial Sequence: Synthetic coding sequence
augcacuccaagguuacgaucauuuguauuagguuuuuguuuugguuucugcuccuguguaugcugaucgggaaaucccauacagaagacgacaucauuaucgccacgaaaaacggcaaaguccgggggaugaaucugacagucuuuggugguaccgugacugcguuccucggaauaccguacgcccagccccccuugggccggcuccgauucaagaagccccagucccugacuaaauggagcgauaucuggaacgccacuaaguacgcgaacagcugcugccagaauaucgaucaguccuucccgggcuuucauggaagugagauguggaauccuaauacugaccuuuccgaggacugucuguaccugaacguauggauacccgcaccgaaacccaagaacgcuacugucuuaauuuggauuuacggcgggggauuucagaccggcacaagcucacuccauguauacgauggaaaauuucuggccaggguggaacgugugauuguuguuuccaugaacuacaggguaggagcucuaggcuuucucgcccuucccgggaaucccgaggcccccggaaauaugggucuguucgaucagcagcuugcacugcagugggugcaaaagaacaucgcugcguuuggagggaauccaaaguccguuacucuguuuggagagagugccggagcagccucugugagcuugcaccugcucuccccaggcagccacucccuguuuacccgggccauucuccagagcggauccuuuaacgcgccuugggcugugacuaguuuguaugaagcccggaaccgcacccugaaccucgcgaaguuaacuggcuguagccgcgagaacgagacugaaaucaucaaaugucugaggaacaaagacccucaagagauuuuacucaaugaagcuuucguggugccuuauggcacaccccugucugucaauuuuggaccuacagucgauggcgauuuccuaacugacaugccugauaucuuacucgagcuggggcaguucaagaagacacaaauccuuguuggugugaacaaggacgaaggcacugcuuucuugguguacggcgcaccgggcuucuccaaagauaacaacagcaucauaacuagaaaggaauuucaggaaggccucaaaauauuuuuuccaggaguaucugaauucggaaaagaguccaucuuauuccacuauacugauugggucgaugaccaacguccagaaaauuaccgagaggcauuaggcgacgucgucggggauuacaauuuuauuugucccgccuuggaguucacaaagaaguucucugaauggggaaacaaugcauucuuuuacuauuuugagcauaggucgagcaaacucccauggccagaauggaugggcguuaugcacggguacgaaauugaauuugucuuuggcuugccauuggaaaggcgggacaacuauaccaaggcugaggagauccuauccagaucaaucgucaagagaugggcuaacuuugccaaauauggcaacccaaacgagacccagaacaauagcacgagcuggcccguauuuaaguccacagaacagaaauaccuaacacugaauaccgagucuacaaggauaaugaccaagcucagggcucaacaaugcagguuuuggacgaguuucuuuccaaagguacuggagaugacgggaaauauugacgaagcagagugggaauggaaggcugguuuccacagauggaauaauuacaugauggacuggaagaaucaguuuaaugacuacacaagcaaaaaggaaucaugugucggacuguag

SEQ ID NO: 248059 - RNA, 399 nt, Artificial Sequence
  Description of Artificial Sequence: Synthetic coding sequence
gccguccaauucacaggcuggagcucauccugcauuuuacacuuuccugaaguccugcaugauuuucacagcuugcagacccugccuagucuccuccaaagaauaggcaacccuaacgagacgcagaauaauucuacauccuggcccguauuuaaauccacugaacagaaauaccugaccuugaauacugagagcacucgcauuaugacaaaacuccgcgcacagcaaugccgauucuggacaaguuucuuucccaaaguucuggagaugacagggaacaucgaugaggccgaaugggaguggaaggcggguuuccaccgguggaacaacuacaugauggauuggaaaaaccaguuuaaugauuauaccucaaaaaaagagagcuguguggggcucuag

SEQ ID NO: 248060 - RNA, 195 nt, Artificial Sequence
  Description of Artificial Sequence: Synthetic coding sequence
augacaaagcugagagcgcaacagugccguuucuggacuucguucuuuccuaaaguucuugagaugaccggaaauauagacgaggcagaaugggaauggaaagccggguuucaccgauggaacaauuauaugauggacuggaaaaaucaguucaacgacuacacuagcaaaaaggagagcugcguaggacucuag

SEQ ID NO: 248061 - RNA, 2499 nt, Artificial Sequence
  Description of Artificial Sequence: Synthetic coding sequence
augauucugcaggcucaucugcacucccucugucuccucaugcuuuauuuagccacagguuauggacaggaaggaaaauuuucaggcccccucaagccuaugaccuucaguauauacgagggccaggagccuagccagaucauauuccaguucaaagccaauccacccgcuguuacuuucgagcugacuggcgaaacugauaacaucuuugugauugagagagagggguugcuguauuauaaucgugcucucgaccgggagacccgcucaacacacaaccuccagguagccgcccucgacgcuaacggaauaauuguugaaggcccagucccuaucaccauuaaagucaaggauaucaaugauaaucguccgacauuucugcagaguaaauacgagggcucagugaggcaaaacuccagaccaggcaagccauuccuguacguaaaugcgacugaccuggacgauccagcaacuccaaacggacaacuuuacuaucaaaucguuauucagcugcccaugauaaauaaugugauguacuuccaaauaaacaacaagacaggggcuauuucacugaccagagagggaagccaggagcucaauccugcaaaaaacccgagcuauaaccuuguuauuaguguaaaggacaugggcggacagagcgagaacuccuucuccgacacuacuucuguggauaucaucgugacugagaacauauggaaagccccaaaaccggucgaaaugguggaaaacuccacugauccgcacccaauuaagauuacccagguaagguggaacgauccuggagcccaauacucacuugucgacaaggagaaacugccccgguucccguucagcauugaucaggaaggagauaucuacguuacacagccgcuggauagggaagaaaaggacgcuuaugucuuuuaugcaguugccaaagaugaguacgggaagccacucaguuauccucuggaaauccacgucaaggucaaggacaucaaugacaaucccccaacaugcccaaguccugucacuguguuugaagugcaagagaaugagcggcugggcaacuccaucggcacacuuaccgcacacgacagagacgaagagaauacagcgaacucauucuugaacuaucggauaguugaacagacuccuaaauugccuauggacgggcuguuuuuaauacaaaccuaugcaggcaugcuucagcuggcgaagcaaucuuugaagaagcaggacacaccucaguacaaucucacgaucgaagugucagauaaggauuuuaagacccucugcuuuguccagaucaacgucaucgacaucaaugaucaaaucccaauuuuugagaagagugacuauggaaaccuuacccuagccgaagacacgaacaucgguagcaccauacugaccauucaggcuacugaugcugaugaaccguucaccggaucgucuaaaauccuguaccacaucauuaagggcgacagcgaaggaaggcugggcguggauaccgauccacacacaaacacgggauacguaaucauaaaaaagccucuggauuucgaaaccgccgccguuaguaauauuguauuuaaggccgagaaccccgagccacugguauuuggggucaaauauaacgcuaguuccuuugcaaaguuuacccucauugucaccgacgucaacgaggcgccacaguucucucagcacguuuuucaggccaaagucagcgaagacguagccauaggcaccaaagucgggaaugugacagcuaaagaccccgagggacuggacaucucuuauucucugaggggcgacacacgcggguggcuuaaaauugaucacgugacuggcgagauuuuuagugucgcuccccuagauagggaagccgggagcccauacagagugcagguggucgcgacugaaguuggcggaucuucguuaucuaguguguccgaauuucaucucauucuuauggauguuaacgauaaucccccucgacuggcgaaagacuauacaggccuuuucuucugccacccuuuaagugcccccggcucucucauuuucgaggcaacagaugacgaucagcaucuguuucgcggcccccauuucacguuuagcuuaggauccggaucgcuccaaaaugacugggaggugucuaaaaucaacgguacucaugccagacugucgacacgccacaccgaguucgaggagagggaguauguuguauugauaagaauaaaugacgguggccgcccgccucuggaagggauugugucacugccugucacuuucugcucuugcgucgaaggaaguuguuuuaggcccgcugggcaccaaacuggaaucccaacggugggcauggcggucggcauucuguuaacgacacugcugguaaucgguauuauccucgcugugguuuuuauucggaucaaaaaggauaagggcaaagauaauguagagagcgcucaggcuucugaggugaagccccuucgguccuag

SEQ ID NO: 248062 - RNA, 795 nt, Artificial Sequence
  Description of Artificial Sequence: Synthetic coding sequence
augacaaaguuuucuuccuucucucucuuuuuccuuauugugggggccuauaugacgcauguaugcuuuaauauggagaucauaggaggaaaagaaguuucaccacauucccgccccuuuauggcaucuauccaauacggaggccaccacgugugcgggggagugcucaucgauccacaauggguccugaccgccgcucacugccaguauagauucaccaaaggccagagcccaacugugguucuaggggcccauucccuuucaaaaaaugaggccucgaagcagacccucgagaucaagaaauuuauccccuucucccgggugaccagcgauccacaaucuaaugacauaaugcucguaaaguuacagacagccgccaaacuuaauaagcacgugaaaaugcuccauauccgaucuaaaacaagucugaggucaggaacgaagugcaaggucaccgguuggggagcgacagaccccgauucccuucguccuagcgauacccuccgggaagucacugugaccguccuaucuagaaaacuguguaauucccagucguacuacaacggagacccauuuaucaccaaagacauggugugugcuggcgacgccaaaggccagaaggauaguugcaagggggacagcggcggcccccuuaucugcaaaggcguuuuucaugcgauagugucaggcggccacgaaugcggcguggcaaccaagccaggcauuuacacuuuacuuacuaaaaaauaucagacauggauuaagaguaaucuagugccuccucacacuaacuag

SEQ ID NO: 248063 - RNA, 9939 nt, Artificial Sequence
  Description of Artificial Sequence: Synthetic coding sequence
augauggcgcggaggcccccuuggagggggcucggcggcagguccaccccaauccugcugcucuugcugcugucccuguucccuuugucucaagaagaacugggcggcggaggacaccaggguugggauccaggacuggccgcaacuaccgggccuagggcgcacaucggggguggggcacucgcacugugccccgaaagcucagguguuagggaagauggcgguccagggcucggagucagggagcccaucuuugugggacugaggggaaggagacagagcgcaagaaauagucgugggccaccagaacagcccaaugaagaacuaggaaucgaacaugguguccaaccccucggcucucgggagcgcgaaacaggacaaggacccggaagcgugcucuacuggcggccagaggucucgucuuguggcagaacuggcccucuacagcgaggaagcuuaagcccuggcgcccucuccucuggcguccccggcucagguaauaguuccccccuacccucagauuuccugauucgccaucacggacccaagccugucagcagccagaggaaugcuggaacgggaucacgcaagagagucggaaccgcucgcuguugcggugaacugugggcaaccgguuccaagggccaaggcgaaagagcaacaaccucaggggccgaaaggacugcuccacggcggaauugccugcccggcgcaucuggcucaggaccugaacuggauuccgcaccucgcacugcucggaccgccccagccuccggcucugcacccagggaaucucgaacggcucccgaaccugccccaaaacggaugaggucacguggccuguuccgcuguagguuccugccgcagcggccuggaccccgcccucccggauugcccgcucggccagaggcccgaaaagugacaucugccaauagggcuagauucagacgggcagcgaacagacacccucaguucccucaguacaauuaccagacacuggucccggaaaacgaagccgccggaacugccgugcucagaguuguugcucaggauccagacgcuggugaagccgguagauuagucuauucccuggcugcacucaugaacucccggagucuggaacuguuuucaauagacccccagucuggacugaucagaaccgcagcugcccuggacagagagagcauggaacgccacuaucuuagagugacggcgcaagaucacggaucucccaggcuguccgccaccaccauggucgcagugacgguugccgaucggaaugaucauaguccgguuuucgagcaggcucaauaccgagaaacucugagagaaaacguggaggaaggauauccgauccuacagcucagagcuacugacggugacgcaccuccaaacgcuaaucugagguaccgguuugugggacccccugcagccagagcugcagcugccgcagcauuugaaaucgacccgcguaguggauugauaaguaccagcgggcgggucgaccgugaacacauggagaguuacgagcuugucguugaggcuucugaucagggccaggaacccgggccucguucagccacaguucggguccacaucacgguuuuggaugagaacgauaaugccccacaguucagcgaaaagcgcuaugucgcacagguccgggaggacguccggccccacacagucguguugcgcgugaccgccaccgacagagacaaggaugccaacgggcuugugcauuacaacauuaucucagggaacucucguggccacuuugccaucgacucccugaccggcgagauucaggugguugcuccccuggauuucgaggcagaacgugaguacgcacugcguauacgggcccaggacgccgggaggccaccucugagcaauaacacaggccuggcuucuauacaggucguagacaucaaugaccacaucccuaucuuuguuucuacuccauuccagguuagcguccuggaaaacgcuccucuggggcauagcgugauucacauacaggcugucgacgcagaucacggagaaaacgcuaggcuggaauacuccuuaacuggcguugcucccgauacaccuuuuguuauuaauucagccacuggcugggucagcgugagcggcccccucgaccgggaauccgucgaacacuauuuuuucggcguggaagcaagagaucacgggucucccccauugucugcguccgcuagcguaacgguuacagugcuggaugugaacgacaacagaccagaguuuaccaugaaggaauaccaccuccgguugaacgaggaugccgcagucggcaccucuguugugagugugacagcuguagaucgcgaugccaacagcgcaaucuccuaccagaucaccggaggaaauacacgcaaucguuucgcuaucagcacacaaggaggggugggacugguaacucuggcacugccucuggauuacaaacaagagagauauuuuaagcugguucugacagcuuccgaccgcgcucuucacgaucacuguuauguacauauuaauaucacugaugccaacacucaucgcccugucuuucagagugcccacuauagcguguccgucaaugaagauagaccuaugggaucaacgaucgucguuaucuccgcgagugacgacgacgugggugagaaugcucgaauaaccuacuugcuugaggacaaucuuccacaauuucgcaucgaugccgacuccggcgcuaucacucugcaggccccacuggauuacgaggaccaaguuaccuacacucucgcaaucaccgcccgugacaacggaaucccacagaaagccgacaccacuuaugucgaggucaugguaaacgacgugaacgauaacgcaccucaguucguggcgagucauuauacaggacucguguccgaagacgcucccccuuuuaccuccgugcugcagaucuccgcaacagauagggaugcacaugcuaaugggcgaguccaguacacguuucagaauggagaggacggggauggagacuucaccauugagccaaccagcggcaucgugagaacaguccgaagacucgaccgcgaggcggugagcguguacgagcugacggccuaugccgucgauagaggcguuccuccacugaggacaccugugagcauccagguaaugguccaagacgugaaugauaaugcacccguguuccccgccgaagaauucgaggugcgagucaaagaaaacagcaucguagggucaguggucgcacagaucacggccguugacccugaugaagggccaaaugcccauauuauguaccagaucgucgagggaaauauccccgagcuguuccagauggacauauucucaggggagcugacugcccugauagaccucgauuaugaagcacgccaggaauauguaauuguugugcaggcgaccucagccccccuugugucacgugccaccguacacgugaggcuuguggaucaaaaugacaauuccccggugcugaacaacuuucagauucuguucaacaacuacguguccaaccguagcgauaccuucccaagcggcaucaucgguaggauuccagcuuacgaccccgaugugucagaccaucuguuuuacuccuuugaacgcggaaacgaauugcagcugcugguagugaaucaaacaucuggggagcuucggcugucccggaaacucgauaacaaccgcccgcucguugccucuaugcucgugacggucacagauggccugcacucugugacugcccagugcguacuacgcguugugaucaucacugaggaguuacuggccaacucccuuaccguuagacuagagaacauguggcaggagcgguuucugucaccccugcuuggaagguucuuagaaggcguggccgccgugcuggccaccccugcugaggauguguuuauuuuuaauauccagaacgacaccgacgucggcgggacaguucuaaacgucagcuuuuccgcuuuggcuccacguggagccggagccggcgcugccggucccugguuuucaucggaggaacuucaggaacaguuauaugucaggagagcugcccucgccgcgcgaucuuuacuggacgugcuuccuuucgaugauaacguuugucuccgggaaccuugugagaacuauaugaaaugugugucagugcucagguucgacucuagcgcccccuuccucgccucugcuucuacacuguuucguccaauacagccaauugccgggcugaggugucggugcccuccgggguucacuggggacuuuugugaaacugagcuggaucuuugcuauuccaauccgugucgcaauggcggagcuugcgcacgccgggaaggaggcuauaccugugucugccgaccucgauuuacaggagaggauugugagcuugauaccgaggcaggccgcuguguuccaggcguauguagaaacggcgggacauguaccgacgcuccuaaugggggcuucaggugccaaugcccagccggaggugcauuugagggaccccgaugcgagguagcugcaaggaguuuuccacccuccucguuuguuauguuuagaggucugaggcaaagguuccauuugacccugucccuguccuucgcuaccgugcaacaguccggacuguuguuuuacaauggccgucugaaugaaaaacaugacuuucuugcacucgagcugguagcggggcaggugagacucacauauagcaccggggagagcaauacuguggucucccccacaguuccaggcgggcuguccgauggccaguggcauaccguacauuugcgcuacuauaacaaaccacgcaccgaugcacugggcggagcucagggaccuagcaaggauaaagucgcggugcugagcguagacgauugugauguggccguggcacugcaguuuggggcugagauugggaauuauuccugugcagcugccggcguucaaacuagcagcaaaaaaucacucgaccugaccggcccucuccugcucgguggaguuccaaacuugcccgagaauuuucccguaucccacaaggauuuuauuggcugcaugagagacuugcauaucgacggucgccgaguugauauggcggccuucguggcuaacaauggcacgauggcugguugccaggccaagcuccauuucugcgacucaggaccguguaaaaacucuggcuuuugcucugaacgcugggggucauucagcugcgauuguccaguagguuucggcggaaaggauugucaacuuacgauggcacacccccaccauuuuagggguaacggaacauuaagcuggaacuucgguucugauauggcggugucuguaccaugguaccugggacuggccuuccgcacacgggccacucagggaguacuaaugcagguccaagcagguccccauuccacacuguugugucaguuggaccguggauuacugaguguaacagucacgaggggaagcggucgggcaucucaucugcuguuagaccaagucaccguuucagacggccgcuggcaugaucugagacuggagcugcaggaagagcccggaggccgccggggccaccacguucucauggugucucuggacuucucacuguuccaggauacgauggcagucggauccgaauugcagggccugaagguuaagcagcuccacgucggaggacugccaccuggcagcgccgaagaagcgccucaaggccuggucgguuguauucagggagucugguuaggcagcaccccaagcggaucuccagcuuugcuuccaccuucacacagaguaaaugcggaaccuggguguguggucacuaacgcaugugccuccggcccuugucccccucaugcagacugccgggauuuguggcagaccuuuucaugcacaugucagccggguuacuacggaccgggguguguagaugcuugcuugcuuaauccgugucagaaucagggcucgugcaggcaccugccaggggcuccucaugguuacacgugcgauuguguaggggguuacuucgggcaccauugcgaacauaggauggaucagcaauguccccguggcugguggggcagcccaacaugcggaccaugcaauugugauguucauaagggcuuugacccaaacugcaacaagaccaacggucagugucauugcaaagaauuccacuaucgaccucggggcucugauuccugccugcccugcgauuguuauccaguaggcucaacaucccgcagcugcgcuccucacucuggacaguguccuugcagaccaggggcucucgguaggcagugcaacaguugcgauucaccuuuugcugaagugaccgccaguggcugcaggguguuguacgacgcaugcccaaaaucucugcgaaguggugugugguggccccagaccaaguuuggcgugcuggcaacaguuccuugcccucgaggggcauugggggcagcaguucggcucugugacgaagcccagggauggcuugagcccgaccuguuuaauuguaccagcccagccuuucgcgagcugagccuucuccucgaugggcucgaacugaacaagacugcgcucgauacuauggaggccaaaaaguuggcccagcgccuucgagaggucacugggcauacugaucacuacuuuucccaggaugugcgggugacagccagacuccuggcgcauuuacuagcauucgaaagccaccaacagggcuuugguuugaccgccacacaggaugcccauuuuaaugaaaaucuccuuugggcugggagugcccuuuuggccccggagaccggggaucucugggcugcacucgggcagagagcuccuggcgggucaccagggucugccggccuggucaggcacuuagaagaguaugccgccacgcuugcucguaauauggagcuaacguaccugaacccuaugggcuuagugacacccaacauuaugcucucuaucgaucgcauggagcacccauccagccccaggggggcucgccgcuauccuagguaccacagcaaccuguuuagggggcaggacgcaugggauccccacacacauguucucuugccuagccaguccccccggcccucuccgagcgaaguguugcccacaucaucguccaucgagaauucuaccacuaguucugugguacccccgccggcgcccccagagccugagcccggaauuagcauaaucauccuguugguguauaggacauuaggcggacuccuccccgcacaguuucaggcagagcggaggggggcuagauugccucagaacccuguaaugaacucaccuguggugucaguagcuguguuccauggccgaaacuuucugagagguauucuugagagcccaauuucucuggaauuuagauuacugcaaacugccaacagauccaaggcuauaugcguucagugggauccaccaggguuagccgagcagcauggaguuuggacagcccgggauugcgagcugguccacaggaacggaucccaugcgcgguguaggugcucccgcacuggcacguucggagugcucauggacgcaucuccucgagaacggcuugagggugaucuggaguuacuugccguuuucacacaugucgugguggcuguaagcgucgccgcccuuguguugaccgcggcgauccuccuaucccugaggucccuuaaguccaacguucggggcauucaugcaaauguggcagccgcgcucggcgucgccgagcuccuauuccucuuggggauccaucgaacccacaaccaacuaguuugcacugcagucgcaaucuugcugcacuauuucuuucuuucuacauuugcauggcuguucgugcagggacugcauuuauaccgcaugcagguggagccgaggaaugucgaucguggagcaaugagauucuaucacgcccuaggcuggggcgugcccgcaguucuccuggggcuggccgugggacucgaucccgaaggauaugggaauccagauuuuuguuggauuucuguccaugagccccugauauggaguuuugcuggucccguuguucuuguuaucgugaugaacggaaccauguuucuucuggcagcacggacuaguugcaguacgggucagagagaagcaaaaaagacaagcgcccuaacucugcgcaguagcuuucugcugcugcuguuagucucggccagcuggcuguucggacugcuggcaguuaaccauuccauccuggcguuucacuaucuccaugccggucucugcggccuccaggggcuggcuguccugcuguuauucugcguacuaaaugccgacgcccgggcggcuuggaugccggcgugccuaggcagaaaggcagcuccggaagaagcccguccagcucccggucuagggccaggcgcguacaauaauacagcgcuuuuugaagaauccggauugauccggaucacacucggugccagcacuguaucuagcgugagcuccgcaaggagcggcagaacacaggaccaggacucucagcguggaaggucuuauuuaagagauaauguacuaguccggcacggcuccgccgcugaccacaccgaccacagccugcaagcucacgccgggccaacagaccucgacguggccauguuucacagggacgcuggagccgauagcgauagcgacucagaccucagccuggaagaggaacggagccugucaaucccaucaucugaauccgaagacaacggccguacgagaggcagguuccagcgaccacuauguagggcugcgcagucagagaggcuucugacccacccgaaggacguagacgggaaugaucuccugucauauuggccugcauuaggugagugcgaggcugccccuugcgcacuccagacauggggcuccgaacggcgccugggccuggacaccucuaaagacgcagccaacaauaaucaacccgaucccgcccugacaaguggggaugagaccagccucggccgugcccagcgucagcgcaagggcauccuuaagaaucggcugcaauauccacucgugccucagaccagaggcgcuccugagcucuccuggugucgcgcagcgacucuggggcaucgggccgucccugccgcuucuuacggaagaaucuaugccgggggcgguaccggaucuuugagccagccggccucucgguacagcucucgugagcaguuagaccuucuacugaggcgacaauugaguagagaacgccuggaagaggccccugcuccuguacugcggccccugagcaggccugggagucaggaauguauggacgcagccccugggagguuggagcccaaagaucguggauccacacugccuaggcggcagccaccccgugacuauccgggugcaauggcugguagguuuggcucucgagacgcucucgaccuaggcgcuccccgagaauggcucucaacucugccgccgcccagaagaacaagggaccucgauccacagcccccaccucugccucucagcccccagcgucagcugagcagggauccgcugcuacccagcaggccccucgauucucugucaaggucuaguaauaguagggagcagcuugaccaggugccuucacgccauccgucuagagaagcccuuggaccguuaccucaguuacugagggcgagggaagacucagugucagggccaucucacggaccguccacagaacaacuggauauccuuagcucuauucuugcuuccuuuaauuccucagcacugucuucggugcagaguuccagcaccccauuaggaccucacacuacugcuacuccaucugccaccgcuagugugcucggcccuaguaccccccggagcgccacaucacauuccaucagcgagcucaguccagauuccgagguaccuagaucugagggacauagcuag

SEQ ID NO: 248064 - RNA, 384 nt, Artificial Sequence
  Description of Artificial Sequence: Synthetic coding sequence
augggcuuucguaaauuuucaccuuuuuuggccuuaagcauccuaguucuguaucaggcgggcucucugcaagcagcuccuuuccggucugcucuggaaucuucccccgacccagcgacauuaucuaaagaagacgcuaggcuucuacuggcggcacugguccaggauuaugugcaaaugaaagcuucagaguugaaacaggaacaggagacacaggggucuaguagcgcugcgcaaaagagagccuguaauacagccacaugcgugacccaucggcucgcuggccuccucucacgaagcggcggaauggucaagucaaauuuugugcccacaaacguggggagcaaagccuucggaaggcgucgccgugaccugcaggcauag

SEQ ID NO: 248065 - RNA, 417 nt, Artificial Sequence
  Description of Artificial Sequence: Synthetic coding sequence
augaaaaaagaagcuaaccuucagagaggcgggaugggguuccguaaauuuucccccuuuuuagcucuuucuauucuggugcucuaucaggcaggcagccuccaggccgccccuuucagaucugccuuggagucgucgccagacccggccacuuugagcaaagaagacgcucgauuacugcucgcagcucucguccaagacuacguacaaaugaaggccucggaacuuaagcaagagcaggagacccaggggucaaguuccgccgcacagaaacgugcauguaacaccgcuacuugcgucacacacagacuugccggacugcuaucccggaguggcgguaugguaaagucaaacuucguuccgacaaacguuggaaguaaagcauucggcagacgacggagagauuuacaggcguag

SEQ ID NO: 248066 - RNA, 384 nt, Artificial Sequence
  Description of Artificial Sequence: Synthetic coding sequence
augggauuuagaaaauucucgcccuuccuagcucuguccauccuggucuuauaucaggccggcucacugcaggcagcgccguuccguucagcacuggaaucuucucccgaccccgccacccuaagcaaagaagaugcaagacuucugcuggccgcccuuguacaggauuacgugcagaugaaagcguccgagcugaaacaagaacaagagacccaaggcucaagcuccgcggcacaaaagagggcgugcaauaccgcuaccugugucacacauagacuugcaggucuacucucucggagcggugggauggugaaaucaaacuucguuccaacaaaugugggcaguaaagcuuucggccgccgccggagggaucuccaggcuuag

SEQ ID NO: 248067 - RNA, 948 nt, Artificial Sequence
  Description of Artificial Sequence: Synthetic coding sequence
augcgaaugugugacagaggaauucagauguugaucaccacugugggcgccuucgcggccuuuucccugaugaccaucgcuguuggaacugacuacuggcuguacucuagaggcguuugcaggacuaagagcacuucggacaacgaaaccucuaggaaaaacgaagaagugaugacucacucuggcuuguggagaaccuguugucuugaaggagccuuccggggcgucuguaaaaagauagaucauuucccagaggaugcggauuacgagcaggacacugcugaauaccugcugcgagccgucagggccagcucuguguuuccuauccugucagugacuuuacuuuuuuucggcgggcucugugucgcugccucagaauuucacagaucucggcacaacgugauucugagcgcuggaaucuucuucgucucagcgggcuuaaguaacaucaucgggauuauaguauacauuagcgcuaacgcaggcgaccccggccaacgcgacucuaagaaaagcuacucuuacgguuggagcuuuuauuuuggcgcguuuucuuucaucaucgcagaaaucgucgggguaguugccguucauaucuacaucgagaaacaucagcagcuacgagccaagucacauucagaauuucugaagaaguccacguucgccagacuaccucccuaucgguaucgguucagaagaagaucauccucccguucaaccgagccccggucgcgcgaucugucaccuauaaguaaaggguuccacacaauccccuccacggauauaucaauguuuacccugucccgggaucccucaaaaaucaccaugggaacacugcugaauucugacagagaccaugcuuuucuacaguuucacaauaguacaccaaaggaguucaaagaaagccugcauaacaacccagcaaauagacguaccacuccggucuag

SEQ ID NO: 248068 - RNA, 891 nt, Artificial Sequence
  Description of Artificial Sequence: Synthetic coding sequence
augucagccugugguagaaaagcucugacacugcuuaguucgguuuucgccguuugcgggcuugggcuccugggcaucgcagugucaacugacuauuggcuauaccucgaggagggaguuaucgugccgcaaaaccagucuaccgaaaucaagaugucacugcauucgggguuguggaggguaugcuucuuggcaggagaggagagaggacgguguuucacaauugaguaugugaugccaaugaacacccagcugacaucugaaucuacagucaacguccuaaaaaugauuagauccgcuacgccguucccacuggugagucucuucuucauguucaucggcuucauucuaaauaacauuggacacauaaggccccaucguacaauccuagccuucgucucuggcauauuuuuuauuuuaagcggucucagccugguugugggauuaguuuuguacauuuccucuauuaaugaugagaugcuuaauagaaccaaggaugcugaaaccuauuucaauuacaaguauggguggucuuucgcuuuugccgccauuaguuuucuccugacagaagugaaaccuguaacucuguccauggacaggcucggucucgggacugcuccuuuaagccggggugaguggggauggggaagacgggauaucccacaaccauucuggaccccugaucaccccuuauacuucccgucaucaagccagaaugucagcuuaucuuaucuguccgguucgccaccagcccgaaugucuccugguccauguaguugcccccacguucacuuucccccgcauucgucaugugucuuaugccgcccccaaccgcgggaaaugaggcaggcuccagccgccucaccuuccuccgccguguuuuccuuguag

SEQ ID NO: 248069 - RNA, 948 nt, Artificial Sequence
  Description of Artificial Sequence: Synthetic coding sequence
auggaucuacgccaguuucugaugugucucucucugugcacagccuucgcacugaguaagccuacggagaaaaaagacaggguccaccacgagccacaacugucugacaaagugcauaacgacgcccaguccuuugacuaugaccaugaugcauuccugggcgccgaagaagcuaagacuuuugaccaauugacacccgaagaaagcaaagaacgccuggguaagaucguaucaaaaaucgacggugacaaggauggguucguuacuguugacgagcuuaaagauuggauuaaauucgcccagaagcgcuggauauacgaagacguggaacgccaguggaaaggccacgaccuaaaugaagacgggcuaguguccugggaagaauacaaaaacgcgacauacggcuacguccucgacgacccagauccagaugacgguuuuaacuacaagcagaugaugguuagagacgagagaagauucaagauggcagauaaagacggagaccugaucgcgaccaaggaggaauuuacagcuuuccugcauccugaggaguaugauuacaugaaggacauuguaguacaggagacaauggaggacauugauaagaaugcggauggauucaucgaccuugaggaguauaucggugacauguauucgcaugacggcaauaccgacgaaccugaaugggucaagacggaacgagaacaauucguggaauucagagacaaaaauagggacggaaaaauggacaaggaagaaacaaaggauuggaucuugcccucugacuaugaccacgccgaggcagaggccaggcaccugguauaugaaagcgaucagaauaaggauggcaaacucacaaaagaagaaauuguugacaaguacgaucuguuugugggcucgcaggcgacugauuuuggggaggcccuaguuagacaugaugaguucuag

SEQ ID NO: 248070 - RNA, 465 nt, Artificial Sequence
  Description of Artificial Sequence: Synthetic coding sequence
auggaccucagacaguuucugaugugccucucucuuugcacugccuuugcccugagcaagcccacugagaaaaaagauagagugcaccaugaaccacaauuguccgacaaagugcauaacgacgcacaguccuucgauuacgaucacgacgccuuucucggggccgaggaagcuaaaacauuugaucagcucacccccgaggaaaguaaggaaaggcuggguaagauagugucaaaaauugauggcgauaaagauggauucgugacuguugaugaacugaaggauuggauccucccaucagauuaugaccacgccgaggcagaagcaagacaccucguauacgagagcgaccagaacaaggacggaaagcugaccaaggaagaaaucguugacaaauaugaucuguuuguggguucacaggcgaccgauuuuggcgaagcacuggugagacacgaugaguucuag

SEQ ID NO: 248071 - RNA, 948 nt, Artificial Sequence
  Description of Artificial Sequence: Synthetic coding sequence
auggacuuaagacaguuucugaugugccucagccugugcaccgcguucgcucugucgaaacccacugaaaaaaaggauagaguccaucacgaaccucagcuuucugauaaagugcacaacgaugcccaaaguuuugacuacgaucacgaugcauuccuaggggcagaggaagcuaagaccuucgaccaauugacccccgaagaaucaaaggaaaggcugggcaugaucguagauaagauugacgcugauaaggacggauuuguuaccgagggggaacugaagaguuggauaaaacacgcgcagaagaaguacaucuacgacaacguggagaaccaguggcaggaauucgacaugaaucaggacggacuuaucucaugggacgaguaucggaacguaaccuauggaaccuaucuggaugauccagacccugacgacggguuuaauuacaagcagaugaugguaagagacgagcgacgguuuaagauggcagauaaggacggagaucugaucgccacgaaagaggaauucacugcuuuucuacacccggaagaguaugauuacaugaaggacaucgugguccaagagaccauggaagauauugauaaaaaugcggacggguuuauugaccucgaggaauauauaggugauauguacucacacgacgguaauacugacgaaccugagugggugaagaccgagcgagagcaguuuguggaguuucgggauaagaacagagacgggaagauggacaaagaagaaaccaaagacuggauuuuaccuagugacuacgaucaugccgaggccgaggcucgacaccucguuuacgagucagaucagaacaaagacggaaaacugacaaaggaagagaucguagauaaguaugacuuauucgugggaucccaggcgacagacuucggugaagcauuagucaggcacgaugaauuuuag

SEQ ID NO: 248072 - RNA, 972 nt, Artificial Sequence
  Description of Artificial Sequence: Synthetic coding sequence
augaaggagacagaucuaauuauaauggaccugaggcaauuucugaugugcuuaucucuaugcacugcuuucgcuuugucaaaaccaacugaaaagaaagaccgaguccaucacgagccccagcucucagacaaagugcauaacgaugcccaguccuucgacuaugaccaugacgccuuucugggcgccgaggaggccaaaacauucgaccaacuuacccccgaggaaaguaaagaacgcuuaggaaaaaucguauccaaaaucgauggagauaaagauggcuucgucacaguugaugaacucaaggacuggaucaaauuugcacagaaaagauggauuuacgaggacguggagaggcaguggaaaggucacgaccugaacgaggacggccuugucucaugggaggaauacaagaaugcuaccuauggauacguguuggaugacccagacccagacgauggcuuuaauuacaaacagaugauggugcgcgacgaaaggagguuuaaaauggcugauaaagauggcgaccugauagccaccaaggaggaguuuacugccuuccuccaucccgaagaguacgacuacaugaaggauaucgucguucaagagacuauggaagacaucgacaagaacgccgacggauuuaucgaccuggaggaguauaucggagauauguauucacaugauggcaacacagacgaacccgagugggugaaaacugagcgagaacaguuuguagaauucagagacaagaaccgugauggaaaaauggacaaagaagaaacuaaagacuggauacugcccucugauuaugaccacgcugaggcugaggcuaggcacuuaguguacgaguccgaccaaaauaaagacggcaaguuaaccaaagaagaaaucguggacaaguacgaucuguucguaggaucucaggcuaccgacuuuggagaagcacuggugcgacacgacgaguucuag

SEQ ID NO: 248073 - RNA, 444 nt, Artificial Sequence
  Description of Artificial Sequence: Synthetic coding sequence
ugaaucgccacgaaggaagaauucacugcuuuuuugcacccagaagaauacgacuauaugaaggacaucguuguucaggagacaauggaggauaucgauaagaacgcagauggguuuauagaccucgaagaguacauuggagacauguauucacacgauggaaacaccgaugaaccagaguggguuaaaacagaaagagaacaguuuguugaauuucgugauaagaaucgugacgggaagauggauaaggaggaaacuaaggacuggauccuaccaagcgauuaugaccaugccgaggccgaagcucgucaccucguuuacgaauccgaucaaaauaaagacgggaaacucacgaaggaagaaaucguagauaaguacgaccuuuuugucggaucgcaagccacggacuuuggggaagcccucguucgccacgacgaauuuuag

SEQ ID NO: 248074 - RNA, 675 nt, Artificial Sequence
  Description of Artificial Sequence: Synthetic coding sequence
auggaucugagacaguuccucaugugccugucuuuaugcaccgcuuucgcauuauccaaaccuacagagaaaaaggacagaguucaucacgagccccaguuaucagauaaaguacauaacgacgcacaaucauucgauuacgaucacgacgcuuuccuuggggcagaggaggcaaagacauucgaucaacuuaccccugaagagucuaaagagcgacucggcaagaucgucucuaagauugacggcgacaaggacggcuuugucacugucgacgaacugaaagauuggaucaaguucgcgcagaagcgguggauauacgaagacgucgaaaggcaauggaaaggccacgauuugaacgaagaugggcuuguguccugggaagaauacaagaaugccacauauggcuacgugcucgaugaccccgaucccgaugacggguucaauuacaagcaaaugaugguuagagaugagagaagauuuaaaauggcagauaaagacggagaucuuaucgccacaaaggaagaguucacugcuuuccugcacccugaggaguacgacuacaugaaggacauaguuguacaggagaccauggaagacauagacaagaaugcagacggauuuauagaccuggaggaguacaucggauggcaggcguaucagggaggagaucgauag

SEQ ID NO: 248075 - RNA, 444 nt, Artificial Sequence
  Description of Artificial Sequence: Synthetic coding sequence
augaaagaaacagaucugauuauuauggaccuacgucaguuccugaugugucuaucccuauguacggcauucgcucucucuaaaccuaccgaaaaaaaagacagagugcaccaugagccccagcucucugacaagguucauaacgacgcacaaucuuucgacuacgaccaugaugccuuucugggggccgaagaggcaaagacauuugaucaacugacaccugaagaaaguaaggagaggcuggguaagauugugaguaaaauugauggcgacaaagacggcuuugucacuguggaugaauuaaaagacuggaucaaauucgcacaaaagagauggauuuaugaggauguggagagacaauggaaagggcaugaucugaaugaagauggucuggugucaugggaagaauauaagaaugcgaccuauggcuacguacuggaauag

SEQ ID NO: 248076 - RNA, 513 nt, Artificial Sequence
  Description of Artificial Sequence: Synthetic coding sequence
auggacuuaagacaauuccuuaugugccuuagccuguguaccgcuuuugcccuaagcaagccuacagagaaaaaggauagagugcaucaugaaccucaacuuagugacaaagugcacaaugaugcucagagcuuugacuacgaccaugaugcuuuucugggcgcagaggaagccaagacauucgaccaacugaccccugaggaaaguaaggagagguugggaaugaucguagauaaaaucgacgcagauaaggauggauuugugaccgaaggagaacugaagagcuggaucaagcacgcgcagaaaaaguauaucuacgauaauguggaaaaccaguggcaggaauuugacaugaaccaggacggguugauuucuugggaugaauaccgcaacguaacuuaugggacauaccuugacgaccccgacccagaugacggguuuaacuacaagcagaugaugguucgcgacgaacgccgcuuuaagauggccgaccgagcuagggcugugugcuag

SEQ ID NO: 248077 - RNA, 606 nt, Artificial Sequence
  Description of Artificial Sequence: Synthetic coding sequence
auggaucugcgccaauuuuuaaugugucugagucuuugcaccgcauucgcuuuaucuaaaccuacagaaaagaaggaccgcguacaccaugagccucaguuaagugacaaaguccauaaugaugcccagucuuuugacuaugaccaugacgcauucuugggcgcugaagaggcuaagacauuugaccaguugacccccgaggagagcaaagagcgccuggggaugauaguggacaagaucgacgccgacaaggauggcuucgugaccgagggcgaguugaagagcuggauuaaacaugcucagaagaaguauauauaugacaauguugagaaccaguggcaagaguuugauaugaaucaggacggccugauuaguugggacgaguauaggaaugugacguacgggacauaccucgacgauccagacccggacgacggauuuaauuacaaacaaaugaugguuagggacgaacgacgauucaaaauggcugacaaggauggugaucucauagcaacuaaagaggagauaguggauaaauaugaucuguuugucgggucacaggcaacggacuuuggagaggcccuggugcgucaugaugaauuuuag

SEQ ID NO: 248078 - RNA, 798 nt, Artificial Sequence
  Description of Artificial Sequence: Synthetic coding sequence
auggaccugaggcaguuccucaugugccuuucacugugcacagccuuugcuuuauccaaaccuaccgaaaaaaaggaccggguucaccaugagccccagcugucggacaaggugcauaacgaugcacaguccuucgauuaugaccaugaugccuuucugggugcugaagaagcuaaaaccuuugaccaguugacaccugaggaguccaaggaaaggcugggaaagauagucucaaagaucgacggcgacaaggauggcuuuguuaccguggacgaacugaaagauuggauuaaauuugcccagaaaagauggauuuaugaagacguggagagacaguggaaggggcaugaccuuaaugaggacggcuuggugucaugggaagaauauaagaaugccaccuacgguuacgugcuggacgauccagacccagacgauggauuuaacuacaaacaaaugauggugcgagacgaacggagauuuaagauggcugacaaggauggagaucucauugccacaaaagaagaguucacagcuuuuuugcauccggaagaauacgauuacaugaaagacauaguugugcaagagaccauggaagacauugauaagaacgcagauggauucauugacuuagaggaguauaucggcgacauguauucucaugacggcaauacggaugagucugaccagaacaaagaugggaagcugaccaaggaggagauuguagauaaauacgaucuguuugucgggucgcaggcuacugauuuuggagaagcccuagugaggcacgacgaauuuuag

SEQ ID NO: 248079 - RNA, 495 nt, Artificial Sequence
  Description of Artificial Sequence: Synthetic coding sequence
augauggugcgugaugagaggagguucaaaauggcugacaaggacggcgaccuaauugccacuaaagaggaguuuaccgcuuuccugcacccugaagaauaugauuacaugaaagacaucguuguccaggaaacuauggaggacaucgacaagaacgcugacggauuuaucgaccuugaggaauauauuggcgauauguacucgcaugaugguaacaccgacgagcccgagugggucaaaacggaaagggagcaauucguugaguuuagggacaaaaauagagauggcaaaauggauaaggaggaaacaaaagauuggauacugccaucggacuacgaccacgccgaagccgaggcuaggcaucugguguacgaaucugaccagaacaaagauggaaagcucacaaaagaagaaauuguagacaaauacgaucuguucguagguagccaggcgacagauuucggugaggcacuugugcggcacgacgaauuuuag

SEQ ID NO: 248080 - RNA, 972 nt, Artificial Sequence
  Description of Artificial Sequence: Synthetic coding sequence
augaaagagaccgaccucauaauuauggaucugcgucaguuccugaugugucuaucacuaugcacugcauuugcccuuucaaaacccacagagaagaaggacagggugcaucaugaaccacaacucuccgauaaaguucauaaugacgcacaaagcuuugauuacgaucacgaugccuuccuuggugccgaggaggcuaaaacguucgaucaauugacucccgaagagaguaaagaaagacucgggaugauuguagacaaaaucgaugcugacaaggacggguucguuaccgagggugagcugaaaagcuggauuaaacaugcucagaagaaguauaucuaugauaacguggagaaccaguggcaggaguuugacaugaaccaggacggucugauuucuugggacgaguaucgcaacguuacauacggaaccuacuuggacgaccccgauccugacgauggcuucaacuacaagcaaaugauggucagagacgagcgacgauuuaaaauggcagacaaggacggugacuugauagccaccaaagaggaguuuaccgccuuucuccauccugaagaauaugacuacaugaaagauaucguagugcaggagacuauggaagauauugacaagaacgcggauggcuucaucgaucuugaggaauacaucggagauauguacucucaugauggcaacaccgacgagccagagugggugaagacagaacgcgagcaauucguugaauuucgagauaagaauagagacggcaaaauggacaaagaggaaacgaaggauuggaucuugccuagugacuacgaccacgcugaagccgaggcccgacacuuggucuaugaaagcgaccagaacaaagacggcaaguugacgaaagaggaaaucguggauaaguacgaccucuucguggguagccaagcaaccgauuuuggcgaggcucuggugcgacaugacgaguuuuag

SEQ ID NO: 248081 - RNA, 1386 nt, Artificial Sequence
  Description of Artificial Sequence: Synthetic coding sequence
augaacacggaucucgccgccggaaagauggcuucagcagcaugcucaauggacccuaucgauagcuucgagcuucuggaccuguuauuugauaggcaggaugggauacucagacacguggaauugggagagggauggggccacguuaaagaccagcagguucugccuaacccagauagugaugauuuucugucuucuaucuuagguaguggagauucccucccguccagcccccuguggucccccgaggggucugacucagguauuagcgaggaucuuccaucagacccucaagauaccccaccacggucaggaccugccacuucaccugccgguugccaccccgcccaacccgggaagggucccugucuaucuuaucacccgggcaacucaugcuccacaacaacucccggcccugucauacaggugccugaggcaucuguuacaaucgaccuagagauguggagccccggagggcggaucugcgccgaaaagccugccgaccccguagaucuaucaccucguugcaaucucacggugaaagaucugcugcuguccggcucaucaggcgaccugcagcagcaccaccucggggccuccuauuuacugcggccuggugcuggccauugucaggaguuaguacugaccgaggacgaaaaaaagcucuuagccaaggaggggaucacucugccaacccaguuaccacucacaaaguacgaggagcggguucuuaagaaaauaagacgaaaaauucggaacaaacagucagcccaggaaagcagaaaaaagaagaaggaauauauugauggucucgaaacacgcaugucggcuuguacagcccaaaaucaggaacugcaacggaaggugcuccaucucgaaaagcaaaaccugagccuccuggaacaauugaaaaaauuacaagcuauagugguucaaucaaccagcaaguccgcccaaacuggaaccugcgucgccguacugcuucugagcuucgcccucaucauccugccauccauuaguccauuuggaccuaacaagacagaauccccaggugauuucgcuccuguuagaguguuuucuaggacguuacauaaugaugccgcgucuagagucgccgccgacgcgguccccgguuccgaggccccgggaccuagaccagaagccgauaccacacgcgaggagucuccugggucaccaggugcugauuggggcuuucaggauacugcaaaccuuaccaauaguacagaggaacuugauaaugcaacucucguuuugaggaaugccaccgagggacuuggucaaguggcccugcucgacuggguugcucccgguccgagcacaggaagugggagagccgggcuggaggcggccggcgacgaauuguag

SEQ ID NO: 248082 - RNA, 4827 nt, Artificial Sequence
  Description of Artificial Sequence: Synthetic coding sequence
auguacucugcacaccgcccacucaugccagccucauccgccgcuagcagaggccucgggauguuuguguggaccaacguugaaccacggucaguggcuguguuucccuggcauagccugguacccuuccuggccccgagccagccugacccuuccguccagccaagugaagcucagcagccagcuucccacccaguugcuagcaaucaauccaaggaaccugcagagucugcugcgguugcccacgagcgcccccccgggggcacaggaucugcggacccagagcggccuccgggagcgacuuguccggagucaccuggcccaggccccccucauccuuugggcgucgucgaguccgggaagggaccgccuccaacaacugaggaagaggcuagcgggcccccaggugagccgaggcuggacucagaaacggaaucggaucaugaugaugcuuucuugucuauuauguccccagaaauccaacugcccuuaccccccggcaaacgaagaacucaaagccuauccgcucugccaaaagaacgcgauucuucauccgagaaggacggacggaguccgaacaaacgcgaaaaggaucauauccggcgcccaaugaacgcguucaugaucuucucuaagaggcaccgagcccuggugcaccagcggcacccaaaccaggauaauagaacggucaguaagauauugggugaauggugguacgcccugggcccaaaagagaagcaaaaguaccaugaccuugcuuuucaggucaaagaagcacacuucaaagcacaccccgauuggaaaugguguaauaaggauaggaaaaagucuuccucagaggccaaaccuacaucucugggccuugccggugggcacaaagaaacccgagagcguuccauguccgaaaccgguaccgcagccgcaccagggguuuccuccgagcugcugucaguagcugcucagacccuccuuuccagcgacacuaaagcccccgggagcucaucgugcggggccgagagacugcacacagucggugguccagguagugcuaggccucgcgccuucucccauucaggugugcacucuuuagauggaggcgaaguggauucccaagcucuccaggagcugacccaaaugguaucaggcccagcuucauacucagggcccaaaccuucgacacaguacggcgccccuggucccuucgcagcccccggagagggcggugcccucgcggccacuggucgucccccucuccucccuaccagagccagcaggucucagcgcgccgccuccgaggacaugacaagcgacgaggagagaauggucauuugugaggaggagggagaugacgaugugauugcugaugacggcuucggcaccacugauaucgaucucaaguguaaggaaagaguaacggauucagagucaggugacuccuccggagaggacccagaggguaacaaaggcuucggcaggaagguuuucagcccugugauucgcagcuccuucacacacugucgcccaccccucgaucccgagccgcccggcccuccagaucccccugucgcauuuggaaagggguacggauccgcccccucauccucggcuagcucuccugcuucaagcuccgccucagcugcaacuaguuucucuuugggauccggcacuuuuaaagcucaggaaaguggccagggaagcacggccggaccucugcggccgccuccucccggcgccgguggcccugccacacccucuaaagcuacccguuuucugccuauggauccagcaaccuucagacgcaagcgaccggagucaguaggaggccuggagccacccggaccauccgugaucgccgcuccccccagcgguggggggaauauccugcagaccuuggugcugccaccuaauaaagaagagcaggagggaggaggugcaaggguaccaagugcaccagcuccaagcuuagccuacggagcuccugcugcuccgcugaguagacccgccgccacaaugguuaccaacguagucaggccaguaagcucuacaccuguuccaauugccuccaagccauuucccacaaguggacgagccgaagcaagcccaaaugacacggccggagcacggacagaaaugggcacaggaagcagaguucccgguggcaguccucuggggguaagccugguauacucagauaagaaaucugcggcagccacguccccugcuccgcaucuugucgccggaccgcuucucgggacugucgguaaggcucccgcgacugugacuaaucuccugguaggcaccccgggcuacggcgcacccgcuccuccugccguccaguucaucgcgcagggggccccgggaggcgggaccacggcgggcucuggugcuggagcggguucuggacccaaugguccugugccucucggcaucuugcagccaggggcccugggaaaggcagggggaaucacucaggugcaguacaucuuacccacccuaccucagcaacuucaaguugcacccgcaccggcucccgcaccugggacuaaagccgcggcaccguccggaccugcaccuacaaccucuaucagguuuacccucccaccugguacuucaacuaacggcaagguucuugcugcuacagcuccuacaccgggcauuccuauucugcaaucugucccgagcgccccaccuccaaaagcccagagugugagcccagugcaggcuccaccuccaggcggcagcgcccaacuacuuccuggcaaaguacuggugccucuagcagcuccuuccaugucuguacgcggcgggggggccgggcaaccuuuaccucuggugaguccaccauucucaguaccugugcaaaacggggcgcagccuccaaguaagaucauccagcugacaccuguucccguuuccacaccgucuggccucgucccuccucuguccccagcaacacuuccaggcccuacaagccagccccagaaagugcuucucccaucuuccacacggaucaccuacguccaauccgcgggaggccacgcacucccucugggcacgagucccgcaagcucucaggcaggcaccguuaccucuuacggaccaacaucauccguggcacuaggcuucacuagcuugggucccucagguccugccuucguucaacccuuauugucagcuggacaggcaccccucuuggcgcccgggcagguuggcgugagccccguuccaucaccucagcuuccgccagcaugugcugcccccggcggcccagugauuaccgcuuucuacucuggcucccccgcaccaaccucuuccgccccucuggcccagcccucacaggccccaccaagccuugucuauacuguggcuaccucaacaacuccacccgcugccaccauccugccaaaaggcccacccgcucccgcuacagcuacacccgcacccacaucuccauuuccaagcgccacggcaggauccaugaccuacagucugguagccccaaaggcccagaggcccuccccuaaagcaccacagaaggugaaggcggccauugccucuauuccugucgggucuuuugaggccggagcaucugggcgcccggggccugccccacgccagccccuugagccugggccugugcgcgagccuaccgcuccugaguccgagcuggagggccagccgacuccaccugcaccaccuccauuaccagagacguggacgcccaccgcuagaagcagcccuccccucccaccuccugccgaagaaagaaccucagcuaagggaccugagacaauggcuaguaaguucccauccucauccagcgauuggaggguccccggacagggguuggagaauaggggcgaaccuccuacgccacccucuccagcuccggcccccgcgguugccccagguggauccucugaaucuagcagcggaagggccgcgggcgauacuccugagcguaaagaagccgcugguacgggcaaaaaggucaaggucaggcccccaccucugaagaagacguuugauuccguugacaaccgcgucuuauccgaagucgauuucgaagagcguuucgcggaacuuccugaauucaggcccgaggaggugcuccccucaccaacacuccagucacuggcuacuucaccaagggcuauccugggauccuaccggaaaaaaagaaagaacagcaccgaccuggacuccgcgcccgaggaccccacuucaccaaagaggaaaaugcggcggcgcagcucauguagcucugagcccaauacacccaaaagcgcgaagugcgaaggggauauuuuuacauuugaucggacugggacagaggccgaagaugugcugggagagcuugaguacgacaaagugcccuauuccucccuccggaggacccucgaccagagaagagcacuggugaugcaacuguuccaggaccauggguucuucccuuccgcccaagccacugccgcuuuucaggccagguaugcugauauauuuccaucgaagguaugucugcagcugaaaauuagagaaguucggcaaaagauuaugcaagcugccacgcccacugaacagccaccgggcgccgaagcgccacugccugugccacccccaaccggcacagcggcagccccugcacccacccccucaccggccgguggacccgaucccaccaguccuaguagcgacucugguacugcccaggccgcuccaccgcugccuccgccaccggagaguggacccgggcagccaggaugggagggcgccccccagcccuccccaccaccuccugggcccucaaccgccgcaacugggagauag

SEQ ID NO: 248083 - RNA, 540 nt, Artificial Sequence
  Description of Artificial Sequence: Synthetic coding sequence
augagggcccugguguugcuucuaucccucuuccuguuagguggacaggcacagcaugucagcgacuggacuuauagcgagggagcucuugacgaggcucauuggccucaacauuacccagcaugugguggccagaggcaaucucccaucaaucuucaacgcacaaaggugagguauaacccuucauugaagggacucaauaugaccggauacgagacucaagcuggcgaauucccaaugguaaauaauggacacaccgacuggcaggccgaacuguuccugccuucccuuagcuccccuugcggagaaggcgccaaacauaaaggacaaaggcagugguuauguagucccagccuggacuccuggugggaagcuaucaucgauggcgggagccugugggccacgcuagcggagugugggcuacgugccgaagggccagaggaaggcagacacauggaggagaaaucccccgcaagccagggagcauguuccgguagcaggcucccuauuaguagagggccuuguaccuucuuucucuag

SEQ ID NO: 248084 - RNA, 942 nt, Artificial Sequence
  Description of Artificial Sequence: Synthetic coding sequence
augagagcacuggugcugcugcuaucuuuguuucugcugggcggucaagcucagcauguuuccgauuggacguacagugaaggggcacuggacgaagcucacuggccucagcacuacccggccugcggcggacagcgccagagucccaucaauuugcagagaaccaagguacguuacaaccccucgcucaagggacugaacaugaccgguuaugagacccaagccggagaguuuccgauggugaacaacgggcacacuguacaaauuaguuuacccaguacaaugagaaugacggucgccgacggcaccguguauaucgcacaacagaugcauuuccacugggggggugccaguucugagauuuccggauccgaacacacuguggacggaauucgacacgugauugaaauucacaucguacacuacaacuccaaauauaagucauacgacauugcacaggacgccccagauggccuggccgugcucgccgcuuuuguggaaguuaagaauuacccugaaaacaccuacuacucuaauuuuaucucucauuuagcuaacauaaaguauccuggccagcgaacuacacugacuggacuggaugugcaagacaugcuaccucguaaucuccagcauuacuauacuuaccacggguccuuaacgacccccccuuguaccgaaaacguacacugguuugucuuagcggauuucgugaaacuuagucggacccagguguggaagcuugagaauagcuuguuggaccaccgcaauaaaaccauccauaaugacuaucgcaggacccagccucugaaccacagaguaguggaauccaacuucccuaaucaaggaaaaggccaugguggucaucgcggucggucucagaauccgaggguucaacccacgagcacccgacacccacuugcucucgguagucucgaagcuuag

SEQ ID NO: 248085 - RNA, 927 nt, Artificial Sequence
  Description of Artificial Sequence: Synthetic coding sequence
augcgggcccugguucuccuucuuucacucuucuugcuugggggacaggcucagcaugucucagacuggaccuauucugaaggcgccuuagaugaggcccacuggccacagcacuauccggcuugcggaggucaacgacagagcccaaucaacuugcaacguaccaaggugcgcuacaauccuagcuugaagggacucaacaugacaggcuacgaaacacaggccggggaguuuccuauggugaacaaugggcacaccguccagauuucucuccccagcaccaugaggaugacagucgcggaugggacaguauacaucgcccagcaaaugcacuuucauuggggaggugccucuucugagauuucaggcagugagcauacagucgacggcauccggcacgugauugaaauccauauagugcacuauaacuccaaguacaagagcuacgauauugcacaggacgcccccgacggucucgccguccucgccgcuuucguugaggugaagaauuacccagagaacaccuacuauagcaauuuuauaucacaccuugccaacaucaaauacccggggcaaaggacaacgcuuacggguuuggacgugcaggacaugcucccccggaaucuccagcauuacuacacauaccacggaucucuuacuacaccuccuugcaccgaaaauguccacugguucguguuagcagacuuugugaaacuuaguagaacucaggucuggaagcuagaaaauucccugcuggaccauagaaacaagaccauccauaacgacuacagacgcacgcaaccucucaaccaccgggugguggaauccaacuucccaaaucaggaauacacucuaggaagugaauuccaauucuaccuccacaaaaucgaggaaauacuugacuauuuaaggcgcgcucucaacuag

SEQ ID NO: 248086 - RNA, 987 nt, Artificial Sequence
  Description of Artificial Sequence: Synthetic coding sequence
augggcgcagcugcacggcuuucugcaccaagagcccucgugcugugggcugccuuaggcgccgccgcccacauuggcccagcccccgacccagaggacugguggaguuacaaggacaaucugcaggggaauuucgugcccggcccuccauucuggggcuuagucaaugcugcuuggucucuuugcgcggucggaaaacgccagagucccguugaugucgaguugaagagagugcuguaugauccuuuucugccaccgcuccggcucuccacgggcggcgagaaacuuagaggaacuuuguacaacacuggccgacacgugagcuuccugccugcuccccgccccguggugaacguuaguggcggaccucugcuguacagccaccgcuugucagaacuccgacugcuauucggugcucgcgacggcgccggcucggagcaucagaucaaucaccaagguuuuucugcugaagugcagcuaauacacuucaaccaggagcuguaugguaacuuuuccgcugccucaagagggcccaauggacucgcuauauugucacucuuuguuaacguggccaguacuaguaaucccuuccugucccgacugcuuaaccgcgacacaaucacacgaauuuccuacaaaaaugacgccuacuuuuugcaggaucuguccuuggaacuguuguuuccugagucuuucggcuucaucacuuaucaagggucacuuucuacucccccuugcucagagacaguuacguggauucuaauugaccgcgcacugaacauuacaucuuuacagaugcacagucuccgcuuacuuagucagaacccucccucucagauuuuucaaucacuaagcgguaacagccgcccacuccagccacuugcccaucgggcauuacgcgggaaccgggacccuagacaucccgaaagacgcugucggggaccaaacuaucgucuccacguggacggcgugccucauggccgcuag

SEQ ID NO: 248087 - RNA, 1260 nt, Artificial Sequence
  Description of Artificial Sequence: Synthetic coding sequence
augcggggccugcuuguccugagcgugcugcugggcgccguuuuugguaaagaggacuucguugggcaucaggugcugagaaucuccguggccgacgaagcucaggugcaaaagguuaaagaacuggaagaucuggaacacuugcaacucgauuucuggagaggaccggcccauccagguagcccuaucgacguccgcgugccuuuuccaucuauucaggcuguuaagauuuuccuugagucacacgguaucuccuacgagacgaugauugaggaugugcaaagucugcuggacgaagaacaagagcagauguucgcauuucgaagccgagccaggucgacagauacguuuaacuacgccacuuaucacacacucgaagagauauacgauuuucuggacuuauuggucgcggaaaauccgcaccugguguccaagauucagauagguaauaccuaugagggccgcccaauuuaugugcucaaauuuucaacaggcggguccaagcgcccagccauauggauugauaccggaauccacucuagagaaugggugacucaagcuucugggguaugguuugcaaagaagauuacccaggacuauggccaggacgcggcuuucacagcuauccucgacacucuggauauauucuuagaaaucgugacuaauccugacggcuucgcuuucacacacagcacuaaucgaauguggagaaaaacacgaucacacacugcaggcucucucugcauuggcguggacccuaaccguaacugggacgcuggguuugggcucuccggcgcaucgucgaaucccugcagugaaacuuaucaugggaaauucgcaaauucugaaguggaagugaagaguaucguugacuucgugaaagaccaugggaauaucaaagccuuuaucuccauccacaguuauagccaacugcugauguauccuuacggcuacaaaaccgaaccuguccccgaccaagaugaauuggaccaacucucuaaggccgcagucaccgcacuugcaucccuauacggcacuaaguucaacuacggcuccauuauuaaggccauuuaucaggcaucaggaucaacuaucgauuggacauacucccaagguauaaaguacuccuucaccuuugaguuaagagacacaggaagguacggcuuucugcuccccgcuucccaaauaauuccuacagcgaaggagacuuggcuugcacugcugaccaucauggaacacacccuuaaucaccccuauuag

SEQ ID NO: 248088 - RNA, 1098 nt, Artificial Sequence
  Description of Artificial Sequence: Synthetic coding sequence
auggauagggccgcccuguuaggucuggcccggcuuugugcacugugggcugcuuuauuaguucuguucccauacggggcucaggggaauuggauguggcugggcaucgcaucguuuggcgugcccgaaaagcuggguugugccaaucugccucugaauucacgacagaaagaacucuguaaacggaaaccauaccuacucccaucuaucagagaaggggccagacuggguauucaagaaugcgggagccaguuucgccacgagcgguggaacugcaugauuaccgccgcagcgacaaccgcccccaugggagccagccccuuguuuggguacgaguuaucuuccggaacgaaagaaaccgcuuuuauauacgccgucauggcagccggauugguacauucugucacuagaucuugcagcgcaggaaacaugacugaaugcagcugcgacaccacccuucaaaaugggggcuccgcaucagagggguggcauuggggaggaugcucagaugaugugcaguacgguaugugguucucucgaaaauuccuggauuucccaaucgguaacacuaccggcaaggaaaauaaggugcuccucgccaugaaccugcacaauaacgaagccggacgucaagcuguggccaagcugaugagugucgacugcagaugucacggagugagcggaagcugugcuguaaagacauguuggaaaacuaugucuucuuucgaaaagaucggccaucugcuuaaagacaaauaugaaaauucuauccagauaucggacaagacgaaaagaaagaugagaagaagagagaaagaccaacgaaagauaccaauccacaaagacgaccuccuguaugucaacaagaguccgaauuauugugucgaggauaaaaaauuggguauaccgggcacccaaggacgggaaugcaaccgaaccuccgagggcgcugauggcugcaaucuucuguguuguggccgaggcuacaauacucaugucgugcggcauguugagagaugugagugcaaauucaucugguguuguuaugucagaugcagacgcugcgaaucgaugacagauguucacaccuguaaauag

SEQ ID NO: 248089 - RNA, 1581 nt, Artificial Sequence
  Description of Artificial Sequence: Synthetic coding sequence
augggacaccuuuccgcgccucuccaucgaguucgggugccuuggcagggacuacugcuuacagcuucacuccuaacauucuggaacccacccacaaccgcucaacucacuacagaaucaaugccauuuaacgucgcggaaggcaaggaaguucugcugcugguacauaaucugccccaacaguuauucggcuacagcugguacaagggcgaaagaguugaugggaaccggcaaauuguaggcuacgcaaucggaacacagcaagccaccccugguccugcaaauuccggucgggaaacgaucuaucccaacgcgaguuugcugauccaaaacgucacucagaaugauaccggauucuacacucugcaagucaucaaauccgaccuggucaacgaggaagcuacugggcaauuucauguguaucccgaacucccuaagcccucaaucucaagcaacaacagcaaucccguggaagacaaggacgcuguagccuucacaugugaaccugaaacccaggacacgacauaucuaugguggauuaauaaccaaucacugcccgugaguccacgccugcaacuaagcaauggcaaucguacucuuacucugcucucagugacacggaaugacacgggacccuaugaaugcgaaauucagaacccagucuccgcaaaucgaucugacccgguaacacugaacgucacauauggcccggauaccccuaccauuuccccuucugauacuuauuaccggccaggggcuaaccucucucugucuuguuacgccgccaguaacccccccgcacaguacaguuggcuuauuaacgggaccuuccaacagagcacacaggaguuauucauacccaauauuacugugaacaauucaggaucuuacaccugccacgccaacaauucuguuacagguugcaauaggaccacagucaaaacgaucaucgugacggaauugaguccaguaguggccaaaccucagaucaaagcgagcaaaacaacgguaaccggugacaaggacuccgucaaccucacuugcuccacaaaugauacugggauuagcaucaggugguuuuuuaagaaccagucguuaccaaguucugagaggaugaaauuaagccagggcaacaccacucugagcaucaauccugucaagagggaggaugccggcacuuauuggugcgaggucuucaaucccaucaguaagaaccaguccgauccaaucauguuaaacgugaacuacaacgcucuuccacaggaaaaugggcugucuccuggugcuauugcuggcauuguuauugggguggucgcacugguggcacucauugcuguagcucuggcuugcuuccugcacuucgguaagaccggcagggcauccgaucagagggaucugaccgaacauaagccuucuguaucuaaucacacucaggaccacucaaaugacccuccuaacaaaaugaacgaaguuacauacucuacccugaauuuugaagcccaacagcccacgcagccuacaucugcuucucccagccuaacggccaccgagaucauuuauagcgaggugaagaaacaauag

SEQ ID NO: 248090 - RNA, 2115 nt, Artificial Sequence
  Description of Artificial Sequence: Synthetic coding sequence
auggugccggacacagccugcguguuacuccuuacucuagccgcccuuggcgccagcggacagggacagucgcccuuaggaucagaccuuggaccucagaugcugagggaacuccaggaaaccaacgccgcgcuucaggauguaagggagcuccugagacagcaaguuagagaaaucacauuucucaagaauacagucauggagugugaugcaugugguaugcagcaaagcguacgaaccggguuaccaagugugagaccccugcugcacugcgcccccggcuucugcuucccaggagucgcaugcauucagacugaaagcggagcucggugcgggccuuguccugcaggauucaccggcaacgggucacauugcaccgauguuaaugaaugcgagaccggucagcauaacugugucccuaauucggucuguauuaacacacgaggaagcuuccagugcgguccuugccagcccgguuuugugggagaucaggcaagugguugccaacgacgcgcucagagauuuuguccugacggcuccccauccgagugccacgaacaugccgauugcguucucgaacgagauggaucccgaagcugcguaugcgcggucggaugggcaggcaacgggauccuguguggacgugauaccgaucuggacgguuuuccagaugaaaaguugagaugcccugaaaggcaguguaggaaggacaauugcgucacaguuccaaacaguggccaagaagacguagaccgggaugguaucggcgaugccugugaucccgacgccgauggcgauggugucccuaaugagaaggauaacuguccacugguacggaaccccgaccagcggaacacagacgaagauaaauggggggacgcuugugacaacugucgaucccagaaaaaugaugaccagaaggacacugaccaggauggccgcggugaugcaugcgaugacgauaucgacggcgacaggaucaggaaucaagcugacaauugccccaggguuccuaauucagaucaaaaggauuccgauggcgaugggauuggugaugccugcgauaacugcccacagaaauccaacccugaccaagcggacgucgaccaugacuucgugggugacgcgugugauucugaccaggaucaggacggcgacgggcaccaagauucacgggauaacugccccaccguucccaacucagcucaggaggacagcgaccacgaugggcagggagaugccugcgaugaugacgaugauaaugauggaguacccgacucccgcgacaacugucgucuggucccgaauccaggccaggaggacgccgaccgggacggagugggugacgugugccaggacgacuucgacgcggacaaagugguggauaagauugacguguguccugagaacgcagaggugacccucaccgacuuccgggcauuucagaccgugguccucgacccagaaggcgacgcccagaucgaccccaauugggugguacugaaccagggcagagagaucgugcaaaccaugaauagcgauccaggguuggccgucggcuacacagccuucaacgguguugacuuugaggggaccuuccaugucaacacggucacggacgacgacuaugcggguuucauuuucggauaccaggauagcagcucuuuuuaugucgugauguggaaacagauggaacagacuuauuggcaggcgaacccauuccgugccguggcagaacccggaauccagcugaaggcagugaaguccaguacggggccuggcgaacagcucaggaaugcacuguggcacaccggcgacacugaaagccaggucagacuguuguggaaggauccccgaaaugugggguggaaggauaagaaaucuuaccgaugguuucuccagcacaggccacaggugggcuauaucagaguucguuucuacgaaggaccagaguugguagcugacagcaauguuguccuggacaccaccaugcgcggcggaagauuaggagucuucugcuuuagccaggaaaacaucauuugggccaaccuaagauaccgaugcaaugacaccaucccugaagauuaugagacacaucagcugaggcaggccuag

SEQ ID NO: 248091 - RNA, 2235 nt, Artificial Sequence
  Description of Artificial Sequence: Synthetic coding sequence
auggucccggacacagccugcgugcuguugcuaacccuggcggccuugggcgcuucagggcagggacagucaccucuggggucagauuuagggccucaaaugcuccgugaguuacaggagacaaaugcggcuuugcaggauguucgagaacuucugcggcaacagguucgugagauaacuuuccugaagaacacagugauggaaugugaugcgugugggaugcagcaaucugugcgcaccggccuucccagugucaggccucuccuacauugcgcccccggguuuuguuucccuggcccuugcccugccggauuuacugguaauggcucucacuguacagacguuaaugaauguaacgcgcacccauguuucccucgugugcgguguauuaauacuucucccggguuuagaugugaagcguguccuccuggauauucugggccaacucaccaagguguuggccuggccuuugccaaggcaaauaagcaggugugcacagacauuaaugagugugaaacagggcaacauaacugcgugccaaacagcgucuguauuaacacuagaggauccuuucagugugguccaugccagcccggguucgugggggaucaggcaucuggaugucagcgaagagcccagagguuuugcccagacggaagccccuccgagugccacgaacaugcugacugcgugcuggagagagacgggaguagaagcugcgucugugccguugggugggccgggaacggcauucugugcgggcgcgacacagaucuagauggguucccagacgagaaguuaagaugccccgaacggcagugcagaaaagacaacugugugacggugccuaacagcggacaggaggauguagaucgggacggcauuggggaugcaugcgauccggaugccgacggcgauggagugccaaacgaaaaagacaacuguccccuggugaggaacccagaccagcgaaauaccgaugaagacaaauggggggacgccugcgacaauuguagaucucagaagaaugacgaccagaaagacaccgaccaggacgggaggggcgacgccugcgaugaugauauugacggcgaucgcauccggaaccaggccgauaacugcccacgcguccccaacucagaucagaaagauucagauggcgacggcauuggggacgccugcgauaacugcccacagaagagcaaccccgaucaagccgacguagaccacgacuucgugggagaugcgugugacucagaucaggaccaagauggcgauggacaccaggauagccgcgauaauugccccacagucccgaauagcgcucaggaggacagcgaccacgauggucagggcgaugcaugcgacgaugaugaugauaacgauggugugccagauagucgcgauaauugucgauuaguccccaaccccggacaggaagacgcugaucgagacgguguaggggacgugugccaggaugacuucgaugcugauaaggucguggacaagauugacguauguccugagaaugccgaaguaacacuuaccgauuuuagagccuuucagacuguggucuuagacccagaaggcgaugcccagauagauccaaauuggguggugcuuaaccagggacgagagaucgugcagacuaugaacagcgacccaggucucgccgucggauauacagccuucaacgggguugauuucgaagguaccuuccacgucaauacagucacagacgaugauuacgccggcuucauauuuggguaccaggacagcagcucguuuuauguugugauguggaagcagauggaacagacguauuggcaggcuaaucccuuuagggccguggcagagccaggcauucagcuuaaagccgucaaaagcagcacaggaccuggggagcagcuccggaacgcucuguggcacacgggcgacaccgaaucacagguuagacuccuuuggaaggauccucgcaacguggguuggaaagauaagaaauccuaucgaugguuccuccagcaucggccucagguaggguacauccgcgugagauucuacgagggcccugaguugguagccgauucgaacguugugcucgauacaaccaugcggggcggcaggcuugguguguucuguuucucccaggaaaacaucauuugggccaacuuaagguaucgguguaacgacacgaucccggaagacuacgaaacucaccaauugcggcaagcuuag

SEQ ID NO: 248092 - RNA, 387 nt, Artificial Sequence
  Description of Artificial Sequence: Synthetic coding sequence
auggggauucaaggaggaagcguucuuuuugggcugcugcucguucuagcaguuuucugccacuccggccauucucuucaauguuacaauugucccaacccuacugcugacugcaaaaccgccgucaauugcaguagugacuucgaugcuugccugaucacuaaagcuggccugcaaguguacaacaaaugcuggaaauucgaacauuguaauuucaacgacgugacgacuagauuacgagaaaacgaacugaccuacuacugcuguaaaaaagaucugugcaauuucaaugagcagcucgaaaauggaggcacaucacucucugagaaaacuguccugcugcuggucacaccuuuucuugcagccgcauggucucuucauccauag

SEQ ID NO: 248093 - RNA, 387 nt, Artificial Sequence
  Description of Artificial Sequence: Synthetic coding sequence
auggguauucagggcggauccguguuauucggcuugcuuuuaguuuuagccguauuuugccacuccggccauucgcuucaguguuacaauugucccaaccccaccgcagacugcaagaccgccgucaacugcuccagcgacuucgacgcuugucugaucaccaaggccggacugcaaguauauaauaaaugcuggaaauucgaacacugcaauuuuaacgacgugacuacuaggcugcgggagaaugagcugaccuacuauugcugcaagaaagaucuguguaacuucaacgagcagcuggagaauggaggcaccagcuuaucugagaagaccguucuacuuuuggugacgccuuuucuagccgcugccuggucccuccaucccuag

SEQ ID NO: 248094 - RNA, 387 nt, Artificial Sequence
  Description of Artificial Sequence: Synthetic coding sequence
augggaauucaaggggggagugugcuguuuggacuucuccucgugcuggccguauucugccacucgggccacagccuucaaugcuauaauugcccaaaucccacugcugacuguaagacagccgugaacuguucgagcgacuuugaugcaugccugauuacaaaagcaggauugcagguguacaacaaauguuggaaauuugagcacugcaauuuuaaugacgucaccacccgccugcgugaaaacgaacugaccuauuauugcugcaaaaaagacuuguguaauuucaaugaacaguuggaaaacggcgggacaucucuguccgagaaaaccguguuacugcuugugacucccuuucuggccgcugccuggagccuacaucccuag

SEQ ID NO: 248095 - RNA, 387 nt, Artificial Sequence
  Description of Artificial Sequence: Synthetic coding sequence
auggggauccagggcggcaguguacuguuuggguugcuucuuguccuugcggucuuuugucacuccggucacucucuccagugcuacaacuguccaaaccccacagcagauugcaaaacugcagugaacugcucaagugauuucgacgccugccucaucacaaaggccggacuccagguuuauaacaagugcuggaaauucgaacacuguaauuucaacgacgucacgacaaggcucagagaaaacgaacugacauacuauugcugcaagaaggaccuguguaacuuuaacgaacagcucgaaaauggcggcacuucacucuccgaaaaaacaguccuucugcuuguaacccccuuucuggcggcugcuuggucacuccauccuuag

SEQ ID NO: 248096 - RNA, 387 nt, Artificial Sequence
  Description of Artificial Sequence: Synthetic coding sequence
auggguauucaaggagguagugugcucuucgggcuguugcuaguauuggccguuuucugucacucuggacacucauuacagugcuauaacuguccaaacccgacugcugacuguaaaaccgcugugaauugcaguucggauuucgaugcuugucuuauuacaaaagcaggacuccaagucuacaauaagugcuggaaauuugaacauuguaacuucaacgauguuacaacucgacugagagaaaaugaacugaccuauuacugcugcaagaaagaucuauguaauuucaaugaacagcucgaaaauggagggacaagucuuagcgagaaaaccguccuucugcuuguuacgcccuucuuagcugccgcguggucgcuucaucccuag

SEQ ID NO: 248097 - RNA, 387 nt, Artificial Sequence
  Description of Artificial Sequence: Synthetic coding sequence
augggaauccaagggggguccguucucuucggucuucuccuuguccuagcuguguucugccauuccggccacucacugcaauguuauaacuguccuaauccuacugccgacuguaagacggcgguaaacugcucuucugauuuugaugcuugccugauuaccaaagcgggacuucaaguuuauaauaaaugcuggaaguucgaacauuguaacuucaacgacgugaccaccagacugcgcgaaaacgagcuaacauacuauugcugcaaaaaagaccuuuguaacuucaacgaacaacucgaaaauggcgggaccucuuugucagaaaaaacugugcugcuccucguaacaccguuuuuggccgcagcaugguccuugcacccuuag

SEQ ID NO: 248098 - RNA, 387 nt, Artificial Sequence
  Description of Artificial Sequence: Synthetic coding sequence
augggaauccagggggguucuguacucuucggccugcuucucguccucgcaguguucugucauucuggacauucucuacagugcuacaacugccccaacccuacugccgauugcaagaccgcugugaacuguaguagcgacuuugacgcuugccugauuacuaaagccggccugcaggucuauaauaaaugcuggaaauuugagcauugcaacuuuaaugaugucaccaccagauugcgugagaacgagcugacuuacuauugcuguaaaaaggaucuuugcaauuucaacgaacaauuagaaaauggcgggacuagcuugucugagaagacuguuuuacuguuggugacccccuuccucgccgccgcuuggucacuucauccauag

SEQ ID NO: 248099 - RNA, 387 nt, Artificial Sequence
  Description of Artificial Sequence: Synthetic coding sequence
auggggauccaaggugggucaguguuguucggguugcuccugguuuuagccguauuuugucauaguggccacagucugcagugcuacaacuguccgaauccuaccgccgacuguaagacagcagugaauugcucuuccgauuucgacgccugccuuauuacaaaagcgggacugcagguguacaauaaaugcuggaaauuugaacacuguaacuucaacgauguaacgacccgacugagagagaacgaacugacuuacuauugcugcaaaaaggaucuuugcaacuucaaugagcaacucgaaaacggcggaaccucuuuaucagaaaaaaccgugcuucuuuuagugacaccuuuccuggcugccgcuuggucucugcacccauag

SEQ ID NO: 248100 - RNA, 387 nt, Artificial Sequence
  Description of Artificial Sequence: Synthetic coding sequence
augggcauccagggcggcaguguacucuucgggcugcugcuuguguuggccguuuucugccauucuggacauucucugcaaugcuauaauugucccaauccaaccgccgacuguaagaccgccguaaacugcucuucggacuucgacgcaugucucaucacaaaggcaggacugcagguguauaauaaaugcuggaaauucgaacacuguaacuucaacgacgugacaacacgacugcgcgaaaaugaacucacauacuacugcuguaagaaggaucuauguaacuucaacgagcaauuggaaaacggcggcaccagucucucagagaagacgguccuccuccuaguaacuccuuuccucgccgcagcauggucgcuccaucccuag

SEQ ID NO: 248101 - RNA, 891 nt, Artificial Sequence
  Description of Artificial Sequence: Synthetic coding sequence
augcauagacgaagaagcagaagcugccgcgaagaccaaaaacccgugauggacgaucagcgugacuuaaucagcaauaacgagcagcugccuaugcucggccgcaggcccggcgccccagaguccaaaugcaguagaggagccuuguauaccggcuucagcauauuggucaccuuacuucuggccgggcaagcaacgaccgcuuacuuucuguaucagcaacaaggaagacuggauaagcugacugucaccagucagaaucuccagcuggagaaucuaagaaugaaacucccgaagccccccaagccagugucuaaaaugaggauggcaaccccgcuucucaugcaggcccuuccuaugggcgcucucccacaggguccuaugcagaaugcuacaaaauacggaaacaugacugaggaucacguaaugcauuuguuacaaaaugcugacccacuaaaggucuacccaccccucaaaggaucuuucccagagaaucuucgccauuugaagaauacuauggagaccauugacuggaagguguucgaguccuggaugcaccacuggcuccuauuugagaugaguaggcacucgcucgagcagaagccaacagaugcaccacccaaggugcucacuaagugccaggaggaagucucucacauuccagccguacauccagguuccuuucgcccaaaaugugaugaaaacggaaauuaccucccucuccaguguuaugguuccauuggauacuguugguguguuuuuccuaacggcacagaaguuccgaauacccgcagccgggggcaccauaacuguucugagagccuugagcuugaagauccaaguaguggccucggugucacuaaacaggaccugggaccgguccccauguag

SEQ ID NO: 248102 - RNA, 690 nt, Artificial Sequence
  Description of Artificial Sequence: Synthetic coding sequence
auggcccgcuuggccuugucuccaguuccuucucauuggaugguggcccuguuacuucuguuaucugcggaaccagucccagccgcuaggagcgaggaccgauaccggaaccccaaaggcuccgccugcaguaggauuuggcaguccccucgcuucauagcucguaaacgagguuuuaccgucaagaugcacuguuacaugaacagcgcaagcggaaaugugagcuggcuuuggaagcaggagauggaugaaaauccgcagcaguuaaagcuagagaagggacggauggaggagucucagaacgagucccucgcaacucuuaccauccaagguauucgguucgaggacaauggcauuuauuuuugccaacagaagugcaauaauacuagugaaguguaucaaggaugugggaccgaacugaggguaaugggcuuuucaacgcuggcacagcuuaaacagcggaauacacuuaaagacggcauuaucaugauucagacacuguuaaucaucuuguucaucaucgugccuaucuucuuacuucuugacaaggacgacucuaaggcugggauggaagaagaucauacauacgagggccuggauauugaucaaacagcaaccuaugaagacauaguaacgcuuagaacaggagagguaaaauggagugugggggaacauccaggacaggaauag

SEQ ID NO: 248103 - RNA, 687 nt, Artificial Sequence
  Description of Artificial Sequence: Synthetic coding sequence
augccuguuaaaggagguaccaaaugcauuaaauaucuacuguucggcuucaauuuuauuuucugguuagcaggaauagccguccucgcaaucgggcucuggcucagauuugacagccaaacuaaauccauuuuugagcaggaaaccaacaacaacaauucgaguuuuuacaccggaguguauauucugaucggagcaggagcauuaaugauguuagugggcuuuuugggguguuguggagcaguccaggagucgcagugcaugcugggauuauucuuuggguuucuccugguaauauuugcuaucgagauugcugccgcaauuuggggauacucccacaaggaugaagugauaaaggaaguccaggaauucuauaaagauaccuacaacaagcuaaagaccaaagacgaaccucagagagagaccuuaaaggcaauucauuaugcucucaauuguugcggacuugccggaggaguggagcaguuuauaucagauaucugcccaaagaaggacguguuagaaacuuucacagugaaaaguuguccugacgcaauaaaggaagucuucgacaauaaguuucacaucauuggugcaguuggaaucgggauagcgguggugaugauauucggcaugaucuucucaaugauucuaugcugcgcgauccgccguaacagagagaugguuuag

SEQ ID NO: 248104 - RNA, 2475 nt, Artificial Sequence
  Description of Artificial Sequence: Synthetic coding sequence
augacugugcugcaggagcccguucaagcagcgauuuggcaggcacugaaccacuaugcguaccgcgaugcuguguuuuuggcugagcggcucuacgccgaaguccauuccgaagaggcccucuucuugcuggcgacuuguuauuaccgcucagggaaagccuacaaagccuaccgccuccugaaagggcacuccuguacaacuccgcaguguaaguaucugcucgcaaaguguugcguggaucugucaaagcuugccgaaggggaacagauccucucuggcggaguuuuuaacaaacagaaaagccacgacgacaucgugacggaguucggagauuccgcuugcuucacacugagcuuguuaggucauguauauuguaagaccgaccgccuggcaaagggcucugaauguuaccagaaaagucucucccugaaccccuuccucugguccccauuugaaucacugugugaaauaggcgagaaacccgauccugaccagacauuuaaauuuacaucguuacagaacuucaguaauugcuugcccaacucuugcacgacacagguucccaaucacagcuugucucacaggcagccagagacaguacuuaccgagaccccucaggauaccauugagcuuaacagacuaaaccuggaguccucuaauucuaaauacucacugaauaccgauuccuccgucucuuacaucgauucagcugucauuagucccgauacgguuccgcuuggaaccggcacauccauucuguccaaacagguucagaacaagcccaagacggggagaagccugcugggcggcccagcagcgcuuucccccuuaacucccuccuucggaaucuugccacuagaaacccccuccccuggcgacggcuccuacuuacagaauuacacuaacacaccgccggucauugacguaccuucaacaggagcaccaucaaagaaaaguguggcgagaauuggccagacuggaaccaagagcguuuuuucccagagcgggaacagccgcgaggucacaccaauucuggcucaaacacaauccucugggccccagacuagcaccacgccccagguacucuccccaaccauaacaagcccuccuaaugcacugccucgcaggucuagucgacuguuuacauccgacaguucaacuacuaaggagaauucaaagaaacuuaaaaugaaguucccucccaagauacccaauagaaagacgaagucaaagacaaacaaaggagguauuacucaacccaacaucaacgauucccuggaaaucaccaagcuugacagcaguauaauauccgaagguaaaauaucaacuauuacgccucagauucaggcuuuuaaccuucagaaagcagccgcugagggacugaugucccuucugcgagagaugggaaaagguuaccuugcccucuguagcuacaauuguaaagaagccauaaacaucuugucccaccuaccaucacaucauuauaauacaggaugggugcugugucagaucggccgcgcauacuucgagcugucugaguauaugcaagcggaacgaaucuucagcgagguacgucgaauugaaaacuauagaguggaggggauggaaaucuacucaacuacucuguggcaccugcagaaagauguggcccucuccguucuuagcaaggaucuuaccgauauggacaagaacuccccugaagcauggugcgccgcuggaaacuguuucucccuucaacgugaacaugacaucgccaucaaauucuuucagagggcuauucagguggauccuaacuacgcuuacgcauacacccuucuuggacacgaauucguacuuacggaggaacuggacaaggcacucgccugcuuccggaacgcuaucagggucaauccgagacacuacaacgccugguacggacucggcaugaucuacuauaagcaggaaaaauuuucuuuggccgagaugcacuuucagaaggcccuggacaucaacccacagaguuccgugcugcugugucacaucggagucgugcaacacgcccuuaaaaagagcgaaaaagcccuggacacgcucaacaaagcuauagugauugaucccaaaaauccucucuguaaguuccaccgcgcaucaguucucuuugcuaaugagaaauacaaaagugcccuucaggaguuggaagaauugaagcaaaucgugccaaaagagucccuugucuacuuccugauuggcaagguguauaaaaaauuagggcagacccaccuugcucuuaugaauuucucaugggcaauggaucuugauccaaaaggagcaaauaaucagauuaaagaagcuauugacaaacgcuaccuuccugaugacgaggaaccuaucacccaggaggagcagauaauggggaccgacgagagccaagaaagcucaaugacagacgccgaugacacccagcuacacgcggcugaaucagacgaauuuuag

SEQ ID NO: 248105 - RNA, 342 nt, Artificial Sequence
  Description of Artificial Sequence: Synthetic coding sequence
augaaaguuuccgucgcugcccuuucuugucucaugcuggucgccguucugggcucccaggcacaguuuaucaacgacgcugagaccgagcugaugaugagcaaacugccucuggaaaaccccguggugcuaaacuccuuccauuuugcugccgacugcugcaccuccuauauuucccaaucaauuccuuguucucugaugaaaaguuacuucgaaacgaguuccgagugcuccaagccaggaguuaucuuccucacaaaaaaagguagacaggucugugcaaaacccagcggccccggggugcaggacugcaugaagaaacugaaaccuuauaguaucuag

SEQ ID NO: 248106 - RNA, 186 nt, Artificial Sequence
  Description of Artificial Sequence: Synthetic coding sequence
ugaugcacuagcuacaucagccaguccauucccuguucguugaugaaaucauacuucgagacuaguuccgagugcucaaaacccggcguuauuuuccugacuaaaaagggacgacaagugugugcgaaaccaagcggcccaggcgugcaagauugcaugaagaagcuuaaaccauacuccauauag

SEQ ID NO: 248107 - RNA, 342 nt, Artificial Sequence
  Description of Artificial Sequence: Synthetic coding sequence
augaagguaucuguggcugcucucuccugccuuaugcucgucgcggugcuaggcucccaggcucaguucaucaaugaugccgaaaccgaacuaaugauguccaaauuaccacucgaaaacccagucguguuaaauucuuuucauuucgcugccgacuguugcacaucuuauaucucacagucuauccccugcucacucaugaaguccuacuucgagaccucgucugaguguaguaagccagggguuauuuuccugacgaagaagggacgucaagugugugcuaaaccaucagggcccggcguccaggauugcaugaagaaacugaaacccuauaguaucuag

SEQ ID NO: 248108 - RNA, 342 nt, Artificial Sequence
  Description of Artificial Sequence: Synthetic coding sequence
augaaaguaucaguggcagcccuguccugucuuaugcugguugcagugcuggguagccaagcucaguuuauuaacgacgccgagaccgagcucaugaugaguaaacucccgcuagaaaaccccgugguccucaacucuuuccauuuugcggcagauugcugcaccucauauauuucucaaucaauuccuugcucacugaugaagagcuacuuugaaaccagcucagagugcucaaaaccaggugugauuuucuugacaaaaaaaggaaggcagguaugcgcaaaacccucuggcccggguguucaagacuguaugaaaaagcuuaaacccuauuccaucuag

SEQ ID NO: 248109 - RNA, 270 nt, Artificial Sequence
  Description of Artificial Sequence: Synthetic coding sequence
augaagggucuugccgcugccuuacuggucuugguaugcaccauggcucucugcucuugcgcucagguggggaccaauaaggaauugugcugccucguguauacgucuuggcaaauuccacagaaguuuauaguagacuacuccgaaacuagcccacaguguccuaagcccggcguuaucuuacuuacaaaacggggcaggcagaucugcgcugauccgaauaagaaguggguacaaaaguauauauccgauuuaaaacugaacgcuuag

SEQ ID NO: 248110 - RNA, 285 nt, Artificial Sequence
  Description of Artificial Sequence: Synthetic coding sequence
augaugggccuuucccuugcaucagccgugcugcucgccucacuguugucucuucaucugggcacagcaaccaggggcagcgacauuaguaagacuuguuguuuccaguauagccacaaaccauuaccauggaccuggguacgaucauacgaguucacaagcaauagcugcagucagagggcugugaucuucacgacaaaacgcggaaaaaaagucugcacucacccuagaaaaaaguggguccagaaauacauaucucuucuaaagaccccuaaacaacuuuag

SEQ ID NO: 248111 - RNA, 384 nt, Artificial Sequence
  Description of Artificial Sequence: Synthetic coding sequence
augcagcaaagaggcuuagccauuguggcccucgcaguuugugcugcacuccaugcauccgaagccauucugcccauugccagcaguugcugcacagagguuucccaucauauuagcagacgccugcucgagcguguuaacaugugccgaauccagagagcugacggggauugugaccuugccgcugucauacuccacguaaaacgccgccgcaucuguguuuccccacauaaucauaccgugaaacaguggaugaaggugcaggcugcuaagaagaacggaaagggcaacguuugucacagaaagaagcaccacggaaagaggaauaguaaucgagcucaccagggaaaacaugagacguacggacacaaaacaccauacuag

SEQ ID NO: 248112 - RNA, 384 nt, Artificial Sequence
  Description of Artificial Sequence: Synthetic coding sequence
augcagcagcggggacuagcuauagucgcacuugccgugugugcagcccuccaugcuuccgaagcuauacuucccauagccaguagcuguugcacugaggucucccaccauaucucaagaaggcuguuagagagggucaauaugugucgaauucagagagcagacggggauugugaucucgccgccguaauuuuacacguaaaacgucgaagaaucugcguaucaccucauaaucauacaguuaagcaguggaugaaaguacaagccgcaaagaagaacgguaaaggcaacgucugucaucggaagaaacaucacggcaagaggaauuccaaccgggcccaucaggggaaacacgaaacuuacggacauaagacuccuuacuag

SEQ ID NO: 248113 - RNA, 243 nt, Artificial Sequence
  Description of Artificial Sequence: Synthetic coding sequence
auguguagaauacagcgcgccgacggagauugugaccuggccgccgucauccugcacgucaagcgaagacggauuugcgugaguccacauaaucacacaguuaaacaauggaugaaagugcaggcagcgaaaaaaaauggaaaggggaacgugugccauaggaaaaaacaccacggcaaacgcaauucuaaccgugcacaccaaggaaaacaugaaacauacggccacaagacaccauacuag

SEQ ID NO: 248114 - RNA, 354 nt, Artificial Sequence
  Description of Artificial Sequence: Synthetic coding sequence
augcaacagagagggcuagcaauuguggcucucgccguuugcgccgcacuacacgcguccgaagccauccugccaaucgccuccuccuguuguacagaaguaucucaucauaucucccgaaggcugcuugagagagugaauaugugcagaauccaacgcgccgauggugacugugaucucgcggccgugaugcuggaauguagcgauaugaucuccgcccauuauaaucuucaccucccagguuccaaugacucuccgaccuccgccuuccagguggccggaauuaccgcuuucaugagcucugcagaggaaucagugagcgcucggacuaccauccugcuuaguaguggcuag

SEQ ID NO: 248115 - RNA, 1194 nt, Artificial Sequence
  Description of Artificial Sequence: Synthetic coding sequence
auggcuccaauuucccuuagcugguugcuccgacuugcuacuuuuugccaucugacugugcugcuggcuggccaacaccauggagucaccaaguguaacaucaccuguagcaaaaugacgaguaagauuccaguggcccuucuaauacauuaucagcagaaucaggccaguugugguaagcgagcgauuaucuuggagacccgacaacacagacucuucugcgcugaccccaaggaacagugggugaaagacgcuaugcagcaccuagacaggcaagcagccgcccugacgcggaauggagggacauuugagaagcagauuggagaagucaagccacgcacaacgccugccgcaggcggaauggaugaaagcguagugcucgagcccgaggcaaccggagagaguuccagccuggagcccacuccgucaagccaggaagcacaaagggcuuuaggaaccuccccagagcucccuacaggaguuacagggaguucugguacucgauugccuccaacccccaaagcccaggauggaggaccagucgggaccgagcuuuuccggguaccaccaguuagcacagccgcuacuuggcagucuucagccccgcaucaacccggccccucgcuuugggccgaagccaagacuuccgaggcuccuuccacucaagauccauccacacaggccucaacagcuucuuccccugcccccgaggagaaugcccccagcgaaggacagagggucuggggucaaggccagaguccuaggccugagaacucacuggaaagagaagagauggggccagugcccgcccauaccgaugcauuccaggacuggggaccagguagcauggcccacgugucuguggucccuguuucgucagaaggaaccccaucuagggagccagucgcauccggcucauggacacccaaggccgaagaaccaauucaugcgacaauggauccacaacgucugggagugcucaucacuccagugcccgacgcucaggcagccacaaggcgccaggcagugggauuguuggcauuccugggccuacucuuuugccugggaguggcuauguuuacuuaccagagccugcagggguguccccgcaagauggcuggggaaauggcugaaggucuaagauacauuccccgguccugugggucuaauucuuauguuuuggugcccguuuag

SEQ ID NO: 248116 - RNA, 285 nt, Artificial Sequence
  Description of Artificial Sequence: Synthetic coding sequence
augucuguaaagggcauggcgaucgcauuggcgguaaucuugugcgcuacugucguucaaggguucccuauguucaaacggggaaggugccucuguaucggaccaggcguaaaggcugugaagguggcagauaucgagaaggcuagcaucauguacccguccaauaacugcgauaaaauugaggugauaaucacauugaaggaaaauaaaggacaaagaugcuuaaauccuaaauccaaacaggcccggcuuauaauuaagaagguugagcgcaagaauuuuuag

SEQ ID NO: 248117 - RNA, 285 nt, Artificial Sequence
  Description of Artificial Sequence: Synthetic coding sequence
augagcgugaagggaauggccaucgcccucgccgucauccugugugcuaccgugguccaaggauuucccauguuuaaaagaggacgcugccugugcaucgguccaggaguaaaagcugugaaaguggcagacaucgaaaaggcuuccauaauguacccaucaaauaauugugacaaaaucgaggucaucaucacacuuaaggaaaauaaggggcaaagaugccugaaccccaagagcaagcaagccagacucauuauuaagaagguggagagaaaaaacuucuag

SEQ ID NO: 248118 - RNA, 1431 nt, Artificial Sequence
  Description of Artificial Sequence: Synthetic coding sequence
augaccaaacuuauccugcuuacuggccucguccugauacucaauuugcaauuggguucugccuaccagcugaccuguuacuucacuaacugggcccaguauaggccgggucugggcagauucaugccugacaauauugaccccugucugugcacucaccucaucuaugcauucgccggcagacagaauaacgaaauuacgacgaucgaauggaacgacgucacucuuuaccaggcguucaauggccugaaaaacaaaaauagccaacucaaaacccuacucgccaucggcgguuggaacuucggaaccgcuccguucaccgcaaugguguccacaccugagaaccgucagacguuuauuacaaguguuaucaaauuccugcggcaauacgaauucgacggccucgauuucgauugggaguaccccggcuccagaggcucacccccacaagauaaacaccucuucacgguacuggugcaggagaugcgugaagccuuugagcaggaggcgaaacagaucaacaagccaagacugauggucacggccgccguggcugccggaaucucuaauauccagucgggcuaugaaauaccacaacuuucucaguaccuggacuauauucaugugaugacuuacgaccugcauggaaguugggaaggauauacaggugagaacaguccccucuauaaguacccuacagauaccggcucgaacgcuuaucucaauguggauuauguaaugaauuauuggaaggauaacggagcuccagccgagaaacugauugugggcuuucccacauacggacacaacuuuaucuugucaaauccaucgaacacagggaucggagccccuaccaguggcgcugggccugcgggcccuuacgccaaggaauccggaauuugggcuuacuacgagaucugcaccuuucuaaaaaacggcgcaacacagggaugggaugcuccacaagaagugccauaugccuaccagggcaaugugugggucggcuacgauaauauuaaaaguuuugauaucaaggcucaauggcuaaagcacaauaaguuuggcggagccauggugugggcaauugaccucgaugauuucaccggaaccuucugcaaccagggcaaauuuccuuuaauuucuacguugaaaaaagcacugggcuuacagagugcuagcuguaccgcucccgcacagccaauugagccaauuacagccgcaccaucuggaagcgggaaugggucuggcagcuccaguuccggcgggucguccggagggucaggguucugugcaguccgugcaaauggucuguaucccgucgcaaauaaccgcaacgccuucuggcacugcgucaacggugugaccuaccagcaaaacugccaagcuggccuaguguuugacacgaguugcgacuguuguaauugggcauag

SEQ ID NO: 248119 - RNA, 948 nt, Artificial Sequence
  Description of Artificial Sequence: Synthetic coding sequence
augagagaagccuucgagcaagaggcaaagcagauaaauaaaccacgacugauggucacagcggcuguugcugccggcauuuccaacauucagagcggcuacgagauuccacagcuaagucaauaucuggauuacauucacgugaugacauacgaucuccacggguccugggagggcuauacaggagagaacagcccgcuguacaaguaccccacugacaccgggucuaaugcauaccugaacguugauuacgucaugaauuacuggaaagacaauggugcuccugccgagaagcugauagugggauuuccaaccuacggucauaauuuuauccugagcaauccaucaaacacuggcaucggagccccaacuagcggggccgguccggcaggcccuuacgccaaggaaucaggaaucugggccuauuacgaaaucugcacuuuuuugaaaaauggcgccacacaggggugggaugcaccgcaggaagugccuuaugcauaucaaggaaacguuuggguggguuacgacaacauuaagucuuucgauauuaaagcacaaugguuaaaacacaacaaauucgggggagcuauggucugggcuauagaccuggacgacuucacaggaacuuucugcaaucaagguaaguucccccugaucagcacucucaaaaaagcacucggcuugcaaucagcaucuugcaccgcucccgcacaaccaauagaaccuaucacggccgcgcccucagggagcggcaacggguccggaucuagcucauccgguggaagcucggguggauccggauucugugcagugcgugcuaacgguuuauacccgguggcuaacaauaggaaugcguucuggcacuguguaaacggugugacguaccaacagaacugucaggccggccucguguuugauacaagcugugauugcugcaacugggccuag

SEQ ID NO: 248120 - RNA, 1431 nt, Artificial Sequence
  Description of Artificial Sequence: Synthetic coding sequence
augacuaaacugauccugcugacaggacucgugcugauauugaaccugcagcugggcucugccuaccaguuaaccugcuacuucacgaacugggcacaauacagaccgggacuagguagauuuaugcccgauaacaucgaucccugccucuguacacaucucaucuaugccuucgcuggacgacagaacaacgagauaaccacaauugaauggaacgaugucacucuuuaucaagccuuuaauggccucaagaauaagaauagucaguuaaaaacguugcuggccauuggcggauggaacuucgggacugccccuuuuacugcaauggugucuacccccgaaaacagacagacauucaucacaucggugauuaaauuucuccgccaguacgaguucgacggcuuggauuucgauugggaauacccuggcaguagaggcuccccaccucaggacaagcaccuguucaccguucugguccaggaaaugcgagaagcauucgaacaagaggcaaagcagaucaauaaaccccgguugauggugaccgcugccgucgccgcggguauuagcaacauucagucaggauaugaaaucccucagcugagucaauaccuggauuacauccaugugaugaccuacgaccugcaugguucuugggagggguacacuggagaaaacagcccgcuguacaaguacccuacggauaccgguagcaacgcuuaccugaacgucgacuaugugaugaauuauuggaaagacaauggagccccggccgagaaacugaucguagguuuuccuacauacggccacaacuucaucuuaucuaacccaaguaacaccgguaucggagccccaacgucuggugcugggccagccggaccuuaugccaaagagaguggaaucugggcguacuacgaaauauguacauuucugaagaauggggccacucagggcugggacgccccgcaggaggugccguacgcguaccaggguaacgucugggucggguacgacaacaucaaaucuuuugauaucaaggcucaguggcugaagcacaacaaauuugguggagcuaugguuugggcaaucgaucucgaugauuucacuggcaccuucuguaaucagggaaaauucccuuuaaucagcacccugaaaaaagcucuuggccuccaaucugcuucuugcacugcgcccgcgcagccgaucgagccgaucacagccgccccaagugguuccggcaauggcuccggauccaguaguaguggaggauccucaggcgggagcggauuuugugccguccgcgcgaauggacucuacccuguggccaacaaucggaacgcuuuuuggcacuguguuaacgggguuacuuaucaacagaacugccaggccggauugguuuucgacacauccugugacugcuguaauugggccuag

SEQ ID NO: 248121 - RNA, 1263 nt, Artificial Sequence
  Description of Artificial Sequence: Synthetic coding sequence
gaaacuucuucaagcgugcacgaacagguugcagauucaggggcccaggcgguagcuuuccagagugguggcgaauccucaaucguuuggaacucucagcugaaaacucugcuugcuauuggcggauggaauuucggcacagcuccauucaccgcuaugguguccacccccgaaaaccgacagaccuuuauuaccagugugauuaaauuccugcgacaauaugaguucgacgguuuagauuuugauugggaguaucccggaagucgcggcucaccuccucaggacaagcaccucuucacaguccucgugcaggagaugagggaggccuuugagcaggaggccaaacaaaucaauaaaccuagauugauggucacggcugcuguugccgcugggauuucuaacauucaauccgguuaugaaauuccccaacuuagccaguaccuggauuauauacacguaaugacauaugaucuacauggaucgugggagggguacacaggugaaaauaguccgcuguauaaguaucccaccgauacuggcucuaacgcuuacuugaacguagacuauguuaugaauuacuggaaggacaauggcgcucccgccgagaagcucaucgucggauucccaaccuauggacacaacuuuauacugucgaacccauccaauaccgggaucggagcaccgacaucaggcgccggacccgcgggcccauaugccaaagaguccggcauaugggcuuacuacgaaauuugcaccuuuuugaaaaauggagccacacagggcugggaugccccacaggagguuccguaugccuaccaaggaaacgucuggguuggauaugacaauaucaaauccuucgauauaaaggcacaguggcuuaagcauaauaaguuuggaggggcuauggucugggcaauagaccuggaugacuucacaggaacauucugcaaccaggguaaguuuccucucaucucaacgcugaagaaggcccugggacuccagucugcauccugcacugcgccagcccagccuauagaaccuauuacggccgccccaagcggcagcggaaaugguaguggaucuucaucuuccgguggcuccuccggcgggucgggguucugugcugugagagcaaauggauuauaucccguggccaacaaccgcaaugcauucuggcacugugucaauggugugaccuaccaacagaacugccaggcugggcuugucuuugacaccuccugcgacuguugcaauugggcguag

SEQ ID NO: 248122 - RNA, 1107 nt, Artificial Sequence
  Description of Artificial Sequence: Synthetic coding sequence
auggugucaaccccugagaaccgccagacauucauuaccagugugauuaaguuucugagacaguacgaauuugauggccucgacuucgacugggaguacccgggaucgcgaggcagcccaccgcaggauaaacaucuuuuuacagugcugguccaggaaaugcgcgaggcauucgaacaggaggcgaagcagaucaauaagccucgccugauggugaccgccgccguugcagcagguaucagcaauauucaaagcgguuaugaaauuccucagcugucgcaguaucucgacuauauccaugugaugaccuaugacuugcacggaaguugggagggcuacaccggggaaaacucuccacuguauaaguauccaaccgacacagggucuaaugcguaccucaacgucgauuaugucaugaauuauuggaaggacaauggagccccagcugagaaguugauugucgguuuucccacauauggacacaauuuuauccucaguaacccaagcaauacggguaucggcgcaccgacgucuggcgcuggaccagccgggcccuacgcaaaagaaagugguaucugggcauauuacgaaaucugcacauuccuuaaaaauggcgccacccaggguugggaugcaccucaggaggucccuuaugcuuaucagggcaacgucuggguggguuacgauaauaucaagagcuuugacauuaaggcacaguggcucaagcauaacaaguuuggcggggcgaugguuugggcaaucgacuuggaugauuuuacugguacuuucuguaaucagggaaaguucccccucauuuccacacucaagaaggcuuuaggccugcagucagccucaugcaccgcuccugcucaaccuauagaaccaauuacagcggcccccuccggaucagguaauggaagcgggucaucguccaguggcgggucaucaggcgguaguggguuuugugccguccgagcuaacggccuuuacccaguggcuaacaaccgaaacgcuuuuuggcacugugugaauggugucacuuaccagcagaacugccaagcaggacuuguuuuugauacaucaugugacugcuguaauugggccuag

SEQ ID NO: 248123 - RNA, 948 nt, Artificial Sequence
  Description of Artificial Sequence: Synthetic coding sequence
augcgagaggcauucgaacaagaggcaaagcagauuaacaaaccacggcugaugguuacagcagcaguggcagcaggcaucucuaacauccaguccggauaugagauuccccaacugagccaauaucuugacuacauacaugugaugacuuaugaccuccacggauccugggagggcuacacuggagaaaauagcccacuguacaaguauccuaccgacacaggcucaaacgccuaucuuaauguggauuacgucaugaauuacuggaaagacaacggagcuccagcagagaaacuaauagucggauucccuacguacggacauaacuucauacugucaaacccauccaauacaggaauuggcgcccccaccagcggggcaggcccagcaggaccuuacgcgaaggaauccggaaucugggcauacuacgagaucugcacauuucucaagaauggagccacacagggcugggacgccccacaagaggucccuuacgccuaccagggaaauguuugggucggcuacgacaacauuaagagcuuugauauuaaagcccaaugguugaaacauaauaaguuuggcggcgccauggucugggcgaucgauuuagaugauuuuacaggcacuuuuuguaaccagggcaaauucccccucaucuccacucucaagaaagcacugggacuacaaucggcuucaugcacugcuccagcccagccuauugaacccaucacggcugccccguccggcuccggaaacgggaguggcuccucuucauccggggggaguagcggaggaagcggauucugcgcuguaagggccaauggcuuguacccgguugcgaacaauaggaaugccuuuuggcacugcgugaacggcguaacuuaucagcaaaauugucaggccggacuggucuucgacacuucuugcgacuguuguaacugggcauag

SEQ ID NO: 248124 - RNA, 948 nt, Artificial Sequence
  Description of Artificial Sequence: Synthetic coding sequence
augagagaggcauucgaacaagaagcuaagcagaucaauaaaccaaggcugauggucacugcagccgucgcagcgggcaucuccaacauucagucuggguaugaaaucccccaauugucucaguaccuugacuauauccacgugaugacauaugaccugcaugguucuugggaaggauauaccggugagaacagcccucuguacaaguauccaacagacacagggucuaacgcauauuuaaacguggauuaugugaugaauuauuggaaggacaacggugcucccgcugagaagcuuaucguugguuucccuacauacggucauaacuucauucuguccaaucccucuaauacgggaauuggagcacccacaucaggcgcagggccagcuggucccuacgcuaaagaaagugguaucugggccuauuacgagauuugcacuuuccuaaaaaauggcgcaacacagggcugggacgcuccucaggaaguacccuaugccuaccaagggaaugugugggucgguuacgacaacauaaagaguuuugacaucaaggcgcaauggcuuaaacacaacaaauuugguggggcuauggugugggcaauugaccuugacgacuuuaccggcaccuuuugcaaucagggaaaguuuccgcuaauauccacccucaagaaagcccucggucugcagucugccucaugcacugcacccgcccagccuauugagccuauuacagcagcacccuccggauccgggaaugguaguggcucuucaagcucuggagggucaucuggugggucggguuuuugcgcugugagagcaaacggccucuacccugucgcuaauaaucggaacgccuuuuggcacugcgugaauggcguaacuuaucagcagaacugucaggcgggacucgucuuugacaccucuugugacugcugcaacugggcuuag

SEQ ID NO: 248125 - RNA, 864 nt, Artificial Sequence
  Description of Artificial Sequence: Synthetic coding sequence
augagagaggccuucgagcaagaggcuaagcaaauuaauaaaccaagacugaugguaacggcagcaguggcagccggcauuagcaacauucagagcggguacgaaauuccacaguuaucccaguauuuggacuacauucacguaaugaccuaugaccuccacggcagcugggagggcuauaccggggaaaauucuccccuauacaaguaucccacugacacaggguccaaugccuaccugaaugucgauuaugucaugaacuacuggaaggacaacggggccccggcggagaaacuaauuguaggauuccccacguacggacacaacuucauccucucuaauccaagcaacaccgguauuggcgcccccaccucuggggccggaccagcaggccccuacgcaaaggaauccgggauuugggcauauuacgagaucuguacuuuuuuaaaaaacggggccacccagggaugggaugccccucaggagguccccuaugcuuaucagggaaacguuuggguagguuaugauaauauaaagucguucgacaucaaagcccaauggcuaaagcacaauaaguuugggggggcgauggugugggcgaucgaccuugacgauuuuacaggcaccuucuguaaccaaggaaaauucccccugauaucaacucugaaaaaggcucugggcuuacagucagcuagcugcaccgcccccgcacaaccaaucgaacccaucacugccgcuccaagugguucggguaauggaaguggcaguucaucuucuggaggaucgucugguggcaguggcuucugcgccguuagagccaaugggcucuacccugucgcgaauaaccgcaacgcuuuuugguag

SEQ ID NO: 248126 - RNA, 2319 nt, Artificial Sequence
  Description of Artificial Sequence: Synthetic coding sequence
augaggcuguccucacugcuggcccuauuacgcccugcacugccgcucauucucgggcuuucuuuaggcuguucauuaucucuucucagaguuuccuggauacagggggagggcgaagacccgugcguggaagcaguuggagagcguggcgggccccaaaacccugauagccgggcuagacuugaccagucagaugaggacuuuaaaccccggaucguccccuacuaucgggauccaaauaagcccuacaagaaggugcugcggacuagauacauacagacugagcucgggagccgugagagacuucuuguggcaguccugacaaguagggcaacgcucucuacccuagcaguggcagugaaccgaacagucgcucaccacuucccucgccugcuuuacuuuacgggacagcggggggccagagcaccagcugguaugcaggucgugucucacggggacgaaaggcccgcauggcucaugucagaaacacucagacaucuacacacccacuuuggggcugacuacgacugguuuuuuauuaugcaggacgacaccuaugugcaggcaccacgucuugcugcauuggcugggcaccugagcaucaaucaggaucuguaccugggccgcgcagaagaguucauuggagcaggcgagcaggcccgcuacugucacggaggauuugguuaucuucugagucggucucuucuuuuacgccuccgcccacaucucgauggcugccggggagauauccugagugccaggccggaugaguggcucggaagaugcuugauagauucucuggguguggguugcgugucacaacaccaagggcaacaguauagaucauucgaauuggccaaaaaucgggaccccgaaaaagaagguuccuccgcuuuccuaucugccuucgccguccaucccgucucagaagguacacugauguaccgucugcacaaacgguuuucugcacuggagcuggaacgcgccuacucugagauagaacaacuccaggcgcagauucgcaaccuuaccguguuaacgccagaaggcgaggccggacucaguuggcccguggggcugccggccccuuuuacgccccacucaagauucgagguuuuaggcugggauuacuuuacggagcagcauacauucaguugugcugacggggcucccaaaugcccacuccagggcgccucccgagcugaugugggcgaugcccuagaaacagcacuagaacagcucaaucggcgauaucaaccacgacugagauuucagaagcagcgacugcugaacgguuacagacguuucgacccugcuaggggcauggaguauaccuuggauuuguugcuggaaugugugacgcagcgcgggcaucgcagggcccuugcaaggcgcgucagucuucuuagaccuuugaguagaguggagaucuuaccaaugccuuacguaacagaggcaacaagggugcagcucgugcucccucuccugguggcugaggcugcagcugcaccugcuuuccucgaggccuucgcugcuaauguccuagagccuagagagcacgcacuucucacacuccuucugguguauggcccuagggaagggggacguggcgcaccagacccuuuccugggcgucaaggccgcugccgcugaacuugagcgcagauacccugguacccgacuugcguggcuagccguacgagcagaagccccgagccaggucaggcuuauggacgugguguccaagaaacauccugucgacacacucuucuuccugacaaccgucuggacccggccuggcccugaagugcugaacaggugcaggaugaaugcaaucaguggcuggcaggcauucuuuccaguacauuuccaagaauucaacccugcacuuucuccucagagguccccaccuggcccaccuggagcugggcccgacccaccaagucccccuggcgcagauccuucucguggagcccccauagguggacgcuuugacagacaggcaucugcggagggcugcuuuuacaaugccgauuaucuggcugcucgagcaagguuggccggagagcuggcuggacaagaggaggaggaagcucuagaaggauuagaggugauggaugucuuuuugcgcuucuccggacuccaccucuuucgcgcagucgagccggggcuaguccaaaaauuuucgcugcgugacugcucuccacgccucucugaggaauuguaucacagaugccgccuguccaaucuggaggggcucgggggucgcgcucaguuagcuauggcguuauucgaacaggagcaggccaacagcacauag

SEQ ID NO: 248127 - RNA, 654 nt, Artificial Sequence
  Description of Artificial Sequence: Synthetic coding sequence
auggcaccaggcucaaggaccucccucuugcucgcauucgcacuauuaugucugccauggcugcaggaggcaggagccgugcaaaccgucccauuguccagacuauucgaccaugccaugcugcaggcccaucgagcccaccaguuagccauugauacuuaccaagaguuugaggagacuuauauccccaaagaccagaaauacucuuucuuacacgacucccaaacuagcuuuugcuuuagcgacuccauuccaaccccauccaauauggaggagacacagcaaaagaguaaucuugaacuccugcgaauuucccugcugcugauugaaagcuggcucgagccagugcgcuuuuuacgcucuauguucgccaacaaccucguguaugauacuagcgacuccgacgauuaccaucuccucaaggaucuagaagagggcauucagacccugaugggacggcuggaggauggaagcagacggacaggacagauucuuaaacaaaccuacaguaaguuugacacaaacucccacaaccacgaugccuuacuuaagaacuauggucuccuuuauuguuuucgaaaagauauggacaagguggaaacauuucugagaauggugcaaugccguucuguugaagggucaugcggguucuag

SEQ ID NO: 248128 - RNA, 771 nt, Artificial Sequence
  Description of Artificial Sequence: Synthetic coding sequence
auggcuccuggcaguaggaccucucuucuucucgcauuugcucucuugugucuuccuuggcuucaagaagccggugccgugcagaccgugccucugagccgccuguucgaccaugccaugcuccaggcccaccgugcccaucagcuggcuauugauacguaucaggaauuugaagaaaccuacaucccuaaggaccagaaguacuccuuccuccaugacucccagacguccuuuugcuucagcgacagcaucccuaccccuucuaauauggaagagacccagcagaaaaguaacuuagaacuucuccggaucucucugcugcugaucgaguccuggcuagagccagugcgguuuuuacgcaguauguuugccaacaacuuggucuacgacaccucugacuccgaugauuaucacuuacugaaagaucuggaagagggcauucaaacccucauggggguccgagucgcaccaggcgucaccaauccuggcacuccacuggcuucaagggcgggcggagagaaauauuguuguccccuguuuagcucgaaagcuuugacacaagagaacucacccuacucuaguuuuagacucguuaauccccccgggcugucccuccacccugaaggugaggggggcaaguggaucaaugaaagaggccgggaacagugcccaagugcguggccccugcuacuguuccuucauuuugccgaagcgggucggaggcagccaccugauugggcugacccacaagcagauuugcagcaaguguag

SEQ ID NO: 248129 - RNA, 369 nt, Artificial Sequence
  Description of Artificial Sequence: Synthetic coding sequence
auggcacccggcaguagaacuagccuccugcucgccuuugccuugcugugucuccccugguugcaggaagcuggcgccguacagacaguuccguugucacgucuauucgaucacgcaaugcuccaagcacaucgggcucaccaacuggcgauugacaccuaucaggaauuccgccuugaagacggcagcaggcgcacuggacagauacuuaaacagacuuauucaaaauucgacaccaauucucauaaucacgacgcucugcugaagaauuauggacuccuguauugcuuuagaaaggauauggauaaaguggagacauuucucagaaugguucagugcagaagcguggagggcagcugcggauucuag

SEQ ID NO: 248130 - RNA, 552 nt, Artificial Sequence
  Description of Artificial Sequence: Synthetic coding sequence
auggcccccgguucacgcaccucccuuuugcuggcuuucgcucugcucugucugcccuggcugcaggaggccgagaccuauauccccaaagaccagaaguauucauucuuacacgacucacagacaucuuucuguuucucagauucuauccccaccccaucuaacauggaagagacucagcagaaauccaacuuagaacuccuucgaaucucuuuacugcuaauagaaaguugguuggagccugugcgguuccugagguccauguuugccaacaacuuaguguacgacacuucagacagugaugacuaucaccuucucaaagaucuggaggaggguauccagacgcuuaugggccggcuugaggaugguucacggcguacaggacagauucuaaagcaaacauauuccaaauuugauacuaacucacacaaccaugaugcccugcugaaaaacuacgggcugcuuuacuguuuuagaaaagauauggauaagguggagacauuuuuaaggauggugcaguguagguccguggagggcucuugcggauucuag

SEQ ID NO: 248131 - RNA, 504 nt, Artificial Sequence
  Description of Artificial Sequence: Synthetic coding sequence
auggcagcuggaaguagaacauccuuacucuuggcuuuugcccuauuaugucucccuuggcuacaagaagcaggagccgugcaaaccgucccucugagucgccuuuuugaucaugccaugcuucaagcgcaucgcgcucaccagcucgccauugacacauaucaggaauucgaggaaacuuauauccccaaagaucagaaauacuccuuucuucacgacucccaaacguccuuuugcuuuagugacuccauccccacccccuccaauauggaagagacccagcagaagucgaaucuggaacuccuucgcaucaguuuacuuuugaucgaaagcuggcuggagcccguccgcuucuuaagaucaauguuugcuaauaaccugguauacgauacuagcgauucagaugacuaucaucuccugaaggaccuggaggagggcauccagacacugauggggguuagaguggcucccgggguggcgaaucccggaacuccacuagcauag

SEQ ID NO: 248132 - RNA, 369 nt, Artificial Sequence
  Description of Artificial Sequence: Synthetic coding sequence
auggcugcaggcucacgaacaucacuccuguuagccuuugcgcuucuaugcuuaccaugguugcaagaagccggagcugugcaaacagucccccuguccagauuguucgaccacgcuaugcugcaggcacacagggcacaucagcuggcuaucgacaccuaucaagaauuccgguuagaggacgggucuagaagaacagggcaaauccugaagcagacuuacucuaaauuugacacgaacucccauaaccacgacgcacuccugaagaauuauggucucuuguauugcuuuagaaaagacauggacaaagucgagacuuuuuugcgcaugguacagugucggucaguagagggauccugcggauucuag

SEQ ID NO: 248133 - RNA, 654 nt, Artificial Sequence
  Description of Artificial Sequence: Synthetic coding sequence
auggcugcgggcucaagaacaucacugcuguuggccuuugcacugcuaugucuuccauggcuucaggaggcuggagcuguccagaccgucccacuuucccggcuguuugaucacgccauguugcaggcucaucgcgcccaucagcuugccaucgacaccuaccaggaguuugaagagacuuacaucccaaaagaucagaaauacagcuuccuucaugauucucagaccucauucuguuucagcgauucuaucccuacgcccagcaacauggaagagacccagcaaaagaguaaccuggaacuccuaaggauaucacuccugcucauugagucauggcucgagccggucagguuucugaggagcauguuugccaacaaccugguuuaugauacuuccgauucagacgacuaucaucucuugaaggaccuugaagagggaauccaaacacugaugggacgccuugaggacgggagcaggcgcaccggccagauucucaaacagacguacuccaaguucgacacaaacagccacaaucacgaugcgcugcucaaaaauuacggccucuuguacugcuuuagaaaagauauggacaaggucgaaaccuuucugcggauggugcaaugucgcucgguugaaggcucguguggauucuag

SEQ ID NO: 248134 - RNA, 483 nt, Artificial Sequence
  Description of Artificial Sequence: Synthetic coding sequence
auggcggcuggaagucgcacuucucuccucuuagcauucgcgcugcugugucucccuuggcugcaagaagcagacucuauuccaacccccagcaacauggaggagacccaacagaagucgaacuuagaacugcugcggaucucucuguugcucaucgagucauggcuggagcccguucguuuuuuacgauccauguuugcgaacaaucuggucuacgacacuagcgacucugaugauuaccacuuauugaaggaccuagaagaagguauccagacccugaugggcagacuugaagacggcucgcgaaggacaggacagauuuuaaaacagaccuauuccaaguucgacacgaacucccacaaccacgacgcccugcugaaaaacuauggacugcuguauugcuuccgcaaagacauggauaaagucgagaccuuccucaggauggugcagugccggucaguggaaggguccugugguuuuuag

SEQ ID NO: 248135 - RNA, 498 nt, Artificial Sequence
  Description of Artificial Sequence: Synthetic coding sequence
ugagggagccgaaccuccuuacugcuggccuuugcccuuuugugucucccguggcugcaggaagcuggggccguacaaaccgugccuuugagccgucuguucgaucaugccaugcuucaggcucaucgggcccaucaacuagccauagauaccuaccaggaauuugaagaaaccuauaucccaaaggaucagaaauacaguuuucuccaugauucccaaacgucauuuuguuucuccgacuccauucccacaccaaguaauauggaagaaacccagcaaaagucaaaccuggaauuacugaggauuucccuccuacucaucgaauccuggcuggaaccagugagguuuuugagaucaauguucgcgaauaaucuggucuacgacacgucagauucggacgacuaccaucugcucaaggaucucgaggaaggcauccagacgcuuaugggggugcgcguagccccuggggucgccaauccugguacuccacucgccuag

SEQ ID NO: 248136 - RNA, 786 nt, Artificial Sequence
  Description of Artificial Sequence: Synthetic coding sequence
augguaguuguggccgccgcccccaaccccgccgauggaacgccaaagguucuguugcugucaggccaaccagcaucagccgccggcgcucccgccggacaggcccucccccucaugguucccgcccaaaggggugccucuccugaagcggccucaggcggacugccccaggcaagaaagcggcaaaggcugacccaucucuccccagaggagaaagcucuuagacgcaaauugaaaaaccguguugcagcucaaacagcuagggaucggaaaaaggcaagaaugucugaauuagaacagcaagucguggaucuggaggaagaaaaccaaaagcuccuccuggagaaccaacugcugcgcgagaagacucaugggcugguaguggaaaaccaagaguugagacaaagguuaggaauggaugccuuaguagcagaagaggaagccgaggcuaaaggaaaugagguucgccccguugcaggcucagcugaaucagcagcauugcgcuugcgcgcaccauugcagcagguccaggcacagcugucuccgcuccaaaacauaagccccuggauccucgccguuuugacucugcagauccaaucguugaucagcugcugggcauuuuggaccaccuggacccaguccuguuccucaaaugcucuuccucagucacugccugcuuggcgcucuagccagagguccacgcagaaggaccccgucccauaucagcccccuuuccucugucagugggggcgacaccagccaagcuggaaaccccuuaugaauuag

SEQ ID NO: 248137 - RNA, 2853 nt, Artificial Sequence
  Description of Artificial Sequence: Synthetic coding sequence
augacuuggcguauggguccgagguuuacaaugcucuuggcuauguggcuggugugugguucagagccccacccacacgcuacaauuaggggcucccaugggggacgcaaggugccucucgugagcccagacucauccaggcccgcccgcuuccuacggcauacaggccgcuccaggggaauugagcgcucgaccuuagaggaaccgaaccuccagccacugcagcggaggaggaguguaccagugcugagacuggccagaccaaccgagccacccgcucgcuccgacaucaacggugccgcaguucggccugaacagaggcccgcugcucgcggcaguccgagagagaugauucgagacgaagggaguagcgcccgaagucggaugcuuagguuuccaucugggucaaguagccccaauaucuuggcgucuuucgcaggcaagaaccgggugugggugauuagcgcaccacacgcuuccgagggcuacuacagauugaugaugagcuugcugaaagacgauguuuacugcgaacuugcugaaagacauauccagcagauagugcuguuccaccaagcuggcgaggaaggaggaaaggugaggaggauuacgagcgagggccaaauucuugaacaaccgcuggauccuucucugaucccuaaauugaugucguuuuuaaagcuggagaaaggaaaauuuggcaugguguugcucaagaagacccugcagguugaggaaagauaucccuacccuguccgccuugaggcgauguaugaggugauugaucaggggccaauucggcgaauugaaaagauacgccaaaaaggauucgugcaaaaguguaaggccuccggggucgagggccagguaguugccgaagggaaugaugggggcggcggggccggacgcccaucccuaggauccgagaaaaagaaggaagaccccagaagggcacaggugcccccgacaagagagagcagaguuaaggugcugaggaagcuugcggcuacugccccugccuugccucaacccccuucgacaccccgcgccacgacccuaccaccggcccccgcuaccacuguuaccaggucuaccuccagggcugucacaguugccgcucgcccaaugacgacaaccgcguucccaacaacccaaaggcccuggacuccaucuccgagccacaggccuccgacaacaacagagguuaucacugccaggcggcccucaguaagcgagaacuuauauccccccagccgcaaggaccagcaccgcgagcguccgcaaacuaccagaaggccuaguaaggcuaccagucuugaaaguuuuacuaaugcuccccccacuacaauaucugagccuucgacgcgggcggcagggccuggcagguuccgggacaacagaauggaccgcagggaacaugggcaccgagaucccaauguggucccaggcccccccaagcccgcaaaggaaaagccacccaagaagaaagcgcaggacaagauuuuaucuaaugaguaugaagaaaaguaugaccugagccguccuacugccucucagcuggaagaugaacugcaggugggcaacgucccgcucaagaaggcaaaagaguccaaaaagcacgaaaagcuggagaaacccgagaaagagaagaagaagaaaaugaagaacgagaacgcagauaaauuacuaaagagcgagaaacagaugaagaaaagcgaaaagaaaaguaagcaggagaaggaaaaaucaaagaagaagaaagggggaaaaacugaacaggauggcuaccaaaaaccaacuaauaaacauuuuacucaguccccaaagaaguccguugcugaccuacucgguucauuugaaggcaaaaggagacugcuguugauaaccgccccaaaagcggagaauaacauguauguucagcagagggaugaguaccuugagaguuuuuguaagauggccaccaggaaaauuagcgucaucacgauauuuggcccugugaauaacucaacgaugaagauagaccacuuucaacucgacaacgaaaagccaaugaggguugucgaugaugaagacuuagucgaucagagacuuauaucugaacuucggaaggaauacggaaugacuuacaacgauuuuuuuauggugcuaacagauguggaucucagggucaaacaguauuacgaagugcccauaaccaugaaaucuguuuucgaucucaucgauacguuccagagccggaucaaggauauggagaagcaaaagaaggagggaaucguguguaaggaggauaagaaacagagccuggaaaacuuccugagucguuucagguggcggcgccgucugcuugucauuagcgcccccaacgacgaagauugggcauacagccaacaguuguccgcccugucgggucaggcaugcaauuucggccuucgccacauuacaauucuuaagcugcuaggcgugggagaagaggugggcggggugcuggaacuauucccaaucaacggguccagugugguugagagggaagacgugccugcccaucuugucaaagauauccgcaauuauuuccaaguaagcccggaauacuucucuaugcuacucgucgggaaagauggaaacgugaaaucuugguauccuagcccaauguggucgaugguuauuguguacgauuuaaucgauucaaugcagcugcgccggcaggaaauggccauacaacaaucgcuugggaugcggugcccagaagacgaguacgccggguacggcuaccauucauaccaccaaggcuaccaagacggguaucaggaugacuaucgccaucacgagagcuaccaccauggauauccuuacuag

SEQ ID NO: 248138 - RNA, 624 nt, Artificial Sequence
  Description of Artificial Sequence: Synthetic coding sequence
augguggcgaccugccuccaggucgugggguuugugacaaguuuuguugguuggauaggugugauuguuacaacaucaacaaacgauuggguagucacaugcggguacacgauccccacuuguagaaaacuugacgaacuggggucaaagggccucugggccgacugcgugauggcuacuggccucuaucauugcaaaccucuaguggauauccugauucuccccgguuauguucaggccuguagagcccucaugauagcugccaguguccugggcuuaccagcaauccuccuguuacuuacuguguuaccaugcauuagaaugggucaggagcccggcguggcuaaguaccgcagagcccagcucgcuggggugcuccuuauucuacuugcucugugugcccuugucgcaaccaucugguucccgguaugugcucauagagagacaacaauaguuaguuuuggauauagccuuuacgcuggguggaucggcgcgguacuuugucucgucggcggcuguguuauccuguguugcgccggugaugcacaggccuuuggagaaaaccgguuuuauuacaccgccggaucaucgucacccacccacgcuaaaagugcacacgucuag

SEQ ID NO: 248139 - RNA, 1350 nt, Artificial Sequence
  Description of Artificial Sequence: Synthetic coding sequence
augaugaaaaccuugcuccuguucguaggucugcuucuaacuugggaauccggccaaguguuaggagaucaaacugugucugacaacgaguugcaggaaaugucaaaucagggauccaaguacguuaauaaggagauccagaacgcuguaaauggcgugaagcagaucaagacacugauugaaaagaccaaugaagaaaggaagacccugcucucuaaucucgaggaggcgaagaagaaaaaagaggacgcucugaaugaaacaagggagucagaaaccaaacugaaggaguuaccagggguuugcaaugaaacuaugauggcccugugggaagaauguaagccgugucuaaaacagacgugcaugaaguuuuaugcccggguuugcaggucaggauccgggcuugucggcagacagcuggaggaguuccuuaaucaaagcagucccuuuuauuucuggaugaauggugacagaauugacagccugcuggaaaacgauaggcaacagacccacaugcuugaugugaugcaagaccacuuuagccgggcaaguagcauaauugaugagcuguuucaggauagauuuuuuacccgagagccacaggacacauaccacuaucuaccuuucucacucccacauagacggccucauuuuuuuuucccuaaaaguagaaucguacggagccuuaugcccuucucuccauacgaaccccucaauuuccacgcuauguuccagccauuucuggaaaugauucaugaggcgcagcaggccauggauauacacuuucauucccccgcuuuucaacauccacccaccgaguucauaagagagggcgaugacgaucgaaccgugugccgagagauccgacauaauagcacagguugccugcggaugaaagaccagugugacaaguguagagagauacuuuccguagacuguucuaccaacaacccaucgcaggcuaaacucagaagggagcucgaugaaagucuccagguggccgagcguuugaccagaaaauacaaugaacuucucaagaguuaccaguggaaaaugcuuaauacauccucucugcuggagcagcugaacgagcaguucaauuggguuuccagacuggcuaacuugacacaaggugaggaccaauauuaccuuagggucacaaccgucgcaagccacaccucugacuccgacgugccaucuggggugacagaaguggugguuaagcucuuugauucugacccuauuacuguaacugugccaguugaggucagcaggaagaacccaaaguuuauggaaacuguugccgaaaaggccuuacaagaguaucggaagaagcacagggaggaauag

SEQ ID NO: 248140 - RNA, 825 nt, Artificial Sequence
  Description of Artificial Sequence: Synthetic coding sequence
augcaagaccacuuuucgagggcgagcagcaucauugacgaguuauuucaagaucgcuuuuucacucgagagccucaggacacauaccacuaccuuccuuucucacucccacaucggcgcccccauuuuuucuuuccuaaaaguaggauuguccgaucauuaaugcccuucucuccauacgagccccuuaacuuucacgcaauguuccagccuuuuuuagaaaugauccaugaggcccagcaagcaauggacauucacuuccacucacccgcuuuccagcacccucccaccgaguucauccgcgagggggaugacgauaggacggucuguagagaaauucgacauaacucaacaggcugucuuagaaugaaggaccagugugauaagugcagagagauccugucagucgauuguucuacuaacaacccuucccaagcaaagcuacgacgcgagcuagaugaaucacugcagguggcugagagacugacaagaaaguauaaugagcuucuuaaaagcuaccaauggaagaugcugaauacaagcucacuacucgaacaacuuaaugagcaguuuaauugggugagccggcuggcuaaccugacccaaggcgaggaccaguauuaucuccgcgugacaacaguugcuagccacacaucagacuccgacgucccuucaggcgucacugaaguugugguaaaacuauuugacucugaccccaucacggucacaguucccguggaagugucuaggaaaaacccuaaauuuauggaaacgguggcugaaaaggcgcuacaggaauaccgcaaaaaacaccgcgaggaauag

SEQ ID NO: 248141 - RNA, 1350 nt, Artificial Sequence
  Description of Artificial Sequence: Synthetic coding sequence
augaugaaaacacuacuucuguucgugggcuuauuguuaaccugggagagcggucaggucuugggcgaucagacugugagcgacaaugaguuacaagaaaugagcaaccaaggcucaaaguaugucaauaaggagauacagaacgccguuaaugguguaaagcagauuaaaacccuuaucgaaaaaacuaaugaagaaagaaagacauugcuaucaaaucuggaggaagcaaagaagaaaaaggaagacgccuuaaacgaaacacgugaaagugaaacuaaacuaaaagaauuaccaggaguuugcaaugaaaccaugauggcucugugggaggaaugcaaaccuugucuuaaacaaacaugcaugaaauucuaugcccgagugugucggucgggaucaggguugguugggcgccagcucgaggaguuccuaaaucaaucuucuccuuuuuacuuuuggaugaacggagauaggaucgauagccuucucgaaaaugauaggcaacagacgcacauguuggacgugaugcaagaccacuucagccgggcaagcuccauuauagaugagcuguuucaggacagguucuucacuagagaaccucaggauaccuaccauuaucugccguuuucucugccucaccgucggccucacuucuuuuucccaaaguccaggaucguuagaucucuuaugccguuuagccccuacgaaccacucaacuuucaugccauguuucagccauuucucgaaaugauccacgaggcacagcaagcgauggacauccauuuucauagucccgcuuuucaacacccaccuaccgaguuuauucgcgagggcgacgacgauagaacagugugucgagagauucggcauaauucaacaggcugccuucgcaugaaggaucagugcgacaaaugcagggaaauacugaguguggauugcagcacgaacaaccccagccaggcaaagcuacgaagagaacuggacgaaucacugcagguggcggagagguugacccgaaaauauaacgagcugcucaagucauaccaauggaaaaugcuuaauacaagcucacuguuggaacagcugaacgaacaauucaauugggugucgagacuggcgaaucuuacccagggagaggaucaguauuauuugcgggugacaaccguugcuucccauacuagcgauagcgacguuccuuccggaguuacugaggugguggugaaacuguuugacuccgacccuauaacugucaccgugccugucgaagugagcagaaagaacccaaaauucauggaaaccguagccgaaaaagcccuucaggaguauagaaaaaagcauagggaggaguag

SEQ ID NO: 248142 - RNA, 615 nt, Artificial Sequence
  Description of Artificial Sequence: Synthetic coding sequence
augaugaaaacucuacuccuguuugugggacugcugcuaacuugggaaucuggacaggugcucggugaccagaccgugagcgacaaugagcuucaggaaaugagcaaucaggggagcaaguacguuaacaaggaaauucaaaacgcagugaacggagugaaacaaauuaagacauugaucgagaagacaaacgaagagaggaagacgcuucugaguaaucuggaggaggccaaaaagaagaaggaagacgcacugaaugagacucgggaauccgagacaaaguuaaaggagcugccuggcguauguaaugaaaccaugauggccuuaugggaggagugcaaacccugcuugaagcagacaugcaugaaguucuacgcucgggugugucgaucaggcuccggacucgucggccgccagcucgaagaguuucuuaaccagucaucuccauuuuauuucuggaugaacggcgaccggauugacucccuccuugaaaaugaccggcagcagacacauauguuggauguuaugcaggaccauuucucccgugccucuuccauuaucgacgaacuguuccaagaucgcuucuuuacccgggaaccacaggacacauacuag

SEQ ID NO: 248143 - RNA, 1350 nt, Artificial Sequence
  Description of Artificial Sequence: Synthetic coding sequence
augaugaagacucuucuucuuuucguuggccuccuccugaccugggaauccggccagguucucggggaccaaacuguuuccgacaacgagcuccaggaaaugagcaaccaagggucuaaauauguuaacaaagaaauucagaaugcuguaaacggggucaagcagaucaagacauugauugagaaaaccaacgaagaacgcaaaacacucuuauccaauuuagaagaggcuaaaaagaaaaaagaggaugcacugaacgaaacuagggaaucggaaacaaagcucaaggaauuaccaggcgucuguaaugagacaaugauggcacucugggaagaguguaagcccugccucaagcagacauguaugaaauuuuacgcuagggucugccgcucugggagcggacuaguggguagacagcuggaggaauuccuuaaccagucaucgcccuuuuauuucuggaugaauggcgauaggaucgauagucugcuugaaaaugaucgccagcaaacacacauguuggacguaaugcaggaccauuucucccgugccucaagcaucaucgacgaacucuuccaggaccgcuuuuuuacgagagaaccacaagacacuuaccauuaccugcccuucagccuuccccaccgacguccccauuucuucuucccgaagucucggauuguaagaucucugaugccuuucuccccauaugagccacuuaauuuucaugccauguuucagccuuuccuggagaugauccaugaggcccagcaagcgauggauauccacuuucauucuccugccuuccagcauccaccgaccgaguuuauuagagagggcgaugacgacagaacagucuguagggaaauucgacauaauucuaccggcugccugcgcaugaaagaucagugugacaagugccgugaaaucuugucaguugauuguagcacaaacaacccuucacaagccaagcugcgacgcgagcucgacgaaagccuccagguggccgaacggcucacucgcaaauacaaugaacucuugaagucauaccaguggaagauguuaaacacuuccagccugcucgaacagcuuaacgaacaguuuaauugggugucccgucuggcuaaucuuacacagggggaggaucaguauuaccugcgagugaccacgguggccucccacacaucugauagugacguccccagcggggugacugaggugguggugaaacucuuugauucugauccuaucacagucacagucccaguggagguuaguagaaaaaacccgaaguucauggagaccguggcugaaaaggcccuccaggaguacagaaaaaaacacagggaagaauag

SEQ ID NO: 248144 - RNA, 816 nt, Artificial Sequence
  Description of Artificial Sequence: Synthetic coding sequence
augaugaaaacccuccuacuuuuuguaggacuccuacugacaugggaaucggggcaaguccuuggcgaccaaacagugucugacaacgaacugcaggaaaugaguaaucaggggucuaaguaugugaacaaggagauacagaacgcugugaauggcgucaagcagaucaaaacacugauugagaaaaccaacgaagagcguaaaacacugcucaguaaucuggaggaggcaaaaaagaaaaaggaagaugccuugaacgagacuagagaaagcgagaccaaacugaaagaacugccuggagugugcaaugaaaccaugauggcccucugggaagaaugcaagccaugccucaagcagaccugcaugaaauucuaugcucgcgugugccgcucagguagcggauuagugggcaggcaauuggaagaguuccugaaccagagcucgccuuucuacuucuggaugaacggggaucguaucgauuccuugcuagagaaugauaggcagcagacgcauaugcuggacgugaugcaggaccauuucagccgggccagcagcauuaucgaugaguuguuccaagacagccugaugcccuuuuccccuuacgagccacucaacuuucaugcuauguuccaaccauuccuugaaaugauucacgaggcccagcaagccauggauauucacuuucacucucccgcauuucagcauccacccacagaauuuauucgggaaggagacgacgaucgcacagugugcagggagauccggcauaacucuacaggauguuuaaggaugaaagaccaaugugacaaaugcuag

SEQ ID NO: 248145 - RNA, 1383 nt, Artificial Sequence
  Description of Artificial Sequence: Synthetic coding sequence
auggaggcaugcaaagauucacgcauaggcgguaugaugaagacacugcucuuguucgugggacuccuguugaccugggagucaggccaaguuuugggcgaucagaccgugucugauaaugaguugcaagagaugucuaaucaagggaguaaguaugugaauaaggagauccaaaacgcagugaauggagugaaacaaauaaaaacacuuaucgagaagaccaacgaagagcgcaaaaccuuacugucaaacuuggaggaggcaaaaaaaaaaaaagaggaugcauugaaugaaacaagggaaagugagacaaagcugaaagagcuccccggaguuuguaacgagacaaugauggcacugugggaagaaugcaagcccugccucaagcagaccuguaugaaguuuuaugcccgggugugccggagcggaaguggacuggugggucgccaguuggaagaauuucuuaaccagucgucaccuuuuuacuucuggaugaauggcgaucgcauugacagccugcuggaaaacgaccggcaacagacucauaugcuggaugugaugcaggaucauuuuagucgggcuucuuccaucauagacgaacuguuucaagaccgcuucuuuacacgugagccacaagacaccuaccacuaucugccauucucgcugccucaccgccgaccacauuuuuucuucccgaagucucgaaucguuaggaguuuaaugccuuucucuccuuaugagccucugaauuuccaugcaauguuccagcccuuccuggaaaugauccaugaggcacaacaagccauggauauacacuuucauaguccagcauuccagcauccuccuaccgaguucauccgcgagggugacgaugacagaacaguuuguagagaaauucgccacaacucaacuggaugccuucggaugaaagaccagugugauaaauguagagagauucugagcguugauuguuccacuaauaauccuucacaggcuaaauugcgacgggagcuagaugagagucuccagguggcagagagacucaccaggaaauacaacgaguuacuuaagaguuaucaguggaagaugcuaaacacaaguucgcuccuugagcagcugaaugagcaguuuaauugggugucucguuuagccaaccuuacccagggugaggaccaauacuaccugcgcgugaccacugucgccagccacacuucggauucugauguuccuuccggcgugaccgaaguggucguuaaacuguucgauagugacccuaucaccguuacugucccaguugaagugucucgcaaaaacccaaaguuuauggaaaccgucgcggagaaagcauuacaggaguaccgaaaaaaacaccgcgaagaauag

SEQ ID NO: 248146 - RNA, 1506 nt, Artificial Sequence
  Description of Artificial Sequence: Synthetic coding sequence
augcaggugugcagccaaccacagcgcggaugcguacgagagcaguccgcaaucaauacggccccaccaagcgcccauaacgcugccucuccagggggugcccgaggccaucgagugccucugacagaagcuuguaaggacagccggauagggggcaugaugaagacacuacuguuauuugugggacuccugcugacaugggagucaggccaggugcuuggggaucagacagucucugauaaugaauugcaggaaauguccaaucagggaagcaaauacgugaauaaggagauacagaaugccgugaauggugugaagcagaucaagacucuuauugagaaaacaaacgaggaacggaagacucugcuguccaaccucgaggaagccaaaaaaaagaaggaagacgcccuaaacgagacucgcgagagugaaacaaagcugaaggaacugcccggcgugugcaaugagacaaugauggcucugugggaagaguguaaacccuguuuaaaacagacuuguaugaaauuuuacgcccgggugugccgaagcgguagcggacugguugggagacagcuggaagaguuccuuaaccagucaucccccuuuuauuucuggaugaauggcgauagaaucgauagucuccuggagaacgaucggcagcaaacccauaugcucgacguuaugcaagaccacuucucucgagccaguagcaucauugacgagcuuuuucaagauagauucuuuacaagggagccucaggauaccuaucauuacuugcccuuuucacucccacacaggaggccccacuuuuucuuccccaaaucccggaucguccgcagccuuaugccuuuuagcccguaugagccucugaauuuucaugcuauguuccagcccuuucucgagaugauacaugaggcccagcaagcaauggacauucauuuccacagccccgcguuccagcacccgcccaccgaguucaucagggaaggcgaugaugacagaaccguuugccgagaaaucagacacaacaguacagguugucugcgaaugaaagaucaaugcgacaagugcagagagauacuaucagucgauugcucuacuaauaacccuucucaggccaaacuucgccgcgaacucgaugagagucuacagguggcagaaagacucaccaggaaguacaaugaacuucuuaaguccuaccaguggaaaaugcugaacacaucaucauugcuggaacaauuaaaugagcaguuuaacuggguaucacgucuggccaacuugacccagggagaggaucaguauuacuugagagugaccaccgucgccagccacacuagcgauagcgacguuccuagcggggucacugagguagugguuaaguuguuugauagcgacccgauuacagucacagugcccguggaggucagccggaaaaaucccaaauuuauggagaccguugcggaaaaagcauugcaagaauaccgaaaaaagcacagagaagaauag

SEQ ID NO: 248147 - RNA, 894 nt, Artificial Sequence
  Description of Artificial Sequence: Synthetic coding sequence
auggaagcaugcaaggauuccagaaucgguggcaugaugaagacgcugcugcucuucguggguuuauugcuaacuugggaaaguggacaagugcucggugaccaaaccgucucugauaacgagcuacaagaaaugucuaaucagggaucuaaauacgugaauaaggaaauccagaacgccgugaaugggguaaagcaaauaaagacccugaucgaaaaaacgaacgaagaaagaaagaccuuacugucgaaccucgaagaggccaagaaaaaaaaagaagaugcacugaacgaaacuagggagagcgagacuaaguuaaaagaauuaccaggggucugcaacgaaacuaugauggcucuaugggaggagugcaaacccugucuuaaacagacgugcaugaaguucuacgcgagggucugucggucggguucugguuugguggggcggcagcucgaagaauuccuuaaucaaaguagucccuucuacuuuuggaugaacggagacagaauagacagucucuuggaaaaugacaggcagcaaacacauaugcuggacgucaugcaggaccauuucaguagggcuagcagcauaauugaugagcuauuucaggacagauucuuuacgcgugagccacaggauaccuaccacuaucugcccuucagcuugccgcaccgccggccccauuucuuuuuuccuaaauccagaaucgugagaucauuaaugccauucucccccuacgaaccccugaacuuucaugcuauguuccagcccuuucuggaaaugauacaugaagcccagcaagccauggacauucacuuccacucuccagcuuuccaacacccacccacugaauucaucagagagggagaugaugauaggacggugugcagauag

SEQ ID NO: 248148 - RNA, 2259 nt, Artificial Sequence
  Description of Artificial Sequence: Synthetic coding sequence
augggcccccuuaugguuuuguucugccugcuguuuuuauaccccggucucgcugauucugcccccagcugcccacagaacgucaauauuuccggaggaaccuuuacucugucacacgggugggcaccagggagccugcuuaccuacuccugcccacagggucuguaucccaguccugcuucacgacucugcaaauccagcggacaauggcagacuccaggagcuacaaggucucuuucgaaagcgguguguaagccagucagauguccagcgcccguuaguuucgagaauggaaucuacacgccucgccugggaaguuacccagucggcggaaacgugucauucgagugugaagacggauuuaucuuacgcggguccccuguacggcagugccggccuaacggaaugugggauggggaaacagcugucugcgacaauggugcgggacauuguccaaauccugggaucagccugggagcaguucggaccggcuuccgcuuuggacacggcgacaaggugcgcuaucguuguagcagcaacuugguacuuacuggauccucagagagggaaugccagggcaauggaguguggagugggacugagccaauaugccgccagccuuacucguaugacuuccccgaagauguggcgccugcccuggggacuagcuucucucacaugcugggagccacaaauccaacccagaaaacuaaggaaucuuugggacgaaaaauccagauccagagaucaggacauuuaaaucucuacuugcugcuggauuguucucaguccgugucagaaaaugauuuccucaucuucaaagagagcgcaucucugaugguagaccggaucuuuagcuucgagauuaaugugagcguugcuaucaucacauucgcuagcgaaccaaagguccugaugagcguuuugaaugacaacagucgugacaugaccgaagugauuuccaguuuggagaacgcuaacuacaaggaccaugaaaauggcacuggaacuaacacuuacgcggcacucaacucaguuuaucuaaugaugaacaaccagaugcgcuuacuggggauggagacuauggcuuggcaggagaucagacaugcuauaauccuucugacugaugggaagagcaauauggggggaagcccgaaaacugcagucgaccauauacgggaaauucugaacauuaaccagaagcggaacgacuaccuggacauauacgccauaggcgugggcaagcuugaugucgacuggcgugaacuaaacgagcucggcagcaagaaggauggcgagcgccacgcguuuauccuccaggacacgaaagcccugcaucaggucuucgaacauaugcuagacguuuccaagcuuacagacacaaucugcggaguagguaacaugagugccaacgccagugaucaagaaagaacgccguggcacgugacuauuaaaccuaagucccaagaaaccugucggggcgcacuaaucuccgaccagugggugcugacugccgcccauuguuucagagacggaaaugaccacucacuguggcgugugaaugucggugaucccaaaucucaguggggcaaagaguuuuugaucgaaaaggccguaaucagcccuggauucgacguguuugcaaagaagaaucaaggcauccucgaauucuauggugaugacaucgccuugcucaagcucgcacagaaagugaaaaugucaacccacgcuaggccaaucugccuucccugcacuauggaggccaaucuggcacugcggcgaccacagggaaguaccugccgagaucaugagaaugaacugcugaauaaacagucugucccugcccacuucguagcacucaacggaagcaaacugaacaucaaucuaaaaaugggaguggaguggacgaguugugcugaaguugucagccaggagaagacaauguuuccuaaccugaccgacgugcgagagguuguuaccgaccaguuucuuugcucuggaacucaggaggacgaaaguccuugcaaaggugaauccgguggugccgucuuucuggaacgccgguuccgguucuuccaaguaggucuagucaguuggggacucuauaacccaugccuugggucugcugacaagaauuccagaaagagagcuccuagaucaaaagugccaccccccagagacuuucacauaaaccuguuucgcaugcaaccuuggcuccggcaacaccucggcgacguguugaauuuucugccacuauag

SEQ ID NO: 248149 - RNA, 1134 nt, Artificial Sequence
  Description of Artificial Sequence: Synthetic coding sequence
augaccgaagucaucucaaguuuagaaaacgccaacuauaaagaccacgagaacgguaccgguacaaacacauacgccgcacugaauagcguauauuugaugaugaauaaccaaaugcgacuacuggggauggaaacuauggcuuggcaggagauaagacaugcuauuaucuuacucacagaugggaaaagcaacaugggcgguucacccaagacagcgguagaccauaucagggaaauucucaauauuaaucagaaaagaaacgauuaucuugacauauaugccaucgggguaggcaagcucgaugucgacuggcgagaauuaaacgagcuagguucuaaaaaggacggggaaagacaugcauuuauucugcaggauaccaaagcacugcaccagguauucgagcacaugcuggacgucaguaaguugaccgacacuauuugcggcguuggaaauaugucagcuaaugccuccgaccaggaaaggacuccguggcauguuaccauaaaaccaaaaagccaggagacuugucggggcgcucugauuagugaccaaugggugcucacugcagcacacuguuuucgagacgguaacgaccauucucuguggcgggugaauguuggagacccaaagucccagugggggaaggaauuuuugauugaaaaggcuguuaucucuccuggcuuugacguguucgcaaagaagaaucaaggaauauuggaguucuacggugacgauauugcccugcuuaagcucgcacaaaaggugaagaugucaacccaugcacggccaaucugucuuccuugcacaauggaagcaaacuuagcacugagacguccccaagguaguacuuguagagaccacgagaaugagcuccuuaacaaacagaguguucccgcacacuuuguugcccucaauggcuccaaguugaauaucaaccuuaaaaugggcgucgaauggacaucgugugcugagguggugucccaggagaagacuauguucccuaaccugaccgacgugagggaagugguuacggaucaguuccugugcagcgggacacaggaggacgaaucgccuuguaagggaggcagcggcgaacugggcagccuacagccacugcccugguuaugcuag

SEQ ID NO: 248150 - RNA, 420 nt, Artificial Sequence
  Description of Artificial Sequence: Synthetic coding sequence
auggguccuuugauggucuuguucugcuuacucuuucuguaccccggacuggcagauagcgccccauccuguccccaaaacgugaauauuagcggagggacauuuacacucagccauggcugggcucccggaagcuugcucaccuacuccugcccacaagguuuguacccuuccccugcaagccggcuuugcaagucuagcggacaguggcagacccccggcgccacacggucacucucuaaggcaguaugcaaacccgugcgguguccugcgcccguuagcuucgagaacggaaucuauacaccccgguuaggcuccuacccugucggagggaauguguccuucgaaugugaagacggcuuuauacugagggguuccccagugagacaguguagacccaacgguaugugggacgguuag

SEQ ID NO: 248151 - RNA, 978 nt, Artificial Sequence
  Description of Artificial Sequence: Synthetic coding sequence
augggaaccagauccgccauugccgccccuagaauucugugcucaagaggacuuaggagugguucugcccgcgccaccgguucuggaguugaaaggucccccuccgccgcuaacccuacgcugaugacaucccuacggaccuggccucugcccugggcucuuccuagccccacuugucugggaccaccuauuccgcccagacgacagcggaucuuuagcuucgagaucaaugugucagucgcuaucauuacauucgcauccgagcccaaggugcuaauguccguacucaaugacaauucccgcgauaugacugaggugauuagcucguuagaaaaugcuaacuacaaagaccaugaaaacggaaccggaacaaauacuuaugcagcccugaacuccguuuaccuuaugaugaacaaucagaugagacuucugggaauggagaccauggcuuggcaagaaaucaggcaugcaauaauccugcugacggaugggaagucaaacaugggcggcucuccaaaaacagccguggaucacauccgcgaaauacucaauaucaaucagaaacguaacgauuauuuagauaucuacgccauuggaguggguaaacuggauguggacuggagggagcugaaugagcuaggaaguaaaaaagauggugagagacaugcauuuauacugcaggauacgaaggcccugcaccaaguguucgaacauaugcuggaugugaguaaguuaacugacacaaucugcggugugggcaacaugagcgcaaacgcgucggaccaggaaaggacacccuggcauguaaccaucaagcccaaaagccaggagaccugucgcggagcacuuauuucugaucagugggucuugacagcagcucacuguuuucgggaugggaaugaccacucacuuuggcgagugaacgugggagacccuaagagucaguggggaaaagaguuccugaucgaaaaagccuag

SEQ ID NO: 248152 - RNA, 1863 nt, Artificial Sequence
  Description of Artificial Sequence: Synthetic coding sequence
auggggccccugaugguacuguuuugucugcuguuucuguaucccgcuggacacugccccaacccugggauuagccuaggcgccguccgaaccggauuccgauucggccauggcgacaagguuagauacagaugcucuagcaaucucguacucacagggucgagugaacgcgagugucaaggcaacggaguauggaguggcacugaacccauuugccgacaacccuauucauacgauuuuccagaagauguggcaccagcucuagguacaagcuucucucauaugcugggcgcaacuaaccccacccaaaagacgaaggaaagccugggccgaaagauacaaauccagcgaagcgggcaccucaaccuguacuuacugcuggauuguucacaguccgucagcgaaaaugacuuucugauuuucaaggagagcgcgucucugaugguggacagaaucuucuccuucgagauuaaugugagcgucgccaucauaaccuucgcuuccgagcccaagguacugaugucuguucugaacgacaacucaagggacaugacugaagugaucucaucacucgaaaaugcaaauuacaaggaccacgagaacggcacugguacaaauacauaugccgcacucaauucaguguaucucaugaugaacaaccagaugaggcugcucgggauggaaacaauggcuuggcaagagauucgacaugcgauaauucugcucaccgacggcaaaucuaacaugggaggcucuccuaaaaccgcggucgaccacauccgggagauuuugaauauuaaucagaaacgaaacgacuaucuggauaucuaugccaucggcgugggcaagcuggacguggacuggagagagcugaaugagcuggggucaaagaaagacggggaaagacaugccuuuauacuccaggacaccaaggcccugcaccagguuuuugaacauaugcuggacguuucaaagcugaccgauaccaucugcgguguggguaauaugucagccaaugccucugaucaggaaagaaccccuuggcaugugacuaucaaacccaaaagucaggagacuugcaggggagcauugaucagcgaucaaugggugcuaacugcugcccacuguuuccgugacggaaaugaucauucccucuggcgggucaacgugggcgauccuaagucccaaugggggaaggaauuucugaucgagaaggcagugauuagcccuggauuugauguuuucgcuaaaaagaaucaggggauucuggaauucuacggggacgacauugcgcugcucaagcuugcccaaaaggugaagaugucuacacaugcccggccuauuugcuuaccuugcacaauggaagcaaaucuugcgcuaaggagaccccagggcucaaccugccgcgaccacgaaaacgagcuguuaaauaaacaaaguguaccagcacacuuuguagcacugaauggaaguaaacuuaauauaaacuugaaaauggggguugaauggacauccugcgcugaaguuguaagccaggaaaagacaauguucccaaaucugaccgacguucgggaggugguuaccgaccaguuccucuguagcggaacccaggaggacgaaucucccuguaagggcgaauccggcggcgcaguguuucuugagcgucgcuuccgguucuuucaagucggacuggugucauggggccuguauaaucccugucugggcucugccgauaagaacagccgcaagcgagccccccggucaaaggucccaccaccgcgagauuuucacauaaacuuauucaggaugcagcccuggcugcgacagcaucuuggcgauguuuugaauuuccugccauuauag

SEQ ID NO: 248153 - RNA, 5235 nt, Artificial Sequence
  Description of Artificial Sequence: Synthetic coding sequence
augcggcuccuguggggauugauaugggcaucaagcuucuucacccugucacuccaaaaacccagacuccugcuguuuucucccagcgucgugcauuugggugugccucuuaguguugggguccagcugcaagauguuccucgcggccagguggucaagggcagcgucuuucucaggaacccaagcagaaauaaugucccauguucacccaaagucgauuucacucucuccucagagcgggacuucgcucuucugucucugcagguuccacucaaggacgcaaaauccugcggacuucaccaauuacugagagggcccgaaguccaacuugucgcucauaguccuuggcugaaggauagucuuaguaggacaacuaacauccaggggauaaaucugcuguuuucgaguaggcgcggccaccuguucuugcagaccgaucagcccaucuacaacccuggacagcgcguaagguaccgcgucuuugccuuagaccaaaaaaugaggccauccaccgauacaauaacuguuaugguagagaacagucacggcuugcgcgugcggaagaaagagguguacaugcccucguccaucuuucaggacgacuucgugaucccagacauuuccgaacccgggacuuggaaaaucuccgcccgcuuuucugaugguuuggaaaguaacucaucgacacaauucgaaguuaaaaaauacguccucccuaacuuugaggugaaaauuacuccaggaaagcccuauauacugaccgugccgggccauuuggacgagaugcagcuggacauucaagccagauauauuuauggcaaaccaguacaaggaguggcuuaugugcgguucgggcuccucgaugaagauggaaagaagacuuuuuuucgaggccuugagucccaaacaaagcuggugaauggccagagccauaucucucuauccaaggcggaguuccaagaugcacucgagaaacugaauauggggauuacagaucugcaaggacuacgccuguacguugcugcagccaucauugagucacccggcggcgaaauggaagaggccgaguuaacuucaugguauuucgugagcucgccuuuuucucuggaccugagcaagacgaagagacaccuagucccaggugcacccuuucuccuucaggccuuaguccgggagaugucugguucuccagccagcgggauuccuguaaaagucagugcaacagucucuucgccuggcuccgucccagaaguucaggacauccaacagaauacugacgggagcggccagguuucaauaccuauaaucaucccacagacaaucuccgaacuucagcucucgguuagugccggaaguccacaucccgcaauugcucggcugacgguugcagcaccccccagcggcggaccaggauuccugucuaucgagcgaccggacucucggccacccagagugggggauacacugaaucugaaccugcgggccguuggguccggggccaccuuuucacacuacuacuacaugauccuuucgagagggcagaucguguucaugaauagggagcccaaacggacccugacauccgucaguguuuucgucgaucaccaccuggcccccucuuucuauuucguggccuucuauuaccacggugaccaucccgucgcgaauagccuacgcguagauguccaagcuggagccugcgaggggaaacucgaacugucaguugacggcgcaaaacaguaccggaacggagagucagugaagcugcaccucgagacagacucacuggcucucgucgcacugggggcucucgacaccgcgcuuuaugccgcuggcucuaagucucacaaaccccugaacaugggcaagguuuuugaagccaugaacagcuaugaccuggggugugguccuggugggggagacucagcucugcaggucuuccaagcugcuggauuagcuuucucugauggagaucaguggacacugucuagaaaaagacugaguugcccuaaggagaagaccacucggaaaaagcgcaacgugaauuuccaaaaggcuaucaacgaaaaauuaggacaguacgcaucuccgaccgcuaagagauguugccaagacggaguaacacgccugcccaugaugcgcuccugugaacagcgcgcagcucgggugcagcagccugacugucgcgagcccuucuuaagcugcugccaauucgcugaaagccuaagaaagaaaucucgagauaaaggacaggcaggccugcagcgagcccuagagauccugcaagaggaggaccuuauagacgaagaugauaucccagugcgguccuucuuuccggaaaauugguuauggcggguggaaaccguagacagauuccagauucucacccuauggcuccccgauucccugacaacaugggagauccauggacucagccucucgaagaccaagggccuauguguagcaacuccuguacaguugcgggucuuucgcgaguuucaccugcaccugcgguuaccuauguccguaaggcgguucgagcaacuggaguugagaccagugcucuauaacuaccuagauaagaaccugacaguuuccgugcacgugagucccguggaggggcugugucuggccggaggcgggggauuagcacaacaggugcuggucccagccggcucagcacguccuguugcauucaguguggugcccacugcagcugcugccguuucauuaaaggugguugccagaggcucuuucgaguuccccgucggagacgcugugucaaagguccuacagauagaaaaggagggggccauucaucgcgaagaacugguuuaugaacuuaacccacucgaucauaggggccggacccuggagaucccuggcaauagcgaccccaauaugauacccgauggggacuucaacucuuacguuagaguuacugcuagugacccuuuggauacccucggcagcgagggcgcccucagccccggggggguggccucccuccuuagacugccccgggguugcggagaacagacgaugauuuaccucgcccccacuuuagccgcaagccguuauuuggacaaaacugaacaguggucaacccucccgccagaaacuaaagaucaugcuguugaucugauucaaaaggguuauaugcggauccagcaguuccgaaaggccgauggcuccuacgcagccuggcuuucgagggauagcucuacauggcugacagccuucguucugaagguacugagucuagcucaagagcaggucggaggauccccugagaaacugcaggaaacuucaaauuggcuucugagccagcaacaagcugaugggucauuccaggauccuuguccaguccucgaccgcuccaugcagggugguuuaguagggaacgaugagaccgucgcucucaccgccuuugucacaaucgcucugcaucacgggcucgcuguuuuucaagaugaaggugccgagccacucaaacaaagagucgaagccucgauuucuaaagccaacaguuuucugggcgaaaaggcuagcgcgggccuguugggagcccaugcugcugccauaacugccuacgcccucacacugacuaaagcgcccgucgacuugcuuggugucgcacacaacaaucuuauggcaauggcacaggagacuggagacaauuuguauugggguucugugacuggaucacagucuaacgccgugucccccacaccugccccaaggaauccaucagauccaaugccccaagcucccgcucucuggaucgagacaacggcuuacgcccuccugcaucuccuacuccacgaggggaaggcggagauggccgaccaggcuucagccuggcugacccgccagggaagcuuucagggcggcuuucgaagcacccaagauacugugaucgcccuggacgcucuuucagcuuacuggaucgcuagccacaccaccgaagagcgcggguugaacguuacccucucaagcaccggacgcaauggauucaaaagccaugcccuucaauugaauaaccggcagaucagaggacuggaggaggagcuacaguuuagccuggguucaaagaucaaugugaaaguuggaggaaacagcaaagguacucugaaggugcuuaggacguacaacguguuggacaugaagaacacuaccugucaggaucuucaaauugaagugaccguuaaaggacacguggaguacaccauggaggccaacgaggacuacgaggacuacgaguacgacgagcugccugcaaaggaugauccggaugcaccacuccagccugugacuccgcuucaauuguuugaggggcggcggaaccggaggaggagggaggcuccgaagguugucgaggaacaggagucgcggguccacuacaccguauguauuuggcggaaugguaaggugggguuaucggggauggcaauugcugacgugaccuuacuuucaggguuccaugcccuccgcgcugaucuggagaagcucaccucgcucagugaucgguacgucagccacuucgaaacggaggguccccauguguuacuguacuucgauucggucccaaccaguagagaguguguggguuuugaagcaguccaggaaguaccagugggccucguacaaccugcaagcgcuacuuuguaugacuacuauaacccagaaagacguugcuccguguuuuauggcgccccaucuaaaucucggcuauuggccacacuguguucagccgaggugugucaaugcgccgaagguaaauguccgagacaaagacgcgcuuuagaaagaggauuacaggacgaagacggguaucgcaugaaguuugccuguuauuauccccggguggaguacgguuuucaaguuaagguucuaagagaggacucccgcgccgccuuucgacuauucgagaccaagaucacacagguuuuacauuucacaaaagacgucaaagcugcugccaaucagaugcggaacuuccuggugagggcuagcugcagacugcgucuggagccuggaaaggaguaucuuauuaugggccucgauggugcaacuuacgaccuagagggucauccacaauacuuguuagacucaaacagcuggaucgaggagaugccuagugagaggcugugccgcucuacucgacaaagagcugcuugcgcacagcugaacgauuucuuacaagaauaugguacccaggggugccaggucuag

SEQ ID NO: 248154 - RNA, 5097 nt, Artificial Sequence
  Description of Artificial Sequence: Synthetic coding sequence
augagacugcuuugggggcuuaucugggccagcagcuuuuucacccugucucuccaaaagccgagacuccugcuauuuucuccaagugugguccaucuggggguacccuugagcguaggugugcaacugcaggacguuccaagaggacaggucgugaagggaagcguuuuccugcggaacccaucccguaacaacguaccaugcuccccgaaaguugauuuuacacugucaagugagcgcgauuucgcucuucugucucugcaagugccccugaaggaugccaagaguuguggccugcaccagcugcugagggggccugaagugcagcuggucgcgcacucccccuggcugaaggacucacuuucucgcacaaccaauauccagggcauuaauuuacuguuuuccucucgucguggacaucucuuucugcaaacugaucagcccauauacaaucccgggcaacgcgugagauaucgaguguucgcucuggaccagaaaaugcgcccaucaaccgauacaaucaccgugauggucgaaaacagccauggucugcgaguucgaaagaaagaaguuuauaugccuuccucaauuuuccaagaugacuuugugauacccgacaucucagagccugggacuuggaagaucagcgcucguuuuagcgauggacucgaaucuaacucuuccacacaauuugaggucaaaaaguacguucugcccaauuuugaagugaagaucacuccagguaaaccauauauucuaaccgugccaggucaccuggacgagaugcagcuggacauucaggccagguauauuuacggaaagccaguacagggcguggccuacgugcgguucggucugcuagaugaagacgggaagaaaacuuucuucaggggacuugagucccaaaccaaacuggugaacgggcaaagucacauuucucugucuaaagcagaguuccaggaugcucuggaaaagcugaauaugggcauaacagaucuucagggccuucgucuguacguggcagcugcgauaauugaaucucccggcggcgagauggaagaagccgagcucacgucuugguacuucgugagcucccccuuuucucucgacuuguccaagaccaaacggcaccugguaccuggcgcaccuuuuuuacugcaggcucuuguccgcgagaugagugggucgccugccucgggaauuccugucaaaguuagugcuaccgugaguaguccaggaagcguacccgaggugcaagauauucaacagaacaccgauggcaguggccagguaaguauuccaaucaucauuccccagacuauuagugaguuacagcuaucugugucugccggaaguccucaucccgccauugcccgacuuacugucgcagcgcccccaagugggggcccuggcuuucuuucuauagagcgcccagauagcaggccucccagggucggggacacguuaaaucugaaccuccgggcggucggcagcggagccaccuucucacacuauuauuauaugauucugagcaggggccagauagucuuuaugaauagggagccgaaaagaacgcugacaucagucucaguguuuguugaucaucaccuggcaccgucuuucuacuuuguggccuucuacuaccauggcgaccaccccguagccaacucauugcggguggaugugcaggcuggcgcuugcgaagguaaauuggaacugagcgucgacggcgcaaagcaguaccggaauggcgagucggugaaacuacacuuggagacugauucccuggcgcucguagcucugggcgcuuuagauacagccuuauacgcagcgggaaguaagagccacaaaccacugaauauggggaaaguuuuugaggccaugaauaguuacgaccucggauguggcccaggcggaggagauucugccuugcagguuuuucaagcugcagggcuggccuucagcgauggugaccaguggaccuuaucucggaaaagacuguccugcccaaaggagaaaaccacccggaaaaagagaaacguuaauuuccagaaggccaucaaugaaaagcuggggcaguacgccuccccaacggccaagagaugcugccaggauggcgucacgagacuuccaaugaugcguagcugugagcagcgagccgcuaggguacagcagccugauugccgugagcccuuucugucauguugucaauucgcugagagucugcgcaagaagagcagagauaagggucaggccgggcuccagagggcauuagagauccuccaggaagaggaccucauugacgaagacgacauuccuguucggucuuucuuuccugagaauuggcuguggcggguggagacaguagaccgcuuucagauacucacccucuggcucccggauagccugacuacuugggaaauucauggacuuucacucaguaaaacaaaaggacuaugugucgcgacgccagugcagcugagaguguuucgcgaguuucacuuacacuuacgacugccuaugagcguccguagauuugagcaguuagaauugcggcccgugcuguacaauuaucuggacaaaaaucugaccgugucggugcacgugucaccuguugaaggauugugucucgccggaggaggugggcuggcucagcagguucugguuccagccgggucugcgcgcccuguggcuuuuagcgucgugccuacugcugcugccgcagucucacugaaagugguugcucgcggguccuucgaauuucccgugggugaugcagucagcaagguccugcagauugaaaaggagggugcaauccaccgggaagaguugguguacgagcugaauccacuggaucaucgcgggcgcacacuggaaaucccugggaacagugacccuaauaugauuccugauggcgauuucaauucauacgugcgcguaaccgccagugauccacuggauacccuaggaagugaaggagcacuaaguccaggagggguggcaucccugcuacgccugccucgggguugcggagagcagacuaugauuuaucuggcucccacacucgcagcuucgcgcuaccuugauaagaccgagcaguggucuacccugccacccgaaaccaaggaucacgccguagauuugauccagaaaggcuacaugcgcauccagcaguuucgaaaggcggacgguuccuaugcagccuggcucucuagggauaguucuaccuggcuuacagcuuuuguccugaaaguucuuucucuagcccaggagcaggucggaggcuccccggagaagcugcaggaaacaucaaacuggcuccugagccaacagcaagcggacgguuccuuccaagauccuugcccugugcuugaucgguccaugcagggaggccucgugggaaaugacgagacuguagcgcugaccgcuuuugugacuauugcccugcaccauggauuagccguuuuccaagacgaaggcgcugagccacugaagcagagaguggaggccuccauuaguaaggcaaacucuuuccucggcgagaaggcauccgcuggacuccugggagcccaugcugccgcgauuacagccuacgcccugacccugaccaaagccccuguggaucuucuaggcguggcccauaacaaccuuauggccauggcucaggaaacgggcgacaaccuuuauuggggauccguaacaggaucccagagcaacgcuguuagccccacaccagccccccggaauccuucugauccuaugccccaggcaccugcacucuggauagaaacaaccgcauaugcccugcuucaucugcuccuucacgaaggcaaggccgagauggcugaccaggcuucugcauggcucaccaggcaaggaaguuuccaagggggcuuccgguccacccaggacaccgugauugcccuggacgcccugucugcauacuggaucgccucucacacaaccgaagaacgcgggcugaacgugacuuuaagcuccacugggaggaauggauuuaaaucgcacgcccugcagcugaacaacaggcaaauccgaggucuagaagaagaacugcaguuuucauuggguagcaaaaucaaugugaaagucggugggaacagcaagggcacucuuaaagugcugagaacauauaacguccuggacaugaaaaacaccaccugucaggauuugcagauugagguaacggugaaggggcacguugaauauaccauggaggccaacgaggacuacgaagacuacgaauacgaugagcucccagcaaaggacgacccugaugccccgcugcaaccuguuaccccacuccaacuguucgaggggcgaagaaaccgaagacgacgggaagcacccaagcucacaucgcucucagaucguuacguuucgcauuuugagacagaagggccccaugugcuguuguauuuugauuccguaccuacauccagagaguguguuggguuugaggccgugcaggaggugccugucggguuggugcagccggcuuccgcaacuuuauacgauuauuacaaccccgaaagaagguguucugucuucuacggcgccccaaguaaaucuaggcuguuggcuacucuuuguagugcagaggugugucagugcgcagaggguaagugcccuagacaacgccgcgcacuagagcgaggucuucaagaugaagauggauaccgcaugaaguuugccugcuauuacccccguguggaauacgguuuccaggucaaaguccuaagagaggacucccgggccgcguuucgauuauucgaaaccaagaucacucagguacuccacuuuaccaaagaugugaaggcugccgcuaaccagaugcgcaauuuccucguuagggcauccugcagacugaggcuugagccaggcaaagaguauuuaauuaugggcuuggacggagcaacuuaugaccucgagggucauccacaguaccuucucgacaguaacuccuggaucgaggagaugccaagcgagaggcuguguaggagcaccaggcagagggcagcgugcgcgcaauugaaugauuuccugcaagaguacggcacucaggggugccagguguag

SEQ ID NO: 248155 - RNA, 813 nt, Artificial Sequence
  Description of Artificial Sequence: Synthetic coding sequence
auguguccggaggacagucuacaagugccacugaaagaugccaaauccugcgguuugcaccaacuucuuagagggccagaggugcagcugguagcacacucuccauggcuuaaggacaguuuaagucgcaccacaaacauccaaggcaucaaucugcucuuuuccucucgccgcggccaucuguucuuacaaacagaucagccaauuuacaacccaggucaaaggguccgguaucgcguuuucgcccuggaucaaaagaugcgccccagcacagauacuaucaccguaaugguagagaauagccacggauugcguguaaggaaaaaggaaguguacaugccuucgagcauuuuccaagacgauuuugugaucccagacauuucugagccugguacuuggaaaaucagugcccgcuucuccgacggauuagaguccaacucuagcacucaguucgagguuaaaaaguacguacuccccaauuuugaggucaagaucaccccuggcaaaccauacauccugacggucccgggacaccuugacgaaaugcaguuggacauccaggcccgcuacaucuaugguaaacccgugcagggaguggcauacguccguuucggucuacuagaugaagacgguaagaagaccuucuuucguggccuggaaucucagacaaaacuugucaauggucagucacauaucuccuugagcaaagcugaguuucaagaugcccuagaaaagcugaacaugggcaucacggaccugcagggucugaggcuguacguugccgcagcaauaauugagucccccggaggguag

SEQ ID NO: 248156 - RNA, 675 nt, Artificial Sequence
  Description of Artificial Sequence: Synthetic coding sequence
auggccacccaccauacucuguggaugggcuuggcuuugcuggguguacuaggagaucugcaggccgcuccagaggcucaggucaguguccagccaaacuuccaacaagacaaauuccucggacgcugguuuagugcuggauuggcuuccaauagcuccugguugcgggaaaaaaaggccgcccugucuauguguaaauccgucguagcccccgccacagaugggggacucaaucuaaccuccaccuuuuugcguaagaaccaaugcgaaacaagaacaaugcuucuucagcccgcuggcagucuuggcuccuacucuuaccggaguccacgagaauggggcuugcaccggcccccuggcccgucccugggcgcgacgcuugccgggacaacccuggggcaaccccccgcugcagaaauccauggugugggcgacuggggcuccacguauucagucucagugguugaaacggauuaugaucaauacgcccuacuguauagccaagguucgaaggguccuggcgaggauuuuagaauggcuacacuuuacucucgaacacagaccccuagagcagagcugaaagaaaaauucaccgccuuuugcaaggcccagggauucacugaagacacaaucguguuccugccgcagaccgacaaguguaugacagagcaguag

SEQ ID NO: 248157 - RNA, 4992 nt, Artificial Sequence
  Description of Artificial Sequence: Synthetic coding sequence
auggccacagacggcgcgagcugugagccggacuugucaagagccccagaggacgccgcuggugcugcagcugaggcugcuaaaaaagaauucgacguugacacccugucaaagagugaguugcgaaugcugcugucugucauggaaggcgaacuggaagccagagaccucgucauagaagcccugcgcgccagacguaaagagguguucauacaagagcgauauggccgauuuaacuugaacgaccccuuccuggcacugcagagagacuacgaggcaggagcuggggauaaagaaaaaaaaccuguaugcacgaacccacuuucuauccucgaagcaguuauggcccauugcaagaaaaugcaggagagaaugagcgcgcaacuggcggcugccgagagccgacaaaagaagcuggagauggagaaauugcagcuacaagcgcuggaacaagaacauaagaagcucgccgcucgccuggaagaggaaaggggaaagaauaagcagguugugcucauguuggugaaagaaugcaaacagcuauccgggaaaguaauugaagaggcccaaaagcucgaggacgucauggccaagcuggaagaggagaagaaaaagacaaacgaacuugaagaagaguugagugcggagaaaagacgcucuaccgagauggaagcccaaauggaaaagcaguuaagcgaguucgacacagagagagaacagcuccgcgcaaagcucaauagagaggaagcgcacacuaccgaucugaaggaagaaauugacaagaugcggaagaugaucgagcaguugaagaggggaagcgacucaaagccaucauuaucgcugccuagaaagaccaaggaucggcggcuugucaguaucucuguuggcacugaggggaccguuacaagaucuguggcuugucaaacggaucucgugaccgaaaacgcugaccauaugaagaagcucccacucacuaugccgguaaagcccaguaccgggucaccgcuugugagcgcgaacgccaaaggcucugucuguacuucugcgacuauggcacggccagguaucgaucggcaggcuuccuacggagaucuaaucggagcuucaguaccggcuuuccccccgcccagugcaaauaagauagaggaaaauggaccuucuacuggcuccacaccagaccccacuucaagcacucccccucugccaucuaacgccgcgcccccuacagcucaaacuccagggauagccccucagaacagccaagcuccuccuaugcacucacugcacaguccaugcgcuaauacaagcuugcacccuggacugaauccucguauucaagcugcccgauuccgcuuucaagguaacgcuaacgacccagaucagaacgguaauacaacccaaaguccuccaagcagagaugucucucccaccagcagagacaaucugguugcgaagcagcuggcucgaaauacgguuacacaggcacuuagucgauuuacaaguccacaagcaggagcucccuccagacccggggugccccccacaggcgacgucggcacacaccccccugucggaagaacaucccucaaaacccacggaguagcucgcguugaucggggcaacccaccucccaucccacccaagaagccgggccuuucacaaacuccaucacccccccacccccaguugaaggugaucaucgacagcagccgcgcaucuaauaccggagcuaaagucgauaacaaaacagucgcuuccacaccuucuucccucccucaaggcaaucgggugauuaacgaggaaaaccugcccaagucgucaagcccacagcugcccccaaaaccaucaaucgaccugacuguugcccccgcuggaugcgcggucuccgcguuggcgacuucucaagucggggcuuggccugccgccacaccuggccugaaccagccagcauguuccgacuccagcuuggugaucccuacaacuauugccuucuguucuucuaucaacccagugagugccagcuccugccgaccgggagcuuccgacucacuccucgucaccgccagcggcuggucuccaucuuuaaccccucuuuuaaugucaggaggcccggccccacuggcgggacgcccgacacugcugcagcaggccgccgcccaggggaauguaacccuccugaguaugcugcugaacgaagagggucuggacaucaacuacuccugcgaggauggccacuccgcccuuuacucagccgcaaaaaacggucauacugacugugucaggcugcugcucuccgcugaggcucagguuaaugcugcugauaagaauggcuucaccccacugugcgccgccgcagcacaaggacacuuugagugcguggagcuccugaucucauaugaugcaaacauuaaucaugccgccgacggcggccagaccccccuauaccuggcuuguaagaacggaaacaaagaaugcauuaagcugcuccuugaagccggaacgaaucgcucugugaaaacuacagacggguggacuccaguucacgcugccguugacacuggcaacgucgauucguugaaacuucucauguaccaucgaaucccagcccacggcaauuccuuuaacgaggaggaguccgaguccuccgucuucgaccuggacgggggagaggaaucccccgaaggcauuuccaagccagugguaccugcugaucugauuaaucacgcgaacagagaagguuggacugccgcccauauagcugcuagcaagggcuuuaagaacugucucgaaauccuguguaggcauggaggucuugaaccagagaggcgugacaaguguaaccgcacugugcaugauguagcuaccgacgacugcaaacaucuucuugaaaaucugaaugcccugaagaucccacuuaggaucucagucggagagauagaaccuagcaauuacggcuccgacgaucuggagugugaaaacaccauaugcgcccugaauauucggaaacagacuagcugggacgauuucagcaaggccgugucucaggcucuaaccaaccacuuccaggcuaucuccagcgaugguugguggagucucgaggaugugaccuguaacaauaccaccgauagcaacauuggauugagcgcuagaucaauccgaucgaucacucuggguaauguaccgugguccgucggccaauccuuugcccagagcccgugggacuuuaugaggaagaacaaagccgagcauauuacuguguugcuuagcgggccucaggaggggugccugucuuccguaacauacgcaagcaugauaccacugcaaaugaugcagaauuaucucaggcugguggaacaguaccauaauguuaucuuccaugggccugagggcagccuucaggauuauauuguccaccagcucgcucucugccuaaaacauaggcagauggcagccgguuucuccugcgaaauugugcgugcggaaguugacgccggcuucuccaaggagcagcucuuggaccucuuuaucucaucggcuugucugauuccagugaagcaauccccaucaaaaaagaaaauuaucauuauccucgaaaaucuggaaaaauccucauuauccgagcucuugcgggacuuuuuggcaccccuggagaauaggaguacagagagccccugcaccuuccagaaggggaacggccuuagcgaaugcuacuauuuccacgaaaacugcuuccuaaugggaaccaucgcaaaagcauguuuacaaggaucugaucuucuuguacagcagcacuuucgguggguacaacucagaugggacggcgaaccaaugcagggucuucugcagcgcuuccucaggagaaaggucguaaacaaguuuaaaggccaggcucccucuccuugcgaucccgucugcaaaauaguggacugggcucugucuguuuggagacaacuuaacucuuguuuagcccggcuugggacgccagaagcauuacuugggcccaaauacuuucuuucguguccaguggugcccggucaugcucagguuacagucaaauggaugagcaagcuauggaauggggucaucgcgccuagaguucaggaggcgauccucucccgagcaucugucaaacgucagcccgguuuuggccagaccacggcuaagagacacccuucacagggccagcaggcuguugugaaggcggcguugucuauccucuuaaacaaggccgugcuccacgguugcccacuuccucgugccgagcucgaucagcacacagcggacuucaaaggcggaucuuuccccuuaagcaucgugagcucuuauaauacuuguaauaaaaaaaagggagaaagcggagccuggcgcaaagugaacaccucaccacgccgcaaauccgguagauuuucucugccaaccuggaauaaacccgaccuuuccaccgagggaaugaagaacaaaaccauaagccaacucaauuguaaccguaacgccagucugaguaagcaaaagucacuagagaacgaucugucucuuacacucaacuuggaucagagguugagccuggguagcgaugaugaggcugaccugguuaaggagcugcagucuauguguuccuccaaaagcgaaucagacauaucaaaaauagccgauagcagagaugacuuaagaauguuugauucauccggcaacaacccggugcugagcgccaccauuaauaaucuuagaaugccaguaagucaaaaagaagugagcccauuaucaucacaccaaacaaccgagugcagcaauucaaagucaaaaacggagcugggagucaguaggguaaagagcuuuuugcccgucccgaggucgaaggugacacagugcucccagaacacgaaaagaucuuccaguucuuccaacacaagacagaucgagauuaauaacaauucuaaagaagugaacuggaacuuacacaagaacgagcaccucgagaaacccaacaaguag

SEQ ID NO: 248158 - RNA, 1233 nt, Artificial Sequence
  Description of Artificial Sequence: Synthetic coding sequence
augcagcgauuauuauuuccuccccugagggcucuuaaggggcgacaguaccucccucuucuggcaccuagggccgccccucgcgcgcagugcgauuguauccgacggccgcuccgucccggucaauacucuacaauuucugagguggcccuccaguccggccguggcaccgugagucuccccuccaaggcagccgagagaguggugggcagaugguugcuagucugcucagggacgguggcuggcgcugugauuuuaggaggaguaacgcggcugacugagucaggcuuauccaugguugauuggcauuuaaucaaggagaugaagccuccaacaagucaagaagaaugggaagcugaauuccaaagauaccagcaguuuccagaguucaagauccugaaccaugauaugacccuuacagaguucaaguuuaucugguacauggaauacucucacagaauguggggccggcugguugggcugguguacauucuuccagcagcuuauuuuuggagaaaagggugguuaagucgugguaugaagggucgaguucuggcucuuuguggauuggugugcuuucagggacuccuugguugguacauggugaaaagcgggcuggaggagaagagugacucccaugauaucccuaggguuagccaguaccgucucgcggcacaucugggaagcgcccuugugcucuacugcgcuagccuguggacaagcuugucucugcuguuacccccucauaaacugcccgagacacaucagcugcuccaacuucggcgguucgcccacggaacugcugguuugguguuuuuaacugcucuguccggagccuucguggcuggguuggacgcuggacugguguauaacagcuucccaaaaaugggcgaaucauggaucccugaagacuuguuuacuuuuucacccauuuugaggaauguuuucgaaaaccccacuaugguucaguuugaccaccgaauauuggggaucacuuccgugacagccauuacugugcuguacuuccugucccggcggauuccuuuaccucggagaaccaaaauggcugcuguuacuuugcuggcucucgccuacacgcaggugggcuuggguaucuccacgcuuuugauguacgucccuacgccccucgcugccacccaccaaagcggcucacuggcucuguuaacgggcgcccuauggcugaugaacgaacuuagacgagucccaaaguag

SEQ ID NO: 248159 - RNA, 2604 nt, Artificial Sequence
  Description of Artificial Sequence: Synthetic coding sequence
auggagguacccgcggccgggagggugcccgcggagggggccccuaccgccgcaguggccgagguucgcuguccuggcccagcuccacugcgccuucuagaguggcggguugcugccggagccgcugugagaaucggguccguguuggcgguguucgaagcugcugcaagcgcccaauccagcggcgcuucucagucuagaguggccagcgguggaugcguccgccccgcuaggccagaaaggcgauugaggagugagcgcgccggcgugguuagggaguuaugugcccagcccggccagguggucgcacccggugcugugcucguccgccucgaggguugcagccaccccguggugaugaagggccuaugugcagaaugcggacaagaucucacccaacuucaguccaaaaacggaaaacagcaagugccucugaguacggccacaguuagcaugguucauagcgugccagaacugaugguuagcucugagcaggcagagcagcugggacgggaggaccagcaacgacuccaccgaaauagaaagcuuguauugauggucgaccucgaucagacccucauccacacaacagaacagcauugccaacaaauguccaacaagggcauuuuccacuuucagcuuggcaggggcgagcccaugcuccauacacgccuccggccccacugcaaggauuuucuggagaaaauugcaaaacuguaugaacuccauguguucacuuuuggcucaagacuguacgcacauacuaucgccggcuuccucgaccccgaaaaaaagcuuuuuagucaccgcauacugucgagagacgaaugcauugacccuuucucgaagacgggaaauuugaggaaccucuuccccugcggagacucuaugguguguauuauugaugauagggaggacguguggaaauucgcaccaaaccuuauuacaguuaaaaaguauguauauuuccagggaaccggagacaugaacgcaccuccagggucgagggaaucacagacccggaaaaaggugaaucacucacgggggacugaggucucagaaccuucaccacccguccgcgaccccgaaggugugacucaagcucccggcguagaaccaucuaacgggcucgagaaaccugcucgagaauuaaauggguccgaggcagccacaccuagggacaguccuaggcccgggaagcccgaugagcgugacaucuggccaccugcgcaagccccaacaucgucccaagaacuggccggcgcaccugagccccaggggagcugcgcccaggggggaagaguugccccagggcagaggccagcacagggugcgaccggcacagacuuagauuuugaccugucuagcgauagugaauccuccagcgaauccgagggcacuaaaucuaguaguucagccuccgacggugagagugagggaaagcgcggucggcagaaaccgaaggccgcccccgaaggggccggggcccuggcacaaggaagcagccuggagccaggaaggccagccgcaccuuccuugccuggugaagcagagccaggagcgcacgcuccagacaaggaaccagagcugggcggacaggaggagggagagagggacggccugugcgggcuugggaacgggugcgcagaucgaaaggaggcugagacugagagccaaaacagcgaacucaguggaguaaccgcgggggagucucuggaccagaguauggaggaagaggaggaagaagacaccgacgaggacgaucaccuuaucuauuuggaggaaauccuugucaggguucacacagacuauuacgccaaguacgaucgauacuugaacaaagagauugaggaggcucccgacauccggaaaauuguucccgaacuuaaguccaaagugcuagcagacgucgcaauaaucuucagcgggcugcauccgaccaauuuucccauagaaaaaaccagagaacauuaucaugcaacagcucugggcgccaaaauacuaaccagacugguccuuaguccagaugcccccgaucgcgccacacaccugaucgccgcgcgcgcuggcacugagaaggugcugcaggcucaagagugcggccauuuacauguugugaauccagauuggcuuuggucuugccuagagcggugggacaaagucgaagaacagcuguuuccccugagagacgaccacacaaaagcgcaaagagagaacucuccagcagcauuuccugacagggaaggagugcccccaaccgcccuguuccauccuaugcccgugcucccaaaagcccagccggggccugaaguuaggaucuaugauaguaauaccgguaagcugauccgcacuggcgcccgggguccgccugcucccuccuccucucuccccauaagacaggagccaucuagcuucagguggacaacuucacuggagaaagcagccaccacggcaacagcacgaagaggcggucugagaagucggaggagaucuccuucaccugguucgcagggaccagcaggaucaggacggucaggccauuugcgccccgccaggggugccagacaaggcgcaggcggaccagaggccaccagaggcaguuag

SEQ ID NO: 248160 - RNA, 606 nt, Artificial Sequence
  Description of Artificial Sequence: Synthetic coding sequence
auggcaagggacuacgaccaucuauuuaaacugcucaucaucggggauuccggugucggaaagagcucacugcugcuccguuuugcugauaauacauuuucaggcucuuauauuacaaccauuggaguagacuucaagauaaggacaguggagaucaacggcgaaaaagugaaacuccagauaugggacaccgccggccaagaacgguucagaacuauuacgaguacuuauuaccguggcacucaugguguuauuguggucuaugaugugacaucugccgagaguuuuguaaacgugaagcgcuggcugcacgaaauaaaucagaauugcgaugaugugugucggauucucgugggaaacaagaacgacgauccagagagaaaaguuguggagacagaggacgcuuauaaguuugcuggacagauggggauucaauuguuugagacaagugcuaaggaaaauguuaacguagaagagauguucaacuguaucaccgaacugguacucagagccaagaaggacaaccuggcgaaacagcaacaacagcagcaaaaugacgugguuaaacucacgaagaacaguaagagaaagaagagaugcuguuag

SEQ ID NO: 248161 - RNA, 1530 nt, Artificial Sequence
  Description of Artificial Sequence: Synthetic coding sequence
auggccgccgcugccggaaugcugcuucucggacugcugcaggcaggaggaagcguauugggccaggccauggaaaaggucacuggcggcaaccuucuuaguauguugcugauugcaugugcauuuacccuuucucuugucuaccuuauccggcucgccgccgggcaucugguucaguuaccugcaggggugaaaagccccccauauauauuuucuccgauucccuucuuaggccacgcuauugccuucggcaaauccccgauagaauuccuugagaacgccuacgagaaauauggcccgguguuuuccuucaccauggugggaaagaccuuuacauaccugcuggguucugaugccgccgcccuccuguucaacucaaaaaacgaagaccugaaugcugaggacguguauucccgucucacuaccccaguauuuggaaagggcgucgcuuaugacgucccaaaucccgucuuccuggagcaaaagaaaaugcugaagucggggcuuaauauagcgcauuuuaaacagcauguuucaauuauugaaaaggagacaaaggaauacuuugagucuuggggggaaagcggagagaagaacguguuugaggccuugagugaguuaauaauccugaccgccucccacugccuacauggcaaagaaauuagaucucaacugaacgagaaggucgcccagcuguacgcagaccuggauggcggauucucucacgcugccuggcugcucccagguuggcugccgcuccccagcuuuagaaggcgggacagggcacaccgggaaauaaaggacaucuuuuacaaggcaauccaaaagagacgacaaagccaagaaaaaauugacgauauuuugcaaacccuucuugaugccacauauaaagaugggcggccuuuaaccgacgacgaaguggcggggaugcucauuggucugcuccuggccggacagcacacuucuuccacgacaucagcauggaugggcuucuucuuggcacgcgacaagacccuacaaaagaaauguuaccuggagcagaaaacaguuuguggugagaaccugcccccgcuaacuuacgaccaauugaaggacuugaaccugcuggaccguugcauuaaagaaacgcugagacuucguccgccuauuaugaucaugaugcguauggcucgcacuccacagacaguggcgggcuauacuauuccaccagggcaucaaguauguguuagcccaacugugaaccagcgccuaaaggacagcuggguagaaagacuugauuuuaaccccgauagauaucuccaggacaacccagccucuggggagaaguucgcguacgucccauucggcgcuggcagacaccgaugcaucggggaaaauuucgcauacgugcagauaaaaaccaucugguccacaauguuaagacuguacgaguucgaccugauugauggcuacuucccuacaguaaacuauaccaccaugauucauacgccagagaaccccguuauucgguauaagcggaggaguaaauag

SEQ ID NO: 248162 - RNA, 1080 nt, Artificial Sequence
  Description of Artificial Sequence: Synthetic coding sequence
augaaggcaacaauuauacuguuguuguuggcucagguaagcugggcaggacccuuucagcagcggggccuuuucgacuucauguuagaggaugaggcaucagguauuggaccagaagugccugacgaccgagacuucgaaccuucgcugggccccguuugcccuuuccgaugucagugucaucuuaggguggugcagugcucggauuugggccuggauaaggugccuaaagaucucccuccagauaccacucuccuggauuuacagaauaauaagauuacagagaucaaagauggugacuuuaaaaaucugaaaaaccuacacgcucugauccuggugaacaauaagaucaguaaaguaagcccaggcgcguuuacgcccuuggucaagcuggaacgcuuauaccucucaaagaaccagcuaaaagagcugcccgaaaagaugccuaaaacacuucaggagcucagagcccaugagaacgagauaacaaaaguccgaaaggugacauuuaauggccuuaaucagaugaucgugaucgaacugggaacgaacccguugaaaagcucaggaauugagaauggcgcauuucaggggaugaaaaaauuauccuauauccguauugccgacacaaacaucacuucaauaccacagggucuaccgcccucucucacugaacugcaccucgacgggaacaaaauaucuagaguggaugcagccucccuuaagggucucaacaaucucgcaaagcuugggcugucuuucaacucaauuucugcaguggacaaugggucccucgccaacacuccacaccuaagggaacuccaccuggacaacaacaaacuuacacgcgucccgggaggacuagcagaacacaaguacauccaagugguauauuuacacaacaauaauauuucugucguaggaucuagugauuucugucccccaggacacaacaccaagaaggccucuuacucuggcgucagucuauuuucaaaccccgugcaguauugggagauccaaccgucaacuuuucgaugcgucuauguccgcucagccauucaacugggaaacuacaaauag

SEQ ID NO: 248163 - RNA, 909 nt, Artificial Sequence
  Description of Artificial Sequence: Synthetic coding sequence
augcacuauccaacagcccuucuguuucugauucucgcgaacggagcucaagccuuccgaaucugugcuuuuaaugcucagaggcuaacacucgcaaaagucgcaagggaacagguuauggauacauuagugagaauucuggccaggugcgauauuaugguccugcaggaagugguggacucauccgggagcgccaucccccuguuacugagagagcucaauagauuugacggaagugguccuuacucuacuuuauccucuccacagcuaggccggagcacguauauggagacauacguguacuucuauagaucucauaaaacacagguguuaucuucauauguuuacaaugacgaggaugauguguuugcaagggagccauucguggcacaauucucauuaccuucaaacguguugccuagccucgugcuugugccuuuacacacaacucccaaggcgguugagaaggaauugaaugcucuguacgaugucuuccuugaaguuucacagcacuggcaguccaaagacguuauucuucuaggcgacuuuaaugccgauugcgcgagcuugacuaagaagagacuggacaaguuggaacugagaaccgaaccuggcuuucacuggguuauagcagauggugaggauacuacaguacgcgcaagcacacauugcacauaugauagagugguacugcacggcgagcguugccguucccuccugcacaccgcugcagcauuugacuuucccacaucuuuccagcugacagaagaggaggcccucaacaucucggaucacuacccaguugaaguggagcuuaaauuaucucaagcucauucuguacaaccauuaucucugaccguccuucuccugcugucgcugcucuccccccaacugugccccgcggcauag

SEQ ID NO: 248164 - RNA, 282 nt, Artificial Sequence
  Description of Artificial Sequence: Synthetic coding sequence
augaaacuuuugauggugcucauguuagccgcucucucucaacauuguuaugcugguucuggauguccucuucucgagaacgugaucagcaaaaccauuaacccccaagucagcaagaccgaauacaaagaacugcuucaagaguucaucgacgauaaugcuacuaccaaugcuauagacgagcugaaagaguguuuuuugaaccagacugaugaaacccugucuaaugucgaaguguuuaugcagcugauuuaugauucaagccugugcgaccucuuuuag

SEQ ID NO: 248165 - RNA, 1689 nt, Artificial Sequence
  Description of Artificial Sequence: Synthetic coding sequence
auggacgccaugaaaagaggccuaugcugugugcugcugcucugcggggcagucuuugugucaccaucucaggagauccacgcucgguucagaagaggagcaaggagcuaccaaguaaucuguagggacgagaaaacucaaaugaucuaucaacagcaccagucuuggcuacgccccgugcugagaucaaauaggguugaguacugcugguguaauucugggcgugcccaaugucauaguguuccuguaaagaguugcagugaaccccgguguuucaauggaggcaccugccaacaagcgcucuacuucagugauuuugugugccaguguccagaaggguucgcagguaaaugcugcgagaucgacacacgggcuaccuguuaugaggaccaaggcauaagcuaccgcgggacuuggucaacugcagagucaggcgcugaguguacgaacuggaacucuagcgcccuggcccagaagccuuacagcggucggcggcccgaugccauccgccugggacuuggaaaccacaacuacugucggaauccagaccgggauaguaagccuuggugcuauguauuuaaagcaggcaaauacucaagcgaauuuugcaguaccccagcaugcucggaagguaauagcgauuguuauuuuggcaauggcagugccuaccguggaacccauucccugaccgaaagcggcgcuuccugccucccuuggaacuccaugauucugaucggaaaagucuauacugcgcagaauccuucagcccaggccuuagggcucgguaagcauaauuacuguagaaaucccgauggcgaugccaaaccguggugccacguucucaaaaaucguagacuuacgugggaauacugcgaugugccaagcugcagcacauguggacugcgucaauacagccagccucaguucagaauuaaagguggccuguucgccgauauugccagucauccuuggcaggccgccaucuucgcaaaacaccgcaggagcccaggggagagauucuuguguggcggaauucuaauuuccaguugcuggauucuguccgccgcccacuguuuccaagagcgauucccgccgcaccaucugaccguaauucugggcagaacuuacagaguagugccuggagaggaggagcagaaguucgagguggaaaaguacaucgugcauaaagaauucgacgacgacacauacgacaacgacauugcucuucugcagcucaagucugauucuucacggugcgcccaggaaaguagcgugguucguacagugugcuugcccccagcugacuugcagcucccagauuggacugagugugaacucuccggcuacggcaaacaugaggcauuaucccccuuuuacuccgaacgucugaaagaagcccaugugaggcuauacccaucuucacgcuguacaagccaacaccugcugaaucggacggugacagauaacaugcugugugcaggcgacacacgguccggcggaccucaagcuaaccuccacgacgccugucagggcgacuccggcgggccccucgugugccugaaugacggcagaaugacacuggugggcauuauuagcuggggucugggcugugggcagaaggacguuccugguguuuacacuaaagugacaaacuacuuagacuggaucagagauaauaugaggccguag

SEQ ID NO: 248166 - RNA, 5286 nt, Artificial Sequence
  Description of Artificial Sequence: Synthetic coding sequence
augcaguuccaguuaacccucuuucugcacuuaggauggcugaguuacuccaaggcccaggacgacugcaaccgaggugcuugccacccuacuaccggagaccuccucgucgggagaaauacccaguuaauggcuucauccacuugcggacuuucuagggcucagaaguauugcauacugucuuaucuggagggagaacagaaguguuuuauuugugauagcagauuuccauacgaccccuacgaccagccuaauucccauaccauugaaaauguuauuguaaguuucgaacccgaucgggagaaaaaaugguggcagucagagaacggguuggaucacguuagcauucgauuggaucuggaggcacuuuuccguuuuucccaucucauccucacuuuuaaaacuuuuaggcccgccgccaugcugguggagagaaguacagauuacgggcauaacuggaaggucuuuaaguauuuugcaaaagauugugcgacuucuuucccaaacauaaccucgggccaagcucagggugucggcgacaucguaugcgacuccaaauacagcgauaucgaaccaucuaccgggggcgaaguuguccuaaaaguacuggaccccuccuucgaaauagaaaacccauauuccccguauauccaggaccugguuaccuugacuaaccuaagaauaaauuucacuaaguugcauacccugggcgacgcccugcuuggaaggcggcaaaaugauucacuagauaaguauuacuaugcucuuuaugagaugauugugcgugggucuugcuuuugcaauggccacgccuccgaaugccgccccaugcagaaaaugcguggggacguuuuuuccccccccgguauggugcacggacagugcgucugucaacauaauacggaugggcccaauugcgagagauguaaagauuuuuuucaagacgcucccuggagaccagcagccgauuugcaggauaaugccugucgcucuuguucuuguaacucucacagcucccgcugccacuuugacaugaccacauaucuggcuucagguggucucagugggggcguaugcgaagauugucagcacaauacggagggucagcacugugaucgaugccguccccuuuuuuaccgcgacccucucaagacaaucagcgacccguaugccuguauaccuugcgaaugcgauccugaugguacaauuaguggaggcauuugugucagccacucugaccccgcucugggaucaguugcagggcagugccugugcaaagaaaacguggaaggagcuaaaugugaucagugcaagccgaaccauuaugggcuuuccgcuacagacccucucggaugucagccuugcgauuguaauccauuggguaguuuacccuuucugacgugcgauguggauaccgggcagugucucugucugagcuacgucaccggugcacacugcgaggaaugcacgguggguuacugggggcucgguaaucaucugcauggcugcucccccugcgacugugacauuggaggagcuuacagcaaugugugcuccccuaagaauggucaaugugaaugucggccucacgucacaggccguuccugcuccgagcccgcuccgggcuauuuuuuugcgccccugaacuuuuaccuuuaugaggcagaagaggcaacaacguugcagggucuugccccccuggguagugaaacuuucggucaaucgccugccguccacgugguacuuggugaaccagugccuggaaauccagugacuuggacagggccgggauucgcgcgcgugcuaccaggagccggguuacgauucgccgucaauaacauuccuuuuccaguugacuucaccauugccauccauuacgagacccagucugcggcugacuggaccguucaaaucgucgugaauccuccuggcggcuccgagcacugcauccccaagacccuccagucuaagccacagagcuucgcucugcccgcugcuacucgaauaaugcuauugccaaccccuauuugccuggagccugaugugcaauauagcaucgaugucuacuucucccagccccugcagggagaaucacacgcccauucucauguccugguggacagucucggucucauaccccagauuaacucucuggaaaacuuuugcucaaaacaggaucucgacgaauaucaauugcacaauugcguggaaaucgcuagcgcuauggggccgcaaguucugccaggcgccugugaaaggcugaucauaucaaugucugcuaagcugcaugauggugcugucgccuguaaaugucacccacaagggucggugggcuccuccuguucacggcuaggcggccagugccaguguaagccgcuggugguagggcguugcugcgacagaugcaguacaggcagcuacgaccuugggcaccacggaugucaccccugccacugucauccccagggguccaaagauacagugugugaucaggugacuggucagugcccgugucacggugagguuucaggccgccggugugaccgcuguuuggccggcuauuuuggcuuuccuucaugucacccuugcccuugcaaccgguuugccgaacuuugcgaccccgaaacaggcuccuguuuuaacuguggagguuucacaacaggucgcaauugugagaggugcauagauggguauuacgggaauccuucuagcggucaaccguguaggccaugccuguguccugaugacccuuccagcaaccaguacuucgcccauagcuguuaccagaaucuguggucuucggaugucauaugcaauugucuccaggguuauaccggaacacaaugcggggaaugcaguacugguuucuacggaaacccucgcaucucuggcgcuccuugucagccaugugccugcaauaacaacaucgaugucacugauccugagaguugcagccgagucacgggggagugcuuaaggugucuccacaauacacaaggcgccaauugucaguugugcaaaccuggccacuauggcagugcucugaaucagacuugucgucgaugcuccugccacgcuuccggcguaucucccauggaauguccccccgggggcggugcaugccuuugcgauccagugacuggugccugccccugucuccccaauguaaccggccucgcaugugaccggugugccgacggguacuggaaucuggugccggggagaggcugccaaucaugugauugcgaccccaggacuucucagaguagccauugcgaucaauugacuggucaguguccuugcaagcugggcuacggagggaaacgguguucagagugucaggagaacuacuacggugacccaccaggcagguguauccccugugacuguaaccgugccgggacccaaaagcccauuugcgauccugauaccgggaugugucgcuguagagagggcgugucgggacagagaugugauagaugugcccguggccacucucaagaguuucccacuugucugcaaugucaucugugcuuugaccaaugggaccauaccaucucgucuuugaguaaggccgugcagggacucaugcgguuagcugcuaacauggaggauaagagagaaacucugccugugugcgaggccgauuuuaaggauuuaagggggaauguaucagaaaucgaaaggauucucaaacaccccguauucccuaguggcaaguucuuaaaagugaaggacuaccaugacucugugcggaggcagauuaugcaacuuaaugagcaacugaaggcgguguacgaauuccaggaucuaaaagauacuaucgaaagggcgaaaaacgaggcggaccuccuccuugaggaccugcaagaagaaauugaucugcagagcucagugcugaacgcuuccauagcggacagcuccgagaauauuaaaaaguauuaccacaucuccagcagugcagagaagaagauuaaugaaacgucauccaccauaaauacaagcgcaaauaccagaaaugaucuccucacaauucuggacacucuaacuaguaaaggaaaucuaucccuggagcgacugaaacagaucaaaauuccugauauccaaauucugaacgagaaaguguguggcgacccugguaacguucccuguguuccacuaccuugcgggggugcccucugcaccggacgcaaaggucacaggaagugucggggaccaggaugccacggcaguuugacccucucaaccaacgcucuucagaaagcccaggaggcuaaaaguaucauucgcaaccuugacaagcaggugcgcggccuuaagaaucagauagaaucgauuagcgagcaggcagaagucucgaagaacaaugcauuacaauuacgagagaagcucggaaacauaaggaaucagucagauagcgaagaggagaacauuaaccuguucauuaaaaaggugaaaaacuuccugcuggaggaaaacgugccuccugaggacauugagaaaguagcuaacggcguguuggacauccaccugccaaucccaagccagaaucuuacagacgaacuggugaaaauucagaagcacaugcagcugugcgaggauuacagaacugacgagaaccggcucaaugaggaggcagacggagcucaaaaauugcucguuaaggcaaaggccgcggaaaaggccgccaacaucuuauuaaaucuggauaaaacuuugaaucagcugcagcaggcucagaucacacaaggccgagccaauaguaccaucacgcaguugaccgcuaacauuaccaagauuaagaagaacgugcuucaggcggaaaaccagacacgugagaugaaaucugagcuggagcucgccaaacaacgguccggccuggaggauggauuaucacucuugcagacaaaguugcagcggcaccaggaucaugcgguaaacgcaaaagugcaggcugaguccgcacagcaccaagcaggaagccucgaaaaggaguuuguggaauugaagaaacaguacgcaauucuccagcggaaaacgucuacgacgggccugacuaaggagacacucggcaaagucaagcagcugaaggaugccgccgaaaagcuggcaggggauacagaggccaagauucggcguaucacugaccuugagaggaaaauucaggauuuaaaucugagucgacaggcuaaagccgaucaacuccggauccuugaggaccagguggucgcuauaaaaaacgagauuguggagcaggagaaaaaguaugcucgcugcuacucuuag

SEQ ID NO: 248167 - RNA, 798 nt, Artificial Sequence
  Description of Artificial Sequence: Synthetic coding sequence
augaugaccaugaccacgauggcagacggccuggaaggucaggauucuucuaagucugccuucauggaauuuggccagcagcaacagcagcagcauagucccgcgauggcaggggcgcauuacccacugcacugccuacacucugccgcagccgccgcagcagcaggcucccaccaccaccaucaccaccagcaucaccaucacgguaguccauaugccuccggcgguggcaauagcuauaaucacaggucgcuggccgccuauccauauaugagccacagccagcacucaccauaucuccaaucauaccauaauucuuccgcugccgcucagacucgaggcgacgacacagaccagcagaagacaacagucaucgagaauggagaaaucagauuuaacggcaagggaaagaagauacgaaagccacguacaauauacaguucuuuacaacugcaggcucucaaccauagauuccaacaaacacaauacuuagcucuuccugaacgagccgaguuggccgccagccuuggauugacucagacccaaguuaagaucugguuccagaacaaaagaaguaaauucaagaagcuucugaaacagggaucaaacccccacgagucugacccccugcaggggagcgccgcacuguccccaagaagucccgccuuaccuccagucugggacguaucagccucugcuaaggggguuuccaugccuccaaauagcuauaugccaggauauucacauugguauucuagcccacaucaagacaccaugcagcggccucagaugauguag

SEQ ID NO: 248168 - RNA, 1563 nt, Artificial Sequence
  Description of Artificial Sequence: Synthetic coding sequence
augccagccagcgaacucaaggccucggagaucccuuuucacccaucuauuaagacacaggacccaaaagccgaagaaaaaagcccgaagaagcagaaagugacccuuaccgcagcugaggcucugaaauuauuuaagaaucagcugucaccuuacgaacaaucugaaauuuugggguacgccgaacucugguuucugggccucgaagccaagaaacucgauacagccccugaaaaguuuucaaaaacaaguuucgacgacgagcauggguucuaucugaagguacugcaugaucacauugcuuaucgcuacgaaguuuuggagaccauugguaagggcagcuuuggacaaguugcuaaaugucuagaccacaagaauaaugaacugguggcauuaaaaauuauuagaaacaaaaagagauuucaccagcaggcccuuauggagcucaagauccuggaagccuugcgaaagaaagacaaggacaauaccuacaacgucguccauaugaaggacuuuuuuuacuuccgcaaucauuucuguauuacauuugaacugcuuggcaucaaccuauaugaguuaaugaaaaacaacaauuuucagggcuucucccuguccaucgugagacgguucacacugucgguccucaagugcuugcaaaugcucagcguggagaagaucauucauugugauuuaaaacccgaaaacauaguccuguaucaaaaaggccaagcguccguuaaaguuaucgacuucgguuccucuugcuacgagcaucagaaaguuuacaccuauauccaaucgcgguucuauaggucacccgagguaauucuggggcaucccuacgauguggcuaucgacauguggucuuuaggcuguaucacugcugaguuauauacaggguauccucucuuuccuggcgaaaacgaaguugaacagcuggcuugcauuauggaggugcucggccuccccccugcuggcuucauacaaaccgccucaagacgccagaccuucuucgacuccaaaggcuuccccaagaacauuacaaauaacagggggaaaaagagauacccugauagcaaggaucugaccaugguucugaagacauaugauacuucauuucuggacuuucugagaaggugucugguaugggaaccuagucugagaaugacccccgaucaagcucugaagcacgcauggauacaccagucaagaaaucuaaagccccagccccgcccucagacacugcggaaaaguaauaguuucuuuccaagcgaaacacgaaaagauaaggugcagggcugucaccacucuucucggaaggcagacgagaucaccaaggaaaccacagagaaaacaaaagauucaccuaccaagcaugugcagcacuccggcgaucagcaagacugccuucaacauggagcugauaccguucagcucccccagcucgucgaugcucccaagaaaagugaggcagcugugggcgcagagguuagcaugacguccccaggucagagcaagaauuuuagucucaagaacacgaacgugcuuccaccaauaguguag

SEQ ID NO: 248169 - RNA, 2619 nt, Artificial Sequence
  Description of Artificial Sequence: Synthetic coding sequence
augaguuccaaggcggaaaaaaagcagagacuuuccggacgggguucgucucaagcuaguugguccggcagagccacaagggccgcugucgccacucaagagcaaggcaaugcuccagccgugucugagccagaguuacaggcggaauuacccaaagaagaaccugaaccuaggcucgaggguccucaggcucaguccgaagagucaguugagccugaggcugacgugaagcccuuguuccugagcagggcagccuugacuggguuagcagacgccguuuggacccaggagcaugaugcaauccuugaacacuucgcacaagaccccacagaaucuauccuuacgauuuuuaucgauccauguuucggacugaaacuggaacugggcaugcccguccagacacagaaccagcuagucuauuuuauccgccaggccccugugccuauuacuugggagaacuucgaagccacugugcaguucgggacuguuagaggaccauacauccccgcacuuuugagacugcuaggaggcguguucgcuccucaaauauuugcgaacacuggauggcccgaaucaauaaggaaccacuuugccucgcacuugcacaaguuccuggcuugccucacugauacaagauauaaacuugaaggccacacaguacuuuauaucccagcugaggcaaugaacaugaagcccgaaaugguaauuaaggacaaggaauuaguccagcggcucgagacaaguaugauccauuggaccagacagaucaaagagauguuaagcgcccaggaaaccguagagaccggcgagaaccucgguccucucgaagaaaucgaauuuuggagaaauagauguauggaccugaguggcauuucuaaacaacuugugaagaagggugugaagcacguugagucgauucugcaucucgcuaagagcucuuaccucgccccauucaugaaauuggcccaacagauccaagacgggucaaggcaggcccagucuaaccugaccuuccucaguauucugaaggagccuuaccaagagcucgcauucaugaagccuaaggauauaucgucgaagcugccaaaacuuauuucucucauccgaaucauuugggucaacucuccacacuauaacacgcgggaacgacugaccucucuauuccgcaaaaugagcaacgagaucaucagacugugcugccaugccauuuccuuggaccguauauucgaagguuaugugagcucguccaaagaggaucuucagggauguauucugugcugucaugcguggaaagaccauuauguccaggccgugcagaugcacauacaguucucuucucggggcugggugcucgaucagacuucgauauucgcacaggucgaugcauuuguacagagguguaaggaccucauugaagugugcgacugccaauaucacuucgcucgcugggaagauggaaagcaggggccccugccaugcuucuucggagcccagggaccccagaucacaaggaaccuguuggagauugaagauaucuuucauaagaacuugcacacacuucgcgccgucagaggggggauucuagaugucaaaaauaccuguuggcacgaggacuacaacaaguuuagagcugggauaaaggaucuggaggucaugacacaaaaucugaucacuucugccuucgagcucguacgcgacguuccccauggaguucugcuguuagacaccuuucaucgauuggcaucucgggaagcuauaaagcgaacauaugacaaaaaggcgguagaccuguauaugcucuuuaacuccgagcucgcccuggugaaucgcgaacggaauaaaaaauggccagaccuggagcccuacgucgcgcaauauaguggcaaggcuagauggguccauauccuccggcgaaggaucgauagggucaugaccugccucgcuggcgcgcauuuccugccuaggaucggaaccggcaaggaaucugugcauacauaucaacaaauggugcaggccaucgacgaauuggugaggaaaaccuuccaagaguggacuucgucucuggacaaggauuguaucaggcgccuggacaccccccucuugcguaucucccaagagaaagcagggauguuggacguaaacuucgacaaguauaggucucaucuggccccuuucccuuauacaccacugcuccagcuuucucaggaguuucacagccaccugcuaacgccccucuucauaauuuugucauuaagucauacuauuugccuucucaguucuuuuuacuucuuuuucaguagcuucaucuuuguaagcccucacuuacccccguguuaccagcacuucaacuuuaccacauaccugaagacacagcagaacaagacuaugaucggccaggcccgauggcucaccccugugauaccugcucucugggaagccgaagucggugccucgcuugaaccaagauccuugcggacggcuugggcaacguggcagaacccugucucugcgaagaauaccaagaucucaugggcuugguggcauaaaccaguggugucggcuaccugggagggugaggucggcgggucuccagagccaggacggcaacgccuccaguag

SEQ ID NO: 248170 - RNA, 2592 nt, Artificial Sequence
  Description of Artificial Sequence: Synthetic coding sequence
auggcccgcagaaguuccuuccaaaguugucaaaucauuucucucuucacuuucgccguggggguaaauaucugucucggguucacugcccauagaauaaagcgggcagagggcugggaagaaggcccgccuacaguccuaucagauagcccuuggacuaacauuuccggaaguuguaaaggacgcuguuucgagcuccaggaagccggucccccugacugccgcugugacaaccucuguaagucuuauaccuccugcugucaugauuucgacgagcugugcuuaaagaccgcgcgcggcugggaaugcaccaaagaccgguguggggaggugcgcaaugaggaaaacgcgugccacuguagugaggacuguuuggcccggggggauugcugcacaaacuaucaggucguguguaaaggugagagucacugggucgaugaugacugugaggagauuaaggccgccgagugccccgcaggguucguccggcccccucucauuauauuuagcguggauggcuuucgcgcaaguuacaugaagaagggcucgaaaguuaugcccaacauugaaaagcuaaggagcugcggcacgcauucucccuauaugagaccugucuaucccacgaagacuuuuccuaaccucuauacuuuggccacaggguuguacccagaaucucacgggauagucggaaacagcauguaugaccccguguucgacgcuaccuuccaccuucgcggacgugaaaaauuuaaccaucguuggugggggggacagccuuuguggauuaccgcuaccaagcagggcgugaaggccgggacuuuuuucuggucggucguuaucccucaugagcgcagaauauugaccauacugcaguggcuaacucugccugaucaugagagaccuuccgucuaugccuuuuacagcgagcaacccgauuuuuccggccauaaguacggccccuucggucccgagaugacgaacccucugcgcgaaauagauaagaucgucggccagcuaauggaugggcucaaacagcugaaacuccaccgcugugucaacgugaucuucgugggagaucacggaauggaagauguuacaugcgaccgaaccgaauuccuuucuaacuaccuuacaaauguugaugauaucacucuggucccaggaacccuuggacggauccggaguaaguucuccaacaaugcgaaguaugacccaaaggccauaauagcuaaccugacuuguaagaagccagaucagcauuucaaaccguaucucaagcagcaccugccuaagcgccugcacuacgccaauaaucggagaaucgaggauauucaccuguugguagaaagaagguggcacguggccagaaaaccauuggacguguauaaaaaaccaucagggaaauguuucuuccaaggcgaucauggauuugacaacaaggugaauuccaugcaaacugucuucgugggguacggcuccaccuuuaaauacaaaaccaagguuccuccguucgagaauauagagcuuuacaacgugaugugugaucuguugggacuaaaaccugccccuaacaacggcacucacggcagccugaaucaucugcuacggacaaauacuuucaggccgacaaugcccgaggaagucaccaggccuaauuaucccgggaucauguaccuucaguccgauuuugaucuuggcugcacuugcgaugauaaaguugaacccaaaaacaagcuagacgaacugaacaagcggcugcauaccaaaggaagcaccgaagaaagacaccucuuguacgggcguccugcggugcuauacagaacucguuaugauauccuguaccauaccgacuucgagucaggcuacucagagauauucuugaugcccuuguggacuucuuacaccguaagcaaacaggcggaagugucaagugugcccgaccaccugacaagcugugugagaccagauguccgcguaucccccuccuuuucacagaauugucuugcuuacaaaaacgauaaacaaaugaguuacggcuuucuuuucccacccuaucugucuuccucucccgaagccaaguaugacgccuuccucgugacaaauaugguccccauguaccccgccuucaaaagggucuggaauuauuuucaaagagugcuggugaagaaauaugcuucggaaagaaauggcgucaacguuaucagcgggcccauuuucgauuacgacuaugacggucuccaugacacugaggauaaaauuaagcaguacgucgagggaucauccauucccguaccuacacauuacuauagcauuauaacuucgugccucgacuuuacacaacccgcagauaagugugauggacccuuaagcgucucuucguucauucucccacauaggccugauaaugaggagucuuguaacagcucugaggaugaguccaaguggguggaggaguuaaugaaaaugcacaccgcucgagugcgugacauugaacaucugaccucacuggacuuuuucaggaagacuagcagguccuauccugaaauccugaccuugaagaccuaucuccauacuuacgaaagugaaaucuag

SEQ ID NO: 248171 - RNA, 1332 nt, Artificial Sequence
  Description of Artificial Sequence: Synthetic coding sequence
augcuccccugcgcaucuugccugcccggcagccuucugcuuugggcucucuugcuccucuuacuagguucagccagcccccaagacucugaggaaccagacuccuacaccgagugcacugauggauacgaaugggaccccgacucccagcacugccgagauguaaacgaaugucugacuaucccggaggccugcaagggagaaaugaaauguaucaaucacuauggaggauaucuaugucucccucgcagugccgcagugauuaaugaccuccauggcgagggccccccaccgcccguaccccccgcacaacauccaaacccuugcccaccaggauaugaaccagaugaccaggacuccuguguugauguggacgagugcgcucaggcucugcaugacugccggcccucacaggauugccacaaccucccgggaaguuaccaaugcacaugcccggauggauauaggaagauaggucccgaauguguggacaucgaugaauguagguaccgguauugucagcauaggugugucaaccucccagguucuuuccgcugucaaugcgagccuggguuucagcugggcccuaacaaccguuccuguguugacguuaaugaaugcgauaugggggcccccugcgagcaacgguguuucaacucauaugguacuuucuugugccgcugccaccagggguacgagcugcaucgggacggcuucucuuguuccgauaucgacgaaugcucuuacucuaguuaccucugccaguacagaugcaucaaugagccgggaagguuuucaugucacugcccucagggcuaccagcugcucgcuaccagauuaugucaggauaucgaugagugugaaucaggagcccaccagugcucggaagcucagaccugugugaacuuccacggaggauacagauguguggauacuaaccgauguguggaacccuauauucaggugucagaaaaccguuguuugugccccgcuagcaacccuuugugucgcgaacagccauccuccauugugcauagguacaugacaauuacaucggagcgcucuguaccugcagacguguuucagauucaagcuaccuccgucuauccaggggcguacaaugcauuccaaaucagggcuggaaacucucagggggauuuuuacaucagacagauuaauaaugugagcgcuaugcugguucucgcccguccugugacuggcccuagagaguacguucuagaccucgaaauggugaccaugaacucucuaaugaguuaucgcgccucuucggucuuaagacucaccguguuuguaggugccuauacguuuuag

SEQ ID NO: 248172 - RNA, 609 nt, Artificial Sequence
  Description of Artificial Sequence: Synthetic coding sequence
augcuccccugcgcaucgugucuaccagggagccuucuccucugggcucuacuucuccugcugcucggguccgccucgccgcaagacuccgaagagccagauuccuauacugagugcaccgacgguuaugagugggauccugauagucaacauuguagagaugugaacgagugucugacuauuccugaagcguguaaaggagagaugaaaugcaucaaucacuacggcggguaccucugucugcccaggucagccgccgucauaaaugaccugcacggggaagggccaccccccccagugccaccugcacaacaucccaaucccuguccucccgguuacgagcccgacgaucaggacucaugcguggacguugacgaaugcgcccaggcacuucacgacugccgccccucccaggauugccacaaucuuccaggaagcuaucaguguacuugcccagacggauaccgaaaaaucggcccagaauguguggauauagaugagugucgcuacagguauugucaacaccggugcgugaaucuuccgggaagcuuucgcugccagugugagcccggauuccagcuagggccaaacaacagaucauguguguag

SEQ ID NO: 248173 - RNA, 552 nt, Artificial Sequence
  Description of Artificial Sequence: Synthetic coding sequence
augcuaccuugugccucaugucugcccggaucucuccuguuaugggcgcucuuguugcuccugcugggcuccgcuucaccccaggacuccgaggaacccgacaguuauacagaauguacugacggcuacgagugggaucccgacucucagcacugccgcgaugucaacgaauguuuaaccauccccgaagcauguaaaggugaaaugaaguguaucaaucauuacggaggcuauuugugccuuccucgcagcgccgcugucauuaacgaccugcauggggaagggccacccccuccgguucccccggcccaacauccaaauccgugcccuccuggauacgaaccagaugaccaggacucauguguugacguggacgaaugcgcccaggcccuucacgauuguagaccuucacaggacugccacaaucugccaggauccuaccaguguacauguccugacggauacagaaagaucggacccgaauguguggacaucgacgagugucguuaucgguacugucagcacaggugcguuaaucuuccuggaaguuag

SEQ ID NO: 248174 - RNA, 1332 nt, Artificial Sequence
  Description of Artificial Sequence: Synthetic coding sequence
augcugcccugugccagcugccucccaggaucucuacucuugugggcacugcuucuucugcuccugggaucagcuucaccucaagauucugaggagccagacagcuacacugaaugcacugauggcuacgaaugggacccugacucccagcacugcagagacgugaacgagugucugacaauaccggaggcauguaaaggggagaugaagugcaucaaccacuaugggggcuaucucugucuuccgcggagugcagccgugauaaacgaccuucacggugaaggaccccccccuccuguuccaccagcgcagcacccaaacccauguccgccaggguaugaaccugacgaucaggauagcuguguggacguugacgaaugugcccaggcucuucacgacugccgaccuucccaggauugccacaaccucccuggaagcuaucaaugcaccuguccugauggguaccggaagaucggaccugaguguguggacauagaugaauguagauacagauauugccagcaccggugcgucaaccuacccgguucuuuuagaugccagugugagcccggguuccaacucggcccaaacaauaggucauguguggauguuaacgagugugacaugggugcuccuugcgaacaacgcugcuuuaauuccuacgguacauuucugugccgcugucaucaaggauacgaacuucaccgggauggauuuagcuguucugauauagacgagugcucauauucuagcuaucucugucaguaucgauguaucaacgaacccggucgguuuagcugccauuguccucagggcuaccaacugcucgccacacgguugugccaagacauugaugaaugcgaaaguggcgcgcaucagugcucagaagcccagacaugugugaauuuccacggaggcuacagauguguugauacuaaucgguguguggagccguacauccaagucagcgagaaucgaugcuuaugcccugcuagcaauccucucugucgcgagcaaccuucaucuaucgugcaccguuauaugacgauaacuucggagaggagugugccagcagauguuuuccagauccaggccacuuccguuuacccaggggcguacaacgcauuccaaauacgggccggcaauucucagggggacuuuuauaucagacaaaucaacaaugugucagcgaugcugguucuggcgcggccugucacgggaccccgcgaguacguucuggaccucgaaauggugacaaugaacagccuuauguccuacagggcaucuuccguucugcgucuuacagucuuugucggagcuuacaccuucuag

SEQ ID NO: 248175 - RNA, 3018 nt, Artificial Sequence
  Description of Artificial Sequence: Synthetic coding sequence
auggcuccugcgaggggccggcuccccccagcccugugggucgugaccgcugcugcugccgcugcgacaugcgucucugcagcaagaggcgaggugaaucugcuggacacaucaacaauucacggugacuggggauggcugacauacccagcacacgggugggacucgaucaaugaaguggaugagaguuuccagccuauccauacauaccagguguguaacguuaugucaccuaaccagaacaauugguugagaaccagcuggguaccaagagacggcgcucggaggguguacgccgagaucaaguucacccugagggacugcaacucuaugccaggggugcugggcacauguaaagagaccuuuaacuuguauuaccuagagucugaccgugaccugggggcuuccacacaggagagccaguuccugaaaauugacacaaucgcggcagaugagaguuuuacuggagcugaucugggggugagacgacucaagcugaacacugagguuaggagcguagguccacucucaaagaggggcuucuaucuggcauuucaggacauaggggccugccuugcuauacugagccugaggaucuacuauaaaaaauguccagcgauggugcggaacuuggccgcauucucagaggcuguuacuggggccgauaguuccagucugguggaaguucgaggucagugcgugcgccacucagaggaaagggauaccccaaaaauguacuguucagccgagggagaguggcuugugccuaucgguaaguguguuugcagcgcaggauaugaggaaaggagggacgcaugcgucgcaugugaacucggauucuauaaaucugcccccggagaucaguugugcgccagaugcccuccacauucacacuccgcagcaccugcagcccaggcuugucauugugaccuguccuauuaucgcgccgcucuggaucccccguccucugcuugcacccgcccaccaucugccccgguuaaucucauaaguuccgucaauggaacaucuguaacauuagaaugggcaccuccgcuggaucccgguggucgaagcgauaucacuuacaacgcggugugcagacguugcccuugggcacuuagccggugcgaagccuguggguccgguacacgguucguuccucagcagacgagcuuaguucaggcuucgcugcucguggccaaucugcuugcucauaugaacuacagcuuuuggauagaagcagugaauggggucuccgaccuuucucccgagcccagaagagccgcugucgugaauaucacuacaaaccaggccgccccgucucaggucguuguuauucgucaggagcgggccgggcaaaccuccgugagccugcuauggcaagagccugaacagccuaauggcaucauccuggaauaugagaucaaauacuaugaaaaagacaaggaaaugcagucuuauuccacacuaaaggccguaacuacccgggcuacgguuucuggccugaagcccgggacacguuacguuuuccagguaagggcucggacaucugcuggcuguggacgguucucccaagcaauggagguggaaacagguaagccuagaccacgcuaugacaccagaacgaucguguggauuugccucacguuaaucacaggauugguaguucugcucuuacugcuuaucugcaaaaagcgucacugcggguauucuaaagcauuucaggauuccgaugaggaaaagaugcauuaccagaauggucaggcucccccucccguuuuucuuccccuccaccacccaccgggcaagcugccagagccccaguuuuacgcagaaccacauaccuacgaggaaccugggcgcgcgggacggagcuucacccgggagaucgaagccucucggauucacauugagaagauuaucggguccggagauucuggagagguuugcuacgggcgccugcguguacccggacagagagauguccccguggccaucaaggcguugaaagccggguauaccgagcggcagcgaagagacuuucuuucugaagcuaguaucauggggcaguuugaucaccccaauauaauacgucucgaaggaguggugacgcgcgggcguuuggccaugauaguuaccgaguauauggagaaugggucacucgauaccuuccugaggacccacgacggacaguucacaaucaugcagcugguugguauguugcggggggucggagccgggaugcgauaucucagugaccucggauauguacaucgggaccucgccgcucggaauguacuagucgauaguaaccuaguguguaagguuagugacuuuggacucucccggguccuggaagacgauccugaugccgcguacacuaccaccgggggcaaaaucccaaucagauggaccgccccagaggcgauagcauuuagaacuuucucuuccgccucggacguuuggucuuucggcgugguaaugugggagguguuggccuacggagaacggccguauuggaacaugacuaaucgggacgucaucuccuccgucgaagaaggcuaccgcuugccagcgccgaugggcugcccacacgcgcugcaucagcuuaugcuagacuguuggcacaaggaucgcgcacagaggccucgauucucucaaaucguauccguguuggacgcacucaucagaucccccgaaagccugcgagccacagcuaccgucucucguugcccaccaccugcuuuuguucggucauguuuugaucuuaggggaggaucuggagguggggguggucucacggucggagauuggcuggacuccauccgaaugggccguuacagggaccauuuugcugcuggaggguauuccucccuuggcaugguacugcggaugaaugcccaggacgugagggcccucgguauaacacucaugggacaucagaaaaaaauccucgguucuauucagacuaugagggcccagcugacuucaacccaaggcccacgucgccaucuguag

SEQ ID NO: 248176 - RNA, 1653 nt, Artificial Sequence
  Description of Artificial Sequence: Synthetic coding sequence
augagcacaagcucuuugaggaggcagaugaagaacauuguccauaacuacuccgaagcugaaaucaaagugcgcgaggcaacuuccaaugauccgugggguccauccagcucucuaaugagugagauugccgaccugacauacaaugugguggccuuuucugaaauuaugaguaugaucuggaaacggcuaaaugaucacggcaaaaacuggcggcacgucuacaaggccaugaccuuaauggaguacuuaauuaagacaggcucugagagagucagucagcaguguaaggaaaacauguacgcggugcagacccuaaaggacuuucaauacguugaucgugaugggaaagaucagggcgucaacguccgagaaaaagccaaacagcuagucgcacucuugcgcgaugaagaccgucuucgcgaggagcgggcacacgcacugaaaacgaaggagaagcuggcucagacggcaaccgcgucuuccgccgccguagggucugggccuccaccugaagcugagcaggcauggccucagaguuccggcgaggaagaguugcagcugcagcucgcucuggcuaugaguaaagaagaagccgaucaagaggagagaauccgccggggggacgacuugcgacuacagauggcaaucgaagaaucgaagagagagaccggagguaaggaggagaguucacugauggaccuugccgacguguuuaccgccccggccccggcacccacuacugaucccuggggcgggccugcaccaauggccgccgccguaccgacagccgcaccuacaucggacccuuggggaggacccccggugccacccgcugcagaccccugggguggacccgcacccacacccgcauccggugacccuuggcgcccagccgcaccugccggacccucuguagauccuugggggggcacucccgcuccagcagcuggcgaggggccuacccccgacccuuggggcuccagcgacggaggugucccuguuagcggccccucugccuccgauccuuggaccccagcuccugcuuucucugauccuuggggagguuccccagccaaacccuccacuaacggaaccacggcagguggauucgauaccgaaccagacgaauuuucugacuucgaccgccugaggacugcccuacccacuucggguucaucggcuggggagcuggaguugcuggcgggcgaaguacccgcgcgguccccuggcgccuuugauaugaguggcgugagaggaucccucgcagaagcugugggcuccccuccuccggccgccaccccuacgccgacccccccaacuaggaaaaccccagaaaguuuucugggcccaaaugccgcccugguggaccuugauucacuggugucgcggccaggcccaaccccacccggcgccaaagcuucaaacccauuucuucccggcggcggacccgccacaggcccaagcguaacaaaucccuuucaaccugcgccccccgccacucuuacacuaaaccaacugcggcuguccccuguucccccaguuccuggcgccccgccaacauacaucucuccccucgggggagggccuggcuuaccgccaaugaugcccccaggacccccugcacccaacacuaaccccuuucugcuguag

SEQ ID NO: 248177 - RNA, 1272 nt, Artificial Sequence
  Description of Artificial Sequence: Synthetic coding sequence
augagcucucaggugguggggaucgaaccgcucuauaucaaagccgagcccgcuagcccagacaguccaaagggcagcuccgagaccgagacagagccacccguagcacuggcaccuggacccgcccccacaagaugccucccaggccauaaagaggaggaagauggggaaggggcaggaccuggagagcagggcggaggaaaacucgugcuuucaagucuaccgaaacgcuuaugccugguguguggggauguugccaguggguaccauuacggcguggccagcugugaggccuguaaggccuucuucaaaagaaccauucaaggaucaauugaauauucuugcccugcuucaaacgaaugugaaauuacaaagcgccggcguaaggcgugccaggcaugcagauucacgaaaugccuccgaguggggaugcugaaggagggcguccgucucgaucgcguaagaggaggacggcagaaguauaagcgcaggccugaagucgacccacugcccuuuccuggccccuuuccugcaggcccccuggcgguggcaggggguccccgcaagacugccgcccccgucaacgcacuugugucccaccuguugguagucgaaccggaaaaacuguaugcgaugccagacccagcuggucccgauggacaccugccugcugucgccacucugugugaucuguuugacagggagaucguggucaccauaucuugggcuaagucaaucccaggguuuagcagcuugucccuuagcgaccagaugucagugcugcagagcguauggauggaaguacuagugcuggguguggcucagcgauccuuaccccugcaggaugaacucgcuuucgcggaagaccuuguucuugaugaggagggcgcccgagcugcggguuuaggagagcugggcgcggcauuacuucagcugguuagacgacuacaggcccuccgucuggagagagaagaauacguacugcucaaggcccucgcucuugcaaacagcgauucaguccauauugaggacgccgaggcaguugaacagcugagggaagcauugcacgaggcauugcuggaguaugaggccgggcgagcuggacccggcggcggggcggaacgccgccgagccggacggcuuuuauugacccugccccuccucagacagacagccggaaagguucucgcucacuucuacggugucaagcuggaggguaaagugcccaugcacaagcuguuucuugagaugcucgaagcuaugauggauuag

SEQ ID NO: 248178 - RNA, 1239 nt, Artificial Sequence
  Description of Artificial Sequence: Synthetic coding sequence
augggccuccaucuccggccauaccgaguaggccuacucccugauggauugcuguuucuccugcuccuguugaugcuguuagcugaccccgcacucccugcaggacgccaucccccugucguacuagucccuggugaccuuggcaaccagcuugaggccaaauuggacaagccaaccguggugcacuacuugugcaguaagaaaacugaauccuacuucaccauuuggcugaacuuagaauugcugcuaccuguuauuaucgauugcuggauagauaacauuaggcugguuuacaauaaaacaucgcgugccacacaguuucccgacggaguagacgugcgagugccgggguuuggcaagacauuuagucucgaauuucuggaccccagcaagucuucagugggcucauacuuccacacaaugguagagucucuuguuggcugggguuacacccgcggugaagacguccgaggcgcaccuuaugacuggcggcgcgcucccaaugagaauggccccuacuuucucgcgcucagagagaugauugaagagauguaucaguuguacgguggacccgucguucuuguugcucauaguauggguaacauguacaccuuauauuuccugcaacggcagccccaggccuggaaggacaaauauauuagggcguucgugagucuaggcgcaccuuggggugggguugcuaagacucugcggguuuuggcuucuggagacaauaacagaauucccgucaucgguccguugaagauucgagagcaacaaaggucugccgugucuacgucguggcuccucccuuacaacuacacguggucacccgaaaaagucuuuguacagacuccuaccaucaauuacacguugcgggauuauagaaaauucuuccaggacauaggguuugaggacggauggcuaaugcggcaggauacagagggccucguugaggcaacaaugcccccaggggugcaacugcacugccuuuaugggacuggagugccgaccccagauucauucuauuaugaauccuuucccgauagagacccuaaaaucuguuucggcgacggagauggaacagucaaucugaagucugcccugcagugccaggcuuggcagucgagacaggagcaccaaguccugcugcaggagcugccaggaucugaacauaucgaaaugcuggcaaaugccacgacucuggcuuauuugaagcggguguugcucggaccauag

SEQ ID NO: 248179 - RNA, 939 nt, Artificial Sequence
  Description of Artificial Sequence: Synthetic coding sequence
auggcaaaggucuuuucuuuuauccucgugacaacugcccucaccauggggagggagaucagugcccuggaagauugugcucaggagcaaaugagguugagagcacaggugcgacugcucgagacucguguaaagcaacaacagguaaagaucaagcaacuccugcaggaaaaugagguucaauuuuuggacaagggagaugagaacaccgugaucgaucugggaucgaaacgccaguaugccgacuguagcgaaauuuucaaugacggauauaagcucucaggcuuuuacaaaaucaagccacuucagagcccggcugaauuuucgguguauugugauaugagcgacggcgggggauggacagugauacaaagacgaucagaugggagcgaaaauuucaacagaggguggaaagacuacgagaacgguuuugggaauuucgugcagaagcauggggaauacuggcucggcaacaagaaccugcacuuucucaccacucaagaggauuauacccuuaaaauagaucuagcugacuucgaaaagaauucaagguaugcacaguauaagaacuucaaagucggugacgaaaaaaacuucuacgaguugaacaucggugaguauucaggcacagcaggagacucccucgcugggaauuuucauccugaagugcaguggugggcuagucaccagcgcaugaaguucuccaccugggaccgcgaucaugacaacuaugagggcaauugugcagaagaagaccagaguggcuggugguucaacagaugccacagcgcgaauuuaaacggcgucuauuacagcggccccuacacagcaaagaccgauaauggcaucguuugguauaccuggcaugguuggugguacucucucaaaucaguagucaugaaaauccggccuaacgauuucauuccuaacgucauuuag

SEQ ID NO: 248180 - RNA, 939 nt, Artificial Sequence
  Description of Artificial Sequence: Synthetic coding sequence
auggccaaaguauuuaguuuuauucucguuaccacagcgcuuaccauggggcgcgaaaucuccgcucucgaagauugcgcucaggaacagaugcggcugcgagcccaaguccgucugcucgagacccgugugaagcagcaacagguuaagauaaaacaacuucugcaggaaaacgaaguccaguuccucgauaaaggugacgaaaacacaguuauugaucucggaucaaaacggcaguacgcugauugcagcgaaaucuucaacgacggguauaagcucucuggcuuuuacaagauuaagccuuugcagagcccggcagaauucucuguguacugugauaugucggauggcgguggauggacaguuauacagaggcggucggacgggagugaaaacuucaaucgcgguuggaaagacuacgaaaacggcuuuggaaauuucguucagaaacauggcgaguauuggcugggcaacaagaauuuacacuuucugacaacucaggaggacuacacacuaaagauagaccuugcugacuucgaaaagaauucccgauacgcccaauauaagaauuuuaaagugggggaugaaaaaaauuucuaugaacucaauaucggugaauauuccgggacugcaggagauucauuggcuggcaauuuucauccugaggugcaauggugggcuucucaccagaggaugaaguuuagcacuugggacagagaccacgauaacuaugaggguaacugcgcagaggaagaucaguccgguuggugguuuaauaggugucauagcgcuaaccuuaaugguguguauuauagcgggccauauacagcuaagacugauaacgggaucgucugguacacauggcauggguggugguauucauugaaaucaguugugaugaaaauucgaccuaacgauuuuauuccuaauguaauuuag

SEQ ID NO: 248181 - RNA, 939 nt, Artificial Sequence
  Description of Artificial Sequence: Synthetic coding sequence
auggccaaaguguucucauucauuuuaguaacgacagcccucacuaugggaagggaaauuucagcccucgaagauugcgcacaggagcagaugagguuacgagcacagguacgucuuuuggagacucgcgugaaacagcaacaagugaaaauuaaacaguuacugcaagagaacgagguacaauuucuggauaagggcgaugagaacaccguuaucgaucugggaagcaagaggcaguacgcagauugcagugagaucuucaacgauggguacaaguugaguggauucuauaagaucaagcccuugcagucacccgcagaauuuuccgucuauugugacaugagcgacggcggcggauggacugugauccagcggagaucugacggcagcgaaaacuuuaaucgaggcuggaaggauuaugagaauggcuuugggaacuucgugcagaagcacggcgaauacugguuggggaauaagaaucuucacuuucuuacuacacaggaagauuauaccuugaaaaucgaccucgcugauuucgaaaagaauucgcgcuaugcacaguacaaaaacuucaaggugggggaugaaaaaaacuucuaugaacuaaacauuggagaguauucaggaaccgcgggggacucauuagccgguaauuuccacccggagguacaauggugggccucacaucagaggaugaaguucucuacaugggauagggaccaugacaauuacgagggcaacugcgccgaagaggaucaguccggguggugguucaaccgaugucacagugcuaaucugaacggcgucuauuauucuggccccuacacagcuaagaccgauaacgggaucgucugguacacuuggcauggauggugguacucucuuaaaucuguggucaugaagauccguccgaacgacuuuauccccaauguaaucuag

SEQ ID NO: 248182 - RNA, 939 nt, Artificial Sequence
  Description of Artificial Sequence: Synthetic coding sequence
auggcgaagguuuucucuuuuauuuuagugacuacagccuugacuaugggaagggaaauuucagcauuggaggacugcgcucaagaacagaugcgccugcgagcucaggugagacugcuugaaacgcgcgugaagcagcaacaagucaaaauaaaacaacugcuccaggagaacgagguucaguuucuggacaagggcgacgagaacaccgugauugaccuagggagcaaacgacaguacgcugauugcucggaaauuuuuaacgacggcuacaaacuuagcggauuuuacaagauuaagccucuccagaguccagccgaauucaguguguacugugacauguccgauggggguggcuggacagucauucagcgccgcagcgacgguucugaaaauuuuaaccgcgguuggaaggacuacgagaacgguuuuggaaacuuugugcagaagcacggcgaauauuggcuugguaauaaaaacuugcacuuccugacaacccaggaggauuauacccuuaagauagaucuggcugacuucgaaaagaauagccgguaugcccaguauaagaauuuuaagguuggugaugaaaagaauuuuuacgaguuaaacauuggcgaauauuccgguacagcaggugauagcuuagcuggcaacuuucacccugaggugcaauggugggccucgcaccaaaggaugaaauuuaguacuugggaccgcgaccacgauaauuaugaggggaacugugcggaagaggaccaaagcggcuggugguuuaaucgcugccauucggcuaaccugaacggaguauacuauuccggccccuauacagcaaaaacugacaacggcauugugugguauacuuggcacgguuggugguauuccuugaaaaguguugucaugaagauacgccccaaugacuucauuccaaaugugauuuag

SEQ ID NO: 248183 - RNA, 939 nt, Artificial Sequence
  Description of Artificial Sequence: Synthetic coding sequence
auggccaaggucuucucuuuuauuuuagucaccacagcucugacaauggguagagaaauauccgcguuagaggacugugcucaagaacagaugcgccuucgugcgcaggugcggcuguuagaaacucgcguaaaacagcagcaggugaagauaaagcagcuccuucaggagaacgaagugcaguucuuagacaagggagacgaaaauaccgucaucgaccugggaagcaaaagacaauacgccgauuguucagagauauucaacgacggguacaaguuauccggauucuacaaaauuaaaccauuacaguccccugccgaauucagcguauauugcgacaugucagauggcggaggauggacagugauucagaggagauccgaugggagcgagaacuuuaacagaggguggaaggauuaugagaacggcuucggaaauuuuguucaaaaacauggagaauacugguugggaaacaaaaaucuucacuuccugacgacucaagaagauuauacccucaagaucgaccuggcugacuucgagaaaaauuccagguaugcacaauacaagaacuucaaagucggugaugagaaaaacuucuacgagcuuaauauaggcgaguacucuggcacugcuggagauagucucgccggcaauuuucauccugaaguacaguggugggcuucgcaccaacgcaugaaauuuucuacaugggaucgggaccaugauaauuaugagggcaauugugcagaggaggaccaguccggguggugguucaauagaugucauagcgcuaaucucaauggcguauauuauucugguccauacacagcuaagacggauaacggcauagucugguauaccuggcacggguggugguacucucuuaaguccguugugaugaaaauccggcccaacgacuucaucccuaacguuaucuag

SEQ ID NO: 248184 - RNA, 939 nt, Artificial Sequence
  Description of Artificial Sequence: Synthetic coding sequence
auggcaaagguguuuucauucaucuuggugacuaccgcgcuuaccauggggcgcgagauaucugcacuggaggauugcgcucaagagcaaaugagacugcgcgcgcaggugagguuacuggagacacgcguuaaacaacagcaggucaagauuaagcaguuguuacaggaaaacgaggugcaguuccuggacaaaggggacgaaaacacagucauugaucuugggaguaagcggcaguacgccgauuguucagaaauuuuuaacgacggcuacaaacucuccggcuucuacaaaaucaagccccugcagagccccgccgaguucagcguauauugugacauguccgacggcgguggcuggaccgugauccaacgcaggucagauggguccgaaaacuuuaauagaggauggaaagauuaugagaacggguuuggaaacuucguacagaagcauggugaauauugguugggcaacaagaaucuacauuuucugaccacccaggaagacuacacuuugaaaauagaucuggccgauuucgagaaaaauuccagguaugcgcaauacaagaauuuuaagguuggcgaugaaaagaacuucuaugagcucaauaucggagaguauuccgggaccgccggagauucacuugccgggaacuuucauccagaagugcaauggugggcuucucaccagcggaugaaguuuucgaccugggaccgcgaccaugauaauuacgagggaaauugugcagaagaagaccaauccggauggugguuuaaucgcugucacagcgccaacuugaauggaguguauuauucugggccuuauaccgcaaagacagauaacggaaucguaugguacacauggcauggguggugguacucgcugaagagugucgucaugaaaaucagaccaaacgacuucauaccuaaugugaucuag

SEQ ID NO: 248185 - RNA, 849 nt, Artificial Sequence
  Description of Artificial Sequence: Synthetic coding sequence
augagauuacgggcucaggugagauuacucgaaacuaggguuaagcaacagcagguuaagaucaaacaacuguuacaagagaacgaggugcaguucuuggauaaaggcgacgaaaacaccguuauugaccuggggucuaagagacaguaugcagauugcuccgaaauuuuuaacgacggauacaagcuuagugguuuuuacaaaauaaaaccucuacagucaccugcagaauuuucgguauacugugacaugucugacggcgggggguggacugugauucagagaaggucugauggaucggaaaacuuuaaccguggguggaaagauuacgaaaacggauuuggcaacuuugugcagaaacacggagaauacuggcucggcaauaaaaaccugcauuucuuaaccacccaggaggacuauacacucaagauugaccuggcggacuuugagaaaaacucccgcuacgcccaauacaaaaacuuuaaggugggcgacgagaagaauuuuuacgagcugaacaucggugaauauucgggaacagccggagauagucuggccggaaacuuccacccagaggugcaguggugggcaagccaucagcggaugaaguuuuccaccugggauagagaucaugauaacuaugaggggaauugugcugaagaagaucaauccggcuggugguucaauaggugucacucagcuaaucucaacggcgucuacuauucuggccccuauacggcaaaaaccgauaauggcauugucugguacacauggcacggcuggugguauagccugaaaaguguggugaugaaaauuaggccuaacgauuuuaucccaaacgucaucuag

SEQ ID NO: 248186 - RNA, 939 nt, Artificial Sequence
  Description of Artificial Sequence: Synthetic coding sequence
auggcaaaaguauucucauuuauccuuguaaccacagcacuuaccaugggccgagaaauuuccgcccuugaggauugugcccaggaacaaaugcgucugcgugcgcaaguacggcugcuggaaacucgggugaaacagcaacagguaaaaauuaaacagcugcugcaagagaacgaggugcaguuccuggauaagggcgacgaaaacacugucauagaucucggcagcaaaagacaauaugcugacuguagugagauauuuaaugauggcuauaagcugagcggauucuauaagaucaaaccccugcaaagcccggccgaguucaguguguacugugacauguccgacggagggggcuggaccguuauucagcgccgcagugacggaucugagaauuucaaucgcggcuggaaggacuacgaaaacggguuuggcaacuuuguccaaaaacacggugaguacuggcuugggaacaaaaaucuccauuuccuuaccacacaggaggauuacacccugaagaucgaccuggccgacuuugagaaaaauaguagauaugcucaguauaagaauuuuaaagucggugaugaaaagaauuuuuacgaauuaaacauuggcgaguacucuggaaccgcuggugauucauuggcuggaaacuuccaucccgagguacaguggugggcaagucaucagcgcaugaaauuuucaacaugggaccgcgaccacgauaauuacgaaggaaacugcgccgaagaagaucaauccggcuggugguucaauagaugccacucugccaaccugaacggggucuauuacucggggccguauacagcaaagacugacaauggcauuguaugguauaccuggcacggcuggugguauucccuaaagagugucgugaugaagauucgcccuaacgauuucauuccgaaugucaucuag

SEQ ID NO: 248187 - RNA, 2052 nt, Artificial Sequence
  Description of Artificial Sequence: Synthetic coding sequence
auggagagagccgcgccuucccgccgugugccccuaccccuccuccugcuuggagggcucgcucugcuagcggccggaguagacgcagauguacugcucgaggccuguugugccgacggccauaggauggcuacgcaucagaaagacugcucccuccccuacgcaaccgagaguaaagagugucgaauggugcaggaacaaugcugccacagccagcucgaagagcuccacugugcuacuggaaucucccuggcaaaugagcaggauaggugcgcgacgccucacggagacaaugcuagcuuagaggccacuuucguaaagagguguugccacuguugcuuguugggcagagcugcacaggcacaagggcagagcugugaguauagucugaugguaggauaccagugugggcagguguuccaggccuguugugugaagagucaggaaacaggagaucuggaugucgggggccugcaggaaacggauaaaaucauagaaguggaggaagaacaagaagauccauaccucaacgauagauguagggguggcggucccugcaagcaacaauguagagacacuggggacgagguggugugcagcugcuuugugggcuaccagcuacuguccgacggcgucaguugugaggacgugaaugagugcauuacaggcucucacucaugucgguuaggugaguccugcauuaacaccguggguaguuuuaggugucaaagagauucaagcugcggcacugguuaugaauuaacggaagacaacucuuguaaggacauugacgagugugagagcggaauccauaacugcuugcccgacuucaucugccagaauacccuaggcuccuuccggugucgcccaaagcugcagugcaaaucuggcuuuauccaagaugcauuagggaauugcauugacauaaaugagugccuuagcauaucagccccgugccccaucggucauacauguaucaauacggagggaagcuacacaugccagaaaaacgugccuaacuguggucggggauaucacuugaaugaagaagguacacgcugugucgacguggaugaaugcgcccccccagccgaaccuugugggaaaggccauaggugugucaacucuccuggguccuucagaugcgagugcaaaaccggauauuacuucgauggcauuuccagaaugugcguugaugucaaugagugucagcguuaccccggaaggcuuugcggacacaaaugcgagaacacgcugggcucauaucuguguuccugcucuguugguuuuaggcuaagcguggacggucgaucuugcgaggacauuaacgaauguuccucuaguccuugcucucaggagugugccaacguuuacgguucuuaccaguguuauugucgucgaggauaccagcugucugauguggaugguguuacaugcgaggauauagacgagugcgcauugcccaccggcggacacaucugcaguuacagaugcaucaacauccccggaucauuucaaugcucuuguccaucuuccggcuacagacuggccccaaauggcagaaacugccaggauauagaugagugugugacagguauccauaauugcucuaucaacgagacaugcuucaacauacagggaggcuuuaggugucuggccuuugaaugcccugagaacuaucgacgauccgcugcaacacgaugcgaaaggcugccuugucacgaaaauagagaaugcuccaaacugccgcucagaaucacauacuaccaucucaguuuucccacuaacauacaggcccccgccguuguguuucggaugggcccuagcagugcugugccgggcgauucuaugcaacucgcuaucacugguggaaacgaagagggauucuuuacaacuaggaagguuucaccccacagcggcgugguggcacucacaaagcccgucccagaaccucgcgaucuacuucuuaccgugaaaauggacuugagccgacauggaacagucaguucuuucguggcaaaacuguuuaucuuugucucugccgaacucuag

SEQ ID NO: 248188 - RNA, 2112 nt, Artificial Sequence
  Description of Artificial Sequence: Synthetic coding sequence
auggagagagccgcccccucccgaaggguuccccugccgcuacugcugcuuggaggacuagcucuacuugcugcugggguggacgccgacgugcuguuggaagccuguugugcagacggccaucgaauggcuacucaccagaaagacugcucccuccccuaugccaccgaauccaaggagugucguaugguucaggagcaguguugucacagccagcuggaggagcuacauugugccaccggcauaucauuagcaaaugaacaggaccguugcgccacuccccauggcgauaacgcuucacuggaagcgacauucgugaagagauguugucacuguugucugcucgguagagcugcccaggcgcaggggcaguccugcgaguacucacugaugguuggcuaccagugcggccagguuuuccaggcuuguuguguaaagucccaagaaacuggugaucuggacguuggaggauugcaggaaacagacaagauaaucgagguggaggaggaacaggaggauccuuaccuuaaugacaggugucggggagggggaccuugcaaacaacagugccgcgacaccggugacgaggucguuugcuccugcuucgucggauaccagcugcugagcgacggagugucuugugaggacguaaaugaauguauaacaggcagccauaguuguagauugggggaaaguugcaucaauacugucggcaguuuccggugucagcgcgacucuucauguggcacaggauacgaacuuaccgaggacaacucguguaaggauauagaugaaugcgaauccggcauccacaacugucugccagacuucauuugccagaauacccugggcucauuccgcugccgcccuaaacugcaauguaagucugguuuuauccaggaugcuuuagguaauuguauugauauuaacgaaugucugaguauuuccgcacccugcccgauuggccacaccuguauaaauacagagggaucuuacacuugucaaaagaaugucccuaauugugguagaggauaccaccuuaaugaggaggggacccggugcguggacgucgacgagugugcaccuccugccgagccuugcggaaaagggcaucguuguguuaacagcccugggaguuuccggugugaaugcaagacuggcuacuacuuugauggcauuagucgaaugugcgucgaugucaaugaaugucaaagauaccccgggagacucugcggccauaaaugcgaaaauacacuaggaaguuaucugugcucuugcagcgucgguuuccgauugagcguagacgguagguccugugaggacaucaacgaaugcagcagcuccccuugcucgcaagaaugcgccaacguauacggcaguuaucaaugcuauugucgaaggggguaccaauugucagacguagacggugucaccugcgaggacauugacgagugcgccuuacccaccggaggacauauuuguucuuaccguugcauaaacauuccuggcucguuccagugcuccugcccuucaucuggauauaggcuugccccgaauggaaggaauugccaagacauugaugagugcguaacagggauucauaacugcagcauuaacgagacgugcuucaacauccagggggguuuuaggugucuagccuucgagugcccugagaacuacaggagauccgccgccacucuucaacaggaaaagacugauacugugcgcugcaucaaauccugccgucccaaugaugucacgugugucuucgauccugugcacaccaucucacacacagugaucucacuaccgacguuucgcgaguucacaagaccggaggaaauuaucuuuuugagggcaauaacaccaccucauccggccagucaggccaacauuauuuucgauauuacagaaggcaaccucagggacucguuugacaucaucaagcguuacauggacggcaugacugucggggugguucgccagguccgacccaucgugggcccuuuucacgccgugcugaaguuagaaaugaauuacguggucggaggugucguaucucacaggaaugugguaaacguccacaucuucgugagcgaauacugguuuuag

SEQ ID NO: 248189 - RNA, 1701 nt, Artificial Sequence
  Description of Artificial Sequence: Synthetic coding sequence
auggagcgagccgcccccucacggaggguaccucuuccccucuugcuguuaggaggacucgccuuguuggcugcuggaguggacgccgauguccuguuagaggccuguugcgcagauggucacagaauggcgacucaccagaaggauugcagucugccguaugcaacugagagcaaagagugcaggauggugcaagaacaguguugccacagccagcuagaagaguugcacugugccacggggaucaguuuggcuaaugaacaggaccgcugcgcaacaccccacggggacaacgcuagccucgaggcaacuuuugugaagagguguugccacugcugccuguugggacgggccgcgcaagcacaagggcaaagcugcgaguauagccugauggucggauaccaguguggccagguguuccaggcuugcugcgugaaaucucaggaaacaggugaccucgaugugggcggucuccaggagacagacaagaucauugagguugaagaggaacaggaagauccauaccugaaugacaggugccgcggcggaggaccuuguaaacagcaaugucgggauacuggggacgaagucguuugcaguuguuucguuggcuaccagcugcuuucagauggcguguccugcgaggacguuaacgaguguauuaccggcucgcauucaugcaggcucggagaguccuguaucaauacugucggaucauuccgaugucagagagauucaagcuguggaacuggguaugagcucacggaagauaauaguugcaaggauaucgacgagugugagucagggauccauaauugccugccagauuuuauuugccagaacacguuaggcucuuuuagaugccggcccaaacugcagugcaagaguggguuuauucaggaugcucucggcaauuguauugauauaaacgaaugucugucaauuucggcuccaugcccaaucggccauaccuguaucaacacagaggggagcuacacaugucagaaaaacguccccaauugcggaaggggguaucaucugaaugaagaggggacacguuguguugaugucgacgaaugcgcaccuccugcagagcccugcggcaaaggacauagguguguaaauagcccagggucuuuuagaugcgaguguaaaacaggguauuacuuugacggcaucagccguaugugcguagacgugaacgaaugccagcgauauccggguagguugugcggccacaaaugcgaaaacacacuuggaucuuaucuuugcucuugcaguguuggcuuccggcucuccguugaugguagauccugugaggacaucaaugaaugcuccucuuccccgugcucacaggaaugugcuaacguuuacggauccuaucagugcuacugcagacggggguaccagcugagcgauguagauggugugacaugcgaagauaucgacgaaugcgcccugccaacgggaggacauauauguagcuaccgcugcaucaauaucccaggaagcuuucagugcucaugccccuccagcgguuauagguuggcuccuaauggacgaaacugucaagauauagaugaauguguuacuggaauucauaauuguuccaucaacgaaacgugcuucaauauccagggcggcuuuagaugucucgcauucgaaugccccgagaauuaccggcgcagcgcugcuaccuag

SEQ ID NO: 248190 - RNA, 2112 nt, Artificial Sequence
  Description of Artificial Sequence: Synthetic coding sequence
auggaacgcgccgcucccaguagacgggugccauugccgcugcuacuccuugggggauuagcgcuucucgccgcuggaguggaugcagauguguugcuugaggcuuguugcgcggauggacaucguauggcaacgcaccagaaggauugcagccucccuuacgcaaccgaauccaaggagugcagaaugguucaagaacaaugcugccacucccagcuugaagaguugcauugugcuacaggaaucucccuggcuaaugaacaagaccgcugugcuacaccucacggggauaaugcuucacuggaagcgaccuuugucaaacgcuguugccauuguugccugcugggacgggccgcacaggcacaaggucagaguugugaguacucucuuauggugggcuaccaguguggccaaguauuucaggccugcugcguaaagagccaggaaacaggggaccuugacgugggggggcuacaggaaaccgacaagauuaucgaaguagaggaggaacaggaagauccauaucuuaacgaucgcugccgggguggcggaccaugcaagcagcagugucgcgauacaggggacgaagucgugugcagcuguuuugucggauaucaacuccucucugacggagucucaugugaggacgugaacgaguguaucacugguucucacuccugucgacucggugaaucauguauaaacaccguugggagcuuccgcugccagcgcgacaguagcuguggcaccgguuacgagcuaacagaggauaacucaugcaaagauaucgaugaaugcgaaucuggaauacacaauugcuuaccagacuuuaucugccaaaacacgcugggcagcuuccgaugccggccaaaguuacaauguaagucaggauuuauacaggaugcccuggguaauuguaucgauauaaacgagugucuuucaauuagcgcgcccugcccgauuggacauaccuguauuaauacagagggcuccuacacuugucagaagaacguucccaauuguggcaggggauaccaucuuaaugaggaaggaacucgaugugucgacguggaugagugugccccacccgcugaaccgugcggaaaagggcaccguugcgugaauuccccgggcucauuuagaugcgaauguaaaacagguuacuauuucgacggcaucagcaggauguguguggauguuaaugagugccagagguauccggggcgacuaugugggcacaaaugcgaaaacacccuggggucuuaccugugcaguugcagcgugggcuuuagacuaucugucgacggacggagcugugaagacauaaaugagugcaguagcucacccugcucucaggagugcgccaauguguacgggucauaccaauguuacugccgcagaggauaucaguugucagacguggauggggugacuugugaggacaucgaugaaugcgcgcuccccaccggaggacacauaugcaguuacaggugcaucaauauaccagguagcuuccagugcucaugcccguccuccggauaucgguuagcaccaaaugggagaaauugucaagacauugacgaguguguuacaggaauucacaauugcucuaucaaugagacuugcuuuaacauccagggaggauucaggugucuagcuuucgaguguccugagaauuauagacgcagcgccgcaacccaaaagagcaagaaaggaaggcaaaacacccccgcuggcucuucuaaagaggacugucguguccuacccuggaagcagggguuagaagacacucaucuggaugcuuaucugcccuguugucgccguuucacgcgaccugaggaaaucaucuuuuuaagggccauuacccccccacacccggcgagucaggccaacauaaucuucgacaucacugaaggcaaccuaagggacaguuucgauauuaucaagagauacauggauggcaugacaguuggaguggugcggcaggugaggcccauuguggguccauuucaugccgucuuaaagcucgagaugaacuaugucguagggggggucguuagucaccgcaauguggugaaugugcauauuuuugugucagaguauugguucuag

SEQ ID NO: 248191 - RNA, 2166 nt, Artificial Sequence
  Description of Artificial Sequence: Synthetic coding sequence
auggagcgcgcagccccaucuaggcgugucccucugccccuucuucugcucggggguuuggcacucuuggccgcuggagucgaugcugacguccugcucgaggcaugcugcgcagacgggcaucggauggcuacacaucaaaaagauuguucccucccuuaugcaacagaaucuaaagaaugcagggcugugggacuggccucacuaugccaagacuuaaacggggcaugggcgguguggaaggucggccgugcaucacaggcagaaggaacugccagugcuagagcacagagacggggcaugguucaagagcaauguugucauucgcagcuggaggaguugcauugcgcuacuggaaucucccucgccaacgaacaggaucggugugcaacaccacauggggauaaugcaagucucgaagccaccuuugucaagcgauguugucacugcugucugcucggucgagcggcacaggcucaaggucagucaugcgaauauucccucaugguuggauaucagugcgggcagguuuuucaagcauguuguguuaagucccaagagaccggugaccuggacgucgggggucugcaagagacugacaagaucauagagguggaggaggagcaggaggacccguaucugaacgaucggugccgcggcggggguccgugcaaacagcaaugccgcgacaccggggaugaaguagugugcuccuguuuuguuggguaccagcugcugucagacggcguguccugcgaagacgucaaugaauguauuacagggucccacuccugucgacugggagagucguguaucaauacgguugguuccuucaggugucaacgagacagcucuugcggcacuggguacgagcugaccgaggacaauucauguaaggauauugaugagugcgagagcgggauucacaauugucucccugacuucauaugccagaacacguugggcaguuuccggugcaggccaaagcugcagugcaaaaguggauucauccaggaugcccucggcaauuguaucgacaucaacgaaugccuguccaucagcgcucccugccccauuggucacacguguaucaauaccgaagguucauacacaugccagaagaauguucccaacuguggucggggcuaccaccucaaugaggaggggacccguugcgucgauguggaugaaugcgcccccccugccgaacccugcggaaagggccaccgcugcgucaacucacccggcagcuuucggugcgaauguaagacgggcuauuacuucgauggaauuaguaggaugugcguggaugugaacgagugucagcgcuaucccggucggcuguguggucacaaaugugaaaacacgcuaggcuccuaccuuugcagcuguagcgucgguuuucggcugucaguggacgguaggucaugugaggacaucaacgaauguagcucuucacccuguucucaggagugcgcaaacguuuaugggucuuaccagugcuauugccggagaggguaccagcugucagacgucgacggggugacaugugaggacauagacgagugcgcccuaccaaccgggggacacauaugcaguuaccgguguauaaauaucccuggaaguuuccaaugcaguugcccuucaagcggcuacagacuggcaccaaauggcaggaacugucaggauaucgacgaaugugugaccggaauacauaacugcucaauuaaugaaacuuguuucaacauucagggaggauuuagaugccucgccuucgaaugcccagagaacuaucggcgaagcgcugcgaccaggugugaacggcucccuugucaugagaaccgagaauguucaaagcucccacugcggaucaccuacuaccaccugaguuuuccgacuaauauucaggcuccggcagugguguucagaaugggcccuucuucugccguacccggagauuccaugcagcuggccaucacggguggaaaugaggagggauuuuucacuacccggaagguaaguccccacucaggaguuguugcgcuaacgaagccugugccugaaccacgggaccugcuguugacugugaaaauggacuuauccaggcauggaaccgugaguuccuuuguggccaaacuguucaucuuuguuuccgccgaauuguag

SEQ ID NO: 248192 - RNA, 570 nt, Artificial Sequence
  Description of Artificial Sequence: Synthetic coding sequence
augaauagcuacacccgagggagccgccggccaucagccaaagcugcuaguccugcagcauccguaaccucacgcguuuccccgaguggaccgggcguacccguggacgcagauguucugcuagaagcaugcugcgcagaugggcacaggauggcuacccaucagaaagauugcagccugccauaugcaacggaguccaaagaaugcagaaugguccaggaacagugcugccacucccaguuagaagaguuacacugugccacugggauaucacucgcaaaugaacaggaccggugcgcuacuccacacggcgacaacgcuagccuggaagcuacuuuugugaagaggugcugucauugcugccuguuggguagagcugcccaggcccagggucaguccugcgaguacagucugaugguaggguaucaguguggccaggucuuccaagcguguuguguaaaaagucaggaaaccggcgaucuggacgugggaggccugcaggagaccgauaaaaucaucgagguggaagaagagcaagaagacccuuaccuuaaugauagaugccgcuag

SEQ ID NO: 248193 - RNA, 81 nt, Artificial Sequence
  Description of Artificial Sequence: Synthetic coding sequence
auggcgacucaccagaaagacuguagccuuccauacgcaacugagagcaaagaaugcagaaugguccaagaacagugcuag

SEQ ID NO: 248194 - RNA, 1806 nt, Artificial Sequence
  Description of Artificial Sequence: Synthetic coding sequence
auggagagggcugccccuagccgccggguuccacuuccacugcuccugcucgggggguuggcuuuacuggcagccggaguggacgcugauguuuugcuggaggcguguugcgccgacggccacagaauggcuacacaccagaaggauuguucgcugccguaugcuacagaaaguaaggagugccgaauggugcaggagcaguguugucacucccaauuggaagagcuucacugugcgacugggauaagcuuagcuaacgaacaagauagaugcgccaccccccauggagauaaugcguccuuagaggccacuuucgugaaaagguguugccacuguugcuuacuuggaagagcugcccaagcccagggccagucuugcgaguauagccugauggugggguaucaaugcgggcaggucuuccaagcguguuguguuaaaagucaagaaacuggcgaucucgacguuggggggcuacaagagaccgauaaaauuaucgagguagaggaggaacaggaagauccauaccuuaaugaucggugccgcggggggggucccugcaagcaacagugcagggacaccggggacgagguagucuguucaugcuucgugggcuaucagcugcuaucugacgggguuucaugcgaagaugugaacgaguguaucaccgguagccacucuuguagacuaggggaaucauguaucaacaccguuggguccuuccgaugccagcgagacucauccugugggacaggguaugaguugacagaagacaacucuugcaaggacauugacgaaugugaaucagggauccacaauugccucccagacuuuauuugucagaacacucuagguagcuuucggugccguccaaagcugcagugcaaaucuggcuucauucaggacgcacugggcaacuguaucgacauaaacgaguguuugagcaucucagcacccugccccaucgggcacacaugcaucaacacugaagggagcuauacaugccagaagaauguaccuaauuguggaagaggguaccaccuaaacgaggagggaacccggugcguggauguggacgagugcgccccaccagccgaaccaugugguaagggccaucggugugucaauucucccggcuccuucaggugugagugcaagacaggcuauuacuucgauggaaucucaagaauguguguagacgugaaugagugccagcgcuacccaggcagacugugugggcacaaaugcgagaacacucuuggcaguuaccuaugcaguuguuccgugggcuucaggcugagcguggacggacggucaugcgaggauaucaacgagugcagcagcucuccgugcagucaggagugugcuaauguguacggcucuuaccaaugcuauuguaggcgcggcuaccagcucuccgauguggaugggguuacgugugaggauauugaugagugugcacuccccacagguggacacaucugcuccuaccggugcaucaacauacccggguccuuucaauguucuuguccaucuagcggauacagacuggcccccaauggacggaacugccaggacauagacgagugugucacaggcauucauaacuguucuauuaacgaaacguguuuuaauauccagggcggcuuuagaugcuuagccuuugaaugcccugaaaacuacaggaggagcgcagcaacacaaaaaucgaagaaaggacgccaaaacacccccgccggcucaaguaaagaggacugcaggguacucccauggaaacaggguuuagaggauacucaucuggacgccuag

SEQ ID NO: 248195 - RNA, 198 nt, Artificial Sequence
  Description of Artificial Sequence: Synthetic coding sequence
auggcuacccaccagaaggacuguagucugccguaugcuacugaauccaaagaaugccggaugguacaggaacaaugcugccacagccagcucgaggaacuucacugcgcaaccgggaucucacuggcaaaugaacaggauaggugugccacaccccacggagauaacgccagcuuagaagcaaccuuugucaaauag

SEQ ID NO: 248196 - RNA, 546 nt, Artificial Sequence
  Description of Artificial Sequence: Synthetic coding sequence
ugccggaugguccaggaacaguguugucacucacaacuugaggaacugcacugugcaacaggaauuuccuuagcuaaugaacaggacaggugugcaaccccacacggggacaaugccagccuagaagcuacauucgucaagcggugcugucauugcugccuucugggacgagccgcccaggcacaaggucagaguugcgaguacagucuaaugguuggguaucagugcggccagguguuucaagcuuguugcgugaaaucccaggaaacaggcgauuuagacguaggaggacugcaagaaacaggcggcgggccuugcaaacagcaguguagggacacaggggaugaagugguguguaguuguuucgucgguuaccaacuucuuucugacggaguuucaugcgaagacgugaacgaguguauaacugguagccacagcugccgacucggggagagcuguauaaacacuguagggucauuccguugccagagagauuccuccugugguacuggauaugagcugacagaagauaacucaugcaaauag

SEQ ID NO: 248197 - RNA, 420 nt, Artificial Sequence
  Description of Artificial Sequence: Synthetic coding sequence
auggcaacucaccagaaggacuguucucuaccuuaugcuacggaguccaaagagugccggaugguccaggaacaguguugccauucccagcuggaagaacugcauugugcuacaggcauuagucucgcuaacgaacaggauagaugcgcuaccccccauggcgacaaugccuccuuggaagcaaccuucgugaaacgcugcugucacuguuguuuauuagguagagccgcucaggcccagggacaguccugcgaguauucucugauggucggauaucagugcggacaggucuuucaagcaugcugugugaaaucgcaggagacaggagaucuggacguugguggguugcaagaaaccgacaaaauaauugaaguagaggaggaacaggaagauccauacuugaacgaccggugcagguag

SEQ ID NO: 248198 - RNA, 519 nt, Artificial Sequence
  Description of Artificial Sequence: Synthetic coding sequence
auggaaagagccgcgccuucuaggagaguaccacugccccugcuguuacuuggaggcuuagcgcuucuggccgccgguguggacgcugaugucuuauuagaggcguguugugccgacggucacagaauggcuacgcaccagaaagauuguagucuuccauacgcaacagaaaguaaagagugccggauggugcaggagcagugcugucacucccagcuggaagagcugcacugugccacgggcauaagccucgccaacgagcaggauaggugcgccaccccucauggagauaaugcuucacucgaggccacauucguaaaacgguguugccauugcugccuccugggccgcgcagcucaagcucagggucaguccugcgaguauagccuaauggugggauaccagugcggccagguguuccaggcuuguugugugaagagccaggagaccggagaucuggacgucggaggacuccaggagacagggggagggccaugcaaacagcaguguagggauuag

SEQ ID NO: 248199 - RNA, 792 nt, Artificial Sequence
  Description of Artificial Sequence: Synthetic coding sequence
augcgaccuggggcaccuggaccucuuuggccccuuccauggggugcacuugcuugggcaguagguuucgugucaagcaugggaagcgggaauccagcaccugguggagugugcuggcuccagcagggacaggaggccacauguagccuuguguugcagacagauguuacccgugcugagugcugugcgagcgguaacauugacacagcauggucaaaccugacacaccccgguaauaagauuaaucuccugggcuucuugggucuuguucauugccugccauguaaagacucaugugauggcguugagugcggcccaggaaaggcuuguagaaugcucggagguaggcccagaugugagugcgcuccugacuguucagggcuuccagcccggcugcaagucuguggguccgauggggcuacauauagagacgaaugugaacucagagccgcucggugucgagggcacccugaccuuucaguaauguacagggguagauguagaaagagcugugaacauguggucugcccacguccacaaagcugcgugguagaccaaacgggaucagcccauugcgucguauguagggccgcuccuuguccaguccccucuucucccggacaggaacuuugcggaaauaacaacgucacuuacauauccucgugucacaugagacaagccaccugcuuccucggccguuccaucggugugagacaugcagguagcugugcuggaacaccggaagagccuccuggcggagaauccgcagaggaggaagagaauuuugucuag

SEQ ID NO: 248200 - RNA, 984 nt, Artificial Sequence
  Description of Artificial Sequence: Synthetic coding sequence
augggaaggacuucuaaagacaagcgggacguguauuaccguuuggcaaaagaaaauggcuggcgugcucgcucggcauucaaacuccugcagcuugauaaagaguuucaacuguuccaggggguuacaagagccguugaccucugcgcugccccaggcucuuggucacagguacucagucagaaaaucggcggucaaggcuccggucaugugguggcuguugaucugcaggcaauggcuccacuaccaggcgucguccaaauucagggagacauuacccaacugucuacugccaaagagaucauucaacacuucaaggggugccccgccgauuugguggugugcgacggcgcaccugaugugacuggccugcacgauguggaugaguacaugcaggcacagcugcuccucgcugcccugaauaucgccacacacgucuugaagccagggggaugcuuuguagcaaagauuuuucguggacgcgaugugacccugcucuauagucaacuucagguguucuucaguuccguccugugcgcaaagccgcguuccucucggaauaguuccaucgaggccuuugccguuugucagggauacgauccacccgagggguuuauacccgaucugucaaaaccccugcuggaccacagcuacgauuuuaaccagcuggauggaccuacaaggauuaucgugcccuucgucacuugcggagaccugagcagcuaugauagcgaccgcucauacccacucgaccuggaaggugguucugaauauaaguauacgccuccaacucagcccccuaucucccccccauaccaggaagcuugcacucugaagagaaagggccaacuagcaaaagagauacggccgcaggauuguccgaucucucgagucgauacauucccgcagccucuugcagcgccccaaugucacacgcuucuggcucccgaaauggaggacaaugaaaugucguguagucccuag

SEQ ID NO: 248201 - RNA, 1404 nt, Artificial Sequence
  Description of Artificial Sequence: Synthetic coding sequence
augcggccccaggagcugccaagacuugccuucccccugcugcuccuccuucugcuauugcucccucccccuccuugccccgcacacagcgcaacacgguuugauccuacuugggagucacuggaugccagacagcugcccgccugguuugaucaggcaaaauuuggaauauucauacauugggggguguucagugugccuucguucggcucggaaugguucuggugguacuggcagaaggaaaagaucccuaaguacguugaauucaugaaagauaauuaccccccgucuuucaaauaugaggauuucgggccauuauuuacugccaaauucuuuaacgcaaaucaaugggcagauauuuuucaggcgagcggagcaaaguacaucguguugaccuccaaacaucaugagggauucacuuugugggguucugaauauaguuggaauuggaacgcaauugacgagggaccuaagagagauauugucaaagagcuggagguggcuauuaggaacagaaccgaccuccgcuuugguuuguacuacucccucuucgaaugguuucacccgcuguuucucgaagacgaaagcucaucuuuccacaagcgccaauuccccguuucuaagacauuaccugaacuguacgaacucgugaacaacuaucagcccgaaguacucuggagcgauggggauggcggcgccccugaccaauacuggaauuccacaggguuuuuagccuggcucuauaacgaguccccugugcggggcacugucgucaccaacgaucgcuggggcgccggcuccaucugcaagcacggggguuuuuauaccugcucagacagauacaaucccggccaucuccucccacacaaaugggaaaauugcaugacaaucgauaaacugagcuggggguaucggagagaagcuggaauuuccgauuauuugacuauagaagaauuggugaaacaacuaguggagacugugagcugcggcggcaaucugcugaugaacauugggcccacccuggauggaacuaucuccguaguguuugaagagagacugaggcaaaugggcuccuggcugaaaguuaauggcgaggccauauacgagacacacaccuggcgaucccaaaacgacacugugacccccgacgugugguauaccagcaaaccaaaggagaagcucguguacgccauauucuugaaguggcccaccagcggacagcucuuuuugggccacccuaaggccauacugggcgccacugaggugaagcuccuugggcacggacagccacugaacuggauaucccuugagcaaaacggaaucauggucgaacucccccagcuaacuauccaccaaaugccuuguaagugggggugggcccuggcccuaacuaacgucauuuag

SEQ ID NO: 248202 - RNA, 354 nt, Artificial Sequence
  Description of Artificial Sequence: Synthetic coding sequence
augaaguggauguuuaaagaggaucacucauuggaacacagauguguugaaucugcuaaaauccgugcuaaguaccccgaccgagugccagucaucguggaaaagguguccggaucucagaucguagacauugauaagaggaaauaccugguucccucugacauuacaguggcucaguuuauguggaucauacgaaaaagaauucaacuaccgagcgaaaaggccauuuuucuauuugucgauaaaacagucccccaaucuagccugacaaugggccagcuuuacgaaaaagagaaggacgaagauggcuuccuauacguugcauauaguggggaaaauacauuugguuuuuag

SEQ ID NO: 248203 - RNA, 1371 nt, Artificial Sequence
  Description of Artificial Sequence: Synthetic coding sequence
augaggaagucaccugggcucuccgauugucugugggcuuggauccuauugcucuccacccuuacuggaaggucauauggccagccuagccugcaggaugagcucaaagauaauacgacagucuuuacacgcauacuggauaggcuucuggauggcuacgacaaccgccuccgcccgggacuuggggagagggugacugaagugaagaccgauauauuuguuacaucuuucgguccaguaucugaccacgauauggaguacacaauagaugucuuuuuuaggcagagcuggaaggacgagcggcuuaaguuuaaaggaccuaugacagugcuacggcugaauaauuugauggcuuccaagaucuggaccccggauacauucuuccacaacgggaaaaagagugucgcgcacaacaugaccaugccaaacaaacugcuuaggauaaccgaagacgggacucugcuuuacaccaugaggcugacugugagagccgaaugucccaugcaccuagaggauuucccuauggaugcccaugcauguccauugaaguuugggucauacgcuuauaccagagcagaagugguuuacgaauggacccgagagccugcuagaucugucgucguggcugaggauggcagcaggcuuaaccaauacgaucugcuggggcagacugucgauagcggcaucguacaaucuucaacuggcgaguacguggugaugacgacacacuuccaccucaaacguaagaucggauacuucgucauucaaacauaccugccgugcauaaugacagugauauuaagccaggucuccuuuuggcugaauagagaguccgugcccgcuagaacgguguuuggcgugacaacggugcugacgaugacuacuuuauccaucuccgcuaggaacucccuaccaaaagucgcauaugcuacugcaauggacugguucauugcagucugcuaugcuuucguuuucucugcucuaaucgaguucgccacgguuaacuacuuuacgaaaagaggcuaugcuugggacggaaagagcguaguuccagaaaagccuaaaaaaguaaaggacccacugauuaaaaagaauaauacuuaugcacccacagcuacuucauauacuccaaaucucgcccggggggacccaggacuugcaacaauagcaaaaagcgccacaaucgaacccaaagaagugaaaccugagaccaagcccccagagccaaagaaaaccuuuaauagcgucucuaagaucgauagacucucccgaaucgccuucccgcuccuuuuuggaauauuuaaccugguguacugggcaacguauuuaaaucgggaaccacaauugaaagccccaaccccacaucaguag

SEQ ID NO: 248204 - RNA, 345 nt, Artificial Sequence
  Description of Artificial Sequence: Synthetic coding sequence
auggcaaacagcggguguaaggauguaaccggucccgaugaggagucguuccucuauuucgccuauggcagcaauuugcugacugagaggauccaucugcguaauccuucugccgccuuuuucugugucgcuagguugcaggacuuuaaauuggauuucggcaauagucaggguaaaacuucacagacuuggcacggugggaucgccaccauauuccaaucccccggagaugaaguguggggagugguauggaaaaugaacaaaagcaaccucaacucucuugaugaacuuuuugccuggguacagaaaaaaauggucugucgguggagcauuaaaaggagcuag

SEQ ID NO: 248205 - RNA, 2196 nt, Artificial Sequence
  Description of Artificial Sequence: Synthetic coding sequence
auggugguggaacacccagaauucuugaaagcugggaaggagccaggguuacagaucuggagaguggagaaguucgaccuggugccaguacccacuaaccuguauggggauuucuuuacaggagaugcguaugucauucugaagaccgugcaauugcguaacggaaauuuacaguaugaccuccacuacugguugggcaaugagugcagccaggaugaaucaggagccgccgcgauuuucacggugcaacucgaugauuaccugaacgggagagcugugcagcauagagagguccagggauucgaaucugcgaccuuccuugguuacuucaaaagcgggcuuaaauacaaaaaggggggagucgcaucuggcuuuaagcaugugguaccuaaugaggugguuguucagagacuguuucagguaaaaggacguaggguggugagggcuacugagguaccaguuucuugggagagcuuuaauaacggcgauugcuucauuuuagaucuggguaacaacauacaccagugguguggcucgaauucaaaucgauacgagagguuaaaggcaacccagguguccaagggcaucagagacaacgaacgaucgggaagggcgagaguucacguaucagaggaggguacugaaccagaggcaauguugcaaguguugggcccuaagccggcacuaccugcagggaccgaggauacagcuaaagaagaugcggcaaauaggaagcuagcaaaacuguacaaggucucuaacggcgcgggcaccauguccguaagucuugucgcagaugaaaauccuuuugcacagggagcccuaaaaagcgaagauuguuucauccucgaccauggaaaagacggaaagauuuuugucuggaagggcaagcaagcaaauacagaagaacgcaaagccgcuuuaaagaccgcuucagauuucaucaccaaaauggauuaccccaaacagacgcaggucagugucuugccagagggaggcgaaacuccuuuauucaagcaauucuuuaagaauuggagagacccggaccagacggauggccugggauuguccuaccuguccucucacauugcuaacguugagagagugccuuuugacgccgcaacccuccacacaucgacugccauggcugcccagcaugggauggacgacgacggcacuggccagaagcagaucuggaggauugagggcucgaauaaggugccugucgauccagcuacauacgggcaguucuacgguggggauagcuauauaauccuguacaauuauaggcacggcgggcggcagggacagaucaucuauaacuggcaaggagcucaaucaacccaggacgaaguggccgccagcgcaauuuuaacggcucaguuagacgaagagcucggcggaacaccugugcagucuagagucguccaaggaaaggagccagcccaccugaugagucuguuugguggcaagcccaugauuaucuacaaagguggaaccucuagagaaggcggccagaccgcacccgcuagcacccgacuguuccagguacgggcaaacagugcaggcgcgacgagagccguggaagucuuaccuaaagccggggcauuaaauucuaacgacgcauuugugcuuaagacucccagcgcagccuaccucugggugggcacuggugccuccgaagcugagaagaccggagcccaggagcugcugagggugcugcgggcucagccaguucaaguggccgagggcucggaaccggacggcuucugggaggcgcuuggagggaaagcugcguaccgaaccagucccagacuuaaggauaaaaaaauggacgcucaccccccccgacuauucgcauguucuaacaaaaucggcagauucgucaucgaggaaguacccggggagcugaugcaggaggaucuggccacugacgacgugaugcuccucgauacuugggaucagguguuuguuugggucgggaaagacucccaagaggaagagaagaccgaggcgcugaccucagcaaagcgguacaucgagacagauccggccaacagggacagaaggacaccgauuacaguggugaagcagggauucgaacccccuuccuucgucgggugguuucuggggugggaugacgauuacuggucggucgacccccucgauagagccauggccgaacuggccgcuuag

SEQ ID NO: 248206 - RNA, 2196 nt, Artificial Sequence
  Description of Artificial Sequence: Synthetic coding sequence
augguggucgagcacccagaguuucugaaggccggaaaagaacccgggcuccaaaucuggagaguggaaaaauuugauuuaguccccguucccaccaaucuguacggagauuucuucacgggggaugcauacguaauucugaaaacugugcaacugcgaaacgguaacuugcaguaugaccuccacuauugguugggaaacgagugcucccaagaugagagcggggccgcagcaaucuucacaguccaacuugacgacuaucucaacggaagggccgugcagcaccgcgaaguccaaggauucgaguccgccacauuuuuaggguacuucaagucuggcuugaaguacaagaagggagggguugcaagcggauuuaaacacguggugccuaaugaagugguggugcaaagguuauuccaggucaaggguagacgggucguucgagccacugaaguuccuguauccugggagagcuuuaauaauggggauugcuucauucuugaccuuggcaauaacauccaccaguggugugggaguaacaguaaucgguaugagagacucaaagccacacaagucucaaagggcauaagagauaaugaaagaagcggacgagcccgggugcauguguccgaggaaggaaccgagcccgaagcaaugcuccaaguccuagggccaaaacccgcccuuccugcagggaccgaagacacggcaaaagaagaugcagcaaaucgaaaacuggcgaaguuguauaaagugaguaacggggccgggacaaugucugugagccucguugcagaugaaaaucccuucgcccagggggcccugaagagugaagacuguuucauccuggaucaugguaaggauggcaagaucuucguguggaaaggcaaacaggccaauacagaggagcgcaaagcggcccugaagacugcuucugauuuuauaaccaagauggacuauccuaaacagacacaggugagcguacugccugaggguggcgaaacuccacucuucaaacaguuuuuuaaaaacuggcgggaccccgaucagacagacggccugggacucucguaccucucgucccacaucgcuaauguggaaagggugccauucgaugccgcuacucugcauacuaguacagcgauggccgcccaacacggcauggacgaugacggaaccggccaaaaacaaauuuggcggauugaagggucuaacaaagugccuguggauccugcuacauacggucaguucuacggaggcgacucuuacauaauuuuauauaauuaccgccacggaggacggcagggacaaaucaucuauaacuggcagggcgcccaguccacccaggaugagguagccgcaagugcaaucuugacugcacagcuugacgaagaauuggguggaaccccaguccagucgcgcgucguacagggaaaggaacccgcucaccugaugucccuguucggggguaaaccaaugauuauauauaaggguggaacuucuagagagggaggacaaaccgccccugcuaguacucggcuuuuccaggugcgggcuaauuccgcuggggccacucgagcaguugaggugcugccuaaggccggcgcucugaacuccaaugaugcuuuugucuuaaagacacccagcgcugcguacuuguggguggguaccggggcaucugaagccgaaaaaacaggugcccaggaacucuugcgcgucuugagggcucagccgguucaggucgccgaggggagcgaacccgacggauuuugggaggcccucggagguaaagcugcauacaggaccuccccacgacuuaaggacaagaaaauggacgcucaccccccccggcuguucgccugcaguaacaaaauuggucgauuugugaucgaagaaguuccaggugaacuuaugcaagaggaucucgcaacggacgacgugaugcugcuggacacuugggaccagguguuugugugggucgggaaggauucccaagaggaagaaaaaaccgaagcacuaacaucugcuaagcgauacauagagacugauccugcuaacagagaccgccggacuccaauuaccgucguuaaacaagguuucgagccaccaucuuuuguugguugguuccucggcugggacgaugauuacuggucuguugauccgcucgaucgcgcuauggccgagcuggcagccuag

SEQ ID NO: 248207 - RNA, 2349 nt, Artificial Sequence
  Description of Artificial Sequence: Synthetic coding sequence
auggccccccaccggccagcaccagcucugcugugugcccugucuuuagcccugugugcuuugucccugccaguuagggcugccaccgcaagucggggcgccucgcaagccggggcuccucaggguagggugcccgaggcccggccaaauagcauggugguugagcaccccgaguuucugaaagccgggaaagagccaggcuuacagaucuggcgcguugaaaaguuugaccucguucccguccccacuaaucuuuacggcgacuuuuucaccggggacgccuacgucauucuuaaaacuguacaacugaggaacgggaaucuccaguacgaccuucacuauuggcugggaaacgaaugcucacaggaugagagcggcgccgcggccaucuucaccguccagcuggacgacuaccuuaaugggagagccgugcagcacagggaggugcaaggcuucgaaagugcaacguuccucggauacuucaaaagcgggcugaaguacaaaaagggagggguagcuucaggguucaagcacguggugccuaacgaggugguugugcagcgguuauuucaagucaagggccgcaggguggugagagcaacagaagugccuguuucuugggaaucguuuaacaacggcgauugcuuuauccuugaucuuggaaacaacauacaucagugguguggcucuaauucaaaccgauaugaaagacuuaaggccacccaggucucaaagggcauacgugauaacgagagaagcggccgggcacgcguccacguuucugaggaaggcacagagcccgaggcuaugcugcaagugcuugguccgaagcccgcucugccugcuggaacugaggauaccgcuaaagaggacgccgccaaccgaaagcuggccaagcuuuauaaagugucaaacggagccggaaccaugagcgugucccuaguggccgacgagaacccauuugcucagggagcacuaaagucggaggauuguuuuauucuugaucacggaaaggaugguaaaaucuuugucuggaagggaaaacaggcuaacaccgaggaaagaaaagcggccuugaagaccgcaucagacuucauaaccaagauggauuauccaaagcagacccaaguguccgugcucccugaagggggagaaacaccacucuucaagcaguucuucaaaaacuggagagauccugaccaaacagacgggcugggacuuuccuaucucuccagccauauugcaaacguggagagagugccguuugaugcagccacauugcauacuuccacagccauggccgcucagcacgggauggaugaugauggaacagggcagaagcagaucuggcgcaucgaaggcaguaauaaagucccuguggauccggcaaccuaugggcaguuuuacgggggugacagcuacaucauccuguacaauuacaggcauggcggaagacaggggcagauuauuuauaacuggcaaggcgcacaaucgacucaggaugagguggccgcaagcgcgauccuuacugcccagcuggacgaggaacucggcggcacccccgugcagagucguguugugcagggaaaagagcccgcccaucugaugagccuuuucggcggcaagccaaugaucauuuacaaaggaggaacaagccgggagggcggccagaccgcucccgccagcaccagacuguuccagguuagagccaauagcgcaggagcuacgcgugcugucgagguguuacccaaagcaggagcccucaauucuaacgacgccuucguacugaaaacccccagcgccgcuuaucugugggucgggacaggcgcuucugaagcagaaaaaaccggggcccaggaacugcugagaguccugcgggcacagccuguucagguugcagaaggaucagagccagacggguuuugggaagcacugggaggaaaagcugcguacaggaccuccccccggcuuaaggacaaaaaaauggaugcccaucccccucgacuuuuugccuguucuaauaaaaucggcagauuugugauugaggaggugccuggcgaauugaugcaggaggaccuggcgaccgacgacgugaugcuccuggacacgugggaucaaguauucguuugggucgguaaggauagucaagaggaagaaaagaccgaggcccugacuagcgcaaaacguuauaucgagaccgacccagccaaucgcgacagacgaaccccuauaacuguaguuaaacaaggcuuugaaccgcccagcuucgucggcugguuccucggaugggaugacgacuacugguccguggacccucuggaccgagcuauggccgaacuggccgcauag

SEQ ID NO: 248208 - RNA, 2196 nt, Artificial Sequence
  Description of Artificial Sequence: Synthetic coding sequence
augguuguugaacauccugaguuccugaaggcugggaaggaacccggauuacagaucuggaggguggagaaauuugauuuaguacccguuccgaccaaccuauacggggacuuuuucacaggugacgcuuacgugauuuugaaaacuguucaacugaggaauggaaacuugcaguaugaccugcacuacuggcuuggcaaugaguguucacaagaugaaucuggcgcugcagcuauuuucacgguucagcuugacgacuacuugaacggcagagcgguccaacacagagaggugcagggcuucgaauccgcaaccuuucucggguacuucaaaucuggucugaaguauaaaaaaggagguguggcuaguggauucaaacaugucgucccgaacgaagucguggugcagcggcuuuuccaggugaagggacgaagaguaguuagggcaacagagguaccugugagcugggaguccuuuaacaacggcgauugcuuuauucuagaucucgguaacaauauucaucaaugguguggguccaauagcaaucgguaugagcggcuuaaggcuacccagguuagcaaggguauaagagauaaugaacggucuggacgcgcuagaguccacguguccgaggaggggaccgagcccgaagcaaugcugcaaguacuggggccgaagccugcucucccagcuggaacugaggacacagcuaaggaggaugccgcuaaucgcaaacucgcaaaacuguacaagguguccaacggagcuggaacgauguccgucucucugguggccgacgagaaucccuuugcacagggagcccucaaaucugaagacuguuuuauacuggaucacggcaaggacggcaaaauauucguguggaaaggcaagcaggccaauaccgaagaacggaaggcugcacugaaaacugcauccgauuuuaucaccaagauggacuaccccaaacagacacaggugucagugcuuccugagggaggagagacgccucuguuuaaacaguucuucaagaauuggagagaucccgaccagacagacggauuggguuuauccuauuuaagcagucauauugccaacguggagagagucccauuugacgccgccacacugcauacaagcacugccauggccgcucaacaugguauggacgaugauggaacaggucagaagcagaucuggagaauugaaggcuccaauaagguccccgucgauccugcuaccuauggacaguucuauggcggagauuccuacaucauccuguauaauuauaggcauggggggagacaaggacaaauuauauacaauuggcagggagcucaaucuacccaggaugaggucgcagccagcgccauccuuacugcucagcuagaugaagaacuuggugggacgcccgugcagagucgggugguccaagggaaagaacccgcccaucucaugucucuguuuggugggaaaccuaugauuauauacaaggguggaacauccagggaaggaggccagaccgcacccgcauccacgaggcucuuucaagugagagcuaauucugccggcgccacacgggcuguugagguucuccccaaggccggggcccugaauagcaaugaugcuuucguucucaaaacuccaagugccgccuaucucugggucggaacgggggccucagaggcugaaaaaacuggggcucaagaguugcugcgcguacucagagcacaaccaguccagguugcugaaggcucugagccugauggcuuuugggaagcacugggagggaaggcugccuaccggaccuccccaagacugaaagauaagaagauggaugcccaccccccaagacuauucgcuuguagcaauaagaucgggagguuuguaauagaggagguccccggggaguuaaugcaagaagaccuggcuacugacgacguaauguugcuugauacgugggaccagguuuucgugugggugggaaaagauagccaagaagaggagaagacugaggcccuaaccucugccaagagauauaucgagacagacccagcuaauagagaccgcaggacucccaucacugucgugaagcagggguuugaaccaccgucuuucgucggaugguucuugggcugggacgaugacuauuggaguguggacccccucgacagagccauggccgaacuggcugcguag

SEQ ID NO: 248209 - RNA, 2148 nt, Artificial Sequence
  Description of Artificial Sequence: Synthetic coding sequence
auggugguggagcacccggaguuuuugaaggcgggaaaagagccggguuugcagaucuggcguguugagaaguucgaugcguaugucaucuugaagacuguccaacuucguaacggcaacuugcaguacgaucuccacuacuggcucggcaaugaaugcagucaggacgagagcggcgcugccgcaaucuucacaguacagcuggacgacuaccugaacggccgggccgugcagcaucgggaggugcaaggauuugagagugcaacauuucuugguuauuucaaaaguggacugaaauacaagaagggaggcguggcaucugguuuuaaacacguggugcccaaugaggucgucguucaacgccuguuucaggugaagggcaggaggguuguuagggcaacugaagugcccguuucgugggaaucauucaauaacggagacugcuuuauacuggaucuggggaacaauauucaucagugguguggauccaauagcaaucguuaugaacgucuuaaggcuacucaagugucaaaagggauucgagauaaugagagguccgguagggcccgggugcacguuagcgaggaaggcacugagcccgaggcuaugcuucagguguuggggcccaagcccgcccucccagcuggaaccgaggauacagcaaaagaggaugcagcaaaucgcaagcuggcaaaacuguauaaaguguccaacggcgccggcacaaugagcgucagccuggucgcagaugaaaauccauucgcccagggggcccuaaaguccgaggacuguuuuauucuggaucauggaaaagacggaaaaauuuucgucuggaaggggaagcaggcuaacaccgaagaaaggaaggccgcuuuaaaaacagcgucagauuuuaucacuaagauggauuaccccaaacagacacaggugagcguguugcccgaagguggcgaaacaccccucuucaaacaguucuucaaaaauuggagagacccagaccaaaccgacggcuuggggcucucuuaccugucaagccacauugcuaacguugaaaggguucccuuugaugcugcuacacuccauacaaguacggcuauggcagcccagcacggaauggaugacgacggcaccgggcaaaagcaaauuuggcguauugaggggagcaauaaggugcccguagacccagcaaccuacggacaguuuuauggaggcgacucuuauaucauuuuauacaacuauagacacggaggacgacagggccagaucaucuacaacuggcagggggcacagaguacacaggacgagguugcagccagugccaucuugacagcucaguuggacgaagagcucggaggcacacccgugcaaagcagggucguacaggguaaggagccugcucaccuuaugagucuuuuugguggcaaaccuaugaucauauacaaaggggguacuucuagggagggaggccaaacagccccagcuaguacuagacuguuucagguccgcgccaauucugcgggugccacgagggcaguugaggugcugccaaaggcuggagcuuuaaacagcaacgacgcauuuguguugaagacuccuagcgcagcuuauuugugggugggcaccggagccagcgaggcagagaagacaggcgcccaggaacuucugagaguacuuagggcacagccggugcagguggccgaaggaucagagcccgacggauucugggaagcccugggaggaaaggccgcguacagaaccucacccagguugaaagacaaaaaaauggacgcccaccccccccgauuauuugccugcaguaacaagauugguagauucgugauugaggaggucccuggggagcucaugcaggaagaucucgcuacggacgacguuaugcuucuggauacuugggaucaggucuuuguuugggugggaaaagacagccaggaggaggagaagaccgaggcccugacaucugccaagcgguauauagagacagauccugccaaccgcgaccggagaacccccaucacagucguuaagcaggguuuugagccccccucuuuuguggggugguuucuagggugggaugaugauuacuggagcguggacccccuugaucgagcgauggccgaacucgcggccuag

SEQ ID NO: 248210 - RNA, 2229 nt, Artificial Sequence
  Description of Artificial Sequence: Synthetic coding sequence
auggagaaacuguucugcugcuucccgaacagcaugguaguugagcauccagaguuucuaaaggcagggaaggaacccggguugcagaucuggcgcguggaaaaguuugaucuggucccaguccccaccaaccucuauggcgacuuuuuuacaggggaugcguacguuauucucaaaacaguucagcugcguaaugggaacuugcaguaugaucuccacuauuggcuggggaaugagugcagucaggaugagucuggcgccgccgcuaucuuuaccgugcagcuggaugacuauuuaaacggcagagcugugcagcaucgagaagugcaagguuucgagagcgcgacauuuuugggguacuuuaagucgggacugaaguauaaaaaggguggagucgcuuccgguuucaagcaugucgugccaaaugagguagugguccaacgccuguuccaggugaaagguagaagagugguaagggcaacugaaguuccgguaucaugggaaagcuuuaauaauggagacugcuucauuuuggaccuggggaacaacauucaucaguggugcggcaguaauagcaaucgcuacgaacgucucaaagccacacaggucucuaagggaauuagagauaacgagaggagcggaagagcacgugugcacguuucugaggaggguaccgaacccgaggccaugcugcagguacuggguccgaagccagcccuccccgccggaaccgaagauaccgcuaaggaagaugcggcuaaucggaagcuggcaaaauuguacaagguuaguaauggggcagggacaaugagcgucagccucgucgccgaugaaaacccuuucgcccagggcgcacucaagagcgaagauuguuuuauccucgaccacggaaaagauggcaaaauauuugucuggaaggggaaacaagccaauaccgaggaacggaaggcggcauuaaaaacagcuuccgauuucauuacuaagauggauuauccaaagcagacucaagucaguguacucccugaggguggggaaacgccucuuuucaagcaguucuucaaaaauuggagagacccugaucagaccgacggucuggggcuguccuaucucucaucccauauagcgaacgucgagcgcguucccuucgaugccgccacccugcacacuagcaccgcaauggccgcucagcacggaauggacgaugacggcaccggacagaaacagaucuggagaauugagggcagcaacaaggugccaguggauccugccaccuacggucaauucuaugggggggacagcuauaucauccuguauaacuaccggcauggcggucggcaaggccaaauuauuuauaacuggcagggugcccagucuacacaagacgaagucgcagccucugcaauucuaacugcccaacucgacgaggaauugggcggaaccccuguucagucuagaguugugcaggggaaggagcccgcacaucugaugagucuguucgggggcaagccgaugaucauuuauaaaggggguacaucucgggagggaggccaaaccgcucccgccagcacacgccucuuucaagugcgcgccaacuccgccggugcaacucgagccguugagguucucccaaaggccggcgcacugaauuccaaugacgcuuucguuuuaaagacgcccagcgcagcuuauuugugggugggaacuggcgcuucugaagccgaaaaaacgggugcacaggaguugcugcgugugcuccgcgcccaacccgugcaggucgccgagggcucggaaccagacggcuucugggaagcauuaggcgggaaagcugcuuauaggacuagcccgagacuaaaagauaaaaagauggacgcucauccaccuagacucuucgcuuguuccaacaagaucggucgguuugucauugaagaaguccccggggagcuuaugcaggaagaucucgcaacagaugaugugaugcugcuggacacaugggaucaaguuuucgucuggguaggcaaagauagucaggaagaagagaagacggaagcacugacgucugcgaagagauauauugaaaccgaccccgcuaaccgcgacaggaggacucccauuaccguggugaaacagggauuugagccacccucauucgucggcugguuucugggaugggacgacgacuauuggaguguugauccccuugacagagccauggccgaguuagccgccuag

SEQ ID NO: 248211 - RNA, 2196 nt, Artificial Sequence
  Description of Artificial Sequence: Synthetic coding sequence
augguaguagaacauccugaauuuuuaaaggcaggcaaggagccuggacuucaaauuuggcgagucgagaaguuugaccuagugccagucccgacaaaccuguauggugauuucuuuacuggcgaugcauaugucaucuugaaaacagugcagcugcggaacgguaacuugcaauaugaccuccacuauuggcuagguaacgagugcucacaggaugagucaggcgccgcugccauauuuaccgugcagcucgacgauuaucugaacggcagggcuguacagcaucgggagguccagggcuuugaguccgcaaccuuucuaggcuauuucaaauccggucucaaguauaagaagggggguguagcuaguggauucaagcaugugguuccaaaugaaguagucgugcagaggcucuuucaaguaaaaggaaggcggguggugagggcaacagaagugcccgugagcugggaaagcuucaauaacggcgacuguuucauccuggacuugggaaacaauauccaucaaugguguggaaguaauaguaauagguacgagcggcugaaagccacacaaguuagcaaagguaucagagauaaugaaagaagcggcagggcgcgaguccaugucucagaagagggaaccgagccagaagcuaugcugcaggucuuggguccgaagccugcccuccccgccggcacagaagacaccgcuaaagaggaugcugcaaaccgcaaacuggcuaagcucuauaaggucucaaauggggccgggacaaugucuguaucccugguggcagacgagaaucccuucgcucaaggggcacugaaaucugaggacugcuuuauccuugaccacggcaaggauggcaaaaucuuuguuuggaagggcaagcaagccaauaccgaggaaagaaaggcggccuugaagaccgcgagcgacuuuaucaccaagauggacuaucccaaacagacccagguuagugugcugccugagggaggugagacaccucuuuucaaacaguuuuuuaaaaauuggagagaccccgaccagacagacggacucggccuaucuuauuugucuagccacauugcuaauguggagcgcgugccuuucgacgcugcuacguugcacacuucuacagccauggcugcccagcacggaauggacgacgacgguaccgggcagaaacaaauuuggaggaucgaggguucgaauaaaguaccuguggacccggcaaccuacggacaguuuuacggaggagauucuuacauuauccucuacaacuaccgccacggugguaggcaaggucagauaaucuacaauuggcagggcgcccagaguacgcaggacgaaguggcugccagugcaauccuuacugcgcagcuggaugaggaacucggcggaacacccguccagucccgugucgugcagggaaaggaacccgcccaucugaugagucuguuugggggcaaacccaugauaauuuauaaaggggggacuuccagggagggcggccagacggccccugcaagcacuagauuauuucagguucgcgccaauucugccggagccacccgggccguggagguauugcccaaggccggggcacuaaacucgaaugacgccuucgugcugaaaacaccgucagcugcuuaucuuuggguaggaacuggcgccuccgaggccgaaaaaacgggagcucaggagcucuugagagugcugagggcgcagccaguacagguagccgaagggucagaaccugauggcuuuugggaagcucugggagggaaggcggcuuaucgaaccucuccgcgccugaaggacaagaagauggacgcacaccccccacgccucuuugccugcagcaauaagauuggacgauucguuauugaagaggugccaggggaacucaugcaagaagaucucgccacagacgauguaaugcuucuggauacuugggaccagguuuucguguggguggguaaggauagccaagaagaggaaaaaacagaagcuuugacaagcgcaaaaagauauaucgagaccgacccugcuaacagagaccgacgaaccccaaucaccguugugaaacagggguucgagccccccucauucgugggcugguucuuaggaugggacgacgacuacuggucuguugacccuuuagauagagcuauggccgaacuggcugcuuag

SEQ ID NO: 248212 - RNA, 783 nt, Artificial Sequence
  Description of Artificial Sequence: Synthetic coding sequence
auggucguagaacacccugaauuucugaaagcugggaaagaaccaggccuacagaucuggcgcgucgagaaguucgaucuugugccagugccuacuaaucucuauggcgauuuuuuuacgggcgaugccuaugugauacugaaaacuguacagcuaaggaacggcaaccugcaguacgauuuacauuauuggcuuggaaaugagugcucccaggacgaguccggcgcugcggcuauuuucacaguccaauuggacgacuaccugaauggacgggcaguccagcaccgugaaguccaaggcuuugagagcgcuacauuucugggauauuucaaguccggucucaaauauaaaaaaggaggcguggcuagcggauuuaaacacguugugccuaacgaggucguaguccagcggcuauuccagguuaaaggcagaagggugguacgcgcaacagaagugccugugucuugggaaucuuuuaacaauggcgacuguuuuauccucgaucucggcaauaauauucaccaguggugcgguagcaacucuaauagguacgagcgucuuaaggccacgcagguuuccaaaggaauccgggacaaugaaaggucugggcgugcacgugugcacgugagcgaggaagguacagagccagaggcuaugcuucagguccuagguccgaaaccagcacugccagcuggaaccgaggauacagccaaagaagaugccgccaaccggaaacucgcuaagcucuauaaagugaguaacggugccggaaccaugagcuag

SEQ ID NO: 248213 - RNA, 2229 nt, Artificial Sequence
  Description of Artificial Sequence: Synthetic coding sequence
auggagaaacuguuuuguugcuuccccaacucaauggucguugagcacccagaguuccucaaagccggaaaggagccaggacugcaaauuuggaggguugagaaguucgaccucguuccagugccuacaaaucuuuacggggauuucuuuaccggggacgccuacgugaucuuaaaaaccguccagcuucgaaacggaaaccuucaguaugacuugcauuacuggcuuggcaacgaaugcucacaggaugagucuggugccgcugcuauuuuuacaguacaacuagacgauuaucugaauggccgggccgugcagcauagggaggugcaaggauucgagucugccacuuuucuagguuauuuuaagagcggacuaaaguacaaaaagggcggaguggcuagcgguuucaagcacguagugccaaaugaggucguugugcagcguuuauuccaggucaagggcagaagagugguacgagccacggagguccccguuuccugggagucauuuaacaacggagauuguuuuauucuagaccucggaaacaacauccaucaguggugcggaagcaauuccaacagauacgaaaggcucaaagcaacacaaguuucgaaaggaaucagagacaacgaacgcaguggacgggcgcguguccacgugagcgaggaagguaccgagcccgaggcuaugcugcagguccuaggucccaagccugcguuaccugcgggaacagaggauacggcgaaggaggaugccgccaaccguaagcucgcuaaacuguacaagguuucgaauggcgcagguacgauguccgucagucuaguagcggacgaaaacccuuucgcccagggcgcauugaaauccgaggauugcuucauucuggaccacggaaaagacggcaaaauuuucgucuggaaggggaagcaggcuaauacagaggaaaggaaagcugcccucaagacugccagugacuuuauuaccaaaauggacuacccuaaacagacucaggucagcguacugccagaaggcggugaaacaccccucuucaagcaguuuuucaaaaauuggcgggauccagaucagacugacgguuuaggccucuccuaccucagcucucacauugccaacgucgagaggguucccuucgacgcagccacauuacauaccucaaccgcgauggcagcucagcacggcauggaugacgacgguacagggcagaaacagaucuggcguaucgaaggaucgaacaagguucccguggacccugcgacauacggacaauucuauggaggcgauagcuacauuaucuuguauaauuaucggcacggggggagacaaggucagaucaucuauaacuggcagggggcucagagcacacaggaugaagucgccgcuagcgcaauccuuacagcccagcuggacgaagaacuuggcggcacaccggugcaaucuagggugguccaggguaaggaacccgcacaccucaugucucuauuuggugguaagcccaugaucaucuauaagggcggcaccagccgagagggcggacagacagcaccugcaucuacuagacuauuccaggugcgggccaacuccgcgggagccacccgugccguagaggugcugcccaaggccggagcauugaacuccaacgacgcauucguucucaagacccccuccgccgcauacuugugggucggaaccggggcaucagaggccgagaagacaggcgcccaggaacuucugcggguacugcgcgcccagccagugcaaguggccgagggaucagagccagacggcuuuugggaagcucuuggggguaaagccgcguacaggacuucaccacgauugaaagacaaaaagauggacgcccauccucccagauuauuugcaugcuccaauaagaucggaagguucguaaucgaggagguaccuggggagcucaugcaagaggaucuggcaacggaugaugugauguuacuagacacuugggaccaaguauucgugugggugggcaaggacagccaagaagaagaaaaaacagaagcacugaccucugcuaagagauauauugaaacggacccugcgaaucgagaccguaggacccccauuacuguugugaagcaggguuuugagccacccucauucgucgggugguuccuggggugggacgacgacuacugguccguggauccccucgacagagcgauggcugagcucgcagccuag

SEQ ID NO: 248214 - RNA, 2196 nt, Artificial Sequence
  Description of Artificial Sequence: Synthetic coding sequence
auggucgucgaacacccugaguuucugaaagcagguaaggaaccuggacugcaaauuuggagaguggaaaaguuugaccugguacccguaccgaccaaccucuauggggacuuuuuuaccggcgaugcuuauguaauucugaaaaccgugcaauugcggaaugguaacuuacaguaugaucuacacuauugguugggaaaugagugcucucaggaugaguccggcgcugccgcaaucuuuacaguucagcuagacgauuacuugaacggcagggccgugcaacaucgugaggugcaggguuucgaaucugcaaccuuucucggguacuuuaagucuggacugaaguacaaaaaaggcggcguugccuccggcuuuaaacacgucgugcccaaugaagucguagugcagcggcuguuucaaguuaaagggcgccgcgugguuagagcgacugaaguaccggugucaugggaaucauucaacaauggagauugcuuuauuuuggaucuugggaauaauauucaccagugguguggcuccaauuccaacagguaugaaaggcuuaaagccacccaggucagcaaaggaauucgcgauaacgaacgaucuggacgcgcccgcguucauguuagugaggaggggaccgagccagaggccaugcugcagguacugggcccaaagcccgcucuucccgcagggacugaagauaccgccaaagaggaugccgccaacagaaaguuggcaaaacuguauaaggucaguaacggagccgguacuaugucugugagucuuguagcagacgaaaacccuuuugcucaaggcgcccugaaaagcgaagauuguuuuauuuuggaucacggaaaagacgguaaaauuuucguguggaaaggaaagcaggccaauaccgaggagaggaaagccgcccugaaaacagccagugauuuuauaacgaaaauggacuacccgaaacaaacucaaguuucagugcuaccggaagggggugagacaccguuguuuaagcaguucuucaaaaauuggcgcgaccccgaccaaacggauggauugggcuuaucguacuugaguagccacauagccaauguugaacguguuccuuuugaugcugccacccuccauacuagcaccgcuauggccgcacagcauggaauggaugacgacgguaccggacaaaaacagaucuggcggaucgagggaucaaauaagguccccguggaccccgcaacuuacggccaguuuuacgguggggauuccuauaucauuuuauacaacuauagacacggcggccggcagggccagaucauuuauaacuggcagggggcgcagagcacucaggaugaagucgccgcauccgcaauacuaaccgcucagcuggaugaggagcuuggcggaaccccagugcagagcagggucguacaggggaaggaaccugcccaccucaugucacucuucggaggcaaacccaugaucaucuauaaaggcgggaccagccgcgagggcggacaaacugccccagcguccaccagguuguuucagguccgcgcaaauuccgcuggagcaacacgagcaguugaagugcugccaaaggcgggggcccugaacucaaacgacgccuucguauuaaaaaccccuagcgcggcguacuuguggguagggacaggagccagcgaagccgagaagacaggagcccaggaacuucuuagggugcugagggcgcagccagugcagguagcugagggcucagaacccgaugguuuuugggaggcccuuggcgggaaggcagcuuacagaacaucaccccggcucaaggauaaaaaaauggaugcacauccaccucgacucuuugccugcuccaauaagaucgggagauucgugaucgaagagguaccgggcgaguugaugcaggaggaccuugccacugaugaugugaugcugcuggauacuugggaccagguguuugugugggugggcaaggacucacaagaggaggaaaagacagaagcacugacaucugccaagcgauacaucgagacagacccagcaaacagagauagacgcacucccauuaccguggugaagcagggguucgagccacccucuuucgugggaugguuccucggaugggacgacgacuacuggagcgucgacccucucgauagagcgauggcugagcucgccgcuuag

SEQ ID NO: 248215 - RNA, 2118 nt, Artificial Sequence
  Description of Artificial Sequence: Synthetic coding sequence
auggucgucgaacauccugaauuccucaaagcagggaaggaaccuggccuucagauauggaggguagaaaaguuugacuuagugcccguacccacuaaucuguacggcgacuuuuuuaccggcgacgcauaugugauccugaagaccguccaauuaagaaauggcaaccugcaauacgaccuucacuacuggcuagggaacgagugcucacaggaugaauccggugcugcugcaauuuuuacugugcaguuggacgauuaccugaaauacaaaaaaggaggaguagcaucaggcuucaagcauguggugccuaacgaagugguggugcagcgccuguuccaggucaaaggccggagaguggucagagccaccgagguucccguuucuugggaguccuuuaauaacggagauugcuucaucuuggaucugggaaacaauauucaccaauggugugggaguaauaguaauagguacgagaggcucaaagcaacacaagucucaaagggcauacgcgauaacgagcgcagcggucgggcuagagugcauguuagcgaggagggaacggagcccgaagccaugcuccagguccugggccccaagcccgcucuuccagccgguaccgaagauacugccaaggaagacgccgccaacaggaagcuugcuaaacuguacaagguuucaaacggggccggcacaauguccguuucccuaguugccgaugagaacccauuugcccagggggcacugaaaagcgaagacuguuucaucuuagaucacggcaaggauggaaagaucuucguuuggaagggcaaacaggcuaauacagaggagagaaaagcugcccugaagacagcgucugacuucauuacuaaaauggacuauccgaaacagacccaggucagcgugcugcccgagggcggagagaccccacuuuuuaaacaguuuuucaaaaauuggcgggacccagaucagaccgacggucuaggacuaaguuauuuaagcucucauauugcaaauguggagagaguccccuuugacgccgccacacuccacacaucuaccgcuauggcugcacaacauggaauggaugacgacggaaccggacagaaacagaucuggcgcauugaaggaucaaauaaaguaccagucgacccagcuacguacgggcaguucuacggaggcgauucuuacaucauucucuauaauuauagacacggaggcaggcagggacagaucaucuacaauuggcaaggcgcucagagcacucaggacgagguggcagccucugcuauccuaacugcacaguuggacgaagaguuagguggaacuccugugcaaagucgggucgugcaaggcaaagaacccgcccaucugaugagucuuuucgggggcaagccgaugauaauuuauaaagggggaacauccagggagggaggacagaccgccccugcuucaacccgacuguuccaaguucgagccaauuccgcgggagccacucgcgcuguggaagugcugccuaaggcaggggcucugaacucgaacgacgcauuugugcugaagacuccaagugcagcguaucucugggugggcacuggcgcaucagaggccgaaaaaacuggcgcgcaggagcuacugaggguacugcgugcucagccggugcagguugccgagggcagcgagcccgauggauucugggaagcguuggggggcaaagccgcauaucgcaccagcccacgacucaaggauaagaaaauggacgcccauccuccuagacuguucgcuugcucuaauaagaucgggagguucguaauugaagaaguccccggggagcuuaugcaggaggaucuggcuaccgaugaugugaugcugcuugauacaugggaccagguguuugugugggugggaaaagacucccaggaggaagagaagacagaggccuugacgucagccaagcgauacaucgagaccgauccugccaauagggauaggaggacucccauaacaguggugaagcagggauucgagccccccaguuucgucggcugguucuuggguugggacgacgauuacuggaguguugacccccuggauagagcuauggcagaauuagcagcauag

SEQ ID NO: 248216 - RNA, 2220 nt, Artificial Sequence
  Description of Artificial Sequence: Synthetic coding sequence
augccccuguguacucccaacucaaugguuguugagcauccagaguuccugaaagcuggaaaagaacccggccugcagauuuggcggguggagaaguucgaccuaguacccgugccaacaaacuuauauggcgauuucuuuacaggagaugcguacgugauucucaaaacagugcagcugcguaacggaaaccugcaguacgacuugcacuacuggcuagggaacgagugcucucaagaugaaagcggcgccgcagcuaucuucacugugcaauuggaugacuaccugaauggccgagccguccagcaccgggagguucaaggauucgaguccgcuacauuccugggguacuucaagagugguuuaaaauauaagaaaggcggagucgccucaggguucaaacauguggucccuaacgaggucgucgugcaaagacuuuuucagguuaaaggaagacgaguggucagagccacagaggugcccgugagcugggaauccuucaacaauggcgauugcuucauccucgaucugggaaacaauauccaucaguggugcggaucuaauucuaaucgguaugagagguuaaaggcuacacaggugagcaaaggcauacgugacaacgaaagaucagggcgggcccgcgugcacgugucagaggaaggcacugaaccugaagccauguugcagguauuaggcccuaagccagcucugccugcuggaacagaagacacugccaaagaggaugcugccaaccggaaauuggccaaauuguacaaggugucuaacggggccgguacgaugucggugagccuaguggcagacgaaaacccauucgcccagggcgcccuuaagucagaggauuguuucauccuagaccacgggaaagacggcaagauauucguuuggaaggguaagcaggcaaacaccgaagaacggaaagcugcucucaaaacugcgagugauuucauaacuaaaauggacuauccuaaacagacacaagugucuguccuucccgaaggcggcgagaccccacuuuucaagcaguucuucaaaaacuggagggauccagaucagacugacggcuuaggucucuccuauuuguccagccacauagccaacguggaacgaguccccuuugacgcagcgacauugcacaccucaaccgcaauggcggcucaacacgguauggacgaugauggaaccggucagaaacagauuuggcggaucgagggcuccaacaagguccccguggaucccgccaccuauggccaguuuuacgguggcgauucauauaucauucuguacaacuaccggcacggcgggagacagggacaaaucaucuacaacuggcagggcgcgcagucuacgcaggaugagguagccgcuagcgcgauucugaccgcgcagcuagacgaagagcugggcggcacucccgugcagagccgaguggugcagggaaaggaacccgcucaucuaaugucucuguucggcggcaagccuaugauuaucuacaaaggugggacuucacgcgaggguggccagacagcucccgccucuacuagguuguuucagguacgagccaauagcgcaggugccaccagggcagucgagguccucccaaaggccggggcacucaacagcaacgacgccuuuguguuaaagacaccuagugccgcauaccuguggguaggaacuggggcgagcgaagcugagaaaaccggugcacaggagcuacugcguguccuccgggcccagccagugcagguugccgagggcagugagcccgacggcuuuugggaggcucuaggcgggaaggcagcuuacaggacuucuccccgccucaaggacaagaagauggaugcacacccacccagguuguucgcuuguuccaauaagauuggccgcuuugugaucgaagaagucccaggagagcugaugcaggaagaucuugccaccgacgauguuaugcuucuggauacaugggaucagguguucguauggguugguaaagacagccaggaggaagagaaaacggaagcucucaccagcgcuaagagauacauugagaccgacccugccaacagagaccgcagaacuccaauuacuguuguaaagcagggcuucgaaccaccgaguuuuguuggaugguuccucggaugggacgaugauuacuggaguguugacccccuggacagggcaauggccgagcuagcugccuag

SEQ ID NO: 248217 - RNA, 351 nt, Artificial Sequence
  Description of Artificial Sequence: Synthetic coding sequence
augcccucaccggguacaguguguucucuucuccuuuuagggaugcuuugguuagaucuggcaauggccggcucuucuuuucuuuccccugagcaccaacggguccagcgaaaggaaucaaagaaaccgccggcgaaauugcagccacgggcacuggccgguuggcuacgacccgaggaugggggacaggcagaaggagccgaagaugaacuugaagugcgcuucaaugcacccuuugacgucggaaucaagcucucuggaguucaguaucagcagcacagccaggcuuuaggcaaguuucugcaagacauucugugggaagaagccaaagaggcccccgccgacaaguag

SEQ ID NO: 248218 - RNA, 354 nt, Artificial Sequence
  Description of Artificial Sequence: Synthetic coding sequence
augcccagcccuggcacugucugcagcuugcuauuacuuggcaugcuaugguuagaccuggcaauggcaggaagcaguuuucugucccccgagcaccaaagggugcaacagcguaaggagucaaagaaaccgcccgccaaauugcagccuagagccuuagcuggguggcuaaggcccgaagaugggggccaggcagaaggggcugaggacgaauuagaaguuagauuuaaugcuccauuugaugucgggaucaaacuuucaggcgugcaguaccagcaacacagccaagcucucgguaaguuucuucaggacauccucugggaagaggcuaaggaagccccagcugacaaguag

SEQ ID NO: 248219 - RNA, 276 nt, Artificial Sequence
  Description of Artificial Sequence: Synthetic coding sequence
augcccucaccaggaacgguauguucacugcugcucuuggggaugcucuggcucgaccuggcuauggcaggaagcucuuuccugucuccagaacaccagcggguccaacaaagaaaggagucuaagaagccaccugcuaaacugcaacccagagcucuggcaggcugguugcggccagaggauggcggacaggcggagggcgccgaagaugaacuggaagugagaagaccccaacccacaagugaucguccgcaagcauugcugacaucucuguag

SEQ ID NO: 248220 - RNA, 102 nt, Artificial Sequence
  Description of Artificial Sequence: Synthetic coding sequence
augccuagccccggaacgguguguagcuugcuuuugcugggaauguuguggcucgaucucgcaauggccggaagcaguuuucuuaguccugaacaccaauag

SEQ ID NO: 248221 - RNA, 354 nt, Artificial Sequence
  Description of Artificial Sequence: Synthetic coding sequence
augcccucccccggcacaguauguagccugcuucugcucggaaugcuuuggcuugaucucgccauggcaggcagcaguuuucuauccccugaacaccagcgcguccagcaacgcaaggaguccaagaagccaccagcuaaacuccaaccuagggcccuggccggguggcuaagaccugaggacgggggccaagcagaaggggccgaggacgaacucgaagugcgauucaacgcaccguuugacguaggcauuaagcuuagcggugugcaguaccaacagcauucacaagcccuggguaaauuucuccaggacauuuugugggaagaggccaaagaggcaccugccgauaaguag

SEQ ID NO: 248222 - RNA, 351 nt, Artificial Sequence
  Description of Artificial Sequence: Synthetic coding sequence
augcccucaccaggcacugugugcuccuuacuccuccuggguauguugugguuggaucuagcaauggccggguccaguuuccuguccccagagcaccagagaguacaacguaaagagucuaaaaaaccacccgccaagcugcagccucgagcacuggccggauggcuccggcccgaggacgggggccaagcugaaggugccgaagacgaauuggaggucagauucaaugccccuuucgaugucgggaucaaacucagcggcgugcaguaccagcagcauagccaagcuuuaggaaaauuuuugcaggauauauuaugggaagaggccaaagaggccccugccgauaaauag

SEQ ID NO: 248223 - RNA, 318 nt, Artificial Sequence
  Description of Artificial Sequence: Synthetic coding sequence
auguuuacuugcugguggagcuaccugagaucuacccuggcagcugucccaggcgaagccucccgugugcagcagcgcaaagagucaaagaaacccccagcaaaacugcagccacgggcacuugcuggaugguugagaccugaagacggcggacaggccgagggggccgaagaugagcuggaaguucgguucaaugcgccauucgacguggggaucaaacugucaggcgugcaguaucagcaacacagccaggcauuaggcaaauuccuucaagacauccugugggaggaagcaaaagaggcucccgcugauaaauag

SEQ ID NO: 248224 - RNA, 201 nt, Artificial Sequence
  Description of Artificial Sequence: Synthetic coding sequence
auguuuacauguugguggucguaucuccgcagcaccuuggcagcuguuccaggcgaggcuagucgcguacaauuuaacgcccccuuugaugucggaauaaaacuguccggcguacaguaccaacagcacucacaagcacucgggaaauuucuccaagauauucuaugggaagaagcaaaggaggccccggcagauaaauag

SEQ ID NO: 248225 - RNA, 315 nt, Artificial Sequence
  Description of Artificial Sequence: Synthetic coding sequence
auguuuaccugcugguggucuuaccugagaagcacacuagcggcuguaccaggcgaggcaucgagggugcagcggaaagagucuaaaaaaccucccgcaaaauugcagccccgcgcuuuagcagguuggcucagacccgaagacggcgggcaggcugagggggccgaggacgagcuagaaguuagauucaaugccccauucgacgucgggaucaagcuuucgggcgugcaauaccagcaacacucacaggcacugggaaaauuccugcaggacauuuuaugggaagaagcaaaggaagcgcccgcggauaaguag

SEQ ID NO: 248226 - RNA, 351 nt, Artificial Sequence
  Description of Artificial Sequence: Synthetic coding sequence
augccauccccaggaacagucugcucccuccugcuuuuaggaaugcucuggcucgaccuagccauggcuggguccucauuccuuucccccgagcaccagcgaguccaaaggaaggaaagcaaaaagccuccagcuaaacuccagcccagggcucuagccgguuggcugcggccagaagauggugggcaggccgagggcgccgaagaugagcuagaagugcgguucaacgcuccauuugacgugggaaucaaguuaagcggagugcaauaucagcagcacucucaggcacugggcaaauuccugcaagauauucuaugggaagaagcuaaagaagcuccagccgauaaauag

SEQ ID NO: 248227 - RNA, 354 nt, Artificial Sequence
  Description of Artificial Sequence: Synthetic coding sequence
augcccucaccaggcaccguguguucuuuacuguugcucgggaugcucuggcuggaucucgccauggccggaagcucuuuccuuucccccgagcaccagcguguacagcaacgaaaagaaagcaagaaaccuccggcuaagcugcagccaagagcacuggcaggauggcuccgaccggaagacggcggacaggcugagggggccgaggaugagcuagaaguccgauucaacgccccauucgacguuggaaucaaacucaguggcgugcaguaccaacagcacucccaagcccuugguaaguuucuacaggauauccuaugggaagaggcuaaagaggcccccgcugauaaauag

SEQ ID NO: 248228 - RNA, 354 nt, Artificial Sequence
  Description of Artificial Sequence: Synthetic coding sequence
augcccagccccggcaccguuugcucucugcucuugcuugggauguuguggcucgaccucgcuauggccggaucauccuuucuuuccccugaacaccaaagaguacaacagcguaaagaaaguaaaaagccuccagcuaaacuacagccgcgcgcccuggcugggugguuacggccugaagacggaggacaagccgagggcgccgaggacgagcuggaagugcgguuuaaugcacccuucgaugugggaaucaaacuuaguggggugcaguaccaacagcacucccaggcgcuagguaaauucuugcaggauauccuuugggaggaggcaaaggaagcacccgccgauaaauag

SEQ ID NO: 248229 - RNA, 1350 nt, Artificial Sequence
  Description of Artificial Sequence: Synthetic coding sequence
auguauucuuuuaauacccugcggcuguaucugugggaaacuauaguuuuuuucucucucgcagcaaguaaggaggccgaagcugcacgguccgcgcccaaaccaauguccccauccgacuuccucgauaaacugauggggcgcacuagcggcuacgaugcucggauccgcccuaauuuuaagggacccccagugaaugucuccugcaacaucuucauaaauuccuuugggagcauugcugagaccaccauggauuaccgggucaacaucuuucugagacagcaguggaacgacccuagauuagccuauaacgaauacccugaugacagccuggaucucgaccccagcaugcuugacucaauuuggaagcccgaccucuucuuugccaaugaaaaaggcgcacacuuucaugagauuacuaccgauaacaaacucuugcgaauuagucggaacggaaaugugcuuuacucaauuaggaucacuuuaacacucgccugccccauggaucucaagaauuuuccuauggacguccagaccugcauuaugcagcuggaaucuuuuggauacacaaugaacgaucuuauauucgaauggcaagagcaaggugccgugcagguggccgacggacucacacucccacaauuuauuuuaaaggaagagaaagaucugcgcuacugcacaaaacacuauaacacaggcaaauuuaccuguauugaagcaagauuucaucuggagagacagaugggcuacuacuuaauccagauguacaucccuagucuguugauagucaucuuauccuggauaucuuuuuggaucaauauggacgccgccccggccagagucggcuuaggaaucaccacagucuugaccaugacuacccagucguccggaucacgcgccucucugcccaaaguuucguacguuaaagccaucgauauuuggauggccgucugccuucuguucguauuuagcgcauugcuggaguacgcugcagucaacuuuguaagucgccagcacaaagagcugcuucgauuucggaggaaacgccgccaccauaaggaggaugaagcaggcgagggcagguucaacuucuccgcguacgguaugggccccgcuugucugcaggcuaaagacggcauuagugucaaaggugcaaauaacagcaacacgacaaauccgccucccgccccaaguaagucuccagaggaaaugagaaagcuguucauucaacgggcaaagaaaaucgauaagauuucucgaaucggcuuuccuauggccuuucugaucuucaacauguucuauuggauuauuuauaaaauagugcgccgcgaggauguucauaaucaauag

SEQ ID NO: 248230 - RNA, 1374 nt, Artificial Sequence
  Description of Artificial Sequence: Synthetic coding sequence
auguacucuuucaauacccugagacuauaccugugggagacuaucguuuuuuuuucccucgcagccagcaaggaggccgaagcugcgagaucagccccaaagccuaugagucccucagacuucuuggacaagcucaugggacgcaccucagguuaugaugcaaggauucgcccuaauuuuaaaggcccaccgguuaaugucucauguaauauuuucaucaacucauucggaucuaucgcagaaacgacaauggauuauagagucaacaucuucuuacgccaacaguggaacgaucccaggcuugcuuacaaugaauauccagacgacucucuugaccuagacccuucuauguuagauucaauuuggaagcccgacuuguuuuuugcuaaugaaaagggugcucacuuccacgaaaucacaaccgauaacaaguuguugcguauaucccgaaauggcaacgugcucuacuccauucggaucacauuaacucuggccuguccuauggauuugaagaacuuuccgauggacgugcaaacuugcaucaugcaguuggagagcuucggcuacacuaugaacgaccuuaucuuugaguggcaggagcagggggcugugcagguugccgaugguuugacccuaccacaauuuauacucaaagaagaaaaagaucuuagguacuguacgaagcauuacaacaccggcaaguucacuuguaucgaagcuagauuccaucucgaacgacaaauggguuacuauuugauccaaauguacaucccuucacuccuuaucgugauucuguccuggaucucauuuuggaucaauauggacgccgcacccgcgcgggugggacuggguaucaccacuguucucacaaugacgacccagagcagcggcucccgugcuucccuuccuaaagucuccuacgucaaagcuaucgauauuuggauggcuguaugccuucuguuuguguucuccgcccuccucgaguacgcagccgugaacuucguuucuaggcaacacaaagaguugcugcgcuucagacguaagaggaggcaccacaaaucgccaaugcucaaucucuuucaggaagacgaggcuggagagggccgcuuuaauuuuucagcauacggcaugggaccugccugcuugcaggcgaaagauggaauuagcgucaaaggcgcaaauaacagcaauacaacaaacccgccccccgccccuucuaaaagucccgaggaaaugaggaaguuauucauccagcgggcaaaaaagauagauaagaucucaagaauuggguucccuauggcguuucugaucuucaauauguucuauuggauuauuuacaaaauuguuagaagagaagacguccacaaccaguag

SEQ ID NO: 248231 - RNA, 1101 nt, Artificial Sequence
  Description of Artificial Sequence: Synthetic coding sequence
auggauuaucgugucaauaucuuucuccggcagcaauggaacgaucccaggcuggcauacaaugaguacccggacgauucucucgacuuggaucccagcaugcucgacucuaucuggaaacccgacuuguuuuuugcaaacgaaaaaggagcucacuuucacgaaaucacaacugacaacaagcugcuccguauuagucgcaacgguaaugugcuguauuccaucaggaucacacucacgcucgcuuguccuauggaucugaagaauuuuccuauggacguccagacgugcauaaugcagcuugaaaguuucggauacacuaugaacgauuuaauuuucgaguggcaggagcaaggugcugugcaggucgcagacggauuaacccugccgcaguuuauccugaaagaggaaaaagaccugcgcuauugcacuaagcacuauaacacggguaaauuuaccuguaucgaggccagauuccacuuggaaagacaaaugggcuauuaccugauacagauguauauuccuagucucuuaauugugaucuuaagcuggauaucauucuggauaaacauggaugccgccccagcgcgcguuggacuggggaucacaacuguacuuaccaugacgacccaaucaaguggaucccgcgccucuuugccuaaagugagcuaugucaaagcaauagauaucuggauggcagugugucuccucuucgucuuuagugcccucuuggaauacgcggccguaaacuuugugagccggcagcauaaggaacuucugagauuccggagaaaacggcgccaucauaaggaagaugaggccggcgaagggagguuuaauuucucugcuuacgggaugggcccugcaugucugcaagcaaaggacggaaucuccgucaaaggagccaacaacucuaacaccacaaaucccccaccagcccccucaaaguccccagaggagaugcguaagcuguucauucagcgcgcaaagaagauagacaaaauuucaagaaucggcuuucccauggcauuucugauuuucaacauguuuuacuggaucauuuauaaaauaguuaggcgcgaggacguacauaaucaguag

SEQ ID NO: 248232 - RNA, 1365 nt, Artificial Sequence
  Description of Artificial Sequence: Synthetic coding sequence
augagugcgggaggcccuugccccgccgccgccggaggcggcccugggggcgcgucuuguuccgugggagcuccggggggcgucucaauguuccgcuggcuggaggugcucgaaaaggaguucgacaaagcauucguugauguugaccuuuuacugggggaaauugauccagaucaagccgauaucacauaugagggcaggcagaagaugacuucucucagcuccugcuucgcucagcuuugccauaaggcccaaagugugucccaaauuaaccacaaacuggaagcucaacugguugaccucaaaucagaacugaccgaaacacaagcggagaaagucguguuggaaaaggaggugcacgaccagcuucugcagcuucacuccauccagcuacaguugcaugccaagaccggccagagcgccgauucugggacaaucaaagcgaaguuggagagagaacucgaagccaacaagaaagagaagaugaaggaggcucagcucgaagccgaagugaagcucuuaaggaaagaaaacgaagcacugcguagacauaucgccgugcuccaggcugagguguacggggcccgccuugccgccaaguaucuggauaaagagcuggcaggaagaguucaacagauucagcuccucggcagagacaugaagggaccagcccaugacaagcuauggaaccaauuggaggcagagauucacuugcaucggcacaagacggugauaagagcaugucgaggccgcaaugaucugaaacggcccaugcaggccccuccagggcacgaccaggacagccucaaaaaaagccagggugugggaccgauccggaaaguccuccuucugaaagaggaucaugagggacucgggaucucuauuacuggaggcaaggagcauggcgugccaaucuuaaucagugagauccacccuggacagcccgccgauaggugcggaggcuuacacgucggagacgcuauacucgccgugaauggagucaaccuuagggauacaaagcacaaagaggcugugacaauuuugagucagcagcggggagaaauagaauucgaggucguuuauguggcaccagagguagacuccgacgaugagaacguugaauacgaagacgaaagcggccauagauauagacucuaccucgacgagcuggaaggaggagguaaucccggggccaguuguaaggacacaagcggggagaucaaaguacugcagggauucaacaaaaaagccgucaccgacacccaugagaacggcgaccuaggaacugcuagugagacgccacuggacgauggcgcuagcaaacuggaugacuugcacacguuguaucacaaaaagucuuauuag

SEQ ID NO: 248233 - RNA, 918 nt, Artificial Sequence
  Description of Artificial Sequence: Synthetic coding sequence
auggccgccggacuggcgagauuguuacugcuucugggacucagcgccggcggaccugcuccagcaggggccgccaagaugaaaguuguagaggaaccuaaugccuucggaguaaacaacccauuucucccccaggcaagucgccuccaggcaaagagggacccgaguccugucucaggccccgugcaucuguuccggcucaguggaaaaugcuucucuuuagucgaauccacauauaaguacgaauuuuguccauuucauaacguaacucagcacgagcagacauuuagguggaacgcguauuccgggauacugggcaucuggcacgaaugggaaaucgccaauaauacguuuaccggcauguggaugagggauggugaugcuugucgcagccguagucgacagagcaaaguagagcucgcgugcgggaagucaaaccgcuuagcucacguuuccgaaccguccaccugcguguacgcccugacguuugaaacccccuuggucugccacccucacgcucugcugguguauccuaccuuaccugaggccuuacagagacagugggaucagguagaacaagacuuagcagaugaauuaaucacaccacagggacaugaaaagcuccuucgcacccuguucgaggaugcugguuaucuuaagacccccgaggagaaugaaccuacccagcucgagggcggccccgacucguugggcuuugaaacacucgagaauugcagaaaggcucacaaggagcugucuaaagagauuaagagauugaaaggauuauugacccagcauggaauacccuacacaaggccuacggaaacuuccaaccuggagcacuuaggccaugaaaccccuagggcaaaaagcccggaacaacuacgcggcgacccuggacuccggggaucuuuguag

SEQ ID NO: 248234 - RNA, 2196 nt, Artificial Sequence
  Description of Artificial Sequence: Synthetic coding sequence
augagcugguuuguugaucuggcuggcaaagccgaggaccuuuuaaaccgcgucgaccaaggcgccgccacugccuuaucccgaaaagauaacgccaguaauaucuacucaaaaaacacugacuauaccgagcuucaccagcagaacaccgaccucauuuaccagacaggacccaaaagcaccuacaucucauccgccgcugacaauauccgcaaucagaaagccacuauccuugcuggaacagcaaacgugaaggugggcucccggacaccugucgaagccagccacccuguggaaaaugcaucggucccccggccaagcucccauuuugugaggaggaaaaaguccgaaccagacgacgagcugcucuucgauuuccugaacuccagucagaaggaaccaacagggaggguggaaauccgcaaagaaaaagguaagacaccaguguuucaaucaagucagacuuccaguguuuccuccgucaacccauccguuacaaccaucaaaacaauugaggagaacucauuuggaucccagacccaugaagcggcuaguaacucugauucaucucacgaaggacaggaagaaucaucuaaggagaauguuucaucaaaugcugcauguccggaucacacaccgacgcccaacgacgaugggaagucccaugaacugucuaaccuucggcucgagaaucaacuccugaggaacgagguacagucucuaaaucaggaaauggcaagucuuuuacagaggagcaaggagacacaggaagaacugaacaaagcucgcgcccgcguugagaaauggaacgcagaucacuccaaaucggaccggaugacccggggccugcgagcccaaguggaugaccugacugaggccguggccgccaaggacagucaguuagcagucuuaaaggugcggcugcaagaagccgaucaguugcucucgacaagaacggaagcacuggaggcccuccagagugaaaagucuagaaucaugcaggaucagagcgaggggaauucgcuccagaaucaggcccugcaaacguuucaggaaagacugcaugaggccgacgcaacacugaagagggaacaggaaucauauaagcaaaugcagucggaguucgcugccagacugaauaagguugagauggagagacagaaccuggccgaagcuauuacccuggcggagaggaaauacucugaugagaaaaagcguguagacgaacugcagcagcaagugaaacuguauaagcugaaccuggaguccagcaagcaggaacugaucgacuauaagcaaaaggcuacacggauucuucagaguaaagaaaagcugaucaauagucuuaaggaagggaguggguuugaaggcuuagauagcaguacugcgucuucaauggagcuggaagagcuccgccaugaaaaagaaaugcagagagaagaaauccagaagcugaugggccagauacaccagcugcgguccgaguugcaggacauggaagcucaacagguuaaugaagccgaaagcgcuagggagcagcugcaggacuuacaugaccaaauugccggacagaaggcaucaaagcaggaacuggagaccgagcuggagagacugaaacaagaauuccauuacauugaggaggacuuguacagaaccaaaaacacccugcagagccgaauaaaggacagggacgaggagauucagaagcugcggaaccaguugaccaacaaaacucugagcaauucuucccagucggaacucgaaaauaggcuccaccagcuaacagagacacuaauucagaaacagaccauguuagaaucucuuucuacugaaaagaacucccucgucuuccagcuggagaggcuggagcagcagaugaacucagcgucaggcucuaguaguaacggaucgucgaucaacaugucaggaaucgacaauggugaaggaacucggcuccggaacgugccugugcuguucaacgacaccgagaccaaucucgcaggaauguacggcaaggucagaaaagcugcauccucgaucgaccaauuuucaauccguuuagguaucuucuugcgacguuacccaaucgcgcggguauucgucaucauuuauauggcccuguugcaccuuuggguuaugaucguguuguugacauacaccccugaaaugcaccacgaccagcccuauggcaaguag

SEQ ID NO: 248235 - RNA, 1782 nt, Artificial Sequence
  Description of Artificial Sequence: Synthetic coding sequence
auguggacacuaguaucauggguggcuuugacagcuggucugguagcaggcacuagaugcccugacggccaauucugccccgucgcuugcugccuggaccccggaggcgccucuuauuccuguugccgaccgcuacucgacaaauggcccacaacacucagccggcaccucgguggacccugucagguugacgcucauuguucagccggccauagcuguauauucacaguauccgggacaagcucuugcugccccuucccagaggccgucgcuugcggggacggacaccacuguuguccacggggguuucauuguucugccgaugguaggucauguuuccagcgaucagggaauaauucaguuggugccauccaaugucccgacagucaauuugaaugcccugacuucuccacaugcugcgugauggucgaugggagcuggggcuguugucccaugccacaagccuccugcugcgaggaccgugugcauugcugcccccacggggcuuuuugcgaccucguccauacacggugcauaacacccaccggaacacacccucuagcaaagaaacugccugcucaacguaccaaccgcgcgguagcauuaucauccagugucaugugccccgaugcaaggagccgcugccccgacgggucuaccuguugcgaguugccuagcgggaaguacggcugcugcccgaugccuaaugccaccugcugcuccgaccaccugcacugcugcccccaagacaccgucugcgaccuuauucagaguaagugucuaucaaaggagaaugccacaaccgaucuucucacaaaauugcccgcacacaccguaggagauguuaaaugugauauggaagucaguugucccgacggguacacaugcugcagauuacaguccggcgccugggggugcugcccauuuacacaggcggucugcugcgaagaucauauucauuguuguccugcuggauuuaccugcgacacacagaaaggaacgugcgagcagggcccccaccaagugccauggauggaaaaggccccggcgcacuuaagccuucccgauccacaggcccucaagagagauguaccaugcgacaaugugagcuccugcccuaguucagauaccugcugucagcugacaaguggagaguggggauguuguccuaucccagaagcaguguguugcagugaccaccagcacugcuguccacagggguacacaugcguggcagaaggccaaugccagcguggcucagagauuguggcuggauuggaaaaaaugcccgccagaagagccagccugagccauccacgcgauaucgggugcgaccagcacacgucaugccccgucggucaaacauguuguccuucuuugggaggcuccugggcauguugccagcugccucacgcggucugcugcgaggaccgacagcacugcugcccagccgguuacacaugcaacgugaaagcgcguagcugugaaaaagaggucgugagugcucagcccgcuacauuucuugcucgcucuccacacgugggagugaaggauguugaaugcggcgagggucacuuuugccacgacaaucagaccugcugucgggacaaucgccaggguugggcuuguuguccauaccggcagggaguuugcugcgcugaccgacgacacuguuguccggccggauuccgcugcgccgcucguggaaccaagugucuuagacgugaagcuccucggugggacgcaccucuucgcgaucccgcucuccgacagcuucuguag

SEQ ID NO: 248236 - RNA, 1080 nt, Artificial Sequence
  Description of Artificial Sequence: Synthetic coding sequence
augacauuggagucuaugauggcauguugccucagugacgaagugaaagaguccaaaagaaucaaugcugagauagaaaaacagcucagacgcgacaagcgggaugcuagaagagaauuaaaacugcugcuacugggaacuggggagucagguaaaucaaccuucaucaaacaaaugagaaucauucauggcgccgguuacagugaggaggacaaacguggcuuuaccaaauugguguaucagaacauuuucacagcuaugcaggcaaugauucgugcaauggaaacgcucaaaauucuuuacaaguacgagcaaaacaaagccaaugccuugcugauucgggaaguggauguugaaaaagugacaacguucgagcaucaguacgugucagcuaucaaaaccuugugggaagacccggguauacaggaguguuaugauaggaggagggaguaucaguugagcgacagcgcaaaguauuacuuaacugauguugacaggaucgcuacccugggauaccuucccacucagcaggacgugcuucggguuagaguuccaaccaccgggauaauagaguaucccuucgaccuggaaaacauuauuuuuagaaugguggacguagguggccagaggucugaacggcgcaaguggauucacuguuuugaaaaugucaccucuaucauguuccuuguugcuuuguccgaguacgaccaaguucugguagaaucagacaacgaaaauagaauggaagaaucuaaggccuuguuuaggaccaucauaaccuacccuugguuccagaauuccuccgugauucucuuccugaauaaaaaggaucucuuagaggacaagauuuuauauucucauuuaguugacuacuucccugaauucgacgggccccagagagacgcacaggcagcuagggaguuuauacugaaaauguuuguugaucugaaccccgacuccgacaagauuauuuacucgcauuucacaugcgccacagauacagagaauauucgauucguguucgccgccgucaaggauacaaucuugcagcugaaccuuaaagaguauaaccucguguag

SEQ ID NO: 248237 - RNA, 606 nt, Artificial Sequence
  Description of Artificial Sequence: Synthetic coding sequence
auggguaaugugauggagggaaaguccgucgaagaacuauccaguaccgaaugccaccagugguacaagaaauuuaugacugagugccccucagggcagcugacacucuacgaauucaggcaguucuucggccucaaaaaucuaucucccagugccagucaauacguggagcaaauguuugagaccuuugacuuuaacaaagacggcuauauugauuuuauggaguacgucgccgcauugucacuuguccuuaaggggaagguggagcaaaaacuacgaugguauuucaaacucuacgacguugaugggaacggguguauugaccgugacgaacucuugaccaucauccaggccauccgagcuaucaacccguguagugacaccacaaugaccgcggaagaguucacagauacgguauuuuccaaaauugacgugaacggagauggcgaacugucguuggaagaguucaucgagggugugcagaaggaccagauguuacuugacacacugacucguagccuagaccucacacguaucguuaggcgguuacaaaauggugagcaggaugaagaaggagcugaugaagccgcggaagcugcuggcuag

SEQ ID NO: 248238 - RNA, 1482 nt, Artificial Sequence
  Description of Artificial Sequence: Synthetic coding sequence
auguccaagggaccagccgugggcaucgaccuagggaccaccuacaguugcgugggagucuuccagcacggaaagguagaaaucaucgcgaaugaccaagggaacaggacuaccccauccuauguggccuuuaccgauaccgaaagacugauuggcgaugcugccaagaaucagguggcaaugaacccuacaaacacugucuuugacgccaagcgccugauuggaagaagauucgacgacgcaguggugcagucugacaugaaacacuggcccuucaugguugucaacgaugcugggaggccaaaggugcagguugaguauaagggggagaccaaaucauuuuauccagaagaagucucuaguaugguccucaccaaaaugaaagaaauugcugaggccuaucucggaaagacgguuaccaacgcaguggugacggugcccgccuacuuuaaugauagucaacggcaagccacaaaggaugccggcacuauugccgggcuuaaugugcuuagaauaauaaacgaaccuaccgccgccgccauugcauauggccucgauaaaaaggucggcgccgagagaaacguguugaucuucgaucugggggggggcacuuucgacgugucuauccucacuauagaggacggaaucuuugaggucaagaguaccgccggagacacacaucugggcggcgaggauuuugauaaucgaauggucaaccacuucauagcagaguuuaagcggaagcacaagaaggauaucucagagaauaaacgcgcuguaaggcgccugcgaacagcuugugagagggccaaaaggacauugaguagcucuacucaggcaucgaucgagaucgauagucuuuaugaggguauagauuucuacaccagcaucaccagagccagguucgaggaacuuaaugcugaucuauuuagaggcacccuggacccugucgaaaaggcccugcgcgacgccaaacucgauaaaucacagauccaugauauagugcugguuggcgggucuacucgcaucccaaagauccagaaacuccuccaggauuucuuuaacggcaaagaacugaacaagagcauuaauccagacgaggcaguggcauacggcgcagccgugcaggcugcaaucuuauccggugauaaaagcgagaauguccaggaccuccugcugcuugacgucacaccucugagucuugguauugaaacagcuggggguguuaugaccgugcugauuaagagaaacacuaccaucccgaccaagcagacucagacuuucaccacauacagcgacaaucaaccaggaguacugauccaaguauacgaaggggaacgcgcuaugacaaaagauaacaaucugcuugguaaguuugaacucacaggaaugcccggagguaugccuggcggauuucccggcgggggugcgccaccuucuggaggagccucuagcgguccaacgauugaggaaguagacuag

SEQ ID NO: 248239 - RNA, 1884 nt, Artificial Sequence
  Description of Artificial Sequence: Synthetic coding sequence
augucuaaggggccugccgucggcauugaucucgggaccacauacucuugcguuggcguuuuccaacacgggaaaguggagaucauugcuaaugaccagggaaaccggaccacucccuccuacguugcuuucacagacacugaaagguuaauuggagaugcugcgaaaaaccaaguggccaugaacccaacaaauaccgucuuugacgcuaagaggcugaucggucgcagauuugacgaugcagugguucagucugacaugaagcacuggccguucauggucgucaacgacgcuggucggccuaaggugcaggucgaauacaagggcgaaacgaagagcuuuuacccugaggagguaaguucaaugguguugacaaagaugaaggaaaucgcagaggcauaccuggggaaggcuaccaaagacgccgggacaauugcugggcuuaacguguugcgcauuaucaacgaacccacggcagcagccauugccuauggacuggacaaaaaggugggcgccgaacgaaaugugcucaucuucgaccuuggcggagggaccuuugaugucucuauuuugacuaucgaagaugggaucuuugagguuaaaagcaccgcuggagauacccacuuagguggggaggacuucgauaaucgcaugguuaaucauuucauagccgaauucaaacggaagcacaaaaaagauauaucagagaauaagcgugcagugcggcgccuucggacugcgugcgagcgggcuaaaaggacauugucuucaagcacucaggcaagcauagagaucgacucucuuuacgagggaauugacuucuacacaucaauuaccagagcaagauucgaggaacucaaugcagauuuguuucgagguacauuggacccagucgaaaaagccuugagagaugcuaaacuggauaagagccaaauacacgacauugucuugguuggcggaaguacacguaucccaaagauucagaagcuccugcaggauuuuuuuaacggaaaagaacugaacaaaucaauuaacccagacgaagccgucgcguauggugcugccgugcaggcagccauucuguccggcgauaagagcgaaaacgugcaggaccugcuacuucuugacgugacaccguugucucuuggcaucgaaacggccggagggguuaugacaguguugauuaaaaggaacaccaccauccccacuaagcagacccagacauucacaacguacucagacaaccagccuggagugcuuauccaagucuacgaaggcgagcgggcuaugaccaaggacaauaaucugcugggcaaguucgaacugacagggauucccccugcacccagagggguaccgcaaauagaaguaacuuucgauaucgaugccaacgguauacugaauguaagcgcagucgauaagucuaccgggaaggagaauaaaauuaccauuacaaaugacaaaggccgauuaucaaaggaagacauugaacggauggugcaggaggcugaaaaauauaaggcggaagacgaaaaacagagagacaaggugagcuccaagaacagccuggaaucuuacgcauuuaauaugaaggcuacaguugaagacgagaagcuucagggcaagaucaacgacgaggacaaacagaaaauuuuggauaagugcaacgagaucauaaauugguuagauaagaaccagaccgcggaaaaggaagaauucgagcaucagcagaaagaacucgagaaggucuguaaucccauuauuaccaaacucuaccaguccgccggagguaugcccggagggaugccuggaggauuuccuggagguggggcgccccccagcggcggagcaucaagugggccgacuauugaagaaguggauuag

SEQ ID NO: 248240 - RNA, 1941 nt, Artificial Sequence
  Description of Artificial Sequence: Synthetic coding sequence
augagcaagggcccugccgucgggaucgaucucgggacaaccuacucgugcguggguguguuucaacacggaaaaguugagaucauagccaaugaccagggaaacagaacuacacccucuuauguggcuuuuaccgacacagaaagacucauuggagaugccgccaaaaaccaagucgccaugaauccuacaaauacaguguucgaugcuaagagauuaaucggacgccgguuugaugaugccgugguccaauccgacaugaaacacuggccuuucauggugguaaaugaugcuggccggccuaagguccaagucgaauacaagggggaaaccaagagcuuuuauccggaggaaguaaguagcaugguacucacgaagaugaaggaaaucgccgaggccuaccuggggaaaacuguaaccaacgccguggugaccgugcccgccuauuucaaugauagucagcggcaagcaaccaaagacgccggcaccaucgccgggcugaacguccugaggaucauaaacgagcccacagccgcagcuauugcuuauggccuugacaagaaaguuggcgcagagagaaacguucugaucuucgaucuagguggcggcacuuucgacguaucuauucugaccaucgaggacgggauauuugagguuaagagcacagcuggcgacacacaccuggggggcgaggacuucgacaaucgcaugguaaaucacuuuauugccgaauuuaagagaaagcacaagaaagacauuucggagaacaaacgugccguuagacgacugcggaccgccugugagcgcgcuaaacggacccucuccuccuccacccaggcuaguaucgagauugauuccuuguacgaaggcauugauuuuuacaccuccauuacgcgagcaagauuugaagagcugaacgcugaccuguucagaggcacauuagaucccguggaaaaggcuuugagggacgccaagcuggauaagagccagauucacgauaucguccuagugggaggcuccacuagaauucccaagauccaaaagcuguuacaggauuuuuuuaaugguaaagaguugaauaaaagcauuaaucccgaugaggcuguagccuauggagccgccgugcaagccgccaucuuauccggagauaaaagcgaaaaugugcaagaucugcucuugcucgaugugaccccucucagcuuagggauagaaacggccggcgggguuaugacagucuugaucaagagaaacacaacaauaccuacuaagcagacacagacuuucacgacuuacucugacaaucagcccggugugcugauccaaguauacgaaggggaaagggcaaugacuaaagauaacaauuuacucgguaaguucgaacugacaggcauuccccccgccccacgcggcgugccacagauugaggucacauuugacauugaugcaaacgguaucuuaaacguguccgcugucgacaagucaaccggcaaggagaacaagaucaccauuaccaacgacaaaggccgccuuagcaaagaggacauagaaagaaugguacaagaagcugagaaguacaaggcggaggaugaaaagcagagggauaaaguuucuucuaaaaauucucuggaaagcuacgccuuuaacaugaaggcuacagucgaggacgagaagcuucaggggaagaucaaugaugaagacaagcaaaagauccuugacaaguguaaugagaucaucaacuggcuggauaagaaucagaccgcggaaaaggaagaguucgagcaucagcagaaggagcuggagaagguuugcaauccuauuauuacaaaguuauaucaguccgccgggggcaugccaggcgguaugcccggaggauucccggggggaggagccccgccuucuggaggggccaguucagggccuacgaucgaagagguugauuag

SEQ ID NO: 248241 - RNA, 1503 nt, Artificial Sequence
  Description of Artificial Sequence: Synthetic coding sequence
auguccaagggaccagcuguugggaucgaucuagggacaacauacagcuguguuggaguuuuccagcaugguaaaguggaaaucaucgcaaacgaccagggaaauagaacaacaccaagcuacguggcuuucaccgauaccgagagguugaucggagacgccgcuaaaaaucagguagcaaugaacccuacgaauacaguguuugaugcgaagaggcucauuggccgacgguucgaugacgcagucguacagagcgauaugaaacauuggcccuuuaugguggugaaugaugccggucggcccaaacauaagaaggauaucagcgagaauaaacgcgcaguuagaagacugagaaccgcuugcgaacgggcuaaacgcacccucucuagcagcacccaggcuagcaucgagauagauagccuuuaugaggggaucgacuuuuacacgagcauuacccgugccagauucgaggagcugaacgcugaccuguuccgcggaacccucgacccgguugagaaggcuuugagggacgccaaacuggauaagagccagauacaugacauaguccugguugguggauccacaagaauccccaaaauucagaaacugcuccaggacuuuuuuaacggcaaagaacucaacaaaaguauuaaccccgacgaggcugucgcuuauggcgcugcaguucaggcagccauacuguccggagauaaaucagagaacgugcaggaccuccuacugcuggacgugacaccucugagccuggguauugagaccgcugggggggugaugacuguacuuaucaaacguaauacaacuauaccgacaaagcagacacaaacuuuuaccacauacagugacaaucagccaggaguacugauucagguauaugaaggggaacgagcuaugacuaaggacaauaaucuucuggguaaauucgagcuuacuggcauccccccagcacccagaggugugccgcagaucgaggugacuuucgauauugaugcuaacggaauucugaacgucucagcaguugacaagaguacuggaaaagagaacaagaucacgauaacaaacgauaaaggacgacuaagcaaagaagacauugaacguaugguccaagaagcagagaaguacaaggccgaggacgaaaagcaacgcgacaagguguccagcaaaaacucccuagagucuuacgcuuucaacaugaaggcaacagucgaagaugagaagcugcagggcaagaucaaugaugaggacaagcagaaaauccuggacaaguguaacgagaucauuaauugguuggauaagaaucagacagcugaaaaggaggaguuugagcaucaacagaaggaacuggagaaggucugcaauccuauuauuaccaagcuguaucagagugcaggaggcaugccagguggcaugcccgggggcuuuccagggggaggcgcuccuccauccgguggugcuaguucagggcccacuauugaagaaguugacuag

SEQ ID NO: 248242 - RNA, 1233 nt, Artificial Sequence
  Description of Artificial Sequence: Synthetic coding sequence
auggugaaccauuuuaucgcugaauucaagagaaaacacaaaaaggacaucagugaaaacaaaagagcagugcggaggcuccgaacugcgugugaaagagcgaaacggacucucaguuccucaacacaagcaaguauugaaauugacagucuguacgaggguauugacuuuuacacuucaauuacccgggcccgauucgaggagcucaaugcugaccuguuccgggggacauuggauccgguggaaaaggcacuucgagacgccaaacuggacaaaucucagauccaugacauuguccuggugggcgggagcacacgaauccccaagauccagaaauugcuacaggacuucuuuaacggaaaggaacugaauaaaagcauuaauccagacgaagccgucgcuuacggugccgcagugcaagcagccauccucucgggagacaaaucugaaaacguccaggaucugcuccucuuagacguuacuccucuaucuuuagguauugagaccgcaggcggaguuaugaccgucuuaaucaaacggaauaccacaaucccuaccaaacagacucagacuuuuaccacuuacucugacaaccagccaggcguucuaauccagguuuacgaaggugagcgagcuaugacaaaggauaacaauuuacuggguaaauucgaauugacgggaauuccaccugccccaaggggggucccacagauugagguuaccuucgauaucgacgcuaacggaauccucaacgucagcgcuguugacaaaagcaccgggaaggagaauaaaaucacaaucaccaacgacaaaggaaggcuuaguaaggaggauauugagagaauggugcaggaagccgagaaauacaaagccgaagacgaaaaacaaagggauaaggugucuuccaaaaauuccuuggaauccuacgcauucaauaugaaagccacuguugaggacgagaaacugcagggaaagaucaacgaugaggacaagcagaagauccucgauaagugcaacgaaauaauuaacugguuggauaaaaaccagacugccgaaaaggaagaauucgagcaucaacagaaagaacuggagaaaguguguaacccuauaauuacgaagcuguaccagagcgcggggggaaugccagguggaaugccuggagguuuuccuggagguggggcaccccccucaggcggggccuccucuggcccuacaaucgaagagguggacuag

SEQ ID NO: 248243 - RNA, 1941 nt, Artificial Sequence
  Description of Artificial Sequence: Synthetic coding sequence
augucuaaaggaccagccguggggaucgauuuaggaaccacauacaguugcgugggggucuuucaacauggcaagguugaaaucauagccaacgaccagggcaauaggaccacccccagcuacguggccuucacugacaccgaacgccugaucggagaugccgcuaagaaccagguagccaugaauccgacaaacaccguguuugaugccaaacgucugauagggcgaagguucgaugaugcuguggugcagagcgacaugaagcauuggccauuuaugguagugaaugaugccgggaggccaaaaguccagguugaauauaaaggcgaaacgaagucuuuuuaccccgaggagguuucuucuaugguacuaacaaagaugaaggagaucgccgaggcuuaucugggcaagacaguaacaaacgccguugugacagugccagccuacuucaacgacagccaacgccaggccacaaaagaugcaggaacaauagcgggucugaauguacuccggauaaucaaugagccgacagccgccgcuauugcuuacggacuggacaagaaggugggggcggaaagaaauguccuaauauuugaccucggcggcggcacauucgacgugagcauucuaaccaucgaagacgggauauucgagguuaagucaacggccggcgauacgcaucugggaggugaagauuuugacaaccgcauggugaaucauuuuauugcggaauuuaaacguaagcacaagaaagacaucucugagaauaagcgcgcuguucgacggcuacggacagcgugcgaaagggccaagagaaccuuguccaguucuacccaggccaguauugaaaucgauagccuuuaugagggaauagacuucuacacgaguauuacccgagccagauuugaggagcucaacgccgaccuauuuaggggcacacuggacccagucgaaaaggcccuacgggacgcaaagcuggauaagagucaaauucacgacaucguucugguugguggcucuacacgcauaccaaaaauccagaaguuacugcaggauuucuuuaauggcaaggagcucaacaagucaaucaauccagaugaggcuguggcguauggagccgcugugcaggcagcuauuuugaguggagacaagagugagaauguucaagacuuauugcuccucgacgugaccccgcuuucgcuggguauugaaacagcuggcggcgugaugacuguucuuaucaagcggaauaccacuaucccuacaaagcagacgcagacauucacgaccuacucugacaaccagccaggcgucuugauccaagucuaugagggggagcgugcuaugaccaaggacaauaacuugcugggaaaguucgagcugacaggaauccccccagccccaagaggcgugccccagauagaggugacuuuugauauugacgccaauggcauacugaaugugucugccgucgauaaauccacagguaaagaaaauaagauaaccaucacuaacgauaagggucgauuaucuaaagaagauauugagagaaugguccaggaggccgaaaaauacaaagcagaagacgaaaagcagcgggacaaggugucuaguaagaauagucucgagucuuaugcauuuaacaugaaagccaccguggaggacgaaaagcugcagggcaaaaucaaugaugaagauaaacagaaaauccuugauaaguguaaugaaaucaucaacuggcuggauaaaaaucagaccgccgagaaggaggaguuugagcaucagcagaaagaauuggagaagguuuguaauccaaucauuacaaaauuguaucaaagugcuggcggaaugccgggaggcaugccagguggguucccaggcgguggggccccuccaaguggcggcgccucuucaggaccuaccauugaagaagucgauuag

SEQ ID NO: 248244 - RNA, 483 nt, Artificial Sequence
  Description of Artificial Sequence: Synthetic coding sequence
auggaaauaccuguacccguccagccgucuugguuacguagagcaagugccccucugcccggcuugagcgccccuggccgacuguucgaucagcgguuuggcgagggccugcucgaggcugagcucgccgcgcucugcccuaccacccuugcuccauauuauuugcgcgccccuucuguggccuuaccugucgcccaagucccaaccgaucccggacacuuuucaguccuucucgaugucaagcacuucucacccgaggagauugccgugaaggucgugggagaacacguugaaguccaugcccgccacgaggaacggccagaugaacacggcuuuguggcucgagaguuccaccguagguaccggcugccaccuggugucgacccagcugcgguaacaucugcccuauccccagaaggcguccucaguauccaggcugccccugcaucugcgcaagcuccacccccugcugcugcaaaguag

SEQ ID NO: 248245 - RNA, 570 nt, Artificial Sequence
  Description of Artificial Sequence: Synthetic coding sequence
auguuaggcaugauaaagaacucacuguucggaagcguagagacguggccuuggcaggugcuaaguaaaggugauaaggaagaggucgcguacgaagagcgcgccugugaaggaggcaaauuugcaaccguggaagugaccgacaaaccaguugacgaggcacucagagaagccaugccuaagguagccaaguaugccggcggcaccaacgauaaggggauaggaaugggcaugacuguaccaauuagcuucgcugucuuuccaaacgaggauggaucacugcagaaaaagcugaaggucugguuccggauccccaaucaguuucagagcgacccccccgccccauccgauaagagcgugaagaucgaagaaagagaaggcaucaccguguacaguaugcaguucggaggcuaugccaaagaggcagauuaugucgcucaagccacacgacugcgcgccgcucuggaggggaccgcaaccuaccgaggggacaucuauuuuuguacaggcuacgauccuccaaugaaacccuacgggagacgcaacgagaucuggcugcugaaaaccuag

SEQ ID NO: 248246 - RNA, 477 nt, Artificial Sequence
  Description of Artificial Sequence: Synthetic coding sequence
auggguaagggcgauccaaaaaagccacgggggaagaugucguccuacgcauuuuuuguucaaacaugccgcgaagagcacaaaaagaagcacccagacgccuccgugaauuucucugaguucagcaaaaaguguagugaaagauggaagacaaugagugcaaaagagaaagggaaguuugaggauauggccaaggcugacaaggcuagauacgagcgcgagaugaaaacauauauuccuccaaaaggcgagacuaagaaaaaguucaaagauccaaacgcaccaaaaagacccccgucugcuuuuuucuuguuuugcagugaguacagaccaaaaaucaagggugagcaucccggacuguccauaggagacguggcgaaaaagcugggcgaaauguggaacaauacggccgccgacgacaaacagcccuaugagaaaaaagccgccaagcugaaggagaaguacgaaaaguucuag

SEQ ID NO: 248247 - RNA, 648 nt, Artificial Sequence
  Description of Artificial Sequence: Synthetic coding sequence
augggaaagggggacccuaaaaaaccaagagggaagaugucuaguuaugccuuuuuuguccagacuugucgcgaggaacauaaaaaaaaacauccugacgcuagcgugaauuucucagaguucagcaaaaaaugcagugagagauggaaaacaaugucugcaaaggagaaggggaaguucgaagauauggcuaaggcggauaaagcgcgcuaugaaagagagaugaaaaccuacaucccaccuaagggcgagacgaagaagaaauucaaggacccuaacgcccccaagcgccccccgagugccuucuucuuguucugcucugaguaucguccuaagauuaaaggagaacacccgggucugucuaucggugacguagccaaaaaacuaggggaaauguggaauaacacugcugcugaugacaaacaaccguaugagaaaaaagcagcuaagcugaaggaaaaguacgaaaaagauauagcugcauauagagcuaagggaaagcccgaugccgccaaaaaaggugucguaaaggcugaaaagucuaaaaaaaaaaaggaggaagaagaagaugaggaagaugaagaagaugaggaggaagaagaggaugaagaagaugaagaugaggaagaagacgaugaugacgaauag

SEQ ID NO: 248248 - RNA, 648 nt, Artificial Sequence
  Description of Artificial Sequence: Synthetic coding sequence
auggggaagggggauccaaaaaagcccagggggaaaauguccucguaugcauuuuuugugcagacauguagggaagaacauaaaaaaaagcauccagaugccucuguuaacuucagcgaguucaguaagaaauguagcgaaagguggaaaaccaugagugcaaaggaaaaaggaaaguucgaggacauggccaaagcugauaaggcgcgcuaugaaagggaaaugaagacuuauauaccaccaaagggagagacuaaaaagaaauuuaaagaccccaaugccccuaaaagaccaccaagcgcauuuuuucuuuuuugcucugaguacagacccaaaauuaaaggcgagcacccagggcugucuauuggugacguggcuaagaagcugggggagauguggaacaacaccgccgccgacgacaaacagcccuaugagaagaaggccgcaaaauuaaaagaaaaguacgagaaagacauugcugcuuacagagccaaggggaaaccugaugccgcgaagaagggaguggucaaggccgagaaaagcaaaaagaagaaggaagaagaggaggaugaggaagaugaagaggaugaagaggaggaagaggacgaggaggacgaagacgaggaggaggaugaugacgaugaguag

SEQ ID NO: 248249 - RNA, 294 nt, Artificial Sequence
  Description of Artificial Sequence: Synthetic coding sequence
augggcaaaggagaucccaaaaagccccgcgguaaaaugucuagcuaugcguucuuuguucagaccuguagagaggagcauaagaagaagcacccugacgcgagugugaacuuuucugaguuuagcaaaaaauguuccgagcguuggaagaccaugagcgcuaaggaaaaggggaaguucgaagacauggccaaagcugacaaggcucguuaugagagagagaugaagaccuauauaccaccaaaaggagaaacaaagaagaaauuuaaggacccuaaugcaccaaaacgauag

SEQ ID NO: 248250 - RNA, 477 nt, Artificial Sequence
  Description of Artificial Sequence: Synthetic coding sequence
auggguaaaggcgauccuaaaaaaccacgcggaaagaugaguagcuaugccuucuuugugcagacaugccgggaggaacauaaaaagaagcauccagacgcaagcgugaauuuuucagaguucuccaagaaaugcuccgagcgcuggaagacuaugucagcuaaggagaaaggaaaguuugaagauauggcaaaggccgauaaggcgagauaugaacgugagaugaagacauacaucccaccuaagggcgaaacaaaaaagaaauucaaggaccccaaugcuccaaagagacccccgagcgccuucuuucuuuuuugcucagaauacagaccuaaaauaaaaggugagcaccccggucuuagcaucggugacguggccaaaaagcuaggcgaaauguggaauaauaccgccgcggaugauaaacaaccauaugaaaagaaagcggcgaaacucaaagagaaauacgaaaaguucuag

SEQ ID NO: 248251 - RNA, 648 nt, Artificial Sequence
  Description of Artificial Sequence: Synthetic coding sequence
augggaaagggcgauccaaagaagccgcgcggaaaaaugaguagcuacgcguucuucgugcagacgugcagggaagagcacaaaaagaagcacccugacgcaucagugaacuucagcgaguuuucaaagaagugcagcgagagauggaaaaccaugagugcaaaggaaaaaggaaaguuugaggauauggcaaaagcugauaaggcacgguacgagcgugaaaugaagaccuacaucccuccaaaaggagaaacuaaaaagaaauuuaaggaccccaaugcaccaaaacgacccccaagcgcguuuuuccuguucugcucugaauacagacccaaaaucaaaggcgaacaccccggccucagcaucggcgacguugccaaaaaacugggcgagauguggaacaauacugccgccgaugacaaacagccauacgagaagaaggcagccaagcucaaagagaaauacgaaaaggauauugccgcuuauagggcgaaaggcaagcccgaugcugccaagaaaggagucguaaaggccgaaaaaucuaagaaaaaaaaagaagaggaagaggaugaggaggacgaggaagaugaagaggaggaagaagaugaggaggaugaggaugaagaagaagaugacgacgaugaauag

SEQ ID NO: 248252 - RNA, 648 nt, Artificial Sequence
  Description of Artificial Sequence: Synthetic coding sequence
augggcaaaggggacccgaagaagccgcgggggaagaugucuaguuacgccuucuucguacagacuugcagggaagaacacaagaaaaaacauccugaugccucugucaauuuuagugaauuuaguaaaaagugcagugagagauggaagacaauguccgccaaagagaagggcaaguucgaggauauggcuaaagcagacaaggccagguacgagagagaaaugaagaccuauaucccuccaaagggcgagacuaagaagaaauuuaaggauccuaacgcucccaagaggcccccaagugcuuucuuucuguucuguuccgaguauaggccgaaaaucaagggggagcauccaggguuaucaauuggagauguggccaaaaaacucggcgagauguggaacaacaccgccgccgacgauaaacaaccguacgaaaaaaaggccgccaaguuaaaagagaaguacgagaaggauaucgcagccuaccgcgcuaaggguaagccagacgcugccaagaaaggggucgugaaggccgaaaagucaaaaaaaaaaaaagaggaagaagaggaugaagaggaugaggaagacgaggaggaagaggaggacgaagaggacgaagacgaggaagaggacgaugacgacgaguag

SEQ ID NO: 248253 - RNA, 489 nt, Artificial Sequence
  Description of Artificial Sequence: Synthetic coding sequence
auggguaaaggugaucccaaaaagccccgaggaaagaugucaaguuacgcuuuuuuugugcaaaccugcagagaagaacacaagaaaaagcaccccgacgccucggugaauuucagcgaguuuucaaaaaagugcucugaacgguggaagacaaugagcgccaaggagaaagggaaguuugaggauauggcuaaagccgauaaagcgcgcuacgaacgagagaugaagacuuacauccccccuaagggagagaccaagaagaaguucaaggaccccaaugccccuaaacguccaccuucugcuuucuuccuauuuugcagugaauacagaccgaagauaaagggcgagcauccugggcuaucuaucggagacguggcaaagaaacuuggggaaauguggaacaacacagcugcagacgacaagcaacccuaugagaagaucuuacugcacauagaacuaaaagagucgcugaugcagcagaagcgauag

SEQ ID NO: 248254 - RNA, 942 nt, Artificial Sequence
  Description of Artificial Sequence: Synthetic coding sequence
auggauuucgaugaacgcggcccauguagcucgaacauguaccuuccuagcugcaccuacuaugugaguggcccugauuucucuagccugcccucuuuccugccccagacgccuagcucucggccaaugaccuacagcuacucaucaaacuuaccucaagugcaaccuguacgagaaguuacauuuagggaauacgccauugagccagccaccaaauggcacccuaggggcaaccucgcacacugcuacucagcugaggaacugguucacagagacugccuccaagcccccuccgccgcuggugucccuggcgacguacuugccaaaaguagugcaaacguauaccaucauccuacucccgcugugucauccaacuuuuauucaacagucggccguaacggcguuuuaccucaggccuucgaccaguucuuugaaacugccuauggcacucccgagaaccuagcaagcagcgauuauccaggggacaagagugccgagaaaggcccccccgcggcuaccgcgacuuccgccgccgccgcugcagcagcuacuggagccccagcgaccuccuccucugacucagguggaggcggcggguguagagagaccgcagcagcagcugaagaaaaggaaagaaggcguaggcccgagaguuccuccagccccgagucgucaucgggacauacagaggauaaggcuggaggcuccagcggucagcgaacaagaaaaaagcggugucccuacacuaaauaucagauccgggagcucgagagagaguucuuuuuuaguguguacauuaacaaagagaaaagacuccagcugucccgaaugcugaaucugacggaucggcaggugaagauaugguuccaaaaccgacggaugaaagaaaagaaaaucaaccgagaucgauuacaauauuacagugccaacccauuacuguag

SEQ ID NO: 248255 - RNA, 729 nt, Artificial Sequence
  Description of Artificial Sequence: Synthetic coding sequence
augagcaguuacuucgugaauccgcuguucaguaaauacaaagcuggagaaaguuuagagccugcguauuacgauuguagauucccucagaguguuggucggucucacgcacuggucuacggcccagguggcucugcccccggcuuccagcaugcgagucaccauguccaggacuucuuucaucauggaacaaguggcaucucaaacaguggcuaucagcagaauccuuguucacuguccugccauggggacgccagcaaguucuacggcuacgaagcccugccaaggcaaucccuguauggcgcucaacaggaggccagcguggugcaguaccccgauuguaagucauccgcgaacacaaacagcuccgagggacaaggucaccugaaccagaauucgucccccucccugauguuccccuggaugcgaccccacgcccccggaaggagauccggaagacagacuuauucuagguaccagacucuggaguuagaaaaagaauuccuguucaacccguaucugacucggaagcggagaaucgaagucucacacgcguuaggacugacagagcggcaagugaagaucugguuucagaaccggagaaugaaguggaagaaggagaauaacaaagauaagcuucccggugcuagggacgaagaaaaagucgaagaagagggaaacgaagaggaggaaaaagaagaggaagagaaagaggaaaauaaagauuag

SEQ ID NO: 248256 - RNA, 7341 nt, Artificial Sequence
  Description of Artificial Sequence: Synthetic coding sequence
auggacaccggcgauacagcacucgggcagaaagcuacgucacguagcggugagacugacaaagccucugggcgguggagacaggagcagagcgcugugaucaagauguccacauuuggaagccacgaggggcagcggcagccacagauugaacccgagcagaucggcaauacagccagcgcacagcuguucggcucuggaaaguuggccaguccaagcgagguuguacagcagguugcugagaagcaguaucccccacaccggccuucccccuacucuugucagcacagcuugagcuucccgcagcacucgcuaccucagggggucaugcacucaaccaagccccaucaaucacuggaagggccacccugguuauucccagguccccugcccuccgucgccucagaggaccuguucccuuucccuauucacggccauucaggcggguacccacgcaagaagaucagcagucucaacccagcauacagccaguauucccagaagucaauugagcaggccgaggaagcccauaagaaggagcacaaaccaaagaaaccaggaaaguacaucuguccuuacugcucgagggcuugugcgaaaccuucaguguugaagaaacacauccgaucccacacaggcgagcgaccauacccuugcaucccaugugguuuuuccuuuaaaaccaagucuaaccucuauaagcauaggaaaagucaugcacaugcaauaaaggccggacuugugccguuuaccgaaagugccguuagcaaacuggacuuggaagccggauucaucgacguagaagcagaaauucacucugacggcgaacagucaaccgacaccgaugaggaaucgucccuguuugcggaggccagugacaagauguccccagggcccccaauuccuuuagacaucgccagcagagggggcuaccaugggucacuggaagagucgcugggagggcccaugaagguccccauccugauuauccccaaauccgggauaccccucccaaaugaaagcucacaguacauuggccccgacauguuaccuaaccccagucugaacaccaaagcggacgauucccacaccgugaaacagaaacuugcccuucggcucucggagaaaaaaggccaggacucugagccuagucugaaccugcucucuccccauagcaaagguucaacggauaguggauauuuuucuagauccgaauccgcggaacaacaaauuuccccuccaaauaccaaugccaaaucauaugaggagauuauauucggcaaauauuguagacugucuccaaggaacgcccucagcguuacaaccacuucccaggaacgggccgccaugggucgaaaaggcaucauggagccuuuaccacacgugaacaccaggcuggacgugaaaauguucgaagacccagugucucaacuuauccccuccaaaggcgacguugacccuagucagacgucuaugcuaaagagcacgaaguuuaauagcgagagccggcagccacagaucaucccuuccucuaucaggaacgaggggaagcuguacccagcuaauuuccagggaucaaauccuguccugcucgaagccccuguggauucuucuccucugauuaggucgaauagcgugccaacaagcucugcuacuaacuugacgaucccacccaguuuaaggggaucacacaguuuugaugaacgaaugacagguagcgaugacguguucuauccagguacuguuggcauuccuccgcagagaauguuacgucgacaagccgccuucgagcugcccagcgugcaggaaggccauguugaggucgaacaccacgggcgcaugcugaaagggauuagcucaucuagccucaaggaaaagaaguugucaccaggugauagggugggcuaugacuaugacgucugccggaagcccuauaagaagugggaggauagugaaacgccaaaacaaaauuacagggacaucucgugcuugagcagccuuaaacacggaggagaguauuucauggacccaguugugccacuccagggagugcccucuauguuuggaacaacaugugagaauaggaagaggcguaaagagaagucugucggcgacgaagaggacaccccaaugaucuguucaagcauugugagcacuccugucggaaucauggccucagacuacgaccccaaacugcaaaugcaggagggggugcgcagcggguuugcaauggcagggcacgagaacuugucucacggucacaccgaaagguucgacccgugcaggccacagcugcagccgggaucgccaagucuugugagcgaggaaucaccuuccgccauugauagugacaagauguccgaccucggcgggcgaaaaccaccaggcaauguaauuagcgugauucaacauacuaacucgcucagccggcccaacaguuucgagcgguccgaauccgcugaauugguggccuguacgcaggauaaggcaccaagccccagugaaacaugugacagcgagauaucugaagccccagugucuccugaaugggcuccaccuggcgacggagcagaaucuggugggaaaccaagucccucccagcagguacagcagcaauccuaucacacccagccucgacucguccgucagcauaauauccaggucccugaaauaagagugacagaggagccugacaaaccagagaaggaaaaagaagcgcaaagcaaggagccagagaagccaguggaagaauuccaauggccucagcgguccgaaacacuaagucagcugccugcugagaaacuuccuccuaagaagaagagauugcgacucgcagauauggagcauucauccggggaguccucauucgagucaacaggaacuggccuuucuaggucuccaagccaagaauccaaccugucacauuccuccuccuucucgaugucuuuugaacgcgaagagacuuccaagcugagugcuuuaccuaaacaggacgaauuugggaaacacuccgaguuuuuaacuguaccugcuggaucuuacucacucagcgugccuggacaccaccaccagaaagagaugcgacgcuguagcuccgaacagaugcccugcccacaccccgccgaagugccugaaguuagaaguaaaucauucgacuacgguaaucugucacacgcucccgugagcggggcugcagccaguacagugucuccgucccgcgagagaaagaaguguuuccuggugcgacaggccaguuucuccggaucccccgagaucucacagggagaggucgggauggaccaaagcguuaagcaggagcaguuagagcaucuucaugccggacugcgcucaggcuggcaucacggccccccugccguccucccaccucugcagcaggaagacccuggcaaacaggucgcuggaccaugcccuccccugucuucuggcccccugcaucucgcccagccacagauuaugcauauggauucccaggagucucugagaaauccccugauacagcccacuucguauaugacgucaaagcaccugccugaacagccucaccucuuuccccaccaggaaacaauuccauuuuccccuauucagaacgcgcuguuccaguuccaguacccaaccguguguaugguccaccuucccgcucagcagccccccugguggcaggcacauuucccccaccccuuugcccaacacccucagaaaucuuacggaaagccuuccuuccaaaccgaaauucacucaucuuacccucuggaacacgucgcagaacauacaggaaagaaacccgccgaguaugcccacaccaaggaacagaccuacccaugcuacuccggcgcaagcggccugcaccccaaaaaccuucucccuaaguuucccuccgaccaguccucuaaaaguacugaaaccccauccgagcaggugcugcaagaggacuucgccagcgcuaaugccgggucccuucagucccuaccugggaccguggucccugugagaauccagacccaugucccuaguuauggaucugugauguacaccagcauuucacaaaucuuagggcagaacagcccggcaauuguaauuugcaaaguggacgagaacaugacucagaggaccuugguuacuaacgcugcaaugcaagggaucggguuuaauaucgcccaggugcuuggccagcaugcaggacucgagaaguacccaauuuggaaagcaccccagacacugccccucggacuagaaaguaguauuccucuuugcuugccuagcacauccgacagugucgcuacccucgguggcucgaagcgcaugcucagcccugccucuucccuugagcuuuuuauggaaaccaagcagcagaaacgugucaaggaagagaaaauguacggacagaucguugaggagcuuucugcuguggaacugacuaacagcgacauaaagaaggaccugucacgcccacagaaaccucagcucguuaggcagggcugugcaucugagccuaaggauggguugcaguccggcaguagcuccuucuccucacuuagcccaagcucuagccaggacuacccgucaguguccccuuccaguagagagcccuuccugccaucaaaggagauguuguccggaucgcgugccccuuuacccggccagaaaucuuccgggcccagugaguccaaggaaucaagcgaugaguuggacaucgacgagacagcaucagacaugucuauguccccacaaucaucuucacugccagccggcgacggucagcuggaagaagaaggcaaaggacacaaacgccccgucggaaugcucguacgcauggcaucugcuccgagcggcaacgucgccgauaguacucuucugcuuacugauauggccgacuuucaacaaauccuccaguuucccucccuccgcacuacaaccacggucaguuggugcuuucuuaacuacaccaagcccaacuaugugcagcaggcgacuuucaagaguucagucuaugcuagcuggugcauuagcagcugcaauccgaacccaagugggcugaauacgaagacuacccuugcguugcuccgcucuaagcaaaaaauuacagcugagauuuacacacuggccgcgaugcauagacccggcacaggcaaguuaacaucaucaagcgccuggaaacaauucacucagaugaagcccgacgcuucauuccucuucggcucaaagcucgagcguaaacugguggggaauauuuugaaggaacgcgguaagggcgacauccauggugauaaagacaucggauccaagcagaccgagccgauccggauuaagaucuuugaaggggguuauaaauccaaugaggacuauguguacgugcgaggaagggggcggggcaaguacaucugcgaggaauguggaaucagauguaagaagcccuccauguuaaaaaaacauaucaggacacauacugacguccggccauacgugugcaaacuuuguaauuuugcauucaagacaaaaggaaaccugacaaagcauaugaagagcaaggcacauaugaaaaaaugccuggaacucgggguauccaugacuucagucgaugacaccgagaccgaggaggcagagaaucuagaagacuugcacaaggcagcugagaaacauuccaugagcucuauuaguacugaccaucaauuuucugacgcugaagagucugacggggaggauggagacgauaacgaugaugacgaugaagaugaggaugauuuugaugaccagggggaccucaccccaaaaaccaggagccgaaguaccucgccucagccuccccgcuuuagcaguuugccugucaaugugggagccgucccccacggcgugcccagcgauucaucacugggccauucuucuuuaauaagcuaucucgugacucugccauccauuagaguuacccagcucaugacccccagugauagcugcgaagauacccagaugacagaguaccaacgacuguuucaguccaagagcacagauagcgagcccgacaaagaucgccuugacauaccaagcugcauggacgaggagugcaugcugccauccgagcccuccagcucgccccgcgacuucucuccuucuagccaccauagcaguccaggguaugacagcuccccauguagagauaacucuccaaagcgguaucuaaucccaaagggcgaccuuaguccuagaaggcaucugagcccuaggcgagaccuuuccccuaugcgacauuugucuccaaggaaggaagcagcucuucgucgcgaaaugucucagagggacgugucuccuagacgccaucuuucuccgaggcgcccugucagcccuggcaaggauaucacagcuaggcgcgacuuaucaccaagaagggaacguagguauaugacaacuauccgugcgccaagucccagaagggcuuuauaucauaacccaccgcucuccaugggacaauaucuucaggcagaaccuauaguguuaggaccccccaaccuacgacgcggacugccucaagugcccuacuucagccuuuauggagaccaggagggugcauacgaacaccccgggucuagucuguuuccagagggcccgaacgacuauguguuuagucaccucccgcuacauagucaacagcagguccgggcuccaauaccaauggucccugugggaggaauccagauggugcacucuaugccuccagcucucagcucccuccauccgagcccaacccuuccucuuccaauggaagguuucgaggaaaaaaagggcgccaguggcgaaucuuucucaaaagauccuuauguccuuaguaagcaacacgagaagagagggccacaugcgcuucagaguucgggcccuccuaguacacccucaaguccucggcuccuaaugaaacaaucuacuucugaggauucucugaacgcuacggagcgcgagcaagaagagaacauccagacuugcaccaaggcaaucgcaagccuuaggaucgccacagaggaggcugcccugcugggcccggaucagcccgcaagaguucaagagccacaucaaaacccguuaggauccgcucacguuagcauucgccacuucagcaggccugagccaggucagcccugcacuucagccacucacccagaucuccaugacggagaaaaggacaacuucggcacaucccaaaccccguuagcacacaguacauuuuauuccaagagcugcgucgacgauaagcaauuggauuuucauuccucuaaagaguuaaguucuagcaccgaggaauccaaggauccuuccucagagaagagccagcuccacuag

SEQ ID NO: 248257 - RNA, 786 nt, Artificial Sequence
  Description of Artificial Sequence: Synthetic coding sequence
auggccgccgcauguaggucaguaaagggccuagucgccgugauuacaggaggugcaagcggacuuggucucgccacggcugaaaggcuuguaggucaaggggcuuccgcuguccugcuagaccucccgaauucuggcggggaggcgcaggcuaaaaaacugggaaacaauugugucuucgcuccugcagacguaacauccgaaaaggacguccaaacugcucucgcuuuagccaagggcaaguuuggaagaguggacguggccgugaauugcgccggaaucgcaguugccaguaaaacuuauaaccugaaaaaaggacagacucacacccuggaggauuuccagcgcguucuugacgugaauuugaugggcacauuuaacgucaucaggcucguggcaggagaaaugggucagaacgaaccggaucagggaggccagaggggggugaucauuaacaccgcuuccguugcugcguucgaaggacaggugggccaggccgcuuauucugccucuaagggagguauuguaggaaugacccucccaauugcacgcgaccuggcuccgaucggaaucagggucaugacaaucgcuccuggccuuuucgguacgccucuccucaccucuuuaccagaaaaaguauguaacuuccuugccucacaaguccccuuccccucccgucugggagacccugccgaauacgcccaucugguccaggcaaucauugagaauccauuucuuaacggugaagugauacgacuagauggcgccaucagaaugcagcccuag

SEQ ID NO: 248258 - RNA, 792 nt, Artificial Sequence
  Description of Artificial Sequence: Synthetic coding sequence
augaagggcggguucaccggcggagacgaauaccagaaacauuuccuuccucgggacuaccucgccacuuacuacucguuugacggcucccccucccccgaagcggagaugcugaaauucaaucucgaaugucuccacaagaccuuuggaccaggaggccuucaaggggauacacucaucgacauuggcuccgguccaacgauuuaccaaguacuggcagccugugacaguuuccaggauaucacccuguccgauuucacagaccggaaucgugaagaguuggagaaauggcugaaaaaggaaccuggcgcauacgacuggacacccgccgugaaguuugcuugcgaacucgagggaaauucgggccgaugggaggaaaaagaagagaaguugcgugccgccgugaagagaguucuuaagugugacguucaucugggaaauccucucgcacccgccguccucccacuagcagauugcguucuuacccuacuugccauggagugcgcaugcugcucccuugacgcuuaucgggccgcucuuuguaaucuugcuuccuuguuaaagccuggcggacaucugguaacaaccgugacccugcgucugccaagcuacaugguggggaagagggaauuuucauguguggcccucgaaaaagaggaagucgagcaggccguacuggacgcaggauuugauauugaacagcugcugcauaguccccagucuuacagcguuacaaacgcagcuaacaacgggguauguuucauagucgcucgcaaaaagcccggccccuag

SEQ ID NO: 248259 - RNA, 1386 nt, Artificial Sequence
  Description of Artificial Sequence: Synthetic coding sequence
auguggcaacuaacuucauuacuccuguuugucgcaacauggggaauaucuggcacccccgcaccacuggacucagucuuuucaucuuccgagcgugcgcaccaaguucugaggauuagaaaaagagcaaacaguuuccucgaagaacugaggcacaguucccucgaacgggagugcauugaggagauaugcgauuuugaagaggcuaaagaaaucuuccagaacguugacgacacacuugcuuuuuggaguaaacacgucgacggugaccaaugcuugguucucccauuagagcaucccugcgcgucccuguguugcggacacggcaccuguaucgacggaauaggcaguuucucgugugauugccguucggguugggaaggccgcuucugucaacgcgaggugagcuuucuaaacugcagccucgauaauggcggguguacucacuacugccucgaagaggucggauggcgacgcugcucuugcgcaccaggcuauaagcuuggcgacgaccuucugcagugccauccagcgguaaaauuccccuguggacguccuuggaagcguauggaaaaaaaacggagccaccucaaacgggauacagaggaucaagaagaucagguggacccacgcuuaauugacgggaaaaugaccaggagaggcgacucuccuuggcaggugguguugcuggauuccaagaagaagcuggcuuguggagcgguccucauccauccaucaugggugcugacagcugcucacuguauggacgaaucaaagaaacuuuuggugaggcugggggaauaugaucugaggagaugggaaaaaugggaacuggaucuggacauuaaagagguauucgugcaccccaauuauaguaagucuacaacggacaacgacauagcucuuuugcaccucgcccagccagcuacucuuagccaaacgaucguuccuauuugucuuccugacucaggccuggcggaaagggagcuaaaccaagcgggucaagaaaccuuaguuaccggauggggcuaccauuccucuagggaaaaagaagccaagagaaacaggacuuuugugcugaacuucaucaaaaucccagugguaccccacaacgaguguucugaggugaugucaaauauggugagugaaaauauguugugugcuggaauccugggagauagacaagacgcaugcgaaggcgauucagggggacccaugguggcaucauuccaugggaccugguuucucgugggccuggucucuuggggagaagguugcggccugcugcauaauuauggcgucuacaccaaggugucacgauaccuagacuggauccauggccacauacgcgauaaagaagcaccgcaaaagaguugggcaccauag

SEQ ID NO: 248260 - RNA, 2934 nt, Artificial Sequence
  Description of Artificial Sequence: Synthetic coding sequence
augacugcccgcgagcauucaccccggcacggcgcuagggcucgggcaaugcagcgcgcguccacaaucgacguagcugcugacaugcugggccucagucuggcggggaauauucaggaucccgaugagcccauucuugaauucagcuuggcaugcagcgagcuucacacaccuucuuuggaucggaaaccaaacaguuucguggccgucucugugacgaccccaccucaagcuuuuuggacaaaacacgcccagacugaaaucauagaggguaccaacaaccccaucuuucugaguagcauugcauucuuucaggacucccucaucaaccagaugacacaggucaaacugucaguguacgaugucaaggaucgcagccagggaacaauguaccugcugggcaguggaaccuuuauagugaaggaccuccugcaggaucgacaccaccggcuccaucucacccugcggucugcugagucugaucgcguugggaauauuacggugaucgguuggcaaauggaagagaagucagaucagcgccccccagucacaaggucaguugauaccguuaacgggcgcaugguccuuccaguggacgagucccuuaccgaagcacugggcaucaggucuaaguaugcaucacucaggaaagacacccuguugaagagcguguucggcggcgccaucuguaggauguaucguuucccuacgacggacggcaaccaucuccgcauccucgagcaaauggcagaaucugugcuuuccuugcacgugccucgccaguuuguaaaauuguugcuggaggaagaugcagccagggucugugaacucgaggaacugggcgaacugagucccugcugggaaagcuugagacggcagauagugacccaguaccaaacuaucauuuuaaccuaucaagaaaaccugacggaccuucaucaguauagggggcccagcuuuaaggccaguagcuuaaaggccgacaaaaaauuagaguuuguaccuacaaaucuccauauccaacguaugagagugcaggaugacggcggcagcgaucagaacuacgauaucgugacuauaggugcacccgccgcucauugucaaggcuucaaaucggggggacuuaggaaaaaacugcacaaguuugaagaaaccaagaagcauuucgaggaaugcuguacuagcuccggaugucagagcaucauuuauauaccucaagacgucgugagagcuaaggagauuaucgcacaaaucaacacccucaaaacucaggucucuuauuacgcugaaagacugucuagggcagccaaagauagaucagccaccgggcucgaacguacccuugccauccuugcagauaaaacuaggcaguuagugaccguuugcgauugcaagcuucuugcgaacuccauucacgggcucaacgcugcuaggcccgacuacaucgcauccaaagcuuccccuaccuccacggaggaggaacaggugaugcuucgcaacgaucaagacacccucauggcccgcuggacaggccguaacagucgcaguucucuacaaguugacuggcacgaagaggaaugggagaagguuugguuaaacguggacaaauccuuggaauguaucauccagagaguggacaaauuacuacaaaaggagagauugcacggggaagggugcgaggauguguucccaugugccgguaguuguacuucuaaaaagggcaauccugauagccaugcauauuggaucagaccugaagacccguucugcgacgucccaucaucucccugccccucaacaaugccaucgacugcgugucauccacaucugacaacucauuguucgcccccgccugaggagucuucucccggagaaugguccgaagcacuguacccccuuuuaacuacacucaccgauugcguugcgaugaugagcgauaaagcuaaaaaagcaaugguauucuuacucaugcaggacuccgcuccaacaaucgcuacauaccuaagucuccaguauaggcgggacgugguguuuugucagacacugacagcucucauaugugguuuuaucauuaaauugagaaauugucuucacgaugauggcuucuugcgccaguuguacacaaucggauugcuggcacaguucgaaucacuccugaguaccuauggagaggaacuggcuaugcuggaagacaugucgcugggcauaauggaccuuagaaaugucaccuuuaaaguuacccaagcaaccucaucagcuucagccgacaugcugcccgucauuacaggcaaccgggauggcuucaauguucgagugccucugccagggccuuuguuugaugcacugccucgcgagauucagagcgguaugcuucugcggguccagccggugcuauuuaaugucgguauuaacgagcaacagacauuggccgagagguucggcgacaccucacuacaggaggugaucaauguugagucccucgugagauugaacaguuauuucgaacaguuuaaggagguccugcccgaggauugccugccucgaagucggagucaaaccugcuugccggagcugcugcgauuccugggacagaacguacacgcucggaagaauaagaauguugauauacuguggcaggccgccgaaaucuguagaagacugaacggugugcgguucacaagcugcaagagugcaaaagaccggacugccauguccgugacacuggaacagugcuugauucuacagcaugaacauggcauggcaccccagguuuucacacaggcccucgaauguaugcgaagcgagggcugcaggcgggaaaacacaaugaaaaauguuggaucucggaaauaugccuucaauucacuccaguugaaagccuuucccaaacacuaucgacccccagaggggacguacggcaagguugaaacauag

SEQ ID NO: 248261 - RNA, 3201 nt, Artificial Sequence
  Description of Artificial Sequence: Synthetic coding sequence
augggccccggcccuagucgugccccacgggcccccaggcugaugcugugugcacuugcccuaauggucgccgcaggagguugugucgugagcgccuucaaccuggacacaagauuccucguggugaaggaagccggaaauccugggucucuguucgguuacagcguggcccuccacagacagacggagcgacaacagcgguauuugcuccucgccggggcgccacgcgagcuugcugugcccgauggguacaccaaucgaacaggagcuguuuacuuaugcccucugacagcgcacaaagacgacugugaaaggaugaacauuaccguuaagaacgacccaggccaccacaucauagaggacauguggcugggcguuacuguggcuucccagggaccugccgggcgaguguuaguuugugcacaucgguacacucaggugcuguggagcggaucugaggaccagaggcgaaugguggggaaauguuacgugcgugggaaugaucuagaguuggauagcagugaugauuggcagaccuaccacaaugagaugugcaauaguaauacagacuaccuagagaccgggaugugccagcucgguacuucagggggguuuacacaaaacacggucuacuuuggggccccgggcgcguacaauuggaaagguaauuccuacaugauucaacggaaagagugggaccugagugaguauagcuauaaggauccagaggaccaagggaaccuguacauuggauauacaaugcagguugguucauucauacuacaucccaagaauauaacgaucguuaccggugcaccucgacaccgucauaugggugcuguguuucuacugucgcaggaagcuggaggugaccuccggcgacggcagguacuggaggggucccaggugggggccuauuucgggucagcuaucgcccuugccgauuuaaauaacgacggauggcaggaucugcuugugggagccccauacuacuucgaacggaaggaggaagucggcggcgcuaucuacguguucaugaaccaggcaggcacaaguuuuccagcccaccccucgcugcugcugcacggaccaagcggguccgcguucggauuaagcguggccuccauaggugacauuaaucaagauggcuuccaagauaucgccgucggggcccccuuugagggccugggcaaagucuacaucuaccacagcucgagcaagggucucuugcggcaaccacaacagguaauacacggagagaaacugggauugcccgggcucgccacuuucggauacaguuuauccgggcagauggacguugaugagaacuucuacccagaucuacugguggguucucuguccgaccauaucguccugcugagggcaagacccgucauuaauauaguccauaaaacucuggugccccggccugcagugcuagauccugcucucuguaccgccaccucaugugugcagguggaauugugcuucgccuacaaccaguccgcagggaauccuaauuauagacggaauaucacauuggccuauacccuugaggccgauagagacaggcgaccaccgcgacuccgcuucgccggcucagaaucagccgucuuucacggauucuucuccaugccugaaaugcgcugucagaagcuggaacuucugcucauggacaaccuacgugacaagcugagacccauaauuauaucgaugaauuauucucuuccucucaggaugccggaccguccacgguuagggcuuagaagccuggacgccuaucccauccucaaccaagcccaagcccucgaaaaucauaccgaagugcaguuccagaaggagugcgguccagauaacaagugugaaucaaacuuacagaugagggcggcauuugucuccgagcaacagcagaaacugagcagacuucaauacagccgcgacgugcgcaagcugcuucuuagcauaaacgugaccaauacccgcacuuccgagcguucuggcgaggaugcccaugaggcgcuccugacacuggucguucccccugcccuacuucuguccagcgugcgucccccgggugcaugucaggcuaacgagaccauauucugugaacugggcaaccccuucaagcgcaaucagagaauggaacuccuaaucgcauuugaagugauaggggucaccuuacacacacgagaucugcagguccaguugcagcuaaguaccucuucacaccaagauaaucucuggccuaugauccugacacucuuagucgacuauacccuccagaccagcuugagcauggugaaccauagacuucagaguuuuuuuggcggcaccgucaugggcgaaagcgguaugaagacuguggaggaugucggcaguccucucaaauacgaguuucagguaggacccaugggugagggauugguuggucucggcacccucgugcucgggcuugaguggcccuaugaagugucaaauggcaagugguugcuguaucccaccgaaauaacaguucacggcaauggaucauggcccugcaggccccccggagaccucaucaacccucugaauuuaacccugagcgacccaggggaccggccaucuuccccacagcgccggcgcaggcaacuggaucccgggggggggcagggaccaccacccgugaccuuagccgccgcuaaaaaagcgaaaagugaaaccguuuugacaugugcuacuggaagggcucacugcguuuggcuugaaugcccaaucccugaugccccuguugugacaaacguuacagugaaagcuaggguguggaauuccacuuuuauugaggauuaucgagauuucgaccgcgugcgaguuaacggaugggcuacccucuuccuccgaacaagcaucccaacgauuaauauggagaacaagacaacaugguuuagcguugauauugauucugagcugguggaggaauugccggcugagauugaacugugguuaguacuuguggccgucggagcgggucugcuacuauugggacuuaucaucuuauugcuuuggaaaugcgacuucuuuaagcgcacacgcuacuaucagauuaugccaaaguaucaugcuguucgcauucgagaagaagagagguauccacccccuggauccacacugcccacaaagaaacauugggugacguccuggcagacucgggaccaguacuacuag

SEQ ID NO: 248262 - RNA, 1644 nt, Artificial Sequence
  Description of Artificial Sequence: Synthetic coding sequence
auggcuaccauggucccauccguccuguggcccagagccugcuggacccuguuaguaugcugccugcugacucccggaguucagggucaagaauuccuucuccggguugagccccaaaacccuguccucucagcuggaggcucauuguucgugaacuguuccacugauugccccucuucagagaaaaucgcccucgaaacuagccucagcaaagagcugguagccuccggaaugggcugggccgcguucaauuugaguaacgucacugggaacagcagaauucuguguagcguguacuguaacggcagucagaucacaggaucguccaacauaaccguguaccggcucccagagcgcguggagcuugcuccacugcccccuuggcagccuguagggcaaaauuucacccuucggugucagguggaagaugggucaccacgcaccucucucacugugguccugcugaggugggaggaggagcuuucccgacagccagccguggaggagcccgccgaggugaccgcaacugugcuggcuucaagagaugaucacggcgcccccuucucauguagaacggaacuggauaugcaaccucagggucuagguuuguuuguuaauacuuccgccccgcgucagcugagaacauucguccuaccuguuacgccaccgcgccuuguggcuccacgguuucuagaaguggagacguccuggcccguggacugcaccuuagacggauuguuccccgccagcgaggcacaggucuaccuagcauuaggagaucagauguuaaacgcaacugugaugaaucacggcgacacucugacugcaacagcuacagccaccgcaagagccgaucaggagggagccagagagauugucugcaacguuacccuggggggggagaggagagaggcgagagaaaaucugacagucuuuucuuuucuggguccaauagugaaccugucggagccaacagcacaugagggcaguaccguaacuguauccuguauggccggcgcgcgggugcaggucacucuggauggggugccagccgccgcccccggccagccagcccaacuccaacugaacgccaccgaaagcgacgauggacgauccuucuucugcucagccacauuggagguugauggagaauuucugcacaggaacucuagugugcagcugcgcgugcuguaugguccuaagaucgaucgugcuaccuguccccagcaucuaaaauggaaggacaaaacccgacacguguuacagugucaagccaggggcaaccccuauccugagcuuaggugccuuaaagagggaagcaguagagaagucccagugggaauuccuuucuucgugaacgugacucauaacgggacuuaucagugccaggcgucaucuucucgggggaaauacacacucgugguuguuauggacauugaagcagggagcucucauuuuguaccuguauuuguggcgguguugcuuacguuggggguugugacaaucguacuugcacucauguacgucuuccgggaacaucagcggaguggcagcuaucauguucgagaggaaucuaccuaucugccucuuacuaguaugcagccuacagaggcgaugggggaggagccuuccagagccgaauag

SEQ ID NO: 248263 - RNA, 1356 nt, Artificial Sequence
  Description of Artificial Sequence: Synthetic coding sequence
augccaaaaaacaaaaaacggaauacaccccauagagguucuagugcggggggcggaggcucuggggcagcugccgccacggccgccacagccggcgggcagcacagaaacguccagccguuuucugacgaggacgcauccauagagacuaugucacacugcaguggguacagcgaucccuccucuuucgccgaagacggaccugaggugcucgacgaagaggggacucaggaagaucuggaguacaagcuaaagggcuuaauugaccugacacuggacaaguccgccaagacccgacaggccgcgcuggaaggaaucaagaacgcacucgcuaguaagaugcuguacgaauucauucucgaacgccggaugacucucacagauucuauugaaagaugucugaagaaagguaaaagcgacgaacaaagggcagccgcagcucuugccucaguccugugcauucaguuagguccuggcaucgaaagugaggaaaucuugaagacgcucgggccgauccugaagaaaauuauaugugauggauccgcauccaugcaggcccgucagacuugcgccacuugcuuuggugugugcugcuuuauagcuacggaugauaucacugaguuauauagcacccuggagugccuggagaacaucuuuaccaaaucuuacuuaaaggagaaggauaccaccgugaucuguucuacuccgaauacgguccuccauaucucuagccuucucgccuggacucugcugcucacaauaugccccauuaacgaggucaagaaaaaauuagaaaugcauuuucacaaacuacccucucugcugagcugugaugaugucaacaugaggauagccgccggcgagucucucgcacugcuguuugaauuagcucgcggcauugaaucugacuuuuucuaugaggacauggaaucucugacacagauguugcgagccuuggcaaccgacggaaacaagcaccgagcuaaaguggauaaacggaagcagaggagcguguuucgagacgugcuucgcgcaguggaagaaagggauuuccccacagaaacaauuaaauucggaccagaaaggauguacauugauugcugggucaaaaaacacacauacgauacauucaaagaagugcugggcuccggaaugcaguaucaccuucagucuaacgaguuucuuagaaauguuuucgaguuaggcccucccgugauguuggacgcugcuacguuaaagacaaugaaaauuagcagauuugaacgccaucucuacaauucugccgcuuucaaagcgaggaccaaggcccgcucuaagugccgggacaagagagccgacguuggcgaauucuuuuag

SEQ ID NO: 248264 - RNA, 1713 nt, Artificial Sequence
  Description of Artificial Sequence: Synthetic coding sequence
augacgcuucugugguguguggucagccuguacuucuaugguauccugcagucugaugcaucagaacgcugugacgacuggggacuggauaccaugcgccagauacagguauuugaagaugaacccgcuaggaucaaaugcccauuauucgaacacuuucuuaaauuuaauuauagcacugcucacucagccggacucacucucauuugguacuggacccgacaggaucgcgaccucgaagaaccaauaaauuuuagauugccugagaacagaauaucuaaagagaaggauguauuaugguuuaggccaacccugcucaacgauacuggcaauuacacuuguauguuacgcaacaccacuuauugcucuaaaguagccuucccccuggaagugguccaaaaagauucaugcuuuaauucacccaugaaacuccccgugcacaagcucuacaucgaauacgggauacagcgcauuacuugcccaaauguggacggguacuuucccucaagugugaaaccaaccaucacaugguauauggggugcuacaaaauucaaaauuuuaauaaugugaucccggaagguaugaaucugucauuucugauugcccugauaagcaauaacgggaacuauacuugcguuguuacuuauccggagaauggcaggacuuuucaucucacuagaacacugacggugaaaguggucggauccccaaagaacgcugucccucccguaauacauagccccaaugaccacgugguuuacgagaaagagccaggcgaagaacugcugauuccuuguacuguguauuuuagcuuuuugauggauucccggaaugagguaugguggaccauagacgguaaaaaaccugaugacaucacaauugaugugacuaucaacgaaucaauuucccacucucguacagaagacgagacacgcacccagauccucucaaucaagaagguaaccucugaagaccuuaagcggagcuaugugugccaugcaagaagugcuaagggugaggucgcuaaggcugcuaaggucaaacagaaggugccugcuccgagguauacgguagagcucgccugcggcuuuggggccacagugcuguuggucgugaucuuaauugucgucuaccauguguacuggcuugaaauggucuuauuuuauagggcucacuucggcaccgaugaaaccauucucgaugguaaagaguacgacauuuauguaagcuacgcucguaacgcugaggaggaagaguuugugcuacugacgcugaggggcgugcuggagaaugaauucgguuauaagcuuuguaucuuugauagagauucacuuccagggggaaucguuacagaugaaacccugucguuuauccagaagagcagacgacuucuggucguucuuaguccuaauuacguguugcagggaacacaggcccugcuagagcugaaagccggauuagagaauauggcaagccguggcaauaucaaugucauuuuggugcaauacaaagcggugaaagagacuaaggucaaggaguugaagcgcgccaaaacgguauuaacugugauaaaauggaaaggugagaaguccaaguauccucaggggagguucuggaagcaacugcaaguugccaugcccguaaagaaaucuccucgaagaucuucaucugacgagcaagggcuuucuuauucaucacugaaaaacguuuag

SEQ ID NO: 248265 - RNA, 987 nt, Artificial Sequence
  Description of Artificial Sequence: Synthetic coding sequence
augggauucuggauucuggcaauccugaccauuuuaauguauagcaccgccgccaaauucucuaagcagucgugggggcuggaaaacgaggcccuaauuguccggugcccucgacagggcaagcccuccuacacuguagacugguauuacagccaaacaaacaagaguauaccuacacaggaaagaaacaggguguucgcgucgggucagcuucugaaguuccuuccagccgccguggccgauucuggcaucuacaccugcauuguucgcucaccaacauucaaccguacagguuacgcaaaugugacaaucuauaagaaacaaagugauugcaacguucccgauuaucugauguauagcacugucucagguuccgagaaaaacuccaaaauauacuguccgaccauugaucucuacaacuggaccgccccacuggaaugguucaaaaacugucaggcucugcaaggcucacguuaucgagcucauaaguccuuucugguaaucgacaacguuaugacagaagacgccggugauuacacgugcaaguuuauccacaaugagaauggugcuaacuacuccguaaccgcuacaagauccuucaccgugaaagaugaacagggcuucagucuguuccccguuaucggugcuccugcccaaaacgaaauaaaggagguugagauuggcaaaaacgccaauuuaaccuguagcgccugcuucgguaaagggacacaauucuuagcugccgugcucuggcaacucaaugggacuaagauuaccgauuuuggcgaacccagaauucaacaagaggaggggcaaaaucagucuuucucuaacggucuggcuugcuuggacaugguauuacggaucgccgaugugaaagaggaggaucuguuacuccaguaugacugccuugcccuuaauuugcauggacugagacgucacacgguuaggcugucccgcaagaacccaagcaaagagugcuuuuag

SEQ ID NO: 248266 - RNA, 780 nt, Artificial Sequence
  Description of Artificial Sequence: Synthetic coding sequence
augggcuuuuggauuuuggccauacucacaauucuuauguauagcacggccgccaaguucucuaagcaaagcuggggauuggaaaacgaagcucucauuguccgaugcccacgucagggcaagcccucuuacacaguggacugguauuauucucagacaaauaaguccaucccuacgcaagagcgaaauagagucuuugccuccggucaacuucuaaaauuccugccagcugccgucgccgauagcggaauauacacauguauugucaggagcccuacauuuaaccguacuggguaugccaacguaacuaucuacaagaagcaauccgacuguaacgugccugauuaucugauguauucuaccguuucggguuccgagaagaauucaaagauauacugcccuacuauugaucuguacaauuggacagcaccuuuggaaugguuuaagaacugccaagcacugcaagggucacguuacagggcccacaagucuuuccuggucauugauaacguaaugacugaagaugccggagacuauaccugcaaguucauccauaaugagaauggugcaaacuacucaguuacagccacccgaucauucacugugaaaguauggugucagucauuuugcaaacucaagaaguccuuaauuuucucuaacacucacuggauccagagccugaugagaggauucgugaugguauacuacggcgugcacaagugcugcagggucguguuuaaccugugccugcaauacuuccaacaccaucaguggccguag

SEQ ID NO: 248267 - RNA, 636 nt, Artificial Sequence
  Description of Artificial Sequence: Synthetic coding sequence
auguacaguacaguaucuggcucugagaagaauagcaagaucuacugcccaaccaucgaucuuuauaauuggacagcgccucuugaaugguuuaagaacugucaggcauuacaagggucuagguaccgagcccauaaaucauuuuuggugauugauaauguaaugacggaagacgcuggggauuauaccuguaaguucauccacaacgaaaacggggccaacuauucggugaccgcuaccagaucuuucacagugaaagaugaacagggauucucacuguuucccguaaucggagcgcccgcucagaaugaaauuaaggagguggaaauuggcaaaaaugcaaaccugaccuguagugccugcuucggaaaaggcacccaauuuuuagcagccguucuuuggcaguuaaauggcacaaaaauuacugauuuuggugaaccuagaauucagcaggaagagggucaaaaccagucuuucagcaacgguuuagcuugcuuggauauggugcugcgcaucgccgauguaaaagaagaagauuugcuccuccaauacgacugccuggcccuaaaucugcacggacuucgcagacauacugugcgacuuagcagaaagaauccuuccaaagaaugcuucuag

SEQ ID NO: 248268 - RNA, 945 nt, Artificial Sequence
  Description of Artificial Sequence: Synthetic coding sequence
augggguuuuggauccuugccaucuugacaauucuuauguauagcaccgcugcuaaauucagcaaacagucaugggguuuagagaaugaagcacuaauuguuagaugcccucggcagggcaaaccuucguauacuguggauugguauuacucccagaccaauaaauccaucccuacucaagagagaaacagaguguucgccucuggucagcuccuuaaauuccucccagcugcaguggccgauucugggauauauacauguauuguucguucaccaacuuucaaucgaacaggauacgcuaacgugacaauuuauaagaaacaauccgacuguaacgugccggacuaccugauguacagcacgguaucuggaucagaaaaaaauagcaagaucuauuguccaacaauugaccuguauaauuggacagccccacucgagugguucaagaauugucaagcccugcaggggucucgauauagggcccacaaaucuuuccucgugaucgauaaugugaugaccgaagacgcgggcgacuauacauguaaguuuauccauaacgagaauggggcuaacuauagcgugacagcuacccgaucauuuacuguaaaagaugagcaaggcuuuucucucuuuccuguaaucggggcacccgcacaaaacgagauuaaggagguggaaauagguacucaguucuuggcagccguguuguggcagcugaauggcacaaaaauaacagacuucggagaaccgcgaauccagcaagaggagggccagaaucagaguuuuuccaauggguuggcgugccuggacauggugcuacgaaucgccgacgugaaggaagaggaucuccuguuacaguacgacugccuggcccucaauuuacacggucuacggaggcauacagugcgucugagucggaagaacccuuccaaggaaugcuuuuag

SEQ ID NO: 248269 - RNA, 117 nt, Artificial Sequence
  Description of Artificial Sequence: Synthetic coding sequence
augggauuuuggauacucgccaucuuaacuauucuuauguauucuaccgccgcuaaauucaguaagcagucguggggacucgaaaacgaagcccucaucgugagaugcccucgcuag

SEQ ID NO: 248270 - RNA, 300 nt, Artificial Sequence
  Description of Artificial Sequence: Synthetic coding sequence
augcaaccuagaguacuacuagugguggcccugcucgcucuccuggccucugcgcgcgccuccgaagcagaggacgccagccucuugucuuucaugcaaggguacaugaagcacgcgaccaagacagccaaggaugcccucucuaguguccaagaaagccaaguagcacagcaggccagaggaugggugacagacggguuuucaucacuuaaagacuauuggucaacuguaaaagauaaauucagcgaguuuugggaucucgaccccgaggugcgcccaacuagugcugucgccgccuag

SEQ ID NO: 248271 - RNA, 1671 nt, Artificial Sequence
  Description of Artificial Sequence: Synthetic coding sequence
augggauucuggauacucgcuauucugacaauucugauguauagcaccgccgcuaaauucucgaaacagucuuggggccuggagaaugaagcccuaaucgugcgcuguccaaggcaagguaagccaucauacaccguggacugguacuacagccaaaccaauaaaagcauuccuacucaggagcgcaauagaguauuugcaucuggccagcuuuuaaaguuccugccagccgcaguggcagacagcgggauuuauaccuguauuguacgaucuccuacauucaaucgcacaggauacgccaacgugacaaucuacaagaaacagucugauuguaacguccccgauuaccuuauguacaguaccgucuccggcuccgagaaaaauaguaaaaucuauuguccgaccauugauuuauauaauuggacggcuccgcuagagugguuuaaaaauugccaggcgcugcaaggcucucgguacagagcccauaaguccuuucuggugauugacaacguuaugacggaggaugccggcgauuauacaugcaaguuuauucauaaugagaauggggcaaacuacagugugaccgccaccagaucuuucacaguuaaagacgagcagggauucagccuguuuccagugaucggugcucccgcacagaacgaaaucaaggaaguagaaaucggcaagaacgcaaaucugaccuguuccgccuguuucggcaaagggacucaguuucuugccgcuguguuauggcagcugaacggcacaaagauuacagacuucggugaacccagaauucagcaggaagagggucagaaccagucuuuuagcaacggucuggcgugccuugacauggugcugaggauagccgacguaaaggaggaagaccugcugcuccaguaugacugucuggcucuuaaccuucaugggcucagacggcacacaguuagacuuucaagaaagaacccaauugaccaucauaguauuuacugcauaauugcuguuugcucugucuuccugaugcuaauuaauguccuugugauaauucugaaaauguuuuggaucgaagccacccugcuguggagagauauugcuaagccuuauaagacaagaaaugaugggaagcuguacgaugccuauguuguguacccacgcaauuacaagagcucuaccgauggagcgucuagaguggaacacuucguucaccagauccucccugaugugcuugagaauaaguguggcuauacacuguguauuuaugggcgcgauauguuacccggagaggacgugguuacggcuguugaaacuaauauccguaaaagcagacgccauaucuuuauuuugaccccgcaaaucacacauaacaaggaauucgcuuaugaacaggagguggcccugcacugcgcacuaauucagaaugaugcgaaagucauccugauugagauggaggcacucagcgaguuggauauguugcaggcugaggcccuucaggauucgcugcagcaccucaugaaaguccaaggaacuaucaaguggcgcgaggaccauaucgcuaacaaacgcagucuuaauagcaaauucuggaagcacgugagguaccaaaugcccgucccgucuaagaucccuaggaaagcuaguucacugaccccccucgcggcacagaaacaguag

SEQ ID NO: 248272 - RNA, 741 nt, Artificial Sequence
  Description of Artificial Sequence: Synthetic coding sequence
augcuguggcggcaguuaaucuauuggcaguuacuggcacuguucuuucugccuuucugucugugccaggacgaauacauggaguccccccaaaccggagggcuacccccugauuguucgaagugcugccacggugacuacucauucagaggcuaccagggaccuccuggcccaccaggaccuccagguaucccugggaaucauggaaacaaugguaacaauggcgcuacuggucacgagggugcaaagggugaaaaaggcgauaaaggugaucucggaccccgcggagagagagggcaacacggaccaaagggggaaaaagguuaucccggaauuccuccggaauugcagaucgcuuucauggcuucccucgccacccacuucaguaaccaaaacagcggcaucauauucucuucagucgaaacuaacaucgggaacuucuuugacguuaugacgggcagguuuggggcgcccgugagcggugucuauuuuuuuacuuucucaaugaugaaacacgaggacguggaggagguauacguguaccugaugcacaauggcaacacuguuuucagcauguacagcuacgagaugaagggcaaaagugauacaucaucaaaccaugcuguccugaagcuagcaaaaggagacgaagugugguuacgaaugggcaauggagcacugcauggagaucaucagcgguucaguacuuucgcgggcuuucuacuguuugaaacgaaguag

SEQ ID NO: 248273 - RNA, 666 nt, Artificial Sequence
  Description of Artificial Sequence: Synthetic coding sequence
auggcugccgcuaggccuagccucggcagaguucugccuggcagcucugugcuguuccuaugcgauaugcaggaaaaguucagacauaauauagcuuacuuuccccaaaucgugaguguggccgcgcggauguuaaagguggcaagacuucuggaagucccugugauguugacugaacaguacccccagggacucggaccuaccguucccgagcuugggaccgaaggacucagaccccuggcaaagacuugcuucaguauggugccugcucuccagcaagaacuagauucgcgcccacagcugagaagcgucuugcucuguggaaucgaggcacaggcuugcaucuuggauccgcggucuuauccuggucuggcacucacuuccuuguacccucagaauacaacgcuugaccugcuugacaggggccuccaggugcacgucgugguggaugcgugcucaucccggucucaagucgauaggcugguugcccuggccagaaugcggcaguccggggcuuuucugaguaccucagaaggucugauauugcaguuggugggugaugcagugcauccccaguucaaagagauccaaaaacuuaucaaagaacccgcgccugauucuggacucuuaggauuguuccaaggucaaaacucccuccuccacuag

SEQ ID NO: 248274 - RNA, 834 nt, Artificial Sequence
  Description of Artificial Sequence: Synthetic coding sequence
auguggccuuuggcauuggugauagcuagccuuaccuuggcccuguccggcggcgugucacaggaaucuuccaaaguacucaacaccaacggcacgucuggguuucugcccggugguuauaccugcuuuccccauucccagccauggcaggccgcccuacuagugcaaggccgccuucuauguggggguguucuggugcacccuaaguggguguugacagccgcacauuguuuaaaggagggccucaaaguuuaucuggguaagcacgccuuaggaagaguagaggccggcgaacagguucgagaaguaguccacaguauaccccaccccgaguaucgcagaucuccgacccaccuaaaucacgaccacgauauaaugcuccuggagcuucagucuccaguacagcucacaggcuauauucagacucucccucugucucauaacaaccgccugacacccggaacaacguguagggucagcggcuggggcaccacgacuaguccacagguaaacuacccaaagacacugcaaugcgcaaacauccagcucaggucugacgaagaguguagacagguuuacccggggaaaaucaccgauaacaugcucugugcuggcacgaaggagggcggaaaggacaguugcgaaggugacuccgggggcccuuugguauguaaucgcacccucuauggcauaguuucuuggggugacuuuccuuguggacagccggaucguccuggagucuauacuagaguuucccgcuauguguuguggauacgcgagacaauccgaaaguaugaaacccagcaacaaaaauggcuuaaagguccccaauag

SEQ ID NO: 248275 - RNA, 804 nt, Artificial Sequence
  Description of Artificial Sequence: Synthetic coding sequence
augagccucagaguucugggcagcgguaccuggccuucugcgccuaaaauguucuugcuccuaacagcacuacaggugcucgcuaucgcuaugacccagagucaggaggacgaaaauaagauaauugggggacauaccugcacaagauccagucagcccuggcaggccgcauuacucgcuggaccaagaagaagauuucugugugggggagcguuguuaaguggccaguggguuauuacagccgcccauuguggcagaccgauucuccagguugcguugggaaaacacaaucugagacguugggaagcaacccagcaaguucuucgcgucguucgacaggucacacauccuaacuauaauucucgcacccacgauaaugaucuuaugcuguuacaacugcagcagccugcucgaaucgguagagcgguuagaccuauugaggugacacaggccugcgcaucuccagggacauccuguagagucaguggguggggcaccauuaguucccccauugcucgguacccggcaagucuacagugcguaaacaucaauauaucuccugaugagguaugucagaaagcauacccucggaccauaacuccaggaauggugugcgcaggcgugccacaggguggcaaagauucuugccagggcgacaguggcggcccccucguaugucggggacaacuucagggguuaguguccuggggcauggaaagaugugcccugccaggcuacccaggcgucuauacaaaucuuuguaaauaucggucuuggaucgaggagacaaugcgcgauaaauag

SEQ ID NO: 248276 - RNA, 804 nt, Artificial Sequence
  Description of Artificial Sequence: Synthetic coding sequence
augucacugagagugcuuggcuccggaaccuggccuagcgcuccaaaaauguuucuguuacugacagcucuacaaguacucgccauagcgaugacucagucccaggaggacgaaaacaagaucauuggaggucauacaugcacucggagcagccaaccuuggcaagccgcucuguuggccggaccuagacggagguuccucugcggaggcgcucuguuaagugggcagugggucaucaccgccgcucauugcggccgcccgaucuugcaagucgcucucgguaagcacaaccuuagacggugggaagcuacccaacaagugcucagaguggugcgucagguuacacacccaaauuauaauucaaggacacacgacaacgaucuaauguugcugcaacuacagcagcccgcgaggauaggaagagcggugcggcccauagaagugacucaggcaugcgcaucacccggaaccucgugcagggugagcggguggggaaccaucucuaguccgauagcccgauauccagcgaguuuacagugcgucaacaucaauauuucaccugaugaaguuugccagaaagcauacccccgaaccauuaccccugggauggugugcgccggagucccgcaaggcgguaaagauuccugccagggagauuccggagggccgcuuguuuguagggggcaacugcagggccugguuagcuggggcauggagaggugcgccuugccagguuaucccggggucuacaccaaccucuguaaguaccggucauggauugaagagacaaugcgcgauaaguag

SEQ ID NO: 248277 - RNA, 804 nt, Artificial Sequence
  Description of Artificial Sequence: Synthetic coding sequence
augagccucaggguucugggaagcggaaccuggcccuccgcgccaaaaauguuucuccuguuaaccgcccuucaggucuuagccaucgccaugacucagagccaggaagacgagaacaaaauuaucgguggccacacgugcacgcggagcagccagccuuggcaggcagcucuucucgccggucccagaagaagauuucuuugugggggugcccuucugagcggucagugggugauaacagcagcacacugcggccguccaaucuuacaaguggcccucggcaaacauaaccuuagacgcugggaggcuacgcaacaagugcuucgggugguuaggcagguaacgcacccgaacuauaacagccgcacacaugauaacgaccucaugcuccugcagcugcagcagccagcucguaucggccgggccguaagaccgaucgagguaacccaggccugcgcgagcccuggcaccucguguagaguguccggcugggggacaauuucaagcccaaucgcuagauauccggccucuuuacaaugcguaaacauuaauaucucuccggacgagguuugucagaaggcuuauccucgcacgaucacuccugguaugguuugugccggcgugccgcagggagguaaggauagcugucagggcgauucaggcgguccacuagucuguagaggacagcuccagggcuuagugaguuggggaauggagagaugcgcuuugccaggcuaccccggggucuauacaaauuugugcaaauaccguuccuggauagaagagacuaugcgggacaaauag

SEQ ID NO: 248278 - RNA, 1068 nt, Artificial Sequence
  Description of Artificial Sequence: Synthetic coding sequence
augagucuccgucuucagucuagcuccgcuagcuauggggguggguuuggaggcggcagcugccaacuuggagggggaagaggcguguccaccugcagcacaagauucguuucuggugggucugccggcggcuaugguggcggaguaucaugcggguuuggcggcggagcuggaagcggauucgguggcgggcuggggggggguuuugguggaggguuugcagguggauuuguggacuucggagccugcgaugggggucuuuuaacuggcaaugaaaaaaucacaaugcagaaucuuaaugaccggcuggccaguuauuuggagaaagugcgggcgcucgaagaggccaacgcugaccucgaagugaaaauuagagauuggcaccugaaacagagcccagcuuccccggaaagggauuauaguccauacuacaagacaauagaagagcucagggauaagauacucaccgcuaccauugagaauaaccgagugauccucgagauugauaaugcaaggcucgcugccgaugauuuucgacugaaauaugaaaaugaguuggcccuuaggcaaucuguugaggcagacaucaacgggcuccggagggugcuugaugaacuaacacugucuaaaaccgacuuggagaugcagaucgagucccucaacgaggagcuggcguauaugaaaaaaaaccacgaggaggaaaugaaagaauucagcaaccaggucgugggucaagugaauguggaaauggaugcgacacccgggaucgaucuaacacggguguuggccgagaugcgcgagcaguacgaagccauggccgagcgcaauaggagagaugccgaagagugguuccacaccaagucagccgaacugaauaaagaagucucuacuaauacugcuaugauccagacauccaagaccgagauuacugaacugagacgcaccuuacagggcuuagagauugaauugcagucacagcuuaguaugaaagcaggacuggaaaacaccgcagcagacccugggacccaucaacagcauagagguccagcugagcgggcgccucaguag

SEQ ID NO: 248279 - RNA, 1275 nt, Artificial Sequence
  Description of Artificial Sequence: Synthetic coding sequence
auggacuucagccggagaucguuucacagaucacuauccagcucucugcaagcccccguugucagcacaguggguaugcagcggcugggcacaacacccuccguauaugguggggccggcggacgcgggauccgaauuaguaacucucgacacacagucaauuauggguccgaccugaccggagggggagacuuauuugugggcaaugaaaagauggcaaugcaaaaucucaaugaccgauuagccuccuaucuggagaaagugagaacccucgagcaguccaacuccaaacucgaaguacagauaaaacagugguaugagacuaaugccccacgggcaggcagggauuacucagcguauuaccgccagaucgaggaacugcgcucccagauuaaagaugcacagcugcagaaugcccggugcgugcuccagauugacaaugcuaaauuggccgccgaagauuuccgccuuaaguacgagacagagagggguauaaggcugaccguggaagccgauuugcagggguuaaauaaggucuuugacgaccuuacccuccacaaaacagaccuggagauucagaucgaagaacuuaauaaagaucuugcccuuuugaagaaagaacaccaagaagaagucgacgggcuucacaaacaccuuggaaauaccgugaacguagagguggacgccgcuccaggguugaaccuugguguuaucaugaacgagaugagacagaaguacgaagugauggcccagaaaaacuuacaggaggcuaaagaacaguuugagagacagacagcugugcuccagcagcaggugaccguuaauacagaagaacugaaaggcaccgagguacagcugaccgaacugagacgaacuucgcagagcuuagaaauagaauugcagagccaucugagcaugaaagaguccuuggagcacacccuggaggaaacaaaagcacgcuauucaucccagcucgccaaccuacaaucucuccucagcaguuuggaggcgcaauuaaugcagauuagaagcaacauggaacgucaaaacaacgaguaccacauuuugcucgauaucaaaacgcggcuggagcaggaaauagcgaccuaccgccggcugcucgaaggggaagauguuaaaacaaccgaguaucagcuguccacuuuagaggaaagagauaucaagaaaacccggaagauaaaaaccguggugcaagaaguaguugacggaaaggucguguccucugagguaaaggaaguggaggaaaauaucuag

SEQ ID NO: 248280 - RNA, 1215 nt, Artificial Sequence
  Description of Artificial Sequence: Synthetic coding sequence
augucauauagcugcggguugccauccuuaucuugccguacuaguugcucaucaagaccaugcgucccucccaguugucauggauguacccugccuggagcaugcaacauuccagcaaaugugucaaauuguaacugguuuugugaggguucauucaacggcuccgagaaagaaacgaugcaguuuuuaaaugauaggcuggcaucuuaucuugaaaaagucagacagcuugaacgggacaaugcggagcuggagaaucucauucgggaacgcucacaacagcaggagccgcuggucugcgccagcuaccaaucuuauuucaagacuauagaagagcuccaacagaagauccucugcaguaagucagaaaacgcaagacucguggugcagaucgauaaugccaagcuggcuucagaugauuuucgaacaaaguacgagaccgaacugucccuuaggcaguugguugagagugauauuaacggccuaagacguauucuggaugagcugacacuaugcaggagugauuuagaggcccagguugaaaguuuaaaagaggaacucuuaugccuaaagcagaaucacgagcaagagguuaauacccuaaggugccagcugggcgauagacugaacguggagguggacgccgcccccaccgucgaccugaaucagguccuuaaugagaccaggagucaguacgaggcuuugguagaaaccaauagacgagaagucgagcaaugguuugcgacacaaaccgaagagcugaauaaacaggucguuagcaguagcgagcaacuacaaagcuaucaggcugaaauaauagagcucagaaggaccgugaaugcauuggaaauugaacuccaggcucagcacaacuuacgggacuccuuggaaaacacgcugacggaaagugaagcacgcuauucaucucagcugagucaggugcagagacucauaacaaauguggaaucccagcuagcugaaaucagaucugaucuggaaaggcagaaucaggaguaccagguccugcuggacgugcgugcaagauuagaaugcgagauuaacaccuacagaucuuugcuggaauccgaagauugcaaacuuccgaguaaccccugcgcuacuacaaaugcuugugacaagucuacugggccauguauuuccaauccuuguggacugagagcccggugcgguccguguaauaccuucgguuauuag

SEQ ID NO: 248281 - RNA, 738 nt, Artificial Sequence
  Description of Artificial Sequence: Synthetic coding sequence
auggcagugaucaucggcgucgccgugggugccggcguggcuuuuuuaguucucauggccacaaucgucgcuuuuuguugcgcucggucacagcgaaaccuuaagggggucguuucugccaagaacgacaucagggucgagauaguacacaaggaacccgccagugggcgcgaaggagaagaacacuccacuaucaagcagcucaugauggaccguggagaguuccaacaggacucuguacucaaacaacuagaggugcuuaaagaggaggagaaggaguuccagaaccuuaaagaucccacuaauggcuauuacuccgugaacaccuucaaggagcaccacuccaccccuaccaucucccucuccucuugccaacccgaccugaggccggcugggaaacaacgcgucccaacuggcaugucuuuuacaaacaucuacaguacacuuagcggucaagggcggcuuuaugacuacggccaaagauuugugcucggcaugggcucuuccagcaucgaacugugcgagagagaauuccagcgggguucguuaagcgacucgaguagcuuucuugauacacagugugauucuucggucuccuccucaggaaaacaagacggauacgugcaauuugauaaagcaagcaaggccagugcgucgagcagucaccacucacaauccagcagccagaauagcgaccccuccaggccccuccagagacgaaugcagacccauguuuag

SEQ ID NO: 248282 - RNA, 2337 nt, Artificial Sequence
  Description of Artificial Sequence: Synthetic coding sequence
augaagccauuucaacuagaccuccuuuucgugugcuuuuuucuguuuucucaagagcuuggacugcaaaaacggggaugcugccuggucuuaggauacauggccaaggacaaguuccggcgcaugaacgaaggacaaguguacucauuuagccaacagccgcaagaucaagucgucguuaguggccagccuguuacguugcucugcgcuauccccgaguacgauggauuugugcuuuggauuaaagacggccucgcucuggggguugggcgggaucucucauccuauccucaguaccuagucgucggaaaucaucuauccggggaacaucaccugaaaauucuccgcgcggaacugcaggacgaugccguguacgaaugucaggcuauucaggccgcaauuaggucuagacccgcucggcugacugugcucgugccucccgacgauccagugauacuugggggcccugucauuagccugagagcgggggacccacucaauuugacgugccaugccgauaacgcuaaacccgcagccagcaucaucugguuaaggaagggggagguuaucaacggugcgaccuacucaaagacacugcucagagacgggaagagggagaguaucguuucuacucuguuuaucagcccuggagaugucgagaauggucagagcaucgucugccgggccacaaauaaagcuauucccggcggcaaggagaccuccgucacuaucgacauccaacacccaccacuggucaaucugagcgucgagccucagccaguucuagaagauaaugugguaaccuuccacuguagcgcaaaggccaaccccgcaguaacgcaguaucguugggccaaacgcgggcagauuaucaaagaagcuagcggcgaagucuaccgcacaacaguugacuacacuuacuuuagcgagccuguaagcugcgaagucacuaacgcguugggcucgaccaaucugagcagaacuguggacguuuauuucggaccucgcaugaccaccgagccacaaagcuuacucguugaucuuggcagcgaugcaaucuucucuugcgcauggacaggcaaccccucucuuacuauaguauggaugaagcgcggauccggggugguacucuccaacgagaagacgcuuacucucaaaagcgugaggcaggaagaugcaggaaaguaugucugucgggccgucgucccuaggguaggcgccggcgaaagagaggucacccuuacaguaaacggaccaccaauuauuagcucaacgcaaacucaacaugcacuccauggcgaaaaaggacagaucaaauguuucauucgcucaacaccuccaccagauaggauugcaugguccuggaaggagaauguccucgagucgggcaccucuggccgcuacacgguggagacaaucaguacugaggaaggcguuauuuccacacugacaauuucuaauauagugcgggcggacuuccaaaccauuuacaauugcacugccuggaauucuuuugguuccgauaccgaaauuauucgucugaaggaacaggggucggagaugaaaucuggggcuggguuggaagcagaaucaguacccauggcaguuauaauugguguugccguuggcgcagguguggcuuuccucguucuuauggccacuaucgucgccuucuguugcgcacguucacaaagaaaccucaagggcgugguuagcgccaagaacgauauccgcguggagauugugcauaaagaaccggcuucuggaagagagggcgaggagcauucuaccauaaagcaacugaugauggaccguggggaauuccagcaagacucaguguugaagcaacuugaggugcucaaggaggaagagaaggaguuucaaaauuugaaagaucccacaaauggauauuauagugucaauaccuucaaagagcaucauagcacgccuaccauuucucucucuucaugucagccugauuugagaccagcgggcaagcagagaguaccuacuggaaugucguucacuaacaucuauucuacccuauccggccagggccgccuuuaugauuacggacaacguuuugugcuugggauggggagcagcuccauagaacucugugaacgggaguuucagcgaggcucgcugagugauaguagcagcuuccuggacacccagugcgacaguagugucagcuccagcggcaagcaggauggcuauguccaguucgacaaggcuucuaaggccagcgcuucuucuagccaucacagccagucuucuucucaaaacucagauccaucacgaccgcuccaaaggagaaugcagacccauguuuag

SEQ ID NO: 248283 - RNA, 1803 nt, Artificial Sequence
  Description of Artificial Sequence: Synthetic coding sequence
augaagccuuuucagcuggaccugcucuuuguguguuucuuucuguuuagucaggagcugggucugcagaaacgcggaugcugcuuagugcucggcuacauggccaaggauaaguucagacgcaugaaugaaggacaggucuacuccuuuagucaacaaccacaggaccaggucgucgucagcggucagcccgucacccugcugugcgccaucccagaguacgauggguuuguccuguggauuaaggauggccucgcccuggguguggguagagaccuuucaagcuacccucaguaccuuguggucggaaaucaccugucuggagaacaucaccuaaagauucugcgggcugaacuccaggacgacgcagucuaugagugucaagccauccaggccgcuauucguagccgaccagcacgcuuaacuguguuagugcccccugaugaccccguaauucugggaggaccggucauuuccuuacgugcuggggacccuuugaaucucacaugucaugcugauaacgcaaaaccugccgcuuccauuaucuggcugaggaagggagaaguuaucaauggagcaacauauagcaagacgcuccugagggauggaaagagggaaagcauuguaucaacacuguucauuuccccuggcgauguagaaaacggccagucuaucgucugcagggcuacaaacaaagcaaucccagguggaaaagagacauccgucaccaucgacauucaacacccuccacuugugaaucugagcgucgagccccaacccgugcuggaggacaacgucgugacauuccauuguagcgcaaaggcuaaucccgcaguuacccaguaccgaugggccaagaggggccagaucaucaaggaagccuccggagagguguaccguacuacggucgauuauacauauuucuccgagccugucucaugugaagucacuaacgcucuuggaucaaccaaucuauccagaacaguggacguguauuuugggccucgcaugacuacugagccucagaguuugcugguugaccucggaagcgaugcuaucuucuccugugcauggacagguaauccaucccuuaccaucguguggaugaagcgaggaagcggggucguccugucuaacgaaaaaacacucacacugaaaaguguucgacaggaggacgcaggcaaguaugugugucgggcugugguaccacgugugggggcaggggagagagaaguaacuuuaacagucaauggcccuccaauuauuagcaguacacagacucagcaugccuuacacggcgaaaaagggcaaaucaaauguuucauuagaaguacuccccccccugaccguauugccuggaguuggaaagaaaauguucucgagucugguaccagcggacgauauacuguugagacuauaaguacugaagaaggagugaucaguacgcugacuauuaguaacaucgugagagcggacuuccaaaccauuuacaacuguacagcauggaacagcuucggaagcgauacugaaaucaucagacucaaggaacagggcagcgaaaugaagagcggggcuggucuggaggccgaaagcguucccauggcgguuaucauugggguugcuguuggcgcuggggucgccuuuuugguacugauggccacuaucguugccuucugcugcgcgcgaagccagcgcaguacaggcggucgcucggguaucagcgggcguggaaccgaaaagaaagcuagacuuaggcuuccccggcgcgcaagcaaacaggaguguaacgagcagggaaguuag

SEQ ID NO: 248284 - RNA, 2301 nt, Artificial Sequence
  Description of Artificial Sequence: Synthetic coding sequence
augaagcccuuccagcuagaucuucuguucguaugcuucuuccucuucucucaggaacuggggcugcagaaacggggguguugccucgucuuaggauacauggcuaaagacaaguuucgacggaugaaugaaggucagguauacaguuuuucccaacaaccacaggaccagguggucgugucaggacagcccguuacccugcucugcgccaucccagaguacgacgguuuuguacuguggauuaaggacgguuuagcacuagggguggggagggaccucucauccuacccucaauaucuggucguaggaaaccaccuaucuggagagcaucaccuaaagauccuccgggcagagcuucaggaugaugccguauaugaaugccaggccauccaggccgcuauccggucucgacccgcuagguugacugugcucgugccacccgacgaucccguuauucucggcggcccuguuauaagucuccgcgccggggacccacugaaccuaaccugccaugcggauaaugccaagccggccgcuaguauuaucugguuacgaaagggagaagugauuaacggagcuacguacucuaaaaccuugcucagggauggaaagagggagucuaucgucaguacacuuuuuaucuccccuggugacgucgagaauggucagagcauuguuugccgcgccaccaauaaagcaauuccgggaggcaaggaaacuucgguuacuaucgacauccaacauccaccacucgugaaucugucuguagaaccacagcccgugcuugaagacaacguugugacuuuccauuguucugccaaagcaaaccccgcuguaacccaguacagaugggcaaagaggggacagauuauaaaagaagcuucuggugaggucuacaggacaacaguggauuacacauauuuuucugaacccgugucgugcgaagugacuaaugcgcucgguagcacuaauuuaucuaggaccguggacguuuauuuugguccuagaaugacaaccgagccgcagucccuccuuguggaucugggaagugaugcuauauucaguugcgccuggacugguaauccuagccucaccauuguuuggaugaagcgaggaagcggcguaguucucucuaacgaaaaaacucugacucugaagucugugaggcaggaagacgcaggcaaauauguuugucgcgcaguggucccucgugugggugcaggagagagagaaguuacccugaccgugaaugggccgcccauuaucagcaguacccaaacccaacaugcgcugcauggugagaaaggucagauuaagugcuucauuaggucaaccccgccccccgacaggauugcuuggagcuggaaagagaacgugcuggaauccggaacgagugggagguacaccguugagaccauuaguacggaagagggugucaucaguacccucaccauuuccaacauagucagggcugauuuccagaccaucuacaacugcacggcuuggaauucuuucggcucagacacagaaaucauaagacucaaggagcaggaaaguguccccauggccguuaucauuggcguggcuguaggcgcugggguggccuucuuaguguugauggcgaccauaguggccuucuguugcgcgcggucacaacggaaucugaagggaguggugucagcgaaaaacgauaucagaguggaaaucgugcacaaggagccagcuucugggagagagggugaggaacauucuacaaucaagcaacugaugauggaucgcggugaguuccagcaagacagcgugcuuaagcaacuggaaguguuaaaagaagaggagaaagaguuccagaauuugaaagacccgacuaacggcuauuauucuguaaacaccuucaaggaacaccauucgacaccuacgaucucucugaguagcugucagccagaucugaggccggcuggaaagcagcgagugccaacgggaauguccuucaccaauaucuacaguacacuguccgggcaagguagacucuaugacuaugggcaaagauucgugcuuggcaugggcaguucaucuauugaguuaugcgaacgcgaguuccagcgaggcaguuugagcgauagcaguucuuuccuggacacgcagugugauuccuccguuuccaguucugguaaacaagauggguauguucaguucgauaaagccagcaaggccucagccuccucuucucaucacagccagucaagcagucagaauucugaccccagccgaccucuucaacggcggaugcagacacauguguag

SEQ ID NO: 248285 - RNA, 1998 nt, Artificial Sequence
  Description of Artificial Sequence: Synthetic coding sequence
auggccgcaggugggucuacccagcagagaagacgagaaauggccgcugcuucugcagccgcaauuuccggcgcagggcgcugccgacugucaaaaaucggagccacgcgaaggccccccccugcccgugugcgaguagcggucagguuacgccccuucguggacggaaccgcaggggccagugauccgccuugugugagaggcauggacucaugcucauuagagaucgcuaauuggcgaaaccaccaggagacccugaaguaccaguucgaugcauuuuacggcgaacguagcacacagcaggauaucuacgcuggaagcguucagccaauucugcgucauuugcuugagggccagaaugcaagcguucuugcuuacggccccacaggagcagggaagacacacaccaugcugggaagccccgagcagccagggguaaucccucgggcccucauggauuugcugcagcucacucgcgaggaaggugccgaaggucgcccaugggcguugucugugaccaugagcuaccuggagaucuaucaagaaaagguccuugaccugcuagaccccgcgagcggcgaucuugugaucagggaggacugcaggggcaacauauugauuccuggccuuucccagaagccgauuuccucuuucgcugauuuugaacgacauuuucugcccgccucuaggaaucgcaccguaggcgccacucggcugaaucagcgcucgucccgaucucacgccguucuguuagugaaaguggaucagcgcgaacgcuuagcgccauuccggcagcgcgagggaaagcuguaccuuaucgaccuggcuggaucugaggacaaccggagaacugggaauaaaggccuuaggcuuaaagaaagcggagcaauaaauaccucccuguucgugcugggcaaaguggucgacgcccuaaaucagggacuuccucgcguaccauacagagauagcaaacuaacaaggcugcugcaggacucucucgguggcagcgcgcacuccauccucaucgccaacaucgcaccagagagacgguuuuaccucgauacagucucugcacuuaauuucgccgcccgguccaaggagguaaucaaucgacccuucacuaacgagucccugcagccacacgcacucgguccagucaagcugagucagaaggagcugcugggaccgcccgaagcgaaaagagcccgaggcccagaggaagaagaaauuggcucuccugaaccuauggccgcccccgccagcgcaucacagaagcugucaccccuccagaaacuuuccagcauggauccugcgaugcuggagcgccugcucucacuagacagguugcucgccucacaagggucccagggagccccuuugcugucaacucccaagagggagcgcaugguacucaugaaaacaguugaggagaaggaccuugagaucgagcggcugaagacaaagcagaaagaauuagaggcaaaaaugcuugcccagaaggcugaagaaaaagaaaaucacugcccaacaaugcuuagaccccugagucaucgcaccguuaccggagcaaaaccccugaagaaagcgguggugaugccucugcagcugauccaggagcaggccgcaaguccgaacgcugagauucacauucuaaaaaauaagggccgcaagaggaaguuggaaucucucgaugccuuagaaccugaagagaaagcugaggauugcugggagcugcagauauccccugaacuuuuagcccacgggcggcaaaagauuuuggaucuacugaacgaaggcucagccagagaucugcggucacuucaaagaauuggacccaaaaaggcccaguuaaucguugguuggcgagaacuccacggcccguuuucgcagguggaagaccucgaacggguggaaggaaucacaggcaaacagauggaaucguuccuuaaggcuaacauucugggccuugcggccggccagcguugcggggcgucguag

SEQ ID NO: 248286 - RNA, 1065 nt, Artificial Sequence
  Description of Artificial Sequence: Synthetic coding sequence
augcaagggcugcuguucagcacacuucuccuugccggucuggcucaguucuguugccguguccagggcaccggaccacuagauacgacaccugaaggacggcccggggagguguccgacgcaccucaaagaaagcaauuuugucauuggccgugcaaaugcccccagcagaagccccguugccccccuggugugucccuuguuagagacggcuguggaugcuguaagauuugugcaaagcagcccggcgagaucugcaaugaagcugaccuaugcgauccucacaagggccuguauugugacuauucuguugauaggccacgguacgagaccggugucugugccuaucugguagcggucggcugcgaauucaaccaggugcauuaucauaauggacagguguuucagccaaaucccuuauucagcugccuuugcgugaguggcgcuauaggauguacuccacuguuuaucccaaaacuggccggaucucacuguagcggugccaagggaggaaagaaaagcgaucaguccaacuguucuuuagagccucuacuccagcagcugaguacuucguacaaaacaaugcccgcuuacaggaacuuaccucugaucuggaaaaagaagugucucguccaggccacuaaauggacucccuguagcaggaccuguggcaugggaauaucuaacagggugacaaacgaaaauucaaacugugaaaugcggaaggaaaagcgccuaugcuauauacaaccgugugacucaaacauucucaagacaaucaagauucccaaaggcaagaccugucagccaaccuuucaauuaagcaaggccgaaaaauuuguguucucggguugcucuaguacacaguccuacaagcccacauucugcgggauuugccucgacaagcggugcugcaucccuaacaaaaguaaaaugauuacaauccaguuugacugucccaaugaaggcaguuuuaaauggaaaauguuguggaucacgucaugcgugugccaaaggaacugccgggaaccuggcgacauuuuuagcgagcugaaaauacuauag

SEQ ID NO: 248287 - RNA, 267 nt, Artificial Sequence
  Description of Artificial Sequence: Synthetic coding sequence
auggcgcucaguucugcuuggcgcaguguauuaccccuguggcuuuuguggagcgcagcauguaguagagcggcgaguggugacgacaaugcauuucccuucgauauagaggggucuuccgcagucggccggcaggauccacccgaaacaucagagccgagggucgcguugggccggcuacccccggcagcagagaaauguaaugcuggcuucuuucacacucuauccggcgagugcgugccuugugacuguaacggaaacuccuag

SEQ ID NO: 248288 - RNA, 363 nt, Artificial Sequence
  Description of Artificial Sequence: Synthetic coding sequence
auggcucuaucgucagcuuggagauccguccuuccccuauggcucuugugguccgcagcauguucacgcgccgcuucaggcgacgacaacgccuuuccuuuugacauugagggaucgagugccguuggccggcaggaccccccugagacaucugaaccacguguagcccuggguagauuaccccccgccgccgaaguccagugccccugccacugccaccccgcuggggcaccagcacccccucgggcagucccccacucuucuuucuccuuaucaccaccccuuuccagcccgcaaugucuggaaagcuuuaccugggcccggucaguacgaaaacuggagauaaaaucuuuuccauuguag

SEQ ID NO: 248289 - RNA, 549 nt, Artificial Sequence
  Description of Artificial Sequence: Synthetic coding sequence
auggccuuguccuccgccuggagauccgugcucccucucuggcuccuuuggagugcugcuugcagccgcgcugcgucuggagacgauaacgcuuuucccuucgacauagagggaucuucugcugucgggcgacaagauccucccgaaacauccgagccucgcgucgcacugggucgucuuccuccugccgccgagaaauguaacgccggcuucuuucacaccuuguccggggagugugugccaugugacugcaacgggaauagcaaugaaugccuagauggcucaggguauuguguucauugccagcgaaauaccaccggggaacauugcgagaagugucuugauggguacaucggcgacucaauuaggggcgcuccucaguucugucaacccugcccauguccacucccucaucuggcaaauuucgccgaaucuugcuacaggaagaauggcgcugucaggugcauuuguaaugaaaauuaugcuggaccgaauugcgaaaggcccucuccacagagcacgaggggcuuucccuuaaacgacucuuag

SEQ ID NO: 248290 - RNA, 537 nt, Artificial Sequence
  Description of Artificial Sequence: Synthetic coding sequence
ugaauuuucgaggauugugacgaggugacgggccaguguagaaauugccuuagaaauacuacaggguucaagugugaacgaugcgcccccggcuacuacggagacgcgcgcaucgccaagaacugugcuguguguaacuguggaggaggcccuugcgauucaguaaccggggagugccuggaggaaggauucgaaccaccuaccggcauggauugcccuaccauuucuugcgauaaaugugugugggauuugacggaugcauuacgguuggccgccuuaagcauagaggaggggaaaucuggggugcugagcguuuccucuggagcugccgcacaccggcacguaaacgagaucaacgccacaaucuaucuacugaaaacaaaacuguccgagagggaaaaucaguacgccuugaggaagauccagaucaacaaugccgagaauacuaugaagagccuacugagcgauguugaagaguuagucgagaaacacuggaacaaaccuaggaggagguuggaacugcaggagggcguguag

SEQ ID NO: 248291 - RNA, 5451 nt, Artificial Sequence
  Description of Artificial Sequence: Synthetic coding sequence
auggcacugagcagcgcauggcggucugugcucccacuguggcuuuuaugguccgccgcaugcucacgugcggcaucaggcgacgauaacgcauuucccuucgacaucgagggaagcagcgcaguaggacgucaggacccccccgagaccuccgagccccgcguggcacuuggacgcuugccccccgcagccgaaaaaugcaacgccggcuuuuuccacaccuugagcggggagugugucccuugugauugcaaugggaacucgaaugaaugccuggacggguccggcuauugcguacauugucaacgcaauaccaccggugagcacugcgagaagugccucgaugguuauaucggcgauucaauccgaggggcaccucaauuuugucaaccuugcccuuguccuuuaccccacuuagccaacuucgcugagaguugcuacaggaagaacggcgccguccgcugcauuugcaaugagaauuacgcugggcccaauugcgaacggugugccccaggcuauuauggaaauccacuucucaucggcagcacuugcaagaagugcgauuguagcggcaauucggaccccaacuuaauauuugaggacugcgacgaggugacagggcaaugucggaacugucugcgcaacacuacaggcuucaagugcgaacggugugcaccuggauacuacggcgacgcuagaaucgcuaaaaauugcgccgucugcaacugcggaggcggaccuugcgacucugugacgggugagugccuggaagaaggguucgaaccacccacggguugugacaaaugcguuugggaucucaccgacgccuuaaggcuugcagcacugagcaucgaggaaggcaaguccggcguuuuaucggugaguaguggagcggccgcacacagacacgucaacgagaucaaugccaccauuuaccuguugaaaaccaaauuguccgagagggagaaccaauaugcgcucagaaaaauucagaucaauaaugcugaaaacaccaugaagucacugcuuucugacguggaggagcucguggaaaaagaaaaucaagccucgagaaaaggacaguuagugcagaaagaaagcauggacacaaucaaccacgcuagucaacuuguggagcaagcccacgacaugcgggacaagauccaggagauuaauaauaaaaugcuuuacuacggggaggagcaugaauugucccccaaagagauaagcgaaaagcugguccuggcacaaaaaaugcuugaggaaauuaggucacggcagccuuucuucacacagagagaacuuguggacgaagaagcugacgaagcuuacgaacugcugucucaggcggaaagcuggcagagacuucacaaugaaacacgcacuuuauucccuguugugcuggaacagcuggaugacuauaaugcaaaacuguccgaccugcaggaggcccuggaucaagcccucaacuacgugagagaugccgaggacaugaaccgagcuacagccgcucggcaaagggaccacgagaaacagcaggagcgcgugcgcgaacagauggaagucgucaauaugagccugucaacauccgcugauucucugacuacaccuaggcuaacccugucagagcucgaugauaucauaaagaacgccuccggcauuuaugcugaaauugauggugcuaaaucugagcuccaggugaaguuaagcaaucuauccaacuugucccaugaccuggugcaggaggcaaucgaucacgcucaggauuugcagcaagaagcaaacgagcuguccagaaagcugcauuccucugauaugaacggucuuguacaaaaagcccuugaugcgucaaacguuuacgaaaauauugugaauuacgucucagaggcaaacgagaccgcagaauucgcacugaauaccaccgacagaauuuacgaugcugugagugggauugacacacagauuauuuaucacaaggaugaauccgagaaucuuuuaaaccaggcuagagaguuacaggccaaagccgagagcucuagugacgaggccguagccgacacauccaggcgggugggaggagcauuagcgcggaaaagcgcuuuaaagacacgacugucugacgcugugaagcaacuacaggccgcugagagaggcgacgcgcagcagcggcucggacaaagccgacugauuaccgaggaagcaaauagaaccaccauggaagugcagcaggccaccgccccaauggccaauaaccugacaaauuggagccagaaccugcagcauuucgacucuagcgcuuauaacaccgcggugaacucagcacgcgacgcugugagaaaccugacugagguugugccacaauugcuagaucagcuucgcaccguagaacaaaaacgccccgccucuaacguaagugccuccauacagcgcaucagagaauugaucgcacaaacuagguccguggccucuaaaauucagguuucaaugauguucgacgggcaaucagcggucgaggugcacucacgcacgaguauggaugaucucaaagcuuucacuagccucucauuauacaugaagccuccagugaaaagacccgaguugacugagacagcagaccaauucauccuuuaccucgguuccaagaacgcaaaaaaggaguauaugggucuagcaaucaaaaacgauaauuugguuuacgucuacaauuuggggaccaaagacguugaaaucccucucgauucaaagccagugucaucuuggcccgccuacuuuucuaucgucaaaaucgagcggguuggcaaacacgggaaaguauuucucaccgugccuagccuauccaguacggcagaggaaaaauucauuaagaaaggcgaauuuaguggcgacgauucccuuuuggaccuggaccccgaggauacugucuucuacgugggcggcguuccuucuaauuucaagcuacccacuucccuuaaccucccaggauuuguaggcugcuuggagcuggccacauuaaacaaugauguuaucagccucuauaacuucaagcacauauacaauauggacccuucgaccucugugcccugugcuagggauaagcuggcguuuacacagucuagggcggcaagcuacuuuuuugacggcagcggauaugcugugguccgugacaucacacgacgggguaaguuuggucaaguaacgcgauucgauauagaaguccgaacucccgcugacaacggucucauacuucucauggugaauggaucaauguucuuccgacuggagaugcgcaaugguuaccuccauguuuuuuaugacuucggguuuagcggcgggcccgugcaccuagaagauacacuuaagaaggcccagaucaacgacgcuaaauaucaugagauaaguaucauuuaucacaaugauaaaaagaugauccuggugguggauaggagacaugugaaguccauggacaaugagaagaugaaaauuccauucacggacaucuauauuggcggcgccccacccgagauccuacaaagccgggcacugagggcucaucugccuuuagauaucaauuuccgcggcugcaugaaggguuuucaauuccagaaaaaggacuuuaaccuauuggagcaaacugagacccucggagugggguacggcugcccggaggacagccuaaucaguagacgagcauauuuuaauggccagaguuucauagccagcauccagaaaauuagcuucuucgacggauuugaggggggcuuuaacuuccgcacccuccaaccaaacggccugcucuuuuauuaugcaucuggaucugacguguuuagcauuagucuggacaacggcacuguuauuauggaugugaaaggaauuaagguccagagcgucgauaagcaguacaacgauggacugucucauuuugugaucucgucagugucacccacacgguacgaacugaucguugacaagagccgagucggaucuaagaauccaacaaaagguaagauugaacagacucaggcuagcgagaagaaguucuacuucgggggcuccccaaucucagcgcaauacgccaacuucaccggaugcauuucaaacgcauauuuuacaagagucgaccgcgacguugaaguggaggauuuccaacgguauacugaaaagguccauaccagccuguacgaaugucccaucgagagcucuccacuguuccuacuucauaagaaagguaaaaaucuuucuaaaccuaaggcuucucagaacaagaaggguggaaaaucuaaggacgccccgagcugggaucccguugcccucaagcuucccgagagaaacacaccaaggaacucccauugccaucugagcaauuccccccgcgcaaucgaacacgcuuaccaauacggaggcacagccaauagucgccaggaguuugaacauuugaaaggagauuuuggugcuaaaucucaguucuccaucaggcugaggacacgcuccucacaugggaugauuuuuuauguaagcgaucaggaggaaaacgauuucaugacguuguuccuggcucacggacggcugguauacauguucaacgucggucacaagaagcucaagauccgaucucaggaaaaguacaaugauggguuauggcacgacgugauauucauucgcgagcgaucuaguggacgccuggugaucgauggccugcgggugcucgaagagucucuaccuccuacugaagccacuuggaaaauaaagggaccgauuuacuugggggguguagcaccagggaaagcugucaaaaacguucagauuaacuccauauacucuuuuucuggguguuuaagcaaucuccagcucaauggugcaucuauuaccuccgccagccagacguucuccgugacaccuugcuuugagggccccauggagacggggacauauuucucaaccgaagggggguauguugugcuagacgagucauuuaauauuggccuuaaguucgagauugcauuugaaguacgccccagauccuccagcggcacccugguucauggacacucagucaacggcgaguaucugaacgugcauaugaaaaaugggcaggugaucgugaaggugaauaauggaauucgagacuuuagcacaagcgucacaccaaaacaaaguuugugugauggccgcuggcacagaaucaccgucauuagagacuccaauguggugcagcucgaugucgacuccgaggugaaccacguggucggaccccucaauccaaagcccaucgaucaucgcgagccaguuuuugucggcggggugccugagagccugcucacaccgcgccuagcacccucaaaaccuuucacuggaugcauccgccauuuuguuauugauggacacccgguuagcuuuuccaaggccgcccuugugagcggggccgugagcauuaacucaugccccgccgcuuag

SEQ ID NO: 248292 - RNA, 5451 nt, Artificial Sequence
  Description of Artificial Sequence: Synthetic coding sequence
auggcccugucaagcgccuggagaucgguucuuccacuuuggcuguuguggagugccgccugcucaagggcugccucuggugacgacaaugcauuuccuuucgauauagaaggaucaucagcuguaggcaggcaggauccucccgagacuagugagcccaggguagcgcuuggccggcugccuccugcugcugagaagugcaaugccggguuuuuccauacacugaguggugagugugugccaugcgacugcaaugggaauucaaaugaaugccuggacggaagcggcuauugcguccauugucaacggaacacgacuggugaacacugugaaaaaugucuggacggguacaucggagacagcauacgcggggcaccccaguucugucaaccuugcccuugcccccuuccccaccuugcgaauuucgcugagagcuguuacagaaaaaauggcgccgugcgcuguauuuguaaugaaaauuacgcaggcccaaauugcgagcguugcgccccuggauauuacggcaacccccugcugaucggaagcacguguaaaaaaugcgauugcagcgguaauagugauccuaacuugauuuucgaggacugugaugaggucacaggccagugccgaaacugucugaggaacaccaccggcuuuaaaugcgagcguugugccccuggcuacuacggagaugcgcgaaucgcuaagaacugcgcuguguguaauugugggggcgggccaugugauaguguaacaggggaaugccuugaggaaggcuuugagcccccaacugggugcgacaaguguguuugggaucugaccgaugccuugcggcucgcugcucuaucuaucgaagaaggaaagagcgguguucugagcgucagcucuggugccgcugcacauagacacgucaacgagaucaaugcaaccaucuaccugcugaagacaaagcuguccgagcgagagaaccaauacgcacugaggaagauccaaaucaauaacgcagaaaauacuaugaaaucacugcucagcgauguugaggaacugguagagaaggagaaccaggcaagccguaaaggccaacuagugcaaaaggaaagcauggacacgauuaaucaugcuucucaacuggucgaacaggcgcacgacaugcgcgauaagauccaagaaauaaauaauaagaugcucuauuacggugaagaacaugaacugagcccaaaagagaucuccgaaaagcuuguccuggcccagaagaugcuggaggaaauuaggagcaggcagcccuuuuucacccaacgggaacuaguagaugaggaggccgacgaggccuaugagcugcucagucaggcugagagcuggcagagguugcacaacgaaacccgaacccuguucccuguuguccuagaacagcuggacgacuacaaugccaagcuuuccgaccugcaggaggcgcucgaccaggcccucaacuaugugagagaugccgaggauaugaacagggcgacugccgcucgccagcgagaccaugagaagcagcaagagcggguuagagaacagauggagguugugaacaugucccucaguacaagugccgacagcuugacaaccccacgucugacccucucugaacuggacgacauaaucaaaaaugcuucaggcaucuacgccgaaaucgauggugcuaagucagaacugcaggugaaacucuccaaccugagcaaucucucccaugaccugguucaggaagcgauugaucaugcacaggacuuacaacaggaagcaaacgagcugucacgcaaguugcacuccuccgauaugaauggucugguccagaaggcccuagaugccagcaacguguaugagaauauugugaacuauguuucagaggcaaaugagacagcugaguucgcucugaacacaacugaccgcaucuaugacgccguuucuggaaucgauacucaaaucaucuaccauaaagacgaaucugaaaaccuccugaaccaggcgagagaacuacaggcuaaggccgaguccaguagcgacgaggccguggcagauaccaguaggagaguuggcggagcccuggccaggaaauccgcgcucaagacacggcuuagugacgcagugaaacaacuacaggcagcugagcgaggcgaugcucagcagcggcucggacagucgcgguugauuacagaagaagcuaacaggaccacuauggaaguccagcaggccaccgcucccauggcgaacaaucuuacaaauuggagucagaaucuucaacacuucgacucuucugccuacaauaccgccgugaauuccgcaagggacgcagugcgaaaccugacggaggucguuccacaauuguuggaccagcuuagaaccgucgagcaaaaaagaccugcuucuaaugugucugcuucaauccaaagaaucagggaauugaucgcgcagacccgcaguguggcaucaaagauucaggucagcaugauguuugauggucagucugcgguagaagugcacucaagaacuagcauggaugauuuaaaggccuucaccagcuugagccuguacaugaaaccacccguuaaaaggccagagcuaacagagacggcugaucaguuuauacuguaccugggcuccaagaacgcaaagaaagaguacauggguuuagcuaucaagaacgacaaccugguguacguguauaacuuagggacuaaagacguggagaucccucuagacaguaaacccgugucgucuuggccugcauauuucucaauugucaaaaucgaaagaguuggcaaacacgggaaaguuuuuuugaccguucccucauuaagcagcacugccgaggagaaauuuauuaaaaagggcgaauuuucuggugacgauucccuacuggaucuugacccugaagacacaguauuuuacguugguggcguuccuucuaacuucaaacugcccaccucucugaaccugccuggauuuguuggcugucucgaacucgccacccugaacaacgaugugauaagccucuacaacuuuaaacauaucuacaauauggacccuagcaccagcgucccaugcgcccgcgacaagcucgccuuuacccagucuagagccgccuccuauuuuuucgaugggucuggcuaugccguggucagagauauuacacggcgaggcaaguucggacagguuacccgguuugauaucgaaguaagaacaccagccgacaacggacugauccugcuuaugguuaacggaaguauguucuuuaggcuggaaaugcggaauggauaccuccauguauuuuacgacuucggcuucucuggaggccccguccaccuugaagacacacuaaaaaaagcccagaucaacgacgcuaaguaucacgagauaaguauaauuuaucacaaugacaagaaaaugaucuuggugguggaucggcggcauguaaagagcauggacaacgagaaaaugaaaauuccuuucacagacauuuauauugggggagccccgccagagauccuccagaguagagcucugagagcucaucugccucuagacauaaacuuucgcggcuguaugaaaggauuucaauuccagaagaaagacuuuaaucuucuugagcagaccgaaacucucggugugggguacgguuguccagaagauagucugaucucucgacgggcauacuuuaauggacaaucauucauagccucaauccaaaaaauuucuuucuuugauggauuugagggcggauucaacuuccggacacuccaaccuaauggauuacuguucuauuaugcgucaggaucagacguguucagcauuucacuggauaaugggaccgucauaauggacguuaagggaauaaaggugcaaucuguggacaaacaauauaaugauggucugucccacuucguuaucucuucagugucuccaacccguuaugaacucaucguagacaagucucgugucgguagcaagaauccgacaaaaggcaagauagagcagacucaggcuagcgagaaaaaauucuauuucggugggucuccaaucuccgcccaauacgccaacuucacuggauguauaagcaacgccuauuucacccguguggaccgugauguugagguugaagauuuccagagauauacugaaaagguccacaccagccuguacgaaugcccaauugagucaucaccacucuuucuguuacacaaaaaagguaaaaaucugaguaagccuaaggcuucccaaaauaaaaaaggcggaaaaucuaaggaugcuccgagcugggauccuguggcucugaaauugccggagcgaaauacaccucggaacucucacugucaccuguccaacucucccagggcuauugagcaugccuaccaguauggagggacagcgaauucgaggcaagaauucgaacauuugaaaggagacuucggagcuaagagccaauucuccaucagacuacguacgcggagcagccacgggaugaucuuuuacgugagcgaucaggaggaaaaugacuucaugacgcuauuccuggcucauggcagacugguguauauguuuaacgugggucauaagaagcugaagaucagaucucaggaaaaauacaaugacggcuuauggcaugaugucauauucauucgcgaaagaaguucaggacgccugguuaucgaugguuugcgggugcuggaggaaagucucccaccaaccgaggcuacauggaagauuaagggccccauuuacuugggaggaguggccccugggaaggccgugaaaaacguccaaauuaauagcaucuacagcuuuucaggcugccuaaguaacuuacagcucaacggagccaguauuaccagcgcuagucagacauucuccgucacgccuuguuuugaggggccuauggagacaggcacauacuucagcaccgaagggggguacguggucuuagacgaauccuuuaauaucggacugaaguuugagauagcauucgaaguaagaccucggaguucgagugggacacugguucacggacacagcgugaauggugaauacuugaacgugcacaugaaaaauggccaaguuaucgugaaagugaauaacgguauccgggacuucagcacuuccgugacuccuaagcagagccuaugugauggccgguggcauaggauuaccgucauccgagauagcaacgucguccagcucgacguugacuccgaagucaaccacgugguaggcccucuuaacccgaagccuaucgaccaccgggaaccuguguuugucgguggcgugccagagagccuucuuacuccgaggcucgcacccuccaagccauuuaccgggugcauccgccacuuuguuaucgacggacaccccgugucuuucagcaaggccgcgcuggucagcggcgccgugagcauuaacucuugcccugcugccuag

SEQ ID NO: 248293 - RNA, 390 nt, Artificial Sequence
  Description of Artificial Sequence: Synthetic coding sequence
auggccuuaaguagugccuggcggucggucuuaccacucuggcuuuuguggagugcugcguguucacgggcugccuccggcgacgauaacgcuuuucccuuugauaucgaaggcucaucugcagucgggcgacaggaucccccagaaacaagugaaccuagaguggccuuggggcggcuaccccccgcagcagaaaaauguaacgccggauucuuccauacacucucaggggaaugcgucccgugugacugcaauggcaauaguaaugaaugccuugacgguaguggcuauuguguaacuaccgacggcgaggacccuggguuuagcgccagugcacucucauuuauccucucuucacaaggcgcacgggaagcucgcgcuccaacauag

SEQ ID NO: 248294 - RNA, 363 nt, Artificial Sequence
  Description of Artificial Sequence: Synthetic coding sequence
auggccuuaucuagugcuuggcguucgguucugccccuguggcuacugugguccgcagcauguucucgggccgcaucaggugaugacaaugccuuuccauuugacaucgaggguuccuccgcuguuggcaggcaagauccuccugaaacuucagaaccacggguggccuugggcaggcucccaccagccgcagagguacagugucccugccauugccaccccgccggagcucccgcucccccccgugccgugccccauucuaguuuuucucuaaguccaccccucagcucaccacagugucucgagucuuucaccugggcccgcuccgugcgcaaauuggagaucaagucauucccacuuuag

SEQ ID NO: 248295 - RNA, 1125 nt, Artificial Sequence
  Description of Artificial Sequence: Synthetic coding sequence
auggcgcugucaagugcauggcggucagugcuaccccuguggcugcuauggucagcugccuguagcagagcugcuucuggcgacgauaaugccuuccccuuugacaucgagggauccuccgccguggggaggcaggacccaccagagacuucugaaccucgggucgcucuaggacggcugcccccagcugcagaaaaaugcaaugcuggcuuuuuccacacacuuuccggggagugcgugcccugugauuguaacgggaauuccaacgaaugccuugacgguucuggguacuguguucauugucagcggaauacaaccggugagcacugcgaaaaaugucuggacggcuacauaggugacucuaucagaggugccccucaguuuugucaacccuguccuuguccacuuccccaccuggccaacuuugcugaaagcuguuauagaaaaaauggggccguaaggugcauuugcaacgagaacuacgcaggccccaacugcgaaaggugugcccccggguauuacggaaauccgcuacuuauuggcucaaccuguaaaaagugcgauuguucuggcaacucagacccuaaccuaaucuucgaggacugugacgaggugacagggcaaugucggaauugucuccggaauacuacuggauuuaagugugagaggugcgcaccugguuacuauggggaugcuagaaucgcaaagaacugugccguuugcaacugcggcggaggcccaugugacagcgugacuggagaaugccuggaggagggguucgagccaccgacugguauggauuguccuacaauuucuugugauaaaugugucugggauuugacugaugcauugaggcuagccgcccugagcauugaagagggaaagucuggcguccugaguguuaguucaggggcggcagcucacagacaugugaacgaaaucaacgcaaccaucuaccugcugaagacuaagcucuccgagagagaaaaccaguacgcacucagaaagauucagauaaacaaugcagagaacacuaugaaaagucuccugucugacguugaggaacucguugagaaacauuggaauaagccgagacgccgccuggaacuucaggaaggcguuuag

SEQ ID NO: 248296 - RNA, 363 nt, Artificial Sequence
  Description of Artificial Sequence: Synthetic coding sequence
auggcuuugagcucagcuuggcggucaguacugcccuuauggcuacuuugguccgccgcuugcucacgggccgccucaggagacgacaaugccuuuccuuuugauauagaggguuccucagccguaggcaggcaagauccaccugaaaccuccgaaccccgcguggcucugggaagacugccgcccgcugcugaaguucaguguccuugccacugccauccugcuggcgccccugcccccccacgcgcugugccacauucaucuuucuccuuaaguccaccgcucuccagcccccagugucuugaaucuuucaccugggccagaucaguccggaaacuggaaauuaaaucguuuccuuuauag

SEQ ID NO: 248297 - RNA, 324 nt, Artificial Sequence
  Description of Artificial Sequence: Synthetic coding sequence
auggcuuugucuuccgcauggagaaguguguugccucugugguuacuguggagugcugccuguucccgcgccgcauccggagacgauaacgccuucccauuugauaucgaaggguccucugcuguaggccgacaggauccaccugaaacaagcgagccacgaguugcucugggccgccugccuccagccgccgagaagugcaaugcagguuucuuccauacucugucgggcgaguguguucccugcgauugcaauggcaauagcaacgagugucuugacgguucgggauacugcguccacugccagagaaacacuacuggguag

SEQ ID NO: 248298 - RNA, 996 nt, Artificial Sequence
  Description of Artificial Sequence: Synthetic coding sequence
auggcccuuaguagugcuuggcggucaguacugccccuguggcuguugugguccgccgcaugcucacgugcugcgagcggcgacgauaaugccuuucccuuugacauugaagguaguagugccgucggaaggcaagauccacccgagacaucugagccaagaguagcacuagggcgccucccaccagcagcugaaaaguguaacgcaggcuuuuuucacacauuaagcggagaaugcguuccuugugauuguaacgguaauucaaacgaguguuuagauggcucgggguacugcguucacugucaaaggaacacuaccggcgaacauugcgaaaagugucuggaugguuauaucggcgauuccauuagaggggccccacaguuuugccagccuugcccguguccuuuaccccaccuggcuaauuuugcagaaaguugcuauagaaagaauggcgcugugcgcugcauuugcaacgaaaacuacgccggucccaauugcgagaggugcgcuccgggcuauuauggcaauccccuccugauuggaucuacuuguaaaaagugcgacugcaguggcaauucagacccaaaucugaucuucgaggauugugacgaggugacuggacagugccgcaacugucucagaaacacaacagguuucaaaugugaacggugcgcuccaggcuauuacggagacgcgagaaucgccaaaaauugugcugugugcaauuguggaggcggcccaugugauucuguuaccggggaaugccuggaggaaggauuugaaccucccaccggcauggacuguccuacaaucagcugugauaaaugcguaugggaucuaacugacgcucugcgguuagccgcccuuucuauugaagagggcaaaucaggagugcugagugugucuuccggggcugccgcccaccgccauguuaaugaaaucaaugccaccaucuaccucuugaaaaccaaauugagcgagcgcgaaaaucaguag

SEQ ID NO: 248299 - RNA, 246 nt, Artificial Sequence
  Description of Artificial Sequence: Synthetic coding sequence
auggcucuuuccuccgcuuggcguucuguucugccccucugguugcuguggucagcagcaugcucaagggcugcgucgggagaugacaacgcuuuuccguucgauauugaagggucuucagcaguaggacggcaggauccuccagaaaccucagagccccgcguagcauuaggacgcuuacccccugcagcggaaaaaugcaacgccggguucuuccacacauuguccggugagugcguacccuag

SEQ ID NO: 248300 - RNA, 5451 nt, Artificial Sequence
  Description of Artificial Sequence: Synthetic coding sequence
auggcucugucgucagcguggagguccguucuuccucugugguuguuauggucggcugccugcucaagagccgcaucaggggacgacaaugccuuuccuuuugauaucgaaggaucauccgcaguagggaggcaggaucccccugagacaagcgagccccggguggcgcuaggucgcuuacccccugcugcagaaaaaugcaacgccggauucuuccacacccugucuggggaguguguacccugcgacuguaauggcaacuccaacgaguguuuagacggcucaggauauugcguccauugccaacgaaacacuacgggagagcacugcgaaaagugccuggacggauauaucggugauucuaucaggggagccccucaauuuugccagccgugcccauguccacugccacauuuagcuaauuucgccgaaucauguuauagaaaaaacggagccguccgcugcauuuguaaugagaacuaugccggcccuaacugugaacgaugugccccugguuacuauggaaacccccuguuaauugguucuacuugcaagaaaugugauugcagugggaacuccgaucccaaucucauuuucgaagauugcgaugaagucaccggccaaugucggaauugccugcguaacaccaccggauucaagugcgagcgcugcgcuccagguuauuacggagacgccagaauagccaaaaacugugcuguguguaauugcgguggcggccccugcgauagugucacuggugagugucuggaggaaggguucgaaccccccacagggugcgacaagugugucugggaccugacugaugcauugcgacuggcggcauugucaauugaagaaggaaagucgggcguccuuucgguaucaagcggggccgccgcccacaggcauguuaacgagaucaacgcaacaauuuaccuacugaaaacaaaacuguccgaacgggaaaaccaauacgcccucagaaaaauucagaucaauaacgcugaaaacacaaugaaaagccuccugagcgauguggaagaacuggucgaaaaagaaaaucaggcgagcagaaagggccagcugguacaaaaagaaucaauggauaccaucaaccaugccucacagcuggucgagcaggcgcaugacaugcgcgauaaaauccaggagaucaauaacaagaugcuguauuacggagaggaacacgaacuaagcccgaaggaaaucucggagaaacuuguacuugcccagaagauguuggaagagauucggagcaggcaaccauuuuuuacacaaagagaacucgucgacgaggaggcagacgaagcuuaugagcugcuuucccaggcugagagcuggcagcgccugcacaaugagacuagaacucuguucccuguggugcucgaacagcuggacgauuauaacgcaaaacucucagaucuccaggaggcgcuggaucaggcucugaacuaugugagggaugcugaggauaugaaucgcgccacugcagcccgccagagagaucacgaaaagcagcaggagaggguuagggagcagauggaaguagugaacaugucuuuaucuacuagcgcagacucucucacaaccccuaggcuaacccugagugaacucgacgacaucauuaagaaugcgucugguauuuacgccgagauugauggugccaaaucugagcuucaggucaaacuuagcaaccuuucaaaccuuucccaugaccugguucaggaagcuaucgaccacgcccaggaccuccaacaggaagcaaacgaacugagccgcaaacugcauagcucugauaugaauggucuggugcagaaagcuuuggaugcuucaaacguguaugagaauaucgugaacuacguaagcgaggccaaugaaaccgcagaguuugcacugaacacaaccgaucgcaucuacgaugcuguguccgguauagacacucagauaauauaccacaaggacgaguccgagaaccugcucaaccaggcacgcgagcuccaggcaaaggccgagaguuccagcgacgaggccguagcagacacaagccggcgcgugggaggagcccuggcccggaaaucggcacucaagacccgcuuguccgaugccgugaagcagcugcaagcugcggagagaggugaugcacagcagagacuaggucaguccaggcugauuaccgaggaggcuaauaggacgacuauggaaguucagcaggcgacagcacccauggccaauaaucuaacuaacuggagccagaacuuacaacacuuugacaguucugcuuauaacacggccgucaacucagccagagacgcuguacgaaaucugacagaagugguaccccagcuguuggaccagcugcgcacuguggagcagaaacgccccgcaagcaacgucucugcuucgauccaaaggauuagggagcugauagcacagacgaggucuguggccagcaaaauccagguaucaaugauguucgacggacaaucugcgguagagguucauagcagaacaucaauggaugauuuaaaagcguuuacuucccugucgcucuacaugaagccgccugugaaaaggcccgaauugaccgagaccgcagaucaguucauacuuuaccugggguccaagaaugccaagaaggaauauaugggccuugcuaucaaaaacgauaauuugguguacguuuacaaucuuggaacuaaagacguggagaucccccuggacagcaaaccgguuaguucauggcccgcuuacuucucuaucguuaaaauagaaagggucggcaaacacggaaaaguguuccuaacagugccaagccucucuagcacagccgaagagaaauucauuaaaaaaggggaguuuaguggugacgauucucuucuugaccuugaccccgaggacacuguuuuuuacgugggagggguccccucaaauuucaagcugcccaccagcuugaaucuuccuggcuuugucggcugucuugagcucgcaacucuaaauaaugacgugauaucucuguacaacuuuaagcauaucuauaacauggacccuagcaccucugucccaugcgcucgagauaagcuggccuucacacagucacgcgcugcaucuuauuucuucgauggcagcgguuacgcuguugugagagauauuaccaggagagguaaguuuggacaagugaccagauucgacaucgaggugaggacgcccgccgacaauggccugauacuacuaauggugaauggauccauguucuuucggcuugagaugagaaacggauaccugcacguguuuuaugacuuuggguucagcggagggcccguacaccuggaggacacucugaaaaaagcacagaucaacgaugcuaaauaucacgagauuucuauuaucuaccacaaugauaaaaagaugauacugguuguugaucggcggcauguuaaaagcauggauaacgagaagaugaaaauacccuucacagauauuuauauaggaggugcgccaccugaaauccugcagucucgggcucucagagcgcaccucccuuuagacauuaauuuucgcggguguaugaaaggcuuccaauuucagaagaaggauuucaaucuacucgagcagacagagacgcugggagucggauacggcugccccgaagacucccucauuucacggagggcuuauuucaauggacagaguuuuauugcaagcauucaaaagauuucuuuuuucgacggauucgaaggcggcuuuaauuuucggacacugcaacccaacggacuucuuuucuauuacgcaucagggagugacguguucucgauuagccuugauaauggaacggugaucauggaugucaagggaauuaaaguccaguccguagauaagcaguauaaugacgggcugagccauuucgucauuaguucuguaucaccuacgcgguaugagcugauuguagauaaauccaggguggggucgaagaacccaacgaagggaaagauugaacagacccaagcauccgaaaaaaaauucuauuuuggcggcagcccgauauccgcgcaauaugcaaacuucacaggaugcaucagcaacgcauauuucaccaggguagacagggacguggaaguggaggauuuucagcgcuauacugaaaagguucacaccucacuguacgagugucccaucgagaguagcccacuauuucugcugcauaagaaggguaagaaccuuaguaagcccaaagcuagccaaaacaagaagggcggcaaaucgaaagacgcaccaagcugggaccccguggcuuuaaagcuuccugagcggaauacgccucguaacagccacugccaucugagcaauucaccacgggccaucgaacaugcauaccaguacggagggaccgccaauucccggcaggaguuugagcaucucaagggagauuucggagccaaaucgcaguuuuccauccgccucaggacaagaucuucacauggcaugaucuucuauguguccgaccaggaagagaaugacuuuaugacacucuucuuagcacacggccgguugguguacauguucaacgugggucacaaaaaacucaaaaucagaagccaggaaaaguauaacgacggacuguggcaugacgugaucuucauaagagaaaggucaagcggcagguugguuauugauggacugcgcguguuggaagagagccuaccaccgacagaggcgaccuggaaaauuaaagggccaaucuaccugggcggcguggccccugggaaagccgugaaaaacgugcagauaaauuccauuuauagcuuuucugggugccuguccaaccugcagcucaauggcgcaagcaucaccucugcaucucagaccuucuccgugacacccuguuuugaaggcccuauggaaacaggcacuuacuuuucuacggagggaggauaugucguucuggacgagagcuucaacaucggauuaaaguuugagaucgcauucgaaguucgcccucgguccucuagcggcacucuugugcacggacacucagugaacggagaauaccugaaugugcacaugaagaauggacaaguuauugugaaggucaacaacggcauccgggacuucucaacaagcgucacacccaagcagucccuaugugaugggcgguggcaucggaucacggucauacgggauuccaauguggugcagcuagauguagacuccgaagugaaucacgugguggguccuuugaauccuaagccuaucgaucaucgcgaaccgguuuuuguggggggcguucccgaaagccuuuuaacuccacgucuggccccaucuaaaccauucaccggcuguauacgccauuucgugaucgacggccaucccgugucguuuuccaaggccgcucucgucucuggcgccgugucgaucaauucuuguccggccgcuuag

SEQ ID NO: 248301 - RNA, 975 nt, Artificial Sequence
  Description of Artificial Sequence: Synthetic coding sequence
auggcccuaucgagugcuuggagaucugugcugcccuuauggcugcuguggucagccgccugcaguagggcagcaucuggugacgacaaugcuuucccuuuugacauugaaggaucuagcgcuguuggaagacaggacccaccggagacaucugaaccgagaguggcgcuagggagacugccacccgccgccgaaaaaugcaaugccggauucuuucauacccugucaggagaaugugucccuugugacuguaacgggaacucuaacgaguguuuggacgguuccggcuacuguguccacugccaacggaauacuaccggagaacauugcgagaaauguuuggauggauauaucggcgauaguauucgcggcgccccacaguucugccagccgugccccugcccucugccgcauuuggcuaacuucgccgagucauguuacaggaaaaacggagccguacgcugcauaugcaaugaaaauuacgcuggccccaauugcgaacguugcgcuccaggcuauuauggcaauccucucuugaucggcucuacguguaagaagugcgacuguucagguaacuccgauccuaacuugaucuuugaagacugugaugaagugacuggacagugccgaaauugucugagaaacacaaccggguucaagugugagaggugugccccagguuacuacggagacgcuaggauugcuaagaacugcgccguuuguaacugcggcggggggccaugcgauuccguuacuggagaaugccuggaagagggcuuugagcccccgaccgguugcgacaaaugcguuugggacuuaacagaugcccuccgccucgccgcccugucuauagaagaaggaaaaucugggguguugagugucucaagcggcgcagcagcucaucgacauguuaacgagauaaaugcuacuauauaucuacucaaaaaaacgaaacagaagaauaacaagaaguag

SEQ ID NO: 248302 - RNA, 276 nt, Artificial Sequence
  Description of Artificial Sequence: Synthetic coding sequence
augggucugcuccaacugcuggccuucucauuucuugcuuugugcagagcucgcguucgcgcccaggagcccgaguucuccuacgguugugccgagggcucuuguuauccugcuacaggugaucuguuaaucggccgcgcccagaaacuuagugucaccagcacaugcggauuacacaaaccagaaccuuauugcauugugucucacuuacaagaggauaaaaagugcuucaucugcaacucccaggacccuuaccaugagacacugaacccuuag

SEQ ID NO: 248303 - RNA, 2553 nt, Artificial Sequence
  Description of Artificial Sequence: Synthetic coding sequence
augggacugcuacaacugcuagccuuuucuuuccuggcccuaugucgggcccgugucagagcgcaggaaccggaauuuuccuaugggugcgccgaagggagcuguuacccagcaaccggagauuuacugaucggccgggcacagaaacucagcgucacuagcaccugcggucuccauaagccugagccauacuguauaguaucucaucugcaagaagacaagaagugcuucaucugcaauucccaggaucccuaucacgagacacucaauccugacagccaucucaucgaaaacguuguuaccaccuuugcuccaaacagguugaaaaucugguggcaguccgagaacgguguugagaacgucacuauccaguuagauuuggaggcugaguuucacuucacccaucuuauuaugaccuucaagacuuucaggccagcagcuaugcuuaucgaaagaaguucagacuucggcaagacuugggguguguauagguauuuugcuuaugauugugaggcgucguucccugggauauccacuggaccuaugaaaaaaguugaugauauuaucugcgacucucgguacuccgacauugagccuuccacugaaggcgagguuauuuuccgggcacuggaccccgcauucaaaauagaggauccuuauucuccuaggauucaaaaccugcugaaaaucacuaaucucagaauuaaguucgugaaacuccacacacugggggauaacuugcuggauucaagaauggaaauucgugagaaauauuacuacgcuguauaugacauggugguucgagggaauugcuucuguuacggucacgccucugagugcgcacccguugacgguuuuaacgaggaaguagaggggaugguccauggccacugcaugugucgccacaacacaaagggcuugaauugcgagcuauguauggauuuuuaccaugacuugcccuggagacccgcagaaggccgcaacaguaaugccugcaagaaguguaauugcaacgaacauagcauuaguugccacuucgauauggccguguaccuggccacuggcaaugucucugguggugucugugacgauugccagcauaauaccaugggccggaauugcgagcagugcaaacccuucuacuaucagcaccccgaaagagauauucgggacccuaauuucugugagcggugcacuugcgauccugccggcucccagaacgaaggaauaugugacuccuacaccgauuuuaguacuggucuuaucgcuggacagugccggugcaaauugaacguggagggggagcacugugauguauguaaggaaggauuuuaugauuuaucaucugaggacccauucggcugcaaauccugcgccuguaauccacugggaacaauaccugguggcaaccccugcgacagcgagaccgggcauuguuauugcaagcgacuggucacgggucagcauugugaccagugccuaccugagcauugggggcuguccaacgauuuggacgguuguagacccugcgauugcgaucuuggaggggcccucaauaacaguugcuuugccgagagcggacaguguucaugccggccucauaugaucgggcggcagugcaacgaggucgaaccuggcuacuacuuugccacuuuggaccacuaccuuuacgaggcugaggaggcaaaccucgguccaggugugaguaucguggaaaggcaguacauucaggauaggauccccuccuggacuggagccggauucgucagggugccagaaggugccuaucuggaguuuuucauugauaacaucccuuauagcauggaauacgacauccucauaagauacgagccucagcuacccgaucacugggagaaagcaguuauaaccgugcagcggcccggaaggaucccuacgucaucccggugcggcaacacuaucccugacgaugacaaccaagucgugucccugucaccaggcagccgcuacguuguauugccuagaccaguaugcuucgagaaagguaccaauuauacggucagguuagaguugccccaguauacauccagugacagcgacguagaaaguccuuauacucucaucgauucacugguccugaugccauacuguaagagcuuagauauuuuuacugugggggguucaggcgaugguguaguuacuaauuccgccugggaaaccuuucagcgguacagaugccuugagaacucucgcucugucgugaaaacaccaaugacugacguaugcagaaacaucaucuuuaguaucucugcucugcuucaccagaccggacuggccugugagugcgauccccagggaucucugucuucugucugugaucccaauggaggacagugucaauguagaccgaauguggucgggcgcaccugcaaucggugugcuccggguaccuucggcuuuggccccuccggcuguaaaaggcgguuucugaagucaauagucaugcacucuuucagacucacgcagccgcuguggcagggcuccauugcugcagaaccaaugcuuccuaguuag

SEQ ID NO: 248304 - RNA, 3912 nt, Artificial Sequence
  Description of Artificial Sequence: Synthetic coding sequence
augccagggccgagaggggcggccggaggccuugcuccagagaugcggggugccggcgccgcugggcuucucgcucugcuucuucuguugcuuuugcuguuacucggucuugguggacggguggagggagggcccgcaggcgagcgcggagccggcgguggcggugcacucgcucgagaaagguucaaggugguuuucgcuccggugauuuguaagcggacuugcuuaaagggacaauguagagauucaugccagcagggaucaaacaugacccugauuggcgagaacgggcauucuacggauacgcuaacaggcucgggguuccgcguggugguuugcccccugccaugcaugaacgggggacagugcuccagcaggaaucagugucucuguccuccugacuuuacaggaagauuuugucagguucccgcagguggcgccgggggagggacugggggaucugggccaggauuguccagaaccggagcccucagcacuggggcccuuccaccccuugcaccugaaggagauucggucgccaguaaacaugcuaucuacgccgugcaagugaucgccgacccuccagguccaggugaaggaccacccgcccagcacgcugcuuuccuuguuccccuuggacccggacagauuuccgcagaagugcaagcaccuccuccaguggugaaugugcgagugcaccauccaccugaggcuucugugcaaguucaccggauugaauccucgaaugcugaaucugcagcuccuagccaacaccuucugccucacccuaaaccuagccauccccggcccccaacucagaaaccucugggcagauguuuccaagauacacuaccgaaacaaccuugcggcaguaacccauugccaggucucacgaaacaggaggacugcuguggauccaucggcaccgccugggggcaauccaaaugucacaagugcccgcagcugcaauauaccggcgugcagaaacccggcccaguuagaggagaagucggcgccgacuguccucagggcuacaagagacugaacuccacgcacugccaagauaucaacgaaugcgccaugcccggagugugccgacacggcgauugccucaacaacccuggcaguuaccgcugcguguguccucccggucauuccuuggguccuucgcggacacagugcaucgcugauaaaccugaagaaaagucccuguguuuuaggcugguuaguccggaacaucagugucagcacccucuaacuacgcguuuaacaagacagcugugcuguugcucuguugguaaggcuuggggcgcccgaugucagcguugcccaaccgacgggacagccgccuuuaaagagauuuguccugcaggaaaaggcuaccauauuuuaaccagccaccagacucugaccauucagggagaaucugauuuuagccuuuucuuacacccagaugguccaccaaaaccucagcaauugccagaaucaccaucacaggcgccuccccccgaggacacggaggaggagagaggugucacuaccgacagcccuguuagcgaggagcgcaguguucagcaaucccauccaacugcaaccacgacuccggcccgcccuuaccccgaauuaaucaguaggcccagcccuccuacgaugcggugguuccuaccugaccuuccucccagucgaagcgcugucgaaaucgcccccacccaggucacagagacugaugagugucggcugaaccaaaacaucugugggcacggggaaugugucccagguccgcccgacuauaguugucauuguaauccaggauaucgaucucauccucaacaccgcuacugcguggacgugaacgagugcgaagccgagccaugcggccccggccgggggaucugcaugaacacaggcggauccuacaacugccauugcaacagaggcuacagguuacauguaggggcgggcggcaggucuugcguggaucucaaugagugcgcuaagccacaucuuugcggagacggaggauucugcauuaauuuucccggacacuacaagugcaacugcuaccccggauacaggcugaaagcuucuagaccuccugucugcgaggacauugaugaaugcagagacccauccuccuguccagauggaaaaugcgaaaauaagccuggauccuuuaaguguauagcuugucagcccggcuaccgcucucaaggagggggggccuguagggauguaaaugagugugcagagggaagcccuugcucgccugguuggugugagaaccuuccugguuccuuuagauguacaugugcucaggguuaugcucccgcuccggauggcagaagcugucuggauguggacgagugcgaagccggcgaugugugugacaacggcaucugcaguaacacaccgggguccuuccaaugucagugccugucuggcuaucacuuaagccgggaucguucacauugugaagauauugacgaaugcgacuuucccgcagccugcauuggcggcgacugcauuaauaccaauggguccuaccgcugcuuaugcccucagggucaccgccugguuggcggccggaagugucaggauaucgaugaguguucacaagacccuucccugugccugccucauggcgcaugcaagaaccugcagggcuccuacguuugcgugugugaugagggcuuuacgccuacccaggaccagcacggaugugaggaagucgaacagccucaccauaaaaaggaguguuaucugaauuucgacgacacggucuucugugacuccguccuggcaacaaauguaacgcaacaagaguguugcugcucucugggugcgggauggggcgaccacugugagaucuaccccugcccaguauauucuagcgcagaguuccauucccuguguccagauggcaaaggguauacccaggauaauaauauuguuaauuauggcauccccgcccaccgugauaucgaugaauguaugcuauucggaucggagaucugcaaggaaggcaagugcgucaauacacaacccggcuaugaguguuacuguaagcagggguucuauuacgacggcaacuugcuugagugcguugacguagacgaaugucuggacgagucuaacugccgcaacggggucugugagaauacccgaggggguuaucguugcgccugcacuccaccggccgaauauucacccgcccaacgucaaugccuuucuccggaagagauggauguggacgagugucaggauccugcagcaugucgccccggcaggugcgucaaccugccuggaucauaccgcugugaaugcaggccuccgugggugccgggcccgucgggacgugauugccagcuacccgaaagcccagcugaaagggcuccagagcgucgggauguguguuggagucagcgaggugaggacgguaugugcgcaggcccccuagcaggaccagcccuaacuuucgaugauugcugcugucgccagggcagggguuggggagcccagugccgucccugcccgccucgaggcgcuggaagccacugccccacaagccagucagagagcaauuccuuuugggacacuucccccuuacuccuugguaagccaccuagggaugaggacucaagcgaagaagacucagacgaaugccgguguguguccggccgcugcgucccucggccgggaggagccgugugcgaauguccgggggguuuccaacuggacgcuagccgugcucggugcguugauauugaugaaugcagagagcuuaaccagagagggcuccugugcaagucugagaggugcgugaacacaucuggcaguuuccggugugugugcaaagcuggauuugcaagaagccguccucauggggcauguguuccucagagaaggcgguag

SEQ ID NO: 248305 - RNA, 792 nt, Artificial Sequence
  Description of Artificial Sequence: Synthetic coding sequence
auguuguucggaagcgagaucuguaaggaagggaagugugugaacacccaaccuggguaugagugcuacuguaagcaggguuuuuacuacgacggaaaucuccuugaaugcguggauguugacgaaugccuugaugaguccaauugccgcaauggcguaugugagaauacacguggcgguuacagaugcgccugcaccccuccugccgaguauuccccagcacaacgccagugccuaucaccugaagaaauggacguagacgagugucaggauccggcagcaugccgccccggccgcugcgucaaucugccuggcucauaucgcugugaaugccggccgcccugggucccuggaccaucaggccgugauugccaacugccggaaucccccgccgagagagccccugagcgaagggacgucuguuggucccaacggggcgaagacgggaugugcgccgguccucuggcagggccugcccucacuuuugacgacugcugcuguagacaaggccgugguuggggcgcccaauguagaccguguccaccacgaggggcaggaagccauuguccaacaagucaaagugaaucuaauucuuucugggacacaaguccucugcuccugggaaagccgccaagggacgaagacuccagugaggaggauagcgaugaauguagaugcgugucugccgcggcuugucggggucgagccgcuccuugcgccuccguccccgccgcaagcagcucgacuccgccagccccagccgccuggauuagcacuucugccgagagcuag

SEQ ID NO: 248306 - RNA, 3771 nt, Artificial Sequence
  Description of Artificial Sequence: Synthetic coding sequence
augccgggcccaaggggagcugccggaggucucgcaccugagaugcggggagcaggagcggccggacuccucgcacuccugcuucugcuucuucuccuacuuuugggcuugggcggccggguugaaggcgggccugcaggugaacggggcgccggcggcggcggcgcacucgcuagagaaagguucaaaguuguguucgcaccagucauaugcaagaggacuugucucaagggucagugucgugacucuugccagcagggcagcaacaugacacugauuggagagaauggacauucaacagauacccuaacaggcucaggcuuucgugucgucgugugcccauuaccaugcaugaaugguggucaauguagcucucggaaucaguguuugugcccaccagacuucacaggccgcuucugccagguaccugccgggggugcagguggcggcacaggaggaagcggcccagggcucagccggaccggcgcacucuccacaggggcucugcccccucuggcucccgaaggggacaguguugccuccaaacacgcaaucuaugcagugcagguaauugccgaucccccuggcccaggcgaaggaccucccgcacaacacgcugcauuucuggugccccucgguccuggccagauaagcgccgagguccaagcuccccccccaguggugaacguucgcguacaucauccacccgaggcuucaguucaggugcauagaauugagucuucgaaugcugaaagcgcagccccaagccagcaccugcucccacacccaaagcccucccaucccaggccgccuacccaaaaaccgcucggacgcuguuuucaggacacacucccaaagcagccuugugguucaaacccccucccuggccuaacuaaacaggaggacuguugugggucuauugggacagccuggggccagaguaagugucauaaauguccccaauugcaguauaccgguguccagaaacccggcccugugagaggagagguaggggcggauugcccacagggguauaaaagacucaacagcacacacugucaggacaucaaugagugugcuaugcccggggucuguaggcacggagacuguuugaauaaccccgggucauacaggugcgugugcccucccggacauucccuggguccaucucggacucaauguauagccgauaagcccgaggagaagagccuguguuuccgauuggucaguccugagcaucaaugccagcauccccugacuacucggcuaacucgucaguuaugcugcuguuccguggggaaggccuggggagcucgcugccagaggugucccacagaugggacagccgcauucaaagaaauuuguccugcagggaaagguuaccauauucucaccucccaucaaacucuuaccauccagggcgaguccgacuucagcuuguucuugcacccugauggacccccuaagccccagcagcugcccgaaucuccaucccaagcgccuccccccgaagacaccgaggaagagagaggagucaccacagacagcccugucagugaagagagaucuguacagcagagucauccuaccgcgacaaccacaccugccagaccguacccugaguuaaucagcagacccucucccccuaccaugaggugguuucuaccagaccuacccccuucucgcucagcaguggagaucgcuccuacacagguuacagaaacggacgagugcaggcugaaucagaauaucugcggccacggcgaguguguucccggcccuccagacuauagcugccacugcaacccaggcuaccggucgcacccacaacaccgguacugcguugacgugaacgagugugaggcagagcccugcgggccugggagaggaaucuguaugaauacaggaggaagcuauaauugccauuguaaccggggauaccggcugcacgucggagcugggggacgauccuguguggaccugaacgaaugcgcuaaaccucaccucuguggcgacggugguuuuuguauaaacuuccccggacauuacaaaugcaacuguuauccugguuaccgacuaaaggccucaagaccuccugugugcgaagauauugacgagugcagagacccgagcaguugccccgacgguaagugugagaauaaaccgggguccuuuaagugcaucgcgugucagccaggcuaccgaagucaaggggggggcgccugccgugacgucaaugagugugcagagggcaguccuugcaguccgggauggugugagaacuuaccgggcuccuucagauguaccugugcccaaggcuacgcgcccgcuccugacggaagaucaugcuuagaugucgaugaaugugaggcaggcgacgugugcgacaacgguaucugcuccaauacgccugggucuuuccaaugccagugcuugagugguuaccaccugucaagagaucggucccauugcgaagacaucgacgaaugugacuucccggcagcaugcaucggcggagacuguauuaauaccaauggcagcuaucggugccucugcccccagggacaccggcuaguggggggccggaagugccaggauauagaugaauguucucaggaccccucacuuugccucccgcacggggcauguaagaaccugcagggcagcuacguuugcgugugcgacgagggguucaccccuacccaagaucagcauggcugcgaggaaguugagcagccacaccacaaaaaggaguguuaccugaacuuugaugauaccguguuuugugacucuguccucgccacaaacgugacucaacaggaguguuguugcucauuaggugcuggauggggcgaccacugugagauauauccaugucccgucuauuccucugccgaauuucacucccugugucccgauggcaagggguacacacaggacaauaacaucgugaacuacggaauucccgcccaucgcgacaucgaugaauguaugcuguuugggagcgagauuuguaaggagggcaaauguguaaauacucagccagguuaugagugcuacugcaagcaaggguuuuauuacgacggaaaucuccuugaaugcguugacgucgacgagugccuggacgaguccaacugccgaaaugggguuugugaaaacacuaggggaggcuauagaugcgcaugcacaccaccugccgaguauucccccgcccaaaggcaaugucuuagcccagaggagauggaaagggcccccgaacgcagagacguguguuggagccagcguggcgaggacggaaugugugcggggccccuggcuggaccugcacugaccuucgacgacugcugcugccggcagggcaggggcuggggggcucaguguagaccaugcccacccaggggugccgguucccacuguccaacaagucagucugaauccaacucguucugggacacuagcccucuucuucuggguaaaccuccgcgugacgaggacucaucugaagaagauagcgaugaaugccgcugugugaguggccgguguguccccagacccgguggugccguaugcgaaugucccggcggguuccaguuggaugccucacgagcaagguguguggacaucgacgaaugcagagagcuaaaccagagggggcuucucuguaaaagugagagaugcgucaacacuuccggcuccuucaggugugucuguaaagccggguucgccaggagucggccucauggagcuugcgucccacagcggagacgguag

SEQ ID NO: 248307 - RNA, 921 nt, Artificial Sequence
  Description of Artificial Sequence: Synthetic coding sequence
augcucuuuggguccgaaauuugcaaagaaggcaaguguguuaauacacagccagguuacgaguguuacugcaaacagggcuuuuacuaugauggaaauuuguuggaauguguugauguggacgagugccucgaugaguccaacugccgcaaugggguuugcgagaacacccgaggcgguuacaggugcgcaugcacaccaccugcugaauacagcccagcccagcggcaaugccuuagucccgaggagauggacgucgaugagugccaagacccagcagccugccgccccgggagaugcgucaaccuaccaggaucuuacagaugcgagugccggccaccuuggguaccuggccccagcggccgugauugccaacugccugagaguccugcugagcgcgcccccgaacgcagggacgugugcuggucccagagaggggaagauggaaugugcgcagguccucuggcagggccugccuuaaccuucgacgacuguugcugucgccagggucgcggcuggggagcacagugcagaccaugcccuccgcgcggcgcuggcucccacugcccaacuucccaguccgaaucuaauuccuuuugggauacauccccuuuacugcucggcaaaccuccgcgugaugaagacaguucagaggaagauagugaugaaugucgcugcguaucuggacgaugugugccacggccagguggggcuguaugcgaaugccccggcggcuuccaacuggaugccaguagggcccgaugcguugacauagaugaaugucgugagcugaaucagagaggccuucugugcaagucugagcgaugcgucaacacuucugggagcuuucgaugcgucuguaaagcuggauucgcccggagucggccacauggugcaugugucccccaacgaagacgguag

SEQ ID NO: 248308 - RNA, 3414 nt, Artificial Sequence
  Description of Artificial Sequence: Synthetic coding sequence
augacgcugauaggagagaacggccacucaacagacacccugaccggcagcggguuuagagucguggucugcccucuuccauguaugaauggggggcagugcucauccagaaaccagugucugugcccgcccgacuuuacgggccgcuuuugucagguccccgcuggcggugcagggggugguacagggggaagcggccccgggcuuagccggaccggcgcccugucuaccggcgcccuaccuccccuagcuccugaaggcgauucagucgcaagcaagcacgcuauuuaugccguccagguaauagcggacccgccagggcccggcgaggggcccccugcacagcaugccgcauuucuggugccgcugggccccggccaaaucucugccgaaguacaagccccuccuccaguugucaauguccgcgugcaucaccccccagaggccucuguccaggugcaucgcauugaaaguucuaacgcagaguccgcugcccccucccagcacuugcugccacauccuaagccaucccauccucgcccccccacccagaagccccuuggaagguguuuccaagauacuuugccaaagcagccuuguggaucaaaccccuugccaggacugacuaaacaggaagauugcugcggcuccauuggaaccgcuuggggucagaguaagugccacaaguguccacaacuccaguacaccgggguccaaaaaccgggcccggucaggggcgaggugggggccgauuguccucagggcuacaaaagacuuaauucgacgcacugccaagacaucaaugaaugcgccaugcccggcgugugccgucacggugacugccugaacaacccagguagcuaucgaugcguuugcccuccuggacacucucucggcccaucaagaacccagugcaucgccgauaagcccgaagaaaaaucucuguguuucagacuggugucaccugaacaucagugccagcauccacucacaacaagacuuacccgacagcugugcuguugcagugugggcaaggcguggggcgcucggugucagagauguccuacagauggcaccgcagcuuucaaagagauaugcccagcaggaaagggcuaccauauccucacaucacaccagacccugacuauacaaggagaaucagauuuuucauuguuucuccauccagacggucccccaaagccgcagcaacugccagaguccccaucucaagcuccucccccagaagacaccgaagaagagagaggggugacgacugauuccccaguuucagaagaaagaucgguucagcagucucaucccacagcuacgacuacuccugcacggccauacccugaguugauuucuaggccuucaccaccaacuaugcgcugguucuuacccgaccugccccccucuagaagugcuguggaaauagccccuacccagguuaccgagacagacgagugccgacugaaccagaacauuugcgggcacggggaaugcguucccggaccacccgacuacuccugucacuguaacccgggcuacagaucacacccucaacaucgguacuguguagacgugaacgaaugcgaggccgagcccuguggaccuggucgcggaaucugcaugaauacuggcggcagcuacaacugucacuguaaucggggauauagacuacacguaggagccggugggcggagcugcguugaucuaaacgagugugcuaaaccccaccucugcggcgacgggggcuuuuguaucaacuucccagggcauuacaaguguaacugcuacccggguuauagguuaaaggcuucaagaccaccuguaugugaagacaucgaugaguguagagauccauccagcuguccugauggcaagugcgaaaacaaaccuggauccuuuaaaugcaucgccugccagccgggcuaccguucccaaggggggggcgcaugucgggacgugaaugagugcgcagaagguucuccaugcagucccggcuggugcgagaaccugccagguagcuuucgcugcacuugcgcucagggguacgcucccgcaccugacgguagaucaugccucgauguugacgaaugugaagccggagacguuugugauaacggaauuugcagcaauacgccugggagcuuccagugccagugccuauccggguaucacuuaagccgcgaucggagccauugcgaggauaucgacgagugcgacuuucccgcagcauguaucggaggcgauugcaucaacacaaacggauccuaccgaugucuguguccccagggucaucgacuggugggcggacgaaagugccaagacauagaugagugcagucaggaccccucgcucugccugccucacggugcauguaagaauuuacaagggucuuacgugugcgugugcgaugagggauuuaccccuacacaggaucagcauggaugugaggaaguagagcagccucaucacaagaaggaaugcuaucuuaacuucgacgacacuguguucugugauagcgugcuggccaccaaugugacacaacaggaauguugcuguagcuuaggcgcggguuggggcgaucauugcgaaauauauccuugucccguguacucuagcgccgaauuccauucacuaugccccgacggaaaaggauauacccaggacaacaacauaguuaacuacggcauccccgcccaucgcgacaucgaugaguguauguuguuugguagugaaaucuguaaagaagggaaaugcgugaauacccagccuggguacgaguguuacuguaagcagggauucuauuacgacggaaaucuucuggagugcguagacgucgaugaaugucuggaugaaucuaacugccgaaacggcgugugcgaaaauacccgcgggggcuaccggugcgccugcacccccccagccgaauauagccccgcccagagacagugucuguccccagaggaaauggacguggaugagugccaagauccagcagcauguaggcccggccgaugcgucaaccuacccggaucuuaccgaugcgagugucgcccacccugggucccugggccuucaggcagagauugccaacucccagagaguccagcugaaagggcuccagaacgcagggauguauguuggagucaacggggggaagacggcaugugugcuggcccgcucgcuggaccagcccugaccuucgacgacuguugcuguaggcagggccgcgguuggggugcccagugcagaccuuguccacccaggggugccggcagccacugccccacaagccaaucugagagcaauagcuuuugggauaccucaccucugcugcugggcaaaccuccaagggacgaggacucuagcgaagaggauagcgaugaauguaggugcgugaguggauag

SEQ ID NO: 248309 - RNA, 2202 nt, Artificial Sequence
  Description of Artificial Sequence: Synthetic coding sequence
augccugccgaaacugaugagugccgguugaaccagaacauuugcggccacggagaguguguaccuggcccgccagacuacagcugucacuguaauccaggauacaggucucacccacagcaucgcuauugcguggaugucaaugagugugaagcagaaccuugcggucccggacgcgguauauguaugaacaccggcgggagcuauaacugccacuguaauagaggguacagauuacacguuggagcgggcgggagaucaugcguggaccuaaacgagugugcuaagccucaccucugcggagaugggggguuuugcauuaacuuuccugggcauuacaagugcaauuguuauccuggauauaggcuuaaggcauccagaccccccgugugugaggacauugacgaaugccgagacccuucuuccuguccugacggcaagugcgagaacaagccugggagcuucaaguguaucgcuugucagccaggguacaggucccaggggggcggcgcaugccgggauguuaacgagugcgcugaagguagcccuuguucaccaggguggugugagaaccuuccuggaagcuuccgguguaccugugcacaaggguaugcuccagccccagauggucggagcugccuggacguugaugaaugcgaggccggagacgucugcgauaacggaauuugcucaaacacaccuggcuccuuccagugccaguguuugucgggguaucauuugaguagagauagaagccacugcgaagacaucgaugaaugcgacuucccagccgcuuguaucgguggggacuguaucaacacaaaugggaguuacagguguuuguguccgcaaggucaucggcuagugggcgguagaaagugccaggauaucgaugaguguagucaagaccccagucuuugccugccgcacggagccugcaagaauuuacagggauccuacguguguguuugcgaugagggauucacuccuacacaggaccagcacgggugcgaggaaguggagcagccucaccacaagaaggaaugcuacuuaaacuuugaugacacaguguuuugcgauaguguucuggccaccaaugucacccagcaagaguguugcugcagccucggcgcagguuggggggaccauugcgaaauuuacccaugcccugucuacucuucugcugaauuccacucucugugccccgacggaaagggguacacgcaagauaacaacaucgugaauuauggaaucccggcccauagagacauagaugagugcauguuguucggcagugaaaucuguaaagagggaaaaugugugaauacucagcccgguuacgaaugcuauugcaaacaagguuucuacuaugacgggaaccuacuugagugcguggacguggacgaauguuuggaugagucuaauugccggaacggugugugcgagaacaccagagggggauaccggugcgcuugcaccccgccugcugaauauagucccgcccagcggcagugccucagcccagaggaaauggacgucgacgaaugucaggacccugccgcuugucgcccaggacgcugcguuaaccuacccggauccuaucggugugaaugccggccaccauggguuccaggcccuuccggcagggacugccagcugccugaguccccugccgagcgugccccugaacggagggauguguguuggagccagcggggcgaggaugggaugugugcaggaccucucgcgggccccgcucuuaccuucgaugauugcuguugccggcagggcagaggguggggcgcacaaugcagaccuugucccccccggggagcaggaucucacuguccaaccucacagucggaaagcaauucauuuugggacacuucaccacuguuacugggcaagccuccucgugacgaagacuccucggaggaagauagcgacgagugcagaugcgugagcggccggugcguaccuaggcccgggggcgccguuugcgaaugcccuggcgguuuucagcuggacgcgucucgggcccgauguguggauauugaugagugucgggaacucaaucagcggggacugcucugcaagucugaacguuguguuaacacuucuggauccuucagaugcguuugcaaagccggauuugcccguucacgaccacacggcgcuugcguaccacagcggcggagauag

SEQ ID NO: 248310 - RNA, 2649 nt, Artificial Sequence
  Description of Artificial Sequence: Synthetic coding sequence
augacccucauuggugagaaugggcacagcacugacacgcucaccggaagcgguuuccgcguggcagacaaaccugaggaaaagagccugugcuucagacucgugucucccgaacaucagugucagcaucccuuaacuacaagacugacgcgacaacucugcugcuguucuguggggaaagcauggggagcgaggugccagcgguguccuaccgacggcacagccgcauucaaggagaucuguccugcuggaaaaggcuaccacauucuuaccucgcaccagacccucaccauucagggggagagugacuuuagccucuuuuugcaucccgacggaccgccuaagccacaacaacugccagaaucacccagccaggcuccuccgccggaagacaccgaggaggagcgaggagucacaacggauagcccuguaucugaggaaagguccguccagcaaagccacccaacagccacuacgaccccagccagaccuuacccagaacugaucaguaggccuagcccacccacuaugcgaugguuccucccugaucucccccccuccagauccgcuguggagaucgcucccacucaggugacugaaaccgacgagugccgucuuaaucagaacaucuguggccauggcgagugcguucccggcccucccgacuacagcugccacugcaauccuggauaccggucacacccccagcaccgcuauuguguagaugucaacgagugcgaagcugagcccugcggucccggcaggggcauuuguaugaauaccggcggguccuacaacugucauugcaaccgcggguaccgacugcacguuggugcuggcggacggucuuguguggaucugaaugaaugugccaaaccucaccucugcggagacgguggauuuugcauuaauuucccuggccacuacaaaugcaacuguuaccccggcuaucggcugaaagcaagccgaccuccgguaugugaagacaucgaugaguguagagacccaagcagcugccccgauggaaaaugcgaaaacaagccugggaguuuuaaaugcaucgccugucagcccgguuaccgaagccagggagggggcgcuugccgcgacgugaaugagugcgccgagggaucaccuugcucccccgguuggugcgagaaccuaccuggguccuucaggugcaccugugcccagggcuaugcgccugcacccgacgggaggagcugccucgauguugacgaaugcgaagccggagauguuugcgacaacgggauaugcuccaauacaccggguuccuuucaaugccaguguuuaucuggauaucauuuaucccgggaccgaucccacugcgaggacaucgacgagugugauuuccccgcggccuguauuggcggugacugcauuaauaccaauggauccuaucgcuguuugugcccucaaggacaccgguuagugggaggucgcaaaugccaggauauagaugaaugcucacaggauccaucccuaugccugccacauggugcuuguaagaaucuacaggggagcuauguuugcgucugcgaugaaggcuucaccccaacacaggaucaacacgggugcgaagaaguggaacagccucaucauaaaaaggagugcuaccuaaauuucgacgauaccguuuucugugacucgguacuggcuacaaaugugacucaacaagagugcuguuguagucugggcgcuggguggggagaccacugcgaaaucuaucccuguccuguuuauucauccgccgaauuccacagccucugucccgaugggaagggcuacacccaggauaacaauaucguaaacuacggcaucccagcccacagggauaucgacgaaugcaugcucuucggaucugagauaugcaaagagggaaagugcgugaauacccagccuggcuacgaauguuauugcaaacagggguuuuacuaugaugggaacuugcucgaauguguagacguggaugaaugucuggaugaaaguaacuguagaaacggagugugcgagaauacacggggaggcuacaggugugcuugcaccccgccagccgaauauaguccagcacagaggcaaugucugucacccgaagagauggagagagcaccagagagacgggacgugugcuggucacagcgcggagaagacgggaugugcgccggaccucuggccgguccugcccucacauuugaugacugcuguugucgccagggccguggauggggagcgcagugccggccuugcccuccgaggggcgccgggagccauugcccaacgucccaaagcgagucuaacucuuucugggacacauccccccugcugcucggcaaacccccccgggacgaggacuccagugaggaagacucugacgaguguagaugcguguccggcagaugcguccccagaccgggcggugcgguaugcgaaugcccaggaggauuccaguuagacgcuucacgagcccguuguguggauaucgaugagugcagggagcugaaccagagaggauugcuguguaaaucggagagguguguaaauacuucuggaagcuucagaugcguguguaaagcuggauuugcacgaucucggccacacggugcuuguguaccacaaagaagacguuag

SEQ ID NO: 248311 - RNA, 2127 nt, Artificial Sequence
  Description of Artificial Sequence: Synthetic coding sequence
augcgcgagcguaucugggcacccccccuccugcuccuccucccccuccuccugccuccaccccuauggggagggccaccagauaguccucguagggaacuggagcuggaacccggcccacugcagccauuugaucuucuguaugccucuggggcggccgcauacuacuccggggacuaugagagagcuguaagggaucuagaagcagcacugaggagccauagaagauugcgugagaucagaacccguugugcucggcauugugcugcuagacacccccugccccccccgcccccuggcgaaggcccuggagcagagcugccauuauuccgcucauuacugggccgcgcaaggugcuacagguccugugagacucagagguugggaggacccgcgaguagacacagagugagugaagacgucaggagcgauuuucagcgcagagugccauauaauuaccugcagcgcgcguauauuaagcugaaucaacuggaaaaagcgguggaagccgcucauacauuuuuuguagccaaccccgaacauauggaaaugcaacagaauauagaaaacuauagagcuacagcaggaguggaagccuugcagcucgucgacagggaagccaagccgcacauggagaguuacaaugcagguguaaaacauuacgaggcagaugauuucgagauggccauucgacauuuugaacaggcccugagagaguacuuugucgaggauacugaaugcaggacacucugcgaaggcccacagagguuugaggaauaugaguaucugggguacaaggcaggccuguacgaagcaaucgccgaccacuacaugcaggugcuugucugccagcacgagugcgucagagaacuggccacacgccccggaagacuguccccgaucgaaaauuuccugccucugcacuaugauuaucuccaguucgccuacuaccgcguuggugaguauguuaaggcccuugaaugcgcuaaggcuuaucugcucugccacccugacgacgaagacgugcuggauaacgucgacuauuacgaaucacucuuagaugauucuaucgaccccgcaagcauugaagccagggaggaccugacuauguucgucaaaaggcacaaacucgaguccgagcugauaaagagugcggccgaaggacuugguuuuucuuauacagagcccaacuacuggauuagguauggugggcgccaagaugagaaccggguaccaucuggggugaauguagagggcgccgaaguucacggguucagcaugggcaagaaacuguccccuaaaauagaccgcgaucuccgcgaaggggggccgcugcuuuaugagaauauuacauuugucuauaacuccgaacaauugaacggcacccaacgugucuugcuggauaacguccugagcgaagaacagugcagagaacugcauaguguugcuagcggcauuaugcucguuggugacggguaucgggggaagaccucuccccacacgcccaacgagaaguucgaaggugcuacggugcuuaaagcccugaaaaguggauaugaaggccgaguuccccugaaaucugcucggcucuuuuacgacaucagcgagaaagcgcgacggaucguggaguccuacuucaugcuuaacucuacccucuauuuuuccuauacccauauggugugucgcacugcucuuaguggccaacaggaccgccgaaacgauuugucucaccccauacaugcggacaacugucuucuggaucccgaagccaacgaaugcuggaaggagccucccgccuacacauucagggauuacucggccuuacucuauaugaacgacgauuucgaaggaggggaguuuauuuucacugagauggaugccaagacuguaacggccucuaucaaaccaaaaugcgggcgcaugaucuccuuuuccagcggaggagagaacccucacggggucaaagcagugaccaagggcaagagaugcgcgguagcacuaugguucacuuuggauccccuguacagagaacuggagcggauucaggccgaugaggugaucgccauauuggaccaagaacagcagggaaagcacgaacugaauaucaacccaaaggacgagcuauag

SEQ ID NO: 248312 - RNA, 1584 nt, Artificial Sequence
  Description of Artificial Sequence: Synthetic coding sequence
auggagaugcaacagaauaucgagaauuauagggccacagccggggucgaggcucugcaguugguagaucgcgaggccaaaccucauauggaauccuacaacgcaggggugaagcacuacgaggcugacgacuuugagauggcuauuagacacuucgaacaggcucuuagagaauauuucguggaggauacggagugcagaacucucugugagggcccucaacguuuugaggaauaugaguaucuuggcuacaaggcaggacuuuacgaagccauagccgaucauuauaugcaggugcucgugugucagcaugaaugcguucgggaacuggccacuaggcccggucgguugaguccaauugaaaacuuccugccucuccauuaugauuaucugcaguucgcguauuaccguguaggagaguaugucaaagcacuugagugcgccaaagccuaccuguugugccacccagaugaugaagacguacuggacaacguugauuauuaugagucccugcuagaugauagcauugacccugcaagcauugaagccagggaagaucugacuauguucgucaagagacauaaauuggagucugagcucauuaaguccgcugcggagggauuaggcuucucuuauacggagccaaauuauuggaucagguaugggggacgccaggacgaaaaccgcgugccaucuggcgucaacguggaaggagccgagguucauggcuucucuaugggcaagaaacugagcccgaagauagacagagaucugcgggaaggugguccccuccuguacgaaaauaucaccuuuguguacaacucugagcagcuaaacggaacucaacggguucugcuugacaacguuuugagcgaggagcaguguagagaacuucauaguguggcuagcggcaucaugcugguaggcgacggauacagaggcaagaccaguccucacacccccaaugaaaaguucgaaggugccacugugcugaaagcgcucaaaucuggguaugaggggcggguaccacuuaaauccgcaagacuguucuaugacauuagcgaaaaagcccggcguauaguggaauccuacuuuaugcugaacucaacacuauacuuuuccuacacccauauggugugccggaccgcgcucucaggucagcaggacagacgaaaugaccuaucacauccuauccacgcugacaacugucuguuagacccggaggcuaaugaaugcuggaaagagccacccgcguauacuuuccgugauuauucugcccugcuguauaugaaugacgauuuugagggcggagaguucaucuuuaccgagauggaugcgaaaacagugacugcuucgauuaagcccaaaugcggccgcaugauaucuuucagcucagggggggaaaauccacacggcgugaaggcggugacuaaggggaagcguugugcagucgcucugugguuuacccuggauccacuuuaccgggaguuggagcguauacaagccgaugaagucauagcaauucuggaccaggaacagcagggcaagcacgagcugaauaucaauccuaaggacgaacuguag

SEQ ID NO: 248313 - RNA, 4614 nt, Artificial Sequence
  Description of Artificial Sequence: Synthetic coding sequence
augaccaccaaaagaaagauaauuggcagacuggugcccugccggugcuuucgaggcgaagaggaaaucauauccguucuugacuacucacauuguagucuucagcaggugcccaaggaaguguucaacuucgagcgcacucuggaagaacuuuaccuggaugccaaccaaaucgaagagcuucccaaacaguuauucaauugccaagcccugcgcaagcugucaauucccgacaacgaccugagcaaccugccaacaaccauagcaucacugguuaaccugaaggagcucgauauuucaaagaacggggugcaggaauucccggaaaacaucaaguguuguaaguguuuaacaauuauugaagccucgguaaacccgauuuccaagcugccagaugguuucacucagcugcucaaucuuacacagcuguaccugaacgaugcuuuccuagaauuucuuccagccaacuuugggcgucuugugaaacuaaggauccuggaacugcgggagaaccaccugaagacucuccccaaaucaaugcauaaguuagcccaacuggagcgacuagaccuuggcaauaacgaauucggagaacugcccgaaguucucgaccagauucagaaccuucgggaacuguggauggacaauaacgcacuccaggugcugccagguagcaucgggaaacucaaaaugcugguuuaccucgacaugucaaaaaaucggaucgagaccguagacauggauaucucuggaugugaggcacucgaggaucuucugcugagcuccaacaugcuccagcaacugcccgacuccauuggucugcuaaagaaacugacuacccugaagguugacgacaaccaacuuacaauguugccaaauacuaucggcaacuugagucugcuagaagaauucgacuguaguugcaacgaacuggagucccugcccucaacgauugguuaucuacauucucucaggacgcuggccgucgaugagaauuuuuuaccagaacuuccccgcgaaauugggucuuguaagaacgugacuguaaugagccugaggucuaauaaguuagaguuccuccccgaggagaucggccagaugcagaagcugagaguucugaaccuuucugauaacagacugaaaaaucucccauuuaguuucaccaaacugaaggagcuggcagcacucuggcuuucugauaaucagucaaaggcucugaucccucugcagacugaggcacacccagagaccaaacaaaggguucuaacaaacuacauguuuccacaacagccccgcggggacgaagauuuccaaucugauuccgauucauuuaaccccacccuaugggaggagcaacggcaacagcggaugacuguugccuuugaauucgaagacaagaaagaagacgacgagaacgccggcaaggugaaggaccugagcugucaggcccccugggaacggggacaacgggggauaacucugcaaccagcuagacugucuggagauugcuguacccccugggcucggugcgaucagcaaauccaggacaugccuguuccccagaacgacccacaacucgccugggguuguauuagcggguugcagcaggagagaagcauguguacaccacugccaguggccgcccaguccaccacucugccaucacuguccgggcgccagguggagauaaaccucaagcgcuacccuacacccuauccagaagaccugaagaauaugguaaaguccgugcagaaccuagugggcaagccuagccacggugugagaguggagaacucgaacccaaccgcuaauacugagcagacagucaaagaaaaguacgagcacaaguggcccguugccccaaaagagaucaccguggaggauagcuuuguucacccugccaaugagaugaggauuggagagcuacaccccagccucgccgagaccccuuuguacccaccaaagcucguuuuacuuggaaaggauaagaaggagucaaccgacgaaagugagguggauaagacacacugucugaacaacucugucucaagcggcaccuacuccgacuauagcccaucccaagcauccucagguucuucaaauacuagagucaagguaggcagucuacagacuacugcgaaggaugccgugcacaauagcuuauggggcaaucgcaucgcaccaucuuucccucaaccucuggacucuaaaccccuuuuaucacagcgugaagcagugccccccggaaauaucccucagagaccugaccggcugccuaugagcgauacauucacugacaacuggacggauggaagccacuacgacaauacaggguuuguggccgaggaaacuacggcugaaaaugccaacagcaacccacuccugagcagcaaaucgcgcaguacuucuucacacgggcggcggccauuaauccggcaggacagaauugugggggucccucuggaacuggagcaguccacacauagacacacacccgagacugaggugccucccaguaauccauggcaaaacuggacuagaaccccuucuccuuucgaggaccguacugcuuucccuuccaagcucgagacgacucccacuaccuccccacuaccugagcguaaagaacacaucaaagagaguaccgagauacccucaccuuuuucaccaggcguccccugggaguaccacgacagcaacccuaaucgcagucucuccaacgucuucucucagauccacugucgcccagaaucgagcaaagggguaaucucaauuucuaagucgaccgaacgacuuucuccucugaugaaagacauuaaaucuaacaaguuuaagaagucacaaagcauugacgagauagacaucgggaccuacaagguguacaacaucccccuugaaaacuacgcuuccggguccgaccacuuaggcucacacgaaagaccugacaaaaugcucgggcccgagcacggaaugaguaguauguccagaagccagagcgucccgaugcuggacgacgagaugcugaccuauggaagcucuaagggcccccagcagcagaaggcaucuaugaccaagaaggucuaucaguuugaucagucauuuaacccacagggcagcguagaggucaaagccgaaaaacgcauucccccuccauuccagcauaaucccgaguaugugcagcaggcuagcaagaauaucgcuaaagacuugauuagcccaagggcguaucguggauauccucccauggaacagauguuuucuuucagccagccuuccguaaaugaggaugcuguugugaaugcgcaguucgccagucagggugcacgggccggcuucuugagacgcgcugauagucucgugucugccacggagauggcaauguuucggagggugaacgaaccacacgaauugcccccuacagaccgcuauggcagaccucccuauaggggaggccuggaccgacaguccuccgugacaguaacugagagccaauuuuugaaaagaaacgggagauacgaggaugagcauccuucauaccaggaagugaaggcccaagcugggucauuucccgugaagaaucugacacagaggaggccgcuaucagccaggucuuauagcaccgagagcuauggggcaucgcaaacacgaccugugucugcuagaccaaccauggccgcccuguuggaaaagauuccuagcgacuacaaucuggggaacuauggagacaagccaucugauaauucugaccugaagaccaggccuacuccugugaagggagaagagucaugcggaaagaugccagcugacuggagacagcaacugcugcgacauaucgaggcccgaaggcucgacaggaaugcugccuauaagcacaauaccgucaaccugggcaugcuccccuacggcggcauaucugcaaugcaugccggaagaagcaugacacucaaccugcaaaccaaaucaaaauucgaucaccaggaauugccucugcagaaaacaccgucucagcaaaguaauauucuggauaauggccaggaagacgugucccccucaggccaguggaauccauaccccuuaggccggagagacgucccuccggauacuaucacgaagaaggccgguucacacauccagacccuuauggggucucaaucccuccagcauaggagcagagagcagcaaccuuacgaagguaauauuaauaaagucaccauucagcaauuccagagcccguuaccuauucagauuccuucgucacaagcaacgcgcgguccucagccuggacggugccuaauccagacgaagggucagagaucaauggauggauacccggagcaguuuugcguccggaucgaaaaaaacccaggauuaggguucagcaucuccggagggaucucaggccaaggaaaucccuuuaaaccaagcgauaagggcauuuucgucacucgcguccaacccgaugguccagccucaaaucugcugcagcccggagacaaaauccuccaggccaaugggcauucauucgugcacauggaacaugaaaaagcuguacuucuauugaaaucauuccaaaauacuguagaccucgucauucagagggaacucaccgucuag

SEQ ID NO: 248314 - RNA, 1320 nt, Artificial Sequence
  Description of Artificial Sequence: Synthetic coding sequence
augaccccuauuuugaccguuuugauuugccucggucugucucucgaucccaggacacacgugcaggcgggcccacuucccaaacccacgcuaugggcggaacccggcuccgugaucacccagggcucacccgucacacuucgcugucaggguucuuuagagacacaggaguaccaccuuuacagagaaaaaaaaaccgcacuguggaucacucgaaucccucaggaauuagucaagaaaggccaguuucccauacucagcaucaccugggaacaugccgggcgguacugcugcauuuauggaagccacaccgccggacugagcgagagcagcgacccacucgaauugguagugaccggagccuauucuaaaccuacucuuucagccuugccaaguccaguuguaaccucaggaggcaaugucacaauccagugcgauucccaaguggccuucgacggcuuuauuuugugcaaagagggagaggaugagcacccccagugcuugaacucccauucccacgcucgaggcaguagccgagccauuuucagcgucgguccagugucuccuucucggcggugguccuaucgauguuacggcuacgauucccgggccccauacgucuggucccuaccuagcgaucugcugggccuguugguccccggugucucuaaaaagccuagccucucuguccagcccgggccagugguugcccccggagagaaguugacauuucagugugguuccgacgcgggauacgaccguuuuguguuguauaaggaauggggacgugacuuccuucagcgccccggccggcagccucaggcuggacugagucaggccaauuuuacccugggccccgugagucgauccuacgggggccaguauaccuguagcggagccuauaaucucucgucggaguggucugccccuagcgauccauuggauauacuaauuaccggccagauuagagcacgcccuuuucuauccgucagacccggccccacaguggcuaguggagaaaauguaacuuuacuaugccagucacagggaggaaugcauacuuuucugcugacuaaggagggggcggccgauagcccucugagacucaaguccaaacgccagagccacaaguaccaggccgaauuucccaugagcccagugacauccgcccacgcggggaccuacagauguuauggcuccuuaucuagcaaucccuaucuccuuacgcaucccucugacccacucgagcuggucgucucaggggccgccgagacucuuagcccaccccagaacaaaucggauucaaaagcaggcgaauag

SEQ ID NO: 248315 - RNA, 1371 nt, Artificial Sequence
  Description of Artificial Sequence: Synthetic coding sequence
augcaccgcgggcugauucacccacaaucaagugccguaggcggggaugcuaugaccccaauacugaccguccucaucugccuuggacugucccucgacccaagaacacauguucaggcggggcccuuaccaaaacccacgcucugggccgagccuggcucuguaaucacacagggcucacccgugacccuacggugucaaggaaguuuagaaacccaggaauaccaccuguaccgcgaaaaaaaaacugcucucuggaucacgcgaauaccacaggaauuggugaaaaagggacaguuuccuauucugagcaucacaugggagcaugcuggaagauauuguugcaucuacggcagucacacagcggggcuuucggaauccucagauccccuggagcugguggugacaggugccuauucaaaaccaacacucagcgccuugccaucacccguggucaccucaggagguaaugucacgauucaaugugacagucaagucgccuuugacggcuucauccucuguaaggagggagaagaugagcauccucaaugucugaauagccacagucaugccagaggcuccucucgggcaaucuucagcguuggccccgugagucccagccggagguggaguuacagaugcuacgguuacgacucaagggcaccauaugucuggagucucccaucugaucuuuuaggacugcuagucccuggcgucucuaagaaaccaucgcuuuccguccagcccggacccgucguggcaccaggcgagaagcugacauuucagugcggguccgacgcggguuaugaucgauuuguguuguauaaagaaugggggcgcgacuuccuccagcgcccaggaaggcaaccccaagccggucuaucccaagcaaauuucacccuuggcccagugucccgcuccuauggagggcaguacacuuguuccggugccuacaaccuaucuagcgaguggucggcuccuucugacccacuagacauacugauuaccgggcagauacgcgcccgccccuuccugucgguucggccggggccuacaguggcuuccggugaaaacguuacacuccucugccaaagucagggggggaugcacaccuuuuuguuaaccaaggaaggcgcagccgacucaccacugagauugaagucaaaaaggcagucacauaaauaucaagcggaguucccuaugucaccuguaacaucugcucaugcgggcacguauagauguuacggcagccugucguccaacccuuaucuguugacccauccaucagauccccuggaacugguuguuagcggagccgccgagacucugucuccgccccagaacaaguccgacucaaaggccggugaguag

SEQ ID NO: 248316 - RNA, 1098 nt, Artificial Sequence
  Description of Artificial Sequence: Synthetic coding sequence
auggcuaaggucgcaaaagauuugaauccuggcgucaagaagaugucacugggacaguuacagagugcuagaggaguagccugucuaggcugcaagggcacguguucuggcuuugaaccacauucuuggcggaagaucugcaagucaugcaaauguucccaagaagaccauuguuugacgucugacuuagaggacgauagaaaaaucggaaggcugcuuauggauucaaaguauaguacacucaccgcucgaguuaaaggcggagacggaauaagaaucuacaaaagaaacagaaugauuaugacuaaucccaucgcaacugguaaagaucccacuuuugacaccauuaccuacgaaugggcccccccaggggugacccagaagcugggucuacaauacauggaacucaucccuaaagagaaacaaccagucaccggcacggaaggcgcuuucuaucgccgccggcagcuaaugcaucaauugccgauuuacgaucaggaucccagucgaugccggggcuuguuggagaaugaacugaaacugauggaagaguucgugaaacaguauaaaagugaggcucugggagugggcgagguggcacuccccggacagggcggauugccaaaggaagagggaaagcaacaggaaaagcccgaaggcgcugagacaacggcugcgacaacuaauggaagccugucagauccgucuaaagaagucgaguaugugugugagcuuuguaagggugccgcacccccugacucucccguaguuuacagcgacagggcaggcuacaauaagcaauggcauccgacgugcuucgugugcgcaaaauguagcgaaccccucguagaccucauauacuucuggaaggacggugcgcccugguguggacggcacuauugcgagagucugcgccccagaugcucagggugcgaugagauuaucuuugcugaggauuaucagcgcgucgaggaccucgccuggcaccgcaagcauuucgucugugagggaugugaacaacuguugaguggccgggcauauauugucacuaaaggccaacuacugugcccuaccugcucaaagucaaaacgcuccuag

SEQ ID NO: 248317 - RNA, 1602 nt, Artificial Sequence
  Description of Artificial Sequence: Synthetic coding sequence
auggcccugagaaaugugccguucagaagugaggugcugggaugggauccugacucuuuggcggauuacuucaaaaaacuuaacuauaaagauugugaaaaagccguuaaaaaguaucacaucgacggugcuagguuccugaaucugacugaaaaugacauccagaaauuuccaaaacuccggguucccaucuuaucaaagcuuagccaggaaaucaacaaaaacgaggaaaggcgcuccaucuuuacacguaagccucaagucccccgguucccugaggaaaccgagucucacgaagaggauaacggagguuggagcucuuuugaagaagacgauuacgaauccccuaacgaugaccaggacggugaggaugacggggacuaugaaaguccgaacgaggaagaagaagcaccaguagaagaugacgcagacuaugagccucccccgucgaacgaugaggaggcucugcaaaacucaaucuugcccgccaagccauucccaaacuccaacagcauguauaucgaccggccucccaguggaaagacuccccagcagccacccgucccuccgcaacggccgauggcugcucucccacccccacccgcaggucguaaucauuccccacucccccccccacaaacuaaccaugaagagccuaguagaucacgcaaucacaagaccgcuaaacuccccgccccaucuauugaccgaagcacuaaaccucccuuagauagaucucuggcuccauucgacagggaaccuuuuacccucgguaaaaaaccgccauuuuccgacaaacccucaauucccgcugggcggagccugggagaacauuugcccaaaauacagaaaccaccccuuccaccgacaacugagcggcacgagcguagcagcccccugcccggaaagaaaccccccgugccuaaacauggguggggcccugaucgcagagagaaugaugaggaugaugugcaccaaaggccccugccucaaccagcccuccugccuaugucuucuaacacguucccuagucgcucaaccaaacccucuccgaugaacccacuaccuaguucccacaugcccggagcuuucagcgaguccaauuccucauucccacaguccgcuucucuuccccccuauuucucacaagguccaaguaacaggccucccauccgagcagagggacggaauuuuccacugccccuuccaaauaagccuaggccaccaucgccagcugaagaggaaaauuccuugaaugaggaaugguaugugagcuacaucacccggccugaggcagaggcugcccuacgcaaaauuaaccaggaugguaccuuccuaguacgugacagcuccaaaaagaccaccaccaauccuuacguacuuauggugcuguauaaggauaaaguguauaacauacagaucagauaucagaaagagagccagguguaccugcuuggaacaggccugagaggcaaagaggauuuccugucuguaagcgacauuaucgacuacuuccgcaaaaugccgcuacugcuuaucgacgggaaaaacaggggcucgcgcuaccaauguacuuugacacacgcggcuggcuacccauag

SEQ ID NO: 248318 - RNA, 1356 nt, Artificial Sequence
  Description of Artificial Sequence: Synthetic coding sequence
auggaacagugggaccacuuucauaaucaacaggaggauacagauuccugcagcgagucaguuaaguuugacgccagaagcaugacugcacuccuuccucccaacccgaagaauucaccaucccuccaggaaaaacugaagucauuuaaggcugcucugaucgccuuauaucuacuuguuuucgcaguucucauuccucuaauuggaauugucgccgcccagcuccugaaaugggaaacuaaaaacuguagcgucucuucaacuaaugcuaaugauaucacacaguccuugacugggaaagggaaugacuccgaagaggaaaugagauuccaagaaguauuuauggagcauaugucuaacauggaaaagcgcauucaacacauucuugauauggaggccaaucuuauggacacagagcauuuucagaauuuuuccaugaccacagaucaaagauuuaaugacauccugcugcaacugagcacccuguuuucuucagugcaaggccacggcaacgcuauugacgagaucucuaagagucugauaaguuuaaacacaaccuuguuggaucuccaacuaaauaucgagaaccugaaugguaaaauccaggagaauacauuuaagcagcaggaagaaauuagcaaguuagaggaaagaguuuacaauguuagugcggagauaauggccaugaaggaggagcaagugcacuuggaacaggaaauuaaaggugagguuaaaguauugaauaacaucacaaaugaccugcgguugaaggacugggaacauucacagacgcuucggaacauuacacuaauucaagggcccccuggcccacccggugagaaaggcgaccgcggcccgacuggggaauccggaccacgcgguuuuccuggaccuauuggccccccuggacugaagggcgauagaggcgcuaucggcuuuccagggaguagaggccucccaggauaugcugguagaccgggaaauuccggcccaaaaggucagaagggagagaagggauccgguaacacccucacaccuuuuaccaaagugcgccucguggguggcagcgggccacaugaaggccgcguugagauacuacauucugggcaauggggcacaaucugcgacgaccgaugggaaguccgaguagggcaggucgugugcaggucccuuggcuaucccggcguucaggcuguucauaaagcagcacauuucggccaggguacuggccccaucuggcuuaacgaaguguucugcuucggucgggagucuaguaucgaggaauguaagauuaggcaauggggcacccgcgcauguucccacucugaggaugcuggcgugaccuguacccucuag

SEQ ID NO: 248319 - RNA, 1167 nt, Artificial Sequence
  Description of Artificial Sequence: Synthetic coding sequence
auggagcaaugggaccacuuccacaaccagcaagaagacaccgacagcuguucagagucugucaaauuugacgcuagaucaaugacugcauugcucccuccgaacccgaagaacucucccucuuugcaagaaaagcugaaaucuuucaaagcugcacugaucgcucuuuauuuacugguguucgcagugcugauuccucuuauuggcauuguggcugcccaacugcuuaagugggagaccaaaaacuguucggugagcuccaccaacgccaacgauauaacccagucucuuaccggaaaggguaaugauucagaggaggaaaugcgcuuccaagaaguauucauggaacacaugucgaauauggaaaagagaauacagcauauacuggacauggaggcaaaccucauggacacagagcacuuccaaaacuucaguaugacuacagaucaaagauucaaugacauccugcugcagcugucaacacuguuuagcucagugcagggacacgguaaugccaucgaugagauuucuaaaagccugauaucccucaacacuacucugcuggaccuccaauugaauauugaaaaccugaauggaaagauacaggaaaauaccuucaagcagcaggaagaaauaucuaaacuugaggagcggguguacaacguaagcgccgagauuauggcgaugaaggaagagcaaguccaucuagagcaggagauuaagggcgaggugaaaguacucaacaauaucaccaacgaccugagguugaaagacugggaacacucacaaacucucaggaacauuacauugauccagggcccucccggcccgccgggcgaaaaaggcgaccgcggucccacgggugagucugguccuaggggguuucccggacccaucgggccgcccggccucaagggagacaggggugcgauaggauucccgggcaguagggggcugcccggauacgccggcagacccggcaauagugguccuaaaggucagaagggagaaaaaggaagcggcaauacccugagcacugggccaauuuggcuuaaugaagucuucuguuuuggacgcgagucaucaauugaagaaugcaagauccgccagugggggacccgugccuguucccauucagaagacgcuggggucacgugcacacuguag

SEQ ID NO: 248320 - RNA, 1167 nt, Artificial Sequence
  Description of Artificial Sequence: Synthetic coding sequence
auggagcagugggaucauuuccauaaucagcaagaagauaccgacucauguagugaaagugugaaguucgacgccaggagcaugaccgcccuucugccaccuaacccaaaaaacucaccuagucuacaagagaagcugaaaucauuuaaggccgcguugaucgccuuguacuuauugguguucgcugugcugauuccccuaauuggcauugucgccgcucagcugcugaaaugggaaacaaaaaacuguaguguuucaucaacuaaugcuaacgacauaacccaaaguuugaccggaaagggcaaugacucagaagaggagaugagauuccaagaggucuuuauggagcacaugagcaacauggagaaacgcauacagcacauccuggacauggaagccaaucucauggauaccgaacacuuccagaacuuuucgaugaccaccgaucagcgguuuaaugauauccuauuacaacuaucuacucucuuuuccucaguucaaggucacggaaacgcaauagacgaaauuuccaaaagccuuauuucacuuaauaccacacucuuagaucugcagcuuaauaucgagaaucugaauggcaaaauucaggaaaacacguuuaagcagcaggaggaaaucagcaaauuagaggagcggguguauaauguuagugcugagauuauggcaaugaaggaagagcaagugcaccucgaacaggaaaucaaaggugaaguuaaagugcugaacaacauuaccaaugacuugaggcuuaaagacugggagcacagccaaacucuuaggaacauuacccugauccagggaccaccagggccaccuggagagaagggcgacagggguccuacgggcgagaguggaccccgagguuucccaggcccaauaggcccaccaggacugaagggagauaggggggccaucggauuuccggggucacgaggguuaccuggguacgccggaaggccuggcaacucugguccuaaagggcagaagggggaaaaaggguccggcaauacccuauccacuggccccauuuggcucaacgaaguuuucuguuucgguagagaguccucuauugaggaaugcaaaauccgacaguggggcacaagggccugcagucauagcgaggacgccggggucacgugcacgcuguag

SEQ ID NO: 248321 - RNA, 1077 nt, Artificial Sequence
  Description of Artificial Sequence: Synthetic coding sequence
auggaacagugggaucacuuccauaaucagcaggaggauacagacagcugcucugaaagugugaaauucgacgcgaggagcaugaccgcccuguugccuccaaaccccaagaauucgccaucauuacaggaaaaacucaaaucuuuuaaggcggcccuuauagccuuguaucuccucguguucgcaguccucaucccuuuaauugguauugucgccgcgcagcuccugaagugggagaccaaaaauugcucagugucuucaacaaacgcaaaugacaucacucagagccugacaggcaaagggaacgacucagaggaggagaugcgcuuccaggaaguauuuauggagcauaugucuaauauggagaaaagaauccagcauauccuggacauggaggccaaucugauggacaccgagcauuuccagaauuucucaaugaccacugaucagagauuuaacgauauucuccuacaacuguccacucucuucucuuccguccaaggucauggcaaugccauugaugagauauccaagucuuugaucagucuuaacaccacccugcucgaucugcaacucaauauugagaaucugaacggcaagauccaggagaauaccuuuaagcagcaagaggaaauuucuaagcucgaagaacgcguauauaacguuucggccgagauaauggccaugaaggaggagcagguucaccuugagcaggagaucaaaggagaagucaaaguccugaauaacaucacaaaugaucuaaggcugaaggauugggagcacagccagacacucaggaauauuacccucauccaggguccuccugguccacccggagagaaaggagaccggggaccaaccggugaaagcggcccgcggggauuucccgggccgauaggcccacccggacuaaagggcgaucggggugccauuggguuuccaggcucacggggacuucccggguaugcuggacggccuggaaauucugggcccaaagggcaaaaaggagaaaagggcuccggaaauacucuuagaccgguucagcuuacugaccauaucagagcuggccccaguuag

SEQ ID NO: 248322 - RNA, 1410 nt, Artificial Sequence
  Description of Artificial Sequence: Synthetic coding sequence
auguguuaccuguccgccauuaucucuauaaguuuacuuaacaaaaaaccguccauggaacaaugggaucacuuucauaaccaacaggaagacaccgacaguuguucugagagcgugaaguucgacgccagaagcaugacugcucuacuuccacccaacccuaagaacucucccagccugcaggagaagcuuaagagcuucaaggccgcccucauugcacuauaucuucugguuuucgcaguucucauaccauugauugguauuguggccgcccagcuccuuaaaugggagacuaagaacuguagugugucuagcacaaaugccaaugacauaacccaaagccugacagggaaaggcaaugacuccgaggaggagaugagguuccaggagguguucauggagcacaugucaaacauggagaaaaggauacagcacauccuagacauggaggccaauuuaauggauacagaacauuuucagaacuuuucaaugaccacugaccagcgauucaacgacauauugcugcaacuuagcacucuguucuccaguguacagggccacggaaaugcuauugaugaaauaucuaaaagccucaucagccugaauacaacucuucuggaccugcagcuaaacauagaaaaccuaaaugggaagauccaagagaacaccuuuaagcagcaagaagagaucucgaaacuagaagaaaggguauauaacgucucagcagagauaauggccaugaaggaagagcaaguccaccuggagcaggagauaaagggugaagucaaaguguugaauaacaucacaaaugaucugcggcuuaaagacugggaacauucccaaacucuuagaaauauaacacucauccaaggucccccaggccccccaggcgagaaaggugaccgcgggccuaccggggaauccggaccucgcggguuuccggggccuaucggcccuccagguuugaagggcgacagaggcgcuaucggcuuucccggcaguaggggguuaccaggauaugcggguaggcccggcaauuccgggcccaagggccagaaaggagagaagggcuccgggaauacccugacuccuuucacuaaaguacggcugguagggggcuccggcccccaugagggcaggguggagauccugcacagcgggcagugggguaccauuugugacgaccggugggaagucagaguaggccaagucguuugcagaucccugggauaccccgggguccaggcuguucauaaagcugcgcauuucggacaggggacuggacccaucuggcucaacgagguguuuuguuucgggcgagaauccagcaucgaggaguguaaaauccggcaguggggaacucgggcuuguagucacagugaggaugcuggagucacuugcacuuuauag

SEQ ID NO: 248323 - RNA, 195 nt, Artificial Sequence
  Description of Artificial Sequence: Synthetic coding sequence
auggaacaaugggaccacuuucacaaucaacaggaagacaccgacagcugcucagaaucagugaaguuugacgcacgcagcaugacagcccuacugcccccgaacccuaaaaauucccccucauuacaagaaaagcucaaaaguuuuaaagcagcucuuauugcucuguaccuguugguauuugccguguuauag

SEQ ID NO: 248324 - RNA, 399 nt, Artificial Sequence
  Description of Artificial Sequence: Synthetic coding sequence
auggcuaugaaggaagaacagguucaccuugaacaggaaaucaagggcgaagugaagguucugaacaauaucacuaacgaucuccggcucaaagauugggaacacucccagacccugcgcaacaucacauugauucagggccccccagguccucccggagagaagggcgacaggggcccaaccggugagaguggaccucgcggauuuccaggacccauugguccuccgggauugaagggagauagaggugcaauugguuucccagggagccgcgggcugccuggauacgcaggaagaccugggaauuccggcccgaaaggacagaaaggagaaaagggaagcggaaauacacuccguccuguacaacugacagaccauauccgcgcuggucccuccuag

SEQ ID NO: 248325 - RNA, 1143 nt, Artificial Sequence
  Description of Artificial Sequence: Synthetic coding sequence
augagguggcuccugcuuuauuaugcucuuugcuuuucccugucgaaggcuagugcccauacaguugaacucaauaacauguucggccagauacagucaccaggauauccagacuccuauccaagcgacucagaaguaaccuggaauauuacuguucccgacggcuuucguauuaaacuguacuucaugcauuuuaaucuagaaagcuccuauuugugcgaauacgacuauguaaagguggagaccgaagaccaggugcucgcaacauucugugggagggagaccacagauacugagcagacccccggacaggaaguugugcuaaguccgggcucuuucaugagcauaaccuuuagaagugacuucuccaaugaggaaagauuuacaggguucgaugcacauuacauggccgucgacguggacgaauguaaagaaagagaggacgaggaguuaucuugcgaccacuacugccacaauuauauaggaggauacuacugcucuugucguuucggguacauacuucauacugauaaucgaaccugccgagucgaauguagugauaauuuguucacgcagcguaccggugugauuaccuccccggacuuucccaauccauauccaaagagcagcgagugccuguauaccaucgaguuggaagaaggcuuuauggugaaccuacaguuugaagacauuuucgacauagaggaucacccagaagugccaugccccuaugacuacauuaaaauuaaggucggacccaaggugcuagggccauuuugcggcgagaaggcaccggaaccaauuagcacacagucgcauuccgugcugauccuguuucauucugauaacagcggagaaaacagaggauggagacucagcuaccgcgccgccggaaaugaauguccugaacugcaaccucccguacaugggaagauugaaccaucccaagcaaaauacuuuuucaaggaccaggugcuugugaguugcgacaccggcuauaagguacucaaggauaaugucgaaauggauacauuucagaucgagugccugaaagacgguacauggucuaacaaaauucccaccuguaaaaagaaugaaauugaccuagagucagaacugaagagugagcaggucaccgaguag

SEQ ID NO: 248326 - RNA, 2187 nt, Artificial Sequence
  Description of Artificial Sequence: Synthetic coding sequence
augcggugguuacuuuuguacuacgcgcuguguuuuagccuuaguaaggcaagugcucacaccguggaacucaacaauauguucggacagauucaguccccagguuaucccgacuccuauccuuccgacagcgaggugacauggaacauuacugucccugacggauuuaggauuaaacuauacuuuaugcauuucaacuuagaauccucuuaccugugcgaguaugacuacguuaagguugagacugaagaccaaguccuagccacuuucugugggcgugaaacuacagauacugagcagaccccagggcaggaagucguccuaucaccuggcagcuucaugaguauuacauuuagaagcgacuuuuccaacgaggagagauuuacuggguuugacgcucauuauauggccguggacguugaugaaugcaaggaacgcgaggacgaagaacugucuugcgaucacuauugucacaauuacauugguggauauuacugcucguguagguucgguuacauucuacauacugacaaucgaacaugccgcguugagugcagugacaaucucuuuacacagcggacgggcguuauaacaucucccgauuuccccaacccuuaucccaagagcagugagugucuguacacaaucgaacuggaagagggauucauggugaauuuacaguucgaagauaucuuugauauugaagaccauccugaaguuccgugcccguacgacuacaucaaaauuaaggucgguccaaaggugcucggcccuuucugcggugaaaaggcucccgaaccgaucagcacccagagccacagugugcugauucucuuccauagugauaauuccggagaaaaucggggguggcgacucaguuaucgcgcugcuggcaacgaguguccugaacuccaaccuccaguacauggcaagaucgagccuagucaggcaaaauacuuuuucaaagaccaaguccuuguauccugcgacaccggauauaagguccuaaaggacaauguggagauggauacauuucagaucgagugccugaaagauggaacaugguccaauaagaucccaaccuguaagaucguggacugucgagccccuggggaauuggaacauggcuugauaaccuucuccacccgcaauaaucugacaacuuauaagagugaaaucaaauacuccugucaggagccguauuauaagauguugaauaacaacacaggaaucuauacauguucagcucaagggguuuggaugaacaaggugcugggaagguccuuaccaacuugucuucccgaguguggccagccaucccgaucccuucccaguuuaguuaagcguaucauuggagggcguaaugccgagcccgguuuguuuccuuggcaggcccugauaguaguugaagacacaucccgagugccuaacgauaagugguuuggcagcggggccuugcugucagcuucauggauuuugacagcugcucacguacugcgaucccagagaagagauaccacugucaucccagugaguaaggagcacguaacagucuaucugggacugcacgacgugcgugauaaauccggugcggucaacaguucggccgcuagggucgugcugcauccggacuucaacauucaaaacuauaaucaugacaucgcacucguacagcugcaagaaccagucccacucggaccacauguuaugccagucugcuuaccuagacuagaaccagaggggccugcuccccauaugcucgggcuggucgccggaugggggauuucuaauccuaacguuaccgucgacgaaauuauuuccucuggaacaaggacacugucagacgugcugcaguaugugaaguuaccaguggugccccacgcugaguguaagaccucguacgagucucgcagcggcaauuauucugucaccgaaaacauguucugugcaggguauuaugaggguggaaaggauacaugucugggagacucggggggggcauuugugauuuuugaugaccuaucacagcgcuggguaguucaagggcuggugaguuggggcggucccgaggagugugguaguaagcagguuuacgggguuuauacaaaggugucaaacuacguggacugggugugggaacaaauggguuugccucagucuguggucgaaccccaaguggagcguuag

SEQ ID NO: 248327 - RNA, 2100 nt, Artificial Sequence
  Description of Artificial Sequence: Synthetic coding sequence
augagauggcuguugcuguauuacgcacugugcuucucucugucaaaggcuucugcucacaccgucgagcugaacaacauguucggccagauacaauccccuggauaccccgauagcuacccguccgacuccgagguuaccuggaauauaaccgucccagauggauucagaaucaagcuguauuucaugcauuuuaacuuggaaucaagcuaccugugcgaguacgacuaugucaagguagaaacggaagaccagguccuggccacauuuugcggcagagagaccaccgacaccgagcagacuccugggcaggaagucgugcucuccccaggaagcuuuaugucuaucacguucagauccgacuuuagcaacgaagagcguuuuacaggguucgaugcccacuauauggcaguggacguagaugagugcaaagagagggaagaugaagaauuauccugcgaccacuauugccauaauuacaucggcggauacuacugcucuugucgcuucgguuauauuuugcauacagauaaucgcaccugccgagucgaauguagugauaauuuguuuacccagaggacgggagugaucacaucucccgacuucccuaaccccuacccaaaaucguccgagugucuguauacuaucgaauuagaagagggguucauggugaaucuucaguuugaggacauuuuugacauagaggaccauccugaaguuccauguccauaugauuauauuaaaauaaagguggggcccaaaguucucgggcccuucugcggagaaaaagcacccgagccuauauccacucagucccacaguguuuuaauccuguuucacucagacaacuccggcgaaaaccgcggcuggcgucuuucauaccgcgcugcgggaaaugaaugcccugaacuucagccucccguacacgggaaaauugaaccaucccaagcuaaguauuuuuuuaaagaucaagugcuuguuucgugcgacacuggcuacaagguucucaaggauaacguggaaauggacacuuuccaaaucgaaugucugaaggacggcaccuggagcaacaagauaccuacuugcaagauuguugacuguagagccccaggugaacuggaacauggccuuaucacauucucgacccggaauaaccucaccacauauaagucagaaaucaaauacaguugucaggaaccuuauuacaagaugcugaacaacaauacuggaauauacacauguucggcacaaggcguguggaugaacaagguacugggcagaucgcuucccaccugccuuccaguauguggauuaccuaaguucucuagaaaauugauggcacgcauuuuuaacggacgaccugcucagaagggcacaacucccuggaucgccaugcugagucaucugaacgggcaacccuuuuguggagguagucuacucgggucaagcuggauugucacagccgcccauugccugcaucagucacuugauccagaggacccuacccucagggacuccgaucuucugagcccuagcgauuucaagaucauccuugggaagcacuggcgccugcgaucagaugaaaacgagcagcaccuaggcgugaaacauaccacccugcacccccaguaugacccaaacacuuucgagaaugauguugccuuaguggaauuacuggaaucucccguauugaacgcuuucgucaugccuaucugcuuaccagaagggccucagcaagagggcgcuauggugaucguuucuggcuggggcaaacaauuccuucagcgauuuccagagacccuuauggaaauugaaauuccaaucguggaucacucuacaugccaaaaggcuuaugccccucucaagaagaaggucacacgugauaugaucugcgcaggcgagaaagaggggggcaaggaugcuugcgcuggggacuccgguggccccauggugacccugaaccgcgagagaggucagugguauuuggugggcacugugagcuggggagaugauugugggaaaaaagaucgguacggcguguauucauauauacaucacaauaaggauuggauccagcgggugacgggagugcgcaacuag

SEQ ID NO: 248328 - RNA, 1848 nt, Artificial Sequence
  Description of Artificial Sequence: Synthetic coding sequence
augucaauuacauuuagaagcgacuucagcaacgaggaaagguuuacuggcuucgacgcccacuauauggccguggaugucgaugagugcaaagagcgggaggaugaagagcucucaugcgaccacuacugccauaauuauaucgggggguacuauugcagcugccgcuuuggauauauauugcauacggacaaccguaccugcaggguagaaugcagcgauaaucuguuuacccagaggacuggaguaauuaccagccccgacuuccccaaccccuacccaaagaguucagagugucuguauacuaucgaguuagaagaagguuucauggugaaucuccaguuugaggacaucuucgacaucgaagaucauccugaaguuccuugcccuuacgacuacaucaaaaucaaaguuggaccgaaaguccucgggcccuuuugcggagaaaaagcgcccgagccuauuuccacgcaaucucacucuguuuuaauauuguuucauuccgacaacucaggagaaaauagaggauggagacuuagcuauagagcggcuggcaacgagugcccggaacugcagccaccaguccacggcaagauugaaccuucacaagcgaaguauuucuuuaaagaccaaguccugguaagcugugauaccgguuauaaaguucucaaagacaauguggagauggauacauuccagaucgagugccugaaggauggaacuugguccaacaaaauuccaacguguaagauuguugauugucgagccccaggcgaacuggaacacggccuaauuacauuuucuacucggaacaaucugacgacauauaaaagcgagaucaaauauagcugccaggaacccuauuacaaaauguuaaacaauaauaccggaaucuacacuuguagcgcccaggguguguggaugaauaaaguucucgggagaucacuccccacaugucuuccagagugcggccagccaagccggagccugcccucccucguaaagcggauuaucggcggucguaaugcagagccuggucuguuuccuuggcaggcgcuuauugugguggaagacacuucccgcguaccuaaugauaaaugguucggcagcggagcuuugcugagcgccuccuggauccuuacagcugcccacguguuaagaagucagcggagagacacaaccgugaucccaguauccaaggaacacguuacugucuaucugggucugcaugauguuagagacaaaagcggcgcagucaacagcagcgccgcccgcguugugcugcaccccgauuucaauauccagaauuacaaucaugauaucgcuuuggugcagcuacaggaaccagugccucuuggaccucaugugaugccugugugcuugccaagguuggaaccugaggguccagcuccacacaugcucgggcucguugccgggugggguauuucuaacccuaauguuaccguggacgagauuauaaguucagguacaaggacacuguccgauguacugcaauauguuaagcucccagucguuccccacgcagagugcaagacauccuaugagucaagaagugguaauuacuccgugacagagaauauguucugugcaggguauuaugagggaggcaaggauacgugcuugggagauagcggaggggcuuucgugauauucgacgaucugagccagcgcuggguugugcaaggacuaguuuccuggggagggcccgaggaaugcgggucaaaacaagucuauggcguuuauacgaaggucuccaauuauguggauugggucugggaacagaugggucuaccacagaguguggucgaaccccaaguggaacgcuag

SEQ ID NO: 248329 - RNA, 249 nt, Artificial Sequence
  Description of Artificial Sequence: Synthetic coding sequence
auguuuugugcaggguauuacgaagguggcaaagacacuugccugggggauuccgguggcgcguuugucauauuugaugaucugagucaacgauggguagugcaaggacucgugagcuggggcggacccgaagaaugcggcaguaaacagguauaugguguuuauaccaaggugucuaauuaugucgauugggugugggagcagaugggauuaccucaaucggucguggagccccagguggaaagauag

SEQ ID NO: 248330 - RNA, 1443 nt, Artificial Sequence
  Description of Artificial Sequence: Synthetic coding sequence
augagcauaaccuuccgaucagacuucagcaaugaggagagguuuacugguuucgacgcccacuauauggcaguggaugucgacgaaugcaaggagcgagaggacgaagaacucaguugcgaucauuauugucacaauuauauaggcggguauuauugcuccugucgcuuuggauacauccugcacacagauaaucgaaccugccgggucgaauguagugauaaucucuucacccagcgaaccggugugauuaccucccccgacuuuccaaaccccuauccaaagucaucugaaugcuuauauacaaucgaacuugaggagggcuucauggucaaccugcaauuugaggacaucuuugauauugaggaccauccugaagugccaugcccuuacgacuacauuaagauuaaggucgguccuaagguccucggccccuuuugcggcgaaaaagcgccugaaccaaucucaacacaaucccauucagugcuuauucuguuucacucagacaauucuggagaaaaucggggcuggagacugucuuaucgggccgccggaaaugaguguccugaauugcagccuccaguucauggcaagaucgagccaucucaagccaaauacuucuucaaagaucagguccugguaagcugugacaccggguauaaagucuuaaaggauaacguggagauggacaccuuucagaucgaaugucucaaggauggcacauggaguaacaagaucccuaccuguaagauaguggacugcagagcucccggagagcuggaacauggccucauuaccuucagcacucggaacaaucuuacaacauauaagucugaaaucaaguauucaugucaggagccuuacuauaagaugcugaauaacaauaccggaaucuacaccugcucagcucagggcguuuggaugaauaaggucuugggcagaagccuccccacaugccugcccgaguguggacaaccuucacggucucugccaucuuuggugaagcggauaauuggcgggcgcaacgcugagcccggcuuauuucccuggcaggcccuaauagugguggaagacacuagucgcguuccuaacgacaagugguucggaucaggcgcucuucugagcgcaaguuggauucucacagccgcucaugugcuacgaagucaaagaagagacacgaccgugaucccugucucuaaggaacacgugaccgucuaccugggucugcaugaugugagagacaaauccggcgcagugaacagcucagccgcaagaguagugcugcacccugacuucaacauccagaauuauaaucacgacauagcccuaguccagcugcaagagccugugccucugggcccacauguaaugcccgucugccugcccagguuagaaccucccgggggaaggcugggacaucuccaaagucagugcgacuccuag

SEQ ID NO: 248331 - RNA, 834 nt, Artificial Sequence
  Description of Artificial Sequence: Synthetic coding sequence
auguuccccuucuacagcuguuggagaacgggcuugcuauuacuccugcuggccguggccguucgagaauccuggcagaccgaggagaaaacuugcgaucuggugggcgagaagggcaaagaaucagagaaggagcuugcgcuaguaaagcggcugaagccccuguucaauaagucguuugagucuacaguuggacagggcagugauacuuacauuuauaucuuucggguuuguagggaggcuggcaaucauacaagcggagcgggcuuggugcaaauaaauaagucuaacggcaaggaaaccgugguaggucgccugaacgagacgcauauauucaauggcaguaacuggaucaugcuuaucuauaaaggcggagacgaguacgauaaucacugugggaaggagcagcgacgugcaguagugaugauaucuugcaauagacauacccuggcagacaauuuuaacccugugagugaggaacgcggaaaaguccaggauugcuucuaucuuuuugagauggauucuagccuggcgugcaguccagaaaucucccaucugagcguuggcucaauccugcucgugaccuuugccucucucguugccgucuacguaguugguggguuuuuguaucagaggcugguagucggagcaaaaggaauggaacaguuuccacaucucgcguuuuggcaagaucugggaaaucugguugccgaugggugcgacuucguauguaggucaaagccccgcaauguacccgcugccuaucguggcgugggcgacgaccaacugggggaggaguccgaggaaagggacgaucaccuccugccaauguag

SEQ ID NO: 248332 - RNA, 3942 nt, Artificial Sequence
  Description of Artificial Sequence: Synthetic coding sequence
augagcggauggcgcuaucuuauaugcguuucuuuccugcugacaauacuuuuagaauugacuuaccagggucccccuguacccgccagcucaaguaccaaacugcugaugacuucuuauucgaugcggagcaccgugguaucccgauaugcacacacucuggugaccuccgugcuauucaauccucaugcugaagcccacgaggcaauuuuugaccuggauuugccacaccuggcguucauuagcaauuuuacgaugacaauuaauaauaagguguauauugcggagguaaaggagaaacaccaagcaaagaagauuuaugaggaagcacaccagcagggaaagacagcagcccauguaggcauccgcgauagggaauccgagaaguuccggauuagcacaucauuagccgcagggacagaaguuacauuuucauuagcauacgaagaacugcuacaacgacaucaaggacaguaucagcuggucgugucacugagaccgggccaacuggucaaacgccucagcauugaaguaacggugagcgaacguacggguauuaguuacgugcauauccccccacugcgcacuggacggcuccggaccaaugcucacgccucugaggucgauuccccucccucgacgcguauagaaagaggagaaaccuguguacgaauaacuuauugucccacauugcaggaccagagcaguauuagcggcaguggaauuauggcggacuuuuuggugcaguacgaugucguuauggaggacauuauuggggaugugcagauuuaugacgauuacuuuauccauuauuuugcuccccgcggacuuccgcccauggaaaagaauguagucuucguuaucgacgugagcuccuccauguucgguacuaagauggaacagacuaaaacagccaugaacgucauucuauccgaccuccaggccaacgauuacuucaauauuauuucguucagcgacaccguuaauguguggaaggcuggcgggagcauacaggccacuauucagaaugugcacagugcaaaagauuaucuccauugcauggaggccgacggauggacagacgugaauagugcucuccuggcugcugcuuccgugcucaaucauuccaaucaggagccgggccgcggcccuucuguagguaggauuccuuugauaauuuucuuaacugacggagaacccacugccggcgugaccacucccagugugauucuguccaauguucggcaagcucugggccaucgcgugucccuauuuucgcuggccuucggugaugacgccgauuucacccuacugcgacgccuuagccuugagaaucgcggaauugccagaagaauuuacgaagacaccgaugcugcucugcaacucaaagggcucuacgaagaaauauccaugccuuugcucgccgacguucgucugaacuaccucggagggcugguuggagcgagcccuugggcaguguuuccaaauuauuucgggggcagcgagcugguaguagccggccaaguucagcccggaaagcaagaauuaggaauccaucucgccgcgagggggccuaaggaucagcugcugguggcccaccacuccgaaggcgcaacuaacaauucccagaaggcuuuuggguguccaggcgagccugccccaaacguagcacacuuuauaagacggcucugggcauaugugaccauuggagaacuacuggaugcucacuuccaagcuagggauacaacaacuagacaccuccucgcagccaagguccugaaucugucucuugaguacaacuucguaacuccuuuaaccagccugguaauggugcagccuaaacaggccuccgaggaaacuagacgacagacuucaacuagcgcaggucccgauacuauaaugccaucuucaagcucaagacacggauugggggucucaacagcgcagccugcauuagugccuaaggucauuucuccgaaguccagaccuguaaaaccgaaguucuaccuguccuccacuacaacagccucaacaaaaaaaaugcugucaucuaaagaguuagagccacucggggagucuccccauaccuuaucaaugcccaccuacccgaaagcaaaaauuccugcgcagcaagacucaggaacguuagcucagccaacccuaagaacaaaaccgaccauucuggugccuaguaacucagggaccuuacuuccucugaaacccggcucccucucccaucagaaccccgacauucugcccacaaacagcagaacucaggugccuccagugaagccuggaauaccagccuccccuaaagccgacacagucaagugcgugacaccccugcauagcaagccuggcgcuccuucccauccacaacucggagcacuuacaucgcaagcaccaaagggccuuccacagucaaggcccggaguaagcacucuccagguuccaaaauaucccuugcacacccgcccucguguuccugccccuaagacacgaaauaacaugccccaucugggcccugguauccugcuauccaaaacccccaagauccugcucucccucaagcccagcgcgccgccccaucagaucuccacaucaauuucacugucuaaacccgagacaccaaauccccauaugccacagaccccauuaccaccgcgcccggacagaccuaggccuccucuccccgagucacugaguacuuuuccaaacacaauauccucaaguacuggaccaaguuccaccacaacuaccuccgugcugggagagccccuuccuaugccuuuuacaccgaccuuacccccuggcagguuuuggcaccaguaugaucugcucccugguccucagagaaccagacaaguccugggaccaucuaggccuggaguucccacaaugaguuugcugaacucuucccgcccgacccccgaggguagcccucccaauuugccgauucuccuuccgagcucuauacugccugaggcuauuucauugcuucugcucccggaagaacuagaacugcugucugaguccaugguggagucuaaguuuguagagucccucaaccccccagcauuuuauacauuucuuacgccugaugaagacgguagccccaacugggacggaaauagugaagagauccucggcggagcuggcggaagcauggagucucagggcagcucuguuggccuggccaagggaacauugcccucaauuuucaccuuuagcagcucuguggacggagacccacacuuugugauccagauaccccauagcgaagaaaagaucugcuuuacccucaacgggcacccaggagacuugcugcagcugaucgaggaccccaaagcuggacugcaugucuccgggaagcugcucggcgcuccuccccgaccuggccauaaggaccaaacacggaccuauuuucaaauuauuacugucacaacagauaagccacgcgccuacacuaucaccaucagccggagcagcauuagccucagaggagagggaacacucaggcuuucaugggaccaaccagcucuccucaaacggccucagcucgaacuguaugucgcagccgccgcuaggcugacccucagauugggaccguaccuagaguuucucguauugcgccauagguaccgccauccgucaacccuucagcugccacaccucggauuuuacguggcuaacggcuccgggcugucuccuagcgcucgcggccugauagggcaauuucagcaugccgauaucaggcugguaacuggacccaugggacccugcuugcgccgacaccauggcccugacgugccuguuauucucggcaaaagacuccuuaaggacucaccgaggcuuuugccuagaugggccagcugcuggcugguuaaaagaucacacguggaacugcuacugggccaccccuaucuuucuuacguucuuuag

SEQ ID NO: 248333 - RNA, 804 nt, Artificial Sequence
  Description of Artificial Sequence: Synthetic coding sequence
augaugagcaguaagcccaccagucaugcggaagucaacgagaccaucccaaauccguacccucccaguaguuucauggcuccuggguuccaacagccccucggcucuauuaacuuggagaaccaggcacagggcgcgcaacgcgcucagccauacggaauuaccuccccaggcaucuuugcuuccagccaacccggucagggaaauauucaaaugauuaaccccucugucggaacagccgugaugaauuucaaggaagaggccaaagcacuaggggucauucaaauuauggugggccugaugcauauuggauuugguaucgugcuaugccuuaucucuuuuucauuccgugaaguucucggauuugcaagcaccgcuguuauuggcggauaccccuucuggggcggcuuaagcuuuaucaucagcgguucccugucaguguccgccucuaaggaacuaagcagaugccuugugaaggguagucucggaaugaauauaguaucaucuauacuugcauucaucggagugaucuuauugcuaguggacauguguaucaaugggguugcuggccaggauuacugggccgucuugucugggaagggaauuucugccacacuaaugaucuucuccuuacuggaguuuuuugucgccugcgccacggcccauuuugcaaaccaggccaacacaacaacaaauaugucuguucuggugaucccuaacauguaugaauccaaccccguaacuccagccucaagcagugcaccgccuagauguaacaacuauucagcgaacgccccaaaguag

SEQ ID NO: 248334 - RNA, 876 nt, Artificial Sequence
  Description of Artificial Sequence: Synthetic coding sequence
auggaaagaaagaggugggagugccccgcguuaccccagggcugggagagggaggaggugccccgucguucagggcuuuccgccgggcaucgagauguguuuuauuacucccccagugguaagaaauucagguccaaaccacaguuagcucgguaccugggcggaucaauggauuuguccacauucgauuuccguacaggcaagauguugaugagcaagaugaacaaaagcaggcagcgcgugcgcuacgacucauccaaucagguaaaagggaagcccgaccugaauaccgcccuuccagugagacagacugcauccauuuucaaacagcccgugacuaaaauuaccaaccauccuucaaacaagguuaagagcgacccucaaaaggccgucgaccaacccaggcagcuguucugggaaaagaagcuuucaggccucaaugcauucgauaucgccgaggaguugguaaagaccauggaucugccuaagggucugcaaggggugggcccaggcuguaccgaugagacccuucugagugcaauagccuccgccuugcauacauccacuaugccaaucaccggccagcugagugcggccguggaaaaaaacccuggaguguggcugaauaccacccagccccuguguaaagccuuuauggugaccgacgaagacaucagaaaacaggaagaacuggugcagcagguucgaaagagacuagaagaggcccuuauggcugauaugcucgcacauguggaagagcuggccagagacggagaggccccucuugauaaagcuugugcagaggaugaugacgaagaggaugaggaagaagaagaggaagagccugacccagauccugagauggagcacguguag

SEQ ID NO: 248335 - RNA, 522 nt, Artificial Sequence
  Description of Artificial Sequence: Synthetic coding sequence
augucccugcuuggaccaaaaguacuacuguuccucgcugccuuuauuauaaccuccgauuggauccccuuaggcgugaauagccagcgaggggaugaugucacacaggccacgccggagaccuucaccgaagaccccaaccuggugaaugauccagccaccgaugagaccguccuugccguacuugccgauauugcccccucuacugacgaccuugcuucacugucagagaaaaacaccaccgcugaaugcugggacgaaaaguuuaccuguacucgucucuacucugugcaccgcccuguaaaacaaugcauucaccagcucuguuucaccagucugagacggauguacauagucaacaaagaaauuugcucuagacuugucugcaaagagcaugaggcuaugaaagaugaauugugcagacagauggccggucugccccccaggcgucuccgacguagcaacuauuuuagacugccuccuugcgagaauguggaccuccagagaccaaauggauuauag

SEQ ID NO: 248336 - RNA, 492 nt, Artificial Sequence
  Description of Artificial Sequence: Synthetic coding sequence
auguccuuacucgguccuaaggugcuucuauuccuggccgcauucauaauuacaucugauuggaucccucucggggugaauucccagcgaggcgacgaugugacucaggccacucccgaaacguuuacagaggacccuaaucucgucaaugaucccgcaacagaugagacaguucuugcagugcuggcagauauagcuccgucgaccgaugaccuggaauguugggacgagaaauucacuugcacccgcuuauacuccgugcaccguccugugaagcaauguauucaucaguuguguuucaccucccuucgaagaauguacaucgucaacaaggaaauaugcucacgccuggucugcaaggaacacgaagccaugaaagaugaauugugucgacagauggccgggcuccccccuaggaggcucagaagaaguaauuauuuccgccuuccacccugugaaaauguggauuugcagcgccccaacggacuguag

SEQ ID NO: 248337 - RNA, 447 nt, Artificial Sequence
  Description of Artificial Sequence: Synthetic coding sequence
augucacuacugggucccaagguguuacuguuccucgcugcauucauaauaacauccgauuggauuccauuaggcguuaacucacagcgcggggaugacguuacccaggcaacgccagaaaccuuuacggaagauccuaaccuggucaaugauccagccaccgacgagacagagugcugggaugagaaauuuacuuguacacgcuuguauagcguacacagaccugucaagcaguguauucaccagcugugcuuuacuagccuuagaagaauguacauaguuaacaaagaaaucugcagccgcuugguuugcaaggagcacgaagcuaugaaagacgaguugugccgccaaauggcaggacuucccccacgacgguugcguagguccaauuauuucagacugccacccugugagaauguggaccugcaacgaccaaacggccuguag

SEQ ID NO: 248338 - RNA, 492 nt, Artificial Sequence
  Description of Artificial Sequence: Synthetic coding sequence
augucucuguuggggccuaagguguuacuguuucuagcugcuuucauaauuacaagugauuggauuccacuggguguuaauucucagagaggagaugacgugacucaagcaacucccgaaacauuuacugaggaucccaacuuggugaacgacccagccaccgacgagacgguucuggccgugcuagcagacauugccccaucaaccgaugaccuggaauguugggaugagaaauucaccugcacaagacuguacagcguacaccgccccgucaaacaguguauucaccaauuauguuucacuucccucagaaggauguacauugugaacaaagagauauguucaaggcugguguguaaagagcaugaagccaugaaggacgagcuguguagacagauggcaggucuccccccccgacgguugcgccguuccaauuacuuuagacucccaccuugugagaacguggacuugcaaaggccaaacggguuguag

SEQ ID NO: 248339 - RNA, 276 nt, Artificial Sequence
  Description of Artificial Sequence: Synthetic coding sequence
augagucuccuaggacccaagguguuauuauuucuggccgcauuuauuauaaccucugauuggaucccccugggggugaauagccagcgaggggaugauguaacucaagcuaccccugaaacuuuuacagaagacccaaaccucguuaacgaucccgcuacagaugagaccguguuagccguucuugcggacauugcuccuaguaccgacgaucucgcaucguuguccgaaaaaaacaccaccgcggaaugcugggaugaaaaauucacguguuag

SEQ ID NO: 248340 - RNA, 468 nt, Artificial Sequence
  Description of Artificial Sequence: Synthetic coding sequence
augguggaucucacccagguuauggacgacgaaguuuucauggcguucgcuaguuacgccacaaucauccucaguaaaaugaugcucaugucaacugccacagccuuuuauagacuuaccaggaaggucuuugccaauccugaggacugcgucgcauuugggaaaggagagaaugccaaaaaguaccuucgcacugaugaucguguugaaagggugcguagagcucaccuaaacgaucuggaaaauaucauucccuucuugggcaucggccugcuuuauucacucaguggaccagauccuucgacugccauccuccacuuucgccucuucgucggagcaagaauuuaccauacuauugccuacuugacuccauuaccacagccuaaucgcgcccucucauuuuuuguaggguacggagugacccugagcauggcauauagacugcugaaauccaaacucuaccuuuag

SEQ ID NO: 248341 - RNA, 4395 nt, Artificial Sequence
  Description of Artificial Sequence: Synthetic coding sequence
auguucaguuuugucgacuuaagacugcucuugcugcuggcagcgacagcacugcugacacauggacaggaggagggacaagucgaaggacaggacgaagauauccccccuaucacaugcguucaaaacggguuacgguaccaugaccgugacguguggaagccagagccaugccguauuugcgugugcgacaacgguaaagugcugugcgaugacgucaucugcgaugagacgaaaaacugcccuggggcagaagucccagaaggcgaguguugucccgugugcccugauggcucggaguccccuacagaucaggaaacaacagggguggaaggcccuaaaggggauaccggcccucgggggccccgggguccagcaggcccaccagguagggacggcauuccagggcagccaggcuugccugguccgcccggaccccccggcccucccggcccacccggauugggaggaaauuucgcuccccaacugagcuacggguaugaugaaaaguccacgggaggcauuagugugccaggcccaauggguccauccggcccccgagggcuucccgggcccccuggggcacccgguccacagggcuuucaggggccacccggcgaaccgggggaaccgggugcuagcgggccuaugggaccaagaggccccccugguccccccggaaagaauggugaugauggggaagcaggcaaaccuggacgaccuggggagcgcggucccccagggccacagggugcgcggggccugccugggacugcgggacuaccuggcaugaaaggccaccgaggcuucucggguuuagacggagcgaaaggcgacgcaggaccugcuggaccuaaaggagaaccuggaucgccuggggagaauggggccccaggccaaauggggccaaggggccugccgggggagaggggacgcccgggugccccgggaccggcuggugcgcgcggaaacgauggagcuacgggcgccgcuggcccaccuggcccuaccgggccugccgguccucccggguuuccuggugccgugggcgcuaagggggaagcaggaccccaagggcccagaggaagugaaggcccucaaggcgugcgaggcgagccaggcccccccgggccagcaggugcagcgggucccgccgggaacccuggcgccgaugggcaacccggugccaagggcgcuaacggugcgccugguauagcaggagcaccaggcuuuccaggggcccggggcccuucaggcccucaaggcccaggaggccccccuggccccaagggaaacucuggggaaccuggggccccuggaucaaaaggugauaccggcgccaaaggcgaaccggggccugugggugugcaagguccccccggacccgcuggcgaagaaggcaagcggggcgcacgcggugagcccggcccuaccgguuugcccggaccuccuggggagagagggggcccugggucacgcggauucccgggcgcagauggaguggcagguccgaaggggccugcuggcgaacgugggagcccaggcccagccgggccgaaagguucuccgggagaggcuggcaggccuggggaggcuggguugccuggcgccaaaggacugaccggaaguccuggguccccugggcccgacggaaaaaccggaccgccagguccagccggucaggauggaaggcccggcccacccgguccucccggagcaaggggacaggccggcgucaugggcuuccccggcccaaagggagcagccggugagccuggaaaagccggggaaagggggguaccagggccaccuggcgccgugggcccugcagggaaagauggcgaggcgggggcucagggacccccgggaccagcuggcccagcuggugagcgcggagaacaaggccccgcaggguccccaggcuuccagggucuaccuggccccgcaggaccccccggagaggcuggcaagcccggagaacagggagucccaggcgaucugggagcgcccggucccagcggggcgagaggggagagaggcuucccaggcgaaagaggcgugcaaggaccaccuggacccgcuggcccucgcggcgcgaauggggcuccaggaaacgauggugcuaagggcgaugccggagcucccggagcucccggaucucagggagcucccggacuccaggggaugcccggagagcggggagccgcugggcuaccugggcccaaaggagauagaggcgaugcaggaccuaagggggcugaugggucaccaggcaaagacggcgugcgggggcugaccgguccuaucggcccucccggaccugcuggagccccaggcgauaagggcgaaucugguccaaguggacccgccggucccacuggagcccgaggcgcuccaggagaccgcggcgagccagggccaccugguccugcagguuuugccggaccuccaggugcggacggacagccuggagcuaagggcgagccuggcgacgcaggagccaagggcgacgcgggaccaccagguccagccggacccgcagguccgccgggaccuaucgggaaugucggagcaccuggcgcaaaaggcgcaaggggcuccgccgguccacccggcgcaaccggguuccccggugcugccggacgaguggguccuccaggccccucagggaaugcagguccaccagguccuccugguccggcaggcaaggaaggaggaaagggaccucgaggugagacggggccugcuggucgucccggagagguaggcccgccaggcccucccggcccagcgggugaaaaagguuccccuggcgccgauggcccggcuggcgcccccggaaccccuggcccacagggcauugcaggccaaagaggggucguaggacuaccaggacagcgaggcgaaagagguuuccccgggcugccaggccccuccggggagccagggaaacaaggacccuccggagccagcggggagcgaggcccacccggaccaaugggacccccaggccuggcaggaccucccggggaguccgggagggagggagcaccaggcgccgaggggucgccuggaagggauggaucaccaggagcuaagggcgauaggggggagacagggcccgccgggccccccggugcuccuggagccccaggcgcaccagggcccgugggcccagccgguaaauccggcgaucgcggugagacagggcccgcaggucccacaggacccguggggccuguuggagcccgcgggccugcagggccucaaggaccaaggggcgacaaaggagagaccggcgaacagggggaucggggcauuaaggggcaccggggcuuuuccggccuccaggguccccccggcccuccagguagucccggagaacagggaccuucaggggcaucuggcccggccgguccucgugguccaccuggauccgccggagcacccggcaaggaugguuugaacggucugcccgguccuauuggaccgcccggcccccgggggagaaccggagacgcggguccagucgggccaccuggcccaccagguccaccaggccccccuggcccgccgucugccggcuuugauuucaguuuucuuccacagccaccccaagagaaagcucacgacggcggcagauauuaccgggccgaugacgccaacguagugagagacagagaucuggaaguugauacaacacugaaaucacucucacaacaaaucgaaaauaucagaucacccgaaggaucuagaaaaaacccagcccggaccugucgggaccucaaaaugugucacagcgacuggaagucaggggaguacuggaucgaccccaaccagggaugcaaucuugacgccauuaaaguguuuugcaacauggagacuggagagaccugugucuaucccacucagcccucaguggcccaaaagaauugguacaucuccaaaaauccuaaagacaagcgccauguaugguucggugaaagcaugacugauggcuuccaguucgaauacgggggucaaggaucugacccugccgauguugcuauucagcuuacuuuucuccguuugaugucaaccgaggccucgcaaaauauuaccuaucacuguaaaaauagcguggcauacauggaccaacagacaggcaaucugaaaaaagcucugcugcugcagggcucaaacgaaauagagauccgcgccgaggggaauuccagauuuaccuacuccgugacuguagacggguguaccucacauacaggagccuggggaaaaacugugaucgaguacaagacuaccaaaaccagcagacugccaauuaucgacguggccccacucgacguuggcgcgccugaucaagaauucggauucgauguaggcccuguguguuuuuuguag

SEQ ID NO: 248342 - RNA, 606 nt, Artificial Sequence
  Description of Artificial Sequence: Synthetic coding sequence
auggccgcacggacugcauuuggggcaguauguagaagguuauggcagggauugggaaauuuuucagugaauacgaguaagggcaacaccgccaagaaugggggccuccuccuuaguacuaauaugaaguggguucaguucuccaaucuacauguggacgugccaaaggaccugacaaagcccguggugaccauuagugacgaaccagauauuuuauacaaacggcuguccgugcucguuaaaggacacgauaaagcaguguuggauuccuaugaauauuuugcuguccuggccgcuaaggaguuaggaaucucgaucaagguccacgaaccuccacggaaaauagaacgguucaccuuacugcagaguguucacaucuacaaaaagcacagagugcaauaugagaugaggacuuuguauaggugucuagaacuugagcaucugacaggauccaccgcugacgucuacuuggaauacauucagcgcaauuugccagaagguguggcgauggaagugacaaagacacagcuggagcagcuccccgaacauaucaaagagcccauuugggaaacccugucugaggaaaaggaagaaucaaaauccuag

SEQ ID NO: 248343 - RNA, 972 nt, Artificial Sequence
  Description of Artificial Sequence: Synthetic coding sequence
auggcugccgccgcccuaccugcuugguugagcuuacaaaguagggccaggacuuuacgcgcguuuucgaccgcgguguacuccgcgacccccgugccuaccccuagccugcccgagcgaacaccaggcaaugaaaggccacccagacgaaaagcacugcccccaaggacugagaagauggcaguagaucaggauuggccuucgguguacccugucgcagcgcccuucaagccaucagcuguaccacuuccaguucgaaugggcuauccagugaaaaaaggggucccuauggcuaaagaagggaaucucgagcuccugaaaauccccaauuuccugcaccucacccccguugcaauaaaaaaacacugcgaagcucugaaggauuuuugcaccgaguggcccgcagcccuggauagugacgagaagugugaaaagcauuucccuaucgaaaucgacuccaccgacuacgugucuagcgguccuucuguacgcaauccccgggcacgcguaguggugcuccgagugaagcuguccagucugaaucuagaugaccacgcaaagaaaaaacuuauuaaauugguaggcgagcgcuacugcaagaccacagauguucugacaaucaaaaccgauagaugcccccuaagaagacagaauuacgacuacgcaguguaccuguugaccgugcuauaucacgaaucguggaauaccgaagaaugggaaaaaucgaagaccgaagcagacauggaagaauauaucugggagaauagcaguagcgagagaaacauauuagaaacacugcuccagaugaaggccgcugaaaaaaauauggagauuaauaaggaagagcuccugggcaccaaagaaauugaggaguacaagaagucuguggucagcuugaagaaugaggaagaaaaugaaaauuccaucagccaauauaaagaaagugugaagaggcuacugaacguaaccuag

SEQ ID NO: 248344 - RNA, 1797 nt, Artificial Sequence
  Description of Artificial Sequence: Synthetic coding sequence
augcucccugauuuccccuccccuaguaccugggccccuggacuucuacugccauccggaccagccuugcucagcccgucaguucugcaagacucucuuagcuuaggucgaagugaacagccucauccaauauguuccuuucaagaugauuuccaagaguuugagaugaucgaugauaaugaagaggaggaugaugaggaugaggaagaggaggaagaagaggaagaaggagauggagaagggcaagaagguggugaucccggaagugaggcacccgcuccgggcccccugauuccuagcccuuccguugaagaaccacauaagcacaggcccacaacccuuaggcucaccacacucggagcacaagacucccaagacccugaagcagcggcuggucccgguggcguggagcucguggauauggaaacccugaauccgacccgggauaccaucaccccccucugggccgccccuggacgcgccgcccggcccggaagagcuuguagugccgccugcagcgaggaagaagacgaagaggaugacgaggaggaggaagaugccgaagacucggccgggucucccggcggucgcggcacaggaccuagcgcaccgcgcgacgcaucucuuguuuaugacgcagucaaguauacuuugguagucgacgagcacacacaguuggaguuggucucucugagaagaugugcaggccugggacaugacuccgaagaagauaguggcggggaagccucugaagaggaggcuggggcagcucuucugggcgguggacagguuucaggcgauacguccccagacuccccagaucugacauuuucuaaaaaguucuuaaaugucuucguaaacagcacgucucggucuucuucuacugaaagcuuuggccuguuuucaugucuggugaauggagaggagcgggaacagacccaucgagcuguguuuagauucauuccacgccauccagacgagcucgagcuggacgucgaugauccugugcuuguugaagcagaggaggacgacuucugguuccgcggguucaacaugcggaccggagagcgagguguguuccccgccuucuacgcccacgccgugccuggaccagcaaaagaccuccugggguccaaacgaaguccgugcugggucgagcgguucgauguccaauuccuugguagcguggaggugccuugccaccagggcaacggcauccugugugccgcuaugcagaaaauugcgacagcacgcaaacugacugugcaccuuaggcccccagcuaguugcgaucucgagaucucuuuacggggcgugaagcugagccugagcggaggggggccugaguuucaaagaugcucccacuuuuuccagaugaagaacaucucauuuugugguugccacccucgcaacaguugcgaagcaccucagggagcugcuuuucagugggaacgaggcguggacagaaagagggugcuucagacacgagguaauguucagccucaccuaggcgcuggccagggggcagcccugaauagagcaacggaggguuccagcacaggaagcgagaagggugaauggaccccacuuguaaucauggagcugacacagucgguuaauucauguuacuucggauuuaucaccaaacacccacuccugaguagauucgcgugccacguguucgugucacaggagagcaugcguccaguugcccaauccgugggucgcgcuuuuuuggaauacuaucaggaacaccucgcuuaugcaugucccacugaggacaucuaccuggaauag

SEQ ID NO: 248345 - RNA, 3357 nt, Artificial Sequence
  Description of Artificial Sequence: Synthetic coding sequence
auggagccgagccgcgcauuauugggguguuuggcauccgcagcugcagccgcuccuccaggcgaagauggugcaggcgcuggggcagaggaggaagaggaggaagaagaggaagccgcagccgccgugggccccggagaacuggggugcgacgcaccacuuccuuauuggacggccguguuugaauaugaagcugcaggcgaagacgagcucacguugcgucugggugauguugucgagguucugucuaaagauagccagguaucuggggacgaaggaugguggacuggucagcugaaucagagagucggaauuuuucccucgaacuacgucacaccuaggagugcauucaguagccggugccaacccggcggcgaggaccccagcugcuacccuccuauucagcugcuugagaucgauuucgcugaguugacccuggaagaaaucaucgggaucgggggcuucggaaaaguguaccgggcuuucuggaucggcgaugaaguggcagugaaggccgcaagacacgacccugacgaggauauuagccaaacuaucgagaauguaaggcaagaggcuaagcucuucgccaugcugaagcacccuaauaucaucgcucugaggggcgugugucucaaggagccaaaccugugucuuguuauggaauucgcucgaggcggaccccugaauagaguucugucugggaagagaaucccaccagauaucuugguaaacugggcagugcagauagcccgcgggaugaauuaccuucaugaugaagccaucgugcccauuauacacagggauuugaagucauccaacauauugauuuuacaaaaggucgagaauggcgaccuaagcaacaaaauccugaagauuacugauuuuggccucgcuagggaguggcaucgaaccacuaagauguccgcugcuggcacauaugcuuggauggccccggaagucaucagggccuccauguucuccaagggcagcgauguuuggaguuacggaguguugcugugggaacugcucacuggcgaggugccauuccgcggcauugauggguuggcggucgccuaugggguggcgaugaacaaguuagcccugcccaucccuucaacuugcccagagcccuucgcaaagcugauggaggacugcuggaaccccgacccacacuccaggccaucuuucacaaacauucuggaucagcugacaaccaucgaggagagcgguuuuuuugagaugccaaaggacucauuucacugucuccaggauaauuggaagcaugaaauucaagaaauguucgaccagcuuagagcaaaggagaaggaacuccguacuugggaagaagagcugacuagagccgcuuuacagcagaagaaccaggaggagcugcuacgccguagagaacaggagcucgccgaacgggaaaucgacauccuggagcgcgaguugaacaucauaauucaccaauugugccaggagaagccccgcgucaaaaaaaggaaagggaaguuuaggaagucccgcuuaaaacuuaaagacggcaaucgcauuucucugcccagcgauuuucagcauaaauuuacaguccaggcaaguccgacuauggauaaacgaaaaucuuugauuaacagcaggaguucccccccugcaucaccuacuaucaucccaagguuacgggccauccaguugacgccgggcgaguccucaaagacuuggggacgguccucagucgugccuaaggaggagggugaggaggaggagaagcgggccccaaaaaagaagggaaggacuugggggccgggcacguuaggucagaaggagcucgccucuggugacgaaggcuccccgcagcgacgggagaaggccaaugguuuaaguacaccauccgagucuccccacuuccaccugggacuuaagucucuggucgacggguacaaacaguggaguuccucugcacccaaucuggugaaagguccccguagcucuccagcauuaccuggguucaccucacucauggaaauggcauuauuagcugcauccugggugguaccuaucgauaucgaagaagaugaagacagcgagggcccuggcagcggugagucuagauuacagcauucuccgagucaaucguaccuaugcauaccauucccuaggggugaagacggggacggucccucguccgauggaauccacgaagagccuacaccggugaauuccgccacuuccaccccacaacugacaccaaccaacucuuugaagcgcggcggggcucaccaccgcagaugugaaguggcccuucugggguguggugcaguucucgccgccaccggccucggauucgaccucuuagaggccgguaagugccagcugcugccucucgaggagccagagcccccagcaagagaagagaagaagcgucgggagggacuuuuccaacgcagcucucgucccagacgcagcaccucaccuccaucaagaaagcucuuuaagaaggaagaaccuaugcuuuugcuuggugacccuucagccucccuuacauugcugucucucuccaguauuagcgagugcaacagcaccaggagccugcucagguccgauucugacgagauuguuguguacgagaugccagugaguccaguggaagcgccuccgcucagcccaugcacccacaacccgcuugugaauguucgcguggagcgauuuaaacgggauccaaaucagucacuuacccccacgcacgugacacugacuacccccucccaacccagcucucaccgucgcaccccaucagacggggcacugaagcccgaaacucuacuggcaagccgcucacccaguucaaauggccugucuccaaguccaggcgccggcaugcucaagacacccucccccucucgggauccaggcgaauucccuaggcuaccggauccuaacguagucuucccacccaccccccguagauggaacacucagcaggacucaacccucgaacgucccaagacacuggaauuucuccccaggccacgaccuuccgcaaaccgacagagacucgaucccuggugguucgucagcccuagccacgcccgcagcacaagucccgccaauucaucuagcacugaaacgccaucaaacuuggauucuugcuucgcgucaucaagcucuacgguggaagagcgcccgggccuuccagcucuucugccuuuccaggccgguccacuuccaccaacagaacguacccuucuagaucuugacgccgaggggcaaagccaggacaguacuguuccuuugugucgcgcugagcucaauacgcaccguccagccccuuacgagauccaacaggaauuuuggucuuag

SEQ ID NO: 248346 - RNA, 2541 nt, Artificial Sequence
  Description of Artificial Sequence: Synthetic coding sequence
auggaagccccucucagaccugcugccgacauucuccgcagaaacccccaacaggacuaugagcuggugcagagggucgguucggguacuuacggcgacgucuacaaagcucguaacgugcacaccggcgaacuugcggcuguuaaaaucauaaagcuugaaccuggagaugauuuuucccugauucaacaggagauauucauggugaaagaaugcaaacacuguaauaucguggcauacuucggcucguaccugucccgugagaagcuguggauaugcauggaguauuguggcgggggcucucugcaggauauuuaccaugucacugguccucucucugaauugcagauagcauacgucuguagagaaacacugcagggacucgcguaccuacauaccaaagguaagaugcaucgcgauaucaaaggcgccaacauucugcugacggaccacggggacgucaagcuugcugauuucgguguugcugcuaagaucacggccacgauugccaaaagaaagucuuuuauugggacuccauacuggauggcucccgaaguagccgcaguggagaagaauggcggauacaaccagcuaugugauaucugggcggugggcaucaccgccauagaacugggcgagcugcagccuccaauguucgaucuccaucccaugagggcccuguuccugaugagcaaaaguaauuuccagccgccuaagcugaaagauaaaaccaaauggucauccacuuuccacaauuuugucaaaaucgcgcuuaccaagaauccgaaaaaaaggccuaccgcugagcgacuauugacucacaccuucgucgcucagccaggacuuagcagagcgcuggcaguggagcuucucgacaaggucaacaacccagauaaccaugcucacuauacugaagcagaugacgaugacuuugaaccccacgcgauaauacggcacacuauucgaucgacuaaucgcaaugcaagagccgaaagaacagccucggagauuaauuucgacaagcuacaguucgagccaccccuacggaaggagacagaggcuagggacgagaugggucuuuccucugaccccaauuucauguugcaguggaacccuuuuguggauggugcuaauacggggaagaguacaucaaagagagcuauaccucccccccuuccgccgaagccccgcaucagcagcuaccccgaagauaacuucccugaugaagagaaggcauccacuauuaaacauuguccggauucagagagccgggcaccgcaaauccuccgccgucagagcuccccuagcuguggcccaguggccgaaacaucuagcaucgggaacggcgacggaauuucuaaacucaugagcgagaacacagagggaucugcccaagcuccacagcucccuaggaaaaaagacaaacgcgauuuccccaagccugcuauuaauggccuaccuccuacccccaaagugcuaaugggugcuugcuucucuaaaguguucgauggauguccucuuaaaauuaacugugccacuucuuggauacaccccgauacaaaggaccaguacauaauuuucgggacugaggauggcauuuauacacugaauuugaaugaacuacaugaggccacaauggagcaguuguuuccccggaagugcacuugguuguacgucauuaauaacacacugaugagucuuucggugggcaaaaccuuccaacuguacagccacaaucucauugcccucuucgaacacgcgaaaaagccuggucuggcagcccacauucagacacaucgcuuuccggauaggauccuccccaggaaauuugcucugaccaccaagauuccagauacaaaaggcugccauaagugcugcauugucaggaaucccuauacagggcacaaguaccuaugcggugcccuccagagugguaucgucuuacugcaaugguaugaaccuaugcagaaauuuaugcugauuaaacacuucgauuucccuuugccaucuccacucaacguguucgaaaugcugguuauaccagaacaggaauauccaaugguuuguguugccaucuccaaagggaccgaauccaaucaggugguucaguuugagacuaucaaucuuaauagcgcaucauccugguuuacagagauaggggcaggaagccagcagcuugacucuauccaugucacacagcuggaaagagacacuguguuagucuguuuggacaaauucgugaaaaucgugaaccuccagggcaaacugaaaucuucaaagaaacuggccucagagcuuuccuucgacuuccgaauugaaaguguggucugccugcaagauaguguucuggcauuuuggaagcauggcaugcagggcaaaagcuucaagucagaugaaguaacucaagagauuuccgaugagacacgcgucuuccgacugcuugggagugaccgcguuguggugcuggagucucgccccaccgaaaauccuacagcucauucaaaccucuacauuuuggcgggccacgaaaauagcuauuag

SEQ ID NO: 248347 - RNA, 345 nt, Artificial Sequence
  Description of Artificial Sequence: Synthetic coding sequence
auggucucgaggaaggccguggccgcgcuucugguuguacacgucgcagccaugcuggcaucacagaccgaagcauuuguaccaauauuuacauauggggaacugcagcggaugcaagagaaggagagaaacaagggacagaagaagucucuaucagucuggcagcgaucaggcgaagaaggccccgucgacccugcagaaccaaucagagaagaagagaaugagaugaucaaacugacggcuccucuugaaauaggcaugcgcaugaacagccggcaacucgaaaaauaccccgccacccucgagggacuguugucugagaugcugccacaacacgcaaaguag

SEQ ID NO: 248348 - RNA, 348 nt, Artificial Sequence
  Description of Artificial Sequence: Synthetic coding sequence
augguuuccagaaaagcagucgcugcccuucuugucgugcauguggccgcuaugcuggcaucccaaacggaagccuucgugccuauuuuuacauauggugaacuacaaagaaugcaagagaaggaaagaaacaagggucagaaaaagucacuguccguguggcagagaaguggagaggaagggccaguggacccagccgagcccauucgcgaagaagaaaaugagaugaucaaacugacagccccacuugaaaucggaaugcggaugaacucucggcaguuagaaaaguaccccgcuacauuagagggucuucucucagagaugcuaccacagcacgccgccaaauag

SEQ ID NO: 248349 - RNA, 327 nt, Artificial Sequence
  Description of Artificial Sequence: Synthetic coding sequence
auggugucacgaaaggcggucgcugcccugcuugugguucacguugcugcuaugcuagcgucacagaccgaagcguucgugccaaucuucacuuauggcgagcuucagaggaugcaagagaaggagcguaauaagggucagaagaaaucucugaguguuuggcagaggucaggagaagaggggccagucgacccagcugaaccuauccgagaagaggagaaugaaaugauaaaacugacagcuccucuagaaauagggaugcggaugaauucaagacaacuugagaaauauccugcuacuuuggaaggccugcucacugcuaaauag

SEQ ID NO: 248350 - RNA, 17121 nt, Artificial Sequence
  Description of Artificial Sequence: Synthetic coding sequence
augggagccccaagcgcaugcagaacguugguauuagcccuggcugccaugcugguggugccccaggcagagacacaggguccaguggagccuuccugggaaaacgcaggccauaccauggacggcggggcaccuacaucaagcccaacucgccgcguuaguuucgugccaccugugacaguuuuccccucccucucuccccuuaauccggcucauaacggcagagucuguaguaccuggggggacuuucauuacaaaaccuucgacggggauguuuuucgcuuucccggccugugcaauuaugucuuuuccgagcacugccgugcggcguacgaggauuucaacguucaguugaggcggggacucguuggcucuaggccaguggugacccggguggucauuaaagcucaagggcugguuuuagaagcuagcaaugggucagugcuuaucaaugggcagagggaagaauugccuuauucaagaaccggguuacugguggagcaauccggcgauuauauuaaggucaguauuaggcucgugcugacuuuccuauggaacggagaggacucugcucucuuagagcuggauccaaaguacgcaaaccaaacuugcggcuugugcggcgauuuuaacggacuccccgcauuuaaugaguucuaugcccauaaugccagacugacgccccuucaauuuggaaaucugcagaagcuggacggcccuaccgagcagugcccagauccucugccucugccagcuggaaauuguacugaugaggaggguaucugucaccgaacuuugcugggacccgcuuuugccgagugucacgcccugguugauagcacagccuaccuggcugcuugcgcccaggaucuaugccgguguccuacaugucccugugcgacuuucgucgaguacagccgccagugugcucacgcugggggccagcccagaaacuggcgaugucccgaacuuuguccgaggacauguccccucaauaugcagcaucaggaaugugggagcccuugcacagauacgugcucuaacccgcagagagcacagcuuugugaggaucacugcguugacggaugcuucugcccaccugggucgaccguccuugaugauaucacacacaguggaugucugcccuugggacagugccccugcacccacgggggacggaccuacucuccuggcacaagcuuuaauacuacaugcagcagcugcacgugcagcgguggauuguggcagugucaagaucugccuugccccggcaccugcucuguccaaggcggagcccacauuucaaccuaugaugaaaagcuuuacgaccugcauggagauuguucauacguccucucaaagaagugcgccgacagcucauucaccguccucgcagagcugagaaagugcggcuugacggauaacgagaacugucugaaagccguaacgcuuagccucgacggcggggacaccgcuauucggguccaggcagacggcgggguguuccugaacuccaucuauacccagcugccacuuucagcugcuaauauaacucuguuuaccccuaguaguuucuucauuguggugcagacaggauuagggcugcagcugcuagugcagcuuguuccccucaugcaagucuucgugaggcuggauccugcucaccaggggcaaauguguggccugugugggaauuucaaccagaaucaggccgaugacuuuacugcauugucaggaguugucgaggccaccggcgcugcguucgcuaacaccuggaaagcucaggcagcuugugcgaaugcacggaacuccuuugaggauccauguucguuaucuguggagaaugagaacuacgcucggcauugguguucccgacugacagacccuaacuccgcguuuagcagaugucauuccaucaucaaucccaagcccuuucacuccaauugcauguuugacaccuguaauugugagagauccgaggauuguuugugugcggcauuguccucauacgugcaugcaugugcugcaaagggcguccagcuuucggauuggagagauggcguuugcacgaaguauaugcagaauugcccaaaaucccagcgguaugcauaugugguggacgcaugucagccaacauguagaggacucagugaagcggacgugacuuguucaguguccuucgugccaguggauggcuguaccugcccggccggcacauuccuuaaugacgcgggggcaugugugccugcccaggagugccccuguuaugcucacggaacaguacuggcccccggagaaguggugcaugacgagggagcagugugcagcugcacaggcggcaagcuuagcuguuuaggagcaagucuucagaaguccacuggaugcgccgcuccaaugguguaccuagauugcuccaauuccucagcaggcaccccuggugcugaaugccuucgcucuugucacacuuuagauguuggcugcuuuucgacacacugcguuucaggcugcgugugcccuccugggcuggugucagacggauccggggguuguauagcggaggaggacugccccugugugcacaaugaggccacauacaagccaggugaaacgauccgaguagacuguaauacauguaccugucggaauaggaggugggaguguagccacagacucugccucggcacaugugucgcauacggugauggccauuucaucacauuugauggcgaccgauacagcuuugaaggauccugugaauauauccucgcacaggauuacuguggcgacaauacgacccacggaaccuuucgcauagugacagagaacaucccuugcgggacuaccgggacgaccuguuccaaggccaucaaacucuuuguugagucuuaugaacugauuuuacaggaaggcacuuucaaggcagucgcuagaggacccggcggagacccuccguacaaaaucagauacaugggcaucuuucucgugaucgaaacucauggaauggcaguuucaugggaucgcaaaacaucuguguucauuagacugcaccaggauuauaaagggcgcguuugcggacugugcggcaauuucgacgauaacgcaaucaaugauuucgccacccggagucgcuccguugucggggacgcauuggaauucggcaacucauggaagcuuagcccgucuugucccgacgcucuggcgccuaaagacccuuguaccgcuaaccccuuccggaaauccugggcccagaaacagugcagcauacugcauggaccaacguucgcggccuguagaucgcagguggacuccacaaaauauuacgaggcgugugugaacgaugcuugcgccugcgacuccgguggagauugcgagugcuucuguacagccguugcagcauacgcccaggccugccaugaugcagggcucugcguguccuggaggacgccugauacgugcccucuguucugcgacuucuacaauccccauggggggugugaauggcacuaccagccaugcggagcucccuguuugaagacgugcagaaauccauccggucacuguuuggucgauuugccggggcuggagggguguuacccgaaauguccuccgagccagccauucuuuaacgaggaucagaugaagugugucgcccaaugugggugcuacgacaaggauggaaacuauuacgacgugggggcccggguaccaacagccgaaaauugccaguccugcaauuguacuccuucugggauucagugugcgcacuccuuggaagcuugcaccuguaccuacgaagauagaacauacucauaucaggaugucaucuacaauacaacagaugguuugggggccugccugaucgcgauuugcggcagcaauggaacuaucauucggaaggcugucgcuugucccgguacgccugcuacuacccccuucacguucacgacugccuggguaccgcacucaacaacgucgccagcucugcccgugagcacagugugcgucagggaagugugucgcuggucauccugguauaacggacauaggccagagccuggacucggggguggagauuuugaaacauuugaaaaucugcggcagcgcggguaccaggugugcccgguccuugccgacaucgagugucgcgcagcccaacugcccgauaugccucuugaggagcucgggcaacaaguggacugcgauaggaugcgcggacugaugugugcuaauagccaacaaucacccccacuaugccaugacuacgaguugcgggugcugugcugcgaguacguucccugcggcccuuccccugcucccgguacgaguccucagccaucgcucagugcguccacagagccagccguacccacuccaacucaaacuacagccacagaaaagacuacccucugggugaccccuucaauccgaucaaccgcugcuuuaacaagccagacaggauccaguagcgggccuguuacgguaacaccuuccgccccuggaacaacaacuugccagcccagaugccaguggacugagugguucgacgaagauuacccaaaauccgaacaauugggcggggacguggaauccuaugacaagaucagggccgcaggggggcaucucugccagcaaccgaaagacauagaaugccaggcugaauccuuccccaauuggaccuuagcucaggucggacagaaaguucauugcgacguccauuuuggccuagugugccggaacugggagcaggaaggagucuuuaaaaugugcuauaauuaccgcauccggguucugugcugcagcgacgaucacugcagggggagggccaccacuccacccccuacaacagaguuggagacugccaccaccacaaccacucaggcacuguucaguacaccucaaccaaccucuucaccuggccugaccagggccccuccugcgaguaccacugcugugccgacuuuguccgagggguuaacaucaccacgguauacgagcacccucgggaccgccaccacuggcgguccuacaacacccgcuggaagcacagagccuaccguuccaggcgucgcgacaucuacgcugccaaccagauccgcucugccaggaaccaccggaucucuggggaccuggagaccuucacaaccccccacccucgcccccacaacuauggccacuucccgcgcacgccccaccggcacggccagcaccgccucuaaagagccccugacuacaucccucgcgcccacuuugaccucagaacugucuaccagucaagcugaaaccagcacucccagaaccgaaacgaccaugagcccucugacuaacaccacaaccagccagggaaccacacgaugccaacccaaaugugaauggacugagugguucgacguggacuuccccacuuccggcguggcuggaggcgauauggagaccuucgaaaacaucagagcagcaggaggaaagauguguugggcuccgaagucuauugagugccgcgcagaaaauuaucccgaggugucgaucgaccaaguaggacagguccuuacuuguucccuagagacuggccugaccugcaaaaaugaagaccagacggggagguucaacauguguuuuaauuauaauguaagaguccugugcugugaugacuauucacauugcccaucuacaccugccacuagcaguaccgccacacccaguucaacaccgggaacuacuuggauccucacuaaacccacuacaaccgcuacaaccacggccaguacuggaucaacagcgacuccgacaucuacucuucguacagccccuccgcccaaagugcucacuacuaccgcuaccacacccacggugacuuccucuaaggcuacuccaucgucuagucccggcaccgccaccgcccugcccgcccuccgguccaccgccaccacacccacggccaccagcguuaccccaauuccaucuaguucguuagguacuacguggacaagacucagucaaacaacaaccccuacagccaccaugaguaccgccaccccuucauccacacccgagaccgcccauacuuccaccguucucacugcgacagcgaccacgaccggggcaacggguagcguagccaccccaaguuccacccccggcaccgcgcauaccacuaaggugccaacgaccaccacuacuggguucacagccacgcccucaucaagccccgguacagcccugacuccacccguguggaucagcaccacaaccacacccacuaccaggggcagcaccgucacccccuccuccauucccgggacgacccauaccgcuacggugcucacuaccacuaccacaacaguugcaaccgggaguauggcaaccccaagcucaucuacucaaacuucuggaacuccacccucucugaccacuacggcuacaacuauuacugcaaccggauccaccacaaauccuuccucaacacccggaacuacgcccaucccgccugugcugaccaccacagcgacuaccccugccgcaacuucuaauacggugacuccuagcagugcuuuaggcacuacacacacacccccugucccaaacacaauggcuaccacucacgguagaagccugccuccgaguucaccccacacaguucgaacagcuuggacgucugcaacuucugguauuuugggaacaacacacauuacagaaccgaguaccgugacaucccauacacuugccgcgacuacaggcaccacacaacauucaacccccgcacugucuucuccgcaccccagcucuagaaccaccgaaagccccccaucaccagggacaaccacucccggccauacaacugcuacuagcagaacaacugccaccgcuacaccaaguaagacccggacgucaacucugcucccgucaagcccaacaagugcaccuaucacaacugugguaacuaugggcugugaaccucaaugcgcauggagugaauggcucgacuacuccuauccgaugccgggucccagugggggggauuucgacacguauuccaauauucgagcugccgguggcgccgugugcgagcagccccuaggccuggagugccgcgcucaggcucaaccuggaguuccccugcgggaacugggacagguugucgaguguucacuggacuucgggcuggugugccgaaaucgcgagcaagucggcaaauucaaaauguguuucaauuaugagauacgcguguucuguuguaacuauggccacuguccaucaaccccggccacgagcagcacagccaugccuagcaguacuccuggcacuaccuggauucugaccgagcucacgacaacugcuaccaccaccgaauccacuggauccacagcuacgccaagcaguaccccugcuacugcgggaaccccucacgucuccacgaccgccacaacacccacuguaacuagcucaaaggcuacacccuucucaagcccaggcacagcuacugcacuuccggcccuacgcuccacggcaaccacccccacagcuaccuccuucacagccauuccuaguagcucacugggcaccacauggacucggcuuagccagaccacuacuccaacagcuacuaugagcacggcuaccccauccuccacuccugagacuguacacacuucaaccgugcucacaacaaccgcaacaacaacuggcgcaacagguucaguggcuacuccaucauccaccccagguacagcgcacacaaccaaaguacuuaccaccacuaccacgggcuuuaccgcuacgcccuccagcucgcccgguacagcucguaccuugcccguguggauuuccaccaccacuacccccacaacgcgugguuccaccgugacgccaucuaguauuccgggaacaacccauacuccuacuguucugacgacaaccacaaccacagucgcaacugguagcauggccacaccaaguagcucuacacagacuuccgguaccccaccgucucugacgacgacagcuacuacuaucacugcaacaggcagcacuaccaacccuaguuccacccccggcaccacucccauucccccuguucuuacuacgaccgcuaccaccccagcugccaccucuagcacugucacuccaaguuccgcccugggcacuacucacacgccuccaguuccuaacaccacugcaacaacucacggccguagccucagcccuagcaguccucacacaguaaggaccgcuuggacaucggcaacuucaggcacauuggguaccacccauaucacagagcccucgaccgggacaucucauacaccugcugccaccacugggacuacacagcauuccacuccagcccuaucuucuccucauccauccucccgcacaacugagucuccuccaagcccagggaccacaaccccgggccacacccgagccaccagcaggaccaccgcaacugccacacccucuaaaacgcggaccuccacacugcuucccucuagccccacaagcgccccuauaacuacuguggucaccaugggaugugaaccccagugugcauggucagaguggcucgauuauucuuacccuaugcccggaccuagcggcggcgacuuugauacauacucuaacaucagggcugccgggggugccgucugugagcaaccccugggacucgaaugucgugcacaggcacagccuggcguaccccugcgggagcucgggcaggugguggaaugcagccuggacuucggacuugugugcagaaaucgagagcagguagggaaguuuaagaugugcuuuaacuaugaaaucaggguguucuguugcaauuaugggcacugcccaagcaccccugccaccucuagcacugccaccccuucaucaaccccuggaacuaccuggaucuugacugagcagaccaccgcggcgaccacaaccgccaccaccggcuccaccgccauuccauccucuacucccggcacagcaccgccucccaaagugcuaacaaguacugcgaccacucccaccgccacgucaagcaaggcuaccaguuccucauccccaaggacugcaacgacacucccgguucugaccucaaccgcgacgaaauccacugcaacgucauucacccccaucccuuccuuuacacucgguacgacagggacccugccugagcagaccaccaccccuauggcaaccaugaguacaauccauccuuccucuaccccugaaacuacacacacuucuaccguccugacaacaaaagccaccaccacuagagcaaccucaucgaugaguacuccuagcuccacaccaggcaccaccuggauccugacagaauuaacgacagcugcaaccacgacagcagcaaccgggcccaccgcgacucccagcagcacccccggcacuaccuggauccugacggaaccguccacgacugcuaccgugacuguacccacugguagcacugcuacagcgaguucaacacgcgccacugccggcacuuugaaggugcucaccucuacugcgacuacaccaacaguuaucucuuccagggccacaccuuccagcagucccggaacagcgacagcgcugccugcccuucggucuacagcgaccaccccgacagccaccucuguuaccgccauccccaguaguucacucggcaccgccuggacccgccucagucagacaacaacuccaaccgccaccaugaguaccgcuacuccauccaguacacccgagacagugcauacgaguacuguccuaaccaccacaacaaccacuacgagagcuacugggagcguggcaacccccucuucaacccccgggacugcacacaccacgaaggugcccacgacaacuaccacaggauucacagccaccccgucuucuuccccuggcacagcccucacaccaccugucuggaucagcacaacgacgacacccaccacuagggguagcacaguaacaccuuccucuaucccagguaccacccauacugcgaccguucugaccacuaccacuacuacaguggcgaccggaucuauggccacaccgucaaguagcacucagacuucaggaaccccuccgagccucaccacaacagcaaccaccaucacugccacuggauccacuacuaauccguccagcaccccugggacgacgcccaucccccccgucuugacuaccaccgccacuacgcccgcagccaccagcucuacugugacucccucuucagcccugggaaccacccauacgccucccgucccaaacaccaccgccaccacacaugggaggagcuugccaccuucuucaccucacacagugcgcaccgcuuggacaucggcuacgagcggaauccuaggcacaacucauaucacagagcccucuacaguaaccucucacacccccgcagcaacaacgucaacgacucagcauagcacucccgcccucuccagcccgcacccgaguagccgcacuacugaaagccccccaucuccuggaacgacaaccccgggccacacacgugguaccagcagaacuacugccacagcaaccccaucuaagacgaggacguccacccugcuaccuagcucucccacaagcgcuccgaucaccaccgucgugacgaccggcugugaaccucagugcgccugguccgaauggcuggacuacagcuauccuaugccaggaccuaguggcggggacuucgacacguacucaaacauaagggccgcagguggugccgucugcgagcagccacucggccuggagugccgagcacaggcacagccaggcguaccucugcgcgagcugggacaagugguugagugcagccuagauuuuggccugguuuguaggaauagggagcaaguaggcaaguuuaagauguguuuuaauuaugaaauucgggucuuuugcuguaauuauggccacuguccuaguaccccugcaaccagcaguaccgccacuccguccuccacaccagggacgacuuggauucugaccaaauuaacgacuacugccacuacuacugagaguacagggagcacggccacgccuuccucuaccccuggcgcuacagccggaacuccacaugucagcacgaccgccacuacaccuacugugaccuccucgaaagcuaccccuuucucaucaccuggcacugccacagcccucccagcucugcguagcacugcuacaacgcccacugcaacauccuucaccgcuaucccuaguucaagccuggggacaaccuggacucgccugucccagacuaccacgcccaccgcuaccaugucaacagccacaccaucgagcacaccggaaacggcccauaccaguacugugcucacuacgacagcaacuacuacuagagcuaccggcuccguugccacuccuuccucaacaccggguaccgcgcauacuacaaaggugcccaccacgacaacuacuggcuucacagugacuccgucuagcucaccagguaccgcucggacuccccccgucuggaucucuacuacuacuacucccaccaccucuggcuccaccguaaccccuuccuccgugccgggcacuacucacacccccaccgucuugaccacaacaaccaccaccguugcaacuggcucgauggcaaccccuucaagcuccacacagacuucugggacaccccccagccugaucacaacugccaccacaaucacugcgacugggucaacaacuaauccauccucaacgccugggaccaccccaauuccaccagugcucaccaccaccgccacuacgcccgccgcuacuucuagcacugugacacccucgucugcgcucgggacgacacacacgccucccgugccgaauacuacagcuacuacucacggccgcagccucucaccaaguucuccucacacagucagaacagcguggacuagcgccacauccggaacauugggcacgacccauaucacugaaccuaguaccggcacaucccauacucccgcagcaacaacagggacgacgcaacauucuacuccagcccuguccagcccacaccccucaagcaggaccacugaaucgccccccuccccuggaaccacuaccccuggacacacuacugccaccucucggacaacugcaacagccaccccuuccaaaacucgcacaucaacgcuguugcccucaucuccaacaucggccccuauuacuacugucgucacaacgggcugugagccccagugcgcuuggagcgaguggcuggacuacucuuauccaaugccaggaccgucagguggagacuucgacaccuacuccaauauccgagccgcgggcggcgccgugugcgaacagccuuuaggacuagagugcagggcucaggcccagccuggcgugcccuugggagaacucggucaggucguggaguguucacuggacuucggucugguuugccguaaccgugagcagguaggcaaguucaaaauguguuuuaauuacgagauccggguguuuuguuguaacuacggccacuguccuuccacaccagccaccaguucaaccgcaaugccaaguucuacacccggcacaacauggaucuugaccgagcugacuacuacagcuacuaccaccgccagcacaggcuccaccgcuacgccuucuaguacaccuggcacagcgcccccacccaaggugcugacuaguccggcuacuaccccuacagcgacaucaagcaaagcgacaagcaguucaucuccuagaaccgccacuacgcuaccugugcugaccuccacggcaacuaaauccaccgccacuuccgugacacccauucccucaucaacuuuaggaaccacugggacucuuccggagcagaccacaacgccaguagccaccaugagcaccauacaccccucuucuacuccugaaaccacacauacuucuacuguacugacuacaaaggccaccacaacuagggcuacuuccaguacaucaacuccauccucuacgccugggaccacauggauccuuacugaacuuacgacagccgcuacaacaacugcagcaacaggacccacugccaccccuaguucuaccccggguacaacguggauucucaccgaguuaacaaccaccgccacaaccacugcaaguacugguucaacggccaccccgucaucuacaccaggcacaaccuggauucuuacagaaccaucuacuaccgccaccgucacagugcccacuggcucuacugccacagcuucuucuacacaagcuacagcugguaccccucaugugucuaccaccgcaacgaccccgaccgucaccucaucuaaggcaacccccuccagcagccccgguacagcgacagcuuugcccgcccuaagguccacggccacuacuccaacagcaaccagcuuuacugccauuccuuccaguucccuggguacuaccuggacgcgcuuaucacagacuacuaccccuacggcuaccauguccaccgcgaccccuaguucaacucccgaaaccgugcacaccaguacaguguugaccgcgaccgccacaacuacaggugcaaccggaagcguggcuacaccaucuucaacccccggcaccgcacauaccacuaaagugccuaccacuaccacaacaggcuuuacagcaacgccuuccaguagccccgggacggcacuuacaccgccuguuuggaucucaaccacuacaacuccuacaaccaccacaccuaccacauccgggucgaccgugacaccaucaucuauuccuggaacuacccacaccgcucgaguuuugacuacaacaacuacaacugucgcuacuggcagcauggcuaccccaagcagcuccacacagaccucaggaacuccaccuucccucacuaccacagcaaccaccauaacagcgaccgguucuacaaccaacccaaguucgacccccgguacuacaccaauuacacccguccugaccucgacugccaccacacccgccgcuacuuccucaaaggcuacauccagcuccucuccaagaacagcuaccacacuccccguccugaccuccaccgcaacgaaaucaaccgccacaagcuucacuccuauuccgucuucaacacucuggacuacguggacugucccggcgcaaacuacaaccccuaugucaacuaugucuacaauucauaccucuucaacuccugaaaccacacacaccuccacugugcuuacaaccaccgccacgaugacucgggccaccaauucaacugccacacccucauccacccuggggacaacuaggauucuaacugagcucacuaccacagccacaacaaccgccgccaccggcucaacagcaaccuugagcuccacucccgguacaaccuggauucucacagagccuuccaccauugcaaccguuauggugccaacagguagcacugcaacugcaaguuccacccucggcaccgcucacacuccuaaagugguaacaacaauggcuacaaugcccacugcuacugcuagcacagucccauccucuagcacuguuggcacuacaagaaccccggcuguacucccauccuccuugccuacauuuagcguguccaccguguccucuucuguucucacaacccugagaccuacuggguuuccuucaagucauuuuucaaccccguguuuuuguagagccuucggacaguuuuucagcccgggugagguaaucuacaacaaaaccgaucgcgccgggugucauuuuuacgcagucuguaaccagcauugcgauaucgacagguuccagggcgcaugcccgacuagcccuccucccgugaguucugcuccucuguccucaccaaguccagcaccugggugugauaaugccauccccuugcggcaggugaacgaaacauggacacucgagaacuguacagucgcucgguguguuggcgacaaccgcgugguguuacucgauccaaaacccguugccaaugugacuugugugaacaagcaucugccaaucaagguuuccgacccaucacagccuugugacuuccacuaugaaugcgaauguaucuguaguaugugggggggaucgcacuacucuacguuugacgggaccucuuauacauuccggggcaauugcacuuacguuuuaaugagagagauccacgcccgguuuggcaaccugucccuguaccuggacaaucacuauugcaccgcuucugcaacagccgcugccgcccgguguccuagggcccugucuauucacuacaaauccauggacauagugcuuacagucacuauggugcacggaaaggaggagggacuuauuuuauuugaccaaaucccagugucuucaggguuuucaaagaacggugugcuugugucagugcuggggacgaccaccaugaggguggauauaccugcacugggaguuucugugacauucaaugggcaaguguuccaagccagacugccuuacagccuguuccacaauaacacggagggacagugugguacuuguaccaacaaucagcgggacgacugccuccaaagggacgggaccacggccgccucuuguaaggauauggccaagaccuggcuuguaccugauucuaggaaagacggcugcugggcaccaaccgggacccccccuacagcuucaccugcagccccgguuuccucuacacccaccccaacaccuuguccaccucagccccugugcgauuuaaugcugucucaggucuucgccgagugucacaaucuggucccaccugggccguucuucaacgcuuguaucuccgaucacugucgcgguagacuugagguaccuugccagucucuggaggcuuaugcugagcuuugucgggccagaggcgugugcucagauuggcgcggagccaccgggggauugugugaccuaaccuguccuccuacgaagguuuacaaaccgugcggcccaauccagcccgcuaccuguaauagccgcaaucaauccccacagcuggagggcauggccgagggaugcuucugcccagaggaucagauccucuuuaacgcgcacaugggaauaugcguucaggccuguccaugcguugggccugacgguuuuccuaaguuccccggcgagcggugggugaguaauugccagucaugugugugcgaugaaggaagugucagcguucaguguaagccccugccuugcgacgcccaagggcagccaccaccaugcaaccguccuggauuugucaccgugacgagaccccgcgccgagaaucccugcugucccgagacugucugcguauguaacaccacgacuuguccgcaauccuugcccgucuguccccccggucaggagucuaucuguacacaggaggaaggugacugcugucccacauuccggugccgaccucagcuguguucauauaaugggaccuuuuacggggugggggcaacauuuccuggugcauuaccgugucauaugugcacuugucugagcggugauacccaggauccaaccguccagugccaagaggaugcuuguaauaacaccacuuguccccaaggauucgaguacaagcggguugcgggccagugcugcggggaaugcgugcagaccgcaugucucacaccugacgggcagccaguccaguugaaugagaccugggugaauucucauguggacaauugcacuguuuaccugugcgaggccgagggaggcguccaccuucucacuccucaaccagcuucuuguccggacgugucuucaugcagaggaucauuacggaagacaggaugcugcuacuccugugaggaggauucaugccagguucggauuaauaccaccauauuguggcaccaggguugugagacggagguaaauauuacuuucugcgaggggagcugcccuggcgccucuaaguauagugccgaagcccaagccaugcaacaucagugcaccugcugucaggagcggagagugcacgaggaaacuguuccuuugcacugccccaauggaucagcgauccuacacaccuauacacaugucgaugagugcggcuguacucccuucugcguaccagcucccauggcccccccucacacaagggguuucccggcccaagaagccaccgcaguuuag

SEQ ID NO: 248351 - RNA, 16587 nt, Artificial Sequence
  Description of Artificial Sequence: Synthetic coding sequence
gccccaaggaugggcgccccaucugccugcaggacacugguucuggcucucgcugcaauguuagucgugccgcaggcaggcaaaagccccccuuugagacccuugucacguaauagcggggcaggccuggaugguggagcgccaacuucuucuccuacccggcgggugucguucgucccaccagucaccguguucccuucacuuucacgaaagcaaaugcugcccuugccugcugguaaggggguuuucgcaagcccuaagggggggggucccgaccugggcgugcagcugccaccggcacucaauccugcucacaauggccgcgucugcagcaccuggggagauuuccauuauaagacguuugacggggacguguucagauuucccggacuguguaacuaugucuucuccgaacacuguagggcagcauaugaggauuucaacgugcagcuccggagggggcucgucgggucacgacccguggugacuaggguugucaucaaggcucaaggucucguucucgaggcaagcaacgguaguguacugaucaacggucaaagagaagaauuaccuuacucccgcaccggucuccuggucgagcagagcggggacuacauaaaggugucaauuagacugguuuugacauuucuguggaauggggaggauagugcgcuccucgaacucgaucccaaauaugcuaaccaaaccugcggccugugcggugauuucaacgggcugccugccuuuaaugaauucuacgcccauaacgcgagacucacaccccuucaguucgggaaucuucagaaacucgacggcccuaccgaacaauguccagacccauuaccucuucccgccggcaacuguacggaugaggaggggaucugucacagaacucuucucggccccgccuucgccgagugccaugcucugguggacuccaccgcauaccuggccgcuugcgcacaggaucuaugcaggugcccaaccuguccgugugccaccuuuguagaguauucucggcagugcgcccacgcuggcggccagcccagaaacuggcguugucccgagcugugcccaagaacauguccucucaauaugcagcaucaggagugugggucaccauguaccgacaccuguuccaacccacagcgcgcucaauuaugcgaagaccauugcguggaugguuguuuuugcccuccuggacggaguuguacuguccucgacgacaucacucauucuggcugccucccucucgggcagugcccguguacccacggcggaagaaccuauucacccgguaccagcuuuaacaccaccuguuccucuugcaccuguagcgggggacuauggcaaugucaggaccuucccuguccgggaacuuguagcguucagggaggcgcucauauuuccacguacgacgaaaaacuuuaugauuuacauggcgauuguuccuacgugcuguccaagaaaugugccgacuccuccuuuaccguccuggcugaacuuaggaagugugggcucacugacaacgaaaacugccuaaaggcugugacacugagucuggauggaggagauacggccauucggguucaggcugauggagggguguuccugaacuccauuuauacacaacugccccugucagccgcuaauaucacguuauuuacccccucaagcuucuuuaucgugguucagacuggacuggggcugcagcugcuuguucagcuagucccauuaaugcaagucuuugugaggcuggacccagcacaccaggggcaaauguguggguugugugguaacuuuaaccagaaucaggccgacgacuucacugcacugucuggugugguugaagcaaccggggcagccuucgccaacaccuggaaggcacaggccgccugcgcaaacgccaggaauucuuuugaagacccaugcagucugucaguggagaaugaaaacuaugcuaggcauugguguucgagguugaccgacccaaacuccgcguucucacgaugccauagcauuaucaauccaaagcccuuucauucgaacugcauguucgacacaugcaauugugagcggucugaggacugucucugcgccgccuugagcucuuauguucaugcaugugcggccaaggggguucagcuaucugauuggagggacgguguguguacaaaguauaugcagaauugcccuaaaucccagagguaugcuuacgucguggacgccugccaaccuacaugccgcggacuuagcgaggccgacgugacauguucgguguccuuuguuccugucgacgguuguaccugcccggcgggcaccuuuuugaacgacgcuggugcaugcgugccugcccaagagugccccuguuaugcccacggaaccgugcucgcuccgggggagguggugcacgaugagggugccgucugcuccuguacaggagggaagcugucgugccucggagcuucacugcagaagucaaccggcugugcagcgcccaugguguaucuagauugcucuaauuccucggccgguacaccuggagcugaaugucugcggucuugucacacucuggaugugggauguuuuuccacacacugugugucuggcugcguuuguccaccuggguugguuagcgauggcagcggaggaugcauugccgaggaagauugcccuugcguccacaaugaggccacuuauaaacccggggaaaccauucggguggauuguaacacaugcacgugccgcaaucggcguugggaaugcagccaccggcucuguuuagggacuugcguugccuauggagacggucauuucauuacuuuugacggcgacagauacucuuucgaagggucaugcgaguacauacuggcucaggacuacugcggcgauaacacuacacaugggaccuuccggaucgugacugagaacauaccauguggaacaaccggaaccacuugcagcaaggccauaaaacuuuucgucgagguuaggaccgcgcccgcaguaaguacuccagaccccgcugcaaaugaaccugcgccgagggaagcuucagucggauucagacagcgccuucccccccuccaaaguuaugaauugauucugcaggaggguaccuuuaaggccguggcucgaggccccggcggcgacccaccuuacaagaucagauacaugggcaucuuucucgucaucgagacccacggcauggccguuuccugggaucgcaagaccagcguguuuauccgccugcaucaggauuauaaaggccggguguguggacuauguggaaauuuugaugauaacgccauaaacgauuuugcaacccgaagccgguccgucguaggcgacgcacuggaguuugggaacucuuggaaacucaguccaucuugucccgacgcccuagccccaaaggauccuugcacagcaaaucccuuuaggaaaagcugggcucaaaagcaguguucuauacuucauggccccaccuuugccgccugccggucucagguugacagcacuaaguauuaugaggcaugugucaaugaugccugugccugugacuccggaggugacugugaaugcuucugcacggccguggccgccuaugcucaggcuugccaugaugccggcuugugcgugagcuggagaacuccagacacuugcccacuguucugcgauuucuauaacccccacggugggugugaauggcacuaccaacccugcggagcaccaugccuaaaaacuugcagaaauccgagcggccauugcuugguggaucuuccgggccuggaggguuguuacccaaaaugcccacccucccagccauucuuuaacgaggaucagaugaaguguguggcucagugcggguguuaugauaaagaugguaacuauuacgaugugggagccaggguucccacugccgaaaacugccagucguguaacugcacgcccuccggcauccaaugcgcccauaguuuggaggccugcacuugcaccuaugaagaucgaaccuauagcuaucaggaugucauuuauaauacaacggaugggcugggggcaugccucauugcaauuugcggcucaaauggaaccauuauccguaaagcuguagcuuguccugguaccccggccacuaccccuuuuaccuucacaaccgcguggguaccucacuccacaaccucuccugcuuugcccgucagcacgguaugcguucgggaggugugccgcuggagcuccugguacaacgggcauaggccagaaccuggucucggcgguggugacuuugaaacauucgagaaccucagacaacguggauaucaggucugcccaguacuggccgauaucgaaugucgggccgcccagcugccagacaugccacuggaagaacugggacagcaggucgacugcgaccgcaugagaggccuuaugugcgccaacucccagcaguccccuccacugugccacgauuacgaacuccgcgucuugugcugugaguaugugcccugcgggccuaguccugcccccggaacaucuccccagcccagccugucugcaagcaccgagcccgcugugcccaccccaacacagacaacugcaacugagaagacuacucugugggugaccccuagcauucgcucgacugcugcuuuaacgucacagaccggcucauccucaggcccagugaccgugacaccaagcgcaccuggaacuaccaccugccagccucgcugccaauggaccgaaugguucgacgaggacuacccaaaaucagagcaacucgggggggacguggaaucauacgacaaaauucgcgcggcggggggacacuugugccagcaaccuaaagacaucgagugucaggccgagaguuucccaaacuggacucuugcccaggugggccagaaaguucauugugauguccacuucggacucguuugucggaauugggagcaggagggaguguucaagaugugcuacaauuaucguauuagaguuuugugcugcuccgaugaccauugccgaggcagggcaaccacaccaccaccaacgaccgaacucgagaccgcuacuacuaccaccacccaggcacuguuuuccaccccucaacccaccuccucacccgguuuaacucgggccccaccugcauccacaaccgccguuccuacccuguccgagggacucaccucuccucgcuauaccucuacucuugguacggccacaacgggagguccaaccacuccagccgggucaacagagccuaccgugcccggagucgccacaucaacccugccuacucguucugcccugcccggaaccacugggucucugggcacuuggaggccuucccagccaccaacacuggccccaacuaccauggcaacuagcagggcacggccaacgggcaccgccucaaccgccucuaaggagccucugaccacgagcuuggcacccacacugacaucggagcugaguacaucacaggcugagaccuccacuccaaggacugaaacgacaaugagcccacugaccaauaccacgaccucucagggcaccacuagaugucagccuaaaugugaauggacugaaugguuugacguggacuuccccacaucgggcguggccggcggugacauggagacauuugaaaacauuagagcagcugguggcaagaugugcugggccccaaagucaaucgagugccgcgcugagaauuacccugaaguaucaaucgaucaggucggucaggugcuaaccugcucccuagagacugggcugaccuguaagaaugaggaucagaccgggcgcuuuaauauguguuucaauuauaacguuagaguucugugcugugacgauuauagucacugucccucuacaccugcgaccucgaguaccgcuaccccaucauccacuccaggcacaaccuggauccuuacaaaaccaaccacaacugcuacgaccacagccagcaccggaucaacggcgaccccaacgaguacacuucgcaccgccccgccccccaaggugcugacuaccaccgcuaccacacccacugugacgaguuccaaagccaccccuagcaguuccccgggaacggccacagcacugccugcguugagaagcacagccacuaccccuaccgccacaucugugaccccuauucccucuagcuccuugggcaccacauggacaaggcucucacagacuacuacuccaacugccaccaugucaaccgcaacuccuagcaguaccccagagacugcacacacgucaaccgucuugaccgcaaccgcuacuacaacaggcgcuacaggcucuguggccaccccuucauccacccccggcaccgcucacaccacuaaagugccuacaaccacuaccaccgguuucacugcaacccccagcuccucaccagggaccgccuugacacccccuguguggauuucuacaacaaccacccccaccacccgcggcagcacaguaacuccuucauccauacccgggacaacgcacacugcaaccguguuaacuacuaccacuaccaccgucgcaacaggaaguauggcuacuccuuccagcagcacacagacuuccggaacaacccauaccccuccagugccaaauacaauggccacuacucauggccgcucacugccaccuuccucuccucacaccguuaggacagcguggaccucagcaacaagcgggauuuuggggaccacccauauuaccgaaccuucuaccguuaccucucacacccuugccgcuaccaccggcacgacacagcacuccacccccgcucugucuaguccacaccccucuucacggaccacggagagccccccaucuccggguacuaccacgccuggucauacaacugcuaccuccagaacaaccgcuaccgcuaccccaagcaaaacccgaacaaguacucuucuuccgagcucaccaaccucugccccaauuacaacugugguuacgaugggcugugagccccagugcgcuuggagcgaguggcuugacuacuccuaccccaugccaggccccagcgggggcgauuuugauacauauucaaacauccgcgcugcaggcggcgccgugugugagcagccuuuaggcuuggagugccgagcgcaggcccaaccuggcguaccccugagggagcuuggccaggugguggaaugcucacuagacuucggacucgugugccgaaauagagaacagguuggcaaauuuaagauguguuuuaacuacgaaaucaggguguucugcuguaacuauggucacuguccuucaaccccagcaaccuccucuaccgccaugcccagcucaacgcccgggaccacauggauucugacagaacucacuacuacagccaccacuacagaaucuaccggaucaaccgcuacacccucaucgacccccggcacaacuuggauucuuacugagccaucaacuacagcuacagucaccgugccaaccggaucuacagccacagccucuucuacucaggcgaccgcggguaccccucauguuuccacaacugccacaaccccaaccguuacauccuccaaggcuacacccuucucaagccccggaaccgcaacugcacugccugcuuugcgaucuacugcaacaaccccuacagcaaccagcuuuaccgccauccccucuuccagccugggcacuacuuggacccggcucucacagacgacuacaccgacugcaacuauguccaccgcuacuccuucuucuacucccgagacuguccacaccaguaccguguuaacaacaacagcgacuacaacgggagccacgggaucuguggcaacaccuagcagcacccccgguacggcucacaccacuaaagucuugacaaccacaacaacuggauuuacggcaacccccucauccagccccggcacggccagaaccuugccaguuuggaucucgacgacaacaacaccuacgacgcggggcucuacagucacuccuagcucgauacccggcacuacucacacacccacaguccuuacuaccacgacuaccacagucgcgacuggaucgauggcgaccccaucuucuucaacccaaacaucugguacaacucacaccccgcccguuccgaauacaacggccaccacgcaugggaggucacuaucuccuucuagcccucacacagugagaacggcuuggacgucggcaaccucagguaccuugggaacgacccacauaaccgagccaucuaccgggacuagccacacuccggccgcuacgacaggaacaacgcagcacucgacaccagcucugaguucgccacauccuuccucgcggacaacagagagcccgccuucgcccgguacuacaacccccggucacacucgugccacaagucggacuacagccacggccacuccgucuaagaccagaaccucgacucugcucccuucauccccuacaagcgccccuauaaccaccguuguaacuauggguugugagccccagugcgcauggagcgagugguuggacuauucauacccuaugccggguccaagcggcggagauuucgauacuuacucuaacauccgugccgcugggggugcugucugugagcaaccacugggccuggagugucgggcacaggcgcagccaggcgucccccuucgcgagcuggggcaagugguggaauguucccucgacuuuggccuagucugucggaaccgcgaacaggugggcaaauucaaaauguguuuuaacuacgaaauuagggucuucuguuguaauuacgggcacugcccaucaaccccagcaacaucuucaacugcuaccccuucaucuaccccuggcaccacguggaucuuaacagagcaaaccaccgcagcuaccacaacugcuacuacagggucuaccgccauacccucauccacaccuggaacugcccccccgccaaagguacucaccucuacugccacuaccccaacggcuaccucuagcaaggccaccuccucaagcagcccaaggacugccacaacccugccaguccuuacuuccacagccaccaaaagcacggccaccagcuucacgccgaucccaucauucacacuugguacaaccggcaccuugcccgaacagaccaccacuccaauggccaccaugagcacgauucaccccucauccaccccugaaacaacucauacuucaacaguguugacuacuaaagcaacuacaacccgggcaacaagcucaaugaguacccccucaucuacucccgguacaacauggauacuaacagaacugacgacugccgcaacuaccacugccgccaccgggcccacagcgaccccuagcuccaccccuggcaccaccuggauucuuaccgagccuagcacaacagccacagugacugugcccaccggcuccaccgcaacagcgucaaguacaagggcaacagcugguacccucaagguucugacgucuaccgccacaaccccuacagucauuuccucccgggcuacaccaagcagcucaccuggcacugcuacagcccugccugcucugaggucuacagcaacaacccccaccgcuacuuccguuacugcaauucccagcagcucauuggguacugccuggacucguuugagccagacuaccacuccuacagcuacaaugaguacggccacuccaucguccacaccagagaccgugcauacuagcacugugcugaccacuaccaccaccacaacaagggcgaccggcucuguugcuacgccaagcuccaccccgggaaccgcccacacuaccaaagucccaaccacuacuaccaccggcuucacugcaacuccaucuagcagcccugguacugcccugacuccucccguguggauaucuacaacaacaacaccaaccacccggggcucaacuguaacaccuagcucuauuccuggaacaacucauacagcgacugugcuaacuacuacuaccacuacaguggccacagggucaauggccacuccuagcuccagcacacaaaccucaggaacuacacauaccccccccgugccaaacacaacagcuacaacccacggacgaucacugccgccauccucuccucacacagugcgcacggccuggacuagugcuaccuccggcauucucggcaccacacacaucaccgaacccaguacuguaaccucccauacacccgcugcaacgaccagcaccacucaacacuccaccccugcucugagcaguccccauccaagcucgagaacaacugaguccccaccuucaccgggcaccacuacccccggccauacacgaggcaccucacguaccaccgcaacugccaccccuuccaagacaagaaccuccacucuauugccuucauccccaacuagugccccuauuacgacuguggugaccacggggugcgagccacagugugcguggagcgaguggcuagacuacucuuauccuaugccugggccaucgggcggcgacuuugacaccuauucgaauauccgagcugccgguggggccgucugugaacagccucuuggccuggagugcagggcgcaagcacagccugggguccccuugcgcgagcugggccagguggucgaguguagccuggacuucggccuugugugccgcaacagggagcagguugggaaauucaagauguguuucaacuacgaaauucggguguuuugcugcaauuauggucauuguccuuccaccccagcuacuaguagcaccgcuacgcccucgucgacaccaggaaccaccuggauccugaccaaacuuaccacuacugcuacaaccacagaaucuacagggucuacugccacaccuaguucuacaccagguacaaccuggauccugacagagccuucgacaacugcaaccgugacagugccuaccggaucuacagccaccgcuuccuccacucaagccaccgcaggcacaccccacgugucgacaacugcaaccacccccacagucacaucaucaaaggcuacuccauucucuagucccggcacagcaaccgcucuccccgcguuacgauccacagcaaccacgcccacugccaccaguuuuacugccauaccuucgagcucucuuggcacuaccuggacccgcuugucucaaacuaccacuccgacggcgacuauguccacugccaccccuuccaguacaccggaaacugcccacacguccacaguccucaccacaacggcuaccaccacgagggccaccgggucugucgcgaccccaucuaguaccccaggcacagcccacacaacaaagguaccuaccaccacaaccaccggcuuuaccguuaccccaagcaguuccccuggcaccgccaggacaccaccuguguggaucagcacuacuacaacaccuacaacaagcgguucaaccgugacgcccagcagcgugcccgggaccacccauaccccuacaguccucacaacaacaacuaccacagucgcgaccggauccauggccacuccgagcaguucuacucaaacguccggaacuacucacacgccuccugugccaaacacgacggccacaacccacggcaggucauugucccccaguaguccucacaccguaaggacugccuggaccucagccacgagugguacacugggcaccacccauaucacugagccuucuacaggaacuucucauaccccggcagcuacuacugggacgacccagcacucaacccccgcgcuaucauccccucauccuucaagcagaacaacagagucaccucccucgccuggaacuaccaccccggggcauacaacagcuacuucuagaacuacagcaacagccacgcccuccaaaacccggacgucaacacuguugcccucgucuccaacaucugcuccaauaacgacaguggugacuaccgguugcgaaccccagugugcgugguccgaauggcuggauuauucuuacccgaugccaggaccuagcgggggcgacuuugauacuuacucuaauaucagagcagcuggcggagcugugugugaacagccucugggcuuagaguguagagcucaggcccaaccaggagucccgcugggggagcugggacaagugguagaguguagccucgacuucggucuaguuuguaggaaccgggagcaggugggaaaguucaagauguguuuuaauuacgagaucagagucuucugcuguaauuauggccauuguccuuccaccccagccacaaguucuacagccaugccuagcucaacgccuggcaccaccuggaucuugaccgagcuaacaacaacugcuaccacuaccgccucaacuggaaguacagcuaccccgaguucgaccccuggcaccgcgccaccccccaaggucuugacuagccccgccacgacuccuacggcaacuucuagcaaagcuaccucaaguagcagcccucggacagccacaaccuugccaguacugacaaguaccgccaccaaguccacugccacuagcguaaccccaaucccuucauccacccucgguaccaccggcacccugcccgaacagacaaccaccccaguggccacuauguccacaauccauccgagcuccacuccugaaacuacucauacgaguacggugcuaacaacuaaggccacaacaacgcgggcaacauccagcacaaguaccccaaguucaacuccuggaaccaccuggauucuaaccgagcugacaaccgcugcuacuaccaccgccgcgacggggcccacugcaacaccaaguagcaccccgggcacuacuuggauucugacagaacucacuacuacagccaccacgacugcaucaacagggagcacagccacucccuccaguaccccaggcacuaccuggauccucacagaaccuucaacaacagcuacagugacggugccuacaggaucaacugccaccgcuucuuccacacaggccacggcggguacaccccauguguccacuacggcuacgacuccuaccgucacaucaucuaaggccacccccucguccucaccaggaacagccacagcccugccagcucucaggucuacagcuaccacaccaacugcuaccucguucacugcgaucccuagcucaucauuaggcaccacauggacccgacugagccagacaacaacgccuacagccacgaugucuaccgccaccccaaguaguaccccagagacaguccauacuagcacagucuugaccgccacggcuaccacuacuggagcaaccggcucaguggccacuccuagcucuacgcccggcacggcccauacuacgaaagucccaacaaccacaacuaccggguucacugcuacuccaagcucgaguccugggaccgcccugacaccucccaccacuacgcccaugucgacuaugucuacaauccacacgucaaguacgcccgaaaccacccacacguccacaguccuaacuaccacugcuaccaugacccgcgccacaaacuccacugccaccccuucaucaacucuuggcaccacaaggauccugaccgaacuaacuaccacagcgaccacuacagccgcaacuggauccaccgcaacacuguccucaaccccugggacaaccuggauccuaacugagccauccacgauugcuaccgugauggugccaacaggauccacugccacagcuagcucuacgcuggguaccgcccauacaccuaagguugucaccacuauggcuacaaugccuaccgccacugcgucaacagugcccaguucaaguaccguggguaccacucgcaccccagccguucugccauccagccugccuacauuuagcguaaguacugugagcucuaguguucucaccacucuucgcccgaccggguuuccgucaucacacuuuuccacaccauguuucugucgcgcuuuuggucaguucuuuuccccaggugaagugauuuauaauaaaacagauagggcaggcugccacuucuacgccgucugcaaucagcacugcgacauagacagauuucagggagcaugcccaacgucucccccccccgugaguucagcaccccugucaaguccuucuccugccccagguugcgauaacgccaucccauuacgacagguaaacgaaacguggacuuuggagaacugcaccguugcuaggugugugggcgacaaucgcgucgugcuucuggaccccaagcccguggccaacgugaccugugucaacaagcaucucccuaucaaggugagugacccuucgcagcccugcgauuuccacuacgagugcgagugugaaugugugggaggccggggcaucacaccaggagcuggcauuugcagcaugugggggggaucucauuacagcacuuucgacggcacauccuacacuuuuagaggcaauuguaccuaugugcucaugcgcgagauucacgcccgcuucgggaaucugucacucuaccucgauaaccacuauugcacagccuccgcuacugcugcugcugcucgcuguccgagggcccugaguauccacuauaagagcauggacaucguucucacugucaccaugguacacggaaaagaggaaggucugauccuuuucgaccagauccccgugaguagcggcuucaguaagaauggagugcucgugucggugcuggggacuaccacaaugcggguagacaucccugccuuaggcgugagcgugaccuucaacggccagguguuucaagcucgacugccuuacagcuuguuucacaauaauaccgagggacaguguggcaccuguacaaauaaccagagggacgauugccuucagagggacggcacaaccgccgccaguugcaaagacauggcaaagacuuggcucguuccugacagcaggaaggacggcuguugggcacccaccggaaccccgccaaccgcuucgccugcagcaccggugucaucaacccccacuccuacccccugcccaccgcagccgcugugugauuugauguugucgcaagucuucgcagagugucacaaucuuguuccaccugguccuuuuuuuaacgcgugcaucuccgaucacugucgcggcaggcucgaaguuccaugccagagccucgaagccuacgcggagcucugcagggccagggggguguguucagauuggcgcggagcaaccgggggacugugugaucuaacuuguccgccuacgaaaguauauaagccaugugggccgauccaaccugccaccuguaauucacgaaaucagucaccccagcuugaaggcauggccgaagguuguuucuguccugaggaccagauucuguuuaacgcucacauggguaucuguguucaagcaugccccugcguggggcccgacggguuuccaaaauucccuggcgaacgauggguaaguaacugccaaagcugcgucugcgaugaagguuccgucucgguccaaugcaagccacugcccugugaugcccagggacagccccccccuuguaaccgaccuggguucguuacggucacuagaccaagagcugaaaaucccuguugccccgagaccguuugcguguguaauacuacuaccugcccucagucucugccugucugucccccugggcaagaaucuauuuguacccaagaggaaggggauugcuguccuacauucagaugccgcccucagcucuguucauauaacggaacauucuauggggugggcgcgacauucccuggagcccugccaugucacaugugcaccugccucuccggcgacacucaagauccaacaguccagugccaggaagaugcuugcaauaauacaacuuguccacagggcuuugaauauaaaagaguagccgggcaguguugcggggagugcguucagacugcaugccugacaccugacgggcaaccaguccaguugaaugagaccuggguuaacucccacguggacaauuguaccguguaccuuugcgaagccgagggcgggguacaucuacucacaccacagccugccucuuguccagacgucucuaguugucguggauccuugcggaaaaccggguguugcuauagcugcgaagaagauucaugccagguccguaucaacacaacaauacuguggcaccaggguugugagacugaggugaacauuacauucugcgaaggguccuguccuggggcaucaaaauauucugcugaagcccaagcuaugcagcaccaaugcaccuguugccaggaaaggcgggugcacgaggaaacggugccgcuccacugcccuaacggauccgcaauccugcauaccuauacccaugcuguacaagugcugugcggccugcucgcguggggacuccaagcaggcggacacauccgaggcgcagugcaggauccacagcagccucugaaagaucaagaggccagcgguaaagccaggcagggagguggauaucggcaaacagucgcguggggcgacaagucaaaugcucgugcauggcugcaaaaaccaguagucuggguccagagcggagcguucccgacgcccggacccgcauccgcccuguguccuugguag

SEQ ID NO: 248352 - RNA, 17298 nt, Artificial Sequence
  Description of Artificial Sequence: Synthetic coding sequence
augggagcuccguccgccugucggacccugguguuggcccucgccgcgaugcugguugugccucaggcugagacucagggcccuguugaaccaucaugggagaaugccggacauacuauggacgggggggcucccacaaguagucccacaagaagaguuuccuuugugccuccuguuacaguuuuucccucacugucaccuuugaauccugcccacaacgguagggucugcaguaccuggggcgacuuucacuacaaaacuuuugacggagacguguuccgcuucccaggacuauguaacuacguuuucucugagcacuguagggccgcauacgaagacuuuaacguucagcuaagaagagggcugguuggcucccggccagucguaacuagggugguuauuaaagcucagggccuagugcuugaagcgucuaauggcucugugcuuaucaacggacagagggaggaacuuccuuauagccguacuggucuccuugucgaacaauccggcgauuauaucaaggucagcaucaggcugguucugacuuuucuguggaauggggaggauuccgcccuucucgaacuugaccccaaauacgccaaucagaccugcggacuguguggggauuucaacggacugccagcuuucaacgaguucuacgcacauaacgcacgccuuacaccccugcaguucggcaaucuccagaaacuugacggucccacugaacaauguccggauccgcuuccuuugccagcuggaaacuguacugaugaggagggcauuugucaccgcacacuccuaggccccgccuucgcggagugccacgccuuagucgauagcacagcauacuuggcggcuugcgcucaggaccuuugucgguguccaacaugucccugugcaacguuuguugaguacagucgacagugugcacacgcagggggucaaccgaggaacuggcguugccccgagcuaugucccaggacauguccccuaaauaugcagcaccaggagugugguuccccauguacagacacauguucuaauccccagagggcgcagcuuugcgaggaccacugcguagauggcuguuucugcccucccggaaggucuugcacagucuuagaugacauuacccacucuggcugccugccuuuggggcagugcccuuguacucacggaggaagaacguacagcccggggaccucuuucaacaccacauguaguuccugcaccuguucgggcgggcuuuggcagugucaggaucugccuugcccagggacaugcucagugcagggcggagcucacaucagcacauaugacgaaaaguuguacgaccugcacggagauugcucauauguguuauccaaaaagugugccgauucauccuucacuguucuggcugaauuacguaaauguggccugacggauaaugaaaacugcuugaaggcuguaaccuugucccucgauggcggugacacggcaauacguguucaggccgauggcgguguguucuugaacucuauuuacacccaguugccccuguccgccgcuaauaucacucuuuuuaccccuucuucuuucuuuauuguuguucagacuggcuugggucuacaacucuugguucagcuggugccccuaaugcagguguucgugcggcuggaucccgcucaccaaggacagaugugcgggcugugcggcaauuuuaaccaaaaucaggcugaugauuucacugcucucucuggagugguagaagccaccggagcagcuuuugcuaacacauggaaagcgcaggcagccugcgccaaugcccgcaacucguuugaagacccuuguagucuaaguguugaaaacgaaaauuacgcacgccacuggugcucuagacucacagaccccaacucagccuucucuaggugccacaguauuauuaacccgaaaccauuucacaguaauugcauguuugauaccugcaacugcgaaagaucugaggacuguuugugcgccgcccugucuagcuacgugcaugcuugcgccgccaagggcguccaguugagugacuggagagacggcguauguacgaaguacaugcagaacuguccgaaaucucaacgcuaugcguacgugguggacgccugucagccaacguguagagggcuguccgaagccgacgucaccuguuccgucucauuugugccagucgacgguugcaccugucccgccggcaccuuccucaaugaugccggugcuugcgucccagcgcaggagugucccugcuacgcccauggaacugugcuugccccaggugagguaguucacgaugagggcgccguuuguaguuguacggguggcaaacugaguuguuugggugccagccugcagaaaucaacugguugcgcagcccccauggucuaucuggauuguuccaauuccucagccggcacuccaggcgcggaauguuugcgaucuugucacacacuggacgucggguguuucaguacccacugugucucuggaugugucuguccacccggccucguuagugacggaagcgggggcugcauugcugaagaagauuguccaugcguccauaaugaggcuacauauaagcccggagaaacaauuaggguggauuguaacacaugcaccugucgaaauaggaggugggaguguucgcaucgacuuugccucggcacauguguugcguauggcgacggacacuucauuacauuugacggcgaccgcuauucuuucgaaggaagcugugaguauauccuggcgcaagauuauuguggggauaauacaacccacggaacuuucagaauugugaccgaaaacauaccauguggcaccacugggacaacauguucaaaagcuaucaaauuauuuguggagaguuaugaguuaauuuuacaagaggguacuuucaaggcgguggccaggggcccgggcggggauccuccauauaagauacgcuacaugggcaucuuccuaguuaucgagacacaugggauggcuguguccugggaccggaagaccagcguguucauccggcugcaccaagacuacaaggggcguguguguggacugugcggaaacuuugacgacaacgccauuaaugacuucgccacccggagccggucuguagugggagacgcgcucgaguuuggaaacucauggaaauugucaccgucaugcccugacgcacuagcaccuaaggaucccugcacggccaaccccuucaggaaguccugggcccagaagcaguguucaaucuuacacggacccacauucgccgcuugcagaucacaaguggauuccacaaaauacuacgaagccugugucaacgacgccugcgcaugcgauucugguggcgacugcgaaugcuucuguacugcgguugcagcauaugcccaagcuugucacgacgccggguugugugugagcuggcguacucccgauacaugccccuuguucugugacuucuacaauccccacggaggaugcgaauggcauuaucagccauguggugcaccaugucuuaaaacaugucgaaaccccaguggccauugccugguggauuugccuggauuggagggauguuaccccaagugcccacccagucagcccuucuuuaaugaggaccagaugaagugcguagcgcaguguggcuguuacgacaaagacggaaacuauuaugacguuggagcaaggguaccaaccgcagaaaacugucagaguugcaauuguaccccaagcggcauacagugugcccacagcuuggaagccuguaccuguaccuacgaagaucggacguacagcuaccaggacgugaucuauaacacgacagacggccugggugcuugccugaucgcuauuuguggcuccaaugguaccaucauuagaaaggccguagcaugucccgggacuccugcuacuacaccuuuuacguuuaccacggcuugggucccucauagcacaacuucccccgcccucccugugagcaccgucugugugcgcgaaguaugccgauggagcucuugguacaacggucaccgaccggagccaggacucgggggcggggacuucgaaacuuuugagaaccuuaggcagcgcggauaccaggugugucccguucuggcagacauugaguguagggccgcccagcugccugauaugccucuugaggagcucggccagcaagucgacugcgauagaaugcgcgggcugaugugugccaacucacaacagagcccaccucugugccacgacuacgaacugcgagugcucugcugugaauauguacccugugggccuagcccagcaccaggaacaagcccgcaaccuagccucucugcauccacagaacccgccgugcccacaccaacacaaacaaccgcgacugaaaaaaccacuuugugggugacucccucuauucguuccaccgcagcucugaccucccagaccgggucuuccaguggaccugugacgguaacuccuagcgcacccggcacaacaacuugucagccucggugucaauggaccgaaugguuugaugaagauuauccuaaaucagaacagcuuggaggcgacguugagucuuaugauaagaucagagcugcuggcggucacuugugccagcagccuaaagacaucgagugccaggcagaauccuuuccaaacuggacgcucgcccagguggggcaaaaagugcauugugacgugcauuuuggacugguuugccgcaauugggagcaggaggggguauucaagaugugcuauaacuaucgaaucagggugcuguguuguagugacgaccacugucgcgggagggcaaccaccccaccucccacuaccgaauuagaaaccgccacaacaaccacuacccaggcacuguuuaguacaccgcaaccuaccucaaguccaggcuugacaagggcuccgcccgcuaguacaacugcagugcccacucuuuccgagggauuaacaucuccacgguacacuagcacccuuggcacagcgaccacaggggguccaaccacaccagcagggucaaccgaaccgacuguacccggaguggccacauccacccugccuacacguucugcccuuccgggcacaaccggaucucuggguaccuggcguccaucgcagccaccaaccuuagcgcccacaacuauggccacuuccagggccagaccuaccgguacagcgucaacggccuccaaggagccccugaccacaagccucgccccuacuuuaaccagcgaacuauccaccucccaggcugagaccucaacuccucgcacagagacaacuaugaguccucugacgaauaccacaaccagccagggaacaacucgcugucaaccgaaaugcgaauggacggagugguucgacguagauuucccaaccagugguguagccggaggugacauggagaccuucgaaaauauucgggcugcaggcggcaagaugugcugggcaccuaaaaguaucgagugccgagcugagaacuauccugaaguguccauugaucaggugggucaggugcugaccuguagccucgaaacaggcuuaaccugcaaaaaugaggaucagaccgguagauuuaauauguguuuuaauuacaauguucgcguccuuugcugcgacgacuacucucacugucccucaacuccagccacuaguagcaccgcuacuccaagcucaacgccaggcaccaccuggaucuuaacaaaaccuacuaccacugccacgaccacggcauccaccggguccaccgcuacaccaacuuccacucucagaacugccccuccgccgaaaguguugaccacaacugcaacaacaccgacugugacaaguucgaaggcuaccccuuccaguucacccggcacggcuaccgcuuuacccgcccuucgcagcacagcaaccacucccacugccacuucugucacaccaaucccuagcaguucucuggggacuaccuggacuaggcuuagccagaccaccaccccgaccgcaaccaugaguacagcaacaccaaguuccacacccgaaacggcucauacuuccacuguccugaccgcaacagcgaccacuacaggagccacaggguccguggcaacuccauccuccacuccaggcacggcccauacuacuaaagucccaacaaccacuacaaccggcuucacagccacccccaguuccagccccgggaccgcccugaccccuccgguguggaucucuaccacgaccacccccacaacacggggaagcacagugacaccuucuaguauccccggcacuacacauaccgcuacggugcucaccaccaccaccaccacuguggccacaggcucuauggccaccccgucuagcaguacacagacuaguggaacgccccccagucugaccacaaccgcgaccacuaucaccgccacaggaucaaccacgaauccuagcagcacucccggcacuacuccgauuccaccugugcugacaacuaccgcuacaacucccgcugcaacaaguaacacggugaccccauccagcgcucucggcacuacccauaccccacccguacccaauaccauggccacuacucauggucgcucucugcccccaaguuccccucacacaguaagaaccgccuggacgucagcaaccucagguauucuggguaccacucacauaacugagccaaguacggugaccucacacaccuuggccgcgacaacggguaccacccagcacucgacaccugcacugucuagcccccauccaaguucccguacaaccgagucgccuccaagcccuggcaccacaaccccuggccacaccacagccaccuccagaaccacugcuacggcaaccccaagcaaaacccguacaaguacccugcuaccuuccagcccuacuagugcuccaaucaccacugucgugacaaugggcugugagccccagugcgcuugguccgaaugguuagacuauuccuauccuaugccaggaccaagcggaggagacuucgacaccuacucaaauaucagggcugccggcggggccguuugugaacagccccucggucuugaauguagggcgcaggcccagcccggagugccccuacgugagcuggggcaagugguugagugcagcuuagacuucggccugguuugccgcaauagggagcaagugggcaaauucaagaugugcuuuaauuaugagauuagaguauuuugcugcaauuacggccacugucccagcacacccgcaacaucaucuacagcuaugccauccucuacccccgguacaacauggauucuaacagaacugacaacuacggcaaccacaaccgaauccacuggaucuacugcuacuccaagcagcacacccgggacgaccuggauccugacugagccaucuacaacagccaccgugacuguaccuaccgggaguaccgcgaccgcgucuagcacucaagccacagccggcacaccccaugucucgacgacagccacuacuccaaccgucacauccagcaaagccacacccuucagcucucccggcaccgcuacagcauugcccgcauugcgaagcacggcuacuacccccacugcgacuagcuucacugccauuccuucaagcagcuuggguaccacauggacccgccucagccagaccacaaccccaacugcuacuaugaguaccgccacgccaucuucaacuccugaaacgguucauacaucaaccguuuuaacaacgacugccacgacaacaggagcgacuggcaguguggcuacgccauccucuacuccaggaacagcucauacuacaaaagucuugaccaccaccacgacuggauucaccgcgacccccaguagcucuccuggcacugcgcgcacgcugccuguguggaucucaaccacaacaaccccuaccacacggggauccaccgugaccccuucaagcauucccgggacaacacauacccccacagugcucacuacgaccacaacgaccguggccaccgguagcauggccacuccuagcuccucuacccagaccuccgguacucccccuucccucaccaccacagcgacgacaauuacagccacuggcuccaccacuaauccuuccaguacaccaggaacuacuccuaucccaccuguacugacaacaaccgccacuacgccggccgcuaccaguuccaccguuaccccgucauccgcccucggcaccacucauaccccccccgugccaaacacaacugccaccacccaugggagaucucucuccccauccagcccucacaccguuagaacugccuggacuucugcuacaucaggcaccuuagggaccacacauaucacagaaccuaguacgggcacgucacauacacccgcggcuacgacugguacuacccagcacucgaccccagcucugagcaguccccauccgucuucuagaaccacugagucaccuccaucaccgggcaccacgacgccaggucacacaagagcuacuucacgcacaaccgccacagccacccccucuaagacuagaacuucaacucugcugcccaguagcccgacaucggcccccauuaccacaguugucaccaugggaugugagccucaaugugccuggucugaauggcuggauuacagcuauccuaugccaggccccucuggaggugacuuugauaccuacuccaauauccgugcugcaggcggggccgugugcgagcagccucugggucuggagugcagggcccaggcgcagccuggcgugccacuccgagagcugggacaggucguggagugcucucuggacuucggccuuguaugucgcaacagagagcaggugggaaaauuuaaaaugugcuucaacuacgaaaucaggguguucugcugcaacuauggccacugcccuaguaccccagcuaccaguagcaccgcaacucccagcucaacgccuggcaccaccuggauccugaccgagcagacgacagcggcuaccacuacagccacgacugggucuacggcgauucccagcucaacuccuggcacagcuccaccaccuaaaguccuuacauccacugcuacaacgcccacagcgacaagcagcaaagccaccagcuccucguccccucgaacagccacuaccuugccgguacuaaccucaacggccacaaagucgaccgcaacaucuuucacgccuauuccaagcuucacucugggaacaacuggaacucuaccugagcagaccacaacaccuauggcuaccaugucuaccauucauccaucuuccacuccggaaaccacacauacgucaaccgugcugacgacaaaggcaacaacgacaagagcaacauccucuaugaguacaccuucuucaacuccagguacuacuuggauuuugaccgaacugacgacagccgcaaccaccacggcugcuacaggacccaccgcaacaccaagcuccaccccaggcaccacauggauacuuacugagccauccacaacagcaaccguuaccguucccacugggucuaccgccaccgcuucuucuacacgugccaccgccggcacauuaaaggugcucacaucuacagccacaacgcccacagugauuagcucccgagcuacacccucuuccagcccagguacagccaccgcccuaccagcccuucggucaaccgcaacaacuccuacugccacuuccguuacagcaauuccauccagcagccuggguacugccuggacacgacugagccagacuaccacaccaacggccaccaugucuacagccacuccuaguagcacuccagaaaccgugcauaccucuacaguccugaccacaacaacuacgacaacaagggccacuggcucugucgcaacuccaucaaguaccccaggcaccgcccacacaacaaaagucccaaccaccacuacuacuggauucacugcgaccccuuccaguagccccgggacagcgcugacaccgccaguuuggauuaguaccacaacuacuccuaccacucggggcagcaccgugaccccaucuagcaucccugguaccacacacacggccacuguguugacaacuacaaccaccacuguggcaacaggauccauggcuacuccuucguccagcacacagacuucagggaccccacccucccugaccacaaccgcgacaacuaucacugcuaccggaagcacuaccaauccguccucaacgccuggaacaacuccgaucccacccguguugacaacaaccgccacaacuccugccgcuacuuccagcaccgugacccccucuagugcucugggcacaacccauacaccaccaguacccaauacgaccgccacaacgcauggcagaucgcuuccacccagcucgccacacaccgugcgaaccgcguggaccuccgccaccuccggcauucuaggcaccacucacaucacagaacccagcacagugacuucacauacacccgccgccaccacaucgacgacccagcauucaacacccgcccugucuagcccgcaucccucgagccguacuaccgagucgcccccuucaccugguacaacuacuccgggucacacucggggaacaagcagaacuacagccaccgcgacgccaaguaagacucggacaucgacucugcugccaaguagccccaccagcgccccaauuacgaccguggugaccaccgguugcgaaccucaaugugcuuggagcgaguggcuugacuauaguuacccgaugccuggccccucggggggggauuuugauacauacagcaauauaagggcagcuggaggagcagugugcgaacaaccgcuggggcuggaaugccgugcucaggcacagcccggcguuccuuuacgggagcugggacagguuguggagugcagucuggauuuuggccucgugugucgaaaucgcgaacagguuggaaaauucaagauguguuuuaauuaugaaaucagaguguucugcugcaacuauggacacugucccuccacgccugcaacaucuucaacagcaacaccuuccuccacuccaggcaccacuuggauauuaacaaaacugaccacuaccgcuaccacgacagagucgacagguagcaccgcaacuccaucaucuaccccuggaacaaccuggauucucaccgagccuuccacgacugcaacagucaccguuccaacuggcuccacagccacggccagcaguacgcaggcuaccgccggaaccccacacgugucaaccaccgccacuacgccuaccgucaccuccucaaaagcaacuccuuuuucaucaccugguaccgcgacugcucuuccagcgcugcguaguacugcuacuacgccgacugcuacuuccuucacagcuaucccguccucaagucuggggacaaccuggacacgccugucucagacaacuacuccaaccgcaacaauguccacagcaacuccuagcucaacgcccgagacagcacauacauccaccguccuuacgacgacagccacaacuacucgugccacaggguccguugcgacacccagcucuacucccggaacggcccacacaacaaagguccccaccacaacaaccacaggauucaccgugacgccauccaguucucccgguaccgcccggacuccaccaguuuggauaagcaccaccaccacacccaccacuagcggcucaacaguaacuccuucaucagucccuggcaccacgcacacccccaccguacucacaaccaccaccacaaccguggccacuggaaguauggcaacaccaaguagcuccacacaaacaagcggaacuccgcccucacugauuacaacggccaccaccauuacggcuaccgggucaacaacaaaccccagcucaacuccuggaaccaccccuauuccgcccgugcucaccacgacggcuaccacgcccgccgcuaccucuaguacaguaaccccuucaucugcucugggcacgacacacacuccucccguccccaauaccacggccacaacucacggacguucucuguccccaucaucaccucacacagugcgaacagcuuggacaagugccacuuccggcacacugggaaccacacacaucaccgaaccuucuaccgguaccucacacacaccagcugcaacuacugguacgacacagcauaguacaccagcacugaguagcccucaccccucuagcaggaccacagaaagcccgccaagcccaggaaccaccacacccgggcacacaacagcaaccuccagaacaaccgcaaccgcuaccccguccaagacaagaaccagcacucugcuuccaagcagcccaacuagugcccccauaacuacaguggugaccacaggcugcgaaccccagugugccuggagcgaguggcuggacuacagcuaucccaugccagggccuagcggcggcgauuuugauaccuacagcaauauaagagcugcugggggagcaguuugcgagcaaccccugggauuagaaugccgggcucaggcccagccuggggucccacugggcgaacugggccaggucguagagugcucucuagacuucggccuagucuguaggaauagagaacagguugggaaauuuaagaugugcuuuaacuacgagauccgggucuucuguugcaacuauggacacugucccucuacucccgccacauccagcaccgcuaugcccagcucaacaccgggaacaaccuggauccucacugaacugaccaccaccgcuacuaccacagcuucgacgggauccacagcaaccccaaguagcacccccggaaccgcuccgccuccuaagguuuugacaaguccugcgacgacgccuacugcaacuuccucgaaagcuaccucuuccucauccccuagaaccgccaccacccucccuguacucacgucgacggcaacuaagucuaccgcuaccagcgugacgccuauacccaguuccacucuagggacuaccggaacacugccugaacagacaacuaccccggucgccacaaugucuacaauacacccuucguccacccccgagaccacccacacaucaacggugcugacuacgaaggcaacgacaacacgcgccacauccagcaccagcaccccauccucaacucccggcacaaccuggauccugaccgagcugaccaccgccgcuaccacuacagcggccacaggacccacugcgacacccucuucuacuccaggaaccacuuggauccuuaccgagcugaccacaaccgcgaccacaacagcuucuacaggcaguaccgcaacgcccucauccacucccggcaccacguggauucugacugagccgucuacuacagccacagucaccgugcccaccggguccaccgcaacugcuaguucuacacaggcuacugcggggaccccacauguuuccaccacggccaccacacccacaguaacuucgagcaaagcuaccccuuccucaucaccagggacugccaccgcccuuccagccuuacggucuaccgccacuacccccacugccacauccuucacugcaauaccuucgucaagucuuggcacuacguggacccgccucagccagaccacaacaccuacagccacgauguccacugcaaccccaagcucaacuccagagacagugcacacuagcaccgugcugacagcaaccgccaccacgacaggugcgaccggcagcguggcgacacccucaucuacaccagguaccgcccacaccacuaaggugccaaccaccacuaccacaggguucaccgcuaccccaucuuccagcccagguacugcccugacuccucccgucuggauaucuaccaccacuacacccacuacaaccacuccuacaacuucugguagcacuguuacccccuccaguauaccaggcacuacacauacugcuagagugcugacuaccacaaccacgaccguagccacuggcuccauggccacucccagcucaaguacccagacgucgggcacuccuccaagcuuaacaaccacggcaaccacaauuaccgccacaggcagcacuacuaauccgucaucuacacccggaacaaccccaauuacucccguccugacauccaccgcuacuacgccugccgcaacuagcuccaaagcuaccucaucuucaucuccccggacagcgaccacccuaccuguguugaccucaacagcgacaaagaguacagccacgucuuuuacgccgaucccaaguuccacucuauggaccacuuggacugucccugcccagacuaccaccccuaugucaaccauguccacuauccacacaucaagcacccccgagacuacucacacaagcacaguucugacuacaaccgcuacaaugaccagggcaaccaacucuaccgccacucccuccucuacccucgggacaacccggauucugacagagcuuaccacuacagccacaacuacagccgcaaccggcucaaccgcuacccugucuaguacuccaggaacaacguggauucuuacugagccuagcaccauugccacugucaugguuccuacaggcagcacagcaaccgccagcucaacucuggguacggcccauacccccaagguugugaccacgauggcuaccaugccaacggccacggcuuccacagugccaaguuccagcacuguaggaacaacucggaccccggccgugcucccuucaucccugcccaccuuuucggugagcacaguuucuucaucgguucugacaacacugcgaccaacaggcuuuccauccucccacuuuaguacaccaugcuuuugccgagccuuuggacaauuuuucucaccuggcgaggugaucuauaauaaaaccgaucgcgccggcugccacuuuuacgcugucuguaaucagcacugcgauaucgaccgcuuucaaggggcaugcccaacaucucccccaccaguuaguucugcuccauugaguagucccagcccagcucccggaugcgauaacgccauuccacuucgucaggucaaugaaacauggacccuugaaaauuguaccguggcaagaugcgugggugacaauagaguagugcuccuugacccgaaaccagucgccaacguaacaugcgugaacaaacaccuccccaucaaagugagugaccccucccagccgugcgauuuucauuacgagugcgaaugcauuugcucuauguggggaggcagucacuacucaaccuuugacgggaccuccuauacuuuucgaggcaacuguacuuacguccucaugagagaaauccacgcacgcuuugggaaucuaucccuguaccuggacaaccacuauugcaccgccuccgcuacagcggcggcagcaagauguccgagagcacuuaguauucacuacaagaguauggauaucguucuaacuguaacuaugguacaugggaaggaagagggccugauacucuucgaccaaaucccgguuuccuccggguucucuaaaaaugguguauuagugagcgugcuggguaccacaaccaugcgcguggauaucccugcauugggaguaucuguaacuuuuaacggccagguguuccaggccagacuaccuuacucucuuuuccacaauaauaccgagggacaauguggaaccugcacgaacaaucagcgugaugauugccugcagagagacggaaccacagcagcuucaugcaaggacauggccaagacauggcucguuccagacucuagaaaagaugggugcugggcccccacuggcaccccaccuacugccuccccggcugccccuguuagcucgacucccacacccacaccaugccccccacaaccccuuugugaccugaugcucucucaaguguucgcugaaugucacaaccuugugcccccagggccauucuucaaugcuuguauuagugaccacugccgcgggcgucuggaaguuccgugucaaucacuggaggcauaugcagagcugugccgagcgcgaggaguuugcucagacuggcgcggcgcuacaggaggacugugugaucugacaugccccccuacgaaggucuacaaacccugcggcccaauucaacccgcuacuuguaauagccgaaaucaaucuccgcagcuugaggggauggcagaggguugcuucugcccagaggaccagauccuguucaaugcccauaugggcauuugcguacaggcuugccccugcguaggaccagacggcuucccaaaguuuccaggcgaaagguggguaagcaacugccaguccugcguaugcgaugagggcuccgugaguguccagugcaaaccucugccuugcgaugcucagggccaaccgcccccuugcaaccggcccggauuugugacugugacucguccccgggccgaaaacccaugcugcccagaaacugucugcguuugcaauacgaccaccuguccccagucucucccaguuuguccacccggccaggaguccaucugcacucaagaggagggagacuguugcccaacauucaggugccggccucagcuuugcagcuauaaugggaccuuuuacggggugggagcgacauuuccgggcgcauugccuugucacauguguacaugucuguccggugauacucaagauccuacaguucagugccaggaggaugcgugcaacaacaccaccuguccucaaggguucgaguauaagcgggucgcuggccaaugcuguggcgagugcgugcaaacggccugccugacccccgauggacagccuguucaacuuaacgaaaccugggugaauucucacgucgauaauugcacggucuaucugugugaggccgaagguggcgugcaucugcugacuccccaacccgccucuugcccugacguguccucgugcagagggagucuccgcaagacugggugcugcuacucuugcgaggaggacagcugccaagugcgcauaaacacgaccauucucuggcaccaagggugcgagacagagguaaacauuacuuucugcgaaggaaguugcccaggagccuccaaauacucugcggaagcccaggccaugcagcaccaguguacauguugucaggagagacgcguacaugaggagaccgugccccugcacuguccuaacgggucugccauuuugcacacguacacacauguugaugaguguggguguacgcccuucugcguccccgcgccgauggccccgccucauacucggggguuuccugcucaagaggcaaccgcggucuag

SEQ ID NO: 248353 - RNA, 17289 nt, Artificial Sequence
  Description of Artificial Sequence: Synthetic coding sequence
augggagcucccuccgccugcagaacccuugugcuggccuuggcugcaauguuggugguuccccaggccgagacucagggccccguugagccaaguugggagaaugccggccauacaauggaugguggcgcuccaacuaguucacccacacgacgaguuucuuuugucccuccuguuacgguauuuccuucccugagcccucucaauccagcucauaacgggcgggucuguaguaccuggggagacuuccacuauaaaaccuuugacggcgacgucuuucgauuuccagggcuuuguaauuacgucuucagcgagcauuguagagccgccuacgaagacuuuaacguucagcugcgccgaggucucgugggaucgaggccuguugugacacgcgucguaaucaaggcccaaggacuagugcuugaggccaguaauggaaguguucuuaucaacggacagcgcgaggagcugccguacaguagaacugggcugcucgucgagcagucaggagauuacaucaaagucuccauuagacuggucuugaccuuccuguggaacggagaagacuccgcgcuccuggagcuggaucccaaauacgcuaaccaaacgugcggguugugcggcgacuucaacgggcuuccugcuuucaacgaguucuacgcccacaacgcccggcugacgccacuacaauuuggcaaucuucagaaauuggauggacccacggagcagugcccugauccccucccuuuaccagccggcaauugcaccgaugaggaaggcauuugucaccgcacucugcugggacccgccuuugccgaaugccacgcccugguugacucgaccgcuuaucuggcugccugcgcccaagacuugugcagaugcccaacaugucccugcgcuaccuucguugaguacagccgccagugugcacacgccggaggacagccucguaacuggcggugcccggagcuuugcccaaggacgugcccucugaacaugcagcaucaggagugcgggaguccuugcacugacacuuguucuaacccucagcgggcccaacugugcgaagaucacugugucgacggaugcuuuugcccuccaggaacaguccuggaugacaucacucauagugggugcuuaccacugggccaaugcccaugcacccaugggggacguaccuauucgccuggaacgagcuuuaauaccaccugcagcaguugcacuuguucgggaggacucuggcaaugucaggaccuuccauguccagggacuuguuccguucaaggaggagcacauaucucaacauaugacgaaaagcuguaugaccugcacggcgacuguucguacgugcugaguaagaagugcgccgacucuagcuucaccguguuggccgaacuucggaaguguggauugacugauaacgagaacugucuuaaggcgguuacacugucccucgacggcggagacacggcuaucagaguacaggcagaugggggcguguuuuuaaauuccaucuauacccagcuccccuugucugcggcaaacauuacauuguucaccccaucguccuuuuuuaucguuguacaaacaggacucggacuucaacuauuagugcagcuggucccacucaugcaaguuuucguuagacuggacccagcucaccaaggccaaaugugcgggcucuguggcaauuucaaucagaaucaggccgaugauuuuacugcccuaucaggcgucguggaggccaccggagcagccuucgcaaacacauggaaagcccaggccgcaugugccaaugcgcgcaauuccuucgaagacccaugcucacugagcguggaaaacgagaacuaugcccggcauuggugcucgcgacugacugauccuaauucugccuuuaguagaugccacucgauaauuaaccccaagccuuuucacucuaauuguauguuugacacauguaauugugagcguagcgaggauugcuugugugccgccuugagcucauacguacaugcaugcgccgcaaagggagugcagcuguccgacuggcgagauggggucugcacgaaguacaugcagaacugcccaaaaagccaaagauaugcuuacgugguggacgcuugccagccaaccugucgggguuuaucugaggccgacgucacuugcucaguauccuucguccccguggauggcugcaccuguccugccgguaccuuccugaaugacgcuggcgccugugugccugcucaggaauguccaugcuaugcccacggaacggugcuggcucccggagagguugugcacgacgaaggagcgguuugcucauguacggguggaaaguuaaguugcuugggcgccaguuugcaaaaaagcacaggcugcgcugcccccauggucuauuuggauugcucaaauagcuccgcugguacacccggagcugaaugccuuaggucaugucacacccuugaugugggauguuuuucuacucacugcgucaguggcugcguguguccucccggacuggucagugaugguagugguggauguaucgccgaggaggacuguccaugcguccacaacgaagcuacauauaaacccggggaaacgauaagggucgacugcaacacuuguaccugccggaaucgcaggugggaauguucacauagguugugccugggcaccugcguagcguacggugauggccacuucaucaccuuugacggcgaccgcuacagcuucgagggauccugugaguauauucuggcgcaggauuauuguggggacaacaccacccauggaacuuucagaaucgucaccgaaaacaucccaugugggacaaccggaacuacuuguaguaaggcuauaaagcucuucgucgaauccuacgaacugauccugcaggaggggacguucaaggcagucgcacgagggcccggaggcgacccucccuauaagauucgguacaugggcauuuuccugguuaucgaaacacaugguauggcggucucgugggaccguaaaacaagcguguuuauuagacuacaccaggauuacaaaggccgugucugcgggcucuguggcaacuucgacgacaacgcuaucaacgacuucgcuacaaggagccggagcguugugggggacgcguuagaauuuggaaauuccuggaagcucuccccauccuguccagacgcccuggcuccaaaggauccuugcacugcaaacccuuuucgaaagaguugggcccaaaaacaguguucuauacuucacgggccuaccuucgccgccugcagaagccaagucgacucaacgaaguauuaugaggcaugugucaacgacgcaugugcgugcgauagcggaggcgacugcgaguguuuuuguaccgccguugcagccuacgcccaagcaugccacgacgccggucucugcgugucuuggagaaccccugauacgugcccacucuucugugacuucuacaacccucauggcgggugugaauggcauuaucagccaugcggggcaccgugucuuaagacuugcagaaacccuuccggacauugccugguggaccugcccggccuggagggaugcuacccaaaaugcccacccucucagccguucuucaaugaagaccagaugaagugcguggcccaaugcggaugcuaugacaaagaugguaauuacuaugacgugggggcuagaguucccaccgccgaaaauugccagucauguaacugcacccccagugggauccagugugcgcacagccuugaggcuugcacaugcacuuaugaggauaggacauacuccuaccaggaugucaucuacaauaccacugauggucugggcgccugucuaaucgcuauaugugguagcaauggcacuaucauccgaaaggccgucgccugucccggcaccccugccacgaccccuuuuaccuucacaacugcuugggucccacauucuaccacuucucccgcacucccuguguccacuguaugcguccgggaagucugucguuggaguucgugguauaacggucaccggcccgagccugggcuuggugggggggauuucgaaacguuugagaacuugagacagcggggguaccagguaugcccaguucuggcggacauugagugcagggcugcccagcucccagacaugcccuuagaagaacugggucagcagguagauugugaucggaugagaggacucaugugcgcgaacagucaacagucaccaccucucugucacgauuaugagcuucggguccucuguugcgaauaugugcccugcggccccaguccagcucccggcaccucuccgcagccuucacuaucagcuagcacggaaccugccguccccacuccuacccagacgaccgccacggaaaaaacaacacuaugggucacacccucuauacgaucaacagcggcccuuacuagccagacagguaguagcuccgguccggucaccguaacccccuccgccccaggaaccaccacuugccaaccucgaugucaguggacugagugguucgacgaagacuacccuaaguccgagcagcugggaggugauguagaguccuaugauaagauccgcgcugcggggggccaucucugucagcaacccaaggauaucgagugucaggccgaaucguucccaaauuggacccuggcacaggugggccagaaggugcacugcgacguacauuucggccugguuugccgcaacugggagcaggagggaguguucaaaaugugcuacaauuaccggauucgagucuuauguugcagugacgaccauuguagaggaagagccaccacgccaccuccaaccaccgagcuggagaccgccaccacuacgaccacccaggcacuguucagcacaccacagccuacauccaguccuggacugacccgagcuccuccagccaguacaacagccgugccaacacuaagugaaggacugacguccccccgcuacaccucuacacugggcacugccaccaccgggggaccaacgacgccugcugggucuaccgaaccuacugucccaggaguugcaacaaguacacugcccacaagguccgcacuaccugguacuacaggcucgcuuggcacguggaggccaagccaaccuccaacuuuggcccccaccacuauggcuacuucuagagcacgcccuaccgguaccgcuucaacugcaucaaaagaaccgcucacaaccucuuuggcgccuacccugaccagcgagcucagcacgucccaggcugaaacuuccacaccccgcacagaaaccacuaugagcccgcugacaaacacaacuacaagucaggggacaacacgcugucagcccaagugcgaguggacugaaugguucgauguggacuuccccaccucaggcguggccggaggcgauauggagacuuuugaaaacauucgggccgcagguggcaagauguguugggcacccaagagcaucgagugcagggccgagaacuacccggagguaagcauagaucaggugggacaggugcugacaugcucacuggagaccggucucacaugcaaaaaugaagaccagacaggacgcuucaauaugugcuucaauuauaacgucagaguucucugcugugaugauuauucacacuguccuucaacaccagcaaccuccuccaccgcaaccccaucuaguacgccgggaacaacuuggauuuugacgaagccgaccacgaccgccacuaccacugccuccacuggaucaaccgccaccccaacgagcacguugcggaccgccccuccccccaagguccuaacaacaaccgccacaacaccaaccguaaccagcagcaaagcuacgcccagcuccuccccugguacagcaacggcccuacccgcucuucgcuccaccgccacaaccccaaccgcaaccucugugacaccuauuccgucaucgaguuugggcacuaccuggacacgcuuaagccaaaccacgaccccuacggccacuauguccaccgccacccccucaucaacuccagagaccgcccacacauccaccgugcuaacugcgaccgccacaaccaccggcgccacaggaucaguggcgacuccuuccagcacaccaggaacggcucacacaaccaaaguucccaccacaaccacgaccggauucacagcaaccccuagcucaucccccggaaccgcacuaacaccuccuguuuggaucagcacaacuacaaccccaacaaccagaggaucaacagucacccccagcucuauuccgggaacuacccacacugcaacagugcugacuaccacuacgacaacagucgccacugguucgauggcuacuccuuccagcucaacacagacauccggcacuccaccaucccugacuaccacugccaccacuaucacagcgaccggcucaacuacgaacccgucuagcacgccaggcacgacacccauuccucccgugcugacuacgacagcuacaacuccagcagcgacgucuaacaccgugacucccuccucugcacuggggacuacucacaccccacccgugccuaacaccauggcaaccacucacggcagaagccugccucccuccagcccucacaccguuagaaccgcauggacaagcgcaacauccggcauccuuggcacgacacacauuacugagccauccaccgugacgucccauacccucgccgcuacuacaggaacuacacagcauuccacgccagcccuuagcagcccacacccaucaucaagaacaacagagucaccucccaguccugggaccacaacaccaggccauacaacagccaccucaaggacuacagcuaccgccacuccguccaaaacccgaacuaguaccuugcuuccgagcagucccaccucugccccaaucacaacuguugugacaauggggugugaaccacagugcgcauggucugaauggcucgauuauucuuaccccaugccuggaccaucggggggcgacuuugacaccuacuccaauaucagggcugcugguggggcgguuugcgagcaaccuuugggguuggaauguagggcccaggcucagccgggcguuccacuucgcgagcucggccaggucgucgaaugcagccuggauuuuggauuaguguguagaaaccgggaacaagucggcaaguucaaaaugugcuuuaacuaugaaauuagaguauuuugcuguaauuaugggcacugucccucuacuccugcuaccucguccaccgcaaugccauccucuacgccugggacaaccuggauccugacugagcugaccacuacagccacuacuacagaaucaacugguucuaccgcuacccccagcaguacaccagguaccaccuggauccugacugaacccuccaccacugcuacggugacgguacccacugggucgacggcuaccgcaucuuccacucaagcuacugcaggcacuccucacguuagcacgacagcuaccacaccaaccguuacuucaagcaaggcuacuccuuucucuucuccaggcacugccacagccuuaccugccuugcggucgaccgccacaacacccaccgcaacuucauucaccgcaauuccgucaucuucucugggcacgacuuggacuagacugagccagaccaccacccccacugccaccaugagcacagccaccccaucauccacccccgagaccguucacacaucaaccgugcucaccacuacagccacuaccacaggagccacagguuccgucgccacaccgaguucgacgccggguaccgcucacacuacuaaaguccucacaaccaccaccacaggguucacugccacuccuagcaguaguccuggaacugcccgaacucugccuguguggauuagcacuacgacaacuccuaccacuagaggaagcacugucaccccuucuagcauucccggcacuacgcacaccccgacgguuuuaacaaccaccaccacuacuguggcaacuggaaguauggcaacccccagcucuucaacgcagacuagcggaacucccccaucucuaaccacaacagcaacuacaaucacggcgacaggaucgacaacaaauccuagcucuaccccagggaccaccccgaucccuccaguguuaacaacaacugccaccaccccugcugcuaccucauccacggucaccccuuccucagcccuuggcaccacucauacaccuccugucccgaauacaacagcaacaacgcacggacgcagccugagcccgagcagcccgcauaccguccguacugcuuggacauccgcaacuucuggcacguuaggcacuacucacauaacugaaccaucaacaggcaccagccauacccccgcggcuaccacagggacuacccagcauucuacacccgcgcuuucuuccccucacccuuccagcaggaccaccgagucaccccccuccccugggaccacaacacccggccauacccgcgcaaccucacgcacaaccgccacggcuacaccuuccaagacacguacaucaaccuuguugccaucuucaccuacuucugcacccaucacaaccgucgugaccaugggaugcgaaccucagugugcauggucugagugguuagacuauaguuaucccaugccuggacccagcggcggagacuuugacacuuacagcaacauaagagcagccggcggagccgugugcgagcaaccucugggccucgaauguagggcccaagcccaaccaggcgucccgcuucgugagcuuggucaggugguggagugcucucuggacuucggcuuggugugucguaaccgcgagcagguaggaaaguuuaagaugugcuuuaacuacgagauucgcgucuuuugcugcaacuacggacacugcccuucuacuccugccacguccucuacagccacacccucuaguacaccaggcaccacuuggauucugacggaacaaacaaccgccgcuacuacaaccgccacuacugggucgacugcaaucccuucgagcaccccaggcaccgcaccucccccuaaaguucugaccagcacugccaccacccccaccgccacaagcucuaaggccacaagcucaucuucuccucggacugcaacaacgcuaccuguguuaacaucuacggccacaaagaguacggcaacuucuuucacgccuaucccauccuucacccucggaacuacuggcacccugcccgaacagacaacgaccccaauggccaccaugagcacaauacauccgucuucuacuccggagacuacacacacguccacugugcugacaaccaaagccacuaccacccgcgcuaccucaaguaugucaacuccauccagcacuccugggaccacuuggauucuuaccgaacugaccacugccgccaccacgacagccgccaccggaccuaccgcaacuccaucgagcacuccaggaaccacuuggauacugaccgaacccucaacaacugccacugugaccgucccgacaggcagcacagccaccgcaagcagcacacgggccacagccgggacgcuaaaaguuuugaccuccaccgccacuacaccgaccgugaucagcagucgcgcuaccccguccagcucgccggguacugccaccgcccucccagcuuuaagaucaaccgcuacaacaccgacagcaaccagcguuacagccauuccaucauccagucuuggcacugccuggacccgacugucccaaacaaccacacccaccgccaccaugaguaccgccacacccagcucaaccccggagacaguccacaccagcaccguauuaaccaccacaacaacaacaacccgggcgacaggcuccguugcuacuccuucuaguacaccuggaacagcacauacuaccaaggugccuacgaccaccaccacugguuuuaccgcaaccccaagcuccucccccggcacugcgcuuacaccccccguuuggauaucuacaacuacaaccccuaccacgagagggaguacuguuacuccaucaucaauccccgggacaacgcacacggcgacagugcuaacuacuacaacuacuaccguggccaccgggucaauggccacacccucauccuccacacagacaagcggcacgcccccgucccugacgaccaccgcuacgacuaucacagcaacagggucuacaacuaauccgagcucaacccccgggaccacuccuauuccaccuguacugacaacaaccgcuaccacaccagcugcgaccagcagcaccgucacuccuuccagcgcuuugggcaccacgcacaccccuccagugcccaacacuacagccacaacacaugggcggucacugccacccagcucaccccauaccgugaggaccgcauggacauccgcuacgaguggaauucuggggaccacacacauaacagagccuagcaccguuaccucccacacgcccgccgccacaacaaguacgacccaacacagcacccccgcucugaguuccccucauccgagcucaagaacaaccgagucaccaccauccccagguaccacaacccccggucacaccagagguacaucgcgaacuacagcaacagccacaccauccaagacccgcacuuccacccugcuaccauccucaccgacgucggcucccauuacgaccguaguuaccacaggcugugaaccacagugcgcauggucagaaugguuggauuauucuuauccaaugcccggcccaucgggcggagacuuugacaccuauucuaacauccgggcggcugguggagcugugugugagcaacccuugggacuggaaugucgggcacaggcacagcccggugugcccuugcgcgaacugggccaaguggucgagugcucccuggacuucggauuagugugccguaaccgcgaacaggugggaaaguuuaagauguguuuuaacuacgagaucagagucuucuguugcaauuacggacauugcccgucuaccccugcuacuucuucaaccgccacccccuccucuacaccuggcacaaccuggaucuugaccaaguuaaccacuaccgcuacgacaaccgaauccaccggaucaacagcgacaccuuccucuaccccgggcaccacauggauacugaccgaaccuagcaccacagccacagugacugugccaacggggagcaccgcuacagccagcaguacccaagcaacugcugggaccccucaugugucuacaaccgcaacuacuccaacagugacuucuagcaaggccacacccuucagcaguccaggcacagcaaccgcacugccugcacugcguuccaccgccacaaccccaacagccaccagcuucacagcaauuccuucgaguagcuuggggacaacauggacccgccugucccagaccacuacaccgacggccaccauguccaccgccacuccuucuagcacuccugagacggcacacacgagcacagugcuuacaaccacagcuacaacuaccagggcuaccggcaguguggcaacucccucuucuaccccugguaccgcacacacaacgaaaguaccuaccacaaccacuacaggcuucaccguaacgccauccucaucaccaggcaccgcuagaacgccuccugucuggaucuccaccaccacuacacccacaaccagcgggagcacugucacacccagcucagucccuggaacuacccacaccccuaccguauugacaaccaccacaacuacggucgcaacagguucuauggcaacuccauccagcagcacucagacaaguggaacuccaccgucauugauuacgaccgccacgacaaucaccgcaacuggguccacaaccaaucccagcucaaccccagguaccacaccaauccccccggugcuuacaaccaccgcaaccacuccagccgccaccuccagcacugugacaccaucuucugcgcuuggaacaacacacacacccccagugccaaauaccacugccacaacccauggucgaucccuguccccuagcuccccucacacuguuaggacagcauggaccagcgccacuagugggacccuggguacaacucacaucacggaacccagcacaggcacaucgcacacacccgcugccaccacagggaccacccaacauucuacaccugcccucuccaguccucaucccuccucucgcaccaccgaguccccuccaucaccagggaccacgacacccgggcauacuaccgccaccaguaggacaaccgcuacagcaacaccuaguaagacuagaacaucgacccugcugccaaguuccccaacuagcgcaccuauaacaaccguggugaccacagggugcgagccccaaugugccuggagcgaguggcuggacuacucguacccgaugccaggcccuucuggcggagauuucgacacauauuccaauauaagggccgccggaggcgccgucugcgaacagccccuggggcuggagugccgagcccaggcccagccgggcgucccacucggugagcugggucagguugucgaaugcagucuggauuucggucuggugugucgaaaccgcgaacaggugggaaaauuuaaaauguguuucaacuacgaaauucggguuuucugcuguaauuacggacacuguccuagcacuccugccacuuccagcaccgcuaugcccucuagcacuccugguaccaccuggauucugaccgaguuaacaacuacagccaccaccacagccaguaccggaucaaccgccacucccagcagcaccccgggaaccgccccgccuccaaaaguguuaaccagucccgccaccacuccaaccgcuaccucuagcaaagccaccagcaguuccucuccuaggaccgccaccacauuaccggugcuuacuagcaccgcuaccaaauccacggccaccagugugacccccauuccaucaucaacccucggaacuaccggcacccugcccgaacaaaccacgacucccguagcaacaaugucuacgauccaucccuccucaacaccggagaccacacauacgucuacagugcuaacuacuaaggcaacaaccacucgcgcuacaucuuccacauccaccccuaguucaacaccaggaaccaccuggauuuugacagaauugacaacagccgccacaacaaccgcggcaaccggcccuaccgcuacuccaucaaguacccccgggacaacuuggauacuuacagagcugacuaccacugccacgacuaccgcuagcacaggcucuaccgccacuccgucaagcacgccaggcacaacuuggauucugacugagcccucgaccacagccaccgugacugucccaacaggauccacugcaaccgccucauccacacaggccacugccggcacaccccaugucucuacuacugccacuacuccuaccgugacaucaagcaaagccaccccaucaagcucaccggguacugcaaccgcacugcccgcucuccgaucuaccgccaccacccccacugcaaccuccuucacugcaaucccuuccucuucccuuggaacuaccuggaccaggcugagucagacuaccacaccaaccgccaccaugagcacggcaacacccagcucgacccccgaaacuguccauacaagcacaguucuuacggccacagcuacuacaacaggugcgacuggcucuguggcaacucccucgucuacaccagggacugcccacacuacuaaggugccuaccacuacaacgacugguuuuacugcaacgccuuccaguucaccggguaccgcccucaccccaccgguauggauuucaaccacaacaacaccgacaaccacgacacccaccacaucuggcagcaccguaacaccauccagcaucccaggaacuacccauaccgcaaggguacugaccaccaccaccacaaccgucgcgacaggcagcauggcaaccccuagcuccuccacacagacuucaggaacgccaccgucacugaccacuaccgcaacgaccaucacugccacuggcagcaccacaaacccaucuucuacccccggaaccacaccgauuaccccuguguuaacaaguacugcaacuacaccagcugcaacguccucuaaagcaacuucaucuuccucuccuagaacugccaccacacugcccgugcugaccucuacagcaaccaagucuacagcuaccuccuucaccccuauccccuccucuacccuguggacgacuuggacagucccugcucagacuaccaccccaaugucuacuaugucuacuauccacacuucuuccaccccagaaaccacacacacaaguacuguucugacaaccacugcuacaaugacccgggcaacuaacucaacugcaacuccaaguagcacccugggcaccacacggauucucaccgaguugacaacgacagccacuacuacagcagcaaccggaucuacagccacacucucuaguacgcccgggaccaccuggauucugaccgaaccgaguacaaucgcgaccgugauggugccgaccggaucuacugcuacagccaguucuacacucggaacagcacacaccccuaaagugguuaccacuauggccacgaugcccaccgcuacggcaucgaccguacccuccuccagcacgguugggaccacccgcacgccugccguucugccuucaagccuccccaccuucucugucagcacagugaguucaagcgugcugacaacacugagaccuacuggguuucccucaucacacuuuuccacacccuguuuuugccgggcauucggacaauuuuuuucucccggggaggugaucuacaauaagacggauagagcuggcugucauuucuacgcaguuugcaaccagcauugcgacaucgaccgguuucagggcgccugcccaacuagcccaccgccugugagcucagcuccccuuagcaguccuagcccggccccuggaugcgauaacgccauuccccugcgccaggucaaugagacauggacuuuagagaauugcacaguggccaggugcguaggagauaauagaguggugcuuuuggacccaaagccugucgcaaacguuacgugugugaauaaacaccucccaaucaaagucucagauccaucccagccuugugacuuucauuaugagugcgaaugcauuuguagcauguggggugggagccauuauucaaccuuugaugggacuucuuacaccuuucgcggaaacugcacauacguauugaugagagagauacacgcacguuuuggcaaccuguccuuguauuuagauaaccauuacugcacagccuccgcaaccgcagcugccgcccgaugcccgagagcacuguccauucauuacaagucuauggacaucguacuuaccguuaccauggugcauggcaaggaggaggggcuaaucuuguucgaucaaaucccaguguccucaggauuuuccaagaacggcguccuggugucaguguugggcacuacuacaaugagagucgauaucccugcacucggcguuucggugaccuuuaauggccagguguuucaggcuagacugcccuauagucuguuccauaacaacaccgaagggcagugcgguaccugcaccaacaaucagagagaugauugucuccagcgggacggaaccacggcugcuuccugcaaggacauggcuaagaccuggcuggugccugacagccggaaagacggaugcugggcuccuaccgguacaccuccuacggccucaccagccgccccgguuagcucaaccccaacccccacacccuguccuccucaaccucuuugcgaccugaugcugucucagguauuugccgagugccacaaucuagugccuccggguccuuuuuucaacgccugcauaucggaccacugucgugggcgucuugagguucccugucagucacucgaagccuaugccgagcugugucgggccaggggcgucugcagcgacuggcggggggcuacuggcggccuuugugaccugacuugcccacccacaaaaguguacaaaccauguggccccauacagccugcaacgugcaacaguaggaaucagagcccacaacuggagggaauggccgaagguugcuucugcccugaggaucagauucucuucaaugcgcacaugggcauuugugugcaagcuugucccugcgucgggccugauggguuucccaaauuuccuggagagaggugggucuccaauugucagucauguguuugugacgaggggagcgucucaguacagugcaagccccuuccaugcgaugcccaagggcagcccccacccugcaaccgcccaggcuucguuacggucacuagaccaagagccgagaacccuuguugcccugaaacaguauguguguguaacaccaccacgugcccucagucgcugccgguuugccccccggggcaagaguccauuugcacccaggaagaaggcgacuguugucccacauuccgcugcaggccucaacucuguagcuacaacggcaccuucuacggggugggagccacguuuccaggagcucuucccugccauaugugcaccugucugagcggggauacacaggaucccacuguacagugucaagaagaugccugcaauaauaccacuuguccccagggauucgaauacaaaaggguugcuggacagugcugcggcgaaugcguacaaaccgcgugucucacuccugacggccagccagugcaauuaaacgaaacuuggguaaacagccacguugauaacugcacgguuuaccugugcgaggcagagggaggcguacaccuccugacaccccagccagcuagcugcccagacguuagcucaugccgugguucuuugcgcaagacaggcuguuguuauagcugugaagaggauuccugucaggugcgcaucaauacaacaauccuguggcaccaaggcugugaaaccgaggugaacauuacuuuuugcgagggcaguugcccuggagcuucuaaguacucugcugaagcccaggccaugcagcaccaaugcaccuguugucaagagcgacgggugcacgaggaaacuguaccccugcauugccccaauggcucggccauacuccauacauacacccacguugaugagugugguuguacccccuuuugugugccagcgcccauggcaccuccacacacacgcggcuuccccgcccaggaggcuacagcggucuag

SEQ ID NO: 248354 - RNA, 1611 nt, Artificial Sequence
  Description of Artificial Sequence: Synthetic coding sequence
gucuucuguugcaacuauggucacugcccucccaggcccccugcacucaggccuugccccccacccuugcgcgggagaccggggagcacugagcugacuaccacugccacaaccaccgccagcacaggcucaacagcgacaccuucaucaacgcccggcacagcccccccucccaagguucugacaagcccagcuaccacaccuacagcuacgaguuccaaagcaacaaguagcagcucuccuaggaccgcaacuacccugccugugcugacuucuaccgcaaccaagucaacagccaccagugugacucccaucccuuccaguacccucggaacuacuggaacacuaccagaacagaccacuacaccaguagcuaccaugagcaccauccacccuucuucuacuccagaaacuacgcacaccucuacgguccugacaaccaaggcaacgacaacuagagcuacaucaucaacuaguaccccuaguucuaccccagggacuacguggauccugacagaauuaacaacagcagccacuacaaccgcagccacuggccccacagcaaccccaucgucuacucccgggaccacauggauccugaccgaauugacuacaacugcuacuacaacagccuccacuggcucuaccgcuacccccaguucuacaccugggaccaccuggauacugacugagccuagcacuacugccaccguuacugugccuacugguagcacugccaccgcgucaucaacgcaggccacagcugguaccccccaugucucaacgaccgcuacaacacccaccguaacuucuucaaaggccacucccuccuccucgccaggcacagccacugcccugccugcccucagaagcacugcuacaacccauaguuaccaacuguauagccacccccuucugcucccgaccacauggacccgucuuucucaaacaaccacuccuacagcaacuaugucaacagccacaccuuccagcacgcccgagaccguucacacaucaacgguucugacugccacggcgacuaccacgggucccgcacuauggccccccccuccgccgccucaggaacaguugacacuucccaaaugccggcugccccagcccaggcauucucacccccuccugcagccacgugacggaacucacgcaucauccguugaccagcacaaccaucauacacacaaucaccauacacacaaucaguggcuacacggcgauccuuugcuccacccaggcgaccacccccaccgccagucggccgaucaccaccaucauaacugcaccgguaguauggcaacucccucgagcucaacccagaccuccggaacccccccuucauugacuacaacggcuacaaccauuaccgcgacaggaagcaccacgaacccauccucaacuccuggaacgacccccaucacucccguccuaacuucaacagcaaccacccccgcggcuaccuccagcaaagcuacaucaagcuccagucccagaacugcuacgacccugccugugcugacuucuacggccaccaagagcacugccacuaguuuuaccccuauaccaagcccuugugguccaaggggccccuccuag

SEQ ID NO: 248355 - RNA, 561 nt, Artificial Sequence
  Description of Artificial Sequence: Synthetic coding sequence
uccuccacuccgggcaccacuuggauacuuacugaacccucuacaacagccacaguaacaguaccuacuggaucgaccgcuaccgcaucuucuacccaagccaccgcaggaacgccacauguaucaacgacagcaacaacccccacuguuacuucuaguaaggccacaccuuucagcucaccuggaacggccacagcccugccagcacuucggucgacugcgaccacaccuacugcuaccaguuucacugcaaucccaaguucaugggcaccuccaggccccgcauaccaccgucccccccaucccaggccaccuuguccucagccccaccccccuccacugcagcgccuaaguacaccaccccaaugucugcccccaagaccuccacggggccaccgccugugcggacauccacuguugcauccucggaacucaucccacuaccagucagcagacuaccauaaucacuucacagcgaccccaucuuccaguccuggcacagcacguacccucccugucuggaucagcaccaccacaacccccacaacccgcgguuccuag

SEQ ID NO: 248356 - RNA, 960 nt, Artificial Sequence
  Description of Artificial Sequence: Synthetic coding sequence
acaaaagcgacaacaacucgggccaccucaagcaugucuacaccuagcagcacuccugggaccaccuggauucugacugaacucacuaccgccgcuacaacaaccgcugcuacuccacacggccauccaguacuccauccacgggaucaccucgacccgcacagagcccagcauuacacagugaccguuccuacaggaucuacagccacugcuucuagcacacgugcaaccgcggguacacugaaaguucucaccucacaccauacacauucacaucagcugcagagccacucccucuugcaauccagggacuguaaccgacccagcuccaccgagaagcacucccaccacacccauagcuaccagcgauacucucacccccuguuccucccuaccgcauggacccgucugagccaaaccaccaccccgacagcuacuaugucuacagccacacccaguuccacaccagaaaccgugcauaccuccacugugcuuacuacgaccaccacuacuacucgugcuacacuguggcccccuccaccgcccccgcaagaacagcucacccucccgaaguguagacuuccccagccgcgccacagccacccccugcugcaaccaagggacggcacccaugcaucauccguggaccaacauaaccaucauacucacaaccaaagauuacacggagacccccugcuacauccgacuacacacacugccacaguccucacgacaaccaccacaacaccucuaguucuguggcaacaccccccacuugcucacagaccaguuguuccccccagccucaccaccaccgccacaaccauuacagcuaccggcagcacuaccaacccuucuuccacaccugggacaaccccuauucccccgguccuaacaaccaccgcucauacgugcagucaccaacagcacagcgauucccugcuuuguccucgggauuag

SEQ ID NO: 248357 - RNA, 2007 nt, Artificial Sequence
  Description of Artificial Sequence: Synthetic coding sequence
augcgugaaauucacgcgcguuucggaaaucucucccuguaccuugauaaccacuacugcacugcguccgcaacagccgcugcugcacgaugucccagggcucugucaauacauuacaaguccauggauaucguccugaccguuaccaugguucauggcaaggaggaggggcugaucuuauuugaccagaucccugucucaaguggcuuuuccaagaacggggugcuagugagugugcucggcacgacuacuaugagagucgacauccccgcucuuggcguguccguaaccuucaauggccagguguuccaagcccgguugccuuauucuuuguuccacaauaacacagagggucagugcggcacaugcacuaauaaucagcgugacgauugccuccaacgcgacgguacuacugcagccuccuguaaagacauggcuaagacguggcugguuccggauucccgaaaggacgguugcugggccccuacuggaacuccaccuacugcauccccggccgcacccgugucauccacacccacaccuaccccuugcccuccacagccgcugugcgaccugauguugagccaggucuucgcugaaugccacaaucucguucccccuggcccauucuucaacgcauguaucuccgaccauugucggggcagauuagaagugccaugucagagccucgaggccuacgccgaacucuguagggcaagagggguuugcagugacuggaggggcgcaaccggcgggcugugugaucugaccuguccccccaccaaagucuacaaaccaugugggccgauccagccagcaacuugcaacucaaggaaccagaguccucagcuggaaggcauggccgaggggugcuucugccccgaagaucagauccuguucaacgcccauauggggauaugcguucaagcaugcccgugcgucggacccgacggcuuccccaaguuucccggggagcgguggguauccaacugucaguccugcguuugcgacgagggcucaguauccguucagugcaaaccucucccaugugacgcacagggccaaccaccacccugcaaccgaccuggguucguuaccgugacuagaccaagagccgagaauccuuguugccccgagaccguguguguguguaauacaacaacuuguccucaauccuugccaguuuguccccccggccaagaaagcauuugcacacaggaagaaggugacugcugcccuaccuuccguugccgcccucaguuauguuccuauaaugggaccuuuuacggggugggcgcuaccuucccuggcgcgcugcccugccauauguguacuugucugagcggagacacacaagauccaacugugcagugucaagaggacgcauguaauaacacuacguguccacagggcuuugaauauaagcggguggcaggacaguguugcggcgaaugcguucaaacugcuugcuuaacaccagacggccagccaguccagcuuaacgaaacaugggugaacucucacguugacaacugcaccguguaccucugugaggcagagggcggcguccaucugcugaccccucaaccagcaucauguccugacguuagcuccugccgggguucauuacggaaaacggguugcuguuauuccugcgaggaggauuccugucaaguucgaaucaacacuacaauccuuuggcaccagggcugugagacugaggugaauaucacguucugugagggcuccuguccaggcgccucaaaguauagcgcggaggcacaagcuaugcaacaccagugcacauguugucaagagaggcgcguacaugaagagaccguaccccugcacugccccaaugggucggcaauucuucauacuuauacucauguugacgaaugcggauguaccccauucugcguaccagcgccgaugaguccccccgcuugcgucuggcaucccgcccugagagcacccgccgcccaccucggguuagccccgcccuag

SEQ ID NO: 248358 - RNA, 441 nt, Artificial Sequence
  Description of Artificial Sequence: Synthetic coding sequence
augacgaugagaucccugcugaggacaccuuuuuugugugggcuccuuugggcuuuuugugcaccuggugcucgcgccgaagagccagcggcauccuuuagccagccuggcaguaugggucuggauaaaaacacagugcaugaccaagaacacauuauggaacacuuagagggggucaucaacaagcccgaggcagagaugucaccccaagagcugcaacugcauuauuuuaagaugcacgauuaugacgggaauaaucuucuagaugguuuagagcuuucaacagcaauaacacacguacauaaagaagagggaucugaacaagccccccucaugucagaagacgagcuuaucaacaucaucgacggugugcuuagagacgaugacaagaacaaugauggcuauauugacuacgccgaauucgccaagagccuccaguag

SEQ ID NO: 248359 - RNA, 441 nt, Artificial Sequence
  Description of Artificial Sequence: Synthetic coding sequence
augaccaugcgaucucuccuccgaacacccuuccuaugcgggcuuuugugggccuucugcgcgccaggugcacgugcagaagagccagcggccucguuuagucaaccuggaucaaugggccuggacaaaaauacugugcacgaucaggaacacauaauggaacaccucgagggcgucaucaacaagccugaagccgagaugucaccacaagaacuucagcugcacuacuucaaaaugcacgacuacgacggcaacaaccuguuagacggucuggaacugucaacagccaucacacacguucacaaggaggaagggagugagcaggccccccuuauguccgaagacgaauugauuaacaucaucgacggcguucucagggacgaugauaagaacaaugacggguacaucgacuaugccgaguuugccaaaucccuucaauag

SEQ ID NO: 248360 - RNA, 285 nt, Artificial Sequence
  Description of Artificial Sequence: Synthetic coding sequence
auggagcaccuggaaggagugaucaauaagccggaagcugagaugucgccucaagaacuucaauuacauuacuucaaaaugcacgacuacgauggcaacaaccuucucgacggauuagagcugaguacggcuaucacccacguccauaaagaagaaggcagcgaacaagcaccgcuuaugucagaggacgaacuuauuaauauuauagauggcgugcuaagggacgacgauaaaaauaacgaugguuauauugacuacgccgaguuugccaagucauugcaguag

SEQ ID NO: 248361 - RNA, 441 nt, Artificial Sequence
  Description of Artificial Sequence: Synthetic coding sequence
augacaaugcgaucucugcuacgaaccccuuucuugugcggccuguuaugggcauuuugcgcuccuggcgcuagggcagaggaacccgcagcuucuuucucucaacccggauccauggggcuggauaagaauaccguacaugaccaggagcacauaauggaacaccucgagggcgugauuaacaagccagaggcugaaaugucuccccaagaauugcagcugcauuacuuuaaaaugcaugacuaugacggaaauaaccuccuagauggacuggagcucagcaccgcaaucacgcacgugcacaaggaggaaggauccgaacaagcaccauugaugagcgaagaugaacugauuaauaucauagacgguguccuccgggacgacgauaagaacaacgacggauauauugacuacgccgaauucgcgaaaagccugcaguag

SEQ ID NO: 248362 - RNA, 441 nt, Artificial Sequence
  Description of Artificial Sequence: Synthetic coding sequence
augacgaugagaaguuugcuuagaacacccuucuuauguggacugcuuugggcuuucugcgcccccggcgcucgcgcugaagaaccugcagcuaguuucucccaacccggcucaaugggccuugacaaaaacacugugcacgaucaggagcauauuauggaacaucuggagggcguaaucaacaaaccugaagcggagaugucaccacaagaacuucaguuacauuacuuuaagaugcacgauuaugacgguaacaaccuguuggaugggcucgaacucucaacagccaucacacacgugcacaaggaagaaggcucggagcaggccccuuugaugagugaagaugaacuuauaaacaucauugacggcguguugcgggaugacgacaaaaacaaugacgguuauauagacuaugcugaauucgcuaaaucucuccaguag

SEQ ID NO: 248363 - RNA, 285 nt, Artificial Sequence
  Description of Artificial Sequence: Synthetic coding sequence
auggaacauuuggagggugugaucaacaaaccugaagcagaaauguccccacaagaacugcagcuacauuacuuuaaaaugcacgacuaugauggcaacaacuuguuggaugguuuagaacugagcaccgcgauuacucacguccacaaagaggaggguuccgagcaggcaccacucaugagugaagacgaauuaauuaauaucaucgacggggucuugagggacgacgacaagaauaaugauggcuauauugacuaugcagaauuugcaaagagccugcaauag

SEQ ID NO: 248364 - RNA, 285 nt, Artificial Sequence
  Description of Artificial Sequence: Synthetic coding sequence
auggaacaccuggaggguguaauaaacaaaccagaggccgaaaugagcccacaggaguugcagcuucacuauuucaagaugcacgauuacgaugggaauaaccugcuugacgguuuagaacugucuaccgcaaucacccacguacauaaggaggaaggcucugaacaagcaccacugauguccgaggacgaacugauaaacauaaucgacgguguauugagggaugacgauaaaaauaacgauggguacauugacuaugcugaguucgcaaagucgcuacaguag

SEQ ID NO: 248365 - RNA, 441 nt, Artificial Sequence
  Description of Artificial Sequence: Synthetic coding sequence
augacgaugaggucucugcuucgcacacccuuccuuuguggcuuacucugggccuucugugcaccaggagcacgcgcugaggagccugcugccagcuuuucacaacccgggaguauggggcucgauaaaaacacaguccacgaccaagaacacauuauggagcaccuugagggcguaaucaacaaaccugaggcugaaaugaguccucaagaacugcagcuucauuauuuuaagaugcaugacuaugacggcaauaaccuucucgauggccucgaacugucuacugcaaucacccacguucauaaagaggagggaagcgagcaggcaccucugaugagugaagaugaauuaauuaacauaauugacggcguacuucgagaugaugauaaaaacaacgauggcuacauagacuacgcugaguuugcuaaguccuugcaguag

SEQ ID NO: 248366 - RNA, 441 nt, Artificial Sequence
  Description of Artificial Sequence: Synthetic coding sequence
augacaaugagauccuugcuaaggacacccuuccucugcgguuugcuuugggccuuuugugcuccaggcgcccgggccgaagaaccugccgcaaguuucucucagcccggcucuaugggacuagacaaaaauacuguucaugaucaggaacacaucauggaacauuuggagggcgugauaaauaaaccggaagcugaaauguccccccaggagcuccaguuacacuacuuuaagaugcacgauuacgauggaaauaaucugcuugaugggcucgaauuauccacagcaaucacccacgugcauaaagaagaagguucagaacaagcaccauugaugagugaggacgaacugaucaacaucauugacggcguacuuagggaugaugauaagaauaacgauggcuacauagauuaugccgaauucgccaagagccuacaauag

SEQ ID NO: 248367 - RNA, 186 nt, Artificial Sequence
  Description of Artificial Sequence: Synthetic coding sequence
augacaaugagaucccuauugcgaacccccuuccucugcggccuuuugugggcauucugcgcgccaggagccagagccgaagaaccagcagcgagcuucucccaaccuggcuccaugggacuugacaagaauacugugcaugaccaagagcacauuauggagcaucuggagggcgugaucaauuag

SEQ ID NO: 248368 - RNA, 384 nt, Artificial Sequence
  Description of Artificial Sequence: Synthetic coding sequence
augcuuucuguauguuccugccggaccaguagcggaaugagaucacaauggccuagugcucgccaacgcucgagcaguuuaagcacauucagacacauaauggaacaccuggaggguguuaucaacaagccugaggcggaaaugagcccccaggaacuucaguuacacuauuuuaaaaugcacgauuacgauggaaauaacuuacuugacgguuuggagcucucaacugcaauuacacauguccacaaagaagagggaucggagcaggccccccuuaugucugaggaugaacucauuaacaucauugacggagugcuucgagacgacgauaagaacaaugacggcuacauugacuacgcugaauucgcaaagucucugcaauag

SEQ ID NO: 248369 - RNA, 1515 nt, Artificial Sequence
  Description of Artificial Sequence: Synthetic coding sequence
augcgguucuucugcgcccggugcugcucauuuggcccugaaaugcccgcaguacagcucuugcugcucgcaugccucgugugggacgugggugcaagaacagcccaacuacguaaagccaacgaccagagcgggcgaugucaauauaccuuuucuguugcuagucccaaugaaucauccugcccugagcagucccaggcuauguccgugauccacaaucuccaacgggacaguaguacacagcgucuggacuuggaagccacaaaagcgagacuguccagccuagagagccugcugcaucaacucacucuggaucaggcagcuagaccccaagaaacccaggaagggcugcagcgggagcuugggacccuccggagagagcgagaccagcuggagacacagacucgcgagcuugagaccgccuacagcaaccuguugagagauaaaucaguacuugaggaggagaagaagagguugcgccaagaaaaugaaaaccuggcacgcagguuggagagcucuucucaggagguagcccggcucagacgcggccaaugcccccaaaccagggauaccgcaagagcugugccuccaggaucuagggaagugucgacguggaauuuggauacgcuggcuuuccaggagcugaagucagaacuuacagaagugcccgcaagccgaauccuuaaggaaucgccuucggguuacuuacgcucuggcgagggcgacacuggcuguggggaacuugugugggugggugagccauugacucugcggaccgcugagaccauuacaggcaaauauggugucuggaugagagacccaaaaccuaccuacccuuacacacaggaaacaacuuggcgaauagacacuguuggcaccgacgucagacagguguucgaauacgaccucaucagccaguucaugcaggguuauccaagcaaggugcauauacugccaagaccacucgaaucaacaggagcggucguguauagugguagucucuacuuucaaggugcugagagccggaccgugauccgcuaugaguugaacacagaaaccgugaaggccgagaaagaaaucccuggagccggauaucauggucaguucccauauuccuggggggguuacaccgauauugacuuagcuguggacgaagccggccuguggguuauuuacucaaccgaugaggcuaaaggcgcuauagugcugucuaaacugaacccggaaaaccuagagcucgaacagacuugggaaacaaacauccguaagcaaagcguggcaaaugcguuuauaauuugcggaacucuguacaccguaucaaguuauaccuccgccgacgcaaccgugaauuuugcuuacgacaccggcacugggauaaguaagaccuugaccaucccauucaagaacagguacaaguacuccagcaugaucgacuacaacccccucgaaaaaaaacuguuugcaugggacaaccugaacauggugacguaugauauaaaacucuccaagauguag

SEQ ID NO: 248370 - RNA, 1107 nt, Artificial Sequence
  Description of Artificial Sequence: Synthetic coding sequence
augggaaggaaaaaaauccagauaucgcguauccuugaucaacguaaucgacaagugaccuuuacgaaaaggaaauuuggucugaugaagaaagccuacgaauugagcguauugugcgacugcgaaaucgcccugaucaucuucaauucggccaaucggcuuuuccaguacgcgucaacagauauggacagggugcugcugaaguacaccgaauauucagagccccacgagucacggaccaauaccgacauccuugagaccuugaagagacgcggaauaggccuugauggacccgaauuagaacccgacgaggguccugaggagccuggggagaaguuucgucgucuggccggcgagggaggagacccugcccugccucgacccagguuguacccagccgcccccgcuaugccuaguccagaugucguguauggggcccucccaccccccgggugugaccccaguggacuaggcgaagcccugccagcccagucgcgccccagcccauuuagacccgccgcaccuaaggcaggcccccccggacuugugcacccucuguucucccccagccaucugacuagcaaaaccccccccccccuuuaccuuccaacugagggacguagauccgaccuuccagggggccucgcuggcccgcgaggcggccucaacacuucucgaagucucuauucaggcuugcaaaaccccugcucuaccgcaaccccgggaccuccccucggaagcuucccuuuucugcccggcggacccccagaguacggacuaggcgacccccccccgccucccggcuugcugcagccucccacgcuggcaccuuggcagccuucgaggggagaugggcccccugcugugucuagccaaccuagcgguggcagaagccugggagaggaggguccaccuacccguggagccagucccccuaccccacccguauccaucaagagcgagagacugagcccagcaccagguggcccaggcgacuucccuaaaacguucccauauccccuccuccuugcuagguccuuagcggaaccacugaggcccggcccugcccucagacggcugccucuggccgacggcuggccaagauag

SEQ ID NO: 248371 - RNA, 3477 nt, Artificial Sequence
  Description of Artificial Sequence: Synthetic coding sequence
auggccgccgugcgaggagcuccauuguuauccugucuguuggcacugcucgcucuuugcccagguggaagaccucagaccgugcugaccgaugacgagaucgaggaauuucuggaaggguuccugucagaacuagaacccgagcccagggaagaugauguugaggcgccgccaccucccgaaccuacuccacggguccggaaggcccaagcagguggcaagccugggaagcguccagggacugccgcugaggugccucccgagaagacuaaagacaagggaaaaaaaggcaagaaggacaagggcccgaaggugccuaaggaaagccuggagggaucaccacgcccccccaagaagggcaaggagaaacccccgaaggcuacuaagaaacccaaagaaaaaccuccgaaggccaccaaaaagccaaaagaaaaaccuccaaaggccacaaagaaacccaaggaaaaaccccccaaagcaacaaaaaagccucccagcgggaaaagaccacccaucuuagcaccauccgagacccuugaauggccucugcccccccccccauccccugguccugaagagcugccucaagaggggggcgcaccucuuagcaauaacuggcaaaaccccggcgaggagacccacguugaggccagggaacaucaacccgaaccggaagaggaaacugagcagccaacacucgacuacaaugaucagaucgagcgcgaggauuaugaggacuucgaauacauccgucgacagaaacagccccgccccccaccaagcagacgucgccguccugaaagagucuggcccgaaccuccugaggagaaagcaccagcacccgcccccgaagagaggauugagccaccaguuaaacccuugcugcccccccugccacccgacuacggagacgguuacgucauuccgaacuaugaugauauggacuacuacuuugguccuccaccaccacagaaaccggacgcagaaaggcaaacugaugaagagaaagaggagcuuaaaaagcccaaaaaggaggacucaagcccuaaggaagagacugacaagugggccgucgaaaagggaaaggaucacaaggaaccucgcaagggcgaggagcuggaagaggaguggacacccacagaaaaggucaaguguccaccuaucggaauggaaagucauaggaucgaggacaaccagauuagagcauccucaaugcugagacauggucugggagcccagcguggacgccugaacaugcagacuggggcaacagaagacgacuauuacgacggcgccuggugcgccgaagaugacgcacgaacucaguggaucgagguugauacacgcagaacaaccagauucacgggugugaucacacagggcagagauucuaguauccacgaugauuucgugacaacuuuuuuuguuggauucagcaacgauagucagaccugggucauguacacaaauggcuaugaggaaaugacuuuucacggaaauguugacaaagauacuccagugcuguccgaguuacccgaaccugugguugcacgcuuuauuaggauuuacccacuuacuuggaaugguuccuuaugcaugcggcuggagguccugggcuguagcguggccccuguguauaguuauuaugcucagaaugaagucguggccacugacgaccuggacuuccgucaccacuccuacaaagauaugagacagcuuaugaaagugguaaacgaagaauguccuacuauaacucgcacuuauuccuuaggcaaguccucacgaggccugaaaauuuaugccauggagaucuccgauaacccuggugagcaugagcuuggugagcccgaguuucgguacacugcuggaauucauggaaacgaggugcugggccgcgagcuucuccuauugcuaaugcaguaccugugcagggaguaccgggauggcaacccuagggucaggagucuggugcaggacacacgcauacacuugguaccaagccugaacccagacggauaugaagucgcugcccagauggggagugaauuugggaacugggcccuaggauuguggaccgaggaaggauucgauaucuuugaggacuuucccgaucuuaacucagugcuuuggggcgcugaagagcggaaguggguuccguaucgagugcccaacaauaaccugccuaucccagagagauauuuaagcccggaugcaacuguuuccacugaagugcgcgccaucaucgcguggauggagaagaacccuuuuguacugggcgcaaaucugaacggcggggagaggcuugugucguacccauacgacauggcgagaacucccacgcaggagcagcugcuggccgcagccauggccgccgcacggggagaggacgaggaugaggugagcgaagcccaggagacucccgaucacgccaucuuucgguggcuggccaucuccuucgcauccgcgcaucuuacucucaccgagccuuaccgcggcggaugucaggcacaggacuacacugguggcauggggauagugaacggagccaaguggaauccacguacuggaacuaucaaugauuuuucuuaccuccacacaaauugucuggaguuguccuucuaccuaggcugcgacaaguucccccacgagagcgaacugccccgcgaaugggaaaacaauaaggaagcccugcuuacuuucauggaacagguucaccgugggauuaaggggguaguuaccgaugagcagggcauaccuaucgcaaaugcaacuaucucgguauccggcauaaaccaugguguaaaaacagccucugggggugauuacuggagaauccuuaauccuggcgaauacagggugaccgcacaugcugaggguuauacuccuagcgcuaaaacaugcaaugucgacuacgacauuggagccacucaguguaacuucauccuggcucguucaaacuggaagcggauacgagaaauaauggcuaugaacggaaaucggcccauaccacauaucgaccccucucggcccaugaccccacagcagagacggcuucagcagcggcgucuccagcacagacuaagacugcgggcccaaaugcggcucagaagauugaacgcuacaaccacguuaggcccgcacacaguaccaccuacacugcccccugccccugccacuacacucagcaccacgauugagcccuggggccugauaccgccuacaacugcuggcugggaggagucugaaaccgaaaccuacacggaaguggugacugaguuugguacagagguggagccggaauucgguacaaagguggagccagaguuugaaacacaguuagagccugaguucgagacccaauuggaaccugaguuugaggaggaagaggaagaagagaaggaggaggaaaucgccaccggucaggcauucccuuucacuacugucgagacuuacacugugaauuucggcgacuuuuag

SEQ ID NO: 248372 - RNA, 471 nt, Artificial Sequence
  Description of Artificial Sequence: Synthetic coding sequence
auggcuuccagaguucuuucggcauauguuaguagacuuccugccgcauucgccccgcuacccagagugagaaugcucgcuguggcucggcccuuauccacagcucugugcucagccggaacucagacucgccuagggacccugcagcccgcacucgugcuggcccaggugccaggacgcgugacacaacucuguaggcaguacagcgauaugccaccccugacccuggaaggaauccaagaucgcguccucuaugugcuuaaacuuuacgauaaaaucgauccugagaagcuuucuguaaacucccacuucaugaaagaccuuggccucgauucucuugaccaggucgaaaucauuauggcuauggaggacgaguucggcuucgagauccccgacaucgaugcugagaaacugaugugcccacaggagaucguggacuacauugcugauaaaaaagacguuuaugaauag

SEQ ID NO: 248373 - RNA, 1707 nt, Artificial Sequence
  Description of Artificial Sequence: Synthetic coding sequence
augaugggcugcuggauccugaacgagggccugucuacaauucugguccuuagcuggcuggguaucaauuucuauuuguuuaucgacacauucuauugguacgaagaggaagaaucauuccauuauacacgggugauucuuggcucaacucuugccugggcucgggccucugcucucugccucaauuucaacugcaugcugauucucauucccguuucucgaaaucuaaucucuuuuauuagggguacaagcauauguugccgugggccguggcgcagacaacuagacaaaaacuuaagauuucauaaacugguugccuauggcaucgcggugaacgccacaauccacaucguggcccacuuuuuuaaucuugagcgcuaccauuggagccagagcgaagaggcacaaggccuccuugccgcccucuccaaacugggcaacacuccuaacgaguccuaucuuaaccccgugcgcaccuucccuacuaauaccacaaccgagcugcugcggacgaucgccggcgucaccgggcuggucaucucccuugcccucgucuugauuaugacuuccaguaccgaguucauucgccaggcaagcuacgaguuguucugguauacucaccauguguucaucguauucuuccuuucucuggcaauacaugguaccggcaggaucgugagggggcagacacaagauagccugagcuugcacaauaucacauucugccgugaccgauacgcagaauggcagacuguggcacagugccccgugccucaauuuucaggaaaggaacccuccgccuggaaguggauacugggaccugucgugcuguaugccugugagcggaucauuagauuuuggagauuucagcaagaagucguuauaacgaagguggugagccacccaucgggagucuuagaacugcauaugaagaagcgggguuucaagauggccccaggacaauauauucugguccaguguccagcaauaagcucccuggaauggcacccauucacccugacaagcgcuccccaggaagauuucuucuccguccauauuagagccgccggagauuggacugcugcucugcuugaggcuuuuggcgcagagggacaggcacugcaggagccuuggaguuuaccucgauuagcuguugauggcccauucgggaccgcccuuaccgacguuuuccacuaucccguuugcguguguguggccgcuggaaucggagucacccccuucgcagccuugcucaaaaguaucugguacaagugcucggaggcccagaccccccucaaacuaucaaaagucuacuuuuauuggaucugccgcgacgccagagcguucgaaugguucgcagaccugcuacugagccucgagacuaggaugagcgaacaagguaagacccauuuucucucuuaccacaucuuucugacaggaugggacgaaaaccaagcacuccauauugcucugcauugggacgaaaauacugaugucauuacaggcuugaaacaaaagaccuucuauggccgcccaaauuggaacaaugaauucaaacagauagccuacaaucaccccucaagcucaauugguguguuuuucugcggaccuaaggcccugucuaggacgcuucagaagaugugucaccuguauuccagcgccgacccaaggggggugcacuucuauuauaacaaagagucguuuuag

SEQ ID NO: 248374 - RNA, 2520 nt, Artificial Sequence
  Description of Artificial Sequence: Synthetic coding sequence
augucaauccgaaggcugcugauucugauccugaagaucggccgaagguggacugagcugauuagaacgauggaauccagaguacugcuucggaccuucuguuuaaucuuuggguugggcgcgguauggggccuuggcguggauccaagucugcaaauagacguucugaccgaacuggaacugggggaaucuaccacuggggugaggcaggugccaggucuacacaacgggacgaaagcuuuccuauuccaagauacuccgcgaagcauaaaagcgucgacagccaccgcugaacaguucuuccagaaacuucgcaacaaacacgaauucaccauucuggucacccugaaacagacacaccugaauuccggagugauccuguccauucaccaucucgaucaccgguacuuggaacuggaaaguagcggccaucgcaaugaggugcgccuccacuacagaucaggaucucacagaccacauaccgaagucuuucccuauauucuagcagaugauaaguggcauaaauuaucacuggccauuuccgcuagccaucugauuuugcacauugacuguaacaagauuuaugagcgcguagucgagaagccaucaacagacuugccgcugggaacaaccuuuuggcugggacagcgcaauaacgcccauggcuauuuuaaggguauuaugcaggacguccaguugcugguuaugccucaggguuuuaucgcgcagugcccagaucucaauagaaccuguccaaccugcaacgacuuucauggucuggugcagaagaucauggaacugcaagacauucuggcaaagacauccgccaagcugucccgcgcugagcagaggaugaaccgccuggaccaaugcuacugugaacgcaccugcacaaugaaggguacgacauacagagaguucgagagcuggauugacggcuguaaaaauugcacaugucugaacggcacaauccagugcgagacauugauuugcccuaauccggauuguccccugaagagcgccuuggccuacguggaugggaaauguuguaaagaaugcaagagcauuugucaauuccagggccgcaccuauuucgagggggaaagaaauacaguguacucuucuuccggaguuuguguccucuacgaauguaaagaucagacaaugaagcucgucgagaguagcgguugccccgcccuugauugcccagaaucacaucagauuacccugucgcauucuuguuguaaagugugcaaaggcuaugacuucugcuccgaaaggcacaacugcauggaaaauaguauauguagaaaccuuaacgaucgggccgugugcucaugucgagauggcuuucgagcccuccgcgaagacaaugcauauugugaagacaucgaugaaugugcggagggacgccacuauugcagggaaaacaccauguguguaaauaccccgggaucuuuuauguguauaugcaagaccggcuacauaagaauugaugauuacuccugcacagaacaugaugaauguaucaccaaccagcacaacugugaugaaaacgcccuaugcuuuaacacaguuggcggccauaauugcgucugcaaacccggauauaccgguaacgggaccacuuguaaagcuuucuguaaagaugguugcagaaaugggggagcuuguaucgcugcgaaugugugugcuugcccacaggguuuuaccggaccgucuugugaaaccgacauugaugagugcuccgacggguuugugcagugugacucacgcgcuaacugcauuaaccugcccggcugguaccacugugagugucgggacggcuaccacgauaacggaauguuuagcccaaguggggagaguugcgaggauauugaugagugcgggacuggccgccauucaugcgccaacgauaccaucugcuuuaaucuggaugggggcuacgauugcagguguccacacggcaagaacugcacaggagacugcauucacgacgguaaagugaagcauaauggccaaauuugggucuuggagaaugaucgaugcucaguuuguuccugccaaaauggauucgucauguguagacguaugguuugcgacugugaaaaccccacuguggaucucuuuuguuguccugagugcgauccgcgucucuccagucagugucuucaccagaacggagagacccucuacaauagcggagacaccuggguucagaacugccagcaguguaggugccuacagggugaaguggacugcuggccauuacccuguccagacguggagugcgaauucucuauccucccggaaaaugagugcuguccucgcugcguuacagaucccugucaggcggauaccauccgcaacgauaucacuaaaacaugucuggacgagaugaauguugucagguucacaggaaguuccuggaucaaacacggaacggaguguacacugugccaaugcaaaaauggacacauuugcuguucgguugauccgcagugcuugcaggaauuguag

SEQ ID NO: 248375 - RNA, 2448 nt, Artificial Sequence
  Description of Artificial Sequence: Synthetic coding sequence
auggagaccgggcucggagccccucuauucaaagccuggcugcuaauuagcguuuggggccucggagucgauccuagccugcagauugauguacucaccgagcuugagcucggugaaaguacaacaggggugcggcaagugccaggccugcauaaugguacgaaggccuuccuguuucaggacacaccucguucaaucaaggcuuccaccgcaaccgccgagcaauucuuccaaaagcuuagaaacaaacaugaguucaccauccuggugacauugaaacagacacaccugaacucaggggugauacucagcauacaucacuuggaucaucgcuaucuugaacuagaauccucaggacaucguaacgaggugcgccugcacuacagaucaggcagccacagaccgcacacugagguguuccccuauauccucgcagaugacaaauggcauaaguugucccuggccaucuccgcaucccacuugauacuccacauagauuguaacaagauuuacgagagagucguggagaaaccuuccacagaccuuccuuugggcacaacauucugguugggccagcgcaacaacgcacauggcuacuucaaaggaaucaugcaggauguccaacuguugguuaugccccagggcuuuaucgcacaaugccccgaccugaaccgcacaugccccaccugcaacgauuuucacggccuuguccagaaaauuauggaguuacaggacauccuggccaagacaagcgcaaaauuaagccgcgccgaacagcggaugaaccggcuggaucaguguuauugugagagaaccugcacaaugaaaggaacuacuuaccgggaauuugaguccuggauugacggcuguaagaacugcacuugccucaauggcaccauucagugcgaaacucugauuuguccaaauccagauugcccccugaaaagcgcacucgcguauguggacggcaaaugcugcaaagaguguaagucuaucugucaguuucaggggagaaccuacuuugagggcgagcggaauacaguguauaguucuuccggcgucugcgucuuguacgagugcaaagaccaaacaaugaagcucguggagucuucuggcugcccagcucucgacugccccgagagccaucagauuaccuugagccacucuugcuguaagguguguaagggcuacgacuucuguucggaaaggcacaauuguauggagaauucaauuuguagaaaccuuaacgacagagcgguuugcuccuguagggacggcuuuagagcauugcgggaagauaaugcuuauugcgaagauauugacgaaugugcugagggucggcacuacugccgggagaacacaaugugugucaacacgcccgggucuuuuaugugcauaugcaaaaccgguuauauccgcaucgacgacuacagcugcaccgaacacgacgaauguaucacgaaccaacacaacugcgaugagaaugcccucugcuucaauacagucggcggccacaauugcguaugcaaacccgguuauacaggcaacggaacuacguguaaggccuuuugcaaagacgguugucggaacgggggugccuguaucgccgccaacgucugcgccugcccccagggcuuuacuggaccuagcugcgaaacugacaucgacgagugcucagacggcuucgugcagugugauaguagggccaauugcaucaaucucccaggcugguaccacugugagugccgcgacgguuaccaugacaauggaauguucucccccucuggagagagcugcgaggacaucgaugaaugcgguacaggcaggcauuccugugcaaaugacaccauaugcuucaaucuggauggaggcuacgauugccgcugcccucacggcaaaaauugcacuggggacuguauucacgacggaaaagucaagcauaacggucagauaugggugcuugaaaacgaucgaugcucugucuguucaugccagaauggauucgugaugugucggcgaaugguuugcgacugcgaaaaccccaccguagaccuauucuguugcccugagugcgauccaagguuaucuucucagugccugcaccaaaacggcgagacacuguacaacucuggagauacauggguucaaaauugccagcagugcagaugcuuacagggugaaguggauugcuggccccugccuugccccgauguggaaugugaauuuucaauucugccugaaaaugagugcuguccccguuguguuacagauccgugucaagcugacaccaucaggaacgacaucaccaaaacaugucucgacgaaaugaacguggucagguuuaccgguaguucguggauaaaacacggaacagaaugcacccucugucaguguaaaaauggacacauauguuguucaguggauccccaaugccuucaggaacuguag

SEQ ID NO: 248376 - RNA, 2451 nt, Artificial Sequence
  Description of Artificial Sequence: Synthetic coding sequence
auggaaucuaggguccuacuucgcaccuuuugcuuaauuuucggccugggagccguguggggacugggaguggauccaucacuacaaaucgacguguugacugaacuugaacucggugaauccaccacuggcguuaggcaggucccuggacugcauaacgguaccaaagccuuccuuuuucaggauacaccgcgcucaaucaaagcuucgaccgccacagcagagcaguuuuuccagaagcuccggaauaagcacgaauucacuauuuuagucacccuuaagcagacccaccucaacucaggugucauucucucuauccaucaccuggaucaccgguaucuggaacucgagucauccgggcaccggaacgaggugcgccuacacuaccgauccgggagccaccgcccucacacagaggucuuuccuuauauucuggccgaugauaaguggcauaaacucagucuggccaucucagccucucauuugauccugcacauugacugcaacaaaauuuacgaacgcguaguggagaaaccuagcacggaucugccucuuggaacuacauucugguugggacagcgcaacaaugcacacggguauuucaagggcauuaugcaggacgugcagcuccuggucaugccucagggguuuauagcccagugcccugaucugaaucgaacauguccuaccugcaaugacuuccaugggcuugugcagaaaaucauggaacuucaggacauccuggccaaaacuagcgccaaauuaucucgggcugagcagaggaugaaccgguuggaucagugcuacugcgagcgcaccuguacuaugaaaggaacaacauauagagaguucgagaguuggaucgauggaugcaagaacugcaccugcuugaacgguaccauucaaugcgagacacuuauuuguccuaauccagacuguccccuuaagucagcauuagcauacguggacggcaaguguuguaaggaauguaaaucaaucugccaguuccagggacgaaccuacuuugagggagaaagaaauacaguguauagcagcucagguguuugcgugcucuacgagugcaaggaccagacaaugaaacugguagaaaguucaggguguccagcucuugauugcccggaaucccaucaaauaacccugucucauucuugcugcaagguguguaagggcuacgacuuuuguucugaacgccacaauuguauggaaaacaguauaugccgcaacuugaaugaucgcgcggucugcuccugucgcgacggcuuucgugcccugcgugaggacaaugcauacugugaggacaucgaugaaugcgcagaagggagacauuacugcagggagaacacuaugugcgucaauacacccgggaguuuuaugugcauauguaagaccggauacauucgcaucgacgauuacuccugcaccgaacaugaugaguguauaacaaaccagcacaauugcgacgaaaaugcccugugcuucaacacuguggguggucacaauugcguguguaagcccgguuacacuggaaacggcacaacgugcaaggccuuuugcaaggacggaugcaggaacgguggggcauguaucgcagccaaugugugcgccuguccccaggguuucaccgguccaucaugugagaccgacaucgaugaaugcuccgauggauucgugcaaugcgacagucgggcuaacugcauaaaccugcccggcugguaucacugugagugucgcgauggcuaccaugacaacgggauguucagcccaucuggggaauccugugaagacauugaugagugcgggacuggaagacauucgugugccaacgacaccaucugcuucaacuuggaugggggcuacgauuguaggugcccucauggaaagaacugcacuggagauuguauccaugaugguaaggucaagcacaauggacagaucugggugcuggaaaacgauagaugcucaguuugcucuugccagaacggcuucgugaugugcagaagaauggugugcgauugcgagaaccccacugucgaucuguucugcugucccgagugugacccucgacuaagcagucaguguuugcaccagaauggagagacucuguacaauagcggcgacacguggguccaaaacugucaacagugucgcugucugcagggugagguugauuguuggccacuucccugccccgauguggaaugugaguuuucaauccugcccgagaaugaguguuguccucgcugcgugaccgacccaugccaggccgacacuaucaggaacgauauuaccaaaacaugucucgaugaaaugaaugucgugcgguuuacuggcuccaguuggauaaaacacgguaccgaaugcacauugugccaaugcaaaaacggucacauaugcugcucagucgacccucaguguuugcaggaauuauag

SEQ ID NO: 248377 - RNA, 2601 nt, Artificial Sequence
  Description of Artificial Sequence: Synthetic coding sequence
augggguucccuccucuguuaaagggacaggccucagcuacaagauccucucuagccucuugcaguuggguggucuuuuuucugucuugccugucgagacacgcccccgaaauugagggggggcgccgguggacugaauugauaaggacuauggaguccagaguacugcuucgcacuuuuugucugaucuucggacugggagccguguggggcuugggcguggacccuucucuccagauugacguucucaccgaacuggagcucggggaguccacuacaggggugagacaggucccuggccugcacaacggaacuaaggcuuuccucuuccaggacacaccucgauccauuaaggccagcacagcaacagccgaacaguucuuucagaagcuacggaauaaacaugaauucacgauuuuggucacguugaaacagacacaccugaauagcgguguaauucucagcauccaccaucuggaccacagauauuuggaacuggagaguagcggccaccgcaacgagguacgauuacacuaccggagcggaagccacaggccacacacagaaguguuuccauauauucuugcugacgauaaguggcacaagcugucucucgcgauuucugcuagccaucugauucuccauaucgauuguaacaagaucuaugagcgcguggucgagaagccaucaacagaucucccucugggaaccacuuucuggcucggucaacguaacaaugcucauggauacuuuaaaggcauuaugcaggaugugcaacugcugguuaugccacaggguuucaucgcccaauguccagaccucaaccggaccugcccaacuugcaacgacuuccacgggcucguccaaaaaauaauggagcuccaggauaucuuagccaaaacaagcgccaaguugucccgcgcugaacagcguaugaaucggcuugaucaaugcuacugugaacgcaccugcacuaugaaggggacgacuuaucgcgaauuugaaucuuggauagauggaugcaagaacuguacgugccugaacggaacaauucagugcgagacacugaucugcccuaacccagacugcccacugaaauccgcccuggcuuacguugacggcaagugcugcaaggaauguaagucaaucugucaguuccagggccggacauacuucgaaggagagagaaauacugucuauucuucuuccggcguguguguucuguacgagugcaaggaucaaacaaugaagcugguagaaagcuccggaugucccgcuuuggacugccccgagagccaccaaauuacccucucccauuccuguuguaaggucuguaagggcuaugacuucuguagugagcgacacaacuguauggagaacucaauuugccgcaaccucaaugacagggcaguauguuccugcagggaugguuuucgcgccuuaagggaagacaaugcuuauugcgaggacaucgaugagugcgcugaaggcagacacuacuguagggagaacaccaugugcgugaauaccccagguucguucaugugcauuuguaagacuggguauauuaggaucgaugauuauagcugcacggaacaugaugaauguaucacaaaucagcauaauugugacgagaacgccuuaugcuuuaauacaguggggggacacaacugcgucuguaagccgggauacaccggaaacgguaccacguguaaggcuuucuguaaggaugggugccgcaaugguggugcuugcauugcugcuaacguuugcgcuugcccacaagguuuuaccggaccuucaugcgaaacggauauugacgagugcucugacggguuugugcaaugugacucucgcgcaaauugcauaaacuugccaggaugguaccauugugagugcagagacggauaccaugauaaugggauguuuucccccuccggagaaagcugugaagacaucgaugaaugugggaccgggcgccauucaugugcaaacgacacuauuugcuucaacuuagacgggggauaugauugccgaugcccucacgggaagaacuguacuggugauugcauccacgacgggaaggucaagcauaaugggcaaauuuggguucuagaaaacgaccgauguucuguuuguucaugccagaauggcuucgucaugugccgccggaugguaugcgauugugagaacccuaccguugaucuguucuguugucccgagugcgauccuaggcuguccucucagugucuccaccagaauggcgagacacuauacaauuccggugacacauggguccaaaacugccagcagugucggugucuacagggagaaguagauugcuggccuuugccaugcccagacguugagugcgaauuuucuauauugccagagaaugaauguugucccagaugugugaccgauccuugccaggcugacacgauacgcaaugacauaacaaaaacaugccuagacgagaugaacguaguccgguucacuggaucuagcuggauuaaacacggcacggaauguacccucugccagugcaagaauggacauauauguugcagcguggauccacaguguuugcaggagcuuuag

SEQ ID NO: 248378 - RNA, 2451 nt, Artificial Sequence
  Description of Artificial Sequence: Synthetic coding sequence
auggaaucucgcguccugcuaagaacauucuguuugaucuucggacuuggugcaguguggggauuggguguagaccccucucugcaaauugauguccucacagagcuggagcugggggagaguacaaccggugucaggcaagugccaggauugcacaacgguacgaaagcuuuucuuuuucaggauacacccagaagcauaaaggccucgacugcgacagccgagcaguucuuccaaaagcugaggaacaagcaugaguucacaauucuggugacccucaagcagacgcaccugaacaguggcgugauccuuucaauccaucaccucgaccaccguuaccucgagcuggaaaguuccgggcacagaaaugaggugcgccugcacuauagaagcggcagucauagaccacacaccgaagucuucccguauauccuggccgacgauaaauggcauaaguugucacuggcaaucagugcuucucaucugauucuucacaucgacugcaauaagaucuacgaaagaguagucgaaaaaccuucuaccgaucuuccucucgggacuacuuucugguuagggcagcgaaacaaugcacacggauauuuuaaaggcauuaugcaggacgugcagcucuuggucaugccacagggcuuuaucgcacaaugucccgaccugaaccguacgugcccaacauguaaugauuuccacgggcucguccagaaaauaauggaacugcaggauaucuuggccaagaccuccgcaaaacuuagccgugcugagcagcgcaugaauagacuggaucaaugcuauugugaacgcacuugcaccaugaagggaacaaccuaucgcgaguucgaaagcuggauugacggguguaaaaauugcacaugcuugaacgggacaauucagugugagacccucauuugcccgaauccggacuguccucuuaagagcgcccuugcuuacguagauggaaaaugcugcaaagagugcaagaguauaugucaguuucaggggcgcacauauuuugagggggagcguaacacuguguacuccucgucaggcgucugugucuuguacgaauguaaggaucagacaaugaagcuagucgagucgucuggaugucccgcauuagauugucccgagucacaccaaaucacccucucacauagcugcuguaaggugugcaagggauaugauuucuguagugaaaggcauaauugcauggaaaacucaaucugucguaaucucaacgaccgcgccguuuguucaugucgugauggauucagagccuugcgugaagacaaugcguacugcgaagauaucgacgagugcgcugaaggcaggcacuacugcagagagaauacuaugugcgucaauacgccugggagcuucaugugcauuuguaagaccggcuauauccgaauugacgauuacucaugcaccgagcaugacgaaugcauaacaaaucaacauaauugugaugaaaaugcucuuuguuucaacacuguuggaggucacaacuguguguguaaacccggauauacuggaaaugguacuacaugcaaagcauucuguaaagauggcugucguaauggcggggccuguaucgccgccaauguaugcgccugcccacaggguuucacagguccaucuugcgaaacggacaucgacgaguguucugauggcuucguucagugcgacucgcgcgcaaacuguaucaaccucccaggcugguaucacugugagugccgagauggcuaucaugauaacgguauguuuucaccauccggagagucuugugaggauauugaugaguguggcacaggcagacauucaugcgcuaaugauacaaucuguuuuaaucucgauggcggauacgauugcaggugcccgcauggaaagaauugcacuggggauugcauucaugaugggaaggucaagcacaauggucagauaugggugcuagagaaugaucgcugcucuguguguagcugccagaauggauucguaaugugccgcaggauggugugcgauugugaaaauccgaccguggaucucuuuuguugccccgagugugacccgcgccuguccagccagugccugcaccaaaacggcgagacuuuguauaacucuggagacacuugggugcagaacugccagcaaugcagaugucuucaaggugaagucgacuguuggccgcugccuugcccagauguagaaugcgaauucucaauccugccugaaaaugaauguugcccccgcugcgugacagacccuugccaagccgacacuaucagaaaugacaucacaaagacaugucuggacgagaugaacgugguucgcuuuacaggcagcucuuggauuaagcacgggacagaguguacuuugugucagugcaagaauggccacauuugcugcagugucgauccacagugucuccaggaauuguag

SEQ ID NO: 248379 - RNA, 1734 nt, Artificial Sequence
  Description of Artificial Sequence: Synthetic coding sequence
auggagacagggcuaggggcuccacuguucaaggcauggcuauugauuagcgucuggggacugggcguggaccccuccuuacaaauagacguccugacagagcuggagcugggcgaauccacgacugggguacgucagguucccgggcuucauaauggaacaaaagccuuccuguuucaggacacgccaagaucgauaaaggccucgacagccacagcggaacaguucuuucagaaacucagaaacaaacacgaguucacgauacuggucaccuuaaagcagacucaccuaaauucgggcgucauauugucaauucaccaucucgaccacagguaucuggaguuggagucuagcgggcacaggaaugaaguacgucugcauuacaggagcggaucccaccgaccccacacugaagucuucccauacauucucgcggacgauaaguggcauaagcugagccuggcuauuuccgcaucccaucugauccugcacaucgauugcaauaagauuuacgaaagaguaguugagaagcccucaacagaccugccucuuggcacuacguuuugguugggccagcgcaacaacgcacacggguauuucaaaggaaucaugcaggauguucaacuuuugguaaugccccagggcuuuaucgcccagugccccgauuuaaaucgaacuugucccacauguaaugacuuucauggcuugguacagaaaaucauggagcuucaggacauacuugccaaaacuucagcaaagcuuagcagagcagagcagcgcaugaaccggcuggaccaguguuauugugagcgaacauguaccaugaaagguaccacauaccgggaauucgagagcuggaucgacggguguaagaacuguacaugccucaacgguacaauacagugcgaaacacuuauaugcccgaacccagacugcccuuugaaaucugcacucgccuacguggaugggaaguguugcaaggaauguaaaucgaucugccaguuucaggggcgcaccuacuuugagggagagcgcaacacuguauauucguccuccggcgugugcguacucuaugaauguaaggaucaaacgaugaaauugguugaaaguagcgggugcccagcauuagacugccccgagagccaucagaucacauuaagucacucguguuguaaggugugcaagggcuaugacuucugcuccgagaggcauaacuguauggagaauuccaucugcaggaacuugaaugauagggcuguuugcagcugcagggacggcuuucgggcccucagagaagauaaugcuuauugcgaagacauagaugagugugccgaaggucgacauuauuguagggagaacacgaugugcgugaacaccccaggcagcuucauguguauuugcaagacgggauacauccgcaucgaugacuacuccuguaccgagcacgacgaauguauaacaaaccagcauaauugugaugaaaaugcucuaugcuuuaacacugucggugggcauaauugcgucugcaaaccgggguacaccggaaauggaacuaccuguaaggcauucuguaaggauggcuguaggaaugguggcgccugcaucgcagccaacguaugugcgugcccccagggcuuuacugggccgagcugugagacggacaucgacgaaugcagcgacgguuuugugcagugcgauuccagggccaacugcauaugcuuagugccgcucuag

SEQ ID NO: 248380 - RNA, 333 nt, Artificial Sequence
  Description of Artificial Sequence: Synthetic coding sequence
auggagaccggauuaggcgcuccguuguuuaaagcuuggcuacucauaucaguguggggcuugggagucgauccgucgcugcaaaucgaugugcugacagagcuagagcugggcgagaguacuaccggcguucgucaaguuccaggacuccauaacggcacaaaagcguuccuguuucaagauaccccucgcucuaucaaagcaucuacugccacugcugaacaguucuuccagaagcucagaaauaaacacgaguuuacaauccuugucacccugaaacaaacacaucuuaacagcggaguaaucuugagcauccaccaccucgaucacuag

SEQ ID NO: 248381 - RNA, 2448 nt, Artificial Sequence
  Description of Artificial Sequence: Synthetic coding sequence
auggaaaccgguuugggcgcaccgcuauuuaaggccuggcugcuuaucucuguauggggacugggcguggauccaucuuuacaaauagacguacugaccgagcucgaauuaggagaaucaacaacaggggucaggcaggucccuggacugcauaacgguaccaaagcuuuucuguuucaagauacgccuaggaguauaaaagcaucuacugccacugcagaacaauucuuucaaaaacugcggaacaagcacgaguuuaccauacuggugacccucaaacagacccaccucaauaguggggugaucuugaguauucaucaccuugaucaucguuaucuggaguuagagagcucgggccaccggaaugaagucagacugcacuaccguuccggaagccauagaccccacacugaagucuuccccuacauucuugccgaugauaaauggcacaaacucucacucgcuauaagcgccucccaucugauuuugcauaucgauugcaacaaaauauaugagcgagugguggaaaaacccuccacggacuugccacucgggacuacauuuuggcugggacagcggaacaacgcccauggcuacuucaaggguauuaugcaggaugugcaguuauuagucaugccgcagggauuuauugcucaguguccagaucucaauagaacaugcccaaccuguaaugacuuucacgguuugguccaaaaaauaauggaacugcaggacauucuggccaaaaccuccgcaaaguugucucgcgcagagcagcguaugaaucgguuggaucaguguuacugugagaggacauguacaaugaagggcacaacauauagagaauucgaaagcuggauugauggcugcaaaaauuguacaugccuaaacgggaccauccagugcgaaacucuuauaugccccaacccagauugcccucugaaaucagccuuggcuuauguagauggcaaauguuguaaggaauguaagucuaucugucaauuucaaggccgaaccuacuucgaaggggagaggaauacuguuuacaguucgaguggggugugcgugcuauacgagugcaaggaucaaacaaugaaauuaguugagucuagcggguguccagccuuggacuguccugagagccaucagauuacccuuagucacucaugcugcaagguauguaaaggcuaugacuucugcucugagcgccacaauuguauggagaacucaaucugcaggaaccucaacgaccgcgcgguuugcuccugcagagacgguuuccgagcucugagggaagacaaugccuauugugaagauaucgaugaaugcgccgagggacgacauuauugccgagagaauacaaugugugugaacacgccuggcucuuuuauguguaucuguaaaacugguuauauacgaauagaugacuacaguugcacugaacaugacgaaugcauuaccaaucagcauaauugcgacgaaaacgcucuguguuuuaauaccgucggcggccauaauugcguuuguaagcccggcuacacugggaacggcaccaccugcaaggcguucugcaaggacgguugccgcaacggaggcgcauguaucgcugccaaugugugugccuguccacagggguuuacgggcccuuccugcgagacagacaucgaugagugcucugacggauucgugcagugugauucccgagcuaauugcauaaaucugccggggugguaccacugcgagugcagagaugguuaucacgauaacggcauguuuagcccaucuggggaaagcugcgaggauauagaugaaugcgggacaggaagacauuccugugcaaacgauacuauaugcuuuaaucuggacggaggauacgauugcagaugcccucauggcaagaacuguaccggagacugcauucaugauggcaaaguuaaacacaacggacagaucuggguucuggagaacgauaggugcucaguauguucuugccagaauggcuucgucaugugccguagaauggucugugacugugagaaucccacuguggaccuguuuuguugcccagagugcgaucccagacugagcucucagugucuccaucagaacggcgaaacacuuuacaauuccggugauacuugggugcagaacugccaacagugucguugcuugcaaggggagguagauuguuggccccuacccuguccggauguggagugcgaguuuucgauucuaccugagaaugaaugcugcccucgcugcgucacagacccuugccaggccgacacgaucagaaacgauauuaccaagacuugccuugacgaaaugaauguggugcguuucacugggagcucuuggaucaagcacggaacugaaugcacacugugccaauguaaaaauggccacaucugcuguagcguggacccacaaugcuuacaggaacucuag

SEQ ID NO: 248382 - RNA, 69 nt, Artificial Sequence
  Description of Artificial Sequence: Synthetic coding sequence
auggaaucgcgugugcuucugcgaaccuuuuguuuaaucuuuggacuuggcgccguguggggguuguag

SEQ ID NO: 248383 - RNA, 966 nt, Artificial Sequence
  Description of Artificial Sequence: Synthetic coding sequence
auggaaucucgcgugcuacucaggaccuucugccugaucuucgggcucggagccgugugggggcugggaguggaccccagcuuacagaucgacguccucacugaguuggagcucggagaguccacaacugggguuagacaaguccccggcuuacauaacgggacaaaggcauuucucuuucaagauacacccagaaguauaaaggcauccacagccacagcagagcaguucuuccaaaaacuaagaaacaagcacgaauuuacuauacucgucacccugaagcaaacucacuuaaacagcggagucauucuuuccauucaccacuuggaccacagguaccuggaacucgaaucuagcggucaccgcaaugaggucaggcugcacuaucgauccgggucccaucggccacauaccgaagucuucccauacauucuugccgaugauaaguggcacaaacucagucucgccaucucugccucccaccugauucugcacaucgauugcaacaaaauuuacgagagagugguugaaaagccguccacugaccugccucugggcacgacuuuuugguugggucaaaggaacaacgcucaugguuacuuuaaaggaaucaugcaggauguucagcugcuggugaugccacaagguuucaucgcccagugucccgaccuuaaucggacuuguccuacauguaaugauuuucauggucugguucaaaaaauuauggaguugcaagauauccucgcuaaaaccuccgccaaacucucuagagcugagcaacgaaugaaucgacuggaucaaugcuacugugaacggacgugcaccaugaaaggaacaacuuaucgggaguuugagucguggaucgauggcuguaagaauuguaccugccugaacggaacaauacagugugaaacucugaucugcccuaacccugauugcccucugaagucugcguuggccuauuag

SEQ ID NO: 248384 - RNA, 246 nt, Artificial Sequence
  Description of Artificial Sequence: Synthetic coding sequence
auggcagcgguggcugcugccagcgccgaacuucugauaauuggcugguacauuuucagaguacuguugcagguuuuucucgagugcugcauauauugggucggcuucgcauuuagaaaucccccuggaacgcaaccaaucgcuagaucugaggucuuccguuauucccugcagaaauuagcuuacacgguuucacguacaggccgacaggugcucggagagcgucgccaacgcgccccaaauuag

SEQ ID NO: 248385 - RNA, 513 nt, Artificial Sequence
  Description of Artificial Sequence: Synthetic coding sequence
augauggcuggaaugaaaauucagcugguaugcaugcuucuacuugccuucuccucuuggucucugugcucagauucugaagaagagaugaaagcccucgaggccgauuuucuaacaaauaugcacacaaguaagaucucuaaagcccacgugccgaguuggaagaugacucuucucaauguaugcagccugguuaauaaucuaaacagccccgcugaggagaccggcgagguucacgaggaagaacuggucgcucgaagaaaguugccuacugcucuugacggcuuuagucucgaggcgaugcugacuauuuaccaguuacauaagauuugucauagccgagcuuuucagcauugggaacuuauccaggaggacaucuuagauacuggcaaugauaaaaacggcaaggaagaggugauaaagcggaagauacccuauauucugaaacgccaauuauacgagaauaaaccucgaagaccuuauauucugaaaagggacuccuauuauuauuag

SEQ ID NO: 248386 - RNA, 348 nt, Artificial Sequence
  Description of Artificial Sequence: Synthetic coding sequence
augacacuccuaaauguguguucucuaguuaauaaucugaauucaccugccgaagagaccggggagguucacgaggaggaacugguggcacgacgcaagcugccaacagcccuugauggguucucccucgaagcaauguugacaauuuaccaauugcauaagauuugccacuccagagcguuucaacauugggaauuaauacaagaggauauucuugauacuggaaaugacaagaacgguaaagaggaagucauaaagagaaaaauuccauacaucuuaaaaagacaguuauacgaaaauaaaccucgcaggcccuauauucucaagagagacucuuacuauuacuag

SEQ ID NO: 248387 - RNA, 288 nt, Artificial Sequence
  Description of Artificial Sequence: Synthetic coding sequence
augauggcuggaaugaagauccagcuuguguguaugcuccuguuagcauucucaucuuggucuuuaugcagugacagcgaggaggagaugaaggcacucgaagcugacuuucugacaaacaugcauacuuccaaacucauucaggaagauauccuugauaccgggaacgauaaaaacgguaaagaggagguaaucaagcgaaagauaccuuauauacuaaagagacagcuauacgaaaacaaaccccgccgaccauacauucuaaaaagagauucuuacuacuauuag

SEQ ID NO: 248388 - RNA, 774 nt, Artificial Sequence
  Description of Artificial Sequence: Synthetic coding sequence
augucuauauuguuuuaugucauuuuucucgccuaccuuagggguauucaggguaauaauauggaccagcguagcuugccugaagacagccugaauucacugaucauuaaauuaauccaggcagauaucuugaaaaauaaacugaguaagcagaugguagaugucaaggaaaacuaccagucuacauugccuaaggcugaggcccccagggagccugagagaggaggcccugccaaaagcgcauuucagccugucauugccauggacacugagcugcuccgacaacaaaggcgcuauaauucuccccggguccugcucucagacucaaccccccucgaacccccaccccucuacuugauggaagacuacguggguagcccaguaguugcgaacaggacauccagaagaaagagauacgccgagcacaagucccacaggggugaauauucagucugcgacuccgaguccuugugggugaccgauaaaaguagcgcaaucgauaucagagggcaucagguaaccguacucggugaaaucaaaaccgggaauagccccgugaagcaguauuucuacgagacaaggugcaaagaggccagaccaguuaagaacggauguaggggcaucgaugacaagcauuggaacucgcaaugcaagacaucccagacauaugucagggcacuaacaucugagaacaauaagcuggugggauggcgguggauucggauugauacaaguuguguaugcgcucugagccguaagauuggaagaaccuag

SEQ ID NO: 248389 - RNA, 813 nt, Artificial Sequence
  Description of Artificial Sequence: Synthetic coding sequence
auggugacauuugcaacaauccuccaagugaacaaagugaugucuauccuuuuuuacgugaucuuuuuggccuaccugcgcgggauucagggaaacaauauggaccaaagaagucugccugaagacucgcugaacucucugaucauuaaacugauucaagcugacauccugaagaauaagcucuccaagcagauggucgacgugaaagagaacuaccagagcacacuaccaaaggcugaagcaccccgcgagcccgagcgaggaggcccugcaaaaagugcuuuucaacccguaauugcuauggauacugagcugcuaaggcagcagcgacgcuacaacaguccacgcguccugcuuagugauuccaccccacuggagccuccuccccuguaccuuauggaggauuauguuggaagccccguuguggcuaauagaacaagccgcaggaaacgguacgcagagcauaaaucacacagaggagaguauucuguuugcgauagugaaucauugugggugaccgacaaaucaucagccaucgacauucgcggacaccaagugacagugcucggggagaucaagacuggcaacuccccugucaagcaguauuucuacgagaccagguguaaagaggcccggccuguuaagaacggaugcagaggcauugaugauaagcacuggaacagccaauguaagacuucccagaccuauguacgagcacugaccucugaaaacaacaagcuugugggguggcguuggauucgcaucgauacuagcugcgugugugcccugucgaggaaaauaggccggacguag

SEQ ID NO: 248390 - RNA, 2754 nt, Artificial Sequence
  Description of Artificial Sequence: Synthetic coding sequence
auggcuuucauccgcaagaagcagcaagaacaacaacugcaauuguauucuaaagaacguuuuucucugcuccugcugaacuuggaagaguacuauuucgagcagcaccgggcgaaucacauccuccauaaggggucccaucacgaaaggaagauucgagguagucugaagauaugcaguaaguccgucauuuucgaaccugacuccauuagucagccuauuauuaagaucccgcugcgcgacuguaucaaaaucgggaaacacggcgagaauggagcaaauaggcauuucaccaaagccaagucaggcgggaucagcuuaaucuuuucacagguauacuuuauaaaagaacauaacgugguggccccuuauaaaaucgaacggggaaagauggaauacguuuucgagcuagacguaccaggaaaaguggaggacguugucgagacucuuuugcagcuccaccgagcaagcugucuggauaagcuuggagaucagacugccaugaucacagccaucuugcagagccgacucgcaaggacaucauucgacaagaaucguuuccagaacaucuccgaaaaacugcacauggagugcaaagcugagauggucacaccacuuguaacaaaucccgggcacgucuguaucacugacacgaaucuguacuuccaacccuugaauggcuacccgaagccugugguccagauuacccuucaggaugugcggcgaaucuacaaaagaagacauggccuaaugccccuaggucuggagguguucugcaccgaggacgaccuauguucugauauauauuugaaauuuuaugagccucaggaucgcgaugaccucuacuucuauauugccacuuacuuggaacaccauguggcagagcacacggcugagagcuacaugcuacaguggcagaggggacaucugaguaauuaucaguaccuccuccaucugaacaaccuagcugacagaucauguaacgaucugucucaauacccgguguuccccuggauuauccacgacuauagcucuucugagcuggauuuaucaaauccagguacauuuagggauuuauccaagccggucggggcacugaacaaggaacgguuagagcggcuuuugacucgguaccaggagaugccugagcccaaguuuauguacgguucccacuauucgucccccggauacguacuuuucuacuuaguuagaauagccccugaguacaugcugugccuucagaacggaagauucgacaaugcugaccggauguuuaauucuaucgccgagaccuggaaaaauugccuggauggcgcgaccgauuucaaggaauuaauacccgaguucuacggugacgacguaucuuuccuggugaacucacugaagcuggacuuagguaaacgucaggguggacagauggucgaugauguugaauugccuccuugggccuccuccccugaggauuuccugcagaaguccaaggacgcuuuagagagcaacuacgugucugaacaucuccacgaauggauagaccucauauucgguuacaagcagaaggggucagacgccgugggcgcccacaaugucuuccacccuuugaccuaugaaggcgguguggacuuaaacagcauccaggacccugaugagaaaguugccaugcuuacucagauccuagaauucggccagacccccaagcaauuguucgucacuccacacccuaggagaauuacaccuaaauuuaagagucuaagccagaccagcagcuauaaugcgucaauggccgauagcccgggcgaggaaucuuucgaagaucugacugaagagucuaaaacucuggcguggaacaauaucacuaagcuucagcuccacgaacacuacaaaauacacaaagaagcggugacugguaucaccgucagccggaauggauccagcguguucacuacaagucaggacuccacucuuaagauguuuuccaaagaaucuaagaugcugcagcgaucuauuuccuucuccaacauggcucugucaucuugucugcuguuaccuggcgacgccaccgucauuaccucaagcugggacaacaacguguacuuuuauagcauagcuuucgguaggcggcaggauacccugaugggucacgaugaugcaguuucaaagauuuguuggcacgacaacagauuguauuccgccuccugggauaguacugucaagguguggagcggaguaccggcagagaugcccggaaccaagcgacaccauuuugaccugcucgcugaacuugaacaugaugugucaguggacacaaucucucugaacgcagcuuccacucuucucguuagcgggaccaaagaagggacaguuaauauuugggaucucacaacagccacguuaaugcaccagauuccuugccacucaggcauugugugcgacacagccuuuuccccugacucacgccacgugcuuucuaccggcacugacggcugucuaaaugugauugacgugcagacugguaugcugauuaguaguaugacaagugaugagccacagagaugcuucgugugggacggcaauagcguccugucugggucucagagcggggaacugcuggucugggaucuucucggagccaagauaagugaaagaauccaaggccauaccggggcaguuaccuguauuuggaugaaugaacaguguucuuccaucauuacagggggagaggacagacagaucauauucuggaagcuccaguacuag

SEQ ID NO: 248391 - RNA, 1188 nt, Artificial Sequence
  Description of Artificial Sequence: Synthetic coding sequence
auggucagcgcggccggccucucgggagacggcaaaaugcggggcguucuucucguucuguugggcuugcucuacucaaguaccucuugcggcgugcagaaggcgagcguguuuuacggacccgacccuaaagaaggacucgugaguuccauggaguuuccuuggguggugaguuugcaagauucucaguacacccaucucgcuuucgggugcaucuugagcgaguucuggguccucagcaucgcuuccgcuauucaaaaccguaaggacaucgugguuauugugggcauuagcaauauggacccaucuaaaaucgcucauaccgaauaucccgugaacacuaucauaauucaugaagauuucgacaacaacagcaugaguaacaacaucgcccuccugaaaacugacacugcuaugcacuucggcaaucucguucagaguaucugcuuucucgguaggaugcuucacacaccaccuguauugcagaauuguuggguguccggguggaacccuaccuccgccaccgguaaucacaugaccauguccguguuaagaaagauuuuugugaaagaucuggauaugugcccucuguauaaacuccaaaaaacugagugcggaucacacacaaaagaagagacgaagaccgcaugccugggcgaccccgguucuccaaugaugugccaacugcaacaguuugauuugugggucuugcggggcguacuuaacuuugggggggaaacgugucccggccucuucuuguauacuaaagucgaagacuauucaaaguggaucacuucuaaagccgaacgcgccggccccccuuugucuucccugcaucauugggaaaaacuuaucucuuucagucaccauggcccuaaugcuaccaugacacaaaagacuuauuccgauagcgaacuuggccaugucgggucauaccugcagggacaaagaaggacaauaacucauucaagacugggcaacucuucgcgcgauagucucgaugugagagagaaggacguaaaggaaagcgggcgcuccccugaagccucagugcagccgcuguauuacgauuauuauggaggagaagugggugaggggcggauuuucgcaggccaaaacagacuauaccagcccgaggaaaucauuuugguuucuuucguguuggucuucuucugcucuucuauuuag

SEQ ID NO: 248392 - RNA, 2085 nt, Artificial Sequence
  Description of Artificial Sequence: Synthetic coding sequence
augaaacaucuuaaaagguggugguccgcagguggaggguugcuccaccuuacacuucuccucagccuggccgggcuccgugucgauuuagaucuuuaucugcugcucccuccaccgacuuuacuacaggacgagcuccuuuuucuugguggcccugccuccagcgccuaugcccugucaccauucagugcaucaggaggcugggguagagccggccaccugcacccuaaagguagggaacucgaccccgcggcuccccccgaaggccagcugcucagggaggucagggcacucgggguacccuuuguccccagaacauccguggaugcuuggcuggugcacuccguggccgcgggcucugccgacgaagcucauggacuuuuaggagccgcagcugcgagcaguacaggcggcgccggggccucagucgacggggguagucaggccguccagggcggcgguggcgacccucgcgcugcccggucggggccucuggaugcuggcgaggaggaaaaagcaccagccgagccaacugcucagguaccagacgccggcggcugcgcuucagaagagaacggcgugcugagggagaaacaugaggccguugaucacagcucccagcacgaagaaaaugaagaaagaguuuccgcucagaaggagaauagccugcaacagaacgaugacgacgaaaauaaaauugcggagaaacccgauugggaagcugagaagacgacagaaagccggaacgagcgucaucugaauggaacugacaccucuuuuucauuagaggaucuauuccagcuccuguccagucaaccagaaaacagccucgagggaauuucacucggagauauuccccuuccagggaguauuucugacggcaugaauucuucugcucauuaucaugugaacuucucacaggcuaucagucaggaugugaaccuucaugaagcaauuuugcugugccccaauaacacauuccgccgugacccuaccgcacggacuagucagagccaagagccguuucuccaacucaacagccacacuaccaacccagagcagacauuaccugguaccaaucucacaggguuccucucuccuguggauaaccacaugagaaaucuuacgucacaagaccuccuuuaugaucuggauauaaacauuuucgacgaaaucaaccuuaugagccuggcaacggaagacaacuuugaucccauugacguuucucaacuguuugacgaacccgacagugacaguggacuuagcuuagacucuucacauaauaauaccucagugauaaagagcaauucaucccacuccgugugugacgagggggccaucggcuacuguacggaccaugagucuuccucccaccaugaucuugagggcgccguuggaggauauuacccagaacccagcaagcucugccaccucgaccagucagauuccgacuuucauggagaccucaccuuucaacauguuuuccacaaccauacuuaucaucugcagccgacugccccggaaucuacuuccgaaccuuuuccauggccagggaagucgcaaaagauucgcucccgcuaccuggaggauacagauagaaaccucuccagggaugaacaacgcgcaaaggcacugcacauucccuuuagcgucgaugagauaguaggcaugcccguggacuccuucaauagcauguuaagccgcuacuacuugacugaccugcaggugucacucauccgcgauauucgacgacgagggaaaaauaaaguugccgcccagaacugccggaaacguaaguuagacaucauucugaauuuggaggacgacgugugcaaucuucaggccaagaaagagacucucaaacgugagcaagcccaguguaauaaagccaucaauauaaugaaacaaaagcuucacgaccucuaucacgauauuuuuucacgcuuaagggacgaccagggacgacccgugaaccccaaccacuacgcauugcagugcacccaugacggauccauucuuauaguuccaaaggaacuuguagccuccggacauaagaaggagacucagaaagggaaacggaaguag

SEQ ID NO: 248393 - RNA, 1404 nt, Artificial Sequence
  Description of Artificial Sequence: Synthetic coding sequence
augccuggcagguggcguuggcagagagacaugcauccagcacgcaaacuacugucucugcuguuucugauccucauggggacugaguugacacaggugcuuccaacgaauccagaagaaucauggcaggucuacagcagugcacaggacucugagggcaggugcaucugcaccgucguggcuccucagcaaaccauguguagccgagaugcaaggacuaaacagcugcgacagcuguuggaaaaagugcagaacaugucccagucuauugagguucuggacaggcggacucagagagaccuacaguauguugagaagauggaaaaucagaugaaaggcuuagagagcaaauucaaacaaguugaagaaagccacaaacagcauuuggcccgucaguucaaagccauaaaagcgaagauggacgaacuucggccccugauucccguucucgaagaguauaaggcagacgcuaagcucguucuccaguucaaggaggaggugcagaaccucacauccgugcucaacgaauuacaagaagaaauuggcgcauacgauuaugacgaacuacagucucgcgucaguaaccucgaggagcgccucagggcaugcaugcagaaacuggcaugcgggaagcugacaggaaucucggacccugugacugugaaaacaagcgguucaagauucggcagcuggaugaccgaucccuuggcuccagagggcgauaauaggguuugguacauggauggauaucacaacaaccgcuuugugagagaguacaagagcaugguugacuuuaugaacacugacaacuuuaccagccacagacugccacacccuuggucgggcacagggcagguuguguauaauggcuccauuuauuucaacaaguuucaaucucacaucauuauccgcuuugacuugaaaaccgaaaccaucuuaaagacgcguucacuggacuacgcaggauacaacaauauguaccacuaugcuuggggaggacauagugacaucgaucucaugguggacgagagcgggcucugggcgguguacgcaaccaaccagaaugccgggaauauaguaguuaguaggcuggaucccguuagccugcagacccugcagaccuggaacacaucauauccuaaacgaucugccggcgaggcuuuuaucaucugcggaacgcuguacgucacaaacggauacaguggcggcaccaaagugcauuacgcguaccaaaccaacgcaucgaccuacgaauacauagacauucccuuucaaaauaaguauucacacaucagcaugcuagauuauaauccaaaggacagagcccuguacgccuggaauaacggacaccagauacuuuacaauguaacacucuuucacguuauacggucugaugaacucuag

SEQ ID NO: 248394 - RNA, 408 nt, Artificial Sequence
  Description of Artificial Sequence: Synthetic coding sequence
augccaggcagauggagguggcagagagauaugcauccugcuaggaaguuacuuagccuauuguuucugauccugaugggaacugaacuuacccagguacugcccaccaaucccgaagaaucauggcaggucuacagcagcgcucaagauagcgaaggcagguguaucuguacagucguagcaccucaacaaaccauguguucucgagacgccaggacaaagcaauugcgacagcuguuagagaagguacagaacaugagccagucaaucgaaguacucgaccggcgaacccagcgggaucuacaauauguugaaaaaauggaaaaucagaugaagggccuggaaaguaaguuuaaacagguggaggagucccacaaacagcaccucgcucggcaguucaaaggauag

SEQ ID NO: 248395 - RNA, 1458 nt, Artificial Sequence
  Description of Artificial Sequence: Synthetic coding sequence
augagugugccacuucugaagauuggugucguccucuccacuauggcaaugauaacuaacuggaugucccaaacgcugcccucacucguaggucuuaauacuacgaaacugucagcugcuggaggggggacgcuggaccgcagcacaggcgugcuucccacaaacccugaggaauccuggcaaguguacucuuccgcccaggauagcgagggccgguguauuugcacugucguggccccgcaacagacaauguguuccagagaugcuaggaccaagcagcugcgacagcuacuggagaagguucagaauaugucccagaguauugaaguucuugaucggaggacacagcgggaccuacaguacgucgaaaaaauggagaaccagaugaaaggguuagaguccaaguucaaacaaguggaggagagccacaagcaacaccuagccagacaauuuaaagcaaucaaagcuaagauggaugaacugcgaccccugauaccugugcuggaggaauacaaagccgaugcuaagcucguacugcaguucaaggaggaaguccagaaccuaaccagcguccugaacgagcuucaggaggagauuggagccuaugauuacgacgaguugcaaagccgugucucaaaucuggaggaaagauugcgcgcuuguaugcagaaacuggcuugcggcaaacucacuggaauuuccgacccugugacagucaaaaccagcggauccagauuugggucguggaugaccgauccuuuagcgccugagggggacaacagagucugguauauggacggcuaucauaauaaucguuucguaagggaguacaagaguaugguggacuucaugaacacugacaacuuuaccagccacaggcuuccucauccgugguccgggaccggccaggugguauacaauggaucuauauauuuuaauaaguuucagagccacauaauuaucagauucgaccuuaaaaccgagacaauccucaagacucggucgcucgacuacgcagguuacaauaauauguaucauuacgccuggggcggacacagugacauagaucuuaugguugaugaauccggacugugggcuguauaugccacaaaucagaacgcaggaaauaucguggugucacggcuggauccagucagccuacagacccugcaaacuuggaacaccuccuacccuaaacgaagcgcaggagaagcuuucauaaucugugggacccuuuacgugacaaacggguacagugggggcaccaaggugcacuacgccuaucagacuaacgcaucgacauaugaauacaucgauauaccuuuccaaaacaaguacagucauauauccauguuagauuacaaucccaaagaccgcgcucuguacgccuggaacaauggccaccaaauuuuauauaacgucacucucuuucacgugauaagguccgacgaacuguag

SEQ ID NO: 248396 - RNA, 1377 nt, Artificial Sequence
  Description of Artificial Sequence: Synthetic coding sequence
augggggaggcacccggacgggaagguagaggaccaugcccccaacuggagagcccacgcagaaggcgcgugcugcccacaaacccugaggaaaguuggcaaguauauuccagugcacaggauucggagggccggugcauuuguacuguaguagccccacaacagaccauguguuccagagaugcccggacuaaacaacuuaggcaguuauuagagaaagugcagaauaugucucagucaauagagguacuggauagaagaacccaacgcgaccuacaauacguugaaaagauggagaaccagaugaaggggcuggagucaaaguucaagcagguggaggagagccacaagcaacauuuggccaggcaauucaaagcgauuaaagcuaaaauggacgaauuaagaccccugauaccugugcuugaagaguacaaagcugaugcuaaacuaguucugcaauucaaggaagagguccagaaccugaccuccguucugaacgagcugcaggaggagauuggugcauaugacuacgacgaacugcaaucaagagugucuaaucuagaggaaaggcugcgggccuguaugcaaaaacucgcuuguggaaaauuaaccggaaucagugacccagucacugugaagacgagcggcagccgcuucgguuccuggaugaccgacccacucgccccugaaggggacaauagagucugguacauggacgguuaccacaauaaucgcuucguccgugaguauaaauccauggucgauuucaugaacaccgacaacuucacaucucacagacucccucauccauggaguggcaccggccaagugguguacaaugguucgaucuacuuuaacaaauuccagucccauaucauuauccguuucgaccugaagacugaaacuauccugaaaacccggagccuugauuacgccggcuacaacaauauguaccacuacgccuggggcgggcacagcgauaucgaucucaugguggacgagucuggccuaugggcaguauacgccacuaaccaaaacgccggaaauauaguugugagcagacucgacccuguaucacugcagacauugcagaccuggaacacgaguuacccuaaaagguccgccggcgaggccuucauaauuugcggcacucuauaugucacuaaugguuacuccgguggcacaaaaguacacuacgcuuaucagaccaaugcuucaaccuaugaguacaucgauauaccguuccaaaauaaguacagccacaucagcaugcuggauuauaacccaaaggauagggcacucuacgccuggaauaauggucaucagauccuuuacaaugugacccuguuccacgugauuaggagcgacgaacucuag

SEQ ID NO: 248397 - RNA, 462 nt, Artificial Sequence
  Description of Artificial Sequence: Synthetic coding sequence
augucugugccuuuauuaaagaucggaguugugcuuaguacuauggccaugaucacuaacuggaugucacagaccuuaccaucccucgugggucuaaacacaaccaagcuuucugcugccggaggaggcacccucgacagaucaacaggcgugcugccgaccaaccccgaagagaguuggcaaguuuacuccucugcucaggacagugaaggucguugcaucuguacagugguugcuccacagcagaccaugugcucccgugacgcucggacaaaacagcuccgccaacugcuagagaaaguucaaaauaugucucaaagcauugaagucuuggauaggagaacccagcgcgaccuccaguauguggagaagauggaaaaucaaaugaagggucucgaaucgaaguucaagcaaguggaggagagccauaagcagcaccuugcaagacaguucaaagguuag

SEQ ID NO: 248398 - RNA, 696 nt, Artificial Sequence
  Description of Artificial Sequence: Synthetic coding sequence
auggcuuccauggcggcaaucgguuccuguucgaaggaguaucgagugcugcugggccaacuccagaagcagacagauuuaaugcaggauacaagccgacuguuagauccauauauuaggauacaggggcuggauguucccaaauuaagagaacacugucgggagcggccuggagcauucccaagcgaagaaacguuacgagggcuugggcgccguggcuuccugcagacuuuaaacgcuacccuggguugcguucuccaucggcuggcagaucuggagcagaggcugccaaaagcacaggauuuagagagaagcggccugaauaucgaagaucuagaaaagcuacagauggcacggccuaacauucucggucugaggaacaacaucuacuguauggcacagcugcuggacaacucugauacagccgaacccacuaaagcugggcgaggcgcaucccagccccccacgcccaccccagccuccgacgcauuccagcgcaaacucgagggaugucgauuucuacacgguuaccauagauuuaugcauucuguugggcguguguuuucuaaauggggcgaaaguccuaaucguagucggcggcauagcccccaccaagcacucagaaaaggcguccgcagaacccgccccaguagaaaaggaaagaggcugaugacacggggucaguugccucgcuag

SEQ ID NO: 248399 - RNA, 849 nt, Artificial Sequence
  Description of Artificial Sequence: Synthetic coding sequence
auggcucuagugcugauucuccaacuacugacacuguggccccugugucacacagacauuacucccucugucccuccugcaucuuaccauccaaaacccugguuaggcgcccagccagccaccguggugacucccggugugaaugucacuuuacggugucgugcaccccagccugcuuggcgauucggucucuucaagccuggcgaaauugccccacugcuuuucagggauguuucuagugagcuugcugaguucuuuuuggaggaagucacacccgcccagggcggcaucuaucggugcugcuacagacggccagacugggguccuggugucuggagccagccuagcgauguccuggaacugcugguaacugaagaguugccucguccuucccugguggcacugccggguccuguuguggggccgggugcaaacgugucgcugaggugcgcuggccggcuccggaacauguccuucguguuauacagagaaggagucgcagccccucugcaauaucgacacucagcucagcccugggccgauuucacacugcuuggagcucgcgcacccggaacuuacuccuguuauuaucacacccccuccgcgcccuacgucuugagccagagaagcgagguacuggugaucucgugggagggggaaggaccagaagcgagaccagcuagcagcgcuccaggaaugcaagccccaggcccgccaccuucugaucccggugcacaggcccccucacugucaagcuuccggccacgaggacucguccugcagccccuguugccccagacacaggauucuugggaucccgccccaccaccuagcgauccuggaguuuag

SEQ ID NO: 248400 - RNA, 759 nt, Artificial Sequence
  Description of Artificial Sequence: Synthetic coding sequence
auggcauuaguucucauucugcagcugcugacacuuuuuccuccugcaucuuaucauccuaagccauggcugggcgcucagcccgcaacgguggugacuccugggguaaaugugacucucaggugucgugcgccccagccugccuggcgcuucggacuauuuaaaccaggagaaaucgccccucuguuauuccgggauguguccuccgaguuggccgaguucuuccuggaagaggugacacccgcccaaggcggcauauaccgcugcugcuacaggcgacccgacuggggacccggagucuggagccagcccagugaugugcucgaacugcucgugaccgaagaacugcccagaccuucuuugguugcucuccccggaccaguaguuggaccaggcgcuaauguaagucuccguugcgccggacggcucagaaauaugucauucguauuauauagagaaggaguugccgcaccauugcaguacagacacagcgcucagccuugggccgauuuuacgcuucuuggcgcgagggcaccaggcacguacagcugcuacuaucacaccccuagugcaccuuacguacucucacagcguucagaaguccuggugauuucaugggaagacucuggcucuuccgacuauacccgagguaaccucgugcggcuggggcucgcgggguugguauugaucucacuaggugcccuggucacuuuugacuggagaucucagaaccgggccccagcuggcauucggccauag

SEQ ID NO: 248401 - RNA, 804 nt, Artificial Sequence
  Description of Artificial Sequence: Synthetic coding sequence
auggcccuugugcucauauuacagcuguuaacccucuggccauuaugccauacagauaucacaccaaguguugccauuaucguuccuccagccuccuaccacccaaaaccaugguugggcgcgcagccggcaacaguuguuaccccaggugugaacgugacucugcguugcagagcuccacagccagcguggagguucggauuauuuaagcccggggaaauugccccccuacuguuucgcgaugugucuagcgaacuggccgaguucuuccuggaggaggugacccccgcacagggggguaucuaccgaugcuguuauaggcggcccgauugggguccuggaguuuggucccaaccaucugacgugcucgaacugcucguuaccgaggagcugccucgaccaagccugguugcccuaccgggaccagugguggguccgggagcaaaugucucgcugcggugcgcugggagacugcgcaacaugucauucguacuuuacagagaaggagucgcggccccccuucaguauaggcacucagcccagccaugggcagacuuuacucuucugggagcuagggcccccggaaccuacuccugcuacuaucauaccccuucugccccuuacguucuaucgcagcgcucggaagugcugguuaucucaugggaggacucaggaagcucagauuacacacggggcaaucucgucagacucgguuuggccggucugguacugauuucuuuaggagccuuggugacauuugauuggagaucucagaaccgcgcacccgcgggaauucgucccuag

SEQ ID NO: 248402 - RNA, 792 nt, Artificial Sequence
  Description of Artificial Sequence: Synthetic coding sequence
auggcccuuguauuaauccugcaauuacugacgcucuggccacugugccauaccgauauuacacccuccgugcccccugcaaguuaucacccaaagccuugguuaggggcacagcccgcuaccguggugacgccgggaguuaacguuaccuugcgaugucgggcuccacaacccgccuggagauucggccuuuuuaaaccuggcgagaucgcuccacuccucuuucgggauguuucaucggagcuggcugaauucuuccuggaagaggucacucccgcacagggcggcauuuaccgcuguugcuaccgacggcccgacuggggaccaggugucuggucacagccuuccgacgugcuugaguuacugguuacugaagaauugccccgaccaagccucguggcccuuccaggcccugucguugggccgggagcaaacgugucacuucgaugcgcaggccgccuucgcaauaugucuuuugugcuguaccgcgaaggcguggccgccccguugcaguacaggcacuccgcacagccaugggcagacuucacccuccuuggcgcacgcgccccaggcacauauucuuguuacuaucacacuccuagugcucccuauguccucagccagcgcucugaggugcuggucaucagcugggaagauagcggcaguucugauuacacuagaggcaaucucgugcgacucggccucgcaggauugguacugauuucccucggcgcauugguaacuuucgacuggcggucucagaaucgggcucccgcuggcauucguccauag

SEQ ID NO: 248403 - RNA, 1716 nt, Artificial Sequence
  Description of Artificial Sequence: Synthetic coding sequence
augaccauccuucccaaaaaaaaaccaccuccacccgaugccgacccagccaaugagccccccccaccugggcccaugccaccagcccccagacgcggaggcggcguaggagucggagggggcggcacaggaguugggggaggcgaccgcgaucgggauagugguguugucggagcgcgaccccgagccucuccucccccucaaggcccucuuccagguccuccaggggcccugcauaggugggcccucgccguacccccuggcgcagucgccggccccaggccacagcaagcgucccccccgccguguggcggaccgggugggcccgguggcgggccaggagacgcccuuggggcagcugccgccggugugggagcagccggcguggugguaggagugggaggugcggucggcguggguggguguuguuccggucccggccacagcaaacgaagaaggcaagcucccggcgucggcgcgguuggcggaggaagcccugaacgagaagaggugggggccgguuauaacagcgaagacgaauacgaagccgcugcugccaggauagaggcgauggauccagccacagucgagcaacaggaacacugguuugagaaagcucuaagagauaagaaggguuucauuauuaagcagaugaaagaagauggugcaugccuauuucgggccguugcagaccaggucuauggcgaucaggauaugcaugagguugucaggaagcauugcauggauuaccucaugaaaaacgcugauuacuuuucaaacuaugugacugaggacuucaccaccuauauuaaucggaagcgaaaaaauaacugccauggaaaucauaucgaaaugcaggccauggcugagauguacaacagaccgguggaaguauaccaguauaguacgggaacuagugcugucgagccaaucaacacuuuccacgguauacaucagaaugaggacgagccaaucagggugucauaccaucgcaauauccacuauaacagcgugguaaauccgaacaaggcaaccauuggagugggcuuaggcuugccguccuucaaacccggauuugcagagcaauccuuaaugaaaaaugcaaucaaaacuucugaagagucauggauagaacagcagaugcuugaggauaagaaacgcgcuaccgacugggaggcaacuaacgaggccauagaggagcagguggcgcgcgagagcuauuugcaauggcugcgcgaccaggagaagcaggcaaggcaggugcggggcccgagccagcccagaaaagcuucugccacauguucaucugcuacagcugcagccagcucuggcuuggaggaauggacgucucggaguccuagacagcgauccucagcauccaguccugaacaccccgagcuccacgcugaguugggcaugaagcccccaagcccaggcaccgugcuggcacucgcuaaaccgccaaguccaugcgccccagggacuagcucacaauuuuccgccggugcggaccgcgccacguccccgcuugugucacuuuaucccgcccucgagugucgugcacugauucagcagaugagucccucugccuuuggacucaacgauugggaugaugacgagauccuggccuccgugcucgcugucucucagcaggaguaccuugacagcaugaagaagaacaaagugcaccgggacccucccccagacaaauccuag

SEQ ID NO: 248404 - RNA, 2529 nt, Artificial Sequence
  Description of Artificial Sequence: Synthetic coding sequence
auggacuuccaggagcgcgacccuccuuuccugcccgagagcgcacaauccucuaaaccuaguucagcccagcaagcuucugaguuaugggaggugguggaggagccucgaguucgacuagguacugaaggggucaugcccgaaaggcaggagggucaucugcuuaagaagaggaaauggccgcucaaaggauggcacaaaagauauuuugugcuggaggauggcauacuacacuacgcaacaacucgacaagauauuaccaaagggaaacugcauggaaguauagacguccgucuuucuguaaugaguauaaacaaaaaggcccagcgcauugacuuagacaccgaagauaacaucuaucaccugaagauaaagagucaggaccuuuuccagucuugggucgcacaguugagggcucaccgccuugcucaccggcuggacaugccucgcggauccuugcccagcacggcacacagaaagguuccaggcgcacagcuuccuacggccgcuacagcaucagcccuuccuggccucgggcccagagagaaggucaguuccuggcuucgcgacagugacggauuggaccgguguagccaugagcugagugagugccaaggaaagcuccaggagcuccacagauuacugcaaagccuugaaagucugcacaggauuccaucugcccccguuauccccacgcaccaggcaaguguuaccaccgagcggccuaagaagggaaaaagaacaucccgaauguggugcacucagucuuucgccaaggaugauacaauagggcgaguuggcagacugcauggcuccgucccaaaucucucucgguaccuagagaguagggauucaaguggcacaagagguuuaccccccacagauuaugcacaucugcagcgcagcuucugggcccuggcccaaaaagugcacaguucauugucuuccguucuugcugcucugacaauggagagagaccagcuacgcgacaugcaucagggcagugaauuaucaaggauggguguuucagaggccucuacaggccagcgacgccuacacucacucucuacaucuagugacacgaccgccgacucuuucuccucacuuaauccugaagagcaggaggcucuguauaugaaaggaagagaacuuacuccucaauugagccagaccaguauacuaucauuagcagacagccauaccgaguucuuugacgccugcgaggugcuguugagugccucuuccuccgaaaacgaggguagugaagaagaggagucaugcacguccgaaauaaccacuagucuguccgaggaaaugcuggaucuucggggcgcugaacgcugucaaaaggggggcugugugcccggucgaccaaugggaccaccuagaaggagaugcuugccagcugcuagugggcccggugcagaugugucccuguggaacauucugagaaauaacauuggcaaggacuuguccaaggucagcaugccaguucagcucaaugagccccugaacacuuugcaaaggcugugugaggaguuagaguauaguucccugcuugaucaagcaagccguaucgcagacccuugugagaggaugguuuauauagcagccuucgccguuucagccuacagcuccacuuaucaccgggcaggcugcaagcccuucaaucccguguugggagagacguacgagugugagcggccagaucggggguuuagauuuauaagcgagcaagugucucaucaccccccaauuucugccugucaugccgagucugaaaauuucgccuuuuggcaggacaugaaguggaaaaacaaauuuugggggaaaucccuugagaucguccccgugggaaccgucaacgugucgcuuccaagguucggcgaccacuuugaguggaauaagguuacuucauguauucacaacguccuaucaggucagcgcuggauugagcacuacggcgaaguacuuaucaggaauacccaggacaguucgugucacugcaagauuaccuucugcaaggccaaguacuggucuucaaacguccacgagguacagggggccguucucagcagaucuggccgugugcugcaccgguuauucggaaaguggcaugaggggcuuuacagaggaccaacaccuggaggucaguguauauggaagccuaauuccaugccaccugaucaugaacggaauuuugguuuuacucaauucgcgcuggaguugaacgagcugacagccgagcugaagcgguccuugcccagcacggacacaaggcuuaggccagaccagcgguaccuggaggagggcaacauucaggcugcugaagcccagaaaaggaggaucgagcaauuacagcgcgacaggcggaaagucauggaggagaacaacauuguacaccaggcccgcuucuucagaaggcagaccgacuccucuggcaaagaauggugggucacaaauaacaccuauuggagguugcgggcagaaccagguuacggaaacauggacggcgccgugcugugguag

SEQ ID NO: 248405 - RNA, 816 nt, Artificial Sequence
  Description of Artificial Sequence: Synthetic coding sequence
auggcuucccccgguugccuguggcuccuagccgucgcacugcucccuuggacaugugccagccgagcucuccaacacuuggaccccccugcccccuuaccauugguuaucuggcacggcaugggaagcagguaugucgcccagaccggacucgaacuucuugcuuccagcaacccaccagccucuaguuaccagucagcagguaugaucggcgacucaugcugcaauccucuuuccaugggagccauaaaaaaaaugguggagaagaagaucccuggcauuuauguuuuaucccuggagaucggcaagacacucauggaggaugucgaaaauucuuuuuuccuaaaugugaauucccaggucaccacaguaugccaggcccuggcuaaagacccaaaacuucaacagggauacaacgcaaugggcuucucacagggcggucaguuucugagagcgguugcgcaacgguguccaucuccaccuaugauaaacuuaauuagcguugguggucagcaucagggcgucuucggacuaccuagguguccuggagagucaucacacaucugugauuucauccgaaaaaccuugaaugcuggcgcuuacucuaagguagugcaggaaagacuagugcaagcagaauacuggcacgaccccaucaaagaagacguguaucguaaccacucuaucuucuuagcagauaucaaccaggagaggggaauaaacgagucuuauaaaaaaaaucucauggcccucaagaaguuugugaugguaaaauuccuuaaugauagcaucguugaccccguggacucagaguag

SEQ ID NO: 248406 - RNA, 921 nt, Artificial Sequence
  Description of Artificial Sequence: Synthetic coding sequence
auggcuucccccggcugccuguggcugcuggccgucgccuuacucccguggacuugcgcaucaagggcccuucaacaucuagauccuccugccccuuuaccucuugugaucuggcaugggaugggcgacagcuguuguaacccucugagcaugggagcgaucaagaagauggucgagaagaagauccccgggaucuacguucugucacuagaaaucggaaagacacugauggaggauguugaaaauucauucuuccuuaacguaaacagucaagucacuaccguuugccaggcgcuggcuaaggauccuaaacugcagcagggcuauaaugcgauggguuuuagccagggaggccaauuucugagagcaguggcccagcguuguccgagcccccccaugaucaaccuuauuaguguggguggucagcaccaagguguauuuggccugccuagaugcccaggcgaauccucucauaucugugauuuuauucggaaaacuuuaaacgccggagccuacagcaaaguugugcaagaacgccuugugcaggccgaauauuggcaugauccaauuaaggaggacguguacagaaaccauucuauauuuuuggcagacauuaaccaagaaaggggaaucaacgagucuuauaagaaaaaucuuauggccuugaaaaaguucguuauggucaaguuucugaaugauaguauagucgauccaguugacucggagugguucggguuuuaccgcagcggccaagccaaggaaacuaucccguuacaggagaccagccuauacacucaggaucgucucggccuaaaggaaauggacaaugcuggacagcucgucuuuuuagcaacugagggcgaucacuuacaguuaagcgaagagugguuuuaugcucacauuauccccuuuuuaggcuag

SEQ ID NO: 248407 - RNA, 612 nt, Artificial Sequence
  Description of Artificial Sequence: Synthetic coding sequence
auggcaucaccugggugucuguggcuccuggccgucgcgcugcucccauggacuugugccuccagagcgcugcagcaucuggauccuccugcgccccugcccuuggugauuuggcauggcaugggagucuucggccuuccucggugccccggggagucuucccauaucugcgacuuuauaagaaaaacccugaacgcgggcgcuuacagcaaggugguacaagagaggcucguccaggccgaauacuggcacgaucccaucaaggaagauguguacaggaaucauaguauuuuucuagcggacaucaaucaagagaggggcauuaaugaauccuauaaaaaaaauuugauggcccugaagaaauucguaauggugaaguucuugaacgauaguauaguggauccaguggauucagaaugguuuggcuuuuaccgguccggucaggcuaaagagaccaucccccuccaggagacaucgcuguacacccaagaccgccugggucugaaagagauggauaacgccggacaauugguuuuccuagcaaccgaaggagaucaccuccagcuuucugaggaaugguucuaugcucauauuauuccauucuugggcuag

SEQ ID NO: 248408 - RNA, 921 nt, Artificial Sequence
  Description of Artificial Sequence: Synthetic coding sequence
auggccucaccaggauguuuguggcugcuugccgucgcgcuucuucccuggacaugcgccuccagagcccuucagcaccuggaccccccugccccacugccacuuguaaucuggcauggaaugggcgacaguugcugcaacccucuguccaugggcgccauuaagaagaugguggaaaagaagauacccgggauauacgugcucagccuugagauaggcaagacccugauggaggacgucgagaacaguuucuuucuaaacgugaacagccaggugaccacagugugccaagccuuggcaaaagacccaaagcuacagcagggguacaacgcaaugggauucagucaaggaggccaauuucugagggcaguugcccagcgguguccgagccccccaaugaucaaucucauuuccgugggcggccaacaccaggggguuuucggguugccuagaugcccuggugagaguucccauaucugugacuucaucaggaagacucucaaugcaggcgccuacuccaaaguaguucaggagagacuggugcaagcagaauauuggcaugauccuauaaaagaagacguauacaggaaucacucaaucuucuuggcagacaucaaccaggaacgcgguaucaacgaaucauacaaaaaaaaucugauggccuugaaaaaauucgugauggugaaguuccuaaacgauaguaucgucgacccuguagauucggaaugguuuggguucuauaggucaggucaagcaaaagaaacuauuccucuccaggagacuucucucuauacacaagauagacugggacugaaggagauggacaacgccgggcagcugguguuucuggccacugaaggggaucaucugcagcuguccgaggagugguucuacgcccauauuaucccuuucuugggcuag

SEQ ID NO: 248409 - RNA, 2310 nt, Artificial Sequence
  Description of Artificial Sequence: Synthetic coding sequence
augggcuguaauaugugcguagugcagaaacccgaagagcaguacaaaguuaugcuccaggugaauggcaaagagcugaguaagcugucucaggagcaaacacugcaggccuuacgguccaguaaggaacccuugguuauccagguccucagacgcucuccaagacuuaggggagauucuuccugccacgaccuccagcugguugauuccggcacacaaaccgacauuacuuucgaacacaucauggcucuaggcaaacucaggcccccaacccccccaaugguaauucucgagccucccccaauuagucacgaguacuacgacccugcagaauucauggaggguggcccucaggaggcagacagacuggacgagcuggaauacgaagaggucgaacuguauaagaguagccacagagacaaacugggauugaugguauguuaccgcacagacgaugaagaagaucucggaaucuaugugggagaggugaacccgaacaguauugcugcuaaggacggccgcauucgcgagggcgacaggauuauccagaucaacgguguggacguucaaaauagagaagaagccguagcuauacugucccaggaagaaaacacuaacaucagucuucuaguggcccgcccagaaagccagcucgccaagcgguggaaagauuccgacagagaugacuuccuagaugauuuuggaucugagaacgaaggagaguugcgggccaggaaauugaagucaccuccggcacagcagccagguaaugaggaggaaaaaggggcaccggaugcugguccuggguuguccaacucccaggagcuugacuccggagucggucgcacagacgaauccacccggaacgaggagucuagcgagcaugaucuguugggagacgagcccccuucaaguacaaacacaccggggucauugcgcaaauuugggcuccagggagacgccuuacagucaagggauuuccacuucucaauggacucucugcucgccgaaggugccggacuuggagggggagauguccccgggcucacagaugaggaauacgagcgguaucgugaacugcuugagaucaagugucauuuggagaacgggaaucagcugggccuacuguucccuagagcauccgggggcaauagcgcauuggacgugaaucggaacgagagccugggccacgagauggcuaugcuggaagaggagcugcgccaucuggaauucaaguguagaaacauccuccgugcucagaagaugcaacaguugcgagaacggugcaugaaggccuggcuguuagaagaggaaagucuguaugaccuagcagccuccgagcccaaaaaacaugagcuuuccgacaucagcgaauugccugaaaaaagcgacaaagauaguaccagcgcauacaauacaggagaauccugccgcucuaccccauuguuggucgagcccuugccugagucuccccuccggagagcuauggccggaaauagcaaccugaaccgcacgcccccagguccagccguggcuaccccugcuaaagcugcccccccacccggaagccccgcaaaauuccgaucccuuagccgggaccccgaggccggccgacggcagcacgcugaagagaggggccgccguaacccaaaaaccggacuuacccuagaacgagucggaccggagucuucuccauaccucucacgccgacaucgcggccagggccaagagggggaacacuaccacucaugugugcaguuggcucccacucguggauuagaagaauugggccacgggccgcugucccucgcgggcggccccagggucggcgguguugccgcggccgccaccgaggccccacguauggaauggaaaguuaaagugcggagcgacggcacucgauaugucgccaaacgaccaguuagagacagacuguugaaagcucgcgcacuuaagauuagggaagaacgcagugguaugacaacggacgacgaugcggucucugagaugaaaaugggccgauauuggucuaaagaggagcgcaaacagcaucuuauucgugcccgggaacagagaaaacggcgcgaguucaugaugcagaguagauuagagugccuacgcgagcaacagaacggcgauuccaaaccggagcugaacauaauugcacuuagccaccguaaaaccaugaaaaagaggaacaaaaaaauacucgacaauuggauaacuauucaggagauguuggcucacggugcccgaucugcggaugggaaacggguauacaaucccuugcuguccguuacgacaguguag

SEQ ID NO: 248410 - RNA, 477 nt, Artificial Sequence
  Description of Artificial Sequence: Synthetic coding sequence
augcucgaggccauggccgagcccaguccugaagacccuccuccuacccuuaagccugaaacacaacccccagaaaaacguagacgaacuauagaggauuuuaauaaguuuuguucuuuuguucucgccuacgcuggauauauacccccaucaaaagaagaaucugauuggcccgccuccggaucuucuaguccauuaaggggcgaauccgccgccgacucagacggaugggauuccgcaccuagugaucuacgcacuauacaaacauuugucaaaaaagcgaaauccuccaaaagaagggccgcucaggccggacccacacagccaggcccaccccgcagcaccuucagccgacugcaggcaccagauucagcaacccugcucgagaaaaugaagcuaaaggacucucuguuugaccuugaugggccaaaggucgcaaguccccucucacccccuugcgccgcaaauaccccuuag

SEQ ID NO: 248411 - RNA, 1665 nt, Artificial Sequence
  Description of Artificial Sequence: Synthetic coding sequence
augcgccgaccucuaaguaaaugcgggauggagccuggaggcggggaugccucucuaacuuugcacgguuugcagaaccguagccauggcaaaaucaaauugcggaagcgcaagagcacccucuacuuuaacacucaggaaaagucggccagacgccguggagaccuccucggagaaaacaucuaccuccugcuguucacgauugcccuccgaauuuugaacuguuuccucguucagaccuccuuuguccccgaugaguauuggcagucccuggaaguuagucaccauaugguguucaacuauggcuaucugacuugggaguggaccgaaaggcugagauccuacaccuacccccucaucuuugcaagcaucuacaaaaucuuacaccuucucggcaaggauuccgugcaguugcugauuuggauuccacggcuggcgcaagcucugcucuccgccguagcagacguccggcuguacagucugaugaaacagcucgagaaccaggagguggcccgcuggguguucuucugucagcucuguucuugguucacaugguauuguugcacacgcacccucaccaauacaauggaaacggugcucacgaucaucgcccuuuucuacuacccucuggagggcagcaaaaguaugaacagugucaaauacucaucccugguggcacuugccuuuaucaucaggccuaccgcugugauccuauggaccccucugcuguuucggcacuucugccaggagcccaggaagcuggaucuuauccuccaccacuuucuuccugugggcuuuguuaccuugucacucucacugaugaucgacaggaucuucuucgggcaguggacauuggugcaauuuaacuuucuuaaguuuaacguccugcagaacuggggaaccuucuacggcucccaccccuggcacugguacuuuucacaaggauucccggugauuuuggguacacaccucccauuuuucauccacgguuguuaccuggcucccaagagguaccggauacuccucgucacuguacuguggacuuugcucguauacaguaugcugucccacaaggaguuuagguucaucuacccagugcuuccauuuugcauggucuucugcggcuacucccugacccaucuaaagacuuggaagaagccagcauugucguuucuuuucuuguccaauuuauucuuagcucucuacaccggacucgugcaucagcgggggacccucgacgugaugucucauauucaaaaaguuuguuacaauaaccccaauaagucuucugcaucaauauucaucaugaugcccugccacucuacacccuacuacucacaugugcauugcccucugccaaugcguuuccuucaaugcccuccggaccucacuggcaagucccauuacuuagacgaagccgacguguucuaccuaaacccgcugaacuggcugcaucgugaguuucaugaugaugcuuccuugcccacccacuuaaucacauuuucuauccucgaagaggaaauuagcgcauuuuuaauuucaucuaauuacaagcgcaccgcugucuucuuucauacacaccugccagagggccggaucggaucccauauauaugucuaugaacggaagcugaaggguaaauuuaacaugaaaaugaaguuuuag

SEQ ID NO: 248412 - RNA, 1482 nt, Artificial Sequence
  Description of Artificial Sequence: Synthetic coding sequence
auguggccccaggaucccagccgcaaggagguacuucgauucgcaguauccugucgaauccugacucuuaugcuacaggcacucuucaacgccaucaucccugaucaccacgccgaagcauucucuccgccuaggcuggcaccuuccggguucguugaucaauugguagagggccuacuagguggccugagucauugggacgcagaacacuuccuguuuaucgccgaacacggcuaucuguaugaacacaauuucgcuuuuuuuccaggguuucccuuggcucuucuggugggaacugaacuccuccgcccacuccgagggcuguuguccuugcgcaguugccugcuuauaucuguagccucucugaacuuccuguuuuuuaugcuggcagccguggcgcuccaugaucucgggugccuuguacuccacuguccgcaucagucuuucuacgccgcccugcuauucugcuuaucgccugccaacguuuucuuagcugccggcuacagcgaggcacuguuugcucuacuuacuuuuagugccaugggccagcucgaacggggucggguuuggacaucaguccuucuauucgcuuuugcaaccggcguacgcucaaacggccuugugucggucgguuuucucaugcacucacagugucagggcuucuuuagcagcuugacaaugcuuaacccucugaggcaacuguucaaacugauggcgucccucuuucucuccguguuuacucugggauugcccuuugcacuuuuccaguacuaugcuuacacacaguuuugucuuccgggaagcgcccgccccaucccagaaccccuggugcagcuggcaguggauaagggguaucgaauugcggagggcaaugagccgccuuggugcuuuugggacgugccucugauuuacucuuauauccaggauguauauuggaacguaggauuccugaaguauuacgagcuaaaacaggugccaaacuuucuucuugccgcaccgguggccauucugguggcaugggcaaccuggacguacgucacaacacacccguggcugugccucacccugggacugcagagaucaaaaaacaacaaaacacucgagaagccugaccuggguuuucugagcccucagguguuugucuauguggugcaugcugccguccuuuugcucuuuggaggacuguguaugcaugugcaagugcucaccagauuucuuggcagcagcacaccgauuauguacugguuccccgcacaucuccuccaagaucaggagccuuugcugaggagccucaagaccgugccauggaaaccccuggccgaggauucuccaccugggcagaaagugccacggaauccuauaaugggccuccuuuaccacuggaaaacaugcucaccuguuacacgauacauccuuggauacuucuuaaccuacuggcuuuugggccuacugcugcacuguaacuuucuucccuggacauag

SEQ ID NO: 248413 - RNA, 2529 nt, Artificial Sequence
  Description of Artificial Sequence: Synthetic coding sequence
augucaaggccucugagcgaccaagaaaaacggaagcagauuucggugagggggcucgccggcguagagaacguaacugagcugaagaaaaauuuuaauagacaucuccauuucacucucguaaaggauagaaacguggccacucccagggacuauuacuucgcccuggcccacaccguaagggaucaccugguuggcagguggauaaggacccagcagcauuauuacgagaaagacccaaaaagaaucuacuauuugucauuggaauuuuauaugggcaggacccugcagaauacaauggugaauuuggcccuugagaaugcaugcgacgaggcaaccuaucaguugggcuuagauauggaggagcuagaggaaauugaagaagacgccggacuugggaauggagggcucggccgcuuggccgcauguuuccuugacaguauggccaccuuagguuuggcugcuuacggauacggcauacgguacgaauuuggcaucuucaaucagaaaauuagcgguggauggcaaauggaagaggcagaugauuggcuuagauauggcaacccaugggaaaaagcccgcccagaauucacuuuaccagugcauuucuacggucaugucgaacacacuucgcagggcgccaaauggguggacacucaagucguccuggccaugcccuaugacaccccaguuccgggguaucgcaauaacgucgugaacacuaugaggcugugguccgccaaagcuccaaacgacuucaaccucaaggacuucaacguggggggcuacauucaggcuguuuuggaccggaaccuggccgaaaacauuucuagggugcucuaccccaaugacaauuucuucgaagggaaagagcugagacugaagcaggaauacuucguaguugcugcuacucugcaggacauuauaagaagauucaaauccaguaaauucggcugcagagauccugugcggacgaacuucgaugccuucccggacaaagucgccauccagcugaacgauacacauccaucacuggcaauucccgagcucaugcgaauccugguugaucuggaacgcauggauugggacaaggccugggacgugacaguccguaccugcgccuacacaaaucacaccguucuaccagaggcucuggaaagguggccuguccaccuguuggagacacuacugccucgucaccuccagaucauauacgagaucaaucagcgcuuccucaauaggguggccgccgcguuucccggugacgucgaccgccuuaggcgaaugucucucguugaagaaggcgccgugaaaaggaucaauauggcccaucugugcauagccggaucccacgccgugaauggaguugcgcgcauccacagcgagauuuugaaaaaaacuauuuuuaaggacuuuuaugaguuagagccccacaaguuccagaauaagaccaacggcauaacuccaagacgguggcugguacuguguaauccgggucucgcugaaguaaucgccgaaaggauuggggaggauuuuauuagcgaccuggaccagcuccgcaaacuccuguccuucgucgacgacgaggccuuuauccgggauguagcaaaggugaaacaagaaaauaaacugaaguuugccgcguaccucgaaagggaauacaaagugcacauuaauccuaacagccuguucgauauccaggugaagcggauccaugaauauaagcgccagcuuuuaaacugccugcacgucaucacucuguacaacaggauaaaaagagagccuaacaaguucuucguacccaggacugucaugaucggcgggaaggcugcuccaggauaccauauggccaaaaugauaauucggcugguuaccgccauuggcgaugucguuaaucaugauccagcugucggcgacagacucagagucaucuucuuggaaaacuacaggguaucgcuagccgagaaagucaucccggccgccgaucucucagagcagaucagcaccgccggaaccgaggccaguggaacagguaauaugaaguuuaugcucaacggagcucuuacuauuggcaccauggacggcgcaaacguggagauggccgaggaggccggggaagaaaacuuuuuuauauucgggaugagaguggaggacguugauaaacuggaucagaggggguauaaugcacaggaguacuaugacaggauuccagagcuucgucaggugauugaacagcugagcuccgguuuuuucagccccaagcaacccgaccuguuuaaggacauuguuaacaugcucaugcaccacgaucgguucaaaguuuucgcugauuacgaagauuacaucaagugucaggagaagguguccgcacuguacaagaauccccgggaauggaccagaaugguuauccggaauaucgcuacuucaggaaaauucaguagcgaccggacaaucgcucaauacgcucgcgagauuuggggaguggagccaaguaggcagcgucugcccgcuccugacgaagccauuuag

SEQ ID NO: 248414 - RNA, 2646 nt, Artificial Sequence
  Description of Artificial Sequence: Synthetic coding sequence
auggcugcgccaggcgccccggcugaauacggauacaucagaaccguguuaggccagcagauccuaggucagcuugauuccuccucgcucgcucucccuagcgaggcuaaacugaagcucgcaggcagcagugguagagguggccagacaguaaagagucugcgcauccaggagcagguucagcagacacucgcccgaaagggcaggaguuccgugggaaacggcaaccugcauaggacguccucugugccggaauaugucuauaaucugcaccucguagaaaacgauuucguggguggaagguccccggucccuaagaccuacgacauguugaaagccggcaccacagccacauacgaaggaagguggggaagggggacugcccaguauaguucccagaaaagcguggaggagaggucucuucgccacccccuacgccggcuugagauaaguccagauuccaguccggagagagcccacuauacgcauagcgauuaucaauacagccagagaucacaggccggacacacauugcaccaccaggagucuagacgggccgcguugcucgugccuccaagauaugccaggucagaaaucguaggagucucgagggccggcaccacaucaaggcagcgccauuucgacaccuaucaucgccaauaucagcacgguagcguaucugacacuguguuugacaguauucccgcaaauccggcccugcugacauauccucgccccggcacgaguagaaguauggggaaucugcuugaaaaggaaaacuaccugacggccggacucacagugggacaggugagaccccugguuccuuugcagccaguaacucaaaaucgagccucacguaguucauggcaucagucaucauuucacucuacccguacacugagagaagccgggcccucgguugcuguugacaguagcggacgaagagcccauuugacuguugggcaggcugcggcugggggcuccggcaaucuccucacagaaaggucaaccuuuaccgacagucagcuggggaacgcggacauggagaugacacuggagcgggcuguaaguauguuagaggcagaccauaugcugccaagccgcaucucugccgccgccacguuuauccaacacgaaugcuuucagaagucggaagcuagaaagagagucaaccaacugagggggaucuugaaacucuugcaacugcuuaagguacagaaugaggaugugcagcgcgccguuugcggcgcccucaggaauuuaguauuugaggacaacgacaacaaguuagagguggccgaguugaauggagugccuagauuacuacagguucugaagcagacccgcgacuuagagacaaaaaagcagaucacugaccauaccguaaaccugaggucccguaauggcuggcccggugcaguggcucaugcguguaacccuuccacacuggggggacaggguggcagaauaacccgaucuggaguacgcgaccagccugaccagcacggucuguuguggaaccucaguucuaaugauaaacugaagaaucucaugaucaccgaggcucugcugacacucaccgaaaauauuauuauucccuuuagcggauggcccgaaggggauuaccccaaggcgaauggacuguuagauuuugauauuuuuuacaacgucaccggcugccuucgaaacaugucgucagcaggcgcagauggucggaaggccaugcgcagaugcgacggccugauugacuccuugguacacuauguccguggcaccauugcugauuaccaacccgacgacaaagccacagaaaacugcguguguauccuacacaaucuguccuaccaacuggaggcugaacugcccgaaaaguauucccaaaauauuuauauccagaaccgcaacauccagacagacaauaacaaauccauaggcuguuuugguucuaggagccgcaaagucaaagagcaauaccaggaugugcccaugcccgaagagaagagcaaccccaaagggguugaguggcuguggcacucuaucguaauccggauguacuuaucucugauugcaaaauccgugcguaacuacacccaggaagccucacuuggagcucuccaaaauuuaacagcugguagcgggccgaugccuacaagcguggcacagacagucgugcagaaagaguccggccuccagcacacuagaaaaauguuacaugucggcgauccaucggucaagaaaaccgcuaucucucuacuuaggaacuuaucccggaaucucagucugcagaacgaaauagcaaaagagacacugccagaccucguaagcauuaucccagauacugugccuucuacugaccuccucauugagaccaccgccucugcuugcuacacgcugaacaacaucauccagaacagcuaucagaacgccagggacuuauugaacacuggcgguauucagaagaucauggccauuuccgcuggggacgccuacgccucaaacaaggcaagcaaggccgccagcgugcugcuuuauucucugugggcucauacagagcugcaccaugccuauaagaaggcccaguucaaaaaaacggacuuuguaaacucuagaacagccaaggccuaccacucccugaaagauuag

SEQ ID NO: 248415 - RNA, 291 nt, Artificial Sequence
  Description of Artificial Sequence: Synthetic coding sequence
auggaacauaaagaagugguuuuguugcuccuguuguuccucaaaucuggacagggcgagccucucgacgacuaugugaacacacaaggaccgucauuguucagcgugacaaaaaagcaacucggcgccgggucaagagaggagugugccgcuaagugugaagaagacaaggaguuuacuuguagagcuuuccaauaccacucaaaggagcagcaauguguaauuauggcagaaaacagaaagucauccaucaucauccgaaugcgcgacgcugugcucuucgaaaaguag

SEQ ID NO: 248416 - RNA, 291 nt, Artificial Sequence
  Description of Artificial Sequence: Synthetic coding sequence
auggaacacaaagaaguggugcucuugcuuuuguuguuucucaaaucuggccaaggugaaccucuggacgacuauguuaacacucaaggccccagccucuucaguguuacaaagaaacaacugggagcaggcagcagggaggaaugugcagcaaaaugugaggaagacaaagaauucacaugcagagcuuuucaguaccauuccaaagaacaacagugcguuauaauggcagaaaauaggaaaagcagcauuauaauuagaaugagagacgccgugcucuucgaaaaguag

SEQ ID NO: 248417 - RNA, 291 nt, Artificial Sequence
  Description of Artificial Sequence: Synthetic coding sequence
auggagcauaaagaaguugugcugcugcuacuccuguuucuaaaauccgggcagggcgagccauuagacgacuaugugaacacacaaggacccagucuguucuccguaacgaaaaagcagcuaggagcuggauccagagaagagugcgccgcaaaaugugaagaggauaaggaguucaccugucgcgccuuccaguaucacucuaaagagcagcaauguguaauaauggcggaaaauagaaagucuucuaucaucauuaggaugagagacgcggugcuuuucgaaaaauag

SEQ ID NO: 248418 - RNA, 405 nt, Artificial Sequence
  Description of Artificial Sequence: Synthetic coding sequence
augaagucccugacuuggauucucggcuugugggcuuuagcagcuuguuucaccccaggcgaaucucagagaggcccacggggcccguacccgccuggcccacuugcacccccuccuccacccugcuuuccauuugggaccggauucgugccaccgccccauccuccuccuuacggcccaggcagguuuccaccuccacuguccccuccguauggcccagguagaaucccacccagucccccuccuccuuacggaccuggccgaauccagagccacucccuuccuccucccuacggaccaggauacccccagccaccaucacagccaaggcccuauccaccaggcccuccuuuuuucccugugaacagucccacagacccugcccuaccaacaccugcaccuuag

SEQ ID NO: 248419 - RNA, 3075 nt, Artificial Sequence
  Description of Artificial Sequence: Synthetic coding sequence
auggcgcagggcgcaaugcgguucuguucggaaggagacugugcgauuuccccacccagaugcccacgccgauggcucccugaaggaccagucccacaaucuccgccagccagcauguacggaucuacgggcucacuccucaggcgcguggccgguccuggcccgagagggcgcgagcuuggcagagugacagcccccugcaccccauugcgcgggccuccaagcccaaggguggccccuagcccgugggccccauccucuccuaccggccaacccccaccgggcgcacaguccuccguuguaauuuuuagauucguugagaaggccagcgugaggccccucaacgggcuucccgcuccuggaggccugucaagauccugggaccuuggcggaguuucuccgccccggccuaccccagcucugggaccugggaguaauagaaagcugcggcuggaagcaaguaccuccgauccucuuccagcgcguggagggucagcacugccgggaagccgcaaccuagugcacggaccuccugcuccaccacaggucggcgcugacgggcuguacuccucucucccuaauggguuaggcggcccacccgaaagacuggccacuuuguuuggaggccccgcugauaccggcuuucuaaaucagggagauaccuggucaucuccucgugaggugucaucccacgcacaacggauugcuagggcaaagugggaguuuuuuuacggaucccuagauccucccuccagcggcgccaaacccccagaacaagcuccuccaagccccccaggugugggcucccgccagggcucugggguugcagugggccgggcugcuaaauacucugagaccgaucuugacaccgugccacugagauguuacagggagacugacaucgaugaaguucucgccgagcgcgaggaggcagacagcgccauagaaucccagcccucaagugagggaccucccggcacggcguauccuccagcuccacgccccgggccccuaccgggaccucacccuuccuuaggauccggaaaugaagaugaggacgaugaugaagcggggggagaagaggacguagacgaugagguguucgaagcuuccgaaggcgccaggccggggucgagaaugccacuuaagaguccagugccuuuucugccuggcacaucuccaucagccgacggaccugauagcuucucaugcguuuuugaggccauucuggagucacaccgugcgaaggguacgagcuacacuagccuggccagccuggaggcacuagccucaccggggccaacacaaaguccauuuuuuacauucgagcucccaccccagccaccugcaccacggccagacccaccugcccccgcaccccucgccccucuggagccugauagcggcacaaguucugcagcagacggccccuggacucagcgaggcgaagaagaggaggccgaggccagggccaaauuggcuccaggaagggaacccccuagcccaugucacucugaagauagcuuaggucugggggcugccccccuggggucagagccuccacugucucaacucgucucugacagugauagcgagcucgacagcaccgagagguuggcauuaggcagcaccgacacuuugucaaacggacagaaagccgacuuagaggcugcccagcgacuugccaagagacuguaucgccuugauggauucaggaaagccgacgucgcccgccaucugggcaagaauaacgacuucagcaaguugguggccggcgaauauuuaaaauuuuucgucuucacaggaaugacccucgaccaagcacugcggguguuucuuaaagaauuggccuugaugggcgaaacccaggaacgagagcgcguccuggcacacuuuucucagagauacuuucaauguaaucccgaagcccucaguucugaggacggagcacacacccugacaugcgcccucauguuacugaauacagacuugcauggucacaacaucgggaagcgcaugacaugcggcgacuucauuggaaaccuggaggggcucaaugacggcggggauuuuccacgagagcuguuaaaggcccuguacucguccauaaaaaaugagaaacugcagugggcgauagaugaggaggaauugagaagaucccuguccgaguuggcagacccaaauccuaaaguaaucaaaaggauuucuggcgggucuggaucaggcagcucucccuuccuggaucucacaccagagccuggggccgccgucuauaaacauggugccuuggugaggaaggugcaugccgaccccgacugcagaaagaccccuagagguaaaaggggcuggaagucuuuccaugggauccuaaaagggaugauacuguaccugcaaaaggaggaguacaagccagggaaagcccuuucagagaccgaacucaagaacgccauuucuauacaccaugcacuggcuacccgagccagcgacuauuccaaacggccucauguuuucuaccugcggacagccgacuggcgcguguucuuauuucaagcaccaagucuggaacagaugcagucuuggaucacacguaucaacgucguggcagcaauguuuagugccccaccuuuuccagccgcugucuccucccagaagaaauucaguagaccacuguugccaucggcugccacacgguugagccaggaggagcagguccggacucacgaggcaaaauugaaagccauggcuagcgagcuucgcgagcacagagcagcccaguuaggaaaaaaggggcgcgggaaagaagcugaggagcagcggcagaaggaagccuaccucgaguuugagaaaagcagauacagcacauacgcugcccugcuaagagucaaguuaaaggcaggaagcgaggagcuugacgcuguggaagccgcccuagcccaagcugggucaaccgaggauggguuacccccaucacacaguaguccuucucuccagcccaaaccaagcagccaaccucgcgcccaaagacacuccagcgaaccucggccgggugcggggagcggucggaggaaaccguag

SEQ ID NO: 248420 - RNA, 2373 nt, Artificial Sequence
  Description of Artificial Sequence: Synthetic coding sequence
augaaagcguucgguccgccccacgagggaccauugcagggccuugucgcauccagaauugagacuuauggaggccggcaucgugccagugcucagucaacagccggucggcuuuacccucggggauacccugugcuggaccccucuagacggcgccuccaacaguauguuccauuugcccgugguuccgggcaggcaagagggcuuucacccaugagacuacgagaccccgaacccgagaagcgccauggggggcacgugggugcuggacuguugcacagcccgaaacugaaagaacuuaccaaggcucacgaguuggaagugcgacugcacaccuuuucuauguucggcaugccucgccugccaccugaagaucgucgccacugggagaucggcgagggcggcgacucugggcuuacgaucgagaaaucuuggagagagcucgucccuggucauaaggaaaugagccaagaacuaugucaccaacaagaagcccucugggaacuucugacaacggagcuuauuuacguccggaagcugaagaucaugacagaccuguuggccgccggauugcugaaccugcagcggguagggcugcuuauggaaguguccgccgaaacacuuuuugguaacgugccuuccuugauccgcacccacagaucauucugggacgaaguuuugggcccgacccucgaagagaccagagcuucuggccagcccuuggauccaaucggccugcagagcggauuucugacuuucgggcagcgcuuucaucccuauguccaauauugucugcgcguaaagcaaacuauggccuacgcccgggaacagcaggaaaccaacccccuguuucaugcuuuugugcaguggugcgaaaagcauaagcgcagcggucgucagaugcugugcgacuuacuuaucaaaccccaucaaagaaucaccaaauacccacuuuuacugcacgcugugcugaagcgaagccccgaagcucgggcucaggaagcacugaaugcaaugauugaagccguggaaagcuuccuacgacacauaaacggccagguccggcaaggggaggaacaagaaucucucgccgccgcagcucagcggauaggaccauacgaggugcucgagccgcccucugacgaagucgagaagaaucuacgaccauucagcacacuggaucucaccucaccuaugcuugggguggcaagugagcacacucgucagcugcugcucgaaggaccugucaggguuaaagagggcagggagggaaagcuggauguguauuuguuccucuuuucugauguacugcuugugacaaagccucagaggaaagcugacaaggccaaggucaucaggccuccacugaugcuagagaaacuugugugucagccccuacgcgacccuaacucuuuucuguuaauucaccugaccgaguuccaguguguaucaucagccuugcugguacauuguccaaguccuacagaucgggcccagugguuggaaaagacucaacaggcccaggccgcucugcagaagcugaaggcugaagaguauguccagcagaaaagagaguugcucaccuuauauagagaccaagaucgggagagcccuucaaccagaccaagcacccccucucucgaaggcucccagucuucggccgagggccgcacccccgaguucaguaccaucauuccccaucucguaguuaccgaggauacugaugaagaugcgccacugguucccgacgacacuucagacagcggauacggcacauugauaccgggaacaccaacuggguccagauccccucucagucgccugcgacaacgugcacugcggcgagacccuaggcuaacguuuagcacccuggagcugcgugauauuccauugcgaccucauccgccugacccccaggccccacagagacgauccgcccccgagcuuccagagggcauucugaaaggcggcucguuaccccaggaggaucccccuacuuggagcgaggaggaggacggugccucugaacgcgggaauguggucgucgagacacuccacagagcaagacugaggggacagcucccaucuuccccaacucacgcggacuccgccggggaaagcccuugggaaucauccggcgaggaggaagaggagggcccucucuuucugaaggcgggacacacgucacugcggcccaugcgcgccgaagauaugcugagagagauucgcgaggaacucgccucccaaaggauagagggcgccgaggaaccuagggauagccgccccaggaagcuuaccagggcccaacuacagagaaugagagguccucacaucauucagcucgauacuccguuaucagccagugagguauag

SEQ ID NO: 248421 - RNA, 819 nt, Artificial Sequence
  Description of Artificial Sequence: Synthetic coding sequence
augguguugcuuacugccgugcuccuuuugcuggcugccuacgcugguccagcccagagucuaggguccuucgugcauugugaacccugugaugaaaaggcucugucuaugugcccucccucaccacuggguugcgaacugguuaaagagcccggguguggcugcugcaugaccugugcccucgccgaaggccagaguugcggaguguacaccgagcgaugugcccaggggcugaggugucuuccuagacaggacgaagagaaaccgcuacaugcucucuuacacggaagaggggucugucugaaugagaaauccuaccgugaacaggugaaaaucgagagagauucgagagagcacgaggagccaaccacaagcgaaauggcagaggaaaccuacuccccuaagauuuucaggccgaagcauacaagaaucuccgagcucaaggcugaagcagugaaaaaggauaggcgaaaaaagcugacucaaagcaaauucguuggaggcgcagagaauaccgcccacccuaggauaauauccgcacccgaaaugcggcaggaaagcgaacagggaccuugccguagacacauggaagcuucccugcaggagcugaaagcuagccccagaaugguaccccgagccguguaucuuccuaauugugaccggaagggguucuacaaacggaaacaauguaagccuucaagggggcguaagcggggcauuuguugguguguugauaaguacggaaugaaauuaccaggcauggaguacguugacggagauuuucagugccacacauuugauucauccaacguggaguag

SEQ ID NO: 248422 - RNA, 2031 nt, Artificial Sequence
  Description of Artificial Sequence: Synthetic coding sequence
auggcugccgcuucuagcccaccgcgcgccgagaggaagagauggggauggggcaggcucccuggggcaagaagggggucugcuggccucgcgaaaaagugcccuuucaguuuagagcuggcagaaggaggaccagccggaggcgcccucuaugcacccauagcacccggggcgccgggaccugccccucccgccagccccgcugcccccgcugcccccccuguugccuccgaucucggaccacgcccacccgucagccuggacccgcgaguauccauuuauucuaccagacguccaguucucgcgcggacucaugugcagggaagggucuacaacuuccucgagaggcccaccggcuggaaguguuucguguaccacuucgccguguuucugauuguauuggugugccuuaucuuuagugugcugucuacuaucgagcaauaugccgccuuggcuacuggaacucuguuuuggauggagaucguguugguggucuuuuuuggcaccgaauacguuguuaggcuuuggucugccgguugcagaaguaaauacgucggguugugggggcggcuccguuuugccagaaaaccaaucuccaucauagaccugauagucgugguggcuucuauggugguguugugcguuggauccaaaggacagguguucgccacuagcgcaaucaggggcauacguuuucugcaaauacugagaaugcuacacguggacaggcaaggaggaacauggagacuccuugggucaguuguguucauccaucgccaggagcuuaucacuacacuuuauaucggguuuuugggccuuaucuucucuucuuauuucguauacuuggccgaaaaagacgcugugaaugaaucagguaggguugaauuuggguccuacgcugaugcccuuugguggggcguagucacaguuaccacuauaggguacggugauaaagugccucagacaugggugggcaagacgauugcauccuguuuuaguguguucgccaucagcuuuuuugcacuuccagccggcauucucgggagcggcuucgcccugaaaguccagcagaagcagcggcagaagcacuuuaaucgccagauaccagcugccgccucacugauacagaccgcuuggagaugcuaugcagcugagaaccccgacagcucaaccuggaaaauuuauauuagaaaggcaccuagaagucauacucucuuauccccuucuccgaaacccaaaaaaucaguggucgugaagaaaaagaaauuuaagcuagacaaggauaacgggguaaccccgggggaaaagaugcugacagucccacacauaaccugcgacccuccagaggagcgaaggcuggaccauuucagcguggauggauaugacucgaguguacgcaaaucaccuacucuacucgaagugucuaugccccauuucaugagaaccaacucuuuugcggaggaccuggaccuagagggcgaaacacugcuuacuccuauuacgcauauuucacagcugagggagcaccacagagccacaaucaaggugauaaggcgaaugcaauauuuuguugcuaaaaaaaaauuucagcaagcucggaaacccuacgacgugcgcgacguaauugaacaguauucucagggccacuugaaucucauggugcggauaaaggaauuacagcgacgacuggaccagagcaucggcaagccuucacuguuuauaagcguuagugagaaaucaaaagaccgcggaucuaauaccauuggggccaggcugaaccggguggaagacaagguuacccagcuggaccaaaggcuggcccucaucacugacaugcuacaucagcugcugucccugcacggaggcuccacacccgguagcggaggacccccaagggaagguggggcccacauuacucagccgugcgggagcgggggcaguguagauccagaacuuuuuuugccauccaacacccucccaacuuacgaacaacucaccgucccuaggcggggacccgacgagggcuccuag

SEQ ID NO: 248423 - RNA, 1104 nt, Artificial Sequence
  Description of Artificial Sequence: Synthetic coding sequence
auguaccccgagaguacgaccggauccccugcccgacucucucuccgacagacagggucacccggaaugauuuacuccacccgcuacggcucaccuaagcggcaacugcaguucuaucgcaaccuugggaaguccggccugagggugucaugccuuggccuuggcacuugggucacguuuggcggucagaucacagacgaaauggcugaacagcugaugacccucgcuuacgacaacgggauuaauuuauuugauaccgccgaaguuuacgcugcuggcaaggcagaaguugugcugggaaacaucauaaagaagaagggauggagaagaagcucuuuagucauuacuaccaagauuuucuggggcggcaaggcagagacggaacgaggauugaguagaaagcacaucaucgagggacucaaagcuucauuggaaagauuacagcuagaguauguagauguuguguuugcaaaccgaccagacccuaauacaccuauggaagaaacggugagagccaugacccaugugaucaaccaaggaauggccauguauugggggaccucucgcuggagcucaauggaaauuauggaggccuacuccguggcgcggcaguucaaucugacucccccaauaugugaacaagccgaauaccacauguuucagcgcgaaaaaguugaaguucaauuaccggaacuuuuccauaaaaucggcguuggugccaugacauggaguccucuggccuguggcaucguguccgggaaauacgacuccgggaucccaccuuacucuagggcuagucugaagggcuaucaauggcugaaggauaaaauccuguccgaagaggggcgccgucagcaagccaaguugaaggaacuucaggccauugcugagagauuaggauguacccugccccaguuggcaauugcuuggugccugaggaaugaaggugugaguucuguucuucugggugcaucaaaugccgaccagcugauggaaaacaucggcgcuauucagguucugccaaaacucucuucaagcaucauucaugaaaucgacucaauucucgggaauaaaccuuacagcaaaaaagauuauagauccuag

SEQ ID NO: 248424 - RNA, 1209 nt, Artificial Sequence
  Description of Artificial Sequence: Synthetic coding sequence
auggggccauugccugcaccuucuuguacucagaggaucacauggaaaggccugcuccugaccgcuagcuugcugaacuuuuggaaccccccaacaaccgcagaagucacuaucgaggcccagccccccaaaguaucugagggaaaagaugugcugcugcucguccauaaucugccgcagaaccugccuggguacuuuugguauaaaggugaaaugacggacuuguaucacuacaucaucucauauauuguggacggcaagauuauuaucuauggaccagcguacucaggcagagaaacuguguacuccaacgcaucccugcuaauucagaacguaacaaggaaagaugcuggcaccuauaccuuacacaucaucaagaggggcgacgaaacacgcgaggaaauuaggcauuucacuuucacccuauaccuggaaaccccuaagccuuacauuucaagcuccaaucucaauccccgcgaggcuauggaggcuguccgccugaucugcgaccccgagacauuagacgccaguuaccucugguggaugaauggucagucucuacccguuacccaccgguugcagcugagcaaaacuaacagaacccuguaccuguuuggcgucacaaaguauauugcagguccauacgagugugagaucaggaauccaguguccgccagcaggagugauccaguaaccuuaaaccuccuccacggucccgaucugcccagaauuuauccuaguuucacauacuaccguagcggagagaaucuugaucuuucuugcuuuaccgaaaguaaucccccugccgaguauuuuuggacuauuaacggcaaguuccagcaaucuggccagaaacuguucaucccccaaauuacuagaaaccauuccgggcuguacgcuuguuccguucauaauucugcuacaggcaaagaaauaucaaagucuaugacggugaaagucagugguaaauggaucccugcgucacuagccgugggauuuuacguugaauccauuugguugagugaaaaaucccaagaaaauauuuuuauuccgucucuuugcccgaugggcacauccaaaucccagauacucuuacugaaucccccaaaucucucauuacagacauuguucucccucuucuuuugcuuccuuauggcugaucuggugucagggcuuaaaaagguggggagagggcucuaucagccuuag

SEQ ID NO: 248425 - RNA, 1281 nt, Artificial Sequence
  Description of Artificial Sequence: Synthetic coding sequence
augggcccacugccagcaccuucauguacgcagcgcauuaccuggaagggcuuacuccugacagccucccugcugaacuuuuggaauccacccaccacagccgaggugaccauagaggcacagccccccaaaguuagcgaaggaaaagaugucuuguugcucgugcacaaucugccccagaacuuacccggcuauuuuugguacaaaggagagaugacggaccuuuaucacuauaucaucucauacauuguugaugggaagauaauuauuuaugggccugcauauucagggagggagacaguguacagcaaugccucucugcuuauucaaaaugucacccggaaagaugcuggcacauauacucugcacaucaucaaacgaggggacgaaacuagagaagaaaucaggcauuuuaccuuuacucuguacuuggaaaccccaaaaccuuauaucuccuccuccaaccuaaauccacgugaagcaauggaagcugucaggcugauuugcgauccugagacccuggacgcaucauaccugugguggaugaacggccagagccuacccgucacccaccgguugcaguuaucuaagaccaaucggacccuauaucucuucggggugaccaaauauauugcaggacccuacgaaugugaaaucaggaaccccgucagugcuucccgguccgauccugucacccuuaaccugcucccaaagcuccccauacccuauauuaccauuaauaaucuuaacccccgugagaacaaggacguccuagcauucacuugcgagcccaagucugaaaacuauaccuacauuugguggcucaacggucaaucucugcccgucucuccaggcgucaaacguccgaucgaaaauagaauccuuaucuuacccagcgucacaagaaacgaaacaggcccuuaucagugcgaaauuagggauagauaugguggcuugaggaguaacccugugauuuugaauguacuguacggacccgaucugccucguaucuauccauccuucaccuacuaccgaagcggagaaaaucuggaccucagcugcuuuacugagaguaacccuccagccgaauauuuuuggacuauaaauggaaaauuucaacaaagcggucagaagcuauuuauuccacagaucacccggaaucacaguggacuguaugcgugcagcguccacaacagcgcuacgggaaaggaaaucuccaagagcaugacgguuaaggucucugggccaugucacggugaccucacagagucucagaguuag

SEQ ID NO: 248426 - RNA, 723 nt, Artificial Sequence
  Description of Artificial Sequence: Synthetic coding sequence
augggaccccugccagcccccuccugcacacaaagaauaaccuggaaaggccugcuccugacugcaagcuuacuuaacuuuuggaauccccccacaacugccgaggucaccaucgaagcccagccucccaagguguccgaggggaaagacguacuguugcuaguccacaaccucccucagaaucugccuggcuacuucugguacaagggcgaaaugaccgaucuguaccacuacauuauuuccuauaucguugacggcaagaucauaauuuauggcccagccuacuccgggagggagacaguuuacagcaacgccucccucuuaauccaaaacgugaccagaaaggacgcaggcacauauacccuucacauuauaaaacguggcgaugagacacgcgaggagaucaggcacuucacuuuuacccuguauuacggcccagaucugccgagaaucuauccaaguuuuacauacuaucggagcggagagaaccuugaccuguccuguuucacagaaucaaacccucccgcagaguacuuuuggacgauuaauggcaaguuucagcagucuggacagaaacuuuuuaucccacagauaacaagaaaccauucuggucuguacgccugcuccguacauaauucugccacuggaaaggaaauaagcaaaucaaugacuguuaaaguguccggucccugccacggagaccuaacggagucacaaucauag

SEQ ID NO: 248427 - RNA, 1164 nt, Artificial Sequence
  Description of Artificial Sequence: Synthetic coding sequence
augggcccacuucccgcacccuccugcacccaaagaauuaccuggaagggacugcuccugacugcuagccuccugaauuuuugguacaaaggggagaugacagaucuguaucauuacaucauuagcuacauuguagauggcaaaauuauuauauauggcccggcauacagcgggagagagaccguauacagcaaugcuucauuacugauucagaauguaacacguaaggacgccggaacuuacacccuucauauaauuaagcgcggagacgaaacucgggaggagauaaggcacuucacguuuacuuuauaccucgagacaccaaagccguauaucucaucuuccaaccucaaccccagggaggcuauggaagccgugcgccuuauuugcgaucccgaaacccuagaugcgucuuacuugugguggaugaacggucaaagccuuccagugacacaccgccugcaacuuucuaagacuaaccgaacacuuuaucuuuuuggcgucacaaaguauauagcugguccuuacgaaugcgaaaucagaaauccagucagugcuucuagaagugacccugugacucuaaaccuccuuccaaagcugccgaucccauacauaaccauuaauaaccuuaacccccgagagaacaaggacguauuggccuuuacuugcgagccaaaaagcgagaacuauacuuacauuugguggcugaacggccagagucugcccgugucgcccgggguaaaacguccgauugagaacaggauacugauucugccauccguuaccaggaaugagacgggcccguaccagugugaaauuagggauagauacgguggacuccggucaaaccccguaauccugaacguguuguacggaccugaccugccaaggauauacccauccuuuacauauuauagauccggcgaaaaucuggaccugucgugcuucacagaaucuaauccacccgccgaguauuuuuggacaaucaauggcaaguuucagcaaucuggacaaaagcuuuuuaucccacaaaucacacguaaccauucugggcuguaugcuuguuccgugcacaacagcgccacagggaaggaaauuagcaaaucaaugaccgugaaggugucagggccgugccauggagaccucacagaaucacagucuuag

SEQ ID NO: 248428 - RNA, 1002 nt, Artificial Sequence
  Description of Artificial Sequence: Synthetic coding sequence
augggcccacucccagcaccauccugcacccagaggaucacauggaaaggccuccuccucacggccucacugcuaaauuucuggaacccacccaccaccgcugagguuacuauugaagcucagccucccaaagugucagaggggaaagacgugcugcuacugguccauaaucucccacagaaccuuccaggguacuucugguacaaaggcgaaaugacggaucuuuaucacuauaucaucagcuacaucgucgaugggaaaauaaucaucuauggcccugcguacagcgguagagaaacaguuuacucuaacgcuucacuucugauccagaauguuacuaggaaagaugccggcacuuauacauugcauauuaucaaacgaggcgacgagacccgggaagaaauccgccauuuuacauucacucuguacucaaagcuucccauccccuacauaacaaucaacaaccuaaaccccagggaaaacaaagacguacuggccuuuacaugugagccuaagagcgaaaacuacacauauaucugguggcucaacggccagucccugccgguguccccaggcgugaaaaggccuauugaaaauagaauucuuauccuccccuccgugacccgcaaugagacagggcccuaucaaugcgaaauuagggacagguauggcggccugagauccaacccugucauacucaacgugcuauaugggccugaccugccgagaauauauccuucguuuacauauuacagaucgggcgaaaaucuggaccugagcugcuucacagagagcaacccuccggcugaauauuucuggacuaucaaugggaaauuccagcagucugggcagaaauuauucauuccacaaauuacaagaaaucauaguggacucuacgcuuguucggugcauaacagugccaccgguaaagaaaucucuaagagcaugaccgugaaggugucaggacccugucacggagaccuuacagaaucucagagcuag

SEQ ID NO: 248429 - RNA, 1485 nt, Artificial Sequence
  Description of Artificial Sequence: Synthetic coding sequence
auggcccgagcugccccgcuccuugccgcauugaccgcacugcucgcagcagccgcagcuggaggggaugcuccccccggcaagauagcugucgugggcgcuggcauaggcggauccgcaguggcacacuuucuacaacagcauuuuggcccuagagugcagauugacguuuacgagaagggaaccgugggcgggcgccuagcuacaaucucugugaauaaacagcauuaugagucgggagcagccuccuuccacuccuuaucacugcacaugcaggauuuugucaaguuacucgggcucagacaucgcagggaaguggugggacgaucggcgauuuuuggcggggagcacuucaugcuggaagaaacggacugguaucucuuaaaucuuuucagacuuugguggcacuauggaaucaguuucuuacgauuacaaauguggguggaggaggucauggaaaaguuuaugaggauuuauaaguaccaggcccacggcuaugcguuuucagguguggaagaacuacucuacagcuuaggggaaucuacuuuugucaauaugacacagcauaguguugccgaaucucuacuccagguuggcguaacucagagauuuaucgacgauguggugagcgcuguccuaagggcuucguacggucaguccgcugccaugcccgccuuugcuggggccaugucccuggccggagcccaaggcucgcuguggaguguagagggggggaauaagcuagucugcucuggccugcugaaacucaccaaagccaauguuauccaugcgacagugacauccgucacacugcacucuacagaagggaaggcccuauaucagguggcauaugaaaacgagguuggcaauuccucugacuuuuaugacauagucgucauugcuaccccccugcaccuagacaauagcuccuccaaucuuaccuucgcaggauuucacccacccaucgacgaugugcagggcuccuuucagccuaccgucgugucacucgugcacgguuaucuuaauagcucguauuuuggcuuuccugauccuaaacucuuucccuucgccaacaucuuaacuaccgacuuucccucuuucuucuguaccuuggacaauauuugccccguaaacaucucagcuagcuuccggaggaaacagccccaggaagccgccguguggaggguucagucuccaaagccacucuuucguacacaguuaaagacucuguuucgguccuauuacucaguccaaacugccgaauggcaagcccacccguuguaugguucucguccgaccuugccaagguucgcucugcacgaucaacuguucuaucuaaacgcauuggagugggccgccucuucuguggaggucauggcgguggccgcuaaaaacguggcccuucuggcauauaaccgcugguaucaggauuuagauaagaucgaucagaaagaccuuaugcauaaaguaaaaaccgagcuguag

SEQ ID NO: 248430 - RNA, 2277 nt, Artificial Sequence
  Description of Artificial Sequence: Synthetic coding sequence
augggcggcugcaccguaaaaccccaacuucuucugcucgcacuggugcuucaccccuggaacccuugccugggcgccgacagcgaaaagccuucaagcauuccuaccgauaagcuccuggugaucaccguggcaacuaaagaaucagacggcuuccauagguucaugcagucagcuaaguauuuuaacuacacugucaaaguccuagggcagggagaagaguggcggggaggagacggaauaaacagcauuggggggggacaaaaagucaggcucaugaaggaggugauggaacacuacgccgaucaagacgaccugguggugauguuuacagaguguuuugaugugauuuuugcugguggcccagaagagguuuuaaagaaguuccagaaagcgaaucacaaaguuguguucgcagcugaugguauccuguggccagacaaacgacucgccgauaaguauccugucgugcauauaggaaagcgcuaccucaauuccggcggguucaucggcuacgcucccuacgugaacaggauagugcagcaauggaaccuccaagauaacgaugacgaccagcuauuuuauacaaaaguuuacauagacccuuugaagcgcgaggcaauaaacauaacgcuggaucacaaguguaaaaucuuccagacacucaacggagccguagaugaaguuguccugaaauuugaaaauggaaaagcuagagcuaaaaauacuuucuacgaaacacugcccguggccaucaacgguaauggcccaacuaaaauauuguugaacuauuuugggaauuaugugccuaauuccuggacacaagauaacgggugcacacucugcgaauucgacaccguggauuuguccgccguugaugugcacccuaaugugaguaucgggguuuucauugagcagccuacaccauuucuccccagauuccuugauauccugcuaacgcuggacuaucccaaagaagccuuaaagcucuuuauccauaacaaggaggucuaccaugagaaggacaucaagguguucuucgacaaggccaaacaugagauuaaaacaauuaagauugugggccccgaggagaaucugucgcaggccgaagcccgaaauaugggcauggauuuuugccgacaggacgagaaaugcgauuauuauuuuaguguggacgcagacguaguccucaccaauccacgcacccugaagauauuaaucgagcagaaucggaaaaucauugcgccccuggucacucgacauggaaagcuguggagcaauuucuggggugcacucucuccugacggcuacuacgccagguccgaagauuacguugacaucgugcaggggaaccgcgucggaguguggaacgugcccuacauggcaaaugucuaucuaaucaagggcaaaacccuccgaagugaaaugaaugaaagaaauuacuuuguuagggauaaacuggacccugacauggcccuguguagaaacgcuagggagaugacacuacaaagagaaaaagacaguccgacuccagagacguuccagaugcugagcccaccgaagggaguguucauguacaucucuaauaggcacgaguuuggacggcuccugaguacagccaauuacaacaccagucauuauaacaacgaucuguggcagauuuucgagaauccaguggacuggaaggagaaauauaucaaccgugacuacaguaagaucuuuaccgaaaacaucgucgagcaacccugcccugauguguucugguuccccauauucuccgaaaaggccugcgacgagcuaguggaagaaauggagcacuacggcaaauggagcggcgggaaacaccaugacaguaggauuaguggagguuacgagaauguuccaacugacgauauacauaugaaacaagucgaccucgaaaacguuuggcugcauuuuauucgggaguucaucgccccugucacccuuaagguuuucgcaggcuauuauacaaaaggguuugcucugcuaaacuuugucgucaaguacucaccagagagacaacgaagcuugaggccacaucacgacgcgagcacauucacuaucaacaucgcccugaauaaugucggcgaagauuuccaaggcggggggugcaaguuucuccgguacaauuguagcaucgaaucuccaagaaaaggcuggucuuuuaugcaucccggcaggcucacccaccuccacgaaggacugccagugaaaaauggaacacgguacaucgccgugucauuuauugaccccuag

SEQ ID NO: 248431 - RNA, 2214 nt, Artificial Sequence
  Description of Artificial Sequence: Synthetic coding sequence
augggaggaugcacggugaaaccacagcugcuacuguuggcauugguacuucauccauggaacccuugucugggggccgauuccgaaaagccuuccucgauccccacagauaaacugcucgugauuacuguggcgacaaaggaauccgacggcuuccaucgcuucaugcaaucagcgaaguacuuuaauuacacugugaaggugcuuggccagggggaggaauggagaggaggcgaugguaucaauagcaucgguggaggccagaagguacggcucaugaaagaggucauggaacauuacgccgaucaggacgaccuugucguuauguucacggagugcuucgaugucauuuuugcagguggcccagaagaaguguuaaagaaguuucagaaggcgaaucauaaggucguguuugcugccgacggcaucuuguggcccgauaagcgccuagccgauaaauauccaguaguacacauagggaaacgguaccugaauagugggggcuucauuggauacgcgccauaugucaacagaaucguucaacaauggaacuugcaggauaacgacgaugaccagcucuuuuauacuaaaguguacauagacccauuaaagcgugaagcaauaaauauuacacuggaccacaagugcaaaaucuuccaaacucuuaauggagcggucgaugaagugguguugaaauuugagaauggcaaagcuagagcaaagaacaccuucuacgagacuuugcccguagcuaucaauggcaauggaccaacaaagauucuucuaaacuauuucgggaacuauguucccaauucuuggacucaagauaauggauguacccuuugcgaguuugauacagucgauuuaucugcuguggacgugcauccuaacgucuccauugggguauucaucgagcagccuacaccuuuccuuccccgcuuucuggauauauuacucaccuuagacuauccaaaggaggcuuugaaacuuuucauacauaauaaagaaguguaccacgaaaaagacauaaagguguucuuugacaaagccaaacaugaaauuaagacaaucaaaauugucgguccagaggagaaccucucgcaggccgaagcucgcaauaugggaauggauuucugccgccaggacgagaagugugacuacuacuuuuccguagaugcagacgugguucucaccaaccccagaacucugaagauacucauugaacagaacagaaagaucaucgcuccgcugguuacacggcauggcaaauuguggagcaauuuuuggggcgcucuuagccccgacggauacuacgcucggucagaagauuaugucgauaucgugcagggaaaccgcguaggaguguggaacguaccuuauauggccaaugucuaucucaucaaagguaagacucugagaagcgaaaugaaugaaaggaauuauuucguuagagacaaacucgacccugacauggcucuuugccggaacgcuagagagauggggguguuuauguacauuucuaaccgccacgaguucggcaggcugcuaaguacugcaaauuacaauacuagccauuacaauaaugaucuguggcagaucuucgagaauccuguugacuggaaagaaaaguauaucaaccgugauuauucuaagauuuuuacagaaaauaucguggaacagccauguccugacguguucugguucccgaucuuuucugagaaagcaugugaugaacucguagaagagauggagcacuaugguaaguggaguggaggcaaacaucacgacagcagaaucucuggaggcuacgagaacguaccaacagacgacauccacaugaaacagguggaccucgagaacguguggcuccauuuuauccgagaauuuauugcgcccgugacucugaaaguguucgcggguuauuacaccaaaggguucgccuugcuuaacuuugugguuaaguauucuccugagcgccagaggagucucagaccccaucacgacgcuucgacauucacaaucaauauagcacucaacaauguuggagaagauuuucaaggcggcgguugcaaauuccugcgguacaacugcucgaucgagagcccucgaaaggguuggagcuuuaugcauccaggaaggcugacacaccuccacgaaggauugcccgucaagaauggcacccgcuauauugccguuagcuucauugauccauag

SEQ ID NO: 248432 - RNA, 1257 nt, Artificial Sequence
  Description of Artificial Sequence: Synthetic coding sequence
augcuggaaaaccacauccugcacaagcguauauauauacugaccuucuuuucgcagcagauuuucauucucugucaugcucacuuuauauuuuucuucaccguucgugauuucugucgccaggacgaaaaaugugauuacuauuuuagcguggacgccgaugucgucuugacaaacccucggacucugaaaauuuuaauugagcagaaccgcaaaauuaucgcaccccuuguaaccaggcacggaaaacugugguccaauuucuggggcgcccuauccccggacggguauuaugcccggagugaagauuacguugauaucgugcagggcaaccgaguuggaguauggaaugugccuuacauggcgaacguguaucucaucaaagggaaaacucugcgaagcgaaaugaaugagcgaaacuauuuugugagggacaaguuggaucccgauauggcucugugucgcaacgcccgcgagaugacauuacagagggagaaggauagcccaacaccagagacauuucagaugcugaguccgccgaagggaguguucauguacauuucaaauagacaugaauucgggaggcuccuguccacggccaauuauaauaccucccauuacaauaacgaccucuggcaaaucuuugagaaccccguugacuggaaagaaaaguacauuaaucgagauuauuccaaaaucuucacggagaacaucgucgaacagccaugcccugacgucuucugguuccccauuuuuucugagaaggccugugacgagcucguggaggagauggagcacuauggcaaguggucgggugguaagcaccaugacaguagaauuaguggagguuaugagaauguacccacagacgauauacauaugaaacaaguggaucuggaaaacguguggcuccacuuuauccgggaauucaucgcccccguuacccuaaaaguauucgcggguuacuauacaaaaggauuugcccugcuaaauuuuguggugaaauacuccccugagagacagagaagucuccggccucaucaugacgcgucaaccuucaccauuaacaucgcucuuaauaacguuggggaagacuuccagggugggggcugcaaguuccuccgauauaauugcucuaucgaaagcccucggaagggauggucguucaugcaccccggacgucugacccaucugcacgagggucugccagucaaaaacgguacccgauacaucgccguuuccuucaucgacccuuag

SEQ ID NO: 248433 - RNA, 2112 nt, Artificial Sequence
  Description of Artificial Sequence: Synthetic coding sequence
augcagucugccaaauacuuuaauuacacugucaagguccuuggacagggggaggaauggcgcggcggggacgggauuaacagcauuggaggaggccagaaagugagauuaaugaaggaggugauggagcauuaugcagaucaagaugauuugguagucauguucacagaguguuucgaugugaucuucgcaggcggaccugaagagguccuaaaaaaguuucagaaggcuaaccacaagguaguuuuugcugccgauggcauuuuauggccagauaagcgccucgccgauaaauaucccgugguucacauuggaaaacgguaucucaacuccgguggcuucaucggcuaugcuccuuacgugaacagaauuguucagcaauggaaccuacaggauaaugacgacgaccaguuguuuuacaccaaaguguacauugauccucuuaaaagagaggccaucaacaucacguuagaccacaaauguaaaauuuuucaaacuuugaauggagcaguugacgaggucguucugaaguuugaaaaugguaaagccagggcaaagaacaccuuuuaugagacacuuccagucgccauuaacgggaauggaccuaccaaaauuuuacugaauuauuucggcaacuacguccccaacucauggacgcaagacaacgguugcacgcucugugaauuugauaccguggaccucagcgcugucgaugugcacccaaacgucagcaucgguguguucauagaacaacccaccccuuucuugccaagauuccuggacauccuacugacacucgauuaccccaaagaagcauugaagcucuucauacacaacaaagagguauaccaugaaaaggauauuaagguguuuuucgauaaggcuaaacacgagaucaaaacaauuaaaaucgucggccccgaggagaaucugucacaggccgaggcacgaaauaugggcauggacuuuuguagacaggaugagaagugcgacuacuacuuuaguguggaugcagacguuguccucaccaacccaagaacccugaagaucuuaauagagcagaauaggaaaauuauugccccacuagugacaagacacggcaaacuguggaguaauuucuggggggcccucucgccugacggcuauuaugccagguccgaagacuauguugauauaguccaggguaaucgagugggcguguggaacguccccuacauggcuaauguguaucugaucaaagggaagacgcucaggagugaaaugaaugaacgaaacuacuucguucgcgacaaacuagaucccgauauggccuuauguagaaacgcccgagagaugacgcuccagagggagaaagacaguccaaccccggagacuuuccagaugcuguccccgcccaagggcguguuuauguacauuucuaacagacacgaguuuggccggcuacugucuacagcuaacuauaauacgucucacuacaacaacgacuuauggcagauuuucgagaauccgguggacuggaaagaaaaauauaucaauagggacuauaguaagauuuucacugaaaacauuguggagcagccguguccagacgucuucugguuuccaauauucagcgagaaggccugugaugaguugguggaagaaauggagcacuacgguaaauggagcggggggaaacaucacgacagccggaucagcgguggguacgaaaacgugcccacagacgacauccacaugaagcagguggaccuggaaaauguuuggcuccacuuuauuagggaguucauugcaccuguuacccugaagguguuugcaggcuacuauacaaagggauucgccuuacugaauuuugugguuaaguacucuccugagcgccagaggucuuugcggccacaccaugacgcaucuacuuuuacuaucaauauugcacuuaauaaugucggcgaggauuuucagggaggcggaugcaaguuucuucgauacaacuguucuaucgaaagccccaggaaaggaugguccuuuaugcacccagggagacugacacaucuucacgaaggguugccugugaagaauggaacaagauauaucgcugugagcuucaucgauccuuag

SEQ ID NO: 248434 - RNA, 1608 nt, Artificial Sequence
  Description of Artificial Sequence: Synthetic coding sequence
augaagcuguggguuagcgccuugcugauggcaugguucggagugcuuucuuguguccaggcagaauuuuuuacaucgauagggcauaugacugaccugauauaugcugagaaagaacucgugcagucuuugaaagaguauauucugguggaggaagcaaagcuauccaaaaucaagucgugggcuaacaagauggaagcccucacuuccaaguccgccgccgacgccgaaggauaccuggcucacccuguuaacgcauacaagcuggucaaacggcuuaauacagacuggccugcgcuggaagaccuggugcuucaggacucggccgcuggguuuaucgcgaaccucucuguccagcgacaguuuuuuccgaccgacgaggaugagauuggagccgcaaaggcacucaugcggcugcaggauacauauagacucgacccgggaacgauaagucggggugagcugccuggcacaaaguaucaagcaaugcuuagcgucgacgauugcuucggaauggguaggagcgcauauaaugaaggggacuauuaucacacaguacuguggauggaacagguccugaaacaguuagacgcaggggaggaggccacuacaacaaaaagccaggugcuggauuaucuguccuacgcuguuuuccagcucggcgaucuacaccgggcucucgaguugacaagacguuuacuuuccuuggauccaucucacgagagggcuggcggaaaccuaagauauuuugaacaguuguuggaggaggagagggagaagacccugacaaaucagacugaagccgaacuggcuacacccgaaggcauuuacgagcgcccuguggauuaccuccccgagcgugacgucuacgagagccugugucgaggugagggcgugaaauugacaccaaggagacagaagaggcuuuucugcagauaccaccacgguaaccgugccccacagcugcuuaucgcaccauuuaaggaggaagacgaaugggauucuccccacauaguucgguauuacgacgugaugucagacgaagagauugaacggaucaaggagaucgcaaagccgaaacucgcuagagccaccgugcgagaucccaaaaccgguguucucacgguugcuuccuacagggugaguaagaguuccuggcuggaggaagaugacgauccaguugucgcccgcguuaauagacggaugcagcauauuacuggucugacaguaaaaaccgcugaacugcuccaagucgcaaauuaugggguugggggccaguacgaaccucauuuugauuuuucacgcaacgacgaacgagacaccuuuaagcauuuggguaccggaaaccggguugccacuuuucugaauuacaugagcgauguagaggccgggggggcuacaguguuucccgaccugggggcggccaucuggccgaagaagggaaccgcaguuuucugguacaaccuccuccgguccggcgagggggacuaucgaacuaggcacgcugcuugcccaguguuaguuggaugcaaaugggucagcaauaaaugguuucacgaaagaggccaggaauucuugagacccugugguucaacagagguggauuag

SEQ ID NO: 248435 - RNA, 1635 nt, Artificial Sequence
  Description of Artificial Sequence: Synthetic coding sequence
augggaccuggagcccgacuggcagcccugcucgccguccuagcauugggcacaggcgauccugaacgcgcugcugcgaggggcgauacuuucucggcacucaccaguguagcucgcgcauuggcuccagagcgacgccuuuugggucugcuacguagauacuugagaggugaggaggcaaggcugcgcgaccucacacgguuuuacgauaagguccugucauugcacgaggauucgaccacccccguagcuaacccuuugcuugcuuucaccuugauuaagcgacuucagucagacuggagaaacgucguccacucacuagaagcuagugagaauaucagggcauugaaagacggcuaugaaaaagucgagcaagacuuacccgcuuucgaagaccuggagggggccgcccgugcccuaaugcgccugcaggauguguauaugcugaacgucaaaggguuggcacgaggcguguuucaaagagugaccggauccgccaucacugaccuguauucuccuaagcggcuguucagucuaacaggcgaugacugcuuucaggugggcaagguggcuuaugauaugggugauuauuaucacgcaauaccuuggcuggaagaggcagugagcuuguuccgaggaagcuauggggaguggaagaccgaagacgaggcuucacuggaggaugcucucgaccaccuggccuucgcuuauuuucgggccgggaaugugaguugcgccuuaucucuuagucgugaauuccuucuuuacucaccagauaacaaacgaauggcucggaacgugcugaaguaugaacggcuccuggcggaguccccuaaccacgucguggcagaggcugugauucagaggcccaacauuccucacuugcagacuagagauaccuaugagggguugugccagacgcucggcucacagccuacacuuuaccaaauuccaucccuuuauuguucuuacgaaacuaacagcaaugccuauuugcuccugcagccaauacggaaggaagugauccaccucgaacccuacaucgcgcuguaucaugauuuuguguccgauuccgaagcucagaaaaucagggagcuggcagaaccuuggcuccagagaagugugguagccucuggggagaagcagcuccagguggaguacagaaucucuaagagcgccuggcuaaaggauaccguggacccuaaacucgugaccuugaaccaucggauugcugcguugacuggccuagaugucagaccuccauaugccgaguaccugcaagucgugaacuauggaauagggggucauuacgaaccucauuucgaucaugccacuucgcccagcucaccacuguaccggaugaaaucugggaaccguguagcgaccuucaugauuuaccuguccucuguugaggcaggcggcgcaaccgcuuucaucuaugcuaacuugucuguuccuguuguuaggaacgccgcucucuuuugguggaaucugcauaggucuggagaaggugauucugauacccuacaugcuggauguccaguucucgucggcgacaaauggguagcaaacaaguggauacacgaauacggccaagaauuccggcgccccuguaguagcucuccugaggacuag

SEQ ID NO: 248436 - RNA, 1815 nt, Artificial Sequence
  Description of Artificial Sequence: Synthetic coding sequence
augggacccggggcacgccucgccgcccugcuggccguacuggcucucggcacgggcgacccagaacgcgcugcugcccggggcgauaccuucucagcacuuacuuccguagccagggcacuggcaccagaacggcgccuccugggccugcugcggcgauaucugaggggggaggaagcuagacuacgggaucuuacacgguuuuacgacaagguccuaagcuugcaugaggacagcaccacgcccguugcuaauccucuccucgccuucacacugauuaagaggcugcaaucugauuggagaaacguggugcauagcuuggaggcauccgaaaacaucagagcauugaaagacggguacgaaaaaguggagcaagauuuaccggcuuucgaggacuuagagggagccgcacgggcacuuaugagacuucaagacguguacaugcuuaaugugaaagggcuggcccggggaguguuccaaagagugacaggcagugccaucacugaccucuacagcccaaaacgacuguuuucuuuaaccggugaugacuguuuccaagucggaaagguggcauacgacaugggcgacuauuaucacgccauuccauggcuggaggaggccgugucccuguuccgcggaucauauggggaauggaaaacggaggacgaagcuucccucgaagaugcccuugaccacuuagcuuucgccuauuuuagagccgguaacguguccugugcucugucccugaguagagaguuucucuuauauagcccugauaauaaacgaauggcccguaauguccuaaaguacgagaggcuacuagcggagucuccaaaccaugugguggcugaggccgugauccagaggccgaacauuccgcaucugcagacucgugauacuuacgagggguugugucagacccugggcucacagccgacauuauaccagauuccauccuuauacugcucauaugaaaccaacuccaacgccuaccugcugcugcaacccauccguaaagaagugauccaccuugaaccuuacaucgcauuguaucacgauuucguauccgacuccgaagcucaaaaaauccgcgagcucgccgaacccugguugcagagaagcgugguggccucaggagaaaagcagcuccaaguugaguacagaaucucaaaauccgcauggcugaaagacaccguggaccccaagcuggucacgcuuaaucaucgaaucgccgcccucaccgggcuagaugugcgcccucccuaugccgaguaucugcagguggucaauuacggcaucggaggacacuacgaaccccacuuugaccaugccaccucaccuucaaguccacuguauagaaugaaaagcgguaauagaguagcgacauucaugaucuaccuguccagcgucgaagccgggggagcuacugcuuucaucuacgcaaaccuguccgugccaguugugcggcauuguuuuggaggcacauguacugggguugugaaggggacugucacucacuuuaugcucgcagugcugucguggugggaaauuagcggcuggccuacuucaggauauaugucaauggaccguaacagugcugacccagccgcaccggcgcucaaaacugaauuacuggcagagagaucuugguggucaccgguggcauuucagaggucccaagaaccuaaggcuggagucggagaggagaaggcggaacagccaccuggaaggcgccccugucaacugugucuuugcuuggccaaccaacgucagggacgcggguguuaucagggcacacucaggauguauauauag

SEQ ID NO: 248437 - RNA, 417 nt, Artificial Sequence
  Description of Artificial Sequence: Synthetic coding sequence
aauauaagccugugucccgaaauuugcuuucagaaaauugagucacaaguuuacuucguuagaguggauaguggaauucagccaggcucugauaucucgauuuacuacgaccccaugauaagcaaacuaauaacuuacgggucugaccgcacugaggcucuuaaaaggauggccgacgcgcucgauaauuacguaauaaggggggucacccauaauauagcacugcuuagagaagugauuauuaauucuagauucgugaagggcgauauaucuacuaaauuuuuaucagacgucuaucccgaugguuucaagggacacaugcugacaaagucugagaagaaccaauugcuugcuaucgccuccagccuguuuguugcuuuucagcucagagcucaacacuuccaggagaauucuuag

SEQ ID NO: 248438 - RNA, 363 nt, Artificial Sequence
  Description of Artificial Sequence: Synthetic coding sequence
augagcauacaguuuuuaggcacaguauacaaggugaauauucugacccgccuggccgccgaacucaacaaguuuauguuagaaaaggucaccgaagacacgaguagcgugcugcguagucccaugccugguguggugguugcuguuagcguuaaacccggugaugcugccacuuccucccugaguguagagaucugccuuuuuuggacuuuccagguggcugaaggucaggaaauuuguguaaucgaggccaugaaaaugcagaacagcaugaccgccggcaaaaccgguacaguaaaaaguguucacugucaggccggcgauaccgucggugaaggagaccugcuuguggaauuggaauag

SEQ ID NO: 248439 - RNA, 2046 nt, Artificial Sequence
  Description of Artificial Sequence: Synthetic coding sequence
auggcaggcuuuuggguggggacggcaccgcugguagcggccggccguaggggcagguggccuccucagcaguugaugcugucugcggcacuccggacccuaaagcaugucuuauacuacuccagacaaugccucauggugucacgaaaccugggcuccguuggauacgaccccaaugaaaagacguuugauaaaauauugguggcaaaccgaggggaaaucgcgugccgagugauccgaacuuguaaaaagauggggaucaagacagucgcaauccacuccgacguggacgccucaucagugcacguaaagauggcggacgaagccgugugcgugggaccugccccuacaucgaaaucuuauuuaaauauggaugcaaucauggaagcuaucaagaagacgcgcgcucaggccguucaucccggauacgguuuccucuccgagaacaaagaauuugcccgaugccuggccgccgaagauguuguauuuauuggccccgauacacaugccauacaggccaugggugauaagaucgagucgaagcugcuggccaaaaaggccgagguaaacaccauuccagguuuugauggagucguuaaagaugcugaggaagcugugcggauugcccgagagauuggguauccagugaugauaaaggccucagccggggggggggggaaagggaugaggauugcuugggacgacgaagagacuagagauggcuuccgccuguccucucaggaggccgccucuucauuuggugacgaccgccugcugaucgagaaguucauugacaacccucgccacauugagauccaggugcuaggcgauaagcacgggaacgcucuuuggcuaaaugaacgcgagugcucuauccagcgucggaaucagaaagucguggaagaggcgccaaguauauuccuggacgcagaaacuagaagggcuaugggcgagcaggcugucgcacuggcgagagccgucaaauacagcuccgcugggacugucgaauuccucguggauucaaaaaaaaacuuuuacuuccuggagaugaacacaaggcuucaggucgaacauccgguuacugagugcauuaccggacuggaucuaguucaggagaugauucgcguugcgaaggguuacccacugagacauaaacaggccgacauccgaauuaaugggugggcugucgaauguagagucuaugccgaagacccauauaagucguuuggcuuaccaucuaucggcaggcuuagucaguaccaagaaccccuacaccucccaggcgugcggguugauucgggcauccagccgggaucagauaucagcauuuacuacgacccgaugauuucgaagcuaauaaccuacggaagcgacaggacugaggcgcucaaaagaauggcagaugcgcuugacaauuaugucauccgagguguuacccacaacaucgcacugcuaagggaggucauaauuaacucuagauucgucaagggagacaucucaaccaaguuccugucggauguguauccggauggguucaaaggacauaugcugacaaaaucggaaaaaaaucaacugcuggcaauugccuccucucuguuuguggcuuuucaacuccgagcccagcacuuccaggaaaauaguagaaugcccguuaucaaaccagauaucgcuaacugggagcucuccgucaaacugcacgacaagguucacacagucguugcuaguaauaaugggucuguauucucaguugaaguagauggcucaaagcugaacgucacaagcaccuggaaucucgcaaguccacuuuuguccgucucagucgaugguacccagcguacaguccaaugcuugagcagggaagccggaggaaauaugucuauucaguuccuugguaccgugguagccgaagggcaggagaucugcguaaucgaggcuaugaagaugcagaauagcaugacagcuggaaaaacagggacuguuaagucgguacacugccaggcgggugauacaguuggagaaggcgaccuccuaguugaauuggaguag

SEQ ID NO: 248440 - RNA, 2187 nt, Artificial Sequence
  Description of Artificial Sequence: Synthetic coding sequence
auggccggauucuggguggggaccgcuccccucguggcagcagggagaagggguagguggccaccucagcaguugaugcuuagcgcagcucugagaacccuaaagcacgucuuguauuacucaagacagugucuuauggucucuaggaaucuggguucagucggguacgaucccaacgagaagacauucgacaaaauccugguugcaaaucggggcgagaucgcuuguagagucaucagaacgugcaaaaagauggggauaaagaccguggcaauucacagcgacguugacgcuuccaguguccacguaaagauggccgacgaggcgguguguguagggcccgcgccgacaucuaagaguuacuugaacauggacgcgauuauggaggccauuaagaaaaccagagcgcaggccgugcauccaggcuacggguucuugucggaaaacaaggaguucgccaggugucuagccgcugaagauguaguguucauuggacccgacacucacgccauucaggcaaugggagauaaaaucgagagcaagcuguuggcaaagaaggcggaggucaauacaauccccggguucgaugggguggugaaagaugcagaggaggcgguuaggauugcgcgggaaaucggauaucccguuaugaucaaagcaagcgccggugggggcggcaaggguaugagaauugcuugggacgacgaggaaaccagagacgguuuuagacuuagcucucaggaggcugcaagcaguuuuggcgaugacagauuguuaaucgaaaaguuuauugacaacccccggcauaucgaaauccagguguuaggagacaaacacggcaacgcgcucuggcugaacgagcgagaguguaguauccagaggaggaaccagaaaguggucgaggaggcuccuucuauauuucuggacgcggagacaagacgugcuaugggcgaacaggcaguagcgcuggcgcgggcggucaaauacuccagcgccggaaccguggaguuucugguugacucaaagaaaaauuuuuacuuccucgagaugaacacacggcuccagguggaacacccagugacggaauguauaacuggacuggaccucgugcaagaaaugauacgaguugccaaaggcuauccccuccgccacaaacaggccgauauacggauaaacggcugggcaguugaguguagaguguacgcggaagauccguacaagagcuuuggccuaccaucaaucggcagguugucucaauaucaggaacccuugcaucugccgggcgugaggguugauagcggcauacaaccaggaucagacauuagcaucuacuacgacccgaugauuucuaagcuaauuaccuacggcucggauagaaccgaagcccugaagcgaauggccgaugccuuggacaauuacguuauuaggggggucacacauaacaucgcucuccuacgcgagguaaucaucaauagccgauucgugaaaggcgauaucucuaccaaguuccugagcgacguauacccugaugguuuuaagggucauaugcucacuaagucugagaaaaaucaauuacuggccauugcguccucccucuuugucgcauuucagcugagggcccagcacuuucaggagaauuccaggaugccugugaucaagcccgauaucgccaauugggaacuauccgugaagcuacacgacaaagugcacacagugguggcuucgaacaacgggucuguuuuuaguguugaggucgacggcuccaaacuuaacgucaccuccaccuggaauuuggcuaguccccuguugagcgucucaguggaugggacucagaggacaguucagugccuguccagggaggccggcggaaauaugucuauucaauucuugggaaccguguacaagguuaacauacugacccggcuggcagccgaacugaauaaauucaugcuggaaaagguaacugaagauaccucaucaguacuuagaucccccaugccuggggugguggucgcaguuagcgugaagcccggggaugcuguagccgaggggcaggaaaucuguguuaucgaagcgaugaagaugcagaauucgaugacagccggaaaaacgggaacaguaaaauccguccauugccaggccggugacacagucggcgaaggagaccuuuuggucgaauuggaauag

SEQ ID NO: 248441 - RNA, 2109 nt, Artificial Sequence
  Description of Artificial Sequence: Synthetic coding sequence
auggccgguuucuggguuggcacugcgccucuuguugcagccggaaggagaggcagauggccuccacagcaacugaugcuauccgccgcacuucggacucugaagaccuuugauaagauucugguggcaaacagaggcgaaauugcuuguaggguaauccguacguguaaaaaaaugggaauaaagacaguggcaauucacuccgaugucgacgcaagcagcguccacguaaaaauggccgacgaggcagucugugucgggcccgccccuaccaguaaauccuaccucaauauggacgcaaucauggaagcaauuaaaaagacccgggcucaagcugugcauccaggauaugguuuccucuccgagaacaaagaguucgcgagaugucuggcagcagaagacguuguguucaucgggccggauacccacgcaauccaggcgaugggcgauaagauugaguccaagcuacuggccaagaaagcagaaguaaacacuauaccugguuuugauggagucgugaaggaugcagaagaggcgguacgcaucgcccgugaaauaggguacccugugaugauuaaggcuagcgccggcgggggcggcaaggguaugagaaucgcaugggacgaugaggagaccagagauggcuuccgcuugagcucgcaagaggcugcuucaucuuucggcgacgaccgguuacucaucgagaaguucaucgacaauccuagacacauugaaauccaggugcugggcgauaagcaugguaaugcuuuguggcucaacgagagagaguguaguauccagaggaggaaucaaaaaguugucgaagaggcuccuagcaucuuccuggacgccgaaacccggagagcaaugggcgagcaagccguagcacuggcuagggcuguaaaguacucaucugccgggacuguugaguuccugguggauagcaaaaaaaacuucuacuuuuuggagaugaacacucgcuugcaaguggaacacccagugacugaauguauaacaggccuugauuuggugcaggagaugaucagagucgcgaagggcuacccccugcgacauaagcaggccgauauucgcauuaacggcugggccguagaaugccguguguacgcugaagaucccuacaagaguuucggccuuccguccaucgggcgccuaagucaguaucaggaaccguuacaucugccaggcgugaggguugacucugguauccagcccgggucagacauuucuaucuauuaugacccaaugauuuccaaacugaucaccuauggcucagaccggaccgaggccuuaaagagaauggcugacgcucuggacaacuaugugauaagaggagucacacacaauauugcccuccuacgcgaagucaucauaaacucuagguucguaaagggcgacauuucaacaaaauuucucucagauguuuaucccgacggauuuaaaggucacaugcuuaccaaaagcgaaaaaaaccaacuauuagccauugcuucuucucuguuuguggcuuuucagcugagggcccagcauuuccaagaaaacucuagaaugccaguuaucaagccagauaucgcuaauugggaacuguccgucaaguuacaugacaagguacauaccguuguugccucaaauaaugggucugucuucucuguggaaguugauggaagcaaacuuaacguaacaaguacauggaauuuggcgucaccucugcuuagcgugagcguagauggaacucagcgcaccgugcaaugucugagucgagaagcuggcggaaauauguccauccaguucuuaggaacuguauauaaggugaacauacugacaagacucgccgcugaauuaaacaaauucaugcuggaaaagguaacugaagauacaaguagcguccugagaagcccuaugccaggcguugucguggcaguguccgugaaaccuggagaugcagucgccgagggacaagagaucugcguaauugaggcuaugaaaaugcaaaacuccaugaccgccgggaagacugggacaguuaagaguguccacugucaggcuggggacaccgugggggagggcgaccugcuugucgaacuggaauag

SEQ ID NO: 248442 - RNA, 255 nt, Artificial Sequence
  Description of Artificial Sequence: Synthetic coding sequence
uagaauugggagcugaguguuaagcugcacgauaaggugcacaccgucguagcuaguaacaacggaagcguuuucaguguugaagucgauggaucaaagcucaaugugaccuccacuuggaaucuagccucaccacucuugucuguuaguguugacgguacacaaagaacagugcagugccugucccgggaggcuggcggcaacaugucuauccaguuucucggcaccguaccauggagaaaguuauuagauuag

SEQ ID NO: 248443 - RNA, 336 nt, Artificial Sequence
  Description of Artificial Sequence: Synthetic coding sequence
uauaaaguuaauauucuuacacgacuggccgcugagcucaauaaguuuaugcuagaaaaagugacagaagauacgucaagcguccucagauccccuaugccugguguagucguugcgguuagcguaaaacccggagacgcagcaacuuccucccuaucugucgagaucugucuguuuuggacuuuucaaguagcggaaggacaggaaauuugcgugaucgaggcgaugaagaugcagaauagcaugacagcgggcaagacgggaaccgugaaaucagugcauugccaggcaggggacaccgugggcgagggagaccuacugguugaacuggaauag

SEQ ID NO: 248444 - RNA, 405 nt, Artificial Sequence
  Description of Artificial Sequence: Synthetic coding sequence
uaaaugccugugaucaagccugacauugcgaacugggagcucuccguaaagcugcaugacaaagugcauacaguuguagccucaaacaacgggucuguuuucuccgucgaaguggauggauccaaacugaacgucacuagcacuuggaaucucgccagcccguuauuaagcguuuccgucgacggcacccagcgcacagugcagugccugagcagagaagcagggggaaacauguccauacaauuccugggaacugugguagccgaaggccaagaaauuugugugaucgaagcaaugaagaugcagaacuccaugaccgcagggaagaccgggacugugaaaucagugcauugucaggccggcgauacagucggugaaggagaccugcugguggaacucgaguag

SEQ ID NO: 248445 - RNA, 309 nt, Artificial Sequence
  Description of Artificial Sequence: Synthetic coding sequence
ucagauguuuaucccgacgguuucaaaggccacaugcugaccaaaagcgaaaaaaaccaguugcuggcaaucgcaucuucacuguucguugccuuccagcuuagagcacagcauuuucaggagaauucgcggaugccaguuauaaagccagauauagcgaauugggaacugucuguuaagcugcaugacaaaguacacacugugguggcguccaacaacgguuccguuuuuucaguggagguggauggauccaaacugaacgucacuucaacauggaacuuauuugcucucauuguuugucagagauag

SEQ ID NO: 248446 - RNA, 483 nt, Artificial Sequence
  Description of Artificial Sequence: Synthetic coding sequence
auggcaacucaccauacacucuggaugggacuggcacugcucggugucuuaggcgaucuccaggccgcccccgaagcacaaguuagcguacaacccaauuuccagcaggacaaauucuuggggagaugguucuccgcugggcuagccagcaacaguaguuggcugcgugagaagaaagcugcccugagcauguguaagaguguuguggcucccgcaaccgauggcgggcuaaaucucacauccacguuucugcggaagaaccagugcgaaacccgcaccaugcuguuacaacccgccgguagccucggaaguuacuccuacagaaguccacgugaauggggguuacaccguccuccagggccgucacucggugcuacacuagcuggcacuacucuaggucagccucccgcagccgaaauccauggcgucggaggugauggaugcccuacuuccguaaggggaaaagggcaggcuugggcauag

SEQ ID NO: 248447 - RNA, 573 nt, Artificial Sequence
  Description of Artificial Sequence: Synthetic coding sequence
auggcaacucaucacacccuguggaugggccucgcacugcucggaguacugggcgaccugcaagccgcucccgaagcacaagucucagugcagccaaauuuucaacaagauaaguuucuggggcguugguucagcgccggauuggccuccaauaguagcugguuacgcgagaaaaaagcagcucugaguaugugcaagucugugguugcgccggcaacagacggcgggcuuaauuugacuucaaccuuccuccgcaagaaucagugcgagacacgaacaaugcugcugcagccugccggaagccuuggaucauacuccuacagguccccgcacuggggcucaaccuacaguguguccgugguagaaaccgauuacgaccaguaugcucuccuauauagccagggaucaaagggccccggugaagacuucaggauggcaacucuuuacagcaggacucagacccccagggccgagcucaaggaaaaauucaccgcuuucugcaaagcgcaaggguuuacugaagacacaauuguauuucugccccaaaccgauaaaugcaugacugagcaauag

SEQ ID NO: 248448 - RNA, 189 nt, Artificial Sequence
  Description of Artificial Sequence: Synthetic coding sequence
uaggguuaccacugcuugccugcccccaaucgagcccaaggcgagguagguggagacgguggcucggugcaguuuggcgguucuguuaagacuaguagcgcccugagggaggaacaagaagcacagugggagaauuggcccaagagcggaguacugacaaccgcccccggauuuuuucuuggcagauag

SEQ ID NO: 248449 - RNA, 642 nt, Artificial Sequence
  Description of Artificial Sequence: Synthetic coding sequence
uagcugaggggaggugggcaguuucuaggaaggggcgugcgcgguguggccgcgagagggauuggacggggagggggcgcgggguuagaaacaggcggaguggauggccggggcgcaccugcagggcgcaggagaugggugcgcagaguucuggcagaugcgggcggcggacgaaguccacaauuuuugggaagaugguuuagcgcuggccuggccucgaauagcagcuggcugcgggagaagaaggcggcucuguccauguguaaauccgugguggcgccagcuacagacggcggguugaaccugacuucuaccuucuugaggaaaaaucaaugcgaaacucgcacaauguugcuccaacccgcuggaagccugggcucauacaguuacagaaguccccauuggggcucuaccuacucagucucugugguggaaaccgacuacgaccaauacgccuugcuguauucgcagggcucuaagggaccuggagaagacuuuagaauggccacacucuauagccggacccagacuccgcgcgcugagcugaaggagaaauuuacggccuucugcaaagcccagggguucacugaagacaccauaguguuccugccacagacagauaagugcaugacagagcaguag

SEQ ID NO: 248450 - RNA, 588 nt, Artificial Sequence
  Description of Artificial Sequence: Synthetic coding sequence
auggcgacacaucacacccuauggaugggacuugcucuuuugggcguccucggcgaucuacaggcugcccccgaggcacaggucagcguucagcccaauuuucagcaagacaaauuucuggggaggugguucucugcgggcuuagcaucuaauucaucuuggcuccgggaaaaaaaagccgcucucuccaugugcaagagugugguggcacccgcaaccgauggcggccuaaaucugacuaguacauuucugcgcaagaaccagugcgaaacucguacuaugcugcugcagcccgcuggcuccuugggaucuuauagcuaucgaucaccucgcgagugggggcugcacagaccaccuggacccucauugggugccacacuggcuggaaccacacucgggcagccuccggcugcugaaauccacggagugggggauuggggaucgacuuauagcgucucagucguggagacugacuacgaccaguacgccuuauuauauucgcaaggaagcaaaggcccaggggaggauuuuaggauggcuacucuguacucucguacgcagacucccagagccgagcucaaagaauag

SEQ ID NO: 248451 - RNA, 573 nt, Artificial Sequence
  Description of Artificial Sequence: Synthetic coding sequence
auggccacacaucauaccuuauggaugggacucgcucuucugggcguccuuggagacuugcaggcugcgcccgaggcucaggugucuguacagccuaacuuccagcaggauaaguuccucggacggugguucucagcaggccucgccucuaacaguaguuggcuuagagaaaagaaagcagcccugucaauguguaaguccguugucgccccugcgacagaugggggccugaaccugaccucuaccuucuuacggaagaaccagugugaaaccaggaccauguuacugcagccugcaggcucgcuagguucuuacucguaucguagcccucacuggggaagcacauauagcguuucaguaguugagacugacuaugaccaguacgcacugcuauacagccaggguucuaagggaccaggcgaggacuuccgcauggccacccuguacagccggacacaaaccccaagagcugagcugaaagaaaaauucacagccuuuugcaaagcacagggcuuuaccgaagauaccaucguguuuuugccccagaccgauaaaugcaugaccgagcaguag

SEQ ID NO: 248452 - RNA, 489 nt, Artificial Sequence
  Description of Artificial Sequence: Synthetic coding sequence
augaaagguuucacagcaacccuguuccucuggacccuuauuuucccaucuuguucagguggagguggcgggaaagcauggcccacccaugugguauguagugacuccggccucgagguccuguaucagucuugcgauccccugcaggauuucggguucucagucgagaagugcagcaagcagcugaaaucuaacauaaacauucgguucggaauuauuuugcgagaggacauuaaggagcucuuuuuggauuuggcccugaugagccaagguucauccguacugaacuucucuuauccuauaugcgaggcugcucuacccaaauucucauuuugcggacgacgaaaaggcgaacagauuuauuaugcagguccuguuaacaaccccgaauucacaaucccgcaaggagaguaccaagucuuacuugaacuauacacugagaagaggaguacaguugcaugcgcaaacgcaaccauuauguguucuuag

SEQ ID NO: 248453 - RNA, 945 nt, Artificial Sequence
  Description of Artificial Sequence: Synthetic coding sequence
augggcgcccgaggcgcucugcugcuugcacuccugcuagcccgagcaggauuaaggaagccugaaucgcaggaagcggccccuuuaucaggacccugcggaaggagagucauuacgucccggauuguuggaggcgaggaugccgagcugggccgguggcccuggcagggcucccugcgcuuaugggacagucacguuuguggaguuucucuucugucacaucgaugggcauuaacggccgcucacuguuuugagaccuauagugaccugagugauccuucuggauggaugguccaguuuggacaguugacaaguaugcccuccuucuggucauugcaggcuuacuacacgagguacuuugugucaaauauauaucugagcccaagauaccugggaaacucccccuaugacauagcacuagugaaacucuccgccccagugacguacaccaaacacauacagccaaucugccugcaagcaucaacuuuugaauucgaaaaccggacugacuguuggguaaccgguuggggcuacauaaaagaggacgaagcuuuaccgagcccucacacgcugcaggaagugcagguugcuaucaucaauaacucaaugugcaaucaucucuuccuuaaauacucuuuucgaaaggacauuuucggagauauggugugugccggaaaugcucaggggggaaaggacgcaugcuuuggugauaguggugguccuuuagccugcaacaagaacggucucugguaccagaucggagucgucuccugggguguaggauguggcagaccaaaucgcccggggguguauacuaacaucagccaucacuucgaauggauucagaagcucauggcccaaucugguaugucccagccugacccgucuuggcccuuguuguucuuuccucugcugugggcucugccacuguuaggaccuguguag

SEQ ID NO: 248454 - RNA, 954 nt, Artificial Sequence
  Description of Artificial Sequence: Synthetic coding sequence
augguaguguccggagcuccuccugcccuggggggggggugccuggggaccuucaccucucuacuucugcuggcaagcaccgcuauccugaacgccgcuaggauacccguaccaccugcuugcgggaagccucagcagcucaaucgagucgucggcggcgaagauuccacagauucugaguggccuuggaucgugaguauccagaagaauggaacacaucacugcgccggaucucugcuuaccucccgguggguuauaacagccgcacauugcuucaaagacaaucuaaacaagccauauuuguucagcguccuccucggagcuuggcagcucggcaaccccggcucgcgcucccagaaagucggcgucgcaugggucgaaccacacccuguuuauucuuggaaagagggagcuugcgccgacaucgcgcucguucggcucgaacguuccauccaguuuucugagagggucuugccuauaugccugcccgacgcuucuauccaccuccccccuaauacucacugcuggaucaguggcugggggucuauucaggacgguguucccuugccacacccccagaccuugcagaaacugaaagugccaaucaucgauagcgaggugugcucucaucuuuauuggaggggagcuggccaggggccuauaaccgaagauauguuaugugcuggguaucucgaaggagagagggacgcaugcuugggcgacuccggugggccccugaugugucagguggauggcgcuuggcuacucgcgggaauuauuuccuggggugagggaugcgcugaaaggaaccggccaggcguguacauuucucugucugcccaucgcucuuggguugaaaaaauagugcaaggcgugcaacugcgaggaagagcucaaggcggcggggccuugcgagcaccgucccagggaucuggagccgcugcucgcuccuag

SEQ ID NO: 248455 - RNA, 1257 nt, Artificial Sequence
  Description of Artificial Sequence: Synthetic coding sequence
auggaagagaucggaaucuugguagaaaaggcccaggaugagauuccugcccuaagcgucagccgcccucagacaggucuguccuuccugggaccggaacccgaagaccucgaagaucucuacagcagauacaagaaacugcagcaggaacuggaauuccuugaggugcaggaagaguauaucaaagacgaacaaaagaaccugaaaaaagaauuucuacacgcgcaggaagaagugaaaaggauucaguccaucccacuggugauuggucaguuucucgaagccguugaucaaaauacugcaauaguuggauccaccaccgggaguaauuauuacguucgaauacucagcacuaucgauagggagcuccugaaaccuaacgcuucugucgcccugcauaaacauuccaaugcucugguggacgugcugcccccugaagcugauucuagcauuaugaugcuuaccucugaccaaaaaccugacguaauguacgccgauauuggcggcauggauauccagaagcaggaaguccgagaagcuguggaacuaccccucacacacuuugaacucuauaaacagaucggcauugaccccccacgcggcguguugauguacgguccacccggcugcgggaagacaaugcuggcaaaggcuguugcccaccacaccaccgccgccuucauuagaguggugggauccgaguuuguccaaaaauauuugggcgaggggccccgcaugguucgagauguuuuccgccuggcaaaagaaaacgcacccgccauuauuuucauagacgagauugaugcuaucgccaccaagcguuucgaugcucaaacgggugcagaucgggagguacaacggauucuucuggaguuacugaaucagauggacgguuuugaucagaaugucaauguaaagguuaucauggccacaaacagagcugauacacuugaucccgcauugcugcgaccuggccggcucgaucgaaaaaucgaguucccacugccagauagaaggcagaaaaggcugaucuucagcacaauuaccuccaagaugaaucugagugaggaaguggauuuggaagauuauguugcuagaccagacaaaauauccggagcugauaucaauucuaucugccaggaguccggcauguuggccgugagagaaaaucgauacauugucuuggcaaaggauuucgagaaggcuuauaagacggugaucaaaaaggaugaacaggagcacgaguucuauaaguag

SEQ ID NO: 248456 - RNA, 786 nt, Artificial Sequence
  Description of Artificial Sequence: Synthetic coding sequence
augagccgaagauaugauucccggacgaccauuuucucccccgaagggcgucucuaccagguugaauaugcaauggaggcaaucggacaugcagggacuugccugggaaucuuggcuaaugauggugugcugcuggcagcagagaggcgaaauauacauaagcuacuugacgaaguuuucuuuuccgagaagauauauaaguuaaacgaggacauggcauguucagucgcagggaucacuagugacgcaaauguucugacgaacgaguugcgacugaucgcccagagauacuugcuacaauaccaagaaccuauuccuugcgaacaacuugucaccgcacucugugacaucaaacaggcuuauacacaguucggaggaaagaggccauucggagugaguuuacuguauauuggaugggacaaacauuauggauuccaacucuaucaaagcgaccccucggguaauuacggggguuggaaggcgaccuguauuggcaacaauagcgcagccgcuguuucaaugcuuaagcaggacuacaaagaaggagaaaugacccugaagucagccuuggcucuugccauuaaggugcugaauaaaacaauggauguguccaagcuguccgcagagaaaguggagauugcaacuuuaacaagagaaaauggaaagaccgugauccggguccucaagcagaaagagguagagcagcugauuaagaagcaugaagaggaggaggccaaagcagagagagagaagaaagagaaagaacaaaaggagaaagacaaauag

SEQ ID NO: 248457 - RNA, 4551 nt, Artificial Sequence
  Description of Artificial Sequence: Synthetic coding sequence
auggacaaccaacaagauaaagcgaucguggcuucugccaauggcgagaauacccuuauuaauggagucaaggagaacgauuccgaggaccaagaugucgcgaugaaaaguuuugcugcuuuagaggccgcugcaccuauacaaccuacuccaguggcccagaaggaaacgcucauguacccgcgaggccuacugccgcuucccagcaaaaaacccugcaugcaauccccuccauccccccugggucugaucgaagccccugaacacgccgccaauucugcuaguguuaacgcuauaucucugacuucugggaucgccaagggucucaauaccuggucccuccccaaugaaugugaaaaagcaccauuugccaucauggagccugccggcauguccgcacucaacggggauugucuuaugcagccauccagaacuugucuuggcuguuucauggagucuaaagacgccguggauccugagccagggauaucccuuaaggugggugaucucaaccgagacuacgaaacuugugcagucucugauauuggaauccagugcauuaacgcaggagagaacaugaaauauggggaacagcuccuguccgaucaauugcuuggauuuccccuccacaagagccgcgcaggcgaucgccgugaaacagagaagcccgauauagaucuggaggauccagcgcagaaaucguacuacgaggcccugcucuuagacaaguguaacacugaagaagcgcuacuggcaaauagcaaccaggacuggggguacuucgaaacuuuuauaucugagagcaagaucgaacugcucgaucuguguagcaaaaacgaacuuagcguaaaucuguuuuccgaggaggauguggauaauuauauguucgaugacgacgaaagcacuuugggcuccgacguguguucacucaagauuagauaugaaagcuuccaggauaaugugagggacaagacuacccugcuuaugcaggaagaugcacaauuuaacuucuucccgucuguuuucacuacaugcccaaagagagagaguaagaguggugcacugaagcaguccagcgacuuuagucaauucaaggugccugauguuucuaucaucuggggggaagaagauaagaaucuggacaagaagaaagggaaggaagaaggucaggaggauaaaggcguggagaaaaaagauggcaaggacaacggggaaaagcccgcauuaaacaagcccuguucuggaaccgagguggaacagcugaaaaauccuaagcagggccaccucgcaaauucauuggagacaagcgggucauucagcgaugauagcucguucaucgaaauuuccuacgaugcuaugggcgagauaaaagauuguagccgcuacauggcaagagauacuaauucaggcaguucuuccucccagcagaauuauggauugagggccaagagaaagguuagguauuccgaagauuaucuguaugauguggauagcuuggagggcgaaaaaguaaaugagagaaaggaguggcugccagugggcaguaaggaagaagaugaugacgaauggugcccuaagaaacgcagaaagguuacaaggaaagagccaccugucaucauuaaguacaucauuaucaauagguucaaaggcgaaaagaacaugcuggucaaacuuggcaagguggacgcaucugaaacuacagugaaccuaagcgagaaccagcugaacaaguacgcgaagcuagccccccuaaaggguuucuggcagaagaagaaaaagcagcgaaacacgaauaccgacuccauuaagaccccauuuagucagaaacagucauuugaacccggcaguuucgaaguuuccuucuuaccucccgcucgcaaaaggaagaguaagcugggcaaucgccaucggauccagcgcauuccuucaaucgagauuagugcuaguaguaagcaaaucucacugugcaaugaucagcggcaugcaucaaaccauaaggaggacgguggccugaaaggaaccuugaagucagcaccccucggugccccuucuugugccaaugggucacaucuaaacgacaucacaggcccagauucuguuaaggugaaagcccaggauacugaguucaaaggacccgaacgaaaggugcugaauaagauuaaauucaagucugaagcucgauugaagucaaaaaaggugaaagccgcaggacaggagagcaaaccuaucguacagauguccccccuguuagagaaucagucgaguaaggcaaaccucaagaacgaagucauaccagggacauccaauagcagucgacugucugaguuccaugaagccaaggcugcgaaaucuaguaccuuucugccuacgacuugcucgagcgaaaugccauuguccagcgcaaauguaacaaccaacaucccagugaucccuggagguuaucugcagacucuacucgaugcuagcgauuugagcaauaacaccagcauaucauacuucucgcaccacucgccugagcagaacgagggaucccugacacaaaccgaaaaauccuuuguuccccugcaaccaacccaggauuguguccuuaccucuucuagcgauucugaguugcagcagagcagucauaacuuuaagauggaaagcucuaacuaucgcaauguauggccgaauaaagccaccucuggcacccaagaauucauggcagaggucagccgagagaucgcgcccacccaaucaucugaguucggagccucccaggucguaucaauggagaacaacuuaacacccacaacauauaauccaaucugccugaauuccgggggguccaacugcaauaaggucuuguacgauuccaugcaggauacgcagcugcccagcgacgauucuuaccaguuaugccacuuuaauaacggagagaucuguuucccguuucagcaggguccaguaaacauggacgacgggcggcuguucagcuucgacagcauggcuccgcuuaguguguccucaucgaauuacuguagucugucauugaagucuugugagaaagauggugaugacgauaucacggacgauuuccuugcucacuguagucccaagcuggugauccagcagagcaucgacgagauugccccucuuaaagaaagcacugaccuauuggauauauccaauuuuacuccugauaaguuucgucacuccagcuuaagcgaaauguccccccccgacacaccuucuuuaucuccccaaaucacacgcugcgagucuaugaagacacucgggacccugaaaggcuuccaggagggggugccugggccccucgauucuguggaaaaaauaaagugggacugcucuacgcugagccgccaagugcagauggaggacggcuucacucucaauaaccaucaauuccaguuccauauguucaaugacgaggauagcgugagcuugcugcagaaaaacccaugccugucuaccuucaacgacccuuccggccagaucuccaccaacaacaagguguccaagucccguaaaaaaagcucaccaucuaaaagcggagccaugaaucagagcucaucccagaaaaacacaagaaagaagagccugaagggaaacaacaagggaauugaaaagccgccagguaaaaacucucggcaggucccuaaaucuaccaagaaagggaaguacauggcggccaucaacggcgaaaaaaugcaaauuggcaucggucggggcggaucacagacaaacaccauuucaucuacgggcaaaacacucgccgaguguauccagcacgguggcccaauggcuuccaugaaaaugccgucucagaagggacuauccggggauugggcucucgggaaggaaaguagcccagguuggucagauaugucuaugggcacaaauaccaacagccugcuugaugacgaccagagggaauuccaagagccuagcuauauccuauccaauaucgcaagugggauggccgacgugcagagguucaugauggcuucuaucgagccuuugugggagcccauggagcaucauggagacccuaacauauuuuacuccccagaaaguaacagccugaaguuaaaaacccuuaaaauuuuggcaggcacaccucaagaaagcaaaaagaaaaucaauagcggaagucagggagccacuaaaaaucaccggucgauuaagggcgucagcaaaagcaacgggaaaaccgccaucggugacccuggccgugcuaauaugccggguuacaaugaagauucccgcaguacauucuucgacaagaaauacucuaauaugaguacccuuggcaacaaugggcccacucacaaaaagcuguaucgccacaagaguuccaguaaggcacuuagggacgaaaaguguaaaggaaagcauauggagagagagcaggugcauaaggacgaauccggcacugcuucuuucgaaaagcugcgugauuccgacuacaacuugcugaaagcugagacaaccuuuugggugcucccuguuuucgaggaagagacacgcauuuuccaaaaagauauuuag

SEQ ID NO: 248458 - RNA, 1494 nt, Artificial Sequence
  Description of Artificial Sequence: Synthetic coding sequence
auggaaacuaagcugccuccugccuccacuccgacaucuccuucaucuccugggcuaucaccagugccuccccccgauaaaguagacggauuuagcagaagaagucucaggcgcgccaggccuagaagaucacacagcucgagccaguucagauaccagucaaaucaacaggaguugacucccuugccacuguuaaaagacguaccagccucagaguuacacgagcugcucagucggaagcucgcucaguguggggucauguucgauuuucucgauugugucgcggaccugaaaggcaaagaggucaaacgggcagcuuugaaugagcucgucgagugcgugggaucaacaaggggcgugcucauugagccuguuuacccagacaucauacgaaugaucucugucaauauuuuccgcacguugccaccuucugaaaauccagaauucgauccugaagaggaugagccuaaccuugaacccuccuggccccaccuccagcuuguuuacgaguucuuccuccgcuuucuugaauccccugacuuucaacccucgguagccaaacgguacguagaccaaaaguucgugcucaugcuccuggaguuguuugacagcgaagacccaagagagcgagaguacuugaaaaccauccugcaccggguguauggcaaauuucugggacucagggcauauauccgaaaacaguguaaccacauauuccugagauuuauuuaugaguuugaacacuuuaauggaguagcagaacugcuggagauacuugggagcaucauaaaugguuucgcacugccuuugaagaccgagcacaaacaauuccugguucgugugcugaucccccugcacuccgugaaaucccuuagugucuuccacgcacaguuggcuuauugcgucgugcaauucuuagagaaagaugcuacacucaccgaacauguuauccgagguuuguugaaguauuggccuaaaacaugcacacagaaggaaguuauguuccugggugagauggaggagauccuggaugucaucgagccgucccaauuugucaaaauucaggagccauuauucaagcagguugcccggugcguguccaguccacacuuucaagucgccgagcgagcucuguacuuuuggaauaacgaauauauacuaucgcugauagaggacaacugucacaccgugcuuccggccguauucggcacacucuaccaagucagcaaagagcauuggaaccagacaaucgucaguuuaauuuauaaugugcuuaaaaccuuuauggagaugaacgguaaacuguuugaugagcugaccgcaagcuacaaacuugagaagcaacaagagcagcagaaggcacaggagcggcaggaacuguggcaaggccuggaggaacugagacuccggcgucuccaagguacccaaggugccaaagaggccccccuacaaagguugaccccacaaguggccgcuuccggcgggcaaagcuag

SEQ ID NO: 248459 - RNA, 1500 nt, Artificial Sequence
  Description of Artificial Sequence: Synthetic coding sequence
auggccauggccgagggcgaaaggacagagugcgccgagccucccagggaugaaccucccgcagacggagcucucaagcgcgcugaagagcugaaaacucaagcaaacgacuacuucaaggcaaaagacuacgagaacgcaaucaaguucuacagccaggcuauugaacugaaccccagcaaugcaauauacuauggaaacagaagcuuagcauaucuccgcacagaaugcuauggguacgccuugggcgacgcaacucgugcuaucgagcuggauaaaaaauauaucaaggguuacuacagacgagcugccagcaacauggcucugggaaaauuucgggcugccuuaagggacuacgagacaguggugaaagugaagccccaugauaaagaugccaagaugaaguaccaggagugcaauaaaauugugaaacagaaggccuucgagcgggcaauugcaggcgaugagcacaaaagaucugugguggacucucuagauaucgaaagcaugacaauugaggacgaguauucagggccuaaacuggaggauggcaaaguaacuaucagcuucaugaaagaguuaaugcagugguacaaagaccagaaaaagcugcacagaaaaugugcauaucaaauccugguacaggugaaggaggugcuaucuaaauugucuacucugguugaaaccacuuugaaagagaccgaaaaaauuacuguuuguggcgauacccauggacaguuuuaugaucuucuuaauauuuucgagcugaaugggcuccccagcgagacgaaucccuacauuuuuaauggugauuuuguggaccgcgguuccuucaguguggaaguuaucuugacgcucuucgguuucaagcugcuuuacccagaccauuuucaucugcuccgcggcaaucaugagaccgauaauaugaaccagaucuacgguuucgagggcgaggucaaggccaaguacaccgcccagauguaugagcuguucucugaagucuucgaguggcuaccucucgcucagugcauuaaugguaaaguccucaucaugcauggaggacuguuuuccgaggauggugugacccuagacgauauuaggaagauugaacgcaauagacaaccuccugacucaggcccgaugugugaucugcuuuggagcgacccccagccucagaauggaagaagcauuaguaagagaggcguuaguugucaauuugggccagauguaacaaaagccuucuuggaagaaaauaaccucgauuacaucaucagaucacacgagguuaaggcugaaggcuacgagguggcucacggagguagaugugugacuguguuuuccgccccaaacuacugcgaucagaugggaaacaaggcaucuuacauacaccuucagggcuccgaucuuaggccgcaauuccaucaguucaccgcuguuccccacccuaacgugaaaccaauggcauacgcuaauaccuuguugcaacugggcaugauguag

SEQ ID NO: 248460 - RNA, 696 nt, Artificial Sequence
  Description of Artificial Sequence: Synthetic coding sequence
augcggguccucggaggacgaugcggugcgcugcuugccugccuguuacuugugcugcccgugucggaagccaauuuuugccuguacuuccguaacgauuuuaucuauaaucgcgcuuguauuaguguccuggucgguuuguccggaugcaacuucuuuuauucaauauguuuucuguccaagcagcaggccucccagguucugguccggaagcgccgcgcgaacagccuccucgaagaaacuaaacaggggaaucuagaacgcgaaugcauugaggaauugugcaacaaggaggaagcgagagaaguauuugagaacgauccugagacugacuacuuuuauccaaaauaccuggugugucuuagguccuuccaaacaggacuauuuacggccgcgcgccagucaacaaaugcuuauccugaucuaaggagcuguguaaacgccaucccagaucaauguucuccucuuccaugcaaugaggauggcuauaugagcugcaaggaugguaaggccucuuuuaccugcaccuguaagccuggauggcaaggugagaaaugugaauucgacauuaacgaaugcaaggacccaaguaauauuaauggcggguguagucaaauuugcgacaacacaccgggcucuuaucacuguuccugcaagaacggauuugugaugcucagcaacaaaaaagacugcuag

SEQ ID NO: 248461 - RNA, 2031 nt, Artificial Sequence
  Description of Artificial Sequence: Synthetic coding sequence
augcgcgugcucggcggcagauguggugcguugcucgcuugccuucuccugguccucccugucucagaagcaaacuuccugucuaagcagcaggccagucaagugcuggucagaaaacgacgcgccaacucccuguuggaggaaaccaaacaaggaaaccuggaaagagaauguauugaggagcugugcaauaaggaagaggcacgcgagguuuuugagaacgaccccgaaaccgauuacuucuacccgaaguaucuggugugccuccgguccuuucagacugguuuguucaccgcggcccgccaaaguacgaacgcguacccagaucucagauccugugugaacgcuauuccugaccagugcagcccucugccuugcaacgaagacggguacaugaguugcaaggacggaaaagccucuuucacauguacauguaaaccuggguggcaaggggaaaagugugaguucgacauuaaugaaugcaaagaccccaguaauauuaauggugguuguucucagauuugugauaacacucccggcaguuaucacugcucaugcaagaauggcuuuguuaugcuaagcaacaaaaaggacuguaaagacguugaugagugcucauuaaagccaucaauuuguggaacagccguguguaaaaacauccccggagacuucgaaugcgagugcccugaaggguauagauacaauuuaaagagcaaaagcugcgaagacaucgaugaauguagcgagaacaugugcgcucaacugugugucaacuacccuggcggcuacaccuguuacugugauggaaagaaaggguuuaaacuggcccaggaucagaagagcugugaggugguaucagucugucucccccugaauuuggauacaaaguaugaacugcuguacuuggcugaacaguuugcuggcguaguucuguaucugaaguuucgccuaccagagaucucccgcuuuagcgccgaguucgacuuuaggaccuaugacuccgaaggggucauccuguaugccgaaagcauugaucauucugccuggcuccugaucgcgcugcgggguggcaagauugagguccaacuuaagaaugaacauacauccaaaauuacuacugguggcgacgucaucaacaauggcuuauggaauaugguguccguugaggagcuggaacauucgauuucaaucaaaauugcaaaagaagcuguuauggacauuaauaaaccggguccacuguuuaagccggaaaauggccuucuugagacaaaagucuacuuugccggauucccccguaaggucgaaagugagcugaucaaacccauuaacccccgccuugacgguuguauccggucuuggaaucugaugaagcaaggugcaagugggauuaaggaaaucauccaggaaaaacagaacaaacauuguuuaguaacuguggagaagggcucauauuacccuggauccgggauugcucaguuucacaucgacuauaacaaugugucgucagcugagggauggcacgucaacguuaccuuaaacauucgcccaucuacaggaaccggggugaugcuugcuuuggugagcgggaauaauacugucccuuucgccgugucucuaguggacucaaccucugaaaaaucccaggacauccuccuguccguggaaaacacuguuauuuacaggauccaagcccuaagccucuguucagaccaacaaucucaccucgaguuucgcguuaauaggaacaaccuggaguuaaguacuccacucaagaucgagacuaucucgcaugaggauuugcaaaggcagcuugcaguguuagacaaagccaugaaggcgaagguggcgacauaucuggggggccuccccgacgugcccuucucagcaacaccugugaacgcauuuuacaacggcuguauggaggucaacaucaaugggguucagcucgaucucgacgaagcuauauccaaacacaacgauauccgugcccacucguguccgucagucuggaagaagaccaaaaauucauag

SEQ ID NO: 248462 - RNA, 1269 nt, Artificial Sequence
  Description of Artificial Sequence: Synthetic coding sequence
auggcaggcugcguccccuuacuccagggcuuagugcucguucucgcguugcacagaguggagccuagcgcgacuagccucaaggagcgacacggcuugcauucagacuccgcuugcacaggagugcaggagucccuguucuuaccugccucuaaagcuaacgacguauugguaagauggaagcgagccggcaguuaccugcuggaggagcuguuugaaggcaaucuggagaaggagugcuacgaagagaucuguguguacgaagaagcuagggagguuuucgagaaugagguuguuaccgacgaguuuuggcgacgguauaaaggaggaucaccauguauuucacaacccugccuccacaaugguuccugccaagauuccauuuggggauacaccuguacaugcuccccuggcuacgaaggaucgaauugugagcucgcuaagaaugaaugccauccagaaagaaccgaugggugucagcacuuuugccugcccggacaggaaagcuauacuuguuccugcgcccagggauaccgacugggagaagaucauaaacagugcgucccucacgaccagugcgcuugugggguccugaccagcgagaagagagcgccagaucugcaggaucugccauggcagguaaaacuaacaaacucagaggguaaagacuucuguggcggggucaucauccgggagaauuucgugcuuaccaccgccaaaugcagccugcuacauagaaauauuacugucaagacguacuuuaauaggaccucccaggauccccuuaugauaaaaauaacccacguucacgugcacaugagguaugacgcagacgccggggaaaacgaccugucacucuuagagcuggaguggccaauccagugcccaggcgccggccuuccgguaugcacuccagaaaaagacuucgcagagcacuugcuaauaccacgcacgagggggcugcuuucuggcugggccagaaaugggaccgaucuggggaauucgcuaacaacccgccccgugacccuuguggagggagaagaguguggccaggugcugaacgucacgguaacgacgcggacauauugcgaaagaagcucuguggccgccaugcauuggauggacgggagcguagucacacgagagcaucguggauccugguuccuaacaggugugcugggcagucaacccguaggcgggcaagcccauauggucuugguuacuaaaguguccagguauucacugugguuuaagcagauuaugaacuag

SEQ ID NO: 248463 - RNA, 1203 nt, Artificial Sequence
  Description of Artificial Sequence: Synthetic coding sequence
auggcaggaugugucccacugcuccagggccucgugcucguuuuagcucuucacagaguggagccauccgucuuccuucccgccuccaaggcuaaugauguucuggugcgguggaaacgagcuggaucauaccuccuggaagaauuguuugaaggaaaucucgagaaggaguguuacgaagaaauauguguuuaugaggaagcucgggagguuuuugaaaacgaggucgugaccgaugaguuuuggcggagguacaaaggaggaaguccaugcaucucucaaccuugccugcacaacggcuccugccaagauucaauuugggguuacacgugcacaugcuccccuggcuaugaggguucaaauugcgaguuggcuaaaaacgaaugucauccagagcggacugaugguugccaacacuucuguuugcccggacaggaguccuacacuugcuccugcgcucagggcuaucgucuuggagaggaucacaagcagugugugccucaugaccagugcgcaugcggaguacugaccuccgagaaaagggcgccagaucuucaggaucugccuuggcagguuaaacugaccaauuccgaaggcaaggacuuuuguggcggugugauuauacgcgaaaacuuuguccugacgaccgcuaagugcucucugcugcacaggaacaucacaguuaagaccuacuucaauaggaccucacaagacccucuuaugauaaagauuacacacgugcaugugcauaugagguaugaugcagaugccggcgagaaugaccugucucugcuggaacuagaauggccuauucagugccccggugcuggucucccuguguguacaccagaaaaagacuuugcagagcaccuacugaucccucgcacgcgcgguuuacuguccggcugggccagaaacggcacggaccuaggaaauucauugaccacacgaccugugaccuuaguggaaggcgaagaaugcgggcagguuuuaaaugucaccgugacaaccaggacuuauugcgaaagaagcuccguggccgcuaugcacuggauggacggaaguguuguaacuagggaacauaggggcucuugguuucucacaggaguguuggggucccagccaguggggggucaggcccacaugguacucgucacgaaaguaagccgcuacagccucugguucaagcaaaucaugaauuag

SEQ ID NO: 248464 - RNA, 1053 nt, Artificial Sequence
  Description of Artificial Sequence: Synthetic coding sequence
auggagccuaaacgcauccgggaaggauaucuggugaaaaagggcaguguguuuaauaccuggaagccaauguggguugugcuuuuggaggaugggaucgaauuuuacaagaaaaaauccgauaauagcccaaaagguaugaucccucugaaagguagcacccuaacaagucccugccaggacuucggcaagcgaauguucguuuucaaaauuacaaccacaaaacagcaggaucauuuuuuucaggcagcuuuccuagaggaaagagaugcuuggguuagagacaucaagaaggccauaaagugcaucgaggguggccagaaguucgcacggaaaagcacacggaggucuauccggcugcccgaaacuauugaucugggcgcacuuuauuugucuaugaaggauacggaaaagggaaucaaggagcugaaccuggaaaaggauaaaaaaauuuuuaaccacuguuucaccggaaacugcguuaucgauuggcuaguuagcaaccaaucugugagaaaucgccaggagggccugaugauugcaucuucacuucugaacgaaggcuaccuacagcccgcuggggacaugaguaaauccgccguggacggaaccgccgaaaaccccuuccucgauaaccccgaugcuuuuuacuacuuuccagacucagguuuuuucugcgaggagaacagcagcgaugaugauguuaucuugaaagaagaauuuagaggaguaaucaucaaacaaggcugccugcugaaacaagggcacaggagaaaaaauuggaaagucagaaaguucauccugcgagaggaccccgcauaccugcacuauuaugacccagcuggggccgaggauccucuuggagccauccacuugcgggguugcgugguuaccuccgucgaaucuaacaguaacgggcgcaaaucugaggaagagaaucuuuucgaaaucauaacugccgaugaggugcauuauuuucugcaggcugcuaccccaaaagagcgcacagaguggauccgggcuauacagauggcuagucguaccggaaaguag

SEQ ID NO: 248465 - RNA, 1236 nt, Artificial Sequence
  Description of Artificial Sequence: Synthetic coding sequence
augaaggccgcuagauuugucuuacgcagugcagggucguugaacggagcagggcuggugccuagggagguggagcacuuuagcagauauuccccgucuccgcugagcaugaagcagcuuuuagacuucgguagcgagaaugcaugcgagcggacaucuuuugcguucuuaaggcaggaacugcccgugaggcucgccaauaucuuaaaggaaaucgacauauugccaacucagcuggucaacaccuccagugugcagcugguaaaguccugguacauccagagcuugauggaccuugucgaguuccacgaaaagaguccugacgaucagaaagcgcuguccgauuucguagauacccuuauaaaaguccgaaacaggcaucacaacgucguacccacuauggcucagggaauuaucgaguacaaggaugccugcacugucgaucccguuaccaaucaaaaccuccaguacuuccucgaucguuuuuauaugaaccgaauuuccacacggauguugaugaaucagcauauccucauuuuuagcgauucucagaccgguaaccccagucauauaggaucaaucgauccaaacugcgauguuguggcuguaguccaagacgcguuugaauguucucguaugcugugugaccaauacuaucugucaagucccgagcugaaacugacccaaguuaacgggaaguuuccugaccagccaauccauaucguguauguaccgagccaccuucaccauaugcuauuugagcuguucaagaaugccaugcgcgccaccguggaacaccaggagaaccaaccuagucucacacccauagagguaauugugguuuugggcaaagaagaucuaacuaucaaaauuagcgauaggggcgggggcgugccacugcggauuauugaucgcuuguucucuuacacauacagcacugcuccuacucccgucauggacaauucgagaaaugcaccuuuggcgggcuucggauaugggcuccccauuucuaggcuguaugcaaaauauuuucagggagaucucaacuuauacucacucagcggcuacgguaccgaugccauaaucuaucucaaggcauugaguagugaguccaucgaaaaguugcccguuuuuaauaaaagcgccuucaaacauuaccaaaugagcucagaggcagacgauugguguauuccaaguagagagccuaagaaucuugcaaaggaaguugcuauguag

SEQ ID NO: 248466 - RNA, 1968 nt, Artificial Sequence
  Description of Artificial Sequence: Synthetic coding sequence
augacagaguguuuccuccccccaaccagcucccccuccgagcaucggaggguggaacacgggagcggacugaccaggacaccuagcagcgaggaaauuuccccuaccaaguuuccaggucuguacaggacaggagagccaagcccaccgcacgauaucuuacacgaaccacccgacgucguauccgacgaugagaaggaucacggaaaaaagaagggaaaguuuaagaagaaggaaaaacggacugaaggauaugccgcguuucaagaagauucgucuggggacgaggcugagagucccucaaagaugaaacggaguaagggaauucauguuuuuaagaaaccaucauuuucuaagaagaaggagaaagauuuuaagauaaaggagaagccaaaagaggagaagcauaaagaagaaaaacacaaggaggagaaacacaaagagaaaaaaagcaaagaucucaccgccgcggauguuguuaagcaauggaaggagaaaaaaaaaaaaaagaaaccuauucaggaacccgagguuccccagaucgaugugcccaaccuaaaaccgaucuucggaaucccgcuggcugacgccguggagagaacuaugauguacgauggcauucgacugccugccgucuucagagaaugcaucgauuauguggagaaguacggcaugaaaugugagggcaucuauaggguuucagguauuaagagcaaaguggaugagcugaaagcagccuacgaccgugaagaguccaccaaucucgaggacuaugagccaaacacaguagcaaguuugcugaaacaauacuuaagggaccuucccgagaaccugcucacuaaggaacuuaugccaagauuugaagaggccuguggacgaaccacugagacugaaaagguccaagaguuccaacgguugcucaaagaguugccagaguguaacuaucuacuuaucucauggcugauugugcacauggaccacgugauagcuaaggaauuggaaacaaagaugaauauccagaacaucuccaucguccucucacccacaguccagaucuccaaccguguucuauaugucuucuucacucacguucaggagcuguucgggaaugugguucucaaacaggucaugaagccgcugagauggagcaauauggcaaccaugcccacccucccugaaacccaagcaggcauaaaggaagaaauccgccggcaggaauuuuuguuaaauugcuugcaucgagaccuucagggaggaaucaaggaccugucuaaggaggagcggcuaugggaggugcaaaggauccugacagcccugaaacgaaaacugcgcgaagcgaagagacaagagugcgagaccaaaauagcccaggagauugccucacugaguaaagaggacguguccaaggaggagaugaaugaaaaugaagaagugaucaauauccuuuuagcucaagaaaaugaaauccuuacugaacaagaggagcuguuggccauggaacaguuucugcgccgccagaucgcuagcgagaaggaggaaauugagcgacugagagcggaaauugcagaaauccagagcagacaacaacacgggagaagcgaaaccgaggaguauuccagcgaauccgaaucugaauccgaagacgaagaggaacugcagauaauccuggaagaccuccagcggcagaacgaggaacuggagaucaagaauaaccaucucaaccaggcaauccacgaagagcgcgaggcuaucaucgaauuacgcguccaguuacgauugcugcaaaugcagagggcuaaggccgagcagcaggcacaggaggaugaggaacccgaauggcgcggcggcgcaguucagcccccucgggacggggugcucgaacccaaggccgccaaagagcaaccuaaggccggaaaggagcccgcgaaaccuucuccuucucgggaccguaaagagaccagcauauag

SEQ ID NO: 248467 - RNA, 1500 nt, Artificial Sequence
  Description of Artificial Sequence: Synthetic coding sequence
auggccgaccuggccaaugaagaaaagcccgcaaucgcgccaccugucuuuguguuucagaaggacaaagggcaaaagcgaagugcuggggggagcucaccugagggaggcgaagauucugaucgggaggacggcaacuauuguccgccuguaaagcgagagcgaacgaguaguuuaacccaguuuccucccagccaauccgaagaacgcucuucuggauuuagauuaaaacccccuacuuugauccauggucaggcuccuagcgccggucuacccucgcaaaaaccaaaagagcaacagcgcagugucuugcguccagccgucuugcaagcgccucagccuaaggcacugagccagaccgugccuagcucugggacuaauggcgugucacuaccagccgacugcacaggcgccgugcccgccgcuucgccugauacugccgcuuggcggaguccuuccgaggcagccgacgaggucugugcgcuugaagagaaggaaccucaaaagaacgagucuucgaacgccagugaggaggaagcuugugaaaaaaaagauccagcgacucagcaggcauuuguguucgggcaaaaucugagagacagaguuaagcuuauuaaugaauccguagacgaggcagacauggaaaaugccggacauccauccgccgauacaccaacagccaccaauuauuuccuacaguauaucuccucaucacuggagaacucaaccaacagcgcagaugcuucaaguaacaaauuuguuuuuggccagaauaugucugagaggguacuaagcccuccuaagcugaaugaggugagcucugacgcaaaucgggagaaugcugcggcagaaucuggaucagaauccagcucacaagaagcgacgccugagaaggaaucucuggcugaaagcgcagcugcguauaccaaggcuaccgcacguaagugucuacuagagaaggucgaagugauuaccggcgaggaagcggaaagcaauguccuucagaugcaguguaagcuguuuguguuugacaagacaagccagaguuggguugaacggggaaggggucuccugagacucaacgacauggccuccacugacgauggcaccuugcagagucgauuggucaugcgcacccaaggaagucugcgcuugauucugaacacuaaacugugggcacaaaugcagaucgacaaagcaucagagaaauccauuagaauuacagccauggacacagaggaccagggugugaaaguguucuuaauuuccgccuccucuaaagauaccggacaguuauacgcugccuuacaccacaggauccucgcccugaggucgagaguugagcaggagcaagaagcuaagaugccagcccccgaaccaggggcagcucccucgaacgaggaggacgauucugaugacgacgauguguuagcccccucaggcgccaccgcagccggcgcgggugaugaaggagauggccagacaacaggcucgacguag

SEQ ID NO: 248468 - RNA, 2190 nt, Artificial Sequence
  Description of Artificial Sequence: Synthetic coding sequence
auguccggccagccuccucccccuccgccccagcagcagcagcagcaacagcaauugagcccaccuccucccgcagcccucgccccaguaucgggcguuguccugccugccccccccgcugucucagcaggguccucucccgcaggaucuccugggggcggcgcgggcggugagggccuuggugccgcugccgcugcgcuucugcuucaccccccuccgccaccuccgcccgcaaccgcagcccccccuccgccccccccgccgccaccaccucccgcaagugcagcagcacccgcaagugggccacccgcuccccccggccucgcugcuggucccggacccgccggcggcgcucccacccccgcccuggucgcugguuccuccgccgccgcuccuuucccucacggagacagugcacugaacgagcaagagaaagagcuucagcggagacucaagagacucuacccggccgucgacgagcaggagaccccucuaccgcgguccugguccccaaaggacaaguucagcuacaucgggcugagucagaacaaccuaagagugcauuacaagggccauggcaaaacucccaaagaugccgcaucagugcgugcuacucaucccaucccggcugcuugcgggaucuauuauuuugaaguuaagauugucaguaagggccgagacggauacaugggcaucggacuauccgcucaaggaguaaacaugaacaggcugccuggcugggauaagcacuccuacggcuaccauggagacgacgggcacagcuuuuguagcagugguacuggucagccauauggcccaacuuucaccacaggcgacgucaucggguguugugugaauuuaauaaauaauacauguuuuuauacaaagaacgggcauagcuugggcauugcauucacagaccugcccccgaaccucuauccaacugucggccuccagacaccaggggagguuguagacgccaacuucggacaacauccauucguguucgauauugaagacuacaugcgggaauggagaacuaaaauccaagcccagauagacagauuuccuaucggggaucgggagggagaguggcagaccaugauucagaagauggugucaucguaccuggugcaccauggcuacugugccaccgccgaggcuuuugcuagguccaccgaucagaccguacuagaggaacuugcuucaauaaaaaauagacaaaggauccagaaauuggugcucgccgguaggaugggagaggccaucgagaccacucaacagcuauacccaagccuccuggagaggaauccaaaucugcuuuucacucugaaagugagacaauucauagaaauggugaauggaacugauagugaggucagaugccuaggcgggcgcagcccaaaaagucaggacuccuaucccgucucuccucggccauucuccaguccuagcaugucaccaagucacggcaugaacauccacaaucuggccaguggcaagggcuccacagcucauuucagcggguuugagagcugcucaaacggaguuaucucaaacaaagcccaccaguccuacugccauucuaacaaacaccagaguagcaacuuaaauguacccgagcugaauaguauuaacaugucccggucccaacaggugaauaauuucaccuccaaugacguugacauggagacagaccauuacagcaauggcguaggagagaccucaaguaauggguuccucaacgguuccagcaagcaugaucacgagauggaggacugcgacaccgaaauggagguugauucgucacagcugcgacggcaacuaugcggugggucccaagccgccauugagagaaugauccauuucggcagggaacuacaagcgauguccgagcagcugcgaagagacugcggaaaaaauaccgccaacaagaagaugcucaaagacgccuuuaguuuacucgcauacuccgaccccuggaacuccccuguggggaaccagcuggaucccauucagcgggagccugugugcucggcucuuaauucugcuauccuggaaacccacaaccucccaaaacagcccccccuggcgcuggccaugggacaagccacacagugccucggccucauggcuagauccggaauaggcucgugcgcuuuugcaacaguugaggacuaccuacacuag

SEQ ID NO: 248469 - RNA, 5298 nt, Artificial Sequence
  Description of Artificial Sequence: Synthetic coding sequence
augcgcaggucaaaagccgacgucgaaagguauguagcuuccguauugggccugaccccaagcccccgucagaagagcaugaagggauuuuacuuugcgaagcuguauuaugaagcuaaggaauacgaucucgcaaaaaaguauauaugcacguauaucaacgugcaggagcgggaccccaaggcacaccgguuucucggccugcuuuaugaacucgaggagaacacugagaaagccguggaguguuaccgccggucaguggaacuuaacccgacacagaaagaucucgugcugaaaaucgccgaguugcuaugcaaaaacgacgugacugauggccgugccaaguacuggguagagagagcagcaaaacucuucccagggucgcccgcaauuuauaaacuuaaagaacagcugcuggauugugagggcgaggauggguggaauaaacuguucgaccugauucagagugaacuguacguuagaccugacgacguccacgugaacauaagacucguggaauuauauaggaguaccaagaggcuuaaagacgcggucgcccauugucaugaggccgagcgcaacaucgcucucagaucgagucuggaauggaauucuugugucgugcagacuuugaaggaguaucuggagagucugcagugccuugaauccgacaaauccgacuggcaggcuacuaacaccgaccuguuguuggccuacgcaaaucucauguuacugacucugagcaccagggacguccaggagaaccgggagcucuuagaaagcuuugacagugcacuccaguccgccaaaagcagcuugggcggaaaugacgagcugagugcaacuuuucuggagaugaagggccauuucuauauguaugcggggucucuguugcugaaaaugggacaacacggcaacaauguccaguggagggcccugucggaguuagccgcccuauguuaucuuauugcauuucaggucccgcggcccaaaauaaagcuuagagagggaaaggcuggccagaaucuguuggagaugauggccugcgaccggcugucccaaucaggacacauguugcugucgcuuagcagagggaagcaagacuuccugaaggaggucguggagacuuucgcaaacaagaucggacaaucugcauuguacgaugcacuguuuucaucacaguccccuaaggacacaagcuuucugggcagugacgauaucgguaaaauugacguccaggagccggaacuggaagaucuugcuagauaugacguaggcgcuauccgcgcacauaauggcucucugcagcaucucacuuggcugggccuccaguggaauucucugccagcgcugccuggcauccggaaauggcugaaacaauuguuccauagacugccacacgagacuagucggcucgagacgaaugcgccagaaaguaucugcauuuuggaccuggaaguuuuccugcugggcguaguguauacuucccaccuacaacuuaaggagaaaugcaacucacaucacagcagcuaccagccacugugccuccccuuucccgugugcaaacagcuguguaccgagcgacaaaagaguuggugggacgcagucugcacgcucauacaccgcaaagccguacccgggaaucuggcaaagcugcgacugcucguccagcacgagaucaauacccugcgggcccaggagaagcauggauugcaaccugcuuugcugguucauugggcuaaauaucugcagaagacugguuccgguuuaaauagcuucuauggccaguuggaauauauuggcagguccguacacuauuggaagaaaguucugccucuccucaagauuauaaagaagaacagcauaccagaaccuauagacccccuuuuuaagcacuuucauucaguugacauucaagcaucagaaauuguggaauacgaggaagaugcucacaucacauucgccaugcuggacgcagucaauggaaacaucgaggacgcuguuacggcuuucgaguccaucaagagcguugucucuuacuggaaucuggcgcuuaucuuccacaggaaagccgaggauaucgagaacgaugccuuguccccagaggaacaggaggagugcagaaacuacuuaaccaagacccgggacuacuugaucaaaaucauugaugacggggacucuaauuuaucugucgugaagaagcucccugugccccuggaguccgugaaacagaugcuuaacuccgucaugcaagaacuggaggauuauuccgaggggggaccacuauacaaaaaugguucucugcguaacgccgauagugagauuaagcacucgaccccuagcccgaccaaauacucccuuagccccuccaaaucuuacaaauauagccccgagacaccuccacguuggacugaggauaggaacucccuguugaacaugaucugccagcagguugaagcuauuaaaaaggagaugcaagaacucaaacuaaauucuagcaagucagcuucucggcaucgcuggccaacugagaacuauggaccugacagcgugccugacggguaucaaggaagccaaaccuuccacggcgccccccugacaguggcgacaaccgggcccuccguuuacuauagccaauccccagcuuauaauucgcaguacuugcuccggcccgccgccaaugucacucccacuaagggguccucgaacacagaguuuaaguccaccaaggaaggguucagcauuccugucuccgcagauggauuuaaguuugggauuucugaaccugguaaccaggaaaagaagagagagaagccgcuggagaaugauacaggauuccaggcgcaggauaucucagggcguaaaaaggggcguggcgucauauucgggcagacauccaguacauuuacauucgcugauguggcaaaguccacgucuggagaaggauuucaguuugggaagaaggauuuaaacuucaagggcuucagcggcgccggcgaaaagcuguucagcucuagguaugggaagauggccaauaaagcgaacaccucuggggauuucgaaaaagacgacgaugccuauaaaacagaggacagcgaugauauccauuuugagcccguagugcagaugccugagaaagucgaguugguaacuggcgaggagggcgaaaaaguucuguacagccaaggugugaagcuguuccguuucgaugccgaggugagacaguggaaggagaggggucugggaaaccucaaaauccugaaaaaugaagucaacgguaaacugcguaugcuuaugagacgugagcagguguugaaagugugugcgaaucacuggauuacaaccacuaugaaucucaagccacuuaguggaagugacagggccuggauguggagugccucugacuuuuccgauggggaugcuaaacuggagagguuggccgccaaguuuaaaacuccagagcuggcugaagaauucaagcagaaauucgaggaaugucagcgccuucuguuagacaucccccugcagacuccgcacaaacuuguggauaccggaagagcggcuaaacuaauccagagggcagaggagaugaaauccggacugaaggacuuuaagacauuccugaccaacgaucagaccaagguuacugaggaggagaacaaggguagcgggacaggggcugccggcgccucugacacuacuauuaaacccaacgcagagaauacgggcccuacccuugagugggauaacuacgaccucagagaagaugccuuagacgauucagugucaaguagcucagugcaugcauccccccuugccaguucacccgugagaaaaaauuuauuucgguucgaugaaucuaccacaggaucaaacuuuaguuucaagucugcacugagccuuucgaagaguccugcaaaguugaaccagucgggcacuuccguaggcaccgacgaggaaucuguggugacccaagaggaagagagagauggccaguauuuugaaccaguggugccucuuccagaucuaguggaggugucaucuggcgaggaaaacgagcagguaguuuucucacaccgggcugaaauuuauagauacgauaaggacgucgggcaauggaaggaacgaggcauuggggauauuaagauccuccagaauuaugauaacaaacaggugcgaaucgucaugcggcgugaucaagucuuaaagcugugcgcuaaucaccguaucacaccugacaugucccuacagaacaugaaaggaaccgagagagugugggucuggaccgcgugugacuuugcagauggggaacggaagguggagcauuuggcaguuagauucaagcuccaggaugucgcugauucuuucaaaaaaauuuuugacgaagcuaaaacagcccaggaaaaggauucccugaucacaccccauguaaguaggucaaguacccccagagagaguccuugcggcaaaauagccguggccauucuggaagaaacaacucgcgagagaacugacgugauccagggggaugauguggccgacgcggcuucagaggucgaagucucgucgaccucggaaacuaccacaaaggcagugguuucaccuccgaaguucguuuucguaagcgaaucugugaaaagaauauucagcuccgagaagucuaaaccuuucguguucggcaauuccagugcuacaggauccuuauuuggcuuuucauuuaacgcaccacugaaauccaauaacagcgagacuucgucugucgcgcaauccggaucugaaagcaagguggagccuaaaaagugcgaguuaagcaagaacucagauaucgagcagagcuccgauaguaaaguaaaaaaccugucagcgagcuucccgacugaggagucaucuauuaauuacaccuuuaaaacaccagaaaaggaaccuccacuuuggcacgccgaguucacuaaggaagaguuagugcagaaacugcgcucuaccacaaaaagcgcugaucacuugaacggccuguugagggaaaucgaagccaccaacgcuguauugauggagcagauuaaacuucugaaauccgaaauucgccgcuuggagcggaaccaggaaagagaaaagucugccgccaaucuggaauaccuuaaaaacguucuguuacaguucaucuucuugaaacccgggagugaaagagagcgccuccuuccagugaucaauacaaugcugcagcuuuccccggaggagaaaggaaagcuugccgccguggcucaagaugaagaagagaacgcuucccggucaagcggcuag

SEQ ID NO: 248470 - RNA, 447 nt, Artificial Sequence
  Description of Artificial Sequence: Synthetic coding sequence
auggcgagggcccucugcaggcugccucgcagaggucuguggcuuuuacucgcucaccauuuguucaugaccacagccugccaggaagcuaacuacggcgcccuccugcgagaacucugucugacccaguuccaggucgacauggaggcaguaggcgagacccuguggugcgacuggggccggacuauacgcucauaucgagaacucgcagacuguacauggcacauggcggaaaaacuaggauguuucuggccgaaugccgagguagauagauucuucuuagcuguccacgggcgauauuuccgaagcugcccgaucucuggucgugcagugagggaucccccgggaucuauucuuuacccauucaucguagucccaaucacuguuacacuuuuggucaccgcccugguggucuggcagucgaaacgaaccgaaggcaucguguag

SEQ ID NO: 248471 - RNA, 381 nt, Artificial Sequence
  Description of Artificial Sequence: Synthetic coding sequence
augaccacugccugccaggaagcgaacuacggagcacuccucagagaguuaugcuuaacacaguuucaaguggacauggaggccguaggcgaaacucucuggugugauuggggaagaacuauucguaguuaucgggagcuggcugauugcacuuggcacauggcagaaaagcuuggauguuucuggccuaacgccgaaguggauagguuuuuccucgcuguccauggaagauauuuucgcaguugucccaucucaggaagagcaguucgugaccccccagggaguauccuguauccauucaucguggucccaaucacagucacucugcucguuacagcuuuaguuguguggcagagcaaacgcacugaaggcauuguuuag

SEQ ID NO: 248472 - RNA, 381 nt, Artificial Sequence
  Description of Artificial Sequence: Synthetic coding sequence
augaccaccgcuugucaagaggcuaacuauggugcauugcuccgggaacugugccugacacaauuucaagucgacauggaggccguuggcgagacauuauggugugauuggggacgcacuauucgcagcuauagagaacuggcagauuguacuuggcauauggccgaaaaauugggcuguuucuggcccaacgcugaaguugaucgcuucuuccucgccgugcauggacgguauuuucggagcuguccuaucucagggcgagcggugagagaucccccuggcucaauccuguauccauucaucgucguuccaaucacagugacgcuguuagucacugcccucgucguuuggcagucaaaaagaacggagggcaucgucuag

SEQ ID NO: 248473 - RNA, 381 nt, Artificial Sequence
  Description of Artificial Sequence: Synthetic coding sequence
augacaacagccugccaggaagccaauuacggcgcuuuguugagagagcuaugucuaacccaguuucaaguggauauggaggcuguaggggagacucuguggugcgacuggggccgcacuauccgaucauaucgugagcuugcagauugcacauggcacauggcugagaaacucgguuguuuuuggcccaacgcagaaguagauagguuuuuccuugcagugcacggaagauacuuuaggucuuguccuaucucuggcagagccguccgagaucccccuggcaguauacuauacccguucaucguugugcccauaaccguaacuuuguuaguuaccgcccuuguuguuuggcaguccaaacgcacggaaggcauugucuag

SEQ ID NO: 248474 - RNA, 606 nt, Artificial Sequence
  Description of Artificial Sequence: Synthetic coding sequence
augguaagcuggauuaucaguagacuugucgugcuuaucuucggaacuuuguaccccgcauauuacucauacaaagcagugaaaagcaaggacauuaaagaauaugugaaguggaugauguacuggaucaucuuugcacuuuuuaccacagccgaaacguuuacggacaucuuccuguguugguucccuuuuuauuaugagcuuaagauugcguuuguagccuggcuccucucuccguacaccaagggcuccagccuuuuauauagaaaauucguucauccuacccugagcucuaaggagaaggaaauugacgacugccucgugcaggccaaggaucggagcuaugacgcccuaguucacuucgguaagcgagggcucaauguggcugccaccgccgccgugauggccgcgucgaagggacaaggugcacucucagaacggcucagaaguuuuucgaugcaggaccucaccacgauccgaggcgacggugccccagcuccaagcggaccuccaccuccaggaagugguagagcgaguggcaagcauggccagcccaaaauguccaggucagcuucagaaagugccucgucaagcggcacggcuuag

SEQ ID NO: 248475 - RNA, 1293 nt, Artificial Sequence
  Description of Artificial Sequence: Synthetic coding sequence
augaagccuaguuuacugugccgcccccugucaugcuuucucaugcuccucccuuggccuuuggcaacucugacaucuacaacccuuuggcaaugcccaccuggcgaggagccggaccuugacccaggccagggcacccuaugccggccuugcccgcccggaacauucuccgccgcuuggggcuccagcccgugucaaccucacgcccgcuguucucucuggcgccggcuggaggcccaagucggcauggcuacacgugacaccuuauguggcgacugcuggcccgguugguuugggccaugggguguuccgagagucccaugucagccaugcaguugggcaccccugggaacacaugguugcgaugaauggggaaggcgcgcuaggaggggcguggagguggcugcuggcgcuucauccgggggggaaacucgucagcccggcaauggcacccgcgcaggagggccagaggagacagcugcccaguaugccguaaucgcgauugucccaguuuuuugccugaugggacuccuggggauucuugugugcaauuugcucaagcggaagggcuaccauuguacugcccacaaagaggucgggccuggcccuggggguggcggcagcggcaucaaccccgcuuauagaaccgaggacgcaaaugaagauaccaucggcgugcuaguccgccucaucacagaaaagaaagaaaacgccgcagcucuggaagaauuguugaaggaguaucauucuaaacagcucguucagacaagccacagacccguauccaaguugcccccugcaccccccaacguuccacacauuugcccucaucgacaucaucugcauacagugcaagggcuggcaucacugagcggcccauguuguaguagguguucccaaaaaaaguggccagaaguccugcuaagccccgaagcaguggcugcuaccaccccagugccaucauugcugccgaaccccacccgcguuccuaaagcaggugccaaggcagggcggcagggggagaucacgauucuguccgugggccgauuccgaguggcgaggauuccugagcagagaacuaguagcauggugagcgaaguuaaaacgaucaccgaggcuggcccauccuggggcgaucuccccgacuccccucaaccaggacugccacccgaacaacaagccuuacugggcuccggggggucccgaacaaaguggcugaaaccuccugccgaaaauaaggcagaagagaaccgauacguuguuaggcuuucagagaguaauuuagugaucuag

SEQ ID NO: 248476 - RNA, 1065 nt, Artificial Sequence
  Description of Artificial Sequence: Synthetic coding sequence
auggagguagaagcuguuugugguggagcaggugaaguagaggcucaggauucugacccugcuccugcauucagcaaagcaccggguuccgcgggacauuacgagcugccguggguggaaaaguaucgcccggugaagcugaacgagauuguggggaacgaggacacagugagccgccuggaggucuuugcuagagaagguaacguccccaacaucaucauugcaggaccgccugggaccggaaagacaacaucgauucugugucuggcaagggcacuacugggaccggcucugaaggaugcuaugcuggagcugaacgcgaguaaugaucgcggcaucgauguggucagaaacaaaaucaagauguuugcacagcagaaggucacucugccuaaagguagacacaagaucaucaucuuagacgaagcagacucaaugaccgacggggcacaacaagcucuccgccgaaccauggaaaucuacaguaaaacaacuagguuugcgcucgcauguaaugcuuccgacaaaauaaucgagccaauucagucaaggugugccguuuugcgcuauacaaaguugacugacgcccaaauucugacaagacucaugaacgugauagaaaaagaacgcgugccauauacagaugauggccucgaagccauuauuuuuacugcacagggagauaugaggcaagcucugaauaauuugcaaucuaccuucaguggauucggauuuauaaacuccgagaauguguuuaaggucugugacgaaccucacccacugcuggucaaagagaugauucaacacugcguaaacgccaauaucgaugaagcauacaaaauucuugcucaucuauggcaucugggauacucaccugaggacaucauaggaaauauauuucgggucuguaaaacauuucagauggccgaguauuuaaaacuggaauucaucaaggaaaucggauauacgcacaugaagaucgccgagggaguaaacucccuguugcagauggcagggcugcuggcucgucugugccagaagacaauggccccgguggcguccuag

SEQ ID NO: 248477 - RNA, 996 nt, Artificial Sequence
  Description of Artificial Sequence: Synthetic coding sequence
auggcccggggcggacgcggccgcagauugggccuugcauuggggcugcugcuggcgcuugugcucgccccgagagugcugagagcaaaaccuacagugaggaaggaaagaguggugaggccugauucugagcuuggcgaacggccaccugaagacaaucaaaguuuccaguaugaucacgaagcguuucugggcaaagaagauagcaaaacguucgaccagcuuacccccgaugaguccaaagaacgacuggguaagaucguggauagaauugauaacgauggugacgguuucgucacuacugaggagcucaagacauggauaaagcgcguacagaaaagauacauauuugacaacgucgcgaagguguggaaggacuacgaccgggacaaagacgauaaaauuuccugggaagaauacaaacaagccacauauggcuacuaucuugggaacccugcggaguuccacgacucuagcgaccaccauacauuuaaaaaaaugcuaccuagagacgagaggcgcuucaaggccgcugaccugaacggugaucugacagccacccgcgaggaguuuaccgccuuccugcaccccgaagaguucgaacauaugaaggagaucgucguucucgaaacacucgaagacaucgacaagaacggagaugguuuuguggaucaggaugaauauaucgcagauauguucucucacgaagaaaacggaccugagccggauuggguucugagcgaaagggaacaguuuaaugaguuccgggaucuuaauaaagaugguaaacuggacaaggacgaaauucgacacuggauuuugccacaggacuaugaucacgcacaggcagaggcccgacacuuaguguaugaguccgauaaaaauaaggaugaaaaacugacuaaagaggagauuuuggaaaauuggaacauguuuguuggcagucaagcgacaaauuauggagaagauuuaaccaagaaucaugaugaauuguag

SEQ ID NO: 248478 - RNA, 1422 nt, Artificial Sequence
  Description of Artificial Sequence: Synthetic coding sequence
augaagagggccucugccggagguagccgccuucuagcauggguguuguggcuacaagccuggcagguagcugcgccaugcccgggcgccugcguguguuauaaugaaccaaaggugacgacuagcugcccucagcagggccuacaggcgguaccgguugggauucccgcagcgagucaaaggauuuuucuccauggcaaccgaaucagucauguccccgccgcuuccuucagagccugucggaaccucacuauccuguggcuacauuccaacguacuggccagaaucgaugcggcagcuuuuacaggacucgcucuguuagaacaacuggaucuguccgauaacgcucagcugcgguccgucgaucccgcaaccuuucacggcuuaggccgcuuacauacacuucaucuggauagaugcggacuucaggagcugggaccaggacuguuuagaggacuggcggccuuacaauaccuguaccuccaggacaacgcacugcaggcuuugcccgaugauacuuuccgagaucuaggcaaucugacucaucuguucuuacacggaaaccgaaucuccagcguacccgaacgcgcguuuaggggacuccacucacuggaccggcuauuacuucaccagaacaggguugcucacguucacccccaugccuuucgggaccuggggcggcugaugacacuauaccuguucgcuaauaaccuaagugcacuucccacagaagcacuggccccacuucgcgccuuacaauaucugagacuaaaugacaacccuugggucugcgauugccgggccaggccgcucugggcguggcugcagaaauuccggggauccagcucugaagucccaugcagccugccucagagacuggcuggucgagaccuaaaacgacuggcagccaaugaucuccagggaugcgcaguugcaacugggcccuaucaccccaucuggaccgggagagccacggaugaagagccgcuuggauugccuaaguguugccagccugaugcugccgacaaggcuaguguucuggagcccggcagaccggcguccgccggaaacgcacugaaaggaagggugccacccggcgauucucccccaggcaauggcagcgggccgcgccacauaaacgauucuccuuucggcacgcuuccagguucagcagagccaccacuaacugccguccguccugaggggucagaaccuccuggauucccaacuuccgggccccgccgccguccugggugcagcaggaagaaccggaccagaucccacugcaggcucgggcaagcagguagcgggggugggggaacaggcgauagcgaagguaguggagcccugccaucccuuacuugcucgcuaaccccuuugggucuggcccucgugcucuggaccguucugggacccuguuag

SEQ ID NO: 248479 - RNA, 2949 nt, Artificial Sequence
  Description of Artificial Sequence: Synthetic coding sequence
auguuaccaucgucgucuuggggaaagcgaaaacuccgaggacggcucgggugggugagaucagaugcaagaggagugaugugggcaaggcaagagggucugcaucauccacauccccacgcagugauucggugcccauccucuuccucaucuagcguguccugcagcggagauuccgaggaagaggacaugggccuucuggaagucucaguaagcgacauaaaacccccugccccugagcuuggcccuaugccugaaggauuaaguccucaacaggugguucgcaggcacauuuuggguagcaucgugcaguccgaaggcucauacguagagagcuuaaaaagaauacugcaggacuacagaaacccgcugauggagauggaaccuaaagcacucagcgcccgcaaaugccaggugguguuuuucagagugaaggaaauauugcacugucacuccauguuucagaucgcacuauccagccgggucgccgaaugggacagcacugaaaaaaucggggauuuguuugucgccucggauaugcuuaagaauaccccacgcgggcacccagaccgccugagcuuacaacuggcccuuaccgaacucgagacccuggccgagaagcucaacgaacaaaaacgccuagccgaucaggucgccgaaauccaacagcugacuaaaucuguuagcgaucgcucuucacuuaauaaacuauuaacuucugggcagcggcaacugcuccuuugcgagacauugaccgagaccguguacggugaccgcggccagcugauuaaaucaaaggaaagaaggguuuuucuccugaaugauauguuggugugugcuaacaucaacuuuaaaggacagcucgaaaucucuucccuggugccauuggggccaaaguacgucguuaaguggaacacagcccugccccaagugcagguggucgaagugggacaggauggcggcacauacgauaaggacaacguccugauccagcauuccggcgcaaaaaaagcuucugccucuggccaagcucagaauaagguguaucucggaccaccccgucuguuucaggaguugcaggaucuccagaaggaucuugccgucgucgaacagauuacccugcugauuaguacauugcauggcacuuaccagaaucuaaacaugacuguggcucaagacuggugccuugccuugcagagacugaugagggucaaggaggaagaaauucacuccgccaacaaguguagguuaaggcuccuccuaccgggcaagccugauaagagcggccggcccaucucauucaugguaguguuuaucacacccaacccucucuccaagaucucuuggguaaacagauugcaucucgcuaagauuggcuugcgagaagagaaccagccggggugguugugucccgaugaggauaagaaguccaaagcccccuucuggugcccuaucuuggccuguugcauaccagccuucucuucucgcgcauugagcuugcagcucggggcgcucguacacuccccagugaacugcccucugcucggcuuuagugcagucaguacuagcuuaccgcagggcuaccugugggugggagggggccaagagggggcaggcggacagguggaaaucuuuagucugaauagaccuucaccccgcaccgucaaaaguuuuccgcuagcugccccuguccucugcauggaguauaucccggaacuggaggaagaggccgagagcagagacgagucaccuacaguugcagacccuuccgccacugugcauccaacuaucugccuggguuugcaggauggaucuauccuacuguauuccagugucgacacaggaacacaaugccuugucagcugcagguccccaggcuuacaaccagugcugugccugcgccauucuccguuucauuuguuagccggccugcaggaugguacccuagcagccuacccucgaacaaguggcggagugcuaugggaccuagaaaguccucccguuuguuugaccgugggcccuggaccuguuaggacucuuuugucauuggaggaugcggugugggcuagcugcggcccaugggugacaguguuagaggcaacuacccugcaaccccagcaguccuuugaagcccaccaagaugaggcagucagcgugacccauauggugaaagcaggcaguggugucuggauggccuuuuccagcgggaccaguauccgccuguuccacaccgagacacuugaacaucugcaggaaaucaacauagccacucgcacgacauuucugcugcccggccagaagcaccugugugugacaucacuucucaucugccaaggauugcuaugggucggaaccgaccagggugugauaguucuacugcccgugccucgucuugagggcaucccaaagaucacggggaaagguauggugagcuugaaugggcauuguggucccguggccuucuuagccguggcuaccagcauccucgcgccugacauuuuacgcuccgaccaagaggaggccgaaggaccccgagcugaggaagauaagccagacggacaggcgcacgagccgaugccugauucacacguaggaagagaacugacaagaaaaaaagggauccugcuccaguaccgacuuaggucgacugcgcaucugccaggaccgcucuugucuaugcgcgagcccgccccugcugauggugcugcccuggaacacucggaggaagacgguucuaucuaugaaauggcugaugauccugauauauggguacgaagccguccaugcgcacgcgaugcacaucgcaaagaaauuugcuccguagcaaucauuucugggggucaggguuaucgcaauuucggcuccgcacugggaaguucagggcgccaggcgccauguggugagacugauucaacccuguugauuuggcagguaccccugaugcucuag

SEQ ID NO: 248480 - RNA, 4794 nt, Artificial Sequence
  Description of Artificial Sequence: Synthetic coding sequence
auggaggcagaggaggcucagaggggugcuucaccaccaauuagcgccaucgaagaguuuucgaucauccccgaggcuccuaugagauccucccaggugucagcacuuggcuuagaagcccaggaagaugaagacccaucuuacaaguggagagaggagcacagacuguccgccacacaacagagcgaacucagagaugugugugauuaugcaauugagaccaugccgagcuuccccaaggaagggagugcagaugucgagcccaaucaggagucauugguggcagaggcaugcgacaccccagagcauugggaagccgugccccagagccucgccggacgucaggcuaggacucucgcccccccagagcugugggcuuguccgauccagucagagcaucucgauauggccccuuucagcuccgaucucggcucagaagaggaagaagucgaguucuggccaggacuaacaucuuugaccuuaggaaguggacaggcggaggaggaggaagagacaagcucugacaacaguggccagaccagguauuacagucccugugaggaacacccugcugaaaccaaccagaacgagggcuccgaguccggaacuauacgccagggggaggaacuccccccugaagaguuacaggagucacagggccuucugcauccacaagaagugcagguccuggaagaacaggggcagcaggaggccgguuuuagaggggaaggcacuuugcgcgaggaugugugugcggauggucugcugggagaagagcagaugauugagcaagugaaugaugaaaagggagaacagaaacagaaacaggagcagguccaggacguuaugcuuggccgacagggggagcgcauggggcugaccggagaaccggagggacucaacgauggugaaugggagcaggaggauauggagagaaaggcccagggccagggcggacccgaacaaggagaagaaaggaagagagagcuccaggugccugaggagaaucgggcggauucacaagaugagaagucccagaccuuccugggcaagagcgaggaggugaccggcaaacaggaagaccaugggaucaaggaaaaggggguucccguguccggacaggaggccaaagaaccagaguccugggacggcggccgacuaggagccguaggacgcgcuagauccagagaagaggagaaugagcaccacggccccagcaugcccgcucuuauugcaccugaggauucaccacacugcgaccuguucccuggcgcuaguuauuuaaugacacagauaccugggacacagacugaaucccgggcagaagagcuuucucccgccgcccugaguccaucccuggaacccauucgcuguucccaccagccaaucucucugcucgguuccuuucugaccgaggaaucuccagauaaagagaucgaccaaaauucccaacaggaggagucacggcuucguaaagggaccgugagcucccaggggaccgagguuguauucgccagugcgaguguuacaccaccuagaacaccugauagugccccccccucaccggcggaggccuauccaaucacgccggcuucgguguccgcuaggccacccgucgcuuuuccucggagggagaccuccugcgcagcacgcgcuccagagaccgcuagcgccccauuaagcauggacgauccuucuccgugugggacgucggaaauguguccugcagcucuauacggauuccccagcacuggaacaagcccuccuaggccucccgccaacuccacaggaacagugcagcaccuucgcucggauagcuuucccggaucccaucgcacagagcagacaccagaccugguuggaauguugcucucauacucacacucagagcugccacaacgcccaccaaagccugccauauauagcagugugaccccuaggagagaucguaggagcgguagggacuacuccacuguguccgcuagucccaccgccuuguccacuuuaaagcaagauucccaggaaaguauaaguaaccuggaacggccuagcaguccaccuaguauacaacccugggugaguccucacaaucccgcuuuugccacagagagcccagcuuaugggucaucucccaguuucgugucgauggaagauguacggauccaugaaccuuuacccccaccucccccccagaggcgcgauacccacccuagcguuguugagacugacggccacgcuagagucguggugcccacacuuaagcagcacagucacccaccaccauuagcucuggguaguggccuccacgccccacauaaagggccccuuccacaagccagcgaucccgccgucgcccgccagcaccgaccccuacccuccaccccugauuccagucaccaugcacaagcgacuccacgguggagauacaauaaaccccucccaccuacaccagaccugccacaaccgcaucugccuccaaucucugcccccgggaguucacggaucuauaggccacuucccccccugccaauaauugaucccccaaccgagccgccuccucuuccaccgaaaagcaggggaagauccagauccaccagaggagggcacaugaacuccgguggccaugccaaaacacggccggcgugccaggacuggaccgugccacugccugccagcgcugggcgcacguccuggccacccgcgacugcccggucuaccgaaucauucaccagcacaucaaggucuaaguccgaaguaagcccaggaauggcguucucuaacaugacuaauuuucucugcccauccaguccuacuacacccuggacaccugaauugcagggcccuacuuccaaggacgaagcugggguguccgaacaccccgaggcacccgcccgcgaaccguugcgcagaacaacaccccagcaaggagcauccgggcccgggcgcagcccagugggccaggcucgccagccugaaaagccuucgcacuugcaccuggagaaggccuccucuuggccccaucgccgagacucaggccgcccuccaggagacagcagcggccaggcgguggcucccucagaaggcgccaauaaacauaagggcuggucgaggcaaggacuuaggcggcccagcauacuaccugaaggcagcuccgacucuagagguccggccgucgagaaacacccagggccaagcgauacugugguauuccgggagaaaaaaccaaaagagguaauggguggguucagcagacgcuguuccaagcuuaucaacucaagccagcuccucuaucaggaguauucggaugucgugcucaacaaagagauucaaucucagcagcggcuugagucccuaucugaaacgccaggcccaucuagcccccgacagccacgcaaagcacucguuucauccgaauccuaucuccagagauuauccauggccucuagcggcucacuguggcaggagaucccuguggugagaaauucgacugucuuacugucuaugacacaugaggaccagaagcugcaggaaguuaaauuugagcucauugugagugaggccuccuaucugcgcagccugaacauagccguggaucacuuucaacucagcacgagucuaagagcaacucugucaaaucaagagcaccaguggcuguucuccaggcuccaggaugugcgggacguguccgcuacuuuccucagugaucuugaagaaaacuucgagaacaauauauuuaguuuccagguuugcgacgucgugcucaaccaugccccugauuuccgacgugucuaccucccuuacgucaccaaucagacauaccaggaaaggaccuuccaaagucuuaugaauagcaacuccaacuuucgggagguucucgaaaaacucgaaucagacccugugugccagagguugucacuuaagucuuuucucauauuaccuuuccagagaauaacccguuugaaacuucuacugcagaauauccuuaagcggacucaaccugggaguucagaagaggccgaggcuacaaaagcccaucacgcacuggagcagcuuauuagagauugcaauaauaacguucaaaguaugagaagaacagaagaauugauuuaccugagucagaagauugaguucgagugcaagauuuucccccucauaagccagucucggugguugguuaagucaggcgaacuuacugcccuggaguuuucagcuucuccuggucugcggagaaaauugaacacccguccagugcaccugcaucucuuuaacgauugcuugcugcugaguaggccgagggaagggaguagauuucucgucuucgaccaugcuccuuucucuucgauucgcggcgaaaaaugcgaaaugaaacuucacggaccacacaagaaucucuuccgacuguuucugagacagaauacucaaggugcgcaggcggaguuccuuuuuaggacugagacucagagugaaaagcuccgguggauuucugcuuuagcuaugccaagggaagagcuagaucuacuggaguguuauaauagcccacaggugcagugcuuacgggcuuacaaaccacgagagaaugaugaguuggcgcuagagaaagcugacguggugaugguuacacagcagucuuccgacgguuggcucgagggcgucagguugagcgauggagagcgcggaugguuucccgugcagcagguggaguuuaucagcaaccccgaggugcgugcucagaaccucaaggaggcacaucgugucaaaaccgcaaagcuccagcucgucgagcagcaggccuag

SEQ ID NO: 248481 - RNA, 573 nt, Artificial Sequence
  Description of Artificial Sequence: Synthetic coding sequence
ugaccacagggugucgauauucggcacaacaaggaucggaaaguaagaagaaaggaaccaaaaucccaggacauuuauuugcgucuccuggucaagcuguacagauuccuggcccgcagaacaaauaguacuuuuaaucaaguagugcuuaagagauuauucauguccagaacaaaccgucccccacugucgcuguccagaaugauacguaagaugaaguugccaggaagggagaauaagacugcggucguugucgguacgaucacagaugauguccguguccaggaagucccaaagcucaagguuugugcauugagagucaccagccgggcccgcagcagaauccuacgggcugggggcaaaauccuaaccuucgaccagcucgcacucgacuccccuaaaggcuguggaacagucuugcuguccggcccccgcaaaggaagggaggucuacagacacuucggaaaggcuccugggaccccacauucccacacuaaaccauacgugcggucuaaaggacggaaguuugagagggcgagaggacgccgagcuucccgcggauacaagaacuag

SEQ ID NO: 248482 - RNA, 360 nt, Artificial Sequence
  Description of Artificial Sequence: Synthetic coding sequence
auggccuucaaagacacugguaaaacuccuguggaaccagaagucgccauucauagaauucggauaacacuuacaucaaggaacgugaaaucucuagaaaagguaugugcugacuuaauacgcggggcuaaagaaaaaaacuugaaggucaaaggcccaguucguaugccuacuaaaacacuucgaauuacuacccguaaaacccccugcggggagggaaguaagacaugggaucguuuucagaugaggauucacaagagacuaauugaucuucacucgcccagcgagauugugaagcaaaucacaucuauauccaucgagccaggggucgagguggaaguuacaauugccgacgcauag

SEQ ID NO: 248483 - RNA, 1998 nt, Artificial Sequence
  Description of Artificial Sequence: Synthetic coding sequence
augaccucagcgaacaaggcuaucgagcugcaacuucaggucaaacagaaugccgaggaacuucaagauuuuaugcgcgaccuggagaacugggagaaggacauuaaacagaaagauauggagcugcgcaggcagaacgguguucccgaagagaacuugcccccuaucagaaacgguaauuuuagaaagaaaaaaaagggcaaggccaaagaauccagcaaaaagacuagagaagaaaacaccaaaaaucgaauuaaaucauacgauuaugaggcaugggcaaagcuggauguugaccgcauacucgacgaguuagauaaggacgacagcacucaugaaagucuaucucaagaguccgagucugaagaagauggcauccacguggauucccaaaaagcguuaguucugaaggagaaaggcaauaaauacuucaagcaggguaaauacgacgaggccauugauugcuauaccaaaggcauggaugcugaccccuauaauccuguccugccaacuaauagagccucagcuuauuuccgucuuaagaaguucgccgucgcugaguccgauugcaaccucgccgucgcacugaaucguagcuauacaaaggcauacucccgacgaggcgcugcccgguuugcccugcagaagcucgaggaggcaaaaaaagauuaugaaagggugcuggaguuggagccaaacaacuucgaagccacaaacgaacuucgcaaaauuucccaggcccucgccagcaaagaaaacucguacccaaaagaagcggauaucgucauaaaaucuaccgaaggagaacguaagcaaauagaggcgcagcagaauaagcagcaggcuaucucagaaaaagaccgcggcaauggcuuuuuuaaggagggaaaguacgaacgagcuaucgagugcuauacuaggggaaucgcagcugacggagccaaugcccugcugccggcaaauagagccauggccuacuuaaagauacagaaauacgaagaagcugagaaagacugcacgcaagcuauccugcucgaugggagcuacaguaaggccuucgcucgacgaggcacagcacgaaccuucuugggcaaguugaacgaagcuaaacaagacuucgagaccguccuguuguuagaaccuggaaacaagcaggccgugacugagcugucuaaaauuaagaaagagcuuaucgaaaagggccauugggacgauguguucuuagacuccacccagcgccaaaacguggucaagccaaucgacaaucccccucauccuggcagcaccaagccccugaagaaggugauuauagaggaaacaggaaaucucauacagacgauugaugucccggacaguacaacugcugccgcuccagaaaacaaucccauuaacuuggcaaaugugaucgccgcuacgggaacaacguccaaaaagaacuccagucaggaugauuuauuuccaacgucagacacgcccagagccaaagugcuuaagauugaggaggucucggacacuaguucacugcagccccaggcgagccucaagcaggacgucugucagucauauuccgagaaaaugcccaucgagaucgagcagaaaccagcccaguucgcuacuacaguccugcccccuauuccagccaauucuuuucaacucgagucugauuuuaggcagcuaaagucaagccccgacauguuguaucaguaccugaagcagaucgagccgucccuguauccuaaacuguuucagaaaaaucuagauccggacguguuuaaccagauugucaagauucugcacgacuuuuacauagagaaagaaaaaccacuguuaauuuucgagauccugcagcgucuauccgagcucaagcgcuucgacauggcagucauguuuaugucugagacugagaagaagauugcacgcgcccuuuucaaccacauugauaagagcggacuuaaagacagcucuguggaggaacucaagaagagguauggugguuag

SEQ ID NO: 248484 - RNA, 636 nt, Artificial Sequence
  Description of Artificial Sequence: Synthetic coding sequence
augauuucacgaauggaaaagaugaccaugaugaugaaaauccugauuauguuugcacucgggaugaacuacuggagcuguagcggauuccccguguaugacuacgaccccucuagcuugagggaugcacucucugcuagcguggugaaagugaauucccagucgcucuccccuuaccucuuccgggcauuucgcagcucacugaaaaggguggagguccuagacgaaaauaaccuagucaugaaucuugaauuuagcauucgcgaaaccacaugucgcaaagacucuggcgaagaucccgccaccugcgccuuccagcgcgauuacuacgugagcaccgcuguguguaggaguacugugaaaguuucagcucaacaggugcagggggugcacgccagguguagcuggucuaguucaacauccgaauccuauucaucugaggagaugauuuucggggacaugcucggaucccauaaauggcgcaauaacuaucuguucggcuuaauuucugacgagucaaucucugagcaguuuuacgaucguagcuuaggaauaaugagacgaguccugccgccuggcaaccgcagguacccuaaucaccggcacagggcccgcaucaauacagauuucgaauag

SEQ ID NO: 248485 - RNA, 1323 nt, Artificial Sequence
  Description of Artificial Sequence: Synthetic coding sequence
augcgcccccacuuauccccuccuuugcaacagcuucugcugcccgugcuucuggccugugcggcccauuccacuggugcauuaccaagacugugcgacguguugcagguucuaugggaagaacaagaucagugccuacaggagcucucccgcgagcagaccggggaccucggcacugaacagccugucccagguugugaggguaugugggauaauauuaguuguuggccuuccagugugcccggccggauggucgaaguggaaugcccaagauuuuugcguaugcugaccagccgcaacggcucccuguuuagaaauuguacacaggacggauggagcgaaaccuucccucggcccaaccuagcgugcggagucaaugugaaugacuccuccaacgagaagagacacucauaccugcugaaguuaaagguaauguacacagucggauauuccagcagccuggugaugcuccugguugcccugggcauccucugugcuuuccgacggcuccauugcacccgcaauuauauucauaugcauuuguuuguaaguuuuauucugcgagcccucagcaacuuuaucaaggacgccguguuauuuaguuccgaugacgugaccuacugugacgcccauagagcuggauguaaacuugugaugguucuauuccaguacugcaucauggcuaauuauagcugguuauuaguggaaggccuuuacuugcauacacuuuuagcuauuuccuucuuuagcgagcgaaaguaccuccagggauucguugccuuugguugggggucuccagccaucuuuguggcucucugggccaucgcaagacacuuucucgaagaugucgguuguugggacauaaaugccaaugcaagcaucugguggauuauacguggcccuguaauucucuccauacugauuaacuuuauucuguuuauaaacauccugagaauucugaugcgcaaacuaagaacccaggaaacccgaggcaaugaagucagucauuacaaacggcucgcacggucuacauuacuccuuauuccacuuuucgguauucacuacauuguguuugcguuuuccccagaagacgccauggagauucagcuuuuuuucgaacucgcccuggguucuuuccagggccucgugguggcagugcuauacuguuuuuuaaauggugaggugcagcuggaaguacaaaagaaauggcagcaguggcaccuccgggaguuuccccugcaccccguggcuuccuucuccaacagcaccaaggccagccauuuggagcagucucaagguaccugccgaaccagcauuaucuag

SEQ ID NO: 248486 - RNA, 363 nt, Artificial Sequence
  Description of Artificial Sequence: Synthetic coding sequence
augaaacuuuuaaugguccugaugcucgccgcccucagucagcacugcuaugccggcuccggauguccccuccucgaaaacguaauuaguaaaaccaucaauccccagguuuccaaaaccgaguauaaggaacuguugcaagaauucauugaugauaaugcaacaacaaacgcgaucgacgagcucaaggaaugcuuucucaaucagaccgacgaaacccuaucaaacgucgagguguuuauggucaucucauuuucaucauacaagcuuuuuaagucucccgaucaaggucagguggguagcagcuuuuugacagauaaugcgaaggcaacuucggaacaggcauuuagcuauaucggcuag

SEQ ID NO: 248487 - RNA, 1092 nt, Artificial Sequence
  Description of Artificial Sequence: Synthetic coding sequence
auggccaugcgccagacaccucucacaugcucuggacauacacgcccagucguggaccuugcguucuccgggauaacgccguacggauauuuucugauuucggcuuguaagggcgcuggacagcaucucccacgccuuuccgggcagcacgacgggaaaccaaugcucaggcagggcgacaccggcgacuggauuggcaccuuucuaggacauaagggagcaguauggggcgccacacuuaauaaagaugccaccaaagcggcuacugcugccgccgauuuuaccgcaaaaguaugggaugccgugucuggugacgaacucaugacgcucgcucauaagcacauugugaaaacaguugauuucacgcaggacuccaacuaccuucuaacaggaggacaggacaagcugcuaagaaucuacgauuugaauaaaccggaggccgagccuaaagaaauaucaggccauacuagugguauaaaaaaagcccucuggugcucugaggacaaacaaauucucuccgccgaugacaaaacaguccgucuuugggaccacgccacgaugacagaagucaaaucgcucaacuuuaacaugucggucucuuccauggaguacauuccagagggcgagauucucguaauaaccuacggccgcuccauugcauuccacuccgccgugucgcuugacccaauuaagucauuugaggcccccgccacuaucaauuccgcuucccuccacccagagaaggaguuccucguggcuggaggagaggacuuuaagcuguacaaauaugauuauaacagcggagaagaauuggagucuuacaagggucauuuugggccaauucauugcguaagauucucaccugauggagagcuguaugcuagcggaagcgaggacgguacccugagacuguggcaaacggugguugggaagaccuacggcuuguggaagugcguccugcccgaagaagauucaggcgaacuggcaaaaccaaagaucggcuucccagagaccacagaggaggaauuggaggagauugcuagugaaaacucugauuguaucuuuccaagugcaccagauguuaaggcuuag

SEQ ID NO: 248488 - RNA, 1335 nt, Artificial Sequence
  Description of Artificial Sequence: Synthetic coding sequence
augaaggucgugcccucccugcuucucucuguucuucuggcacaaguguggcuagucccaggccuggcgccuucuccucagaguccugaaacaccggcuccacagaaccaaacaagccgcguugugcaggcuccuaaagaggaagaggaggaugaacaggaggccagugaggaaaaggccuccgaagaggagaaagcauggcucauggccucgaggcaacagcuagcaaaggaaacuucuaacuucgguuucagucuucuccgcaaaauuucuaugcgucacgacgguaauaugguguucucuccauucgguaugucccuagccaugacggggcugaugcucggcgccaccggccccacagaaacccagaucaaaaggggccuacaucuccaggcccucaaaccaacaaagcccggccuccugccaucucucuuuaaaggccugagggagacacuaagucgaaaccuugagcuuggacucacucagggcucguuugcauuuauucacaaagacuuugaugucaaagaaacguuuuuuaaccugucaaagagauauuucgauacugaaugcguucccaugaacuucaggaacgccagucaagcuaagcgccuaaugaaccacuauaucaauaaggaaacccguggcaagaucccuaaacuauuugaugagaucaacccugaaaccaaacuuauacuuguggacuauauccuguucaaagggaaauggcucacccccuucgaccccguguucacugaggucgauaccuuccacuuagacaaauauaaaaccauaaaagugccgaugauguacggugccggcaaguuugcuucaacguucgauaaaaacuuuagaugucaugugcugaaauuaccauaccaagguaacgcaacaaugcucguggugcugauggaaaagaugggcgaucaucuggcccucgaggacuaucuuaccaccgacuuaguugagaccuggcugcgcaauaugaagacccgcaauauggaagucuuuuuucccaaauucaagcuagaccagaaguaugagaugcacgaauuacucaggcagaugggcauucgucggauuuucucucccuuugcagaccugucggagcugagcgcaacaggaagaaacuugcaggucaguagggugcuucaacgcacaguaaucgaaguagaugaaagggguacagaagccguggcuggcauccucagugaaaucacugcuuacuccaugccacccguaaucaagguagaccgcccauuucacuuuaugauauaugaggagaccucaggcaugcuacucuuucucgggcgggucguaaauccaacucugcuauag

SEQ ID NO: 248489 - RNA, 1335 nt, Artificial Sequence
  Description of Artificial Sequence: Synthetic coding sequence
augaaggugguucccucacugcuucugagcguacuauuagcccaaguguggcugguucccggacuugcuccuucaccccagagucccgagacacccgcuccacagaaccaaaccucgcgcguugugcaagcacccaaagaagaagaggaagaugaacaggaagcuucagaggagaaggcaucagaagaagagaaagccuggcuaauggccucgcggcagcagcuugccaaagaaacauccaauuucggcuucagccugcuuagaaagauaagcaugcgccaugaugggaauaugguguucaguccauuugggaugucucuugcuaugacuggucucauguuaggugcuacugggccaaccgaaacacagauaaaacggggccugcaccugcaagcccucaaaccuacaaagccggggcuacugccuucucuguucaagggucuucgcgaaacguuaagcagaaacuuagagcucggccucacgcagggauccuucgcuuucauucacaaagauuuugacgugaaggaaacuuuuuuuaaccugucgaagcgcuauuucgauaccgagugcgugccuaugaauuucaggaacgccagccaggcuaaaaggcucaugaaucacuacauuaauaaagagacgagaggcaagaucccaaaacuguuugaugaaauuaauccagaaacaaaacugauucucguagacuacauccucuuuaaggggaaguggcucaccccauucgaccccguauucacugagguugacacauuccaucuagacaaguauaaaacaaucaagguuccuaugauguauggcgcagggaaguucgccucaacauuugacaaaaacuuuagaugccacgugcugaaacugccauaccaggggaacgcuacuaugcucguugugcuuauggaaaaaaugggcgaucaccuugcucuugaagauuaucuaacuacagaccuugucgagaccugguuacgaaauaugaagacuagaaacauggagguuuucuuuccuaaguucaaacuagaccagaaauacgaaaugcacgaacuguuacggcagaugggaauccgccggauauucagcccguuugcugaccucuccgagcuguccgccaccgggcgcaaucugcaagugagucgggugcugcaacgaacagugauugaaguggaugagagaggaaccgaggcagucgcuggcauccuuucugaaaucacugccuauucuaugccuccugucauuaaaguugauaggccuuuccauuucaugaucuacgaggagaccucaggaaugcuccucuuccugggccgcguggugaacccaacucuuuuguag

SEQ ID NO: 248490 - RNA, 1335 nt, Artificial Sequence
  Description of Artificial Sequence: Synthetic coding sequence
augaaagucgucccuagccuuuuauuaucugugcuacuggcacaaguuuggcuggucccuggcuuagcgccuuccccacaguccccagagacuccagcaccccaaaaccagacuagcagggugguccaggcccccaaggaagaggaggaagaugagcaagaagcuagugaagagaaggcuuccgaggaagagaaagcauggcucauggcaucuagacaacagcucgccaaagagaccucuaauuuugguuuuagccuccuacgcaaaauuagcaugcgacaugauggaaauaugguuuucucuccauuuggcauguccuuagcuaugacaggucuaaugcugggugcaacagguccuacggagacgcaaaucaaaagaggacugcaccuccaggcucugaagcccacuaaacccgggcugcucccgucccucuucaaaggccugcgugagacccucagcaggaaucuggaacuaggcuugacgcagggauccuucgcuuucauccacaaagacuuugauguuaaggagacauucuucaaucuuagcaaacguuauuucgacacagaauguguucccaugaacuucaggaacgccagucaggcaaaacgauugaugaaccacuacauuaauaaggaaacacgaggcaagaucccaaaguuauucgaugagauuaaccccgaaaccaagcucauccugguagacuacaucuuauucaaggggaaguggcugacaccauuugaccccguguucacagaaguugauacuuuccaucucgauaaauacaaaacuauuaagguuccuaugauguacggugcaggaaaauuugcuagcacuuuugauaagaauuuccggugccacgugcuaaaauuaccuuaccagggcaaugcuacaaugcucgucguacucauggaaaagaugggcgaccaccuugcccucgaggauuauuugacgacggacuuaguggagacauggcugcggaacaugaaaaccaggaauauggaaguguuuuuucccaaauuuaaacuggaucagaaauacgagaugcacgagcuccuccgacagaugggaauucggcgaauauuuaguccauucgcggaccuuagcgaacucucagccaccggaagaaaccugcaagugagcagaguccugcaacgcacugugaucgagguagacgaaagaggaaccgaggcaguggccggcauucuuucagagauuacagcuuacucaaugccaccugugauuaaggucgauaggccuuuccacuuuaugaucuacgaggagacgucuggcaugcuccuuuuccuggggcgugugguuaauccaacacugcuguag

SEQ ID NO: 248491 - RNA, 1455 nt, Artificial Sequence
  Description of Artificial Sequence: Synthetic coding sequence
augaguagaagcacacaagaguugcugggguaucacuguagauugcaggauaaacuucaggaacaagagggaucccuggccgcggagggaaggcauucacuagcuucugcggcugaccacaugaaggucgugccaucccuuuuauuauccguacugcuagcccaggugugguugguuccuggccuggccccaagcccucaguccccagagacaccugcuccccagaaucagacgucgaggguagugcaggcacccaaggaggaggaagaagaugagcaggaggccucugaagaaaaggccuccgaggaagagaaggcuuggcuaauggcaucacgccagcagcuggcaaaggagacaucuaauuucggcuuuucccugcugcggaagaucucuaugcgacacgacggcaauaugguguuuaguccguuuggaauguccuuagcaaugaccggacuuauguugggggcuaccgguccaacugaaacccaaaucaaacguggauuacaucuucaggcauugaaaccaacgaagccuggucuucucccguccuuguuuaaaggucucagggaaacccuuuccaggaaucuagaauugggucugacccagggcagcuucgccuuuauucauaaagauuucgacguuaaagaaacauucuuuaauuuaucaaaaagguacuuugacaccgaguguguucccaugaacuuccggaaugccucgcaggccaaacgucugaugaaucacuacaucaauaaagagaccagagggaaaaucccuaaguuguuugaugaaauuaauccugaaacuaaacuuauccuaguggacuauauuuuguuuaagggcaaauggcugacgcccuuugacccaguguuuacugaaguugauaccuuucaccuggacaaauacaaaaccauuaaaguaccaaugauguacggcgcggguaaauucgccuccacauucgauaaaaauuuucggugccauguucugaaacugccuuaccagggaaacgcuacuaugcuuguuguucuuauggaaaaaaugggugaccaccuggcuuuagaggauuaccugacuacugaucugguggaaacuugguugcgaaacaugaaaacaaggaauauggaggucuucuucccuaaauucaaacucgaccagaaguacgaaaugcacgagcugcugcgccagaugggaauacgacggaucuuuuccccuuucgccgaccugucugaauugagcgcuacuggcagaaaccugcaggucucucgugucuugcaacguacaguaaucgagguagacgagcgaggaacugaggccgucgcaggaauccugagcgaaauaaccgcauacaguaugccgccugugauuaaggucgaucggccauuucauuuuaugaucuacgaggaaacguccgguaugcuacuguuucugggcaggguggucaacccuacacuauuauag

SEQ ID NO: 248492 - RNA, 1197 nt, Artificial Sequence
  Description of Artificial Sequence: Synthetic coding sequence
augaauuggcaccuaccgcucuuccugcuggccuccgugacucuacccagcauaugcucacacuuuaauccucucagcuuggaagaacugggauccaacacagggauacaaguuuuuaaccaaauuguaaagucccgcccucacgauaacauuguuaucaguccccauggaaucgccucaguuuuagguauguuacaacucggagccgacgggagaaccaagaagcagcuggcuauggucaugagguaugguguuaacggagugggaaagauucugaagaagauuaacaaagcgauuguuuccaagaaaaacaaggacaucgugaccguugccaaugcuguuuucguaaagaacgcaagcgaaauugagguuccauuugucaccagaaauaaagacgucuuucaaugcgagguacggaacgugaauuuugaagaucccgccucagccugugacagcaucaacgcuugggugaagaaugaaaccagggauaugauugacaaccuucugaguccagauuugauugacggggugcucacucgccugguccuugugaaugcuguguacuuuaagggacucuggaagaguagauuucagcccgaaaacacaaagaaacgcacauucgucgccgcugacgguaaaucguaucaggugccuaugcuggcccagcugagcguuuuucgcugcggcagcacuagcgccccaaacgaccuuugguauaacuucauagagcugccuuaccauggggagaguaucagcauguuaauugcauugccuacagaaagcucgaccccacuguccgccauuauuccccauauuuccacaaaaaccauugauucauggauguccaucaugguuccgaagagaguccaggucauucuuccaaaguucaccgcaguggcucagaccgaucucaaagaaccccugaaggugcuuggaauuaccgacauguuugacaguagcaaagcgaauuucgcaaaaaucaccacuggaucagagaaucuccacgugucccauauucuccaaaaggcuaagauugaagugagcgaagauggcaccaaggcuuccgcugccaccaccgccauccugaucgcaagaucgucccccccuugguuuaucguggaccguccuuuucuguuuuuuauuagacauaacccuacaggagccgucuuguuuauggggcagaucaacaaacccuag

SEQ ID NO: 248493 - RNA, 1194 nt, Artificial Sequence
  Description of Artificial Sequence: Synthetic coding sequence
augaauuggcaccuacccuuauucuuacucgccucugugacacugccaucaauuugcucucacuucaacccucugucucucgaagagcuuggguccaauacaggcauccaaguguucaaucagauugugaaaucaagaccucaugacaacaucgugaucagcccgcauggaauugcuagcgugcuugggauguugcagcuaggcgcggacggaaggacuaagaaacaacuugcaauggugaugagauacggagugaauggcgucggcaagauucugaaaaaaaucaauaaggcuaucguuuccaaaaagaacaaagauaucgugacaguugcgaaugcugucuucgugaagaacgcuucagagauugaagugccauuugugacucggaauaaagacguauuucagugcgaagugagaaauguuaacuucgaggauccagccuccgcuugugauucuauuaaugcuuggguaaagaacgaaaccagggauaugaucgacaaucuucucagucccgaccuaauugacggaguccugacgcggcuggugcuggucaacgcgguguauuuuaagggcuuguggaagagcagauuucaacccgagaacacuaaaaagaggacauucguggcugccgacggaaaaaguuaucaagugccaaugcuagcccagcugucgguauucagaugugggagcaccucagccccuaacgaucugugguacaauuucauugaacuuccuuaccacggagaaagcaucuccaugcuuauugcacuuccuaccgaguccucgacuccgcuguccgcuaucauuccccauauuaguacgaaaacuaucgauaguuggaugucaaucaugguaccuaagaggguacaagugauucugccuaaguuuacugccguugcacagaccgaucucaaggaaccccucaaagugcugggaauuaccgauauguucgacucuucuaaggccaauuucgccaagauuacgaggucugaaaaccuccaugugagccauaucuugcagaaggcaaagauugaagugagcgaggacggaacaaaagccucagcagcgacaacugcgauucucaucgcccggucuuccccucccugguucauugucgaucgcccauuccuauuuuucaucaggcauaacccaacaggggccguacuuuucaugggacagaucaauaaaccauag

SEQ ID NO: 248494 - RNA, 1194 nt, Artificial Sequence
  Description of Artificial Sequence: Synthetic coding sequence
augaauuggcaccucccccucuuuuugcuggcaaguguaacucugccgucgauuugcucucacuuuaauccccugucccuugaggaacucgggagcaauacuggcauccaagucuucaaccagaucgugaagucaagaccacacgauaacauuguuaucagcccccacggaaucgcuaguguguuaggcaugcuacaguugggagcugacgguaggacaaagaaacaguuagccauggugaugagauauggagucaacggugugggaaagauccugaagaaaaucaacaaggcgauugugagcaaaaagaauaaggauaucgucaccguagccaacgcgguuuuugugaaaaacgccuccgagaucgagguccccuucgugacgaggaacaaagauguguuccaaugugaaguaaggaacgugaacuucgaagauccggccuccgcuugugacagcauuaaugcgugggugaaaaacgagacccgggacaugauagauaaccugcucagccccgauuugaucgauggagugcucacacgauuaguucuugugaaugcuguguacuucaagggacuguggaaaagccgauuccagccugagaacaccaagaaaaggacuuuuguggccgccgacgguaaaucguaccagguaccuauguuagcccagcugagcguguuuagguguggaucgaccucugcccccaaugauuuaugguacaacuucauugaacugccuuaccauggcgaguccaucucuaugcucauagcacuuccuacagaguccuccacuccccucuccgccauuauuccucacaucucuacaaagaccaucgauuccuggaugaguaucauggucccaaaacguguacaggugauccugcccaaguucacagccguggcucagacugauuugaaagaaccucuaaaggugcuugggauuacagacauguuugauuccucaaaagcgaauuuugccaaaauuacucgaucagaaaaucugcacgucucccacauucuucagaaggccaagauugaagucuccgaggauggaaccaaggcuagcgcugcaacuacugccauacugauugcgaggucuucuccaccuugguucaucguggaucgcccuuuucuuuucuucauaaggcacaacccaacgggagcgguuuuauuuaugggccagauuaauaagccuuag

SEQ ID NO: 248495 - RNA, 129 nt, Artificial Sequence
  Description of Artificial Sequence: Synthetic coding sequence
augaacuggcauuuaccccucuuucuuuuggcuucugucacccugccauccauuugcucacacuuuaauccucugucccucgaagaacucggguccaacaccggaauucagguuuuuaaucagauuuag

SEQ ID NO: 248496 - RNA, 831 nt, Artificial Sequence
  Description of Artificial Sequence: Synthetic coding sequence
augaauuggcaccugccauuguuccugcuugcuagcguaacacugccuuccauuugcagccacuucaauccgcugagccuggaggagcuagggaguaacacgggaauacaggucuucaaucagauagugaaaagcaggccucaugauaacaucgucaucucaccgcacggaaucgccucgguucucggaauguugcaacucggcgcugacgggaggacuaagaagcagcucgccauggugaugcguuauggggugaauggaguuggaaaaauccuuaagaaaauuaacaaagcaauugugucaaaaaagaacaaagauaucguaacuguggccaaugcuguauucgugaaaaacgcaagugaaaucgaagugccauuuguuacaagaaacaaagacgucuuucagugugaagucaggaacguuaauuuugaggacccagcuucggcaugcgauaguauuaacgcuuggguuaaaaacgagacgcgggacaugauugauaauuugcuuucuccugaccugauugacggugucuuaaccagacuagucuuggugaaugcaguguauuuuaagggucuuuggaaguccagguuccaaccagaaaauacuaagaaacgaaccuucgucgcugccgaugggaagucauaucaggugccgaugcuggcacagcugucuguguuucgaugugggaguacaagugcacccaacgaucuuugguauaacuucaucgaacuaccuuaccacggcgaaucuaucucuaugcugaucgcucugccaaccgaaucgagcaccccucuguccgcuauuauuccccacaucucuacuaaaaccuag

SEQ ID NO: 248497 - RNA, 1230 nt, Artificial Sequence
  Description of Artificial Sequence: Synthetic coding sequence
auguccgauugcagaagcucucucguggagggaacaaugaacuggcaucugccucucuuccuguuagcauccgugacccugccuaguauaugcucccacuuuaauccuuuaucacucgaggagcucgguuccaauacuggcauucagguguucaaccagaucguuaaaucucggccacaugauaauauagugaucaguccgcacgggauagccucuguucuggguauguuacaacuuggcgcugacggacggacuaaaaagcagcuugccauggugaugagauacggcguaaauggagugggaaagauucuuaagaagaucaauaaggcaauugugaguaaaaagaauaaggacaucgugacggucgccaacgcuguguucguuaagaaugcaucagagauugaggucccuuucgugacucggaauaaagacguuuuccagugugaggugcgcaauguaaauuucgaagacccggcaagugcuugugauuccauuaaugcuugggugaagaacgagaccagagacaugaucgacaaccuacucucuccugaucugaucgauggcgugcugacacgccuaguccucgugaaugcaguauacuuuaagggcuuguggaagagucgcuuucaaccugagaauacaaagaagcgcaccuuuguggcugcugauggcaaaucauaccaaguaccaauguuggcgcagcugagcguguuuagaugugggucaacauccgccccuaaugaucugugguacaauuuuauugaacugcccuaccauggcgagucuaucagcaugcugaucgcccugccgacggagaguucuacaccgcugagcgccaucaucccucacauuucgacgaagacaaucgacuccuggaugucuaucauggugccaaaacgcgugcaggucauccuuccuaaauucacugcugucgcucagacugaucugaaagaaccacuaaaggugcuugggaucacugauauguucgauucaucaaaggccaauuuugcuaaaaucacccgcagcgaaaaccugcacgucucccauauucuucagaaagcgaaaauugaggucagcgaggacggaaccaaagcauccgcugccaccaccgcaauucucauagcccguucgaguccaccaugguuuaucguggaucguccguuucuguuuuuuauccgccacaaccccacgggcgcuguguuauucaugggacagauuaacaagccguag

SEQ ID NO: 248498 - RNA, 264 nt, Artificial Sequence
  Description of Artificial Sequence: Synthetic coding sequence
augaauuggcaccugccacucuuccuuuuagcgucagugacccucccuucgauuugcucccacuuuaacccgcuuucacuugaggaacuagguucaaacacagguauccaagucuuuaaucagauuguuaagucccgcccucaugauaacauugucauuagcccccacggcauugccuccgugcucgggaugcuucaacugggagcugauggccguacaaagaagcaacuggcaaugguaaugagguacggcgucaacggauag

SEQ ID NO: 248499 - RNA, 426 nt, Artificial Sequence
  Description of Artificial Sequence: Synthetic coding sequence
auggaaauguugcaaggcuuguuauugcugcuccuccugaguaugggaggcgcaugggccaguagggaaccucugcgucccuggugccauccaauaaacgcuauccucgcagucgagaaggaaggauguccagucugcaucaccgugaauacgacaaucugugcuggguacuguccgacuaugaugagaguacuccaagcugugcuaccccccuugccccaggucguaugcacuuacagagaugugcgguucgaauccauaagauugccuggcuguccuagagguguagaccccgucgugucuuuccccgucgcccugaguugccggugcggaccuugcaggcggagcacaucagauugcggcggcccaaaggaucacccucugacaugcgaccacccccaacugucuggcuuauuauuucuauag

SEQ ID NO: 248500 - RNA, 1491 nt, Artificial Sequence
  Description of Artificial Sequence: Synthetic coding sequence
auggggacccaaaaagugacuccagcccugauauuugccauuacuguugccacgaucggaaguuuucaauucggcuauaacacaggaguuauaaaugcuccugagaaaauuaucaaggaauuuauuaauaaaacccugaccgacaaagguaaugcaccacccagcgagguucugcugaccagcuuauggucccuguccguggcaaucuucucaguugguggcaugauaggcucuuuuuccguuggucuuuucgugaauagauucgggaggaggaacuccaugcugaucguaaaucugcucgccgucacugggggguguuucaugggucucuguaaaguugccaaguccguggagaugcugauacuugggcgcuuggucaucggucuuuuuugcggcuugugcaccggauucgucccuauguauauaggugaaauuaguccaacugcacuccgaggcgccuuuggcacccuuaaucaguugggcauagugguugggauccuuguggcgcagaucuucgggcuagaauucauccugggaagugaggagcuguggccucuguuauuagguuuuacgauucuccccgcaauacugcaaucugcugcccugcccuuuugucccgaauccccgcgcuucuuguugauuaaccggaaagaagaggaaaaugcuaagcagauccugcaaagauugugggggacgcaggacgucagccaggacauacaggaaaugaaggacgagucugcccgcaugucccaagaaaagcagguuacaguacucgagcucuuccgggucagcucguauagacaaccaauuaucauaucaaucguccuacagcucucacagcagcucuccggcaucaaugcaguguucuacuacagcacaggaauuuucaaggacgcaggaguacaagaacccaucuaugccacgauaggugcaggaguggugaacacuaucuucaccguggugagccucuuucugguugagcgagccggacgacggacauuacacaugauuggacucggggggauggcuuucugcucuacucuaaugaccgucucuuuguuacugaaggauaacuauaacgggaugucuuucguguguaucggcgcaauccuuguguucguugccuucuucgagaucggccccggucccaucccuugguucaucguggccgagcuguuuagucagggaccacggcccgccgcaauggccguugcaggcugcucuaacuggacuaguaauuuuuuaguaggccuguuguuucccagcgcugcacacuacuugggcgcuuacguguuuaucaucuuuacaggcuuccugaucacauuuuuggccuuuaccuuuuuuaagguccccgagacgagaggcagaacauuugaggacauuacaagagcauuugaaggucaagcgcauggugccgaucggaguggcaaagauggugugauggagaugaacaguauugaaccugccaaagaaacaaccaccaacguguag

SEQ ID NO: 248501 - RNA, 2097 nt, Artificial Sequence
  Description of Artificial Sequence: Synthetic coding sequence
augaaaaucgaaaccagcggcuauaacucugauaagcugaucugcagagguuucaucggcacuccugcaccuccuguuugcgauucuaaguuccugcugucccccucguccgaugucagaaugaucccuuguagagcugcccucacauucgcucgcugucucaucagacggaagauagucacgcuugacucucucgaagacacuaaguugugcagaugccugagcaccauggaccuaauugcuuuaggugugggaucuacacugggagccggcguauauguucucgcuggggaaguugcuaaggcggauagcggacccagcaucguugucucuuuccuuauugcugcccuggccagcgucauggcaggucuguguuacgcugaguucggcgcucgugucccaaagacaggauccgcguacuuguacacauacguuaccgugggugaacuuugggccuucaucacggguuggaaucugauacugagcuacguaaucggcacauccucuguugccagagccugguccgguaccuucgaugagcuguugucuaagcagaucggacaguuccugcgaaccuacuuccgcaugaauuauacggggcucgccgaguacccugacuucuuugccgugugucugauccucuuguuagcuggacugcucucuuuuggcgucaaagaaucugccugggucaauaagguuuucaccgcugugaauauccuggugcuauuguuugucaugguagccggcuucguaaaggggaauguggccaauuggaagauuucagaagaguuccuuaagaacauaagcgccucugcacgugaaccccccagugaaaauggcaccuccaucuauggggcggggggauucaugcccuacggauuuacuggaaccuuggcuggggccgccacauguuuuuacgccuuugucggauuugacuguaucgccacuacuggagaagaggugcgcaacccucagaaggccaucccgaucggcaucgugacuagccugcugguguguuuuauggcuuacuucggaguuucugcagcccugacccucaugaugccauacuaccuccuagacgaaaaaucaccacucccuguugccuucgaauaugucggcugggggcccgcaaaguaugugguggcagccgggagcuugugugcuuugagcacaucuuuacuaggaucgaucuuuccaaugccucgagucauuuacgccauggcugaggacggguugcucuuuaagugccuggcucagaucaacuccaagaccaagacaccuauuaucgcuacccugagcuccggcgccguggcugcacugauggcauuucucuuugaucugaaggcgcuuguugacaugaugucgaucggaacguugauggcuuauagucugguugccgccugcguucugauccuccgauaccagcccggccugaguuacgaucagccuaaaugcucccccgagaaagauggauugggaagcucaccccgcgucaccucuaaguccgagagccaggugaccaugcugcaacgucagggcuucucaaugcggacucucuuuuguccaucccuguugcccacucagcagagcgcgagccucguuucuuuucuggucggauucuuagccuuccugguguugggacugucagugcuaacgaccuauggaguccacgcaaucacccgcuuagaagcuuggucccuggcccugcuagcccucuucuuaguccuauucguugccaucguccugacaaucuggcgccagccacagaaccaacagaagguggcauucauggugccuuuccugccuuuucugccagcauucuccauccucgugaauauauacuuaauggugcaacuaagugcugacaccuggguucgauucucaauuuggauggccauaggguuuuugauuuacuucuccuacggaauuagacauagucuggagggucaucugagggacgaaaacaacgaggaggacgcuuaucccgacaaugugcaugccgcugcugaagagaagagugcuauccaagccaacgaucaccacccgcgcaauuugucauccccauuuauuuuccaugaaaagaccagcgaauucuag

SEQ ID NO: 248502 - RNA, 1464 nt, Artificial Sequence
  Description of Artificial Sequence: Synthetic coding sequence
augggagacacuggccugagaaagagacgugaagaugaaaaaucuauccagucccaggaaccuaaaaccacaucccugcaaaaggaacugggacuaauuagcgguaucaguaucauaguaggaacaaucaucgguucuggaauuuuugucuccccaaagucaguccugucgaacacagaggcaguugguccaugucugauuauaugggcagcaugcggcguccucgcuacucugggggcacugugcuucgccgaacuggggacgaugaucaccaagucuggcggcgaauacccauaucuuauggaggcauauggucccauuccagcauaccuuuucuccugggcguccuuaauuguuaucaaaccuacaucuuuugccauuauuugccuuucuuuuuccgaguaugugugugccccuuucuaugucggcugcaaaccaccucagauuguagugaagugucuggcagccgccgccauacucuuuaucucaacggugaauucacucuccguacgacuggggaguuauguucagaacaucuucacugccgcaaaacuugugauuguugccauaauuauuaucuccggccuggugcugcuggcccagggaaauacaaagaauuuugauaauucuuuugagggagcacaauugagcgugggcgcuaucucacuggccuucuauaacggacugugggcuuaugauggauggaaccaauugaacuacaucaccgaggaacuucgcaaucccuaccggaaccuuccuuuggccaucauuaucggaauuccuuugguaaccgcuugcuacauuuugaugaacguguccuacuuuacuguuaugacagcuacggaacuucuacaaucucaagccguggcugugacuuucggcgaucgugugcuguauccagccucguggaucguuccacuguuuguugccuucucuacuauuggcgcugcgaauggcacuuguuucaccgcaggccgacugaucuaugucgcaggccgggagggucacaugcugaagguuuugagcuacauaucuguucggaggcugaccccggccccagccauuauuuucuacggaauuaucgcaacuaucuauaucaucccuggcgauaucaacucccuggugaacuacuuuuccuuugcagcgugguuguuuuacggcuugacaauucugggacuaaucgugaugcgguucacucguaaggagcucgaaagaccaaucaaagugccugucgugaucccuguccugaugacauuaaucucugucuuuuuggugcuggcgcccaucaucuccaagccuacgugggaguaucuguacugcguucuguucauucugucaggccugcuuuucuacuucuuguuugugcauuacaaguuugggugggcccagaagauaucaaagccaauuacuaugcaccuccagaugcuuauggaaguggugccucccgaggaggauccagaguag

SEQ ID NO: 248503 - RNA, 1311 nt, Artificial Sequence
  Description of Artificial Sequence: Synthetic coding sequence
augcugaagguaucagccgugcucugcgucugugccgcagcaugguguucucagucucuggcugccgcagccgcuguggcagcugcugggggcagaucugauggcggaaacuucuuggacgauaagcaauggcuuacgacgauaucccaguacgacaaggagguuggccaguggaacaaguuccgggaugagguagaggacgacuacuucaggacauggucaccagguaaaccuuuugaccaggcccucgaccccgcuaaagaccccugccugaaaaugaaaugcucucggcacaaaguauguauagcccaggauucucagacggccguuugcaucucacaccgccggcugacccaucguaugaaagaggcaggaguugaccaccgacaauggcggggccccauccugagcacauguaagcagugcccagugguguaccccagcccaguuugcggcuccgauggucauacauacuccuuucagugcaaacucgaguaccaagcguguguguuaggcaagcagaucaguguuaagugcgagggacacugccccugucccuccgacaagccuacaaguacuucacgcaacguuaagcgagccugcuccgauuuagaguuuagagaaguagcuaaccggcugagagauugguuuaaggcccugcaugaaagcgggucacagaacaagaaaaccaaaacccugcucagaccugaacguuccagauuugauaccucaauuuuacccauuugcaaagacucauugggauggauguucaaccgccuggauacuaacuaugauuugcuacuugaccaauccgaacugagguccaucuaucucgauaaaaaugagcaaugcacuaaggcuuucuuuaacagcugcgacacuuauaaagacucucugauuuccaacaaugaauggugcuauugcuuccagaggcagcaggaucccccuugccaaacugaacuaucaaauauccagaagagacaaggcguaaagaaauuacucgggcaguacauaccccucugugaugaagacggcuauuauaaaccuacacaaugucaugggucuguuggacagugcuggugcguagauagauauggcaaugaaguuauggguagucgcaucaauggaguggccgacugugccaucgauuucgagauuagcggcgauuucgcgucgggagacuuccacgaguggacagaugacgaggaugacgaggaugauaucaugaaugacgaggacgagauagaggacgacgacgaggaugagggugaugacgaugacggaggcgaugaccacgacguguauauauag

SEQ ID NO: 248504 - RNA, 1302 nt, Artificial Sequence
  Description of Artificial Sequence: Synthetic coding sequence
augcugaaggucagcgccguuuugugcgucugugccgcugcuugguguagucagucauuggcugcggcugccgcagucgcagcugccgguggacgcucugaugggggaaacuuucuggacgauaaacagugguuaaccaccauaucccaguacgauaaggaagugggucaguggaauaaauuucgcgacgacgacuauuuucguaccuggucuccuggcaagcccuuugaucaagcucuugaccccgcgaaagauccuuguuuaaagaugaaauguucgcgacacaagguaugcauagcucaagacucacagacggcaguguguaucucucaucgccggcucacacaucggaugaaagaggccggcguggaccauagacaguggcggggcccaauccugaguacuuguaagcaguguccuguggucuauccaaguccagugugcgggucagacgggcacacauauaguuuccagugcaagcucgaguaccaggccugugucuuagggaagcagaucucugucaagugugagggucauugcccuuguccaagcgauaagccaacaaguaccucucgaaaugucaaacgugcuugcagcgaccucgaguuucgggagguggccaauaggcuacgcgauugguuuaaggcacugcacgagucuggaucucaaaacaaaaagaccaaaacccuccugcgucccgaacgcucccgguuugacacaaguauccugccuaucugcaaagauagucugggcuggauguucaaccgacucgacacaaacuaugaucuguuacuugaucagucagaauuacguaguaucuacuuagacaagaaugagcagugcacuaaagcuuucuucaacucaugcgauacauauaaagauucucugauuagcaacaacgaguggugcuacuguuuucagagacaacaagacccacccugccaaacggagcucagcaauauccagaaaaggcaagguguuaaaaaacugcugggccaguauauaccacugugugacgaggacggguacuacaagcccacccagugucauggguccgugggccaguguugguguguugauagguaugggaaugaagucaugggcuccagaauuaacggagucgcagauugugcgaucgacuucgagauaucaggugacuucgcuagcggagauuuccacgaauggacagacgaugaggaugacgaggaugacauaaugaaugacgaagacgagauagaagaugaugacgaagacgagggggacgacgaugacgguggagacgaucacgacgucuacaucuag

SEQ ID NO: 248505 - RNA, 1158 nt, Artificial Sequence
  Description of Artificial Sequence: Synthetic coding sequence
augaucacccaagaccauauucauaugaguucgggacucagccaggacgauuauuuucggacuuggucaccaggaaaacccuucgaccaggcgcucgauccugcuaaagacccaugcuugaagaugaaguguucaagacauaaaguguguaucgcucaagacucacaaacagccgucuguaucucucaucggcgacugacacacaggaugaaagaggcaggcguugaucauaggcaauggcggggcccuauccucuccacuugcaagcaauguccagugguguacccaaguccagugugcggcagcgauggccacaccuauuccuuccaaugcaaacuugaauaucaagccugcgugcugggaaagcagaucucugugaaaugcgagggucacugcccguguccgagcgauaaaccgaccucaaccucacggaauguuaaaagggcauguagcgaucuggaguucagagagguugccaauagacugagagacugguucaaagccuugcaugaaucggguagucaaaacaaaaagacaaagacucuccugagacccgaacgaucucguuucgacacuucuauauugcccauuuguaaggacucauuaggauggauguucaaccguuuggauaccaauuacgaccuguuacuggaccaguccgagcuuaggagcauuuaccuggacaaaaaugaacaguguacaaaagccuucuucaacaguugcgauacuuacaaggacucucugaucagcaacaacgaauggugcuacuguuuucaacgucagcaagacccucccugccagacagagcuguccaacauucagaagcgucagggugugaagaaguugcuggggcaguacaucccccuuugugaugaggauggguacuacaaacccacccagugccacggcucaguggggcaauguuggugcguugaucgcuacggcaaugaggugaugggcucaagaauuaauggggucgcagacugcgcaauagauuucgagauaaguggcgacuuugcuucaggugauuuucaugaauggacugacgaugaggaugacgaggacgauaucaugaaugaugaggaugagaucgaggaugacgacgaagaugaaggcgaugacgacgacgggggagacgaucacgauguguacauuuag

SEQ ID NO: 248506 - RNA, 1311 nt, Artificial Sequence
  Description of Artificial Sequence: Synthetic coding sequence
augcucaaggucagcgccgugcugugcguaugugcggccgccuggugcagucaaucccuagcugcugcggccgcuguggcagccgccggagggcggagcgacggggggaauuuucuggacgauaagcaguggcucacaacgaucagccaguacgauaaagaaguaggacaguggaauaaguuucgugaugaagucgaagaugauuacuuccgaaccuggagcccgggaaaaccuuuugaccaggcauuagacccagccaaggacccuugcuugaagaugaaauguaguagacauaaaguaugcaucgcucaagauucucagaccgccgugugcauuucucaccggcgccugacacauaggaugaaggaggcaggcguagaucauaggcaguggcguggaccuauuuugagcaccuguaagcaauguccuguuguguacccuuccccagucuguggcucugacggucauacauauaguuuucagugcaaacucgaauaccaggcaugcguucuggguaagcagauuuccgugaagugugagggccacugcccgugcccaagugacaagcccaccucaacuaguaggaacgugaagagggccugcuccgaucuggaguuuagagaggucgcaaaucgcuuaagggacugguuuaaagcacuccacgaguccggcucgcagaauaagaagacaaagacgcugcucagaccagagaggagccgauucgacacuagcauccuuccaaucuguaaagacucccugggguggauguucaaccgacucgacacuaauuacgaccuccuucucgaucaauccgaauugaggagcauauaccucgauaaaaaugaacagugcacaaaagcauucuucaauucuugugacacauauaaggauagucucauuucgaauaacgaauggugcuacuguuuucagcgacagcaggacccgccuugucagaccgagcucaguaauauucagaagcgccagggggucaagaaacuguugggacaguauaucccauuaugcgacgaggacggcuauuacaaaccuacucagugucaugggucaguggggcagugcuggugcguugaccgguauggcaacgaggugaugggcaguaggaucaaugggguggcagauugcgcaauugauuuugagauuaguggugacuuugcaagcggcgacuuccacgaauggacugacgacgaagaugacgaggaugauauuaugaacgaugaagacgagauagaagacgaugacgaggacgaaggagacgaugacgauggcggugacgaucacgauguuuauauauag

SEQ ID NO: 248507 - RNA, 1302 nt, Artificial Sequence
  Description of Artificial Sequence: Synthetic coding sequence
augcucaaagucagcgccguucugugugucugcgccgccgcuugguguagucagucacuugccgcagcugcagcugucgccgccgcaggcggacggucggacggaggcaauuuucuugacgacaaacaguggcucacaacuauuagucaguaugacaaggagguagggcaauggaauaaauucagagacgacgacuacuucaggacuuggaguccuggcaagccuuucgaucaggcacuggacccggcuaaagaucccugccucaaaaugaaauguucaagacacaaaguauguaucgcccaggacucccaaaccgccguaugcaucucacaccgaagacugacacaccggaugaaagaggccggcguugaucaccggcaauggagagguccuauccugucaacauguaagcagugcccaguuguuuacccaucgcccguguguggaagcgauggacauacuuauagcuuucaaugcaaguuggaauaucaggccugcguguuaggcaaacaaaucucugugaaaugugaaggacacuguccauguccaagugacaagccaacuaguaccagcaggaaugugaaacgggcuugcagugaccuagaguuucgggaaguugccaaccggcugcgugauugguucaaggcacuacaugaaucaggcagccagaacaagaagacgaagacacuccucagaccugaaagguccagauucgauacuucuauccugccuaucugcaaagacucucucggauggauguucaaccggcucgauaccaacuaugaccuccugcucgaucaguccgaacuuaggucuaucuaucucgacaaaaacgaacagugcacaaaggcuuucuuuaacucuugcgauacauacaaggacagccugauuuccaacaaugaauggugcuacugcuuucagcggcaacaggacccccccugccagaccgagcugucuaacauccagaagcgccagggcguuaaaaaacucuuggggcaauacaucccccugugugacgaagauggcuacuacaaaccgacucaaugucauggcucuguuggucaaugcuggugcgucgauagguacggcaaugaggucaugggcucccgaaucaacggcguggcggauugugcuaucgauuucgaaauaucaggcgacuucgcauccggggacuuccaugaguggacagaugacgaggaugaugaagaugauaucaugaaugaugaagacgagauugaagaugacgacgaagaugaaggugacgacgaugacgguggggaugaccacgaugucuacauuuag

SEQ ID NO: 248508 - RNA, 348 nt, Artificial Sequence
  Description of Artificial Sequence: Synthetic coding sequence
auguuaaaagugucugcugugcucugugucugcgccgccgccuggugcagucagagcuuagcagccgcagcagcaguugccgccgccggaggacggucggauggagggaauuuccuugacgauaagcaguggcugacuaccaucucacaguaugauaaagaaguaggccaguggaacaaguuucgggacgagguggaagacgacuacuuuaggacauggucuccaggaaaacccuuugaucaggcacucgacccugcuaaggaccccugccuaaaaaugaaauguucccgccauaagguguguauagcccaggacucucagacagcagugugcauaucccauagguag

SEQ ID NO: 248509 - RNA, 1311 nt, Artificial Sequence
  Description of Artificial Sequence: Synthetic coding sequence
augcugaaaguuagcgccguguuaugugugugcgcugccgccugguguucacaaucccucgccgccgccgcagcuguggcagccgccggaggcagaagugauggggggaauuuccuggacgacaagcaguggcugacaaccauuucacaguaugacaaagaaguuggucaguggaauaaauuuagagaugagguugaggacgacuauuuucguaccuggucaccagggaagccauucgaucaagcucucgauccagcaaaagacccuugccugaagaugaaauguagcaggcacaaagugugcauugcucaggauucacagacugccguaugcauaucacauagacguuugacccaccgcaugaaggaggccggcguugaucacaggcaguggcgggguccaauacuguccacuuguaagcagugcccggugguguaccccucuccagugugcggauccgauggccacacuuauagcuuccaaugcaaacucgaguaucaggcguguguacuggggaaacaaaucagcgugaaaugcgaggggcacugccccugucccuccgauaagccgacauccacaagucggaaugucaaaagggccuguagugaucuugaauuccgcgaaguggcaaaccgccuuagagauugguuuaaagcacuucaugagagugggagccagaacaagaagaccaagacccugcuuagacccgaacggucucgauucgauacuucaauucugccuaucuguaaggacucccuggguuggauguuuaaucggcuagacacaaauuacgaccuccugcuugaucagucggaacucagaucuauuuacuuggauaaaaacgagcaguguaccaaggcauuuuucaacucaugcgauacguacaaggauucucugauaucgaauaacgaaugguguuauugcuuccagcgccagcaggauccuccaugucaaacugagcugucaaauauucagaaaaggcagggaguaaagaaacuguuaggacaguacaucccccugugugaugaggaugguuauuauaagccgacgcagugccacggguccgucggccagugcugguguguggaccguuauggcaacgaagugaugggaagcagaaucaacggaguggcugauugcgcuauugacuucgaaaucucuggagacuuugcaagcggagacuuucaugaguggaccgacgacgaagaugacgaggacgacauuaugaacgacgaagacgaaaucgaagacgaugacgaggaugaaggagaugaugaugaugggggugaugaucacgacgucuauaucuag

SEQ ID NO: 248510 - RNA, 486 nt, Artificial Sequence
  Description of Artificial Sequence: Synthetic coding sequence
augcucaagguuuccgccguccucugugugugcgcagccgcuuggugcucccaaucacuggccgccgcagcugcugucgcagccgccgggggcagaucggaugggggaaacuuccucgacgauaagcaguggcucacaaccaucagccaguacgacaaggaggugggacaguggaauaaguucagagacgacgauuacuuucgaacgugguccccugggaaacccuuugaucaggcacuagaccccgccaaagacccaugccucaagaugaaauguucacgccacaagguuuguauugcccaagacucccaaacagcuguguguaucagucaccgcagacucacccaucggaugaaggaagcugggguggaccauagacaguggagagggccuauccugucaaccugcaaacaguguccagucguguaccccagccccguuuguggaucagauggccauaccuacuccuuucaguguaaguuguag

SEQ ID NO: 248511 - RNA, 522 nt, Artificial Sequence
  Description of Artificial Sequence: Synthetic coding sequence
augcugaaaguuagugcgguccucugcgugugcgccgcugcgugguguagucaaucccuugcagccgcagcugccgucgccgccgccggaggaagaagcgaugguggcaacuucuuagacgacaaacagugguugaccacuauuucucaauaugauaaagaaguggggcaguggaauaaguuucgggaugacgacuauuuucggacuuggagccccggaaaaccuuuugaucaggcgugcagcgaccuugaguuccgcgaggucgccaauaggcuacgcgacugguucaaggcccuccaugaaucuggcucccaaaacaaaaaaacuaagacccucuugcggccugagcgcucgcguuuugauacuucuauucucccaauuugcaaagauuccuugggcuggauguucaaccggcucgauacaaauuaugaccuucugcucgaccaaagugaacugcgaucaaucuaccucgacaaaaaugagcagugcaccaaagccuucuucaauaguugugauacauag

SEQ ID NO: 248512 - RNA, 1182 nt, Artificial Sequence
  Description of Artificial Sequence: Synthetic coding sequence
augcugaaagucucugccguguuaugcgugugugcagcagcuuggugcucacagagccuggccgcagcagcugcaguggcagcagcggggggcagaagcgauggagggaauuuccuagacgacaaacaguggcugacgacgaucucucaguaugauaaagaagugggacaguggaacaaguuucgagaugaugacuacuucagaacuuggaguccugguaagccguuugaccaagcccuugacccagccaaagauccuugccucaaaaugaagugcagcaggcacaaaguuugcaucgcccaggauagccagaccgccguaugcaucucccaucgcagacuuacucaccgaaugaaagaggccggcguugaucaccgacaguggcgcggaccuauuuugucaacauguaagcaguguccuguaguuuacccaaguccaguuugcgggucugauggacauacauacagcuuucagugcaaacucgaauaccaagcguguguucuggguaaacaaauaucugugaaaugcgaggggcacugccccugccccucugauaagcccacgagcacauccagaaacgucaaaagaggauuugauacaucuauacugccaaucuguaaggauaguuuaggcuggauguuuaacagauuggacacaaacuacgaccucuuauuagaucagagcgagcugagaucaaucuaccuggacaaaaacgaacagugcacaaaagccuucuucaacagcugcgauacauauaaagauagccuaaucuccaauaaugaguggugcuacuguuuucagcgacaacaagacccuccaugccagacggagcugucgaacauccaaaagcgucagggcgugaagaagcugcuggggcaguacauuccacugugugacgaagacggguauuauaaaccaacgcaaugucauggaucagucgggcaaugcuggugcguggacagauacggcaacgaagucaugggcucacgcaucaaugguguggcagacugugccaucgacuuugaaauaucaggagauuucgccagcggggauuuccaugaguggacugaugacgaggacgacgaggacgauauuaugaaugacgaagacgaaaucgaggacgaugaugaagaugaaggcgaugacgacgacggcggcgacgaccaugacgucuacauuuag

SEQ ID NO: 248513 - RNA, 1302 nt, Artificial Sequence
  Description of Artificial Sequence: Synthetic coding sequence
augcuaaaaguuagcgcuguguuaugcgucugcgccgcugcaugguguucucaaucccuggccgcagcugcugccguagccgcugccggaggccgcucggacggagggaacuuucucgaugauaagcaauggcuuacuacuaucucccaauacgacaaagagguaggccaguggaauaaguucagggaugaugauuauuuucguacauggaguccuggcaaaccuuuugaucaggcuuuagacccugccaaagaccccugucugaaaaugaagugcuccagacacaaggugugcauugcgcaggauucccaaacugcaguguguauaucccauaggaggcuaacccaccgcaugaaggaggccggcguagaccaccgacaguggcgcggacccauccuguccacauguaagcagugcccugugguauauccgagucccgucuguggcagcgacggccacacguacaguuuucaguguaagcuagaguaccaagccugcguucucgguaagcaaaucucagugaagugcgaaggacauugccccugcccuucagauaaaccaaccucuaccucacgaaacguuaaaagagcuugcagcgaucuugaauuuagagagguggcaaaccggcugcgagauugguuuaaagcccugcaugagagcgguucccagaauaagaaaacuaagacucucuugcgcccagaacgcagcagguucgauacauccauauugccuaucugcaaggacucucuuggcuggauguucaaucgacuggacaccaauuacgacuuguugcuagaccaguccgaacugagaagcauauaccuagacaaaaaugagcaguguaccaaggccuuuuucaauaguugugacacauacaaagauagccugaucucaaauaacgaauggugcuacuguuuccagaggcagcaggauccaccaugucaaaccgagcuuagcaacauccagaagagacaaggagugaaaaagcugcugggccaguacauuccccucugcgaugaagacggcuacuacaagccaacucaaugucacggaagcgucggacagugcuggugcgucgauagauaugguaaugaggucaugggcucccgaauuaacggcguugccgacugugcgauagacuucgagauuucaggugacuucgccucgggggauuuucaugaauggacugacgacgaagaugacgaggacgacauuaugaacgaugaggacgagauugaagacgacgaugaagacgaaggugacgacgacgacgguggagaugaucaugaugucuacaucuag

SEQ ID NO: 248514 - RNA, 1311 nt, Artificial Sequence
  Description of Artificial Sequence: Synthetic coding sequence
augcugaagguauccgccguuuuauguguuugugcugccgccuggugcagccagagccuugcagccgccgccgcagucgcagcugcuggcggaaggucagauggaggcaauuuucuugaugauaaacagugguugacuacuauuagccaguaugauaaggaagugggccaauggaauaaguuuagagaugaaguagaagaugauuauuuucggaccuggaguccuggcaagcccuucgaccaagcgcucgaccccgcgaaagacccaugucugaaaaugaagugcucucgacauaaagugugcaucgcgcaggacucccaaaccgcugugugcauuucgcacaggagacugacccaucgaaugaaggaagcaggaguggaccaucgacaguggcgcggccccauacucuccacuuguaagcagugccccgucguguacccuucaccaguaugugguucugacggucacaccuauaguuuucaauguaagcuugaauaucaagcgugcgugcuugguaagcaaauuuccgugaagugcgagggucacuguccaugcccuucagacaaaccgaccucgaccucacggaauguuaaacgggcauguucugacuuagaauuucgcgaaguugcgaaucgcuuacgugauugguucaaagcccuccaugaaucaggcucucagaacaagaagacuaagacucuguugcggcccgaacggagccgguucgacacaaguauucugccuaucugcaaagacagccugggauggauguucaacaggcuugauacuaauuacgaccugcugcuggaccaguccgaauuacggagcauauaccucgacaagaaugagcaguguaccaaggcuuuuuucaacuccugcgacacauacaaagacucucugaucuccaauaacgaguggugcuauugcuuucagcggcagcaagacccuccuugccaaacagaacuguccaauauccaaaagaggcaggguguuaagaagcugcucggacaguauaucccgcuaugugacgaggacggcuauuauaaaccuacccagugucaugggagcgucggacaaugcugguguguugaccgauauggaaacgagguaauggggucccggauuaacggugucgcggauugcgcuauugacuucgagaucuccggcgauuuugcgagcggcgacuuccaugaguggaccgacgacgaagaugacgaggacgauauaaugaaugacgaggacgagaucgaggaugaugaugaagacgagggagacgaugacgacggaggcgacgaccaugauguguauauuuag

SEQ ID NO: 248515 - RNA, 348 nt, Artificial Sequence
  Description of Artificial Sequence: Synthetic coding sequence
augcugaaggugagugcagugcuuugugugugugcagcggcauggugcucucaguccuuggcugccgcugccgcuguagccgccgcagguggacggucagauggaggcaacuuccuggaugauaagcaguggcuaacaacuaucucucaguaugauaaggaagucggccaauggaauaaguuucgagacgaaguugaagacgauuauuuuaggaccuggagcccuggaaagccguuugaccaagcucuggaccccgccaaagacccaugccuaaagaugaaauguucuaggcauaaagugugcauugcucaagauucccaaaccgccgugugcauuagucauagauag

SEQ ID NO: 248516 - RNA, 942 nt, Artificial Sequence
  Description of Artificial Sequence: Synthetic coding sequence
augcucaaggucucagcuguacugugugugugugcugcagccuggugcucacagucucuugccgccgccgcugccguugcagcugcuggagggagaucugacggaggcaauuuucuggacgacaaacaaugguugaccacaauuucccaguaugauaaagagguggggcaguggaauaaguuccgggacgacgacuacuuuaggacuuggucaccuggaaagccuuuugaucaggcacuggaucccgcuaaggauccaugucucaaaaugaaauguucucgacauaaagucuguauagcacaggacucucagacagccguaugcaucucgcaccgaagauuaacccaucgcaugaaggaagcuggaguggaccauagacaguggcggggaccaauuuuaagcacaugcaagcagugcccuguuguuuaccccucuccagucuguggcucagacggccacaccuauuccuuccaaugcaaacuggaauaccaagccugugucuuagggaagcaaauuaguguaaaaugugagggucauugcccaugccccucagauaagccuacuucuacaucaaggaacgugaaaagagcaugcagugaucucgaguuucgcgagguggcgaaucguuugcgcgacugguuuaaggcucuucaugagagcggaagccagaauaagaaaaccaaaacucugcugcgcccagagcgaucccgcuucgacacuagcauccuuccuauuugcaaagauucacucgguuggauguuuaaucgguuagauacuaacuaugaccugcuguuagaucagucugagcugcguaguaucuaucuggacaagaacgagcaaugcaccaaagccuucuucaacagcugcgacacguacaaggacucucugauaagcaacaaugaauggugcuacugcuuucagcgucaacaggguaagagauag

SEQ ID NO: 248517 - RNA, 1017 nt, Artificial Sequence
  Description of Artificial Sequence: Synthetic coding sequence
auguugaagguuuccgccguccuaugugugugcgcugcagccugguguucucagucccucgccgccgccgccgcuguugccgcagccggagggagaucugauggaggcaauuucuuagaugacaagcaguggcugacaaccauuucgcaguaugauaaagaggugggucaguggaacaaauucagagacugcaaguuagaauaccaggccugcguucugggcaaacagaucagugugaagugcgaaggucacugccccugcccauccgacaagcccaccaguaccucacgcaacgugaagcgggcuuguagcgauuuggaguuucgggaagucgcuaaucgacugcgcgacugguuuaaggcacuccacgagucagggucacagaauaaaaaaaccaagacacugcucagaccugagcgaucuagauucgauaccuccauuuuaccaaucuguaaagauucacugggcuggauguucaaccgacuagacacuaacuacgaucuccuccucgaucagucugagcugagauccauuuaccuggacaagaaugaacaguguacaaaggccuucuuuaacagcugcgauacuuacaaggacucucuaauuagcaauaacgagugguguuacuguuuccaacgacagcaagauccgccaugccagaccgaacuuuccaauauccagaagcgccagggcgugaagaaauugcuggggcaguauaucccccuaugugacgaggacggcuauuacaaacccacucagugucauggcucggugggucaaugcugguguguggaucgauacgguaacgagguuaugggaucacgaauaaacggaguggcagauugcgccaucgacuuugagauuagcggugauuucgcuaguggcgacuuccaugaguggacagaugaugaagacgaugaggaugacaucaugaaugacgaagacgaaauagaggacgacgacgaagacgagggugacgacgacgauggaggugaugaccacgauguuuacauuuag

SEQ ID NO: 248518 - RNA, 1023 nt, Artificial Sequence
  Description of Artificial Sequence: Synthetic coding sequence
augauaaauaacgggaguccccagagccuguccaugacacggaagucugacaguggaaccaacagcgaaacgaugaaggaagccggcguagaccacagacaauggcgcgggccaauacugagcaccugcaagcaaugcccagucguauacccauccccaguaugcgguagcgauggccacacauacaguuuucaguguaaguuagaguaccaggccugugugcuugggaagcagaucagcgucaaaugcgaaggacauugcccuuguccuucugauaaaccaacaagcacaagccgaaauguaaaacgggccuguucagauuuggaauuucgagaaguggccaauagacugagggacugguuuaaagccuugcacgaaaguggaucgcagaauaagaagacgaagacucuccugcggccagaacgaagucgguuugauaccagcauucugccuaucugcaaagauagccugggcuggauguucaacagacucgacacaaacuaugaccugcuguuagaccaaucagaguuaagaagcauauaccuggacaaaaaugaacagugcacaaaagcuuucuucaauuccugugacaccuacaaggauucccuaauuucuaacaacgaauggugcuauugcuuccaaaggcaacaagauccuccaugucagacugaauuaaguaacauccaaaagcggcagggugugaaaaaacugcugggccaguauauaccuuuaugugacgaagauggcuacuauaagccuacucagugccauggcucugucggacagugcuggugugucgaucgauacgggaaugaggugauggguuccagaauaaacggcguagcagacugcgcgaucgacuuugagauuuccggugauuuugccaguggcgauuuccacgaguggaccgacgaugaggaugacgaggacgacauuaugaacgacgaggaugagaucgaagacgaugacgaagaugagggugaugacgacgacgguggggacgaucacgauguguacauauag

SEQ ID NO: 248519 - RNA, 915 nt, Artificial Sequence
  Description of Artificial Sequence: Synthetic coding sequence
augaaguguuccagacacaagguguguauagcucaagauucacagacugcagucuguauuucccaccggcgcuugacgcauaggaugaaggaagcuggcguggaucacagacaguggcgagguccuauucuaaguacuugcaagcagugcccggucguuuacccauccccagucugcgggagcgacggacacacuuauucuuuccaauguaaacuggaguaccaggcuuguguucucggaaagcaaauuucuguuaaaugugaaggacacugccccugcccaagcgacaaacccacaagcaccucccggaacgugaaaagaggcuucgacaccagcauccuccccaucugcaaggacucccugggauggauguuuaaccgucucgauacgaauuacgaccuucuguuagaccaguccgaauugcgauccaucuaucuggacaagaacgagcaguguacaaaggcguucuucaacucgugugauacuuacaaagauagccugaucagcaauaaugaguggugcuacugcuuccagaggcagcaagacccaccaugccaaacagaacugucuaauauccaaaagcgccagggugucaagaagcuccugggccaguauaucccccucugugacgaggacggauacuauaaaccaacacaaugucauggcuccgucggccagugcugguguguagacagguacgggaaugaaguaaugggcagccgcauaaauggaguggcagacugugcgauugacuuugagaucucuggugauuuugcaucuggugacuuccacgaauggaccgacgacgaggaugacgaagaugacauuaugaaugacgaggaugaaaucgaggacgacgaugaagacgaaggagacgaugacgauggcggcgaugaccaugaugucuacauuuag

SEQ ID NO: 248520 - RNA, 951 nt, Artificial Sequence
  Description of Artificial Sequence: Synthetic coding sequence
augaaagaagcgggcguggaucaccgacaguggcgggggccaauacucuccacauguaagcaaugccccgugguguaccccagucccgugugcggauccgauggccauaccuauucuuuccaaugcaaacuggaauaucaggccugcguuuuaggaaagcaaauaagcgugaaaugcgaaggacacugucccugucccucugauaagcccacauccacaagucgcaacguuaaacgcgccuguuccgauuuggaguucagggaaguggcaaaccgguugagggauugguuuaaggcccuucacgagagcggcagucagaacaagaagacaaagacccugcuuagaccagagcgcucccgcuuugacacaaguauauugccaauauguaaagauagcuugggguggauguucaacaggcuggauacaaauuaugauuuacugcuggaucagucggagcugcggaguauauacuuggacaagaacgagcagugcacgaaggccuuuuucaacaguugcgacaccuauaaagacucucugauuagcaauaaugagugguguuacugcuuucagcgucagcaggacccacccugccagacggagcucuccaacauucagaaacggcaaggcguuaaaaaguuguugggccaguauaucccucugugugaugaggauggauauuauaagccuacucagugccacggauccgugggccaguguuggugcgucgacagauacgguaaugaagucaugggcuccagaauaaacggaguugccgacugugccauugauuucgagauuagcggagacuuugcaagcggagauuuccacgaauggaccgaugacgaggacgaugaagacgacauaaugaacgaugaggaugagaucgaagacgaugacgaggacgagggcgaugaugaugacggcggagaugaccaugacguuuauauuuag

SEQ ID NO: 248521 - RNA, 1017 nt, Artificial Sequence
  Description of Artificial Sequence: Synthetic coding sequence
auguuaaaggugucugccgugcugugugugugugccgccgccugguguucucagucccuggcugcugccgcugcgguggccgccgccgguggccgaucagauggaggaaauuuucuugaugacaagcagugguuaaccacuauuucucaguaugauaaggaaguugggcaauggaacaaguuuagagauuguaaguuggaguaccaggcuugcgugcucgggaagcagaucagugucaagugugagggucacugucccuguccauccgauaagccuacuaguaccagccguaauguaaaacgggcauguucugacuuggaauuuagagagguggcuaaccggcuacgcgauugguuuaaggcacugcaugagucgggcucccagaacaaaaaaaccaagacauuauuaagaccagagaggagccgguucgauacauccauucugccuauuugcaaagacucccugggauggauguuuaaucggcuggauaccaacuaugaucucuugcuggaccagucagaauuaagaucuauauacuuagacaaaaaugaacaguguacaaaggcguucuucaacuccugugauaccuacaaggauagcuuaauuucuaacaacgaaugguguuacugcuuucagcgacaacaagacccccccugccagaccgaacugagcaauauucagaagagacagggggucaagaaguuguuaggacaguacaucccgcugugugacgaggacggcuacuauaaaccaacacagugucaugguucuguuggacaguguugguguguagaucgguacgggaaugagguuaugggcucuagaauaaauggcguggcggauugcgccaucgauuucgaaauuagcggcgauuuugccucaggagacuuccacgaguggaccgaugacgaggacgacgaagacgacaucaugaacgacgaagaugaaaucgaggaugacgacgaggaugaaggagaugacgacgauggaggggacgaucacgacguguauauuuag

SEQ ID NO: 248522 - RNA, 2409 nt, Artificial Sequence
  Description of Artificial Sequence: Synthetic coding sequence
augcucggagcucgcgccuggcuggggcgcgucuuguugcugccucgggcaggugcuggccucgcggcaucucggagauguccgggcgucuggccccgaaccuggccucaccgcaguccaagccgcggcagcucuucuagggacaaagaccgcuccgccaccgucagcucuucugucccuaugcccgcaggaggcaagggcagucacccuucaagcacaccacagcgcguucccaaucguuuaauucaugagaagucuccauaccugcuacagcaugcuuacaacccuguagauugguaccccuggggacaagaagcuuucgacaaggcaaggaaagagaacaaacccaucuuccugucuguuggcuacucaacaugucacuggugucauaugauggaggaggaaaguuuccaaaaugaggagaucgggaggcugcugucagaggacuucgucucagugaaaguggacagggaggaacgcccugauguggacaagguuuacaugaccuucguccaagcaaccucaucuggcggcggcuggcccaugaacguauggcuuacgccaaaucugcagcccuuuguuggaggcaccuacuuucccccagaagacggacugacucgggucggauucaggacagugcugcuucguauacgcgagcaauggaaacagaacaagaacacucuacuggagaauagucagagagugacaacagcacuucucgcgcggagcgagaucaguguaggugacagacaguugcccccuucugccgcgacagucaacaaccggugcuuccaacagcuggacgagggcuacgaugaagaauacggaggauuugccgaagcuccaaaauucccaacuccagugauacuguccuuccuuuucuccuacuggcucucacauagacucacucaggacggaucccgagcucaacagauggcucugcacacucugaagaugauggccaacggugggauuagggaccacguugggcagggcuuccaucgauacagcacugaccgccaguggcacgucccacauuuugaaaagaugcuguaugaccaggcccagcuagcugucgcuuacucgcaggccuuucaacuuagcggggacgaguuuuacuccgacguggccaaggguauucuucaguacguugcgcgcucucuaucucaucgaagcggcgguuuuuacuccgccgaggacgcagacucuccacccgagagaggccagcgacccaaggaaggggccuauuacguguggacugucaaagaagugcagcagcuucugccugagccgguccuuggggccaccgagccucugacaucuggucaacuccucaugaaacacuacggccugacagaagcugggaauauuucgccaagccaggaccccaaaggcgaacuccagggccagaacgugcuuacgguacgcuacagccucgagcucaccgcagcgcgcuucgggcucgauguagaggcuguccguacacuguugaacagcggucuagaaaaguuguuucaggcgagaaagcauaggccuaagccucauuuggacucuaaaaugcucgccgccuggaacggacugauggugagcggauaugcugucacaggcgcaguccugggacaggacagguugaucaacuacgcaaccaauggggccaaauuccuuaaaaggcacauguuugauguagcauccgggcgguugaugcggacuuguuauaccgguccaggcgguacaguugaacacuccaaucccccauguuggggauuuuuagaagauuaugccuucgugguuaggggguugcucgaccuuuaugaagccucacaggaaucugccuggcucgaaugggcacucagacugcaggacacacaagauaaacuguuuugggacucccagggcggaggguauuucugcucagaagccgaauuaggugcggggcugccuuuacggcucaaggaugaccaggauggcgcugagccaucggccaacuccgucagcgcccauaaucugcuccgguugcacggcuucacaggacacaaagacuggauggacaagugcguaugcuuacucacggccuuuucggagcggaugagaagagugccugucgcccugccugaaaugguucgcgcucucagcgcucagcaacaaacuuugaagcagauugugauuuguggcgaucgccaggccaaagauacuaaagcucugguccagugcguccacuccgucuauauccccaauaaaguacuuauccucgcggacggugaccccuccucauucuugucacgccagcugccuuuccuguccacacugagaagacucgaggaucaggcaacagccuauguuugcgaaaaccaagccugcuccguuccuauuaccgauccuugcgagcugcggaagcugcuccacccuuag

SEQ ID NO: 248523 - RNA, 1377 nt, Artificial Sequence
  Description of Artificial Sequence: Synthetic coding sequence
auggacgggucccggcgagugagagccacaucuguacucccuagauauggccccccuugccucuucaaggggcauuuguccaccaaaaguaacgccuuuuguacugauagcucuagccuucggcucaguacucuccaguuagugaagaaucacauggccguucacuauaacaagauucuuucugccaaagcagcagucgacugcuccgugcccguaagcguaucgacaaguauuaaauacgcugaucagcaacgucgugaaaaacugaaaaaggaacuugcacaaugcgagaaggaauuuaaacuuaccaaaacagcuaugagagcaaauuauaaaaacaauuccaagucccuauucaauacccugcagaagccuuccggagagccccagauagaagaugauaugcucaaggaggagaugaauggauucucaagcuucgcccgaagccucgucccuagcagugagcgacugcacuuaagucugcacaaaucuucaaaggucaucacuaacggcccagagaaaaacagcaguuccagccccucaaguguagacuacgcugccuccggucccaggaaacuaucaagcggggcacuuuacggcagaagaccuagaaguacuuucccaaacagccaucgcuuccaacucgugauuucaaaggcccccuccggggaccuccucgauaagcauuccgaguuguucuccaauaagcagcuccccuuuacaccgagaacuuuaaaaaccgaagcgaaaagcuuucuuagccaauauagauacuacacccccgcuaagcggaagaaggacuucaccgaccaaagaaucgaagcugagacccagaccgaacugaguuucaaguccgaacugggcacggcggagacuaaaaauaugacagacuccgagaugaauauuaagcaggccaguaauuguguaacguacgacgcuaaggagaaaaucgcucccuugccauuggaaggccacgacuccacgugggacgagaucaaggaugacgcuuuacagcacagcucgccuagggccaugugccaauacucccugaaaccccccucaacccggaagauuuauucggaugaagaggagcuauuguaccugucauucauugaagauguaaccgacgaaauucuuaagcucgggcuguuuucgaaucgguuucuugaacgacuguucgaaagacacaucaaacagaacaaacaccuugaagaagagaagaugaggcacuuacugcacguuuuaaaggucgaccuggguugcaccucagaagaaaacuccuucagcuccgugaagggcgauaauaaccaugacauggagcuaaguacacuuaagaucauggagaugagcauagaggacuguccccuggacguguag

SEQ ID NO: 248524 - RNA, 990 nt, Artificial Sequence
  Description of Artificial Sequence: Synthetic coding sequence
augguuagcaaaucacgguggaaguuacuugcuaugcuggcuuuagugcugguagucauggugugguauucgaucuccagggaggauaguuuuuacuuucccauccccgaaaaaaaggagccaugucugcagggggaagccgaaaguaaagcaagcaagcucuuugguaauuauaguagggaccaaccgauauuucugcgcuuagaagauuacuuuugggucaagaccccuucagcuuaugagcugccauaugguacuaagggcuccgaagaccuccuucuccggguguuggcgauuaccuccucaagcaucccuaaaaacauucaaaguuuaagaugcagaaggugcguuguggugggaaacggacauagacucaggaacagcucucuuggcgacgcuauuaacaaguacgaugucguuauucgccugaacaaugccccuguagcuggguacgagggggacguggguuccaaaacaaccaugcgacuuuucuacccugagagugcccacuucgauccuaagguggagaacaacccugauacacuacuugucuuaguggccuucaaagcaauggauuuucauuggauagaaacuauuuugucugacaagaaacguguucggaaaggauuuuggaagcagcccccccucauaugggauguuaacccaaagcaaauaagaauccuuaaucccuuuuucauggagaucgcugcagacaagcugcucucucugccgaugcaacagccgagaaaaauuaaacaaaagccuaccaccggguuacucgcgauaacauuagcuuuacaucugugugaccuuguccauaucgcgggcuuuggcuacccugacgccuacaacaaaaagcagacaauucacuauuacgagcagaucacacucaagucuauggccgggagcggacauaacguuucucaggaggcucuggcgaucaagcggaugcuggagaugggagccauuaagaaucugaccagcuuuuag

SEQ ID NO: 248525 - RNA, 744 nt, Artificial Sequence
  Description of Artificial Sequence: Synthetic coding sequence
auguuacagaacagugcuguucugcuugugcugguuauaagugcaagcgccacacaugaagccgaacagaacgauucuguaagcccacggaaaucacgggucgccgcucaaaauagcgccgaagucguuagaugucucaauuccgcacuacagguuggaugcggcgccuucgcuugucuagagaauuccaccugcgauaccgacgguauguaugacaucugcaagagcuuccuuuacagcgcagccaaauucgacacccagggcaaagcuuuugugaaagaaagucugaaaugcaucgcgaacggggucacguccaaggucuuucucgcaauuaggagaugcuccacuuuccagcgcaugaucgcugagguacaggaggagugcuacuccaaacuuaacgucugcucgaucgcaaagaggaacccagaagccaucacagaagucguccaacugccuaaucacuuuagcaacagauacuacaauagacucgugaggucuuugcuggagugcgacgaagauacuguaagcacuauucgggauucucugauggagaagauuggccccaacauggcguccuuguuucacauucugcagacugaucacugcgcccaaacucacccaagagccgauuucaaccgucguaggaccaaugaaccucaaaaacugaagguucuacuacgcaaccuucgaggggaagaagacucucccagccauauaaagcggaccagccaugaguccgccuag

SEQ ID NO: 248526 - RNA, 537 nt, Artificial Sequence
  Description of Artificial Sequence: Synthetic coding sequence
auguacgauaucugcaaaaguuuucuguacagugcugcaaaguucgacacccagggaaaagcauuugugaaagagagccugaagugcauugcgaacggagugacaaguaagguguuucucgccauacgaagguguaguacauuccagaggaugaucgccgaggugcaggaagaaugcuauucuaaacugaacguuuguucaauugcaaaacggaauccagaagcaauuaccgagguggugcagcuaccuaaccacuucucuaaucgguauuacaaucgucucgugcggagccugcucgagugcgacgaagacaccgugagcacaauaagagacaguuuaauggaaaaaauugguccgaacauggcuagccuguuucacauacuccagaccgaccacugcgcacagacccacccccgcgcggacuucaauagaaggcgcaccaaugaaccccagaaacuuaaagugcuacugcgaaaccugcggggcgaagaagauagcccgucucacauuaagagaacaagccaugagucugcauag

SEQ ID NO: 248527 - RNA, 537 nt, Artificial Sequence
  Description of Artificial Sequence: Synthetic coding sequence
auguacgauauuugcaaaucauuucucuauucugccgccaaguuugacacccaggggaaggcauucgugaaagaaucacugaaguguauugcuaauggaguaacaagcaaaguguuucucgccauacgccgcuguucuaccuuccaacggaugauugcugaagugcaagaggaaugcuauucuaaacucaauguguguucuaucgccaaaagaaacccggaggccaucaccgaagucgugcaguugccgaaucacuucucaaauagguauuauaaucgacuggucaggucacugcuggagugcgacgaagauacuguuagcaccauacgagacucacugauggaaaaaauuggaccgaauauggccucacuguuccauauacuccagacagaccauugcgcccagacacauccucgagcugacuucaaucgccguaggacuaacgagccccagaagcuaaaagugcuacuccgcaaccuacggggcgaagaggacucccccagccacaucaaacgcacuucccacgaauccgcuuag

SEQ ID NO: 248528 - RNA, 705 nt, Artificial Sequence
  Description of Artificial Sequence: Synthetic coding sequence
augaaucacuugcccgaagauauggaaaaugcucuaaccggcucacagucgucucacgcuuccuugagaaacauacauuccaucaaccccacucaguuaauggcuaggaucgagucauacgaagggcgggaaaaaaaggggaucuccgauguucgaaggaccuuuugucuauucgugacuuucgaucuguuauucguaacuuuacuuuggaucaucgagcugaacguaaacggugguaucgaaaacacacuggaaaaggagguaaugcaguaugacuacuauuccucuuacuuugacauauuccugcuggcuguguuccgguuuaaagugcucauucuggcauaugccguuugucgacuucgccauuggugggccaucgcucugacgacugcuguuaccucugcuuuccugcuagcgaaggugauucugucaaaacuguucagccagggagcuuucggcuauguccuccccaucauauccuuuauucuggcguggaucgagacaugguuccuggacuuuaaggugcugccucaagaggccgaggaagagaaccgccugcuuaucguacaggaugccuccgagcgcgccgcauugauucccggaggccugagugacgggcaauuuuauucacccccugaaucugaggccgggucagaggaggcagaagagaaacaagauagcgaaaagccucuccucgagcucuag

SEQ ID NO: 248529 - RNA, 1935 nt, Artificial Sequence
  Description of Artificial Sequence: Synthetic coding sequence
auggacgauaucgcggaucgcaugaggauggacgcaggcgagguuacacuggugaaccacaacucugucuuuaagacccacuuacucccgcagaccggauucccugaggaucagcugucccucucagaccaacagauucuuucuucucgacagggccaccucgaccgguccuuuaccugcagcacccgcagugcugccuacaauccuucuuacuauagcgacaauccuucuagcgacuccuuucugggaagcggggaccuaagaacauuuggacagagcgcaaaugggcaguggagaaacucuacaccaucuucaucuaguucccuucagaagucccgcaauuccagaagccuguaccucgaaaccaggaaaacuuccagcggauugaguaacucauucgcaggcaaaagcaaucaccauugccauguaagugccuaugagaagucauuuccuauuaaaccaguacccuccccaucaugguccgggagcugcaggcgcucgcugcuaagccccaagaagacccagagaagacacguaucaacugcagaagaaacaguccaggaagaagagcgcgagaucuaccggcagcuccugcagauggugaccggaaaacaauucaccaucgccaaacccacaacucacuucccauugcacuugucuagaugccucucauccucaaagaauacucugaaggauagucuguuuaaaaauggaaacuccugcgccagccagaucaucgggagugauacgaguaguucagggucagccucaauucucaccaaccaggaacagcuuucucauagcgucuacucccugucuuccuacaccccagacguugccuucgguucuaaggauucagggacccuucaccauccccaucaucaccacuccguaccacaucagccagauaaucucgcagcgucgaauacucaauccgaaggcucagacagugucauccucuuaaaggugaaagauagccaaacuccgaccccaucuagcacguucuuucaggcagagcuuuggauuaaagagcucacuagcguauacgacuccagggcaagagaacgacuacgccagauagaggaacagaaggcccuugcccuacagcuccagaaccagaggcuacaggagagggaacacucugugcacgauagcguggagcugcaccuacgggugcccuuggagaaagagauuccugucaccguggugcaagagacccagaaaaaaggccauaaacugaccgacagcgaggacgaguuuccagagaucacugaagagauggaaaaggagaucaagaacguguucagaaauggcaaucaggacgaaguucugagugaggcuuuccgacugaccauuacccgcaaagacauacagacuuugaaucacuuaaauuggcugaacgacgagauuauuaacuuuuauaugaacaugcucauggagcgcagcaaagagaaaggccugcccagcguucacgcguuuaacacauucuuuuucaccaagcugaagacugcugguuaucaggcggucaagagauggaccaaaaaaguggaugucuucucuguggauauucuucugguccccauacaccugggggugcacuggugucucgccgucgucgacuuccggaagaaaaauauaacauacuaugauucuaugggcggcaucaacaaugaggccugucggauccuccugcaguaucugaaacaggagagcaucgacaaaaagagaaaagaguucgauacaaacggcuggcagcuuuucuccaaaaagagucaggaaauuccucagcagaugaacgguucagacuguggcauguuugccuguaaguacgcugauuguaucaccaaggaucgaccuaucaacuucacucaacagcacaugcccuauuucaggaaaaggaugguaugggagauucuucaccgaaagcugcuauag

SEQ ID NO: 248530 - RNA, 1281 nt, Artificial Sequence
  Description of Artificial Sequence: Synthetic coding sequence
augguccucucuguuccuguaaucgcacucggcgcaacccugggcacagcaacaagcauccuggcacucugcggcguaaccugccugugucgccacaugcaccccaaaaagggucugcugccucgagaccaagacccugaccuagagaaagcaaagccuucacuccuggguagugcacagcaguuuaaugugaagaagagcaccgagcccgugcaaccacgagcacucuuaaaauuccccgacaucuacggcccacgcccagccgucacagcccccgaggugauuaacuaugccgauuauucguugcgcucgacggaggagcccacagcaccugcgucaccccagccuccuaacgacucgagacugaagaggcaggugacagaagaacuguuuauauuaccacagaauggaguuguagaagauguaugugugauggaaacguggaauccagagaaggcugccucauggaaucaggcccccaaauugcauuauugccucgauuaugacugccagaaggcagaguuguucguuacucgauuagaggcugugacauccaaccacgacggcgggugugacuguuacgugcaaggcuccguugcuaaccgcaccggguccguggaggcucagacugcacugaaaaaacggcaacuccauacaaccugggaagaaggauuagugcugccacucgcagaggaagagcugcccacagcuacccugacucugacacugcguaccugugaccgcuuuucccgucacucugucgccggcgaacugaggcugggcuuagacggaacaucagugccucuaggggcugcccaguggggcgagcugaagaccagcgccaaggagccgagugcaggagccggagagguucugcuuucuaucucauaucugccagccgccaauagacuacugguggugcugauaaaagccaaaaaucugcauaguaaccaaucaaaggaacuccuuggcaaagaugugucugugaaggugacauugaaacaccaggccaggaagcuuaaaaaaaaacagaccaaacgugcaaagcauaaaauuaauccagucuggaacgagaugaucauguuugaguuaccagaugaccugcugcaagccuccucaguugagcuugaaguucuaggucaggaugauuccggccagucgugugcccugggacacugcucccucggucugcauaccuccggcucagagcgaucccacugggaggaaaugcugaagaacccucgccgucagauugccauguggcaucaguuacaucuuuag

SEQ ID NO: 248531 - RNA, 234 nt, Artificial Sequence
  Description of Artificial Sequence: Synthetic coding sequence
augagcgucgcuuucguuccagauuggcugaggggcaaagcugaagugaaccaagagacaauucaacgucuacuagaagagaacgaccaguuaauucguugcauuguggaguaccagaacaaggggagggguaaugaauguguucaguaccagcauguuuuacaccgcaaucugauuuauuuggccacaauugccgaugcaucacccaccuccacaucuaaggccauggaauag

SEQ ID NO: 248532 - RNA, 366 nt, Artificial Sequence
  Description of Artificial Sequence: Synthetic coding sequence
augagaauuaugcugcuauucacugcuauccucgccuucucucuggcccagucauucggggcgguaugcaaagaaccucaggaagagguaguuccggguggcggaagguccaaaagagauccugaccuauaccaauuacuucaacgacuguuuaaaucacacuccagccucgagggacucuugaaggcgcugucacaggcuuccacagaccccaaggaaucuaccagcccagaaaaacgcgacaugcacgauuucuucgucggccuuaugggcaaaagaagcguucaaccugauagcccuacggacgucaaccaggagaacgugccaagcuucggaauccugaaauacccuccacgagcugaguag

SEQ ID NO: 248533 - RNA, 366 nt, Artificial Sequence
  Description of Artificial Sequence: Synthetic coding sequence
augcgaauuaugcuacuauuuacagccauccuagccuucucacucgcucaaagcuuuggugccguauguaaagagccucaggaggaggucgugcccggaggcggccgauccaaaagagaucccgaccucuaucaauugcuacaaagacuguucaaaucacacucuagucuggaggggcuccugaaagcucuuagucaggcuagcacugacccuaaggagucgaccucaccugaaaaacgcgacaugcacgacuucuuugugggccucaugggcaagagaucuguacagccagacaguccuaccgaugugaaucaagaaaacgucccuagcuucgguauccuuaaauauccuccaagagcugaauag

SEQ ID NO: 248534 - RNA, 312 nt, Artificial Sequence
  Description of Artificial Sequence: Synthetic coding sequence
augcggaucaugcuacuauucacggccaucuuggcauucucacuggcacaaucuuucggcgccguguguaaagaaccucaagaggaggugguaccuggcggcggacguuccaagagagaccccgaccuuuaucagcuccuacaaaggcucuuuaagucccauagcucgcuagaaggccuacucaaagcauugucacaggcuucuaccgacccuaaggaaucaaccucucccgagaagcauucuccaaccgacgucaaucaagaaaacgugcccucguuuggaauauugaaguacccuccgagagcugaauag

SEQ ID NO: 248535 - RNA, 366 nt, Artificial Sequence
  Description of Artificial Sequence: Synthetic coding sequence
augcggauaauguugcuguuuacagccauccuggccuuuuccuuggcacagucauucggagcugucuguaaagaaccucaagaggagguggucccuggcgguggaaggaguaaacgcgauccggaccuuuaccaauugcugcaacggcuguuuaagagucacucaagucuggaaggacugcugaaggcauugucacaggcauccacugaccccaaagagagcacaagccccgaaaagagggauaugcacgauuuuuuuguuggccucauggguaaaagguccguccaaccagacucaccuacggaugugaaccaggaaaauguucccuccuuuggaaucuugaaguaccccccucgcgcggaguag

SEQ ID NO: 248536 - RNA, 4866 nt, Artificial Sequence
  Description of Artificial Sequence: Synthetic coding sequence
auggaguggguguuggccgaagcgcugcucucgcagagucgugauccaagagcccuauugggagcucucugucaaggcgaagcaucugccgagcgcguugagacucugcguuuucugcugcagagauuagaagaugaagaggccaggggaucaggaggugccggagcccuaccggaggccgcaagagagguugccgccggcuaucugguuccucuguugcgcucacugcgggggaggccagcgggcggccccgaccccagccuccagccacgccauagacggaggguauuaagagcugcuggcgcagcgcugcgguccugugugcgacuggcgggccgcccacaguuggccgcagcauuagcugaggaagcauugcgcgaucugcuggcugguuggagagcuccuggcgcagaggcugcaguugagguacuggccgcgguuggaccgugucugcgcccacgugaggacgggccccugcuugaaagaguggccggaacagccguggcacuggcccugggaggcgguggugacggcgacgaggccggcccagccgaagacgcugccgcccugguggccggacgccuacugccaguucucguucaguguggcggcgcagcgcugcgagccguguggggcggacuggcugccccaggcgcuucucugggcuccgguagaguagaggaaaagcuacugguuuugagugcguuggcagagaaacuucugcccgagcccggcggugauagggccaggggugcuagggaagcuggcccagacgcuaggagauguuggagauuuuggcggacuguucaagccggccucggccaggcugaugcccuaacgagaaagagggcacgguaccuguuacagagggcagucgaggugagcgcugaacugggagcugauuguacuugcggcccucaagaaggcaacggacccagccucuuuuggugguccgaacggaaaaaggacgaacuccugaaauucugggagaauuacauacucaucauggagacacucgagggaaaucagauccacgugaucaagcccgugcuuccaaagcugaacaaccuuuucgaauacgcgguaagugaagagaacggaugcuggcucuuccauccaagcuggcauaugugcauauauaaacgaauguucgagagcgagaacaaaauucuaucuaaggagggagucauucacuuucuugaacuauaugaaacaaaaaucuugcccuucagccccgaauuuucagaauucauuaucgggccgcugauggacgcucuuucagaaagcucacuauacucuagaucucccggacagccaauuggcuccugcuccccacuggggcugaaauugcagaaauuucuggucacuuacaucagccucuugccggaggaaauuaagucuucuuuccugcugaaauucauuagaaagaugaccuccagacauuggugcgcgguacccauucuguuccucagcaaggcucuggcaaacgugccaaggcacaaagcucucgggaucgacgggcuccuugcgcuuagagaugugauacacuguaccaugaucacgcaccaaauucugcuccgcggggccgcucaauguuaccuguuacagaccgcgaugaaucuacuggacguugaaaagguuagucucuccgacgugucuaccuuccugaugagccucagacaagaggagucacuggggaggggaacuucccuguggaccgaacucugcgauuggcugagggugaaugagucguauuuuaaacccuccccgaccugcuccucaaucggucuccacaaaacaucucucaacgccuacgugaaauccaucguccaggaguacgugaaaucuucugcuugggagacaggcgagaauugcuucaugcccgacugguuugaagcuaaauuagugucucugaugguucuucuggcagucgacguggaggggaugaagacccaguauagcggaaaacagcgcacugaaaacguccucagaauauuucucgacccgcugcuggacguguuaaugaaauuuuccacuaacgcuuacaugccucuguugaagaccgacaggugccugcagcuccugcuuaaguuauugaauacaugucgauuaaaagggaguagcgcucaggacgacgagguaagcacugugcugcagaauuucuucauguccacuacugaguccaucucugaguuuauccugcgccgucugaccaugaacgaauuaaauagcgugagugacuuagaucgcugucaucuuuaccugaugguguugaccgaauugauaaaccuccaccucaagguaggcuggaaaagaggaaacccuaucuggagagugauuagccugcugaagaacgcuaguauucaacaucuucaggagauggauucuggccaagagcccacagugggaucccaaauacaaagggucgugucuauggccgcacucgccauggugugugaagccaucgaccagaagccugagcugcagcuggauucucugcacgcggggccccuggaaaguuuucucucaucuuuacagcugaaucagacacugcagaaaccucaugccgaagagcaguccaguuaugcgcauccacuggaauguagcagcgugcuggaagaaucaucaucuucacagggguggggaaaaaucguggcccaguacauucaugaucaguggguuugucugucuuuuuugcugaaaaaguaccacacccugauccccacaacagggagugaaauccuggagccauuccuuccggcagugcagaugccaauucgaacacugcagucagcgcuggaggcccugacagugcugucaucugaccaagugcuuccuguuuuccacugccugaaagugcuggucccuaaacugcugaccucaagugaaagccuuuguaucgagucuuuugacauggcauggaaaauuaucucuucucugagcaauacucagcuuaucuuuugggccaaccucaaggccuuuguacaauucguuuucgacaacaaggugcuuacgauugcugcaaagauuaaaggccaagcauauuucaaaaucaaagaaauuauguauaagaucauugagauguccgccaucaaaaccgggguauuuaacacgcugaucaguuauugcugucagucauggaucgugagcgccucaaacgugagccaggguagcuuaucgucagcuaaaaauuauucugaauugauacuugaggcuuguaucuucgggaccgucuuucgaagggaccagaggcugguacaggacguccagacguuuaucgaaaaccugggccacgacugcgcugcaaauauugugauggagaacacuaagagagaggaucacuauguucgcaucugcgcagugaaauuucugugucugcucgauggaaguaauaugagccauaagcuguuuauugaagaucuggcaauaaagcuauuggauaaagacgagcuuguaagcaaaucaaaaaaaagauacuaugucaauucccugcaacacaggguuaaaaauagaguguggcaaacauuacucgucuuguucccucggcuggaccaaaauuuccucaauggaaucauugacagaauuuuccaagccggguuuacaaacaaccaggccucaauuaaauacuucauugaauggauuauuauucucauccugcacaaguucccucaguuccugccgaaguucugggacuguuucuccuacggagaagagaaccuaaaaacaucaaucugcaccuuccuagccgucuuaagucaucuagacauaauuacacagaauaucccugagaagaaacuuauacuuaagcaagcccucaucgucguguugcaguggugcuuuaaucacaauuuuagcguuaggcucuaugcucugguagcgcugaagaaacuguggacagucuguaagguccugucaguggaagaauucgaugcgcucacuccugugauagaguccagccuacaucaaguugaaagcaugcacggagccggcaaugcgaaaaagaauuggcaacguauacaagagcacuucuucuuugccacauuucacccccuaaaagacuauugccuggagaccauuuucuacauacugccccgccugucuggacucauugaggacgaauggauuaccauugacaaauuuacccgauucacugauguuccucucgcagccggcuuccaaugguauuugucccagacccaacucucuaagcugaaacccggcgacuggucucaacaggauauaggaaccaaucugguagaggcggacaaccaagcugaauggaccgacgugcagaagaaaaucauaccauggaauagucgcguauccgaucucgauuuggaguugcucuuucaggaucgggccgcaaggcucggaaaaucaauuagcaggcugaucgugguugcuucucuaauugacaagcccacaaaucuaggcggccucugcaggacgugcgagguguucggagcuagcgugcuggugguggguucgcugcagugcauaucagacaaacaauuucaacauuugucagugucggcagagcaauggcuaccccuaguggaagucaagccaccccagcuuauugacuaucuccagcagaagaaaaccgagggguacacuauaaucggggucgagcagacggccaagucucuagacuuaacgcaguacugcuucccugaaaagucguuacuccuccucgggaaugaaagggagggcauaccugcaaauuugauccagcagcuggacgucugcgucgaaauaccucagcaagggaucauccguucuuugaaugugcaugucaguggugcucuccucauuugggaauacacuagacagcaguuacuaucgcauggggauacaaagccuuag

SEQ ID NO: 248537 - RNA, 759 nt, Artificial Sequence
  Description of Artificial Sequence: Synthetic coding sequence
auggguguucuuuugacacagcgcacacugcuuucccucguucucgcccugcuuuuccccaguauggccaguauggcugccauagggucuuguucaaaggaguaucgcguguugcucggucaguuacagaagcagaccgaccucaugcaggacacaagcagauuacuagacccauacauccgcauucagggacucgacgugcccaaacugcgggagcauugucgcgaaaggcccggcgcuuuuccuagugaggaaacacugcgggggcugggacgacgcggauuccuccagacauugaaugcuacucucggcugcguucugcaucgcuuggcugauuuagaacagagguugccgaaggcacaggaccuggagagaagcggucucaauaucgaagauuuggagaagcuccagauggcucgccccaauauucugggacuaaggaauaacauuuacugcauggcccaguuacuggauaauucugauaccgccgagccuacgaaagccgguagaggagccucucagccaccaaccccuacuccugcaucagacgcuuuccagcgaaaacucgagggcugccgcuuucugcacggauaucacagauucaugcauuccguggggaggguauuuucuaaguggggugaaucacccaaucggucgaggagacauucgccccaccaagcacuucgcaaaggcgugagacggacuagacccaguagaaaaggaaagagacugaugaccaggggccagcugccccguuag

SEQ ID NO: 248538 - RNA, 2049 nt, Artificial Sequence
  Description of Artificial Sequence: Synthetic coding sequence
augugccccgggcuauacccguacuccagucuacuugaauaugggcgguccaugaucauuuacgaacaggaaggcgucuacauccauaguaguugugguaagacuaacgaccaagacggacuuaucuccgggauccugagagugcuggagaaagaugcggaagugaucguagacuggaggccgcuugacgaugcucuugacucuuccagcauuuuauaugccagaaaggacagcuccuccgucguagaauggacucaggcccccaaagagcgaggacaccgagguucugaacaccuaaacucauaugaagcggaaugggacauggugaauacuguaucauucaagcgaaagccucauacaaacggggaugcgccuagucaccgcaacgguaaguccaaguggagcuuucuguuuucuuugacugaccugaaaaguaucaaacaaaacaaggagggcaugggauggucuuaccucguuuucugucugaaggacgacguggugcugcccgccuugcacuuccaccaaggugacucuaaguugcugaucgaaucccucgaaaaguaugucguccugugugagucaccccaggacaagagaacauugcuggucaauugccagaacaaaagccugagucagaguuuugaaaaucugcuggacgaaccugccuaugggcugauucaaaagaucaagaaggaucccuacacugcaaccaugaucgguuucucuaaggucacaaacuacauuuucgauucuuuaagaggcuccgauccuucuacccaucagagaccacccagugaaauggcugacuuccuuucagaugcuauacccggccugaagauaaaccagcaggaagaacccggauucgaggucauuacucgcauagacuugggcgagcguccuguggugcagagaagggaaccuguauccuuggaagaauggacaaaaaauaucgacucagaggguagaauuuuaaacguugauaacaugaaacaaaugaucuuccgcggcggccugucucaugcgcugcgcaaacaggcuuggaaauuccuguugggcuacuucccuugggauucaaccaaagaggagcgcacacaacugcagaaacagaagacagacgaauacuuccguaugaagcugcaguggaagagcaucucacaggaacaagagaaaagaaauagcaggcugagagauuacagaagcuugaucgagaaggacguaaauaggaccgauagaaccaauaaauucuaugaggggcaggacaacccugggcugauuuuacuccaugauauccugaugacauacuguauguaugacuucgaucuuggcuaugugcaggggaugucagaucuccuuucuccucugcuguacguaauggagaacgagguggacgccuuuuggugcuuugccucauauauggaucagaugcaucaaaauuuugaggaacagaugcagggaaugaagacucagcugauccagcuaucaacacugcuucgcuuacuagacaguggauucugcucuuaccucgagucucaagauaguggguaccucuacuuuugcuuuagguggcuccucauacgcuucaagcgugaguucuccuuccuugacauacuuaggcucugggaggugauguggaccgagcuuccuugcacuaauuuucacuugcugcucuguugcgccauucuggaaucugagaaacagcaaauuauggaaaaacacuacggguucaaugagauacucaaacauaucaacgaacugagcaugaagaucgaugucgaggacauccuaugcaaggcugaggcuaucucccuucagauggugaaaugcaaagaacugccccaagccgugugugaaauucucggacugcaggggagcgaagugacuacucccgacucagaugugggcgaggaugaaaacguuguuaugaccccaugcccaacgucugcuuuccaguccaaugcccuuccgacacuguccgccucuggggcccgaaaugacucaccaacacagauucccgugucuucugauguguguagacugacucccgccuag

SEQ ID NO: 248539 - RNA, 1338 nt, Artificial Sequence
  Description of Artificial Sequence: Synthetic coding sequence
augaucggcuucuccaagguaacaaauuauauuuucgauagccuuagaggaagugacccuaguacacaucaaaggccaccaagcgagauggccgauuuucugucugaugccauuccuggccuuaaaaucaaccaacaggaagaaccaggauuugaggugauuacucgcaucgaucugggugagagacccgucguucagagaagagaaccugugucccuugaagaauggacuaagaacauugacagcgagggucgaauucugaacguggacaacaugaagcagaugauuuuucgaggcggguuaucucaugccuuacggaaacaagcauggaaauuuuugcucgguuauuuuccaugggacaguaccaaggaagagagaacucagcuacagaaacagaaaaccgacgaguacuuucgaaugaaacugcaguggaagagcauuagccaagaacaggaaaaacgaaauucacgauuacgugacuacagaagucugauugaaaaggauguaaaucgcacagauagaaccaauaaguuuuaugagggacaggacaauccuggccugauccuccuucacgacauccugaugacuuacuguauguacgacuuugaucugggguacguccaggguaugagcgaccucuugucacccuuauuauacgugauggaaaaugagguggacgcauuuuggugcuucgcuuccuacauggaucaaaugcaccagaauuuugaggagcaaaugcaaggcaugaaaacccagcucauccagcuuagcacacugcuccgucuacuggacucaggcuucugcucauauuuagagucucaggacagcgguuaccuguauuucugcuuuagauggcugcugauucguuuuaaacgcgaguucaguuuucuggacauucugagacuaugggaaguaauguggacagagcucccuugcaccaacuuucaccugcuucuguguugcgccauccuggaaucagagaagcagcagaucauggagaagcacuacggauucaacgagauauugaaacacaucaacgaguuaaguaugaagauugacgucgaggacauacuaugcaaggcagaagcaaucucucugcagauggucaagugcaaagaacuaccucaggcuguuugcgaaauucuuggacugcagggauccgaggugacuacccccgauucugacgugggcgaagaugaaaauguugugaugaccccauguccaacaagcgcauuucagucaaaugcacugccgacacuuuccgcuagcggggcacgcaacgacucuccgacccagauuccugugagcucugacgucuguagauugaccccugccuag

SEQ ID NO: 248540 - RNA, 2025 nt, Artificial Sequence
  Description of Artificial Sequence: Synthetic coding sequence
auggcagcugcaggcgugguuucagguaagaucaucuacgagcaggaaggcguguacauccauagcucaugcggaaaaaccaaugaucaagacggccucauaucuggaauccugcgaguguuagagaaggacgcagagguuaucguggacuggcggccccuggacgacgcgcuggacucaucaucaauucucuaugcccguaaagacaguuccuccgugguagaguggacucaggcgcccaaggagagaggucauagaggcucagaacaccuuaacaguuaugaggcugagugggauaugguaaacacaguguccuucaagcgaaagccccacaccaacggagaugcgccaucacacagaaauggcaagagcaaguggagcuuccuguuuucuuugacagaucugaagagcauuaagcagaacaaggaagggaugggauggucuuauuugguguuuugcuuaaaagaugaugugguccugcccgcccugcauuuucaucagggcgauucuaaacuccucaucgaaagccuggaaaaguacguuguacugugugaauccccacaagacaagagaacacugcugguaaauugucagaauaaaucucugagccaaucauuugagaaccugcuugacgagccugcauauggccuuauucaaaagauuaaaaaagauccuuauaccgcaacaaugauaggcuucucaaaagugaccaacuauauuuuugacagucuaagaggauccgacccauccacccaucagcgcccaccgucugagauggccgacuuccugagugaugccauucccggccuuaagauuaaccaacaagaagaaccaggauuugaagugauaacgaggauugaucucggagaaaggccggucguccagcgcagggaaccagugucgcuggaagaguggacaaagaacauugacucagaggggcgcauccugaacguggauaacaugaagcaaaugauuuuuagagggggccuuagccacgcccuaagaaaacaagccuggaaguuccugcugggguacuuuccaugggauaguaccaaggaagagcgcacucagcugcaaaaacagaaaaccgacgaguacuuuaggaugaaguugcaguggaaaaguaucucgcaagagcaggaaaaacggaauucaagguuaagggauuaucgaucucucauagaaaaagacguaaaccgcacugacagaaccaauaaguucuacgaaggucaggacaauccuggcuuaauucuucuccacgacauucugaugacuuacugcauguacgauuuugaucugggauacguccaaggaaugagcgauuuguuauccccucuauuguauguuauggagaaugagguggacgccuuuuggugcuucgccuccuauauggaucagaugcaccagaacuuugaggagcagaugcagggcaugaaaacccaauuaauccagcucaguacccuucugcgacuucuggauaguggguuuuguucauaucucgagucucaagauagcgguuaccucuacuucugcuuccggugguugcuuaucagguucaaaagagaauuuucauuucuggauauccuaaggcugugggaggucauguggacagaacuucccugcaccaacuuucaucugcugcucugcugugcaauccuugagagcgaaaaacaacagauaauggagaagcacuacgguuuuaacgagauucugaagcacaucaaugaacugucaaugaagaucgauguugaagacauccuguguaaggccgaggcuauuucccuccaaaugguaaaauguaaagaacugccccaggcagugugugagaucuuagggcugcaggguucagaaguaaccacaccugacuccgaugugggagaagaugaaaaugucguuaugacacccugcccaacgagcgccuuucaguccaaugcgcuccccacucucuccgccaguggggccaggaacgauucaccaacacagauaccagucucuuccgauguguguaggcugaccccagcauag

SEQ ID NO: 248541 - RNA, 2076 nt, Artificial Sequence
  Description of Artificial Sequence: Synthetic coding sequence
auggcagccgcgggaguggucagcgggaaaauuaucuaugagcaggaggggguauauauccacuccaguugcgguaagacaaacgaccaggauggacuuauuagugggauccugaggguucuugaaaaagaugcagagguaauuguggauuggcgcccucuugacgaugcgcuugauagcuccagcauccuauacgcgcgaaaagauagcagcuccgugguagaauggacacaggcacccaaggagagggggcacagagggucagaacaucucaauucauacgaagcagaaugggauauggugaacacugugucuuuuaaaaggaaaccccauacgaacggcgacgcacccucucaccgcaauggcaaauccaaauggucuuucuuauucucucugaccgaccuaaaguccaucaagcagaacaaggaggggaugggauggucuuaccuggucuucugccugaaagaugacguaguguugccagcacuccacuuccaucagggagauucuaagcuguugauugaaucacucgaaaaguacgucguguuaugugagucgccccaggacaagaggacccuucucgucaauugucaaaauaaaagccuaagccagucauuugagaaucuacuggacgaacccgcguauggccugauucaagcuggccuguuagaccggcggaaguugcugugggcuauccaccacuggaaaaagaucaaaaaggacccuuacaccgcaaccaugaucggguuuucuaaagugacuaacuacaucuucgauucauuacgcgggucugauccaagcacacaccagagacccccuucagagauggcggauuuucuguccgacgcaaucccuggacugaaaauaaaucaacaggaggagccggguuucgaggugaucaccaggaucgauuuaggggagcggccagucguccagagacgggaacccgucucucucgaagaguggacuaagaacaucgacuccgagggccgaauacuaaauguggauaauaugaagcagaugauauuucgcgggggacugucucaugcacugagaaagcaagccuggaaauuuuuauuaggauauuuucccugggauucaacuaaggaagagaggacucagcugcagaagcaaaagacagaugaguacuuuaggaugaagcuacaauggaagaguauaagccaagaacaggaaaagcgcaacucuaggcuucgugauuauaggucucugauagaaaaagauguaaauaggacugaccggacaaauaaauucuacgagggccaggacaacccuggcuuaaucuuacugcaugacauucugaugacuuacugcauguacgacuucgaccugggauauguacagggaauguccgaccucuugucaccucuauuguacgugauggagaacgaaguggaugccuuuugguguuuugccagcuacauggaccagaugcaccaaaacuuugaggagcagaugcagggaaugaagacucaacugauccagcugagcacccuccugaggcucuuagacaguggcuuuugcagcuaccuggagagccaggacucaggguacuuauacuucugcuuucgcuggcuguuaauccgauuuaagagggaauucucuuuccuagauaucuugagacucugggagguaauguggacugaacuuccuuguacaaauuuccacuugcucuuauguugcgccaucuuggagucugagaaacaacagaucauggagaaacacuauggauuuaaugagauacucaagcacaucaacgaauugaguaugaaaauugacguugaggauauccucuguaaagcugaggcuauaucucugcaaauggugaagugcaaggagcucccgcaggcugucugugagauucugggacugcagggcagugaaguuacuacucccgauuccgacgugggcgaagacgaaaauguugugaugaccccaugcccaacaucugcauuucaguccaaugcccucccaacccugucugccuccggcgcgaggaaugacucucccacccagaucccggugagcuccgaugugugcagacugaccccagcauag

SEQ ID NO: 248542 - RNA, 5514 nt, Artificial Sequence
  Description of Artificial Sequence: Synthetic coding sequence
augggagcgaugacccagcugcuggcggguguguuucuggcuuuccuggcucuggcuaccgaggguggcgugcuuaaaaaagugauccgccauaagagacaguccggugucaacgcuacauugcccgaggaaaaccagcccgugguuuucaaccacguguacaacaucaaacugccagugggcucucagugcucaguggaccucgaauccgcuaguggcgagaaggaucucgcgccuccgagcgagccuagcgagaguuuccaggaacacacuguagacggcgaaaaccagauugucuuuacgcaccgcaucaacauucccagacgagcaugcgggugcgccgcagcuccagacguuaaggaauugcucagucgccuugaggaacuggaaaaccuggugagcagccugagagaacaguguacugcuggugcugggugcugucugcagccggcaacgggaagauuagauacccguccuuucuguucuggcagaggaaacuucucaaccgaaggauguggaugcgucugcgagccuggguggaaaggcccaaauuguuccgagccugaaugcccagggaauugccauuuacgggggcgguguaucgacggacagugcaucugcgaugacggguucacaggcgaggauugcucccagcucgcuugucccagcgauuguaacgaucagggaaaaugcguaaacggcgugugcauuugcuuugaagguuacgccggagcugacugcucccgcgaaauauguccggugcccuguagcgaagagcauggcacuugcguggacgggcugugcgucugucacgacggauucgcuggugaugacugcaacaagccacugugccucaauaauugcuacaaccgggggagauguguggagaacgaaugcgucugugacgaagguuucacuggugaggauuguucggaacugauuuguccaaaugacuguuucgaucggggaaggugcaucaacggaacauguuauugugaagagggguucacaggcgaggacuguggcaagccaacuuguccgcacgcgugucauacacagggacgcugugaagagggacaaugcguuugcgacgaggguuucgccggcguugacuguucugagaagcggugccccgcugacugccacaaccgggggcggugugucgauggacggugugaaugcgacgacggcuuuaccggagcagacuguggagagcucaagugcccuaacggauguuccggacaugggcgcugcgucaacggccagugcgugugugaugagggguacacaggugaagauuguagucaauugcgguguccgaacgauugccacucaagaggacgcugcguggagggaaagugcgugugcgagcaaggauuuaagggguacgauuguuccgacaugucaugucccaaugacugccaccagcacgguaggugugugaacggcaugugcgugugcgaugacggcuacaccggcgaggauugccgcgauagacaguguccucgugauugcucuaaucggggccucuguguggauggccaguguguuugugaagacggcuuuacagggcccgacugcgcggaguuaagcugcccaaaugauugccacggccaggggagaugcgugaauggccagugcgugugccacgagggguuuauggggaaggacuguaaagaacagagaugucccagcgauugucacggccaaggccgguguguggacggccaauguauuugccacgaaggcuuuacgggacucgacugcgggcaacauuccugcccaucagacugcaacaaucucggacagugcgucucagggcgcuguauuugcaaugagggguacaguggggaggauuguucugaaguaucgccccccaaggaucuaguggugaccgaaguuacggaagagacgguuaaccucgcaugggauaaugaaaugagggugaccgaguaccuggugguuuacacccccacucaugaaggggggcuggagaugcaauuccgaguccccggcgaccagaccagcacaaucauccaggaauuagaaccuggcguugaguauuucauccgcguguucgccauacuugagaacaaaaagucuaucccaguuucugccaggguggccacuuaccugccagccccugagggccugaaguuuaagucaaucaaagagacuuccgucgaaguggaaugggauccccucgauauugccuuugagacgugggaaauaauauuuagaaauaugaacaaggaagaugagggagagaucacaaagucccucaggcggccagagacaucuuaccggcagacaggccuggcucccggacaagaauacgagauuucccuacacauagugaagaacaacacacguggacccggucucaagcgcguuaccacaacaaggcucgacgcccccagccaaaucgaggugaaagacgugaccgauacuaccgcacugaucacaugguuuaagccccucgccgagaucgacggcaucgaacucaccuauggcaucaaggacgugccaggugaccgcacuaccauugaccugacagaagaugaaaaucaguauagcauuggcaaccugaagcccgacaccgaauacgagguaaguuugauauccagaaggggggauaugucaucuaacccugccaaggaaaccuucaccaccgggcucgacgccccacguaaccuccgaagagucucccagacugauaauaguauuacauuggaauggagaaauggaaaagcugccauugacagcuacagaauaaaauaugcuccuauaaguggaggggaccacgcagaaguggacgugccaaagagccaacaagccacgaccaagaccacccuuaccggcuugcggcccggaaccgaauacggaauaggugugagcgcagugaaggaagauaaagaaucaaauccagcuacuaucaaugcagcuacugagcuagacaccccuaaggaccuccaagucagcgagacagcugagaccucccugacauuacuauggaaaaccccacuugcgaaauucgaccguuacaggcucaauuauagucuaccaaccggccagugggugggaguccagcucccuagaaauacuacaucauauguccugcgcggcuuagaaccuggccaggaguauaacguccugcuuacagccgaaaagggccggcacaaguccaagccugcaagagugaaagcaaguacugcaaaagaacccgaaaucggaaaccugaaugugucggacauaacaccggaguccuuuaaucucucuuggauggcuaccgacggcauauuugagacauuuaccaucgaaaucauagauuccaaccgacugcuugagaccguugaauauaacaucaguggggccgaaagaacggcgcacauauccggucucccacccagcacugauuucaucguuuaccugaguggccuagcuccuaguauacggacuaagacuaucagcgcaacagcgaccacugaagcucucccucucuuagaaaauuuaaccauaagcgauaucaauccuuacggguucaccgugagcuggauggcuucugaaaacgccuuugauaguuuucuggugacagucgucgacucugguaaacugcucgacccccaggaguuuacauugucugggacccaaagaaaauuggaacugagaggcuugauuaccggcaucggguacgagguuauggugucaggauuuacccagggccaucagacuaagccccugagagcagagaucgugacagaagcugaaccugaaguagauaaucuccuggucagcgaugcgacgccggauggauuucgguugucuuggacagccgaugagggcguguucgauaauuucgugcugaagauacgcgacaccaaaaagcagucggagccauuggagauuacuuuacucgcuccggaacggacaagggauauaaccggacuaagggaagcuacagaguacgaaaucgaacuguacggaaucucuaagggccggaggucacagacuguuagugcaaucgccaccaccgccaugggcucaccgaaggaggucauauucagugauauuaccgagaauagugccacuguguccuggagggcaccgacugcucagguggaaagcuuccgaaucaccuaugugccuauuacgggggggacaccuucuaugguuacuguggacggcaccaagacacagacuaggcuggugaaauugaucccuggaguggaguaccugguauccaucauagccaugaaggguuuugaagaaagcgagcccgugaguggcucguucacaacagcucuggauggcccauccggguuagucacagcaaacauuacagauagcgaagcccuggcccgguggcagccagcuauugccacugucgauucauacguuaucuccuauacaggcgagaaaguacccgaaaucacuagaacggugagugguaacacuguagaauacgcgcuuacugaccuggaacccgccacugaguacacuuuaaggauauucgcugaaaaagggccgcagaagagcuccaccaucacagcuaaauucaccaccgauuuagauucuccucgugaucucaccgcgaccgagguucaguccgaaacugcacuauugacguggcggccuccccgggcaucagugaccggauaucugcucguguaugaauccgucgauggcacggucaaggaggugauaguaggcccugauacaacauccuauagccucgccgaucuguccccaucuacacauuacaccgcuaaaauucaggcucuaaauggcccauuaaggagcaauaugauucagaccauuuuuaccaccaucggacucuuguauccuuuuccuaaggacuguucacaagccaugcugaacggugacacuaccucggggcuguacacaaucuauuugaauggagauaaggccgaggcuuuggagguguuuugcgauaugacuuccgauggcggcggcuggaucguguucuuaagaaggaaaaacggaagagagaauuucuaucaaaauuggaaagccuaugccgcaggauucggcgaucgaagagaggaguucugguugggccucgauaaucugaauaaaauuacagcccagggacaguacgaauugagaguugacuugcgugaccauggggagaccgcuuuugcaguguacgacaaauuuagcguaggcgacgcaaaaacccguuauaaacugaaaguggagggauauuccggcacagccggcgacaguauggccuaucauaauggcagaucguucaguaccuuugacaaagacacugacuccgccauuacgaacugugcgcuuuccuacaaaggagccuucugguaccgaaacugucaccgugugaaccuuaugggcagauauggugacaauaaccacagccagggcgucaacugguuccacuggaaagggcaugaacauagcauucaguucgcagaaaugaaguuaagaccgucgaacuuccgcaaccuugaagguaggaggaaacgcgcguag

SEQ ID NO: 248543 - RNA, 4695 nt, Artificial Sequence
  Description of Artificial Sequence: Synthetic coding sequence
augggggcuaugacccagcuccuggcagguguuuuucucgcguuuuuagcguuagcaaccgagggaggagugcucaaaaaggucauccggcauaagcggcagagcggcguuaaugcaacauugcccgaggaaaaucagcccguggucuucaaucauguguacaacauuaaacugccagugggaucacagugcucuguugaucuugagagcgcuaguggggagaaggacuuagcuccgcccucugagcccagcgagagcuuccaggaacacaccguugauggcgagaaccaaauuguguucacucaccgaauaaauaucccccgucgggcgugcggaugugccgcggcaccugaugugaaggaacuacugucccgucuugaagagcucgagaaccuggugagcucucuccgcgagcagugcacugccggggccggaugcugucuucagccugccacggggagacuggacacgcgaccauucugcucaggccgggguaauuuuagcacugaaggaugcgggugcguuugcgagccaggcuggaaggggccuaauugcuccgaacccgaaugccccggcaacugucaccucagagggagauguaucgacggccagugcaucugcgacgacgguuucaccggagaagauuguucccaacuagcauguccaagcgacuguaaugaucagggcaagugcguuaauggagucuguaucuguuucgaaggcuaugcuggcgccgacuguagccgcgagaucuguccugugccauguagcgaggagcauggcacuugcgucgauggauugugcgugugucaugacggauuugcaggggaugauuguaauaaaccucucugcuuaaauaacuguuacaauagggggagauguguggaaaaugagugcguuugugacgaggguuuuacuggggaggauugcuccgaacucaucuguccuaacgauugcuucgaccggggaagaugcauuaacggcacaugcuauugugaagagggauuuacaggcgaagauugcggcaagcccaccugcccgcaugcuugccauacucagggccgcugcgaagaaggucagugugugugugaugaggguuucgccggaguagauugcagcgagaagcgcugcccugccgauugucacaacaggggcagaugcguggauggaagaugcgaaugcgacgaugguuucacgggcgcagacuguggcgagcugaaauguccaaauggauguucugggcauggaagaugcgugaauggucagugcgucugcgacgaagguuacacuggcgaagauuguucucagcucagguguccuaacgauugucacucccgcgggcgcugcguggaaggaaagugcguaugugaacagggauuuaaaggcuaugauugcagcgauaugagcugccccaacgacugccaucagcauggucgaugcgugaauggcaugugugucugugaugacgguuacaccggugaagauugccgggaccggcaguguccuagagauugcagcaaucgcggccuuugcguugauggccaaugugugugugaggauggauucaccgggccagauugcgccgagcucucauguccaaacgauugccaugggcaggggcggugugucaacgggcaaugugugugccaugagggguuuauggggaaggacugcaaggagcagagguguccgagugacugucacggucagggacgcugugucgacgggcaaugcaucugccacgagggguuuacagggcucgacugcggccagcacucuuguccgucagacuguaacaaccucggucagugugucucuggccggugcauuugcaacgagggcuacagcggggaggauuguuccgaggugucaccccccaaagauuuggugguuacagaaguuaccgaggaaacugugaaccuagccugggauaacgagaugagagucacugaguaccugguuguguacacaccgacccacgaagguggacuggagaugcaguuucgagugccaggcgaccagacaucuacuauuauccaggagcuugaaccugguguggaauacuuuauucgcguguucgcgauacucgaaaacaaaaaaagcaucccaguguccgcaagagucgcaacguacuuacccgcaccugaggggcugaaauuuaaauccaucaaagagacuucaguagagguggagugggacccauuagacaucgcuuucgagacuugggagaucaucuucagaaacaugaacaaagaggaugagggcgagauuaccaagucuuuaaggagaccagagacaucauaccggcaaacaggucuugcuccaggccaggaguaugaaaucagucuccacauuguuaaaaauaauacucgaggcccagguuuaaaaaggguuacaacaacucgucuggacgcuccaucccaaauagagguaaaagacguaacagauacaacugcgcugauuacaugguuuaaaccacuggcagagauugauggaaucgaguugacauacgggaucaaagacgucccaggggaucggaccaccaucgaucucaccgaggacgaaaaucaguacaguaucggaaacuugaagccugacacugaguaugaggucucccucaucagccggcgcggggauaugucuucaaauccugcuaaggagaccuucacaacaggccuggacgcuccucgaaacuugagaagggugagucagacugacaacuccaucacauuggaguggagaaaugggaaagcagcaauugacagcuauaggauaaaguacgcuccuaucagugguggugaucacgccgagguugaugugccaaaaucacagcaagcaaccacuaaaacaacguugaccggacuucguccagguacggaauauggaauuggggucagugccgucaaggaggacaaggaguccaauccugcuacaaucaacgcagcaacagagcucgauacuccuaaggaccugcaggugucugagaccgccgaaacuucccucaccuugcuguggaagaccccccuggcuaaauucgaucgauauagacugaauuacagcuugccaaccggacaaugggugggagugcagcugccaaggaacaccaccucauacguccuacgaggccuggagccuggccaggaauauaaugugcuucugacagcugagaagggacgucacaagucuaagcccgcaagagucaaggccaguacagccaugggcagcccuaaagaagugauauucagugacauaacggaaaauucggcuacuguaucuuggcgcgccccaacagcgcagguggagagcuucagaaucacguacgucccuauuaccggggguacacccuccauggugaccguagacggcacuaagacacagaccagacucgugaagcuuaucccuggggucgaguaccuggugaguauaauagccaugaagggguucgaagaaagcgaaccggugaguggauccuuuacgacagcccuggacggccccaguggccuggucaccgcuaauauuacagauagugaagcccuggcucgguggcagcccgccauugcaaccguagacagcuaugugauaagcuacaccggggagaaggugcccgagaucacaaggaccgugucaggaaacacuguggaguacgcucucacugaccucgaaccagccaccgaauacacgcugcgaaucuucgccgaaaagggcccucaaaaaagcucuacuauuaccgccaaauucacaacugaucuugacaguccucgggauuuaacagccaccgaaguucaaagcgaaacugcccuuuuaacauggcguccacccagagcaucugugaccggauaccugcuggucuacgagagcguggaugggacagugaaggaggucauugugggccccgacacuacauccuauucccuggcggaccuaucaccuaguacucauuauacagcaaaaauucaagcccugaauggcccccugagaaguaacaugauccagacaauuuucacuacaauaggccuucuguauccauuuccaaaagauuguucacaggcaaugcugaauggggauacaaccucgggucucuacacuauuuauuuaaacggggauaaggcggaggcccuggagguuuuuugcgacaugacauccgaugggggaggauggaucguguuucuccggcgaaagaacggcagggagaacuucuaccagaauuggaaagcauaugccgccgguuucggggaucgcagagaagaauuuuggcugggacuugacaaucugaacaaaaucacugcccaaggccaguacgagcugcgcguggauuugcgagaccacggagaaacugccuucgcagucuacgauaaguuuucgguuggggacgcaaagacuagguacaagcugaaaguugagggcuauaguggaaccgccggagauuccauggccuaucauaacggacgaucguucucaaccuuugacaaggauaccgacucggcuaucacgaacugcgcgcugagcuauaaaggggccuucugguauagaaauugccaucgcgugaaccucaugggucgcuauggugacaacaaucacagccaaggcguuaauugguuucacuggaagggucaugagcauagcauucaguuugcugaaaugaaacugcggccuagcaauuucagaaaucuagagggcagaagaaagcgcgcuuag

SEQ ID NO: 248544 - RNA, 4968 nt, Artificial Sequence
  Description of Artificial Sequence: Synthetic coding sequence
augggagccaugacucaguugcuggcuggcgucuuucuggccuuuuuagcguuagccacagaagggggagugcuuaagaaggugaucagacauaagagacagaguggugugaaugccacucucccagaggagaaucagccuguuguuuucaaucacguguacaauauuaagcugccuguagggagccaauguuccguggacuuggagagcgcaagcggugaaaaagaucuggcuccccccagcgagccuucugagucuuuucaggaacacacaguggauggcgagaaccagaucguguucacccaccgcaucaauauaccuaggcgggcuugugggugcgccgcugccccagacguaaaagaguuacugaguaggcuagaggaacucgagaaccuugugucaucacuuagagagcagugcaccgccggggccgguuguugccugcagccugccaccggacggcucgacaccaggccauucugcuccgguaggggcaauuucuccacagaagguugcggauguguaugcgaacccggauggaagggcccaaacuguuccgaaccugagugcccuggcaauugccaccuucgcggcagguguauugacggccaaugcaucugugacgauggcuuuacaggggaagauuguagucagcucgcuugcccaucugauugcaacgaccagggaaagugcgugaaugguguuuguauuuguuucgagggguaugcuggcgcugauuguucccgcgagauaugcccagucccauguuccgaagaacauggaaccuguguugauggguugugcgucugucaugacggauuugccggagaugacugcaacaaaccucuguguuuaaauaacugcuacaauagaggaagguguguagaaaacgaauguguuugcgacgagggcuucacuggcgaggacuguagcgagcugauuugccccaaugauuguuucgauagaggcagguguauuaacggaaccuguuauugcgaggaaggcuuuacuggcgaagauugugggaaacccacuuguccacaugcuugccacacccagggucggugcgaagaaggacaaugcguaugugacgagggcuucgccgggguggauuguagcgaaaaaaggugcccagcagacugucacaauaggggcagguguguugacgggaggugcgaaugugacgacggguuuaccggggccgauuguggagaacucaaauguccuaacggcugcucugggcacggaagaugugugaacggccagugcguuugcgacgaggguuacaccggcgaagauugcagucagcugcgcugcccaaacgauugucacucacggggaagaugcgucgaaggcaagugcguuugugagcaaggguuuaaaggcuaugacuguucugauaugucguguccaaaugauugccaccagcaugggagauguguaaacgggaugugugugugugacgacggauauacaggugaggacugucgugaucgccaguguccccgggacugcuccaacaggggccuuuguguggauggccaaugcgucugugaggacggauuuacaggaccagacugugccgaacuguccugccccaaugacugucaugggcagggaagaugcgugaacggccagugugugugccacgagggguucauggggaaagauuguaaggaacaacgguguccgagcgacugucacggucaaggcagguguguggauggucagugcauaugucaugagggauuuacagggcucgacugcggacaacacaguuguccuucagacugcaauaacuuaggccaaugcguuucaggccgcugcauaugcaaugagggcuauuccggcgaggauuguagugaggucucaccccccaaggaccucguugucacagaggugaccgaggagaccgugaaucuagcuugggauaaugagaugcgagucacggaguacuugguaguguauacgccaacucacgagggcggcuuggagaugcaguucagaguccccggcgaucagacuuccacaauuauucaagagcuggaaccuggaguagaguauuuuauuaggguauucgcaauccucgaaaauaagaaaucuauaccagugucugcucggguggcuacuuaucugccggccccugagggccugaaguuuaaauccaucaaggagacaaguguggagguggagugggauccucuugacauagccuuugaaacuugggagauuauuuuuagaaacaugaauaaggaggacgagggggaaauuaccaaaagccugcggcguccugaaaccucuuaucgacagacaggacucgccccaggucaagaguacgagauuagccugcauaucgucaagaauaacacccgggggccagguuugaagcgugucacgacuacuagacuggaugcacccucucagauagaggucaaagacgucaccgacacaacggcucugauuaccugguucaaaccucucgcagaaaucgaugguauugaauugaccuacggaauuaaagacgucccaggggauagaaccaccauugaccuaaccgaggacgagaaccaauacaguauugguaaucucaagccagauaccgaguaugaggucucauugauuucccggagaggcgauaugucaucuaacccagcuaaggaaaccuuuaccacaggacuggaugcgccucggaaucugcgccgaguuucacagacagacaauuccaucacacuggaguggcggaacggaaaagcugcgaucgauagcuaccggaucaaauacgcucccauuucagguggggaccacgcugaagucgaugugcccaagucccagcaggccaccaccaagacuacccugacgggucuccgccccgguacagaauacggcaucggggugucugcagugaaagaagauaaagagaguaauccugcuacaaucaaugccgcuacugagcucgacaccccaaaggauuuacaggugucugagaccgcugaaacgagcuugacacugcuguggaaaaccccccuggccaaguuugauagguaccgacugaauuacucacugccuacuggccaaugggucggcgugcaguugccuaggaauacaacgucuuacguucuccguggccuagagccaggccaggaauacaacguacugcugaccgcugagaagggaagacacaagaguaagccugcucgggucaaggcaagcacugaagccgagccagagguagauaaccugcucguuuccgaugcgacaccagacgguuuccggcuuaguuggacugccgaugaagggguuuucgacaacuucguacugaagauaagagauacaaagaaacagucugagccucuagaaauuacucuccucgcuccagaaaggacccgcgauauaacuggacuacgggaggcuacugaguacgaaaucgaacuguaugggaucagcaaaggucgccgcagccaaaccgucagugccaucgcgaccacggcgauggggucccccaaggaggugauauuuucagauaucacagaaaauuccgcgacaguuucauggcgggcuccaacagcccaagucgagagcuuucggaucaccuacguccccaucaccggugggacacccaguauggucacaguggauggaaccaaaacacagaccaggcuuguuaaacugaucccaggaguggaguaucuggucucuauuaucgcuaugaagggguucgaagaguccgaacccgucagcggaucuuuuacaaccgcucuggauggcccuagcggccuugugaccgccaacauuacagacagcgaggcacuggcaagauggcagccugcuauagcaacuguagauaguuauguuauaagcuacacgggagagaaagugccugaaauuacuagaacgguguccgggaauacaguggaguaugcccugacugaucuggagcccgcaaccgaguauacucugagaauuuucgcagagaagggcccccagaagagcucuacaaucacugcuaaguuuaccacggaccucgauaguccuagggaccuuaccgcuacugagguccagucugaaaccgcacugcuaacauggagaccaccucgggccuccgugacaggcuaucugcugguguaugaauccguugacggcacagugaaggaggucaucguuggcccagacacaacuaguuauucgcuggcugaucuaucaccguccacccacuauacagcuaagauucaggcauugaacggaccacugagaucaaacaugauacagacaaucuucaccacgaucgggcuguuauacccguuuccgaaggacugcucucaagcuaugcucaauggagacacgacgucaggccuguacacuauuuacuugaauggagacaaggcagaagcgcuugaaguguucugugacaugacuagugacgguggaggauggauaguauuccuccggcgaaaaaauggccgcgaaaauuuuuaucagaacuggaaggccuaugccgccgguuucggcgaucggcgggaagaguucugguugggccuggacaacuugaacaagaucacagcucagggccaguaugaauuacggguggaccuaagagaccacggagagacugccuuugcaguguaugacaaguuuagugugggcgacgcuaagacucgauauaaacugaagguggagggauauuccggaacugccggggacaguauggcuuaucacaacggccguucauucucuacuuucgauaaggauaccgacuccgccauuacaaacugugcucugucuuauaagggugcauucugguaccgaaauugucaucgggugaaccuuaugggccgcuacggagacaacaaucauucucagggcguuaauugguuccacuggaagggacaugagcacucuauucaguuugcagagaugaaacuucgaccuagcaacuuuaggaaucuugaagggcgacgcaaacgggcuuag

SEQ ID NO: 248545 - RNA, 6606 nt, Artificial Sequence
  Description of Artificial Sequence: Synthetic coding sequence
augggcgccaugacgcagcuacuugccgggguguuucucgcuuuucucgcccuugccacugaagggggcgugcugaaaaaggugauuaggcacaaacgacagagcggggucaacgccacucugccagaagagaaccaacccguaguauucaaccacguguacaauaucaaacuucccguaggaucacaguguucgguugaucuggaauccgcauccggggaaaaggaucuugcuccgcccagugagccgucagagaguuuccaggaacacaccguugauggagagaaucaaaucguuuucacacaccgcaucaacauuccacguagagccugcgguugugccgccgcgccagauguuaaagagcuccuuagucgauuggaagaauuagaaaauuuggucuccucacugcgcgagcaauguacugccggagccggaugcugcuugcaaccugccacagggagguuagacaccaggcccuuuugcucuggacgaggaaauuucagcaccgagggcuguggaugcgucugugaacccggauggaaaggcccgaacuguagcgagcccgaaugcccugguaauugccaucugagaggucgauguaucgaugggcaguguauuugugaugauggcuucacuggcgaggauuguagucaguuggccugcccuucugauugcaaugaucagggaaagugugugaacggaguauguaucugcuuugaggguuacgcaggggccgacugcucucgggaaaucuguccagucccuuguucugaagagcacggaacauguguugauggcuugugcgugugccacgaugguuuugcaggagacgauugcaauaaaccgcugugccuuaacaauugcuacaaccggggacgcugcgucgagaaugaguguguuugcgacgagggcuuuacgggugaagacugcuccgaguugaucugcccuaacgacuguuuugaucggggccgaugcaucaaugggaccugcuauugugaagaaggguuuaccggggaagacugcggcaagcccaccugcccccaugcaugccauacacaggggcguugugaggaaggucagugugugugcgacgagggcuuugccggagucgacugcucagaaaaaaggugcccugccgacugccacaaucgaggccggugcguugacggccgcugcgaaugugaugauggauucacaggcgccgacugcggcgaacuaaaauguccuaauggauguagcggccacgggagaugcguuaacgggcagugcgugugcgaugaaggcuauaccggagaagacuguagucagcuccguuguccaaaugauugucauucgcgcggcagguguguggaagggaaaugugugugugagcaaggguuuaaaggauacgacuguuccgacauguccugucccaaugacugccaucagcacgggcggugugugaauggaaugugcgugugcgaugacggauauacgggcgaagacugucgcgaccgacaaugcccgagggauuguaguaaucgggggcuauguguugauggacagugcguuugcgaagacggguucaccgggccagauugcgcggagcucaguugcccaaacgacugucacggccagggcaggugcgugaauggacaaugugucugucacgaaggauucaugggaaaggacugcaaggagcagagaugcccaagugauugccauggccagggaaggugcguggauggccagugcaucugccacgagggcuuuaccggccuggacugcgggcagcacagcuguccuucagacugcaacaaucugggucagugugugagugggcggugcaucugcaaugagggcuacucuggagaggacugcagcgagguguccccgcccaaggaucuggucguuacagaggugacggaggaaaccgugaaucucgcuugggacaacgaaaugcgggugacugaauaucuugugguuuacaccccgacucaugaggguggccuagaaaugcaguuccgcgugcccggcgaucagacaucaaccauuauucaagagcucgagcccggcguggaguauuucauuaggguguuugcuauucuggagaauaagaaaagcauacccguuagcgcccgcguugcaacuuaucuucccgcucccgaggguuugaaguucaaguccauuaaagaaacuucaguggagguggaaugggauccucuggauaucgcauucgaaaccugggaaauuauuuuucguaauaugaauaaggaagaugagggcgagaucacaaagucccugcgaaggccugaaaccucuuauaggcagacuggacucgcucccggccaagaauaugaaauaagccuccauaucgugaagaauaauacgcgagggccaggguugaaacgcgugacuacaacccgccucgacgccccaucacagaucgagguuaaagaugugacagacaccacggcuuugauaacuugguucaagccacuggcugagaucgacgggaucgaacucacuuacgggauaaaggauguuccuggagauagaacaacgaucgaccugacagaagacgagaaucaguauaguauugggaaucucaagccagacaccgaguacgaagugucucucauuucacguaggggcgacaugucuuccaauccugcuaaagagacauucacaaccggguuagaugcuccccgcaaucugaggagagugucccagacagacaacucuauuacccuggaguggcguaaugguaaagcugccauugacagcuaccgaaucaaguacgcaccaaucagcgguggcgaccaugccgaagucgaugugccaaagucccagcaggcgacaacuaagacgacgcuuaccggccucaggccaggcacagaguacgguauugggguguccgccgugaaagaagacaaggaaucuaaucccgcaacuauuaaugcugcaacagaauuagauaccccuaaagaucugcagguguccgagaccgccgaaacaucgcuuacacugcuguggaaaacgccucucgccaaguuugacagauacagacucaacuacucgcuccccacaggacaauggguaggcgugcagcuuccccggaauacuacuucuuacgugcuccggggucuggagccaggucaagaauauaauguacuacucaccgccgaaaaaggacgacauaaguccaaacccgcgagaguuaaggcuuccacagaacaagccccugagcuggaaaaccugaccgugacagagguuggcugggacggccuuagauugaauuggaccgcugccgaccaggcuuacgagcauuuuaucauacaaguucaggaagcuaauaaaguggaggccgcccggaaucugacugugccugguagccugcgagcuguggauaucccagggcugaaagccgccaccccauauacaguuuccauuuauggugucauccagggguaccgcacacccgugcuuuccgcagaagcgaguaccggcgaaacccccaaucugggggaaguugugguagcagaaguaggaugggacgcguugaagcucaauuggacagcuccugaaggcgcauacgaguacuuuuucauacaagugcaggaagcggauacuguagaggcugcccagaaccucacgguuccaggagggcugaggucgacagaucucccaggcuuaaaagcugccacccauuacaccaucacaauccgaggggugacccaggauuucagcacaacucccuuaucuguggaagugcugaccgaggaaguacccgacauggggaaccuuacugugacagaggucucaugggacgccuugcgccugaauuggacaacacccgaugguacuuacgaucaguucaccauccagguucaggaagcugaucagguugaagaggcucauaaccugacugucccuggaagcuugcgaucuauggaaaucccuggguugcgcgcaggaaccccguacacugugacccugcacggagaagugagggggcacuccacgcguccgcuugcuguugagguagugacagaggaccuuccacagcugggagaucuggccgucuccgagguggguugggacggucugagauugaauuggacagcggccgauaaugccuaugagcacuucguuauacaggugcaagaagugaauaaggucgaggcugcacagaaucugacucuuccugguaguuugcgggcuguggauauuccgggccuggaagccgcuacccccuaccgugucucuaucuacggaguuaucagaggguaccgcacucccguuuuaucagcugaagcuuccaccgcaaaggagccugagaucgggaaccuuaauguaucggacaucacaccggaaucuuucaaccucuccuggauggcaacugacgggauauucgagaccuucacgauugagauuaucgacucaaauagacugcuggagacuguggaauauaauaucaguggagcugaacguacugcacacauuagcggccuuccaccuucuaccgacuuuauuguguaccugagcggacucgcaccauccauccguacuaagaccauuagcgcuacugccaccaccgaagcucuuccgcuccucgagaaccucacuauaucugauaucaacccuuaugguuucacagugaguuggauggccagugaaaacgcauucgacuccuuccucgugacugugguugauagcggaaaacuacuggauccucaggaauuuacucugucaggcacucagcgcaaguuggagcuuagaggacucauuacuggaaucggauacgaagucaugguauccggauuuacacagggucaucaaaccaagccacuccgcgcagagaucguaacagaggccgagcccgaaguggauaauuugcuggugucagacgcuacccccgacgguuucagacuuuccuggacagcugacgaaggaguuuuugauaauuucguacucaaaauucgggauaccaaaaagcaauccgaaccccuggaaauaacucugcuggcucccgagcggacacgggacaucacuggccuccgggaggcaacugaauaugagauagaauuauacggcaucagcaagggcagaaggucccagacaguuuccgccauagcuacaacagccaugggauccccuaaagaggugauauuuucugacaucacugaaaacuccgccacugucucauggagagccccaacggcucagguugagagcuucaggauaacauacgugccuauuaccggagguacacccucaauggucacuguggacggcaccaagacccagacccgguugguaaaacucauuccgggugucgaguaucuggugucuauuaucgcuaugaagggcuucgaagaaucagaaccaguguccggauccuuuacuaccgcgcucgacggaccguccggcuuagugaccgccaacaucacggacagcgaagcacuggcaagauggcagccugcuaucgccacuguggacagcuacgugaucagcuauaccggcgaaaaagucccagagauuacaagaacaguaaguggaaauaccguggaguaugcucugaccgaccucgagccagccacugaguauacccugagaauuuucgccgaaaaagggccucagaaaaguucaacgaucacugccaaguuuacaaccgaucuggauuccccaagggaccucacagcuaccgaagugcagagcgaaacagcccucuugaccuggaggccaccacgggcuucagugaccggguaccugcugguguaugaauccguugauggaaccguuaaggaggucaucguuggaccugacacaacgucguacucacuggcugaucugagcccaucaacccauuacacagcaaaaauccaggcccuuaacgguccucugagaaguaauaugauucagacuaucuuuacuacuauuggguuacuauauccuuuccccaaagauugcagucaagccaugcuuaacggcgacacgaccuccgggcuauacacuaucuacuugaauggugauaaggcagaggcccuggaggucuucugcgauaugacuucggaugggggaggcuggauugucuuucugcggagaaaaaauggucgagagaacuucuaucagaacuggaaggccuaugcugccggcuuuggcgaucgaagggaagaguucuggcugggccuggauaauuugaacaaaauuacagcgcagggacaguaugaacugcggguagaccugcgggaccauggagagaccgccuucgcgguguacgacaaguucagugugggugacgcuaagacccgguacaaauuaaagguggaaggcuacagugguacggcaggcgacucuauggcauaccauaaugggagaucauucucuacauuugacaaggacaccgauucagccaucaccaacugugccuugaguuacaaaggcgcauuuugguaucgaaauugucaucgugugaaucuuauggggagguacggggauaacaaccacucucaaggugugaacugguuccauuggaagggucacgaacauuccauccaguucgcugagaugaagcugcggcccaguaacuuccgaaaucuugagggccgccgcaagcgagcuuag

SEQ ID NO: 248546 - RNA, 3240 nt, Artificial Sequence
  Description of Artificial Sequence: Synthetic coding sequence
augggcgcaaugacccagcugcuugccgggguguuuuuagcguuccuagcccuggcaacagagggggggguacuuaaaaaaguaauuagacacaagaggcagucaggcguuaaugcuacauuaccagaggagaaucagcccgugguguuuaaucacguguauaauaucaaacuccccguaggaucacagugcucagucgaucuggaaucagccucaggcgaaaaagauuuagcccccccauccgaaccuucugaaucauuccaagagcacacgguggacggggaaaaccaaaucguguucacccaucgcaucaacaucccuagacgagccugcggcugugcggcugcccccgaugugaaggaacuacuaagccgacucgaagagcucgagaaccucgugagcagccuccgagaacagugcaccgccggugcaggcugcugccuucaacccgcaaccggucggcuagauacucgcccauuuugcucuggucggggaaacuuuaguaccgaggguugcggcuguguaugugaaccgggguggaaaggaccaaauuguucugagccggagugcccuggaaacugucaccugcggggccggugcauugacgggcagugcauuugugaugacggcuuuacaggcgaggacuguagucaauuagcaugccccagugauugcaaugaucagggcaagugugugaauggagucuguaucugcuuugaaggcuaugccggugccgauugcagucgggagaucugcccagugcccugcuccgaggagcaugguacuugcguggacggacucugcgugugucaugacggguuugcgggagacgacuguaauaagccauuauguuugaacaacuguuauaaucgagggaggugcgucgaaaacgagugugugugcgacgaaggauuuaccggggaagacuguucggagcugauuugcccgaaugacugcuuugaucgcggccgcuguauuaauggaacauguuacugugaagagggcuucaccggggaagauugcggcaaaccaacauguccgcaugccugucacacacagggacgaugcgaagaagggcagugugugugcgacgaaggcuucgcagggguagacuguucggagaagagaugucccgcagauugucacaauagagggcgaugcguggacggaagaugcgaaugcgaugaugguuuuacaggggcugacugcggcgaacuaaagugccccaacggcuguucuggccacgggcggugcguuaauggacagugugugugcgacgagggguauaccggagaggacugcagucagcuucgaugucccaaugacugucauaguagaggccgcuguguggaggguaagugcgugugcgaacaaggguucaaaggguacgacuguuccgacaugagcuguccgaacgauugucaucagcacggucgcugcguaaauggaaugugcguaugugacgacggcuacacaggcgaggacugucgagaccgccagugcccccgagacuguuccaaucgcgggcuuuguguggacgggcagugugugugugaagauggcuucacuggacccgauugugccgaacugucaugcccaaaugauugccacggucagggacgcugcgugaacggacagugcgugugccacgaaggcuuuaugggaaaggauuguaaagaacagcgaugccccagugacugccacggacaggggcgcugugucgauggccaguguauuugccaugagggcuuuaccggucuugacugcggacagcacagcugcccguccgauugcaauaaucuuggacaaugcgucaguggcagaugcauaugcaaugaaggcuauagcggcgaggacugcucggaagugucaccuccaaaggaccugguggucacagaggucaccgaggaaaccgugaaccuagccugggauaaugaaaugcgcguuaccgaguaucuggugguguacaccccuacccacgaaggaggauuggaaaugcaguucagggugccuggggaucagacuucuaccaucauccaggaacuggagcccggcguugaguacuuuauaagagucuucgccauacuggagaauaagaaaagcauuccugucagcgcaaggguggccaccuaccucccugcuccugagggacugaaguuuaaaagcauuaaggaaacgaguguggaaguggagugggacccccucgauauugcguucgagacaugggaaaucaucuucaggaacaugaacaaggaggacgaaggggagaucacaaaguccuuaaggagaccugagacuucuuaccgacaaacaggauuggcacccgggcaggaguacgagauaucacugcacauaguuaagaacaacacccgggguccggggcugaaacgcguaacuacaaccagacuugaugcuccaagccagauugaaguuaaggacgugacagacacuaccgccuugauaacgugguuuaaaccccucgcagagauugacggcaucgagcuaacuuauggaauuaaggacgugccuggagaccguacuaccauagaucugaccgaagaugagaaccaguacucuauagggaaccugaaaccggacacagaguaugagguaucucugaucucucgccgcggagauaugaguuccaauccugcuaaagaaaccuuuacaaccggccuugacgccccacguaaucugcggagagucagccagaccgauaacaguauuacgcuggaauggaggaacggcaaagcggcuauugauucuuaucggaucaaauacgcacccaucuccggcggugaccacgccgagguugacgucccuaagagucaacaggcuacgacaaaaaccauuacagcuaaauuuacaacagaccuggauagcccucgcgauuuaacggccacagaggugcaaagcgagaccgccuugcucacuuggaggcccccccgagccucaguaaccggauaccugcugguauacgaaucagucgacggcacgguuaaggagguuaucgucggaccugacacaacaucauauucucuagcagaucugucgccuccuucuuuauuccugcacuucauacagcagaagccagaaaagcaauauuguuuccacuuuaaggauaugauaaacaucauaaauauuauuaugaugaugaugaugaugaaaacaaaggacuuuucucgagaucugucuuuccagaacaucaguggccaguaccuuauaguauucuucuuuuag

SEQ ID NO: 248547 - RNA, 279 nt, Artificial Sequence
  Description of Artificial Sequence: Synthetic coding sequence
augggugcaaugacacagcuuuuggcaggcguuuuucucgcguuccuagccuuggcgaccgaagggggaguccuuaagaaagugauccgacacaaaagacagucuggcguuaaugcaacacucccugaggagaaccaaccaguggucuucaaccacguauauaauaucaagcugccagugggaucccaaugcuccguggaucuggaaucugcuucaggggagaaagaccuggcgccgccuucagagccaucugaauccuuccaggaacauaccgucuag

SEQ ID NO: 248548 - RNA, 5241 nt, Artificial Sequence
  Description of Artificial Sequence: Synthetic coding sequence
augggcgcuaugacacagcuguuagcaggcguguuucuggcauuuuuggcucuggccaccgaaggugguguacuuaagaaggugauuagacacaaaaggcagagcgguguuaacgccacccuccccgaagaaaaccagcccgucguguucaaccauguguacaacaucaagcucccgguggguucccagugcucaguggacuuggaauccgcaucaggcgaaaaagaccuugcuccucccucagagcccagcgagagcuuucaagagcacacagucgauggagaaaaccagaucguguucacacacaggaucaacauuccacggcgggccugcgggugugccgccgcccccgauguaaaggaacuucugaguagacucgaggaacuggagaaccuggucagcucauuaagggagcaguguaccgcuggcgccgggugcugccuucagccagccacuggccgacuggauaccaggccauucuguuccggccgcgggaacuuuuccacugaaggcugcgggugcguuugugaaccgggauggaaaggaccaaauugcagugaacccgaguguccgggcaauugucaccugagaggccgguguauagacgggcagugcauuugcgaugauggcuuuaccggagaagauugcucgcagcucgccuguccuucugacugcaaugaucagggcaaaugcgucaacggcguguguauuugcuuugagggauacgcgggagccgacugcaguagggaaauuugcccaguucccugcuccgaagagcacgguacauguguugauggccuguguguuugucacgacgguuucgccggcgacgauugcaacaagccgcugugucugaauaacugcuauaaccgcggccggugcguugagaaugagugcgucugcgaugagggguuuacuggggaagauugcucagagcugaucugucccaaugauugcuucgauaggggaaggugcauaaaugggacaugcuauugugaagagggauucacuggagaagauugcggcaagccuaccuguccucaugccugccacacacaagggagaugcgaggaaggccagugugugugcgaugagggguuugcgggaguagacuguagcgaaaaacggugcccagccgauugucacaaucgcgguagaugcguggacggaagaugugagugugaugacggguuuaccggagcagauuguggugagcugaaaugcccaaacggcugcucuggccauggucgaugcguaaauggucagugcgugugugaugagggguauacgggcgaggauugcucucaacugagaugcccaaacgacugccacaguagagggaggugcguugaggguaagugugugugugagcaaggauuuaagggauaugauuguagugacaugucgugcccuaacgacugccaucagcacggccgauguguaaaugguaugugcgugugcgacgauggauacacaggcgaagacuguagggacagacaguguccaagggacugcuccaauagaggguuauguguggacggccaguguguuugcgaggauggguucaccggcccugauugugccgaacuguccugcccaaaugauugccauggucagggaagguguguuaacggccagugcgugugccaugaaggcuuuauggguaaagacuguaaggaacagcgguguccuagugauugucacgggcaggggcgaugcgucgacgggcaguguauuugccacgaggguuucacuggauuagauugcggacagcauagcugcccauccgacuguaauaaucugggacagugcgugagcggaaggugcauaugcaacgaaggcuauucuggugaggauuguucggaggugucuccgcccaaagaucuagucguuacagaagucacagaggaaacugugaaccuugcaugggacaacgaaaugagagugacugaguaccuagugguauacacgcccacacaugaggggggcuuggagaugcaguuuagaguuccuggggaccagacauccaccauuauucaggaacuggagccuggaguggaauauuucauacggguuuucgccauccuggagaacaagaagaguaucccugucagcgcgaggguggccaccuaucuccccgcccccgaaggcuuaaaguucaagucgauuaaagagacuucuguggagguggagugggacccacucgauauugccuucgagacaugggagauuaucuucagaaauaugaacaaggaagacgagggugagaucaccaagagccuuagacggccggaaaccaguuaccgccagacaggccuggcgccuggccaagaguacgaaaucagucugcacauuguaaagaauaacacccgggggccaggacugaagcgcguuacgaccaccagacuggacgcuccaagucagauugaggucaaggauguuaccgauaccacagcauugaucaccugguuuaagccacuggcugagauagauggaauagaacugacuuauggcauaaaagauguuccuggcgacagaaccaccauagacuuaaccgaagacgagaaucaguacagcaucggcaaccucaagccugacacggaguacgagguuucacugauaucucggcgaggcgauaugucuuccaauccggccaaagagacauucaccacaggucuugacgcuccaaggaaucugaggagggugucacagacggauaauuccauuacccuugaauggagaaaugggaaggcugcuaucgacaguuaccgcauuaaauacgcccccauuagcgggggagaucacgcugagguggacgugcccaaaucccaacaggcaacaaccaaaaccacucugacgggucugcgccccggcacugaauauggcaucggggugucugccgugaaggaagacaaggagaguaauccagcuaccaucaacgcagccaccgaacucgacacuccaaaagaucuacaggucucagagacagccgagacuucccugacacuguuauggaagaccccucuugccaaauucgaccgcuauagacucaauuacucuuugccuaccggccagugggucggcguccaacuuccuaggaauacuacgagcuaugugcuacggggacuggaacccggccaggaguacaacgugcugcuuacugccgagaagggaagacauaagucaaaaccagcucgggucaaggccucaacugcuaaggaaccagagaucgggaauuugaacgugucagauauuacuccugaguccuuuaaucuaucuuggauggccacagacggaauauuugaaacuuuuacaaucgagaucauagacucaaauagauugcuugagacuguugaguacaacauuuccggcgcggagagaacagcucacaucucgggcuuaccacccucuacugauuucauugucuaucucucaggccuagcgccgucgauccgcaccaaaacgauauccgccacugccacgaccgaggcugagcccgaaguggauaaucuuuuaguuucugacgccacuccugacggcuuuagauuaucuuggacggccgacgaaggugucuuugacaacuuuguccugaaaauuagggauacaaagaagcagagugagccucuagagauaacccugcuggcuccugagagaacucgcgacaucacaggucugcgagaggccacugaauacgagauugagcuuuacggcauaaguaagggccgucguucgcagaccgugagcgcgauugccaccacggcuauggggucuccuaaagaagucaucuucagugacauuacggagaauucugcaaccgugucauggagggcuccaacggcccagguagaaagcuuucggauaaccuaugugccaaucacuggaggaaccccuuccauggugacuguggacggaacuaaaacucaaaccaggcugguuaagcuuaucccagguguggaauaccuggugucuaucaucgcaaugaaagguuuugaagaaagcgaacccguaucaggguccuuuacuaccgcacucgacggaccuagcggcuuggugacagcuaauauaacugauucagaggcuuuggcccgguggcaaccugcgaucgccacaguagacucuuacguuauaucuuauacgggggagaaaguuccggagaucacucggacuguuucagguaacacggucgaauacgcucugacggauuuagaacccgcuacagaauacacccugagaaucuucgccgaaaaaggaccucaaaaaaguucaacgaucaccgcaaaguucacuacagaccuggauucccccagggaccuuaccgccacagagguucagagcgagaccgcauuacugacauggaggccuccccgggccucggugacuggauaccugcugguuuacgagucugucgacgggaccgugaaggaggugauagugggcccagauacaacaaguuauucacuugcugaccuguccccaagcacucauuacaccgccaaaauucaggcucuuaauggcccccugagaucgaacaugauacagaccauauucaccacuaucggacugcuguaccccuucccgaaagauuguagccaggcgauguugaacggagacacaacgucuggucucuacaccauuuaucugaacggcgauaaagcggaggcucuggagguguucugcgacaugaccuccgaugggggcggcuggaucguuuucuugagacgcaaaaauggccgggagaacuuuuaucaaaauuggaaagcuuacgccgccgguuucggcgaccgcagggaagaguuuuggcuagggcuggacaaccucaauaaaaucacugcccaaggacaauacgaacugcgaguugaucuucgagaccacggcgaaacagcguuugcugucuaugacaaguucucagugggggaugccaagaccagauacaaacugaaggucgagggauacucaggcaccgcaggagacaguauggccuaucauaauggacggaguuuuagcacauuugauaaggauacagacagcgcgaucaccaauugcgcccugagcuauaaaggcgccuuuugguaccggaacugucaccgcgugaaccugauggggagauauggagauaacaaccacagucagggcguaaacugguuucacuggaaaggucacgagcauuccauacaguuugcugaaaugaaacugaggcccaguaauuuuaggaaccuagaggggaggagaaagagagccuag

SEQ ID NO: 248549 - RNA, 5517 nt, Artificial Sequence
  Description of Artificial Sequence: Synthetic coding sequence
augggcgcuaugacucaguugcuagcuggaguuuuccucgcauuucuugcacucgcgaccgagggagguguacugaaaaaagugaucagacauaagaggcaguccggcgugaaugcaacuuugcccgaggagaaucaaccggugguguucaaccauguauauaacauuaagcuuccugucggcucccagugcucuguggaccuagaauccgcauccggagagaaggaccuggcccccccgucugagccaagugaauccuuucaggagcacaccguggauggagagaaccagaucguuuucacccaccgaaucaauauaccucggcgggcaugcggcugcgccgccgccccagaugugaaggaguugcugucucgucuggaagagcucgagaaccucgugucuucgcuucgagaacaaugcacugcaggagcggggugcuguuugcagccugcaacuggacggcucgauacccgcccauuuuguagcggacgagguaauuuuagcacugagggcugugggugcgugugcgagcccggcuggaagggccccaacuguagcgaaccagaaugucccggcaacugucaccuccgggguagguguauugacggacaaugcauuugugaugauggguucacaggcgaggauugcucgcagcucgccuguccauccgauugcaaugaucagggcaaaugugugaacggaguguguaucugcuucgagggauaugcuggggccgacugcucacgagagaucugcccagugcccugcuccgaagaacauggaaccugugucgacggcuugugcguuugccacgauggauuugcuggggaugacugcaacaagccacucugccugaauaacugcuacaaccggggacggugcguugaaaaugaaugugucugcgaugagggcuuuacuggggaggacugcagcgagcugauuuguccuaacgauuguuucgaucguggccguugcaucaaugggacauguuauugcgaggaaggauucaccggggaagacugcgggaagccgacuuguccccaugcgugccacacacaaggaagaugcgaggaaggccagugcgugugcgaugaaggauucgcgggcguugauuguuccgagaaacgaugccccgcggauugucacaauagaggucgcugcgucgacggcaggugugaaugugacgaugguuuuacaggcgcagauugcggcgagcugaaauguccuaacggauguucuggccauggucgcugugugaacggacagugugugugcgacgagggcuauacgggcgaagacugcagccaacucagaugcccaaacgacugccacagcagaggacgguguguugaaggaaaaugcguuugcgagcaggguuuuaagggauacgauugcuccgauaugucuugcccaaaugacugucaccaacauggacgguguguaaauggcaugugugugugcgacgacggguauacaggcgaggacugucgcgaccgccaaugcccgcgggacuguuccaaucggggacuguguguggauggacagugugugugcgaagacgguuuuaccgggcccgacugcgcagagcugucuuguccuaacgauugccacgggcaggggcguugcgucaacggccagugugugugccaugaaggcuucauggguaaggacuguaaggaacaaaggugccccuccgauugucaugggcaggggagaugcgucgaugggcaaugcauuugccaugagggauuuaccggguuggacugcggccagcauucuugcccaucugacuguaacaaccucggucaauguguguccggucgcuguaucugcaacgagggcuacagcggcgaggacugcagcgaagugucaccgcccaaggaucuggucguuacggagguuaccgaggagacugugaaccuugcaugggacaaugagaugagggugacggaguaccuugucguguacacuccgacucacgaaggcggccucgagaugcaguucagagugccuggagaucagacgagcaccauuauacaggaacuugagcccggagucgaguauuuuaucagagucuucgccauucucgagaacaaaaaaucaauaccugucagugcccgcgucgccacauacuugccagcgccagagggccucaaguuuaagucuauaaaagagaccaguguggagguagagugggaucccuuggacauugccuucgaaaccugggaaauaauuuuucguaauaugaauaaggaagacgaaggcgagaucacgaagucccuacgcagaccugaaaccucauaucggcaaacuggguuagccccuggccaggaguaugaaaucuccuugcacauuguuaagaauaacacucguggcccagggcucaagaggguaacaacaacaagauuagacgcccccucucagaucgaaguaaaggacguuacugauaccacugcacucaucacuugguuuaagccccuggcugaaauugacgguauugagcucacguauggaauaaaggauguccccggcgacaggacgacgauugaucuuacugaagacgaaaaccaguacaguauugggaacuugaaaccagacaccgaguaugagguguccuuaaucagccgccgcggcgauauguccuccaacccagcaaaggagacuuucaccaccggacuggaugcaccccguaaccuucggcgcgugucacaaaccgauaacucaauuacccuugaguggagaaauggaaaagcugcaaucgacucuuaccgcaucaaauacgccccaaucuccgggggcgaccacgccgaggucgauguucccaaaucccaacaggcuacaacuaaaacaacccuuacuggacugagaccaggaaccgaguacgggaucgguguuuccgcagugaaggaggacaaggaguccaacccugccaccauuaaugcggccacagaacuugacaccccaaaggaucugcaggugucagagacugccgaaacuagccugaccuuauuguggaagaccccucuagccaaguuugaccgguauagauugaacuacucacugcccacaggucaauggguugguguacaacugccaaggaauaccaccuccuaugugcucagaggacuggagcccggucaggaauauaauguucuacuaaccgcggagaagggaaggcacaagaguaagccugcccgaguaaaagcaagcacugcuaaggaaccugagaucgguaaucuuaacgucagcgacauaacuccagaguccuuuaaucucagcuggauggcaaccgacgguauuuuugagacguuuacuaucgagaucauugauaguaacagguugcuggaaacuguggaguauaauaucucuggcgcugagcguaccgcacacauuuccgggcucccacccucgaccgauuuuauuguauaucucucugggcuugcaccuucaauccggacaaaaaccaucuccgccacugcuacuacagagccaaaaccucagcugggaacccuaaucuucagcaauaucacaccuaaguccuucaauaugucauggaccacucaggcagguuuguucgccaagauagugauuaaugugagugaugcgcauaguuuacaugaaucccaacaauuuacuguguccggcgaugccaaacaggcccauauuacaggcuuggucgagaacacuggguaugaugugaguguggcaggcacuacauuagccggcgacccaacaagaccgcugaccgcuuucgucauuaccgaggcugagccugaggucgauaaccugcucguaucagaugcuaccccagaugguuuucgucucucuuggacugcugacgaagggguguuugacaauuucguguugaaaauccgcgauacaaagaaacagucugagccacuggagaucacccugcuggcccccgagcgcacgagggacauuaccggguuacgggaggccaccgaguacgagauugagcuauaugguauauccaagggcagacggagccagacugucagugccaucgccacgaccgcuaugggcucacccaaagaagugauauuuuccgauaucacggagaacagugccacggugaguuggagggcaccuacugcgcagguggaaucuuuucguaucaccuacguaccgaucacaggggguacaccuagcauggugacgguugaugggacuaagacacagacgaggcuggugaagcugauccccgggguggaguaccuggucucuaucaucgcuaugaagggauuugaggagagcgaaccagucaguggaagcuuuaccacugcuuuggacgggccuuccggucuggucacugcuaauauuaccgacucagaagcucucgcucgauggcagccugcaaucgcuacuguggauagcuacgugauuucuuacaccggagagaaggugccggaaauuacccggacuguuaguggaaacacgguggaguacgcucucacagauuuagagcccgcaacagaauauacacuucguauuuuugcugaaaagggcccgcagaaaucaaguacaauaacagcaaaauucacuacagaccuugacucuccaagagaucucacugccacagagguccaaagcgaaacugcauuacucacauggagaccaccuagagcuagcgugacaggauaccucuugguguacgagucugucgacggcaccguuaaagaaguuauuguggggccugauacaacaucuuauucccuggcagauuugucuccaaguacacauuauaccgcaaaaauucaagcucuuaacggcccacucagauccaauaugauacagacaauuuuuacgaccaucggccucuuguacccauuuccuaaagacuguagucaggccauguugaacggcgauaccacgagcggucuuuauaccaucuaccugaacggugacaaagcagaggcccuggaaguuuucugcgauaugaccucugacgguggaggauggaucguuuuccugcggcgcaagaacggacgugagaacuucuaucagaauuggaaagcauacgccgcuggauuuggagacagacgggaggaauuuuggcugggcuuagauaaccucaacaaaaucaccgcucaaggccaauaugaacuccguguggaucuccgggaucauggcgaaaccgcuuuugcagucuacgauaaauucagcgucggagacgcuaaaacuagauauaaacuuaagguagagggguacaguggaaccgcgggggauucuauggcauaucacaacggacgaucauuuucaacguucgacaaggauacagacucagcgauuacaaacugcgcucuaucuuauaaaggcgcuuucugguaucgcaacugccaucggguuaaucugaugggacgcuacggagauaauaaccauucccagggcguaaacugguuucauuggaaagggcacgaacauucaauucaguuugccgaaaugaagcucagaccuagcaauuucaggaaucuagaaggacguaggaagcgcgccuag

SEQ ID NO: 248550 - RNA, 720 nt, Artificial Sequence
  Description of Artificial Sequence: Synthetic coding sequence
auggcaagggguugcuuguguugcuuaaaauauaugauguuccucuuuaaucuaauuuucugguuaugcgggugcggacuucugggggugggaauuuggcuguccguuagccaagggaauuuugcaacauucaguccaucuuucccuucacugucugcugcuaaucuaguuaucgccaucgggaccaucguuauggugacaggguuccucggaugccugggcgccaucaaggaaaacaagugccuucugcugagcuucuucaucguacugcuugucauucucuuagccgaacucauucuucugauucuuuuuuuuguguacauggacaaaguuaaugagaaugcaaagaaagaccugaaagagggacugcugcucuaccauaccgagaauaacgugggguuaaagaaugccuggaacaucauccaggccgagaugcgauguugcggagugaccgauuauacagacugguauccgguucugggagagaacacugugccagacagauguuguauggagaacucccagggauguggacggaacgccaccacaccacuuuggcggacaggauguuacgagaaaguuaagaugugguucgacgacaacaagcacguguuagguacggucgggauguguauacugaucaugcagauccuuggaauggccuuuucuaugacuuuguuucaacacauucaucgaacaggaaagaaauacgacgcuuag

SEQ ID NO: 248551 - RNA, 720 nt, Artificial Sequence
  Description of Artificial Sequence: Synthetic coding sequence
augccuaaaucuugcgcugcaagacaguguugcaacagguauagcagccgucgaaaacaguuaacuuuucaccgauuccccuuuucccggccugagcugcucaaagaauggguucugaacaucggaaggggaaacuucaagccaaaacagcacacugugauuugcuccgaacacuuucgcccggaaugcuuuagcgccuuuggcaaucguaagaaccugaaacauaaugccguaccuacuguauuugcuuuucaggaucccacccagcaggugcgugagaauacagaccccgcuucggaacgcgguaaugcuuccaguagccaaaaagaaaagguccugccagaagccggagccggcgaagacucuccgggucgcaauauggacacagcccuugaggaacugcagcugccuccuaacgcagaaggacaugucaaacaagugucuccuagacggccacaggcgacugaggcugugggaagacccacgggccccgcaggccuuaggaggacuccuaacaaacagcccagcgaucauuccuaugcccugcuugaccucgauagccugaagaaaaaguuguuccucacccuaaaagaaaacgagaaacuuaggaagagguugcaggcucagagacuggucaugcggcggaugucgucucgacugcgggcgugcaagggacaccaaggccugcaggcaagacuuggacccgaacagcaguccuag

SEQ ID NO: 248552 - RNA, 135 nt, Artificial Sequence
  Description of Artificial Sequence: Synthetic coding sequence
auguccgauaaaccagacauggcugagauugagaaguucgacaagucaaagcuaaaaaagaccgaaacacaagagaaaaauccccuacccagcaaagaaaccauugagcaggagaaacaggccggcgaaucauag

SEQ ID NO: 248553 - RNA, 135 nt, Artificial Sequence
  Description of Artificial Sequence: Synthetic coding sequence
augagcgauaaacccgacauggcugagauagagaaguucgauaaauccaaacuuaagaagaccgagacacaagagaagaauccucucccuagcaaagagaccauagagcaagaaaagcaggcaggagaaaguuag

SEQ ID NO: 248554 - RNA, 135 nt, Artificial Sequence
  Description of Artificial Sequence: Synthetic coding sequence
augagcgauaaaccugauauggcugaaauagagaaauucgacaagagcaaacugaagaagaccgagacccaggagaagaauccucugccgucaaaagaaacaauagaacaagagaagcaagcuggcgagucguag

SEQ ID NO: 248555 - RNA, 135 nt, Artificial Sequence
  Description of Artificial Sequence: Synthetic coding sequence
augagugacaagccagauauggccgaaaucgaaaaguucgacaaaucuaaauuaaagaaaacagaaacucaggagaagaauccauuaccuucuaaagaaacaauagagcaggagaaacaagcaggggaguccuag

SEQ ID NO: 248556 - RNA, 3042 nt, Artificial Sequence
  Description of Artificial Sequence: Synthetic coding sequence
augggacuggguaccuugaguccaaggaugcugguauggcucguggcaagcgguaucguguucuacggcgaauugugggucugcgccggucuggauuacgauuacacuuucgacgguaacgaggaagauaagacugagacgaucgauuacaaggauccaugcaaggcagcaguuuucuggggggauauugccuuagaugacgaggaucugaauaucuuucagaucgauagaaccauagaccugacacaaaacccguucggaaaccugggacacacuacgggagggcuaggugaucacgcuauguccaagaagaggggcgcccuuuaccagcucaucgacagaauccgcagaaucggguuuggacuagaacagaauaacaccgucaaaggaaagguucccuuacaauuuucaggccagaaugagaagaauagagugccccgggcagccacaucccguacagaacggaucuggccuggaggugugauuccauacgugaucggcggaaauuuuacuggcucccagcgggccauguucaaacaggccaugagacacugggaaaaacacacuugcguuaccuucauugagcgcuccgacgaggaaagcuacaucguuuuuacguaccgccccuguggaugcugcucuuaugucggaagaagagggaaugggccccaagccauuucuaucgguaaaaauugcgacaaguucgggauugugguccaugagcucggacaugugaucggguucuggcacgagcacacuagacccgaccgggauaaucaugugaccaucaucagagaaaauauucagccgggucaggaauauaauuuucugaagauggaaccaggcgaggugaacaguuugggggaacgcuacgacuucgacuccaucaugcacuacgcccguaauaccuucucacguggcauguuucuggacacaauccuacccuccagggacgauaaugguaucagaccugccauuggccagcgcacucgacucucgaaaggcgauauugcucaggcuaggaaguuguaucggugccccgcaugcggcgaaacucugcaggaguccaacggaaaccugagcuccccaggcuuuccuaaugguuauccuaguuacacacauugcauuuggagaguguccguuacaccuggagagaaaaucgugcucaacuucacuaccauggauuuguacaagucuucauuguguugguaugauuauauugaagugcgagauggauauuggagaaagaguccacuuuugggacguuuuuguggggauaagcugccagagguccugaccagcacagacagccguauguggauugaauuucggagcaguucuaacugggugggcaaagguuucgccgcuguguacgaggcuauauguggcggagaaauuagaaagaacgaagggcagauucaaagucccaacuauccugacgacuauaggccuaugaaagaaugcguguggaaaauaacugugucagagaguuaccacgucggccucaccuuucaguccuuugagaucgagaggcacgacaauugugccuacgauuaucuggaggugagagacggaacuuccgagaacagcccacugauuggacguuucuguggauaugauaagcccgaagauauucgaucaaccagcaacaccuuguggaugaaauucgucucagauggcacaguuaauaaagcaggcuucgccgcaaacuucuuuaaggaggaggaugaaugugccaaaccagacaggggaggcugcgaacaaaggugccuaaauacccucggaucuuaucagugugcaugugagccaggcuacgagcucgguccugauaggcgcagcugcgaggcugcauguggcggccugcuuaccaagcucaacgguacaauaacuacuccuggguggccaaaagaauacccuccaaacaagaauugcguauggcaggugguggcuccgacucaauauagaauuuccgugaaguucgaguuuuucgaacucgaggggaacgagguguguaaauacgacuauguggagauaugguccggcuugucauccgaguccaagcugcacggaaaguuuugcggcgcagaagucccggaagucaucacaagucaauucaacaauaugcgaaucgaguuuaaauccgacaacacugugucuaagaaaggguucaaagcccacuuuuucagugauaaggacgaauguagcaaagacaaugguggcugccagcacgagugcgugaacaccauggggagcuacaugugucagugccgaaauggguucguguugcacgauaauaagcacgacuguaaggaagccgagugugaacagaagauucauucuccgucaggccugauaacgagccccaacuggccagacaaguaccccuccagaaaagaaugcacgugggaaaucuccgcuacaccaggacaucgcauuaaacuagccuucucugaauucgagauugaacagcaccaggagugcgccuacgaccaccuggaaguauucgauggugaaacagaaaagagcccaauucuaggacgccucugugggaauaagauaccagacccguugguugcuaccggcaauaaaauguucgugcgguuugugucagaugcgagcgugcagagaaagggguuucaagccacccacucuacagagugugggggacggcugaaggcugaaucaaagccucgggacuuauacucucacgcucaguucggggauaauaacuauccaggucaaguugacugugaauggcugcucguuucugaaagaggaucacgccuugaacugucuuuucaaaccuuugaaguggaagaggaagcagacuguggguacgauuauguggaacucuuugacggacucgauucuacagcuguuggacuggggcgguucugugguucaggacccccagaggagauuuauucuauuggcgauaguguguugauccauuuccacaccgaugauaccauuaacaagaagggguuccacauccgguauaagucuauucgauauccugacaccacgcacacuaaaaaauag

SEQ ID NO: 248557 - RNA, 1596 nt, Artificial Sequence
  Description of Artificial Sequence: Synthetic coding sequence
augaucuccccugacccacggccgagccccggauuagcacgcugggcugagucauacgaagcgaaaugcgaaagaaggcaagaaauccgagagaguaggagaugucgccccaacguuaccaccugccgccaaguggggaaaacgcugcggauccagcaaagagaacaguuacagagggccagguugcaacaguuuuuccgccgccgcaaucuugaacuugaagagaaagguaaggcccagcauccucaagcccgcgaacagggcccuucuaggcgccccggccaggugacagguaccuccagugaaguguucccagcccagcauccgcccccaagcgggaucuguagggaccugagcgaucacuuauccucucaggcaggcgggcugccuccucaagauacaccaauuaaaaagccgcccaagcaucaucgcgggacccagacaaaggcagagggcccuacaaucaaaaacgacgcuucucaacagacuaauuacgguguugccguucuugacaaagaaaucauacagcugucagacuaucugaaggaagcuuuacaacgagagcuggugcugaagcagaagauggucauauugcaagacuuauugucaacccuaauucaagcuagugauagcucauggaaaggacagcucaacgaggauaaacugaaagguaagcugcggagucuggagaaccagcuuuacaccuguacccagaaauacagcccuugggggaugaaaaaaguguuauuagaaauggaggaccagaagaacucauacgagcagaaagccaaggagagccugcagaaagugcuugaggagaagaugaaugcggaacagcagcuccaguccacgcagcgcucucuggcccuugccgaacaaaagugugaagaauggcggucucaguaugaagcacucaaggaggacuggcgcacacuaggcacccagcauagagagcuagagucccaauuacacguucuacaguccaagcuccagggggcugacucccgggaccuucagaugaaccaggcucuccgguuccuggaaaacgaacaccagcaguugcaggcuaagauugagugccugcagggagaccgagaucugugcucacuugacacccaggauuugcaagaccagcugaagagguccgaggcagaaaagcugacucuugugacucgggugcagcaacuucaggggcuauugcaaaaucagagucuacagcuucaggagcaggagaagcuuuuaaccaaaaaagaccaggcccuaccugucuggagccccaaaucuuuuccgaacgagguggaaccugagggcacgggcaaggagaaggacugggaucugagagaccaguugcagaaaaagacauugcagcugcaggcaaaggaaaaagaaugucgugaacuucacucagagcuugacaaucugagcgacgaguaucuauccugccuccggaaacugcagcacugucgagaggaacuuaaucaaucgcagcagcugccaccucggcgccagugcggaagguggcugccuguacucaugguggugaucgcugcagcacucgcgguauuccuagcaaauaaggacaaccuuaugaucuag

SEQ ID NO: 248558 - RNA, 1359 nt, Artificial Sequence
  Description of Artificial Sequence: Synthetic coding sequence
augucgaccacuuuuccaggccuggugcacgacgccgaaauucgucacgacgggagcaacaguuaccgccuuaugcaguuggguuguuuagaguccguggcaaauaguacaguugcuuauucaucuucuaguccuuugaccuauucuacuacgggaacagaguuugcuagcccguacuucucuacuaaccaucaguacaccccguugcaccaucaaucuuuccacuaugaguuucagcauagucaccccgcugugacuccugacgcauacagccucaauagccuucaccacucucagcaauacuaccaacagauucaucacggcgaaccgaccgacuucauuaaccuucacaacgccagagcacugaaguccagcugccucgaugagcagcgaagggagcuggggugccuggaugcauaccggagacaugaucugucucugaugucucacggcucucaguauggaaugcacccugaucaacgccuauugccaggcccgucccuaggccuggcugcagcgggcgcugaugaucugcagggcuccgucgaagcccaguguggacucgugcucaauggacagggaggaguuauuagaagaggaggaacuuguguggugaaccccaccgaccuuuucuguuccguuccagggagauuaagccuacucaguucaaccagcaaauacaaaguuacaaucgccgaagucaagagacgacugucuccuccugaaugccugaacgccucacuucuuggagggauccugcggagggcgaagagcaaaaacggaggccgaugccuccgggaaaaacuugaccgccugggccugaacuuaccugcugggagaagaaaagcugcaaauguaacucucuugaccagucucgucgaaggggaagcgcugcaucuggcuagggacuuugguuacacgugcgagacggaguuccccgcaaaagccguuggggagcaccuugcacgacagcauauggaacagaaagagcagacagcuaggaaaaagaugauccuggcuaccaagcaaaucugcaaagaguuucaggaccuucuuucccaggacagaucuccccugggcucuagucgcccuacgccaauucuugaccuugacauacagagacaccugacucauuuuucucuuaucacccacgguuucggaacuccggcaaucugcgccgcacuguccaccuuccagacuguccugagugaaaugcugaacuaccuagagaagcacacaacucacaagaauggaggugccgcugacaguggacagggccaugcuaauucagagaaagccccucuuaggaaaacaucagaagccgcuguaaaagaagggaagaccgaaaagacugauuag

SEQ ID NO: 248559 - RNA, 2244 nt, Artificial Sequence
  Description of Artificial Sequence: Synthetic coding sequence
auggccgacgaggcugcccuggcuuugcagccuggggggagcccuucagccgcgggcgcagaucgggaggcggccucgucaccugcuggugaaccgcuccgcaaaagaccaaggagagauggcccaggcuuggaacgaaguccaggugagccgggaggcgccgccccagagagagaagugccagcugcugcucgcggaugcccuggagccgccgcagcugcacuguggcgggaggccgaagccgaagccgcagccgccggaggggagcaggaggcccaggcuacggcagcugcaggagagggcgacaauggcccagggcuccaggggcccucgcgagagccaccccucgcggauaauuuauaugacgaggacgacgacgaugaaggagaggaagaggaggaggcugccgcugcugccaucggcuaccgggacaaucugcuauucggugaugagaucauuacuaauggguuccacaguugcgagagcgacgaggaggaucgcgcaucacaugcuucuucguccgauuggacaccuaggccacgaaucggccccuauaccuucgugcagcaacaucucaugauaggaacagacccccgcaccauucuaaaagaucuacuucccgagaccauaccaccuccagaacuggaugauaugacacuguggcaaaucgugaucaauauucucucugagcccccuaagaggaaaaagagaaaggauaucaacacaauagaagaugcagugaaacucuuacaggaaugcaagaagauuauugugcuuacuggggcugggguuuccgucuccuguggaauuccagacuuucguucaagagacggcauuuaugcacgccuggccguggacuuuccugaucugcccgauccucaggccauguuugauauugaauacuucagaaaggacccacggccauuuuucaaguuugcaaaagagauauauccuggccaguuucaaccuagccugugccauaaauuuaucgcacugucagacaaggaagguaaacucuuacgcaacuauacacagaacaucgauacccucgagcagguggccggcauucaacgaauaauccagugccacggcuccuucgcgacagcaucuugucugaucuguaaauacaaagucgauugugaggcugucaggggagauaucuucaaucagguugucccuagauguccucgaugcccagcagacgagccucuggccauuaugaagcccgaaaucgucuucuuuggggagaauuugccugagcaguuucaucgggccaugaaauacgauaaagaugaaguugaucuccuaauugugaucggaucaucccugaagguuaggccaguggcccuuauucccuccucuaucccccacgaagugccacagauccugaucaacagggaaccucucccccacuuacauuucgauguggaguugcucggggauugcgacguuauuauaaacgaacugugccaccgguuaggcggcgaguaugccaagcugugcugcaacccagucaaacucucugaaauaaccgagaagccaccucgaacacagaaagaacuugccuaccucuccgaacuccccccaacuccucuccacgucucggaagacaguucaucccccgagcgcacauccccacccgacucuuccgugaucgugacucuucuugaccaggccgcaaaaucaaaugacgaccuugacgugagcgaaagcaaagggugcauggaggagaaaccacaagaaguccagacuagucgaaauguugaaucuauugcagagcagauggagaaccccgaccuaaagaaugugggcagcuccacuggagagaagaacgagagaacaucuguagccgguacagucagaaaauguuggcccaaucgcguugcaaaagagcagauuucucgccgacuggauggcaaucaguaucuguuucucccgcccaaucgguacauauuccauggagccgagguguacagcgauagugaagaugacguacugaguucaagcagcuguggaagcaacuccgauucugguacaugccagucaccaucccuggaggagccaauggaagacgaaagugaaauagaggaguuuuacaauggucuggaagacgagccugacgucccugaaagggccggcggggccggauuugguaccgauggcgacgaccaagaggcgaucaaugaagcuaucucugugaaacaggagguuacagacaugaacuauccaaguaacaagaguuag

SEQ ID NO: 248560 - RNA, 3498 nt, Artificial Sequence
  Description of Artificial Sequence: Synthetic coding sequence
augcaagacgugcagggcccuagaccgggaucacccggcgaugccgaagaucgucgggagcucgggcuucacaggggugaagugaacuucggagguuccgguaaaaaaagggguaaguucgugcgcgugccaucaggcguugcaccaucuguacuguuugaccuguuguuagcagaauggcaucuuccagcacccaaucuaguuguaagcuugguaggcgaagaacagccauuugcaaugaagucaugguuacgggacgugcugcggaaaggucuugugaaggcugcccaguccacaggggccuggauucucacaucagcacugcgcgugggucucgcuaggcaugucgggcaggcuguuagagaucauucgcucgcaucuaccucaacuaaaguccgugucgucgcugugggcauggccucacuggggaggguccuucaucggcgcauacucgaagaagcgcaagaagacuuuccuguccacuacccugaagaugacggagggucccagggacccuugugcagccuggacuccaaccuuagccauuuuauccuagucgagccuggucccccagggaagggcgaugggcugacugagcugagacucagacucgaaaaacacaucagugagcagagggccggauauggagguacaggauccaucgagauuccaguguugugucuccuggugaauggugaucccaacacccuugaaaggauuuccagggccgucgagcaggcugcgccuugguugauccuuguuggcucaggaggaauugcagacguacucgccgcccuggugaaccaaccccauuugcuuguuccaaaagucgcagaaaaacaauucaaagagaaauuucccucaaagcauuuuaguugggaagacauugugcguuggaccaaacugcugcagaacaucacaagucaucaacaucuccuaacaguguaugacuuugaacaagaaggauccgaggagcucgauaccgugauucuuaaagcguuggugaaggcauguaagagccacucccaggaaccacaagauuaccuugacgagcucaagcuggcaguagcuugggacagaguggauauugccaagucagagaucuuuaacggugauguagaguggaaguccugugaccuugaagaaguuaugguugacgcccucgugaguaacaaaccugaauucguuagguuauucguugacaauggcgccgauguggcggauuuucugacuuacgguagacuccaggaacuguacagaucggugucuagaaaaagccuucuguucgaucugcugcaaaggaaacaggaggaagccaggcugaccuuggcagggcugggcacccagcaagccagagagccuccugcaggaccaccagccuucucccuucacgaggugagccggguccugaaggauuuccuucaagacgccugcagaggauucuaucaggacggcagacccggggauaggagacgcgccgagaaagggcccgcaaagcgacccaccggccagaaguggcugcucgaccucaaccagaaaagcgagaaccccuggcgcgaccucuuccugugggcagugcuccagaacagacacgaaauggcuacuuauuuuugggcgaugggacaagaaggugucgcugcugcacucgcagccuguaagauccugaaggaaaugucacacuuagaaaccgaggcugaggccgcgcgagccacaagggaagccaaguacgagaggcuggcccuggaucuguucagcgagugcuacaguaauuccgaggcucgagccuucgccuuacucgugcgcaggaaccgcuguuggucuaagacaacuugccugcaucuugcuacagaagccgacgccaaagccuuuuuugcccacgacggcgugcaggccuuccugacaaggaucugguggggggacauggcugcuggaaccccgauccugagacugcugggugcauuuuuguguccagcccucguguacacaaaucucauuaccuuuuccgaggaggcaccucugcggaccggccuggaagaccuacaggaccuggauucccuggauacagaaaaguccccacucuacggacuacagucacgaguagaagaacuggucgaagcaccuagagcucagggugacagaggcccacgggcaguguucuugcucacacgauggcgcaaauucuggggggcgcccgugacgguguuccuugggaauguagugauguauuucgccuuucucuuucuauuuaccuacgugcuccugguggacuuucggcccccuccacagggcccuagugggccugagguaacacuguacuucuggguguuuacacuggugcuugaggagaucaggcaaggcuucuuuacugacgaagacacgcaucucgugaagaaauuuacucuguacgugggcgauaauuggaacaaaugugacaugguggcuaucuuucuguuuauugugggcgucaccugccggaugcucccauccgcauuugaagccggccgcacgguguuggcuauggauuucaugguguucacccuaaggcucauucacauauucgccauucacaagcagcuaggcccaaaaauuaucgucgucgagagaaugaugaaagauguuuucuuuuuccuguucuucuuaaguguguggcugguggcuuacggggugaccacacaagcacuucuacacccccacgacgguagacuagaguggaucuuucgacggguccuuuaucggcccuacuuacagauuuuuggacaaauuccucuggacgaaauugacgaagccagagugaacugcucgacucacccccugcugcuggaagacucccccaguuguccgucccucuaugccaacuggcugguuauucuucuccuagugaccuuccuacuggugacuaacguucuacuaaugaaccuccugaucgcgauguucagcuauacguuccagguuguucaggggaacgccgacauguucuggaaauuucagcgcuacaaccugauuguugaguaccaugagagacccgccuuggcaccaccuuuuauucuacugucacaccucucgcucacgcuucgccggguguuuaagaaagaggcagagcacaagcgcgagcaucuggaaagggaccugccugacccucuggaucagaagguggucaccugggaaacagugcagaaagagaauuuccucagcaaaauggagaagagaaggagagauagugagggcgaggucuugcggaagacggcgcacagaguggauuuuauagccaaauaucucggaggacuucgcgagcaggagaagcggauuaagugccuagaaagccagauuaacuacugcaguguccucguuuccuccgucgccgaugugcuggcacagggaggcgggccaagauccucucaacauugcggugagggcagccagcugguugccgccgaucaccgaggggggcuggauggaugggagcagcccggagcaggucaaccuccaagcgauaccuag

SEQ ID NO: 248561 - RNA, 828 nt, Artificial Sequence
  Description of Artificial Sequence: Synthetic coding sequence
auguugaaccuccuucuucuggcccugcccguucucgcuucccgcgcguaugcugcaccagcgccaggacaagcauugcaaagaguagggaucgugggcggucaggaagcgccccgaucgaaguggccuuggcagguuaguuugagaguucacgguccauacuggaugcauuucugcggcgggaguuugauacauccccaaugggugcugacugccgcacacuguguugguccagacguuaaagaccuggccgcucuccgggugcaguugcgggagcagcaccuguacuaucaggaccaacugcugcccgucagccguauuauaguacauccacaguuuuacaccgcucagauuggcgcagacauugcucuucuggaauuggaagaacccguuaauguaucaagccacguccauaccguaacucuuccucccgcuuccgaaaccuuucccccaggcaugccaugcuggguaacaggguggggggauguugauaaugaugaaaggcucccacccccauuuccccucaagcaggugaagguucccauaauggaaaaccacauaugugaugccaaguaccaccugggcgcauacaccggcgaugauguucgcaucguucgggaugacauguuaugcgcgggcaauacaaggagagauucuugccaaggagacagugguggcccucuaguguguaaggucaacgggacuuggcugcaagcgggcgucgugucauggggagaagggugcgcccagcccaacaggccuggcauuuacaccaggguuacauacuaucucgacuggauccaucauuacgugccaaagaagccauag

SEQ ID NO: 248562 - RNA, 849 nt, Artificial Sequence
  Description of Artificial Sequence: Synthetic coding sequence
augcugcuccuugcuccucagauguuaaaccuccuccuccucgcccugcccguauuagcgucucgugcguaugccgcgcccgcucccggacaggcacuucagagggucggaauugugggcggccaagaagcaccccgauccaaauggccuuggcagguuucacugcgggugcacggcccauacuggaugcauuuuugcgguggcucccugauucauccccagugggucuugacagcggcgcacuguguaggucccgauguuaaagaccuggcugcccuaaggguacagcuucgcgagcagcaucuuuacuaccaggaccaacugcuccccgucucacguaucaucguccauccccaguucuacaccgcacaaaucggggccgauaucgcccuacuagaauuggaagaaccaguuaauguuaguucccauguucauacugucacccugccaccagccagugagacuuuuccuccugggaugccgugcugggucacuggcuggggagauguggauaacgacgagaggcugcccccgccauucccccugaagcaagugaaagucccaaucauggagaaucacauuugcgacgcuaaguaucaccugggggcuuacaccggugaugaugugcgcauugugcgagaugauaugcucugcgccgggaacacaagacgggacaguugccagggcgauucggguggcccacuagucugcaagguuaauggcacuuggcugcaagccggcgugguuucuuggggcgagggcugcgcccaacccaaccgcccugguauuuacacuagaguuacguauuaccuagacuggauccaccacuaugugcccaagaagcccuag

SEQ ID NO: 248563 - RNA, 492 nt, Artificial Sequence
  Description of Artificial Sequence: Synthetic coding sequence
auggccgagggaggggggcaaaaccaccaugaaguggucaaauuuauggacguuuaccagcguagcuacugccacccuauagagacccuuguagauaucuuccaggaguauccugaugagaucgaguauauauucaaaccgaguugcguuccauugaugaggugcggggguuguugcaacgacgaaggccucgagugcgugcccaccgaagagucaaacaucacgaugcagauaaugagaauuaagccacaccagggucagcacaucggugagaugaguuuccugcagcauaauaagugugaaugcagacccaagaaggaccgagcccgacaagagaauccuuguggcccauguagcgagcgccguaaacaccuuuuuguucaggacccacagacuugcaagugcagcuguaaaaacacugauagcagguguaaggccagacaacuagagcugaaugagcgcacguguagaugugacaaaccacgacgauag

SEQ ID NO: 248564 - RNA, 555 nt, Artificial Sequence
  Description of Artificial Sequence: Synthetic coding sequence
auguuacagauggcggggcagugcucccagaaugaguauuucgacagccugcuucaugcguguauccccugucagcugagauguucuaguaauacaccuccacucacuugucagagauauuguaaugcauccgugacgaauucagugaaagggacaaaugcuauccuguggacaugccucggguugagucugauaaucagccuggccguguucgucuuaauguuucuucugcgcaaaauaaauucugaaccacuuaaagaugaguucaaaaauacagguucagggcuucuggggauggcuaauaucgauuuggaaaagucuaggacaggagaugagauuauccuaccuaggggacuggaauauaccguggaagaaugcacaugcgaggacugcauuaagagcaagcccaaaguggacuccgaucacugcuuuccucugccugcaauggaagagggagccacaauucuggugaccacaaagacaaacgauuauugcaaaucccuucccgccgcccuuuccgccacagaaauagagaagaguauuagcgcaagauag

SEQ ID NO: 248565 - RNA, 567 nt, Artificial Sequence
  Description of Artificial Sequence: Synthetic coding sequence
augauuaucuacagagaccucauuagccacgaugagauguuuagcgauaucuacaagauacgagaaauagcagacggccugugccuugagguugaaggcaagaugguaagucggacugaaggaaauauugacgauucccugaucggggggaaugcaucugccgaggggcccgaaggagagggaacagaaucaacugugaucaccggggucgacaucgucaugaaucaucaccugcaggagaccucuuuuacaaaggaagccuacaaaaaguacaucaaggacuauaugaaaucaauuaagggcaaauuggaagaacagaggccagagagggugaaaccauucaugacuggggccgcagaacagaucaagcacauuuuagccaauuucaaaaacuaccaguuuuucaucggagagaauaugaacccugauggcaugguggcucugcuggacuaccgagaggauggagugaccccauacaugauauucuucaaggacggacucgagauggaaaagugcgugucuacuagaaaguggguaaaaaucaauaacgugaaaaagacuuucuag

SEQ ID NO: 248566 - RNA, 417 nt, Artificial Sequence
  Description of Artificial Sequence: Synthetic coding sequence
auggugucuaggacugaaggaaacauagaugauagccucauaggggggaaugcaucugcugagggucccgaaggugagggcaccgagagcacagugauuacggguguagauaucgugaugaaucaccaccuucaggagaccucguucaccaaagaggcauauaaaaaauacaucaaggacuacaugaaaucuauuaaaggcaaacuggaggagcaaagaccagaaagagucaagccguuuaugacaggugcagccgaacagaucaaacacauacuugccaauuucaagaauuaccaauuuuuuauaggugagaacaugaauccagauggaaugguagcguugcuagacuacagggaagauggggugacuccguacaugauuuuuuucaaagauggccucgagauggaaaagugcuag

SEQ ID NO: 248567 - RNA, 417 nt, Artificial Sequence
  Description of Artificial Sequence: Synthetic coding sequence
auggugucacggacugagggaaacaucgacgacaguuuaauuggggguaacgcaagcgcggaggggccagaaggcgaaggaacagaguccacugucauuacugguguggauaucgugaugaaucaccaccuacaggagacaucauuuacaaaggaagccuauaaaaaauauaucaaagauuacaugaagucuauuaagggaaagcuugaggagcagcgcccugagcgagugaagccauuuaugacaggugccgccgaacaaauuaagcauauccuagcaaauuucaaaaauuaucaguuuuuuauuggagaaaacaugaauccagacggcauggucgcccugcuggacuaccgggaagauggggucacaccuuauaugaucuuuuucaaggacggucucgaaauggaaaaauguuag

SEQ ID NO: 248568 - RNA, 483 nt, Artificial Sequence
  Description of Artificial Sequence: Synthetic coding sequence
auguuuagcgauaucuauaagauucgggaaaucgcggauggacugugucucgaagucgaagguaagaugguuucaagaacagaggguaauaucgaugauagucugauagggggcaaugcaagcgccgaggguccugaaggagagggcacugagucaaccgugauuacaggcgucgacaucgugaugaaucaucaccugcaggaaacuucuuucaccaaggaggcuuacaagaaauacauuaaagacuacaugaaaaguauuaagggcaaauuagaagaacagaggcccgagagagugaaaccuuucaugacgggcgccgcagaacagaucaagcacauccuugcaaacuuuaagaacuaccaguuuuucauuggcgaaaacaugaauccugacgggaugguggcucugcucgacuaccgugaagauggcgugacuccauauaugauuuuuuuuaaggauggacuggaaauggagaaauguuag

SEQ ID NO: 248569 - RNA, 519 nt, Artificial Sequence
  Description of Artificial Sequence: Synthetic coding sequence
augauuauuuauagagaccuaaucucacaugacgagauguucucugauaucuacaaaauccgcgagaucgcagacgggcugugccuggaagucgaaggcaagauggugucccggaccgagggcaauauagaugacucauuaauuggggguaaugccucugcagaggguccugaaggugaggggacagagaguacaguuauuacuggcguggauaucgucaugaaccaucaucuucaagagacuucauuuacuaaagaggccuauaaaaaauauaucaaggacuauaugaaaucuaucaaagguaaacuagaagagcaacggccugaaagagugaaacccuuuaugacuggcgcugccgagcagauaaagcauaucuuggcaaacuuuaagaauuaccaguuuuucauuggcgaaaauaugaacccagauggaaugguggcccuauuggauuacagggaggacggagugaccccguacaugauuuuuuucaaagacggguuagagauggaaaagugcuag

SEQ ID NO: 248570 - RNA, 1278 nt, Artificial Sequence
  Description of Artificial Sequence: Synthetic coding sequence
auggcaggugccgaaggagcugccggucgucagagugaguuggaaccuguggucucacucgucgauguccucgaggaggaugaagagcucgagaacgaggccugcgcuguucugggaggcuccgauagugaaaaaugcaguuacucucaggguuccgugaagagacaagcacucuaugccuguaguacuugcaccccugaaggcgaagagccugccggcauaugucuagccuguuccuacgaaugccacggaucacacaagcuguuugaauuguauacuaaacggaacuucaggugcgauugcgggaacagcaaauucaagaaccuggaaugcaaguuacuaccugacaaggccaaagugaauaguggaaauaaguauaaugauaauuuuuucggacuguauuguaucuguaagcgaccuuaucccgacccggaagacgagauccccgaugagaugauacaguguguaguaugcgaagauugguuucacggaaggcaucugggggcuaucccacccgaaagcggagacuuccaggaaauggugugccaagcauguaugaagaggugcucuuuccugugggccuaugccgcccaacuggcagugacuaagauuucaacagaggacgacggucucgugcggaacauugacggcauaggugaccaagaggucaucaaaccugaaaacggcgaacaucaggacucuacccuaaaggaagacguaccugaacagggaaaggacgaugugcgcgaaguuaaggucgagcaaaacuccgaacccugcgcuggcucuagcagcgaaagugaucuccagacagucuuuaagaacgaauccuugaacgcugaaaguaaaagcgguugcaagcuacaagaacugaaagccaaacaacugauuaaaaaggauaccgccacguacuggccccuuaauuggagguccaaauugugcaccugucaagacuguaugaaaauguacggagaucuugaugugcucuuucucaccgaugaguacgacacgguccuggccuacgagaauaaggguaaaaucgcucaggcaacggaucgcagugauccccugauggauacacuuagcucaaugaaucggguacagcagguggaacugauuugugaauacaaugaucugaaaaccgagcuaaaagauuaucugaagcgauuugccgaugaggguaccguggugaagcgagaagauauccaacaauucuuugaggaauuucagucgaagaagagacgaagggucgaugggaugcaguacuacugcucguag

SEQ ID NO: 248571 - RNA, 3234 nt, Artificial Sequence
  Description of Artificial Sequence: Synthetic coding sequence
augaccgccgaacugcaacaggacgacgcugcuggcgccgccgauggacaugggucaaguugucaaauguugcuuaaucagcuuagagaaaucacugggauacaggacccuucauuucugcaugaggcccuuaaggcuuccaauggcgacauuacccaagcugucucuuuauuaacggaugaaagggucaaggaacccagccaagacacaguggccaccgagcccucagaggucgagggcucugcagcuaauaaggaaguauuggccaaagugauugauuugacccacgacaauaaagacgauuugcaagcugcuauugcccucaguuuacuggagaguccuaaaauucaggccgacgggcgagauuuaaacaggaugcacgaagcuaccucugcugagacaaagcguuccaagcgcaagagaugcgaaguguggggggaaaaccccaauccaaacgacuggcgucggguggauggcuggccagugggguuaaagaauguaggcaacacauguugguuuagugcagucauucagucccuguuccaacucccagaguuccgucggcucguucuauccuacagccuuccccaaaacgugcuagagaacugucggagucacacugagaagagaaacauaauguuuaugcaggagcugcaauaccuguuugcauuaaugaugggcuccaauagaaaguucguagaccccucugccgcucucgaucuccugaaaggagcguuccguaguuccgaagagcaacaacaggaugucucagaguuuacacauaaauuacucgacuggcuggaggaugccuuucagcuggcaguuaaugugaacagcccuaggaacaagagcgagaaccccauggugcaacuguucuacggcacauuccuuaccgagggugugcgagagggcaaaccauuuuguaauaaugagaccuucggacaauacccccuacaaguuaauggauaucggaaccuggaugaaugucuugaaggggcgaugguggagggcgacguggaacugcuacccagcgaucauuccgugaaauacggccaggaaaggugguucacaaaacuuccaccgguguugacauucgagcucucucgguucgaguucaaccaaucgcucggacagccugagaagauucauaauaaguuagaauuuccccaaaucauuuauauggaccgcuauauguacagaagcaaggaacugauccguaacaaacgcgaauguauccguaaacucaaggaagagauuaagauccuccaacagaaguuggagagguacgugaaauauggcucgggcccagccagauucccacugccagauaugcugaaauaugucauugaguucgcaagcaccaaaccagcaagugagucgugcccacccgagucugauacccacaugacuuugccacugagcucagugcauugcagugugucugaccagacuucuaaagaaucaaccagcacagaauccucuagccaggauguagaaucuacguuuaguucaccugaggacucauuaccaaaaucuaagccucuuacauccuccaggaguucuauggagaugccuucccagccggcaccgcgcaccgucaccgacgaagagauaaauuucgugaaaacgugccuacaacgguggcgguccgagaucgagcaggacauucaggaccuaaagacguguaucgcaagcacaacccagacuauagaacagauguauugugacccuuuacugcggcagguuccuuacagauugcaugccguucuggugcaugagggucaggcaaacgcaggacauuauugggccuauauauauaaccagccacgccagucauggcugaaguacaaugacaucucggugaccgagucaaguugggaagagguagagcgggauagcuauggcgggcuccgcaacgucuccgcuuacugccugauguacaucaacgacaagcucccauacuuuaaugcggaggcugcucccaccgagagugaccagaugagugagguugaggccuuaucuguugaacucaagcauuacauccaagaggacaacuggcguuucgaacaggaggucgaagagugggaagaggaacaguccuguaaaauuccgcagauggaguccuccacaaauucaucuucacaagauuacuccaccucgcaggagcccuccgucgcuaguucacauggggucaggugccuguccagugaacacgccguaauagugaaggaacagaccgcgcaggcgaucgccaacacggcuagagcuuacgaaaaaucuggugucgaggccgcgcucagcgaggucaugcugucaccugcuaugcagggggucauccuugccauagccaaagcacgccagacuuucgacagggaugggucugaagcgggccuuaucaaagcauuucacgaagaauauaguagguuauaucagcuugccaaagaaacacccaccucucauagcgacccccgcuuacagcacguuuugguguauuucuuccaaaacgaggccccgaagcggguugucgagcgcacccuacuagaacaguucgcagacaaaaaccuuuccuacgacgagaggucaauaaguaucaugaaagucgcucaagcaaaacugaaagaaaucgggccggacgacaugaacauggaagaguauaaaaaauggcacgaagauuauucucucuuccggaaagugagcguuuaucuccugacuggccuggaacucuaucagaagggcaaauaccaggaagcucuguccuaucuaguguacgcuuaccagucuaacgccgcccugcugaugaaaggaccccggagggguguuaaagaaucaguuaucgcgcuguaccgacgcaaaugucugcuggagcucaacgcuaaggcagccagccucuucgagacaaaugaugaccauaguguuacggaaggaaucaauguuaugaaugaacugauaauaccuuguauccaccugaucaucaauaacgacauuagcaaagaugaccuugacgccauagagguaaugcgcaaccauugguguucuuaccuggggcaggacauugcagaaaaucuccagcugugccugggugaauuccuucccaggcuguuggaucccucugccgagaucaucguccucaaggaaccgcccacgaucaggccuaauuccccuuacgaccuuuguagccgcuuugcugccgucauggagagcauacagggggucuccaccgucaccgucaaauag

SEQ ID NO: 248572 - RNA, 2274 nt, Artificial Sequence
  Description of Artificial Sequence: Synthetic coding sequence
augguuccagacacugccugugugcugcuccugacccuggccgcacugggagcgaguggccaggggcaaaguccgcugggaagugaucucgguccacagaugcuucgcgaacuacaggaaacaaacgcugcucugcaggaugugcgagaacugcucaggcagcaggucagagagaucacuuuucugaagaauacagugauggaaugugacgccugcggaaugcagcaguccguccgcacggggcucccuagugucagaccccugcuccacugcgccccuggcuucuguuuucccggaguugccugcauucagacagagaguggugcaagauguggccccuguccagccggcuuuacaggcaauggcucacauuguacugacguuaaugagugcaaugcgcacccuugcuuuccuagaguccgcugcaucaauacuagcccuggcuuucgaugugaagcauguccucccgguuacucgggccccacacaccaggggguaggucucgcuuuugcgaaggccaauaaacaggugugcaccgauauaaaugagugcgaaacuggacagcacaacugcguuccaaacucuguuugcaucaauacaaggggaucauuccagugcgggccaugucagccaggguucgucggagaucaggccuccggcugucagagaagggcccaaagauuuugcccagacggaagcccaagugaaugccaugagcaugccgauugcguguuagaaagagauggcucgagaagcugcgucugcgccgucgggugggcagguaaugggauccuguguggaagagacaccgaccuggacggauuuccugaugagaagcucagauguccagagcggcaaugccggaaggauaacugugugacaguuccaaacucugggcaagaagaugucgacagagacggcauuggggaugcaugugacccagacgcggacggcgacggagugccgaaugaaaaggauaacuguccacucgugcgaaacccagaccagaggaauacugacgaagauaaguggggcgaugcaugcgacaauugccggagccagaaaaaugacgaccagaaggacacugaccaggacgggcguggugaugcaugugacgacgauaucgacggggaccgcauucguaaucaagccgauaacugcccccgggucccaaauucugaucagaaggacagcgauggcgaugguaucggcgaugccugugacaacugcccucaaaagagcaauccggaucaagccgacguggaucacgacuucgucggggaugccugcgacagcgaccaggaucaagauggcgauggucaccaggacucuagagauaacugucccacugugccaaacuccgcacaggaggauagcgaucaugauggucagggcgacgccugugacgacgacgacgacaacgacgggguuccggacagcagagacaacugccgccuaguucccaauccaggucaagaggacgcugacagggauggcgugggagacgugugccaggacgacuuugaugcggauaaggucguagacaagauugacgucuguccugagaaugcugaagugacccucaccgauuucagagccuuccaaaccgucguucuggaccccgaaggcgacgcccagaucgacccuaauugggugguucuuaaucaagguagggagaucgugcagacaaugaacuccgacccaggacucgcugugggguacaccgccuucaaugguguggauuucgaggggacuuuccacgugaacaccgugaccgaugaugauuaugccggcuucaucuuuggguaucaggacagcucuucguuuuaugucguaauguggaaacagauggaacagacauacuggcaagccaacccguuucgugcaguggccgagcccggcauucaguuaaaagcugucaaaucaucuaccggcccaggugaacaacugaggaaugcacuguggcacacaggugauaccgagucccaagugcggcuguuguggaaagauccuagaaacgucggauggaaggauaaaaagaguuacaggugguuucuacaacaucgcccucaggucggcuacauuagagugcgcuucuacgaaggccccgagcugguggccgacucaaauguaguacuggacaccaccaugcgagggggaaggcugggugucuucuguuuuucucaggaaaauaucauaugggcaaaccugcgauaccgauguaacgauacuauccccgaagacuacgaaacacaccagcuccgccaagcuuag

SEQ ID NO: 248573 - RNA, 2700 nt, Artificial Sequence
  Description of Artificial Sequence: Synthetic coding sequence
auggaucgaaagguagccagagaauuucgucauaaaguagauuucuugauugagaacgacgccgagaaagauuacuuguaugauguucugagaauguaucaccaaacaauggacguggcugugcuugugggggauuugaagcuggugaucaacgaacccucccgccugccccuguuugacgcgauacgaccucuaaucccgcugaagcaccagguggaguacgaccaacuuaccccucggcggagucguaaguuaaaagaagugaggcucgacagacuccacccggagggucugggguuguccgugcgaggcggacuagaauuugguugcggcuuguucaucagucacuuaaucaaaggcggacaggccgacucgguggggcugcaggucggcgaugaaaucguucgcauaaauggguacucaauuucuaguuguacccacgaggaggugauuaaccugauccgaacuaagaagacagucaguauuaaaguucgacauaucggccuuaucccggucaaaaguaguccagacgagccccugaccuggcaguauguggaccaguucgucagugagucugggggcgugaggggaucacucggcucuccgggcaaucgggaaaacaaagagaaaaaggucuucauuucuuuaguggguagccggggacuaggguguucaauaaguuccggaccuauucagaagccuggaaucuuuaucucacaugugaagccaggcagucucagugcugaggucgggcuagagaucggggaccagaucgucgagguuaacggggucgacuucucuaaccuggaccauaaagaagccgugaauguucuaaagaguagucgauccuuaacgaucuccaucguggccgccgccggcagggagcuauucaugaccgacagagagaggcuggcugaggcccgccagagagagcugcagcgacaagaguuacugaugcagaagcgccuggcaauggaaagcaacaagauacugcaagaacagcaggagauggaacgucagagacgcaaggaaaucgcccaaaaagcagcugaagaaaaugagcgguacaggaaagaaauggagcagauaguugaagaggaagaaaaauucaagaaacaaugggaggaggauugggguagcaaagaacagcucuugcucccaaagacgauuacggcugagguacauccuguucccuugagaaaaccuaaaagcuuugggugguucuaucgguacgaugguaaguucccaaccauuagaaaaaagggaaaagacaagaaaaaagcaaaauaugggucacugcaggaccugcggaaaaacaaaaaagagcuggaguucgagcagaagcuguacaaagaaaaagaggaaauguuagagaaagagaagcagcuaaagaucaaccgguuggcccaggaagucucggaaacugaacgggaggacuuagaagagucagaaaagauccaauacuggguggagaggcugugccagacucgauuggaacaaauuucauccgcugauaacgagaucuccgagaugacuacagggccgcccccucccccacccucaguuuccccucuggccccaccccuccgaagguucgcagguggucugcaucugcacacuaccgaccuggaugacauaccccuggacauguuuuacuauccccccaagacaccgucggcuuuaccagugaugccucaccccccgcccucuaaccccccacacaagguuccugccccucccgugcuuccacuaucaggccacgugucugccagcagcucuccguggguccaacgcacucccccaccuauaccaaucccaccaccacccaguguccccacucaggaucugaccccgacucgcccauugccaagugcccuagaggaagccuuguccaaucaucccuuucgcaccggugauaccggcaaccccguggaagacugggaagcaaaaaaccacuccggaaagcccaccaauucccccgucccagagcaaucauucccaccuaccccgaaaacauuuugccccagcccucagccgccaagaggaccuggggucuccaccaucuccaaaccugucauggugcaccaagagcccaauuucauuuauagaccugccgugaaauccgaaguucugccacaggagaugcuuaagagaaugguaguguaccagaccgcguucaggcaggauuuucgcaaauacgaggaaggguuugacccuuauaguauguucacucccgagcaaauuaugggcaaggaugugcguuuacugcgaaucaagaaggaggguucccuggaccuugcccuggagggcggcguggacuccccaaucggcaagguuguggugagugcaguuuaugaacgaggcgcagccgagcggcauggcgguauaguuaaaggagaugagaucauggccaucaauggcaaaauaguuacugauuauacccuagccgaggcagaggcagcuuugcagaaggcuuggaaccagggcggcgauuggauugacuuggucguagcugugugcccuccaaaagaguacgacgacgaacuagccaguuugccguccucaguggcagagucaccacagcccguccggaaguuacuagaggaccgcgcugcgguacacaggcacggauuucugcuccagcucgagccuaccgauuuguugcuaaaaaguaagcgggggaaucaaauccacagauag

SEQ ID NO: 248574 - RNA, 825 nt, Artificial Sequence
  Description of Artificial Sequence: Synthetic coding sequence
augauaaucucccauuuuccgaagugcguugcaguauucgcauugcuggcacugagcgugggcgcauuggauacauuuauugccgcuguguacgagcacgccguuaucuuaccgaaccguacagaaacaccuguaucuaaggaagaggcacugcuguuaaugaacaagaauauugacguacuggaaaaagccguaaagcuggcugccaagcaaggcgcacauauuauagucacaccugaagacggaaucuacggauggaucuucacccgcgagucaauuuauccuuacuuagaggauauucccgacccaggcguuaauuggaucccgugucgggaccccuggagauuuggaaacacucccguacaacagcguuuaucaugccuggccaaggacaacuccauuuauguggucgcgaacauaggugacaaaaaacccugcaacgccagcgauucacaguguccaccagauggcagguaccaguacaacacggacguuguguuugauucucaaggcaaacuccuggcccgcuaucauaaauauaaucuguucgcacccgaaauucaguuugacuucccuaaggacucagaauuagugacauucgauacgccguuuggaaaauuuggcauauucacuuguuuugauauuuuuucacaugauccugccgucgucgucguggaugaauuucagcuuaccgcuuucucaacuccccagcauggcacgacacgcugccccucgucucggcucuucccuuccauccagcauggaccgagacccugggaauccauauaccuuuuacagauccccaccacacccgcaugcacuuag

SEQ ID NO: 248575 - RNA, 444 nt, Artificial Sequence
  Description of Artificial Sequence: Synthetic coding sequence
augauaaucucgcacuuucccaaauguguugccgucuuugcccuccuggcccugucugugggggcacucgauacuuucauugcggccguguacgagcaugcuguuauauuacccaacagaaccgagacgcccguuaguaaagaagaagcuuugcuucuaaugaauaaaaacaucgacguacuggagaaggccgugaaauuggccgccaagcagggagcccauauuauagucaccccagaagacggcaucuaugguuggauuuucacaagagagucaaucuaucccuaccucgaagacauuccagacccuggaguaaauuggauuccuugccgggauccuuggcguaagagcaagaaaaugaacgagccagucucaaaagaacuuugcuaucacugucacucugaauguaaccaauauggucaauggaaguuguacagaaccuag

SEQ ID NO: 248576 - RNA, 624 nt, Artificial Sequence
  Description of Artificial Sequence: Synthetic coding sequence
augauuaucucacauuuccccaagugcguagcgguguuugcccuccucgcuuuguccgucggagcacuggauaccuucaucgcugcaguguacgaacaugccgucauccuaccaaacaggacagagacccccgugucaaaggaagaggcucucuuacucaugaacaagaauaucgauguucucgaaaaagcugucaaauuggcugccaagcaaggugcacacaucaucgugacccccgaggacggcaucuaugguuggauuuuuacccgugaaaguauuuaucccuauuuggaggacauaccugauccaggugucaauuggauuccgugucgcgacccuuggcgcuuugggaacacuccgguucagcaacggcuuaguugccuugccaaggacaacaguauuuacgugguagcuaacauaggcgacaagaaaccaugcaacgccagcgacucccaaugcccaccagacggacgguaccaguauaauacugacguuguguucgacucccagggaaagcuccuugccagguaucacaagggcguggaaucuacaccucagaagcaaaguagguguacaacaaugacauggaagcaacgugugguaucuugcuguuaucagaauuag

SEQ ID NO: 248577 - RNA, 303 nt, Artificial Sequence
  Description of Artificial Sequence: Synthetic coding sequence
augucgaccggcccaaccgcugccacaggcuccaauagaagacugcagcagacacagaaccagguugaugaaguuguugacauuaugagggucaauguggacaagguauuagagagagaucaaaagcuaucugagcucgaugaucgggccgacgcucugcaagcuggcgcgucccaauucgaaacuuccgccgcaaagcugaaacgaaaguacugguggaaaaacugcaagaugugggcgaucggcaucaccguccugguaauuuucaucaucauaaucaucguauggguaguuucauccuag

SEQ ID NO: 248578 - RNA, 1110 nt, Artificial Sequence
  Description of Artificial Sequence: Synthetic coding sequence
augcgagcuugcauuagucugguacuugcuguccugugcggucuagccugggcugaggaucacaaagagucagagccccugccucaguuagaggaggagacagaagaggcucuugcaagcaaucuauacuccgcucccaccucuugucagggaagguguuaugaggccuucgacaagcaccaucagugccacuguaaugcccgcugucaggaguucgggaacuguugcaaagauuucgaguccuuauguucagaucacgaggugucucauagcucugacgcaauaacuaaggaagagauacaguccaucucugagaaaauuuauagagccgacaccaacaaagcccaaaaagaggacauugugcugaacucacaaaauugcauaaguccuucugagacccguaaccaaguagaucgcugcccuaagccacucuucacuuaugucaaugagaaacuuuuuaguaaaccuacguaugcugcuuucauuaacuugcugaauaacuaucagagggccaccgggcauggcgaacacuuuagcgcccaggagcuggcggagcaggaugcuuuucugagggaaaucaugaaaaccgcagugaugaaagaacuuuacagcuuucugcaccaccagaacagauauggcuccgaacaagaauuuguggacgaccuaaagaauaugugguuuggccuuuacucacguggaaacgaggagggagauucuaguggauuugagcauguguucuccggggaggucaaaaaggguaaagucaccggauuccauaauuggauuagauucuaccucgaagagaaagaggguuuaguggacuacuacucccauauuuacgauggaccuugggauagcuacccagauguacuggccaugcaguucaacugggacggauacuauaaggaggugggaagugccuucaucggaucgagcccagaauucgaauucgccuuguauucccuuuguuuuauagcucggccuggcaaggugugccagcuuagccugggcggauacccucuugcggugagaaccuacacgugggauaagagcacauacgggaacggcaaaaaguauauagccacugcuuacauuguguccuccacuuag

SEQ ID NO: 248579 - RNA, 852 nt, Artificial Sequence
  Description of Artificial Sequence: Synthetic coding sequence
augugcaauacuccuacauauugcgaccuuggaaaagcugcgaaagacguuuucaauaagggguauggcuuuggcaugguuaaaaucgaucuuaagacaaagucuugcucuggcguggaguuuaguacuucgggacaugccuacaccgauacaggcaaggccucugguaaccuggagacuaaguacaaggucuguaauuauggcuuaaccuucacgcagaaauggaacacugacaauacgcuugggaccgagauuucaugggagaauaaacuggcagaaggguugaaacugacauuggacacuauauucgucccgaauacagguaaaaaauccggcaagcucaaagccucauacaaaagggauugcuuuuccgucggguccaacguggauauagauuucucugggccaaccaucuacggcugggccguccucgccuucgagggcuggcuggcgggcuaucagaugucauuugauacagccaaaucuaagcugucacagaacaacuucgcccuuggauacaaagcugcugauuuccagcuacauacccacgucaacgauggcacagaguuuggcggaucaauauaccaaaaagugaaugagaaaauagaaacaagcauaaacuuggccuggacagccggcagcaacaacacaagguucggcaucgcugcuaaauacauguuggauugcaggacgucccuuagcgcaaaagucaacaacgccucccugauuggacuuggcuauacccaaacucuccgucccggugugaaacucacucucuccgcucucauugauggaaagaauuuuucggcaggcggacacaaaguaggacuuggauuugaacucgaagcauag

SEQ ID NO: 248580 - RNA, 621 nt, Artificial Sequence
  Description of Artificial Sequence: Synthetic coding sequence
auggcugcaaauaagccuaagggacaaaacagccuggccuugcacaaggugauaaugguaggcucaggaggcgugggaaaguccgcacuuacauugcaauucauguacgacgaauuuguggaagacuacgagccuacaaaagcagauagcuaccggaaaaaaguggugcuugauggugaggaggugcaaauagacauacucgacaccgcuggccaagaagauuacgccgcaauucgcgacaacuacuuccggucuggagagggcuuccuguguguguucagcauuaccgaaauggagagcuucgccgcaaccgcagacuuucgcgaacagauuuuacggguaaaggaagacgaaaaugugcccuuucuuuugguaggaaacaagagcgaucuggaggacaagaggcagguuucuguugaagaggcaaagaaucgggcagagcaguggaaugucaauuacguugagaccagcgcuaagaccagggcaaauguggacaagguuuucuucgaccucaugagggagauuagagcacggaagauggaggauucuaaggaaaagaacgguaaaaaaaagagaaagucacuugccaaaaggauacgcgagagaugcugcauauuguag

SEQ ID NO: 248581 - RNA, 1170 nt, Artificial Sequence
  Description of Artificial Sequence: Synthetic coding sequence
augcuugaggaaccacguccucgcccuccaccuucuggccuggcaggauugcucuuccuggcucuguguuccagagccuugaguaacgagauccuuggacugaaacugcccggagaaccaccccugacagccaauaccgugugccucacauugagcgggcuuucaaaaagacaauugggacugugucugcgaaacccugaugugacagcguccgcauuacaagggcugcacauagccgugcaugaaugccagcaccagcuccgggaucagcgcuggaauuguagcgcccuagaggggggaggcaggcugccacaccauucagccauucuaaaacggggauuuagagaaucugcauuuuccuuuucaaugcuggccgcuggagugaugcaugcuguugccaccgcuugcagcuuggggaaacuggugucuugcgggugcgguuggaagggcagcggggagcaagacagacuacgagccaagcuuuuacagcugcaggcucugucuaggggaaaaagcuuuccccauagccugccaaguccuggaccuggcagcagucccucuccuggcccacaggacaccugggaguggggcggcuguaaucaugauauggauuuuggagaaaaguuuucccgagauuuccuggauagccgagaagcuccucgugacauucaagcucgaaugagaauacacaauaacagggucggccgacagguugugaccgaaaaccugaagcguaagugcaaaugccauggaacaucugggucuugucaauucaagacaugcuggagagccgcaccagaguucagagccgugggagccgccuuacgagaacggcuggguagggcaaucuucauagacacccauaacaggaauaguggagccuuucagccacgccuucgccccaggagacucuccggggagcugguguacuucgaaaaguccccagauuuuugugagcgagauccgacaaugggcagcccuggaacuagagggagggccugcaacaaaacaucccgauugcucgacggaugcggaucucugugcuguggcagaggucacaauguccucaggcaaacacguguagagaggugccacugcagguuucacugguguuguuaugugcucugugacgaguguaaggucaccgaaugggucaacguuugcaaguag

SEQ ID NO: 248582 - RNA, 576 nt, Artificial Sequence
  Description of Artificial Sequence: Synthetic coding sequence
auguuagaggaaccacggccccgacccccucccucuggcuuggcgggacuuuuguuccuugccuugugcuccagagcccugucgaaugagauucugggucugaaacugccuggcgaaccuccccucacggccaauaccgugugucuuacauuguccggcuuauccaaaaggcagcucgguuuaugccugcgcaacccugacguaacugcaucagcucugcagggacugcauaucgccguccacgagugucagcaucaguuaagagaccaaagguggaauugcuccgcgcuugaaggaggcggccgucugccccaccacucugcuauucuaaaaaggggcuuucgggagagugcuuuuuccuucagcaugcucgccgcuggggugaugcacgccguggccaccgcuugcagccucgggaaguugguuucuugcggauguggcuggaaagggaguggugaacaagaccggcugagagcuaagcuacuacagcuucaagcacuuucccggggaaaacuuccuggaaccagccggcacgaaugcgagucuaccaccacgggauggggcgcccggugguag

SEQ ID NO: 248583 - RNA, 309 nt, Artificial Sequence
  Description of Artificial Sequence: Synthetic coding sequence
augcuggaggagccacgaccgcggccaccuccguccggguuagcuggacugcuauuucucgcacuguguagccgcgccuugaguaaugagauccuggggcugaaacugccgggcgagccuccacugacugcaaacacugucugccuuacacugucaggccuuagcaaacgacaguugggccugugcuuaagaaauccugacguaacagcuucugcacugcaaggauugcacauagcuguacacgagugucaacaccagcuccgagaccaacguuggaacugcagugcuuuggaaggcggggggcgcuag

SEQ ID NO: 248584 - RNA, 1050 nt, Artificial Sequence
  Description of Artificial Sequence: Synthetic coding sequence
augcaucguaauuucaggaaguggaucuucuacguuuuucuguguuuugguguacuuuauguuaagcucggagcucuaucgagcguugucgcacugggcgcaaauaucaucugcaacaaaaucccuggccuugcaccaaggcagcgagcaauuugccaguccagacccgacgcaauuauagugauuggagagggcgcucagaugggaauuaacgaaugucaauaucaguuuagguuugggcgauggaauugcucggcgcucggagagaagaccguguucggccaggaauugcgagucggcucacgugaagccgcuuucaccuacgccaucaccgccgcggggguggcccaugcuguuaccgcugcguguucccaaggaaaucugagcaacugugguugcgaccgcgaaaaacaagguuacuacaaucaggcagaggguuggaaaugggguggauguuccgcagacguuagauauggcauugauuucucgagaagguucgucgacgcccgugaaauuaagaaaaacgcuaggagacugaugaaucuucacaacaacgaggcaggcaggaaggugcuggaggacagaaugcaacuugaguguaagugucacggcgugucuggcagcuguacaacaaaaacaugcuggacuacacugcccaaauuuagagagguagggcauuugcugaaagaaaaguacaacgccgccgugcaaguggaggugguucgagcaagccggcugcgccagccgacuuuuuugcggauuaagcagcuccgaucauaucaaaagcccauggagaccgaccuuguguacaucgagaagagccccaacuacugugaggaagaugcagccacgggaucuguggggacccagggaaggcuguguaaccgaacuucaccuggcgcugacgguugcgacaccaugugcuguggacgcggguacaacacucaccaauauaccaagguguggcaaugcaauugcaaguuccauuggugcugcuucgucaaaugcaacaccuguucggagagaacugagguuuuuacaugcaaauag

SEQ ID NO: 248585 - RNA, 1062 nt, Artificial Sequence
  Description of Artificial Sequence: Synthetic coding sequence
augcuucuacugaguccccgaagugcacucgugucuguguacuguccccaaaucuuucuucuuuuauccucuggaucuuaccuugcccuguccagugugguggcuuugggagcuaacauaaucuguaacaagauacccggccuugcuccgcgacaacgcgcaauuugccaaucccgcccugacgcuaucauuguuaucggagaaggugcccagaugggcaucaaugaaugucaguaucaguuuagguucgggagguggaacugcucugcacuaggugagaaaaccguguucggacaggagcugcgggucggcagccgggaggccgcuuucaccuaugccauuaccgccgcuggaguggcccaugcugugacggcagcuugcagccaaggcaaccucagcaacugugggugcgaucgugaaaagcaaggauauuacaaccaagcagaagguuggaagugggguggguguagcgccgacguucgguacggaaucgauuuuucaagacgguucguugaugcacgcgaaaucaagaagaaugcucgccgcuuaaugaaccugcacaacaaugaggccggccggaaaguucuagaggaucgaaugcagcucgaguguaagugucauggagucucugggagcuguacaaccaaaacgugcuggacaacacuccccaaguuucgggaagugggacaucuguuaaaggagaaguauaaugccgccgugcagguugaagugguccgagcaucuagacucagacagccuaccuuccugcguaucaaacagcugcgcucauaucagaagccaauggagaccgaccuugucuacaucgaaaaaaguccuaacuauugcgaagaggaugcggcuaccgggucaguuggcacccagggaaggcucugcaacaggacgagcccaggcgcagauggaugcgacacaauguguuguggaaggggguauaauacccaucaguauaccaagguguggcaauguaacugcaaguuucacugguguugcuuugugaagugcaauacuuguucugaaagaaccgaaguguuuacauguaaguag

SEQ ID NO: 248586 - RNA, 618 nt, Artificial Sequence
  Description of Artificial Sequence: Synthetic coding sequence
augcaucgaaacuucagaaaguggauuuucuaugucuuucuuuguuuuggugugcuguaugugaagcugggagcuuugaguagugugguugcccucggugcgaacauuaucugcaauaagauacccggcuuggccccgcgacagcgugcuaucugucaaucgagacccgacgcaauuaucgucaucggugagggggcccagaugggcauuaaugagugucaguaucaguucagguucggcagauggaacuguagugccuugggugaaaaaacuguguuuggccaagaguuaaggguuggcagcagagaggccgcuuucacuuacgccaucaccgcugcuggaguagcucaugccgucaccgccgccugcucccaagggaaucuuucgaacugcgggugcgaucgcgaaaaacagggcuacuauaaucaggccgaaggcuggaagugggggggcugcagcgcggacguuagguacggcaucgauuuuucccgccgguuuguggaugcucgcgagauaaaaaaaaacgccagacgccuuaugaacuugcauaauaaugaagcaggacguaaaggccugcuaggucagccccgcgucacaucaucccccuuguucccuuag

SEQ ID NO: 248587 - RNA, 1002 nt, Artificial Sequence
  Description of Artificial Sequence: Synthetic coding sequence
augucugcuccuccauuuuaucgggcccuuuccucggugguggcgcugggagccaacauaaucugcaacaaaaucccuggacuugcuccccgucaaagagccauuugucaguccagaccagacgcuauuauugugauuggcgagggugcucagaugggaauaaacgaaugccaguaccaauucagguucggacgguggaauugcucugcccugggggaaaaaacugucuuuggccaggagcugcguguggggucaagggaggcagcauucacauacgcuaucaccgccgcaggaguggcccacgcugucacugcagcuugcucucaaggcaaccuuucuaacugcggcugcgaucgagaaaaacaggguuauuacaaucaggcagaaggcuggaaaugggggggcugcuccgccgaugugagguacggaauugacuuuucuagaagguucguagaugcacgggaaaucaaaaaaaacgcucgcaggcugaugaaccugcauaacaacgaggccggucgcaaaguuuuggaggacaggaugcaauuagagugcaaaugccacggagugucuggaucauguaccacaaaaacauguuggacgacacugccuaaguuucgugaggucggucaucugcugaaagaaaaauacaaugccgccguucagguggaagucguaagggcaagccgcuugcggcaaccaacuuuccuccggauaaagcaacucagaagcuaccagaaaccaauggaaaccgacuuaguuuacauugagaaaagccccaauuacugugaagaggaugcugcaacagguucagugggaacccaaggcagguuauguaaccgcaccucgccgggggcugaugguugcgacacuaugugcuguggucgagguuauaauacgcaucaguauaccaagguguggcaguguaauugcaaauuccacugguguuguuucgugaagugcaacaccuguucugaaagaacugagguguuuaccugcaaauag

SEQ ID NO: 248588 - RNA, 174 nt, Artificial Sequence
  Description of Artificial Sequence: Synthetic coding sequence
auggguaucaaugaaugccaauaucaguuuagauucgguagauggaauugcucugcacugggcgagaaaacggucuuuggucaagaguugagagugggauccagagaagcagcuuuuacauacgcaauaacggcagccggaguggcccacgccgugacugcugcuugcuccuag

SEQ ID NO: 248589 - RNA, 1119 nt, Artificial Sequence
  Description of Artificial Sequence: Synthetic coding sequence
augaacaaaaggcggcuucuauauccuaguggauggcugcauggccccagugacaugcagggccucuuauuuagcacacucuuauuagcuggauuggcacaauuuugcugccggguccaaggcacuggaccccuugacacuacuccggaaggacgcccuggcgagguaucugaugcaccucagagaaagcaguuuugucauuggccaugcaaaugcccucagcaaaaaccgcggugccccccagggguuagccucguaagagacggcuguggguguuguaaaauaugugccaagcaaccaggagaaauuugcaacgaggcagaucugugcgauccccauaaaggcuuauauugcgacuacagcguggaccgcccacgcuacgaaacuggaguuugugccuaucuggucgcagugggcugcgaauuuaaccaggugcacuaucacaacggacaaguguuccaacccaaucccuuguuuagcugcuugugugucucaggcgccauuggcugcacgccacuguucauacccaagcuugccggcucccacugcucgggagcaaaagggggcaagaaauccgaucagucuaacuguucucuggagccccugcuccagcagcucucuaccagcuacaaaacgaugccagccuaucgaaaccucccccugauuuggaagaaaaaaugccuagugcaggcgaccaaguggacuccauguagucggaccugugggauggguaucuccaaccgggucacgaacgagaauuccaacugcgagaugagaaaagagaagcgacugugcuacauucaacccugcgauucuaacauacucaagaccaucaagauacccaagggaaagacuugccagcccacguuccagcuguccaaggccgagaaauuugucuuuuccgguuguagcaguacucaguccuauaaaccuacuuucugcggaaucuguuuagacaaaagguguugcauaccuaauaaauccaaaaugaucaccauccaguucgauugucccaaugaggggagcuucaaguggaaaaugcuuuggaucacuucaugugugugucaaagaaacugccgcgagccaggagacaucuuuucugaauugaagauccuuuag

SEQ ID NO: 248590 - RNA, 996 nt, Artificial Sequence
  Description of Artificial Sequence: Synthetic coding sequence
augaagauuagcaggggccggguaugucuugaauccgagaacaaggacgcaggcgucgcuggucggaagcaauucugucauuggccaugcaagugcccucagcagaaacccaggugcccacccggagugucccugguuagagauggcugugggugcugcaagaucugugcgaagcagcccggugagaucugcaacgaggcagaucugugcgauccccacaaggggcuuuacugcgacuauucaguggaucgaccccgguacgagacaggagugugcgccugcaaaagcguuggcugugaauuuaaccaggugcauuaucacaacggucaggucuuucaacccaacccccucuucucaugccuaugcguuucuggggcaauuggcuguacuccacuauucauaccuaagcuugcggggagccacugcaguggagccaagggcggcaagaaaucagaccaguccaauugcucgcucgaaccauuacuccagcaacugucuacuagcuauaagacgaugcccgccuaucguaacuuacccuuaaucuggaaaaagaaauguuuagugcaggcuacgaaguggacacccuguucaagaaccugcgguauggguauuuccaacagaguuaccaaugaaaacaguaauugugagaugagaaaggagaagcgauuaugcuauauacagcccugcgacucaaacauccucaaaacaauuaaaauuccaaaagguaagacaugccagcccacauuccagcucaguaaagcagaaaaauuuguguuuaguggaugcaguucuacucagucauacaaaccaacuuuuuguggaaucugcuuagauaaacgcugcugcauuccaaauaaauccaaaaugauuacuauucaguucgacuguccaaacgaaggcucuuucaaauggaaaaugcuguggauuacaaguugcguuugucagagaaacugccgggagccgggugacaucuuuucggaacucaagauccuguag

SEQ ID NO: 248591 - RNA, 1065 nt, Artificial Sequence
  Description of Artificial Sequence: Synthetic coding sequence
augcagggccugcucuucuccacucuccuauuagcuggucucgcacaauuuugcugcagagugcagggaaccggaccccuggauaccacaccagaagguaggcccggggagguuucugacgccccgcagagaaagcaauuuugucacuggccaugcaagugcccccagcagaagccacggugucccccuggaguuucccuuguccgggauggcugcggcugcugcaaaauuugugccaagcagcccggcgagauauguaacgaggccgaucuuugugacccccauaaggggcucuacugugauuauagcguagaccgaccuagauacgaaaccggagugugcgcauacuuaguggcaguagggugugaguuuaaccagguucacuaccauaacgggcagguguuccagccaaacccuuuguuuucaugccuuugugucagcggcgcuaucgguuguacacccuuguucauaccaaagcuggccgguucucauugcuccggggcgaagggagggaaaaaauccgaccaaucuaacugcucacuugaaccgcugcuucaacaacuguccaccagcuauaagacgaugcccgcuuaccguaacuuaccacucaucuggaagaaaaaguguuugguucaggcaacaaaauggaccccgugcagcaggaccugcgggaugggaauuucaaacagggugacaaacgagaauucuaauugcgaaaugcgcaaagagaagcgccucuguuacauccaaccuugugauagcaacauucuaaagacgauaaaaaucccaaaaggcaagacaugccaaccaacauuccaacugucaaaagccgaaaaauucguuuucucuggauguuccaguacucagagcuauaagcccaccuuuugcggaauuugccuggauaagagguguugcaucccaaauaaaaguaagaugauuacuauccaguuugauugcccaaaugagggaaguuucaaauggaaaaugcuguggauaacaucguguguuugccagaggaacugccgagagccaggagacaucuucuccgaacugaaaauucuguag

SEQ ID NO: 248592 - RNA, 693 nt, Artificial Sequence
  Description of Artificial Sequence: Synthetic coding sequence
augcagggacuucuuuucaguacguuguuauuggcaggguuagcucaguucugcugccgcgugcagggcaccggaccauuggauaccacccccgagggacguccuggcgaggugucugacgcaccccaacgcaagcaauucugucacuggcccugcaagugcccucagcagaaaccuagguguccucccggagucucacuggugcgggacggguguggcugcugcaaaauaugugcaaaacagcccggcgagaucuguaaugaggccgaucucugcgauccccacaaaggacuguauugcgauuacucagucgacaggccuagauaugaaacaggcgucugcgcguaucuugucgcgguagguugcgaauucaaccaggugcacuaccauaacgggcaaguguuccagcccaauccucuauucucuugucuguguguaagcggcgcaauagguuguacuccucuguuuauuccuaaauuggcaggcucccauugcagcggcgcuaaaggagguaaaaaaagcgaccagucaaacugcucacuggagccacugcugcaacaacugaguacgucuuauaagaccaugccagccuaccggaaccuaccacugaucuggaagaagaacguucuauguaaacagcaaaacgggcuuccugcuccagagcaugucggaugggaguacuugaccggcuag

SEQ ID NO: 248593 - RNA, 393 nt, Artificial Sequence
  Description of Artificial Sequence: Synthetic coding sequence
augggaauuucgaauagagugaccaacgagaauucuaacugcgagaugcggaaggagaaacgcuugugcuauauccaaccuugcgacucuaauauauuaaagaccauuaaaauuccaaagggaaagaccugucagccaaccuuccaacuuucaaaagccgaaaaguuuguguuuagcggaugcucgagcacacagagcuauaagcccacuuucugcggaauuugucucgauaaaagguguuguauucccaauaaguccaagaugaucaccauccaauuugacuguccuaacgaagggagcuucaaauggaaaaugcucuggauuacuaguugcgugugucagcgaaacugcagagaaccuggcgauaucuuuagugagcugaaaauacucuag

SEQ ID NO: 248594 - RNA, 462 nt, Artificial Sequence
  Description of Artificial Sequence: Synthetic coding sequence
auguaccguaugcagcugcuuucuuguauugccuuaucucuggcucuggucaccaauagugccccuacuuccuccuccacuaagaagacacaauugcaguuagaacaucuucugcucgauuuacagaugaucuugaacggcaucaacaauuacaaaaauccuaagcuuacaagaaugcucacauuuaaauuuuauaugccaaagaaggcuaccgaacuuaaacaucugcaaugccuagaggaagaguuaaagccucuagaggaggucuuaaaccuugcucaaucaaaaaauuuccauuugcguccccgcgauuuaaucuccaacaucaauguuauaguacucgagcucaaaggcucagagacaaccuuuaugugcgaauaugccgacgaaaccgcuacaaucguugaauuccucaaucgcuggauaaccuuuugucaaaguauuauuucaacgcugaccuag

SEQ ID NO: 248595 - RNA, 984 nt, Artificial Sequence
  Description of Artificial Sequence: Synthetic coding sequence
auguuucccucccgacgaaaggccgcucaacuacccugggaggauggaagaucuggccugcugagcggggguuuaccacggaagugcagcguauuccacuuguuuguggcaugcuuauccuuggguuucuuuucacugcucuggcugcagcugaguuguuccggcgauguggcucgggccguucggggccaggggcaagaaacaagugguccgcccagagccugucccccugagccgcccccugagcacugggaggaggacgcaagcugggguccccaucggcuggcuguucuggugcccuuuagagaacgauucgaggagcuguuaguguucguuccacauaugagacgguuucucucacguaaaaagauccgacaccacauauaugugcucaaucaaguggaccacuuccgauucaaucgugccgcccuuauuaauguaggauuccuggagucuucaaacagcacugacuacauugcuaugcaugacgucgaccugcuuccccuuaacgaggaguuagauuacgguuuccccgaggcuggcccuuuucaugucgcaagccccgaguuacauccucucuaucacuacaaaacuuacgugggagguauucuguuacugucgaagcagcauuaccgccugugcaauggcaugaguaaucgcuuuuggggcugggguagggaggacgaugaauuuuauaggcggaucaaaggggcuggacuccagcucuuuaggcccucuggaaucacaacaggcuauaaaacauuucggcacuuacacgacccggcauggagaaaacgcgaucagaaaagaauugccgcccagaagcaagaacaguuuaagguggaccgggaaggcggacucaauacagugaaguaucacguggcaagucgcacagcauuauccgucggaggggcccccuguacagugcuaaacaucaugcuggauugcgauaagaccgcuacaccuuggugcacuuucagcuag

SEQ ID NO: 248596 - RNA, 2598 nt, Artificial Sequence
  Description of Artificial Sequence: Synthetic coding sequence
augguagcauccgccagagugcagaaacuggugagacgcuacaaguuggcuauugcuacagcacuggcuauucugcucuuacagggccuggugguuuggucuuucaguggacuagaggaggacgaagcaggggagaagggacggcagaggaagccgagaccucuggauccaggggaagggucgaaggacacugacaguagugcuggaaggaggggaucaacuggacgccggcacggaagguggaggggccgcgcagagucccccggggugccugucgcuaaggucgugcgugccguaacaucccgucaaagggcuucuagaagggugccuccagccccuccucccgaggcucccggaagacagaaucugaguggcgcugcggcaggugaggcucucgugggggcagcaggguuuccuccacacggagacaccggcaguguagaaggcgcuccccaacccaccgauaaugguuucacaccuaagugcgagaucguaggcaaggaugcccucucagcauuagcgcgcgccucuaccaaacagugucaacaggaaaucgcaaacgucguaugucuccaccaggccgggagccugaugccgaaggcuguuccgcgccacugccagcucacggguaaaaugucuccggguauucagugggacgagagccaggcgcaacaaccaauggacgguccuccaguacguauugcguacauguuggugguccauggcagggcuauccgacaguuaaagcggcugcuaaaagcagucuaucaugagcagcacuucuucuauauucacgucgacaagagauccgauuaccuccacagggagguuguggagcuagcgcaggguuacgacaauguucgugugacacccuggagaauggucacuauuuggggcggcgcuagucugcugcgcauguaccuccguucaaugcgugaucuucuagaagugccagguugggccugggauuuuuucauaaaucugagcgcuacagacuauccaacaagaacgaacgaagagcucguggccuuccugaguaagaacagagauaaaaacuuuuugaagagccacggacgagacaacagccgguuuauuaagaagcaaggccuugauagacuuuuccaugaaugcgauucacacauguggcgccuuggagagcgccaaauaccagccggaaucgucguggacggcgggucagauugguuuguccugacuagaaguuucgucgaguacgucguguacaccgacgauccguuaguugcccagcugaggcaguucuauacuuacacacuucucccugccgaaagcuucuuucauacagugcuggagaauuccuuagccugugagacucuaguggauaauaaucugcguguuacaaacuggaaucggaaguugggauguaagugucaguauaaacacaucguggacuggugugggugcagccccaaugacuucaagccgcaggauuuucuuagauugcagcagguaucuaggccaacauucuuugcaaggaaauucgaaucaacugugaaucaagaggugcuugagauccucgacuuccaccuguaugguagcuauccccccggcacucccgcacugaaagccuauugggaaaauacauacgaugccgcugauggcccuagcggacugagcgaugucauguuaacugcauauacagccuuugcaaggcuguccuuacaccacgcugcaaccgccgcuccuccgauggguacuccccuuugucgguucgaaccucgcgggcugcccuccucggugcaccuguacuucuaugacgaccacuuucagggguacuuggucacgcaggcuguccaaccaagugcucaagggcccgccgaaacccuggagauguggcucaugccccagggaucucuuaagcuccuuggacgguccgaccaagcaagcagacuccaaucuuuggaggucggcacagacugggacccuaaagagaggcuuuuucggaacuucggcgguuugcuggggccacuggaugagccugucgcagugcagcgcugggcgaggggccccaaccugacagcgacggugguguggauugaucccacauaugugguggcgacaucauacgauaucacagucgacacugagaccgaagucacucaguauaaaccuccuuugucaagaccuuuaagaccuggcccuuggaccguacgacuacugcaguuuugggagccuuugggcgagacucgguuuuuggucuugccacuuacauuuaacagaaagcuuccccuuagaaaagacgacgcaagcuggcugcaugcaggacccccacacaacgaauauauggagcaaaguuuccagggauuguccagcauuuuaaaucuuccgcagccugagcuagccgaggaggcugcccagaggcauacacaacuaaccggcccugcucucgaggcuuggaccgaucgggagcucagcagcuucuggucuguugccggauugugcgcaauugggcccaguccaugccccucucuugagccaugcagguuaaccucuuggucgagccuuucuccagauccuaagagugagcucggaccugugaaggccgacggacgacugagguag

SEQ ID NO: 248597 - RNA, 1503 nt, Artificial Sequence
  Description of Artificial Sequence: Synthetic coding sequence
augauuauuagccauuuccccaaauguguugccguauuugcgcuucucgcacucagcguaggcgcucuugacacguucaucgcggcgguguaugaacacgcugucaucuugcccaaccgcacagagacccccgugagcaaagaagaagcccugcuucucaugaauaagaauaucgauguccuagaaaaagccguaaagcuggccgcgaaacagggcgcccacauuaucgugacacccgaggaugguaucuacggcuggauauuuacacgcgagagcaucuaccccuaccucgaagauaucccagacccuggcgugaauuggaucccaugccgugauccuuggagguucgggaacacaccuguucaacagcgacuuucuuguuuggccaaggacaauagcauuuaugugguugcuaacaucggggauaagaaacccugcaaugcuuccgauagucaguguccacccgacggaagauaccaguauaacaccgacgugguguuugacucucaggguaaauugcuggcucgauaucauaaguacaaccucuuugcccccgaaauucaguuugauuucccaaaggacagcgaacucgucacauucgauaccccauuuggaaaguucggcauuuucacuugcuuugauauauucucucacgauccggcagucguggugguggacgaauccauugacuccauccuguaucccacugccugguacaacacucuuccccuauuaagcgcaguaccauuucacagugccugggcuaaggcaaugggaguaaaccuccucgcagccaacacccauaacacuucaaugcacaugaccggcuccggcaucuacgcacccgaagcagugaaaguauaucauuacgauauggagaccgaaagcggacaguugcugcuuuccgagcugaaaaguagaccccggcgggaaccaaccuaccccgcagccguggacuggcacgccuacgcaucgucugucaaaccauucuccagugagcaaucugauuuucugggcaugaucuacuucgaugaauuuaccuuuacgaagcuaaaaagaaacacagggaauuacaccgccugccagaaggaccuuuguugccauuugacuuacaagaugucugagaagaggacagacgagauuuaugcucugggugcauucgacggacuucauaccgucgagggacaauacuauuuacagauuugugcuuuacuaaagugucagaccacagacuuggaaaccugcggagaaccugugggcucagccuuuacaaaauuugaggacuuuucucucuccgggacauucggcacacgauauguguucccccagaucauccugucuggcagucagcuggcucccgaacgacacuaugaaaucagccgcgacggucggcugcgaucucgauccggagcaccucugcccguucuugucauggcccuuuacggccgggucuucgaaaaagacccgccgagacucgggcagggaagcggaaaauuccaauag

SEQ ID NO: 248598 - RNA, 10704 nt, Artificial Sequence
  Description of Artificial Sequence: Synthetic coding sequence
auggaaacaugugauucaccuccuaucagccggcaagagaauggccagucuacaagcaagcuaugugggacgacccagcuugauaaugaggugcccgaaaagguugcaggaauggaacccgaucgagagaauucuucuaccgacgauaacuuaaagacugaugaaagaaaaucggaggcccugcucggguucaguguggaaaacgcagccgccacucaggucacuagugcuaaggaaaucccguguaaugaaugugccacuagcuuuccaucccuucaaaaguauauggaacaccacugccccaaugcuaggcugccgguucucaaagaugauaacgagagugagaucucagagcuugaggauucugacguagagaaucuaaccggcgaaaucguguaccagcccgaugguucugcauacaucaucgaagacucuaaggagagcggacaaaacgcccagacuggcgcuaauuccaaacuuuucucuacagcaauguuuuuagacucucuggccagcgcgggggagaagagugaccaaucggcuuccgcucccaugucuuucuauccccaaauuauuaacacguuccauaucgccagcucucucggaaagcccuuuacugcggaccaagcauucccaaauaccuccgcccuugcgggagugggcccaguacugcacuccuucaggguguaugaccugagacauaagcgagagaaggacuaccucaccagugaugggagcgcuaaaaacaguugugugaguaaggacgugccaaauaauguagaccugaguaaauucgacgggugcguaucagacgguaagcguaaacccguacuuauguguuuccuguguaaacugucuuuuggauauauacgcagcuucgugacgcaugcaguccaugaucaccguaugacccuaaaugacgaagaacagaagcuacugagcaauaagugcgugucagcuauuauucaagguauagguaaggauaaggaaccucucaucagcuuucuggagccuaagaagucaacaagcguguacccacauuuuuccaccacuaaccugauaggaccugacccgacuuuucgcgggcucuggagcgccuuccauguggagaauggggacagcuugccggcgggauuugccuucuuaaaaggcuccgcuucuacguccuccucugccgagcagccuuuaggcaucacgcagaugcccaaggcagagguaaaccucgggggacuaagcucacucgucguaaauacccccauuacuucagucucccugagucacucuagcucugaguccuccaaaaugucugaguccaaggaccaggaaaauaacugugaacggcccaaagaauccaauguccuacacccaaacggggaauguccaguaaaaagcgagccaacugagcccggggaugaggacgaggaggaugcguauucaaacgaacucgacgacgaggaggugcugggcgaacugacggacaguaucggcaacaaagauuuuccgcuucuaaaucaguccaucaguccccuuaguucaaguguucugaaguucaucgagaaaggcacaagcucaucaucagccacagugagcgaugacaccgaaaagaaaaaacagacagcugcugucagggcgagcggauccgucgccucgaauuauggcauuagcggaaaagauuucgccgaugcuucugcuuccaaggacagugcaacugccgcucacccgagcgaaaucgcacgaggagaugaagacucauccgccaccccccaccaacauggcuuuacuccaaguaccccuggaacuccugggccagggggcgacgggagcccuggcucagggauugagugccccaagugugauaccgugcugggauccucucggagccuuggagggcacaugacaaugaugcauaguaggaauagcuguaaaacccucaagugucccaagugcaauuggcacuacaaauaccaacagacacuggaagcccacaugaaggaaaagcaucccgaacccggagggucuugcguguauugcaaaaccggacagccccaccccagacuggcgcguggagaaucuuauacuuguggcuacaaaccuuuccgcugcgaagucugcaacuacuccacaacaacaaaaggcaaucuguccauacauaugcaaucagauaagcaccugaauaauguccagaaccuucaaaauggaaauggagagcagguguuugggcacuccgcuccagcacccaacaccucacuguccggauguggcaccccgaguccuucaaagccaaaacaaaagcccacauggcggugugaagucugugacuacgaaacaaacguugcgcguaaucuccgaauccauaugaccagugaaaagcauaugcauaauaugauguugcugcagcaaaacaugaagcagauccagcacaaccugcacuugggcuuagcccccgcagaggccgaacuguaucaguacuaucucgcccagaacauagggcucacaggcaugaagcuggagaacccggcagacccccagcugaugauuaauccauuucaacucgaucccgccaccgccgcagcucuggcccccgguuuaggcgagcugucaccguauaucagcgacccagcauugaagcuguuucaaugugcagucugcaacaaguucacgucugauucauuagaggcccucagugugcacgucucuuccgagagauccuugccagaggaggaguggagagcugucaucggggacaucuaucaaugcaagcuuugcaacuauaacacgcagcucaaggccaauuuccaacugcacugcaagaccgauaaacauaugcagaaauaucaacugguugcccacauuaaagagggcgggaaaucuaaugaguggaggcugaaguguauugcaaucggcaauccaguccacuugaaaugcaacgcgugcgauuacuacacuaacaguguggacaagcugcgucuacacacgacaaaccaccgacacgaggccgcccucaaacuauacaaacacuugcaaaagcaggaaggcgcugugaacccagagucuugcuacuacuacugcgcggugugcgacuacaccaccaagguuaagcuuaauuugguccagcaugugcgguccguuaagcaccagcagacugaggggcuccgaaagcugcaacuacaccagcagggacucgccccagaggaagauaaccugagcgagauauucuucgugaaagauugcccccccaacgagcucgagaccgccucacugggugccaggaccugugacgacgauuugaccgagcagcaugaggaggcugagggggcgaucaagccuacggccgucgcggaggacgaugagaaagauaccucugagagagauaauucugagggcaagaacucuaacaaagauucagucaguguugccggcgggacacaaccccucuuguuagcaaaagaggaagacgucgccacaaaacgauccaagccuacagaggacaacaaauuuugucacgagcaauuuuaccaguguccauacugcaauuacaacucuagagaccagucacggauacagaugcauguucucagccagcacucaguacagccugugaucuguugcccauugugucaagacgugcugagcaacaagaugcaccuucaauuacaucugacccaccuacacuccgucucgccagacuguguggaaaaauugcugaugaccgugccugucccggacgucaugaugccuaacuccaugcugcucccugcagccgccucagaaaagagugagagagacacccccgcugcuguaacagccgaaggcuccgguaaguacagcggcgagucaccaauggaugauaagagcauggcugggcucgaggacagcaaagcuaacgucgaagugaagaaugaggagcagaagcccaccaaagagcccuuggagguaucagaguggaacaaaaacaguagcaaagacgugaagauccccgauacucugcaagaucagcugaaugaacagcaaaagcggcagccuuuaucagucagcgacaggcauguguacaaauacagauguaaccauugcagccuggcuuucaaaaccaugcagaaacugcagauccauucucaguaucacgcuauucgcgcagccaccaugugcaaccugugccagcgcuccuuuaggaccuuccaagcauugaagaagcacuuggaggcaggucacccugaacucucugaagcugaguuacagcaguuguaugccucccugccuguuaacggagaacucugggcugagucugagacuaugucacaggaugaucauggcuuagaacaggagauggagcgggaguaugaaguggaccacgagggcaaggcaagcccagugggguccgauuccuccaguauccccgacgacauggguucugagcccaaaaggacccuucccuuuagaaagggcccuaacuucaccauggaaaaauuccucgauccaucaaggccauacaagugcacagugugcaaagagucuuuuacccaaaagaacauacugcugguccauuacaacagugucucacacuuacauaagcucaaaaaaguauuacaggaagccuccagcccagugccacaggagacuaacucgaacacugauaauaagcccuacaaguguaguauuugcaacgucgccuacucucaauccagcacucucgaaauccacaugaggagcguucuccaccagacuaaagcaagagcagccaaacuugaaccaaguggacauguggccggcggucacagcauagcugcaaauguuaauucuccgggucaggggauguuggacucuaugucccucgccgcugucaauaguaaggacacucaucuggaugccaaagaguugaacaaaaaacagacaccggaucugaucucggcucagccagcucaucaccccccacaguccccugcccaaauccagaugcaguuacagcacgaacugcagcagcaggcugccuuuuuccagccccaauuuuugaacccagccuuccugccacacuuccccaugacccccgaggcccuacuacaguuucaacaaccucaguuucuguuccccuuuuacauuccuggaacagaguuuucccuggggccugaccugggccugcccggaucggcgaccuucggcaugcccggaaugacugguauggcaggcucccuguuggaagaccugaaacagcagauccaaacccaacaucaugucggacaaacccagcuacagauuuugcagcaacaagcccagcaauaccaagcuacacagccucagcugcaaccucagaagcagcaacagcagcccccuccuccacagcagcagcaacagcaacaggcaucuaagcuccugaaacaagaacaaucuaauauuguuagugcggacugccagauuaugaaggacgugccuaguuacaaggaagccgaggauauuagugaaaagccagaaaagcccaagcaggaauucaucuccgaaggagagggcuuaaaggaagguaaagacacuaaaaaacagaagucccuggagccuagcaucccgccgccaaggauugcuucaggcgcacgaggcaaugcugccaaagcucugcuggaaaacuucggauucgagcuggucauccaguacaaugaaaaucgacagaaaguacagaagaagggaaagucaggcgagggcgagaacacugauaagcuggaaugugggaccugcgguaaguuguucucuaauguauuaauucucaaaagccaucaggaacacguccauggacaguucuuccccuaugcagccuuggagaaauucgcccggcaguaccgcgaagcuuaugacaaacuguacccuaucaguccauccagcccugaaacaccgcccccuccgccuccaccaccuccccugccaccagcacccccccagcccucaucuaugggaccagucaagaucccaaacaccgucagcaccccacuccaagcuccccccccaaccccuccuccaccaccgccaccacccccaccucccccacccccucccccucccccccccccuucggcucccccucaggugcaacucccaguuucucuagaucugccccucuucccaagcaucaugaugcaaccagugcaacacccggcauuaccuccucagcuugcccuccaauugccucagauggaugcucugagugcggacuuaacacaguuaugccagcagcaguuaggucuggacccuaacuuccugcgccauucacaguucaaacgaccucgcacacgcauuaccgaugaucaauugaagauucucagagccuauuucgauauuaauaauucaccuuccgaagagcagauacaggaaauggcugagaagaguggccugagucaaaaggucauuaagcacugguucaggaauacccuauucaaggaaagacaaaggaauaaggacucccccuacaacuucucaaauccccccaucacaguccucgaggacauuaggauagacccgcagcccacaucauuggagcauuacaaguccgacgcuagcuucucaaagaggagcucacggacacgcuuuacagauuaccaguugcgggucuugcaggacuucuuugacaccaaugcuuaucccaaggacgaugagaucgagcaguugaguacaguccugaacuugccaacccguguuaucguugugugguuccaaaacgcccgucagaaggcaaggaaaucauaugagaaccaggccgagaccaaagauaacgagaagcgggaacucacaaacgaaagguacauuaggacaucaaacaugcaauaccagugcaaaaagugcaauguggucuuuccacgaauauuugaucucaucacccaccagaagaagcagugcuauaaagacgaggacgaugacgcgcaagaugagagucagacugaagacucuauggaugcuacagaccaagucguguacaagcacugcacugucagcggccagaccgaugccgcuaagaacgcugcagcuccagcugccuccuccggcucuggcacaagcacaccucugauccccagcccaaaaccugagccggaaaagacuucucccaaacccgaguaccccgccgagaagccuaagcaauccgacccaaguccucccucccaaggaacaaaacccgcccuuccacuugcuagcaccuccagcgaccccccccaggcauccaccgcccagccccagccucagccacagcccccuaagcagccccaguuaauaggccgccccccuucagcuucccaaacuccugugccaaguaguccccugcaaauuagcaugacgucgcuucaaaacucacugccuccacaguugcuacaguaucagugcgaccaguguacuguagccuucccuacgcuggagcuguggcaggagcaccaacauaugcauuuccucgcugcucaaaaccaguuccuccauucuccuuuucuugaaaggccgauggacaugccuuacaugaucuucgaucccaacaacccucuuaugaccgggcagcuuuugggcuccucucucacucagaugcccccucaggccucuucaagucauacuacugcacccacaaccguugcagcaucacucaagcgcaagcucgacgacaaagaagauaauaacuguucugaaaaggaggggggcaacucaggcgaagaucagcauagggacaagcgauugcggacaacuauuaccccugagcagcucgagauccuuuaugagaaguaccugcuggacucuaacccuacgaggaaaaugcuggaccacauugccagagaggugggccuaaaaaaaagggucguucaggucugguuucagaauacgcgcgcccgcgaacgaaagggccaguuuagagcagucgguccagcccagucccacaaaagaugcccuuucugucgcgcccucuucaaagcaaaaucugcgcuggagucccacauuaggagucggcauuggaacgaagguaagcaggcaggauacucucuuccuccaucaccacuuauuuccaccgaagauggcggcgagaguccccagaaauacaucuacuucgauuauccauccuugccccucaccaaaaucgaccucuccagugagaaugagcuggccaguaccguaagcacccccguaucuaaaacagcggagcugucuccaaaaaaccuguugaguccuagcucuuuuaaagccgaaugcagcgaagacgucgagaaccugaacgccccuccugccgaggcaggguaugaccagaauaagaccgacuucgacgagaccucaucaaucaauacagcuauuucggacgcaaccacgggagacgaggguaacaccgagauggaaucuacgacaggcaguuccggagacguuaaaccagcccuuuccccaaaggagccuaagacccuagauaccuuaccuaaacccgccaccacuccaacaacggaaguuugcgacgacaaguuccucuuuucuuuaacaucuccuuccauccauuucaaugacaaggacggagaccacgaccaguccuucuacauuacagaugacccagacgacaaugcagaccgauccgagacaucaucaauagccgaccccaguucaccaaaucccuuugguagcucuaaucccuucaagagcaaaucaaacgaucguccagggcacaaaagguucagaacacagaugagcaaucugcagcuaaaaguccucaaagcaugcuuuucagauuacaggacccccacaaugcaggagugcgaaaugcucggcaacgaaaucggccuuccaaagcgagugguacaggugugguuccaaaacgccagggcaaaggagaaaaaauucaaaaucaauaucggcaagccauuuaugaucaaccaagggggaacugagggaacgaaaccugaaugcacguuguguggcgugaaauauagugcaagacugaguaucagagaucauauauucuccaagcagcacauaucgaaggugcgcgaaaccgugggcagucaauuggaccgcgagaaagacuacuuggcgcccacuacaguccgccaguugauggcccagcaagaauuggauaggauuaagaaggcuucugacguucucggacuuacaguacaacagccagguaugauggacucauccagccuccacgggaucucacucccgacagcauacccgggauuaccaggccuucccccugucuugcugcccggcaugaauggcccaaguagucugccuggcuuuccccagaauaguaacaucgccagcggaaugcucgguuucccuacuucagccacaucaaguccagcccugucccucagcagugcaccaacaaagccccugcuucaaaccccgcccccacccccaccccccccuccaccaccaccauccucgagccucucaggucagcagacagagcaacaaaauaaagaguccgagaagaagcagacaaaaccaaacaagguuaagaagaucaaagaggaggaacuggaggccacuaaaccagaaaaacauccuaaaaaggaagagaagauuagcuccgcccucaguguucuuggcaagguugugggugagacccauguagacccaauccaacuccaggcauuacagaacgcaaucgcaggcgacccagcaaguuucauuggggggcaguuucuuccguacuuuauucccggguucgccucuuauuuuacuccacaguuacccggcacugugcaagguggcuauuuuccacccguuugcgggauggaaucuuuguuccccuaugggccaacaaugccucagaccuuggcggggcuuuccccaggagcacugcugcaacaguaccagcaguaccagcagaaccuucaggaaagccugcaaaaacagcagaaacagcaacaagagcagcagcagaagcccgugcaagccaagacuaguaagguugagucugaccagccgcagaauucaaacgacgcauccgagacaaaggaggacaaguccacagcgaccgagagcacuaaggaagagccccagcuggaguccaagagcgcagacuuuucagacacauacguggucccauuugugaaguacgaauuuauuugcaggaagugccaaaugauguucacagacgaagaugcugcgguuaaucaccagaagagcuucuguuacuuuggacaaccucugaucgauccccaagaaacaguguugaggguaccugugaguaaauaccaaugccucgccugcgauguugccauuagcgguaaugaggcucucucacagcaucuacagagcucgcugcacaaggagaagacaauuaagcaggccaugagaaacgccaaggaacacguacggcuccugccacacucaguauguucuccuaacccuaacacuaccaguacgucacagagcgccgccaguaguaacaacaccuacccucaccugucuugcuuuuccaugaagaguuggcccaacauuuuguuucaagcguccgcccggcgcgccgcaucaccaccaagcagucccccuagcuugagccuuccguccacugucacuuccagucucugcucuacaagcggcgugcagacaagccuacccaccgagucgugcuccgaugaauccgauucagagcugucccaaaagcucgaggaccuggauaacaguuuggaagugaaagccaagcccgcgucuggccuagacggcaacuucaauucuaucagaauggacauguuuucugucuag

SEQ ID NO: 248599 - RNA, 1821 nt, Artificial Sequence
  Description of Artificial Sequence: Synthetic coding sequence
augacccuccucacuuuuagggacgucgcuauagaguucucacuggaagaauggaagugccuagauuuagcacagcaaaaucuguaccgagaugugaugcucgaaaacuauaggaaucuauuuucugucgggcuuaccgucuguaaacccggccucauaacuugccucgagcagagaaaggagccuuggaacgucaagcgacaggaagccgcagacggccacccggaaauggguuuucaccacgccacccaagccugccuagaacugcucggauccuccgaucugccggccucagccucucaaagugccggaauuacuggcgugaaucauagagcucagccgggccucaaugugagcguugacaaguucacagccaugagcucacauuuuacucaagaucugcugccagaacaggguauccaggacgcauucccgaagcggauacucaggggguacggcaauugcggccuugacaauuuauaccuucggaaagacugggaaucauuagaugaaugcaagcugcaaaaggacuacaacgggcucaaccagugcuccuccaccacccauuccaaaauuuuucaauauaacaaguacgugaagauuuucgacaacuuuaguaaccugcacaggagaaauauuagcaacaccggcgagaaaccuuuuaagugucaggagugcggaaaaaguuuucagauguuguccuuccuuacggaacaccagaagauccacaccgguaaaaaauuccagaaguguggugaguguggcaaaaccuuuauccagugcucucauuuuaccgagccugaaaacaucgacacaggcgagaaaccauacaagugccaggagugcaacaaugucauuaagacaugcucagugcugacaaagaauagaaucuacgccggaggggaacauuaccguugugaagaguucggaaagguguucaaucaguguagucacuugacagagcacgaacacgggacagaagagaaaccuuguaaguacgaggagugcucaucuguguucaucuccugcaguagccuaucuaaccaacaaaugauauuggcaggcgagaagcugagcaaaugugagaccugguauaaaggcuucaaccauagucccaaccccuccaagcaccaaaggaacgaaaucggcggcaaaccuuucaaaugcgaggaaugcgauuccauauuuaagugguuuagcgaucugacuaagcacaagcguauucacaccggagagaagccuuacaaaugcgacgagugcgggaaagcuuacacccaguccucccauuugagcgagcacaggaggauccauaccggggaaaagccuuaucaaugcgaagaguguggaaagguguuccguacuuguuccucuuugucaaaucacaaaagaacacacagcgaagaaaaacccuacaccugcgaagaaugugguaacauuuuuaaacagcucagcgaucugacaaaacacaagaagacccacacuggcgagaaacccuacaaaugugacgaaugcgggaagaauuucacccaaucaucuaaucugaucguucacaaacguauccauacaggugagaaacccuauaagugugaggaaugcggccguguguucaugugguuuucugacauuacuaaacacaaaaagacucauaccggugagaagccuuacaaaugcgacgagugcggaaagaauuuuacccagucaagcaaccuaauagugcauaagagaauucacacuggagaaaagcccuacaagugugaaaaaugcggcaaagccuuuacccaguuuucccaccucacugugcacgagaguauucacaccuag

SEQ ID NO: 248600 - RNA, 3804 nt, Artificial Sequence
  Description of Artificial Sequence: Synthetic coding sequence
augggcgauaugaagacuccugauuucgacgaucugcucgccgccuucgacauaccggauccgacgagucuugacgcuaaagaagccauccagacgccuucggaagagaacgagucgccccucaaacccccagguauaugcauggacgaaagcguuagucuaucucacucggggucugcucccgauguucccgcaguuucugucaucgucaagaacaccucacgccaggagucuuuugaagcugagaaagaucauauaacacccagucuccugcacaacggcuucaggggaucagaucucccucccgacccucacaauuguggcaaguucgauuccacauucaugaauggcgacucugcucgaagcuuuccuggcaagcuggagccuccaaaaagcgagccuuuaccgacguucaaucaguuuagcccgauuucaucgccggagcccgaggaucccauuaaagauaauggauuugggaucaagcccaagcauagugacagcuauuuccccccuccccugggcugcggagcugugggggggcccguguuggaggcacuggcuaaguuuccagucccagagcugcauauguucgaccauuucugcaagaaggaaccuaaaccagagccauugccacucgggucucagcaagagcacgaacaguccggacagaacacaguggagccucauaaggauccugacgcuacucguuuuuucggcgaagcacucgaauucaacucacacccgagcaauaguauaggagagucaaaaggcuuagcucgcgaauugggaaccuguuccucagucccuccucgacagcgacuuaagccggcacacuccaaacugucuucaugcguugcagcauuaguagcccugcaggcaaagcgcguggcuagcguuaccaaagaagaccagcccgggcauacaaaagaccucagugggcccacuaaagaauccuccaaagggaguccuaagaugccuaagucuccuaagagccccaggagcccauuggaggcaacacguaaaagcaucaaaccaucugacucaccgagauccauuugcagugacucaagcuccaagggcagcccaucuguggccgcaagcucaccgccggcaauuccaaaagugaggauuaaaacuaucaagacaucaucaggagagauuaaacgaacagugacccggauucugccugaccccgacgauccuucaaaaagcccaguggguucuccccucgggucggccauugccgaagcuccuuccgaaaugcccggcgacgaggucccagucgaggaacacuuuccugaagcuggaaccaacagcggcaguccccagggagcacguaagggggacgagucaaugacuaaggcuucugacaguaguucuccuucgugcagcagugguccacgggugccaaagggagccgcacccggcucacagacugguaagaaacagcaauccaccgcucugcaagccagcacccuagcaccagccaaucuccugcccaaggcgguccaccuugccaaccucaaucugguuccccauucugucgcugccagugugaccgccaagucuuccgugcaaagacgcagccaaccucagcugacacaaauguccgugccacuuguccaucaggugaaaaaggcagccccccuuauuguugagguauucaacaaagugcuccauuccucuaauccagugccacucuaugcccccaaccuuucuccuccugcggauucccgcauacauguucccgccagugguuacuguugccucgaauguggcgaugccuuugcacuggagaaaucucuuagucagcacuauggucgcagaagugugcauauugaggugcugugcacucuuugcagcaagacgcuccuguucuucaacaaaugcagccugcuucggcaugcucgggaccauaagagcaagggacucgucaugcagugcucucagcuccucgugaagcccaucagcgccgaucagauguucgugucagcuccagugaauagcacugcuccggccgcccccgcuccuagcucaagcccaaagcacggcuuaacuuccgguucagcaagccccccuccacccgcgcuucccuuauaccccgauccagugagauuaauccgauacagcauaaagugucuggaaugucacaagcagaugagagacuacauggugcuggcugcucacuuucagagaacuacagaggaaaccgagggacuuaccugccaggucugccaaaugcugcugccgaaccaguguagcuuuugcgcacaccagcguauucacgcucauaagucccccuacugcugcccugagugcggaguucugugucgaagugccuauuuucaaacucaugucaaggagaauugccuccacuaugcacggaagguggguuaucgauguauucauugugguguggugcauuugacucuugcucuucugaagucccacauccaggaacggcacugccaagucuuccauaaaugugccuucuguccuauggccuucaaaaccgccagcaguaccgccgaccauucagcuacacagcaccccacucagccgcaucgcccaagccaacugaucuacaaguguaguugcgagauggucuuuaauaagaagagacauauccaacagcacuucuaccaaaaugugucuaagacacagguaggcguguuuaaaugcccugaguguccucucuuguuuguccagaagcccgagcugaugcaacacguuaaguccacccacggaguuccgcguaauguggacgaacuaucgucucugcagaguucagcugauacuucaagcagcagacccggcucucgagugccuacagagcccccugcuacaagcguugccgcccggucuaguucacugccaaguggacgguggggccggccggaagcccacagaagaguggaagcuaggccuagacucaggaacacgggguggaccugccaggagugccaggaauggguccccgaucgcgaaagcuaugugucucacaugaaaaagucucacggacggacacuuaaacgauacccuugccggcaaugugaacagucuuuucauacacccaauagccugcgaaagcauauaagaaacaaucacgauaccgucaaaaaauucuauacuuguggguacugcaccgaagacagccccagcuucccgcgccccucccuccuugagucacauauuagccugaugcacggcauaagaaacccagaccugucacagaccagcaaaguaaaacccccugguggucauucaccacaggugaaucaucucaagagaccaguuucuggcguuggagacgcgccgggcacauccaacggggccacuguaucuucuacaaaaagacauaagucucuguuucagugugccaaauguuccuucgcuacagacuccggccuugaguuccagucucacaucccacagcaucaaguugauucuagcacugcccagugccuuuuaugcggccuuuguuacacuucugccaguagcuuauccagacaccuauucaucgugcauaagguccgagaucaggaagaagaagaggaagaagaagcggcugccgcagagauggccguggaaguggcugagcccgaagaggggagcggggaagaagugccaauggagacgcgcgagaacggccuggaggagugugcaggcgaaccacuuagugccgacccugaagcccggagacuccucgggcccgcuccagaagaugacgggggacacaacgaccacagucagccccaggcaucucaagaccaggauucccacaccuuaaguccccagguguag

SEQ ID NO: 248601 - RNA, 2406 nt, Artificial Sequence
  Description of Artificial Sequence: Synthetic coding sequence
auggaugaggaugaguuugagcuucagccacaagagcccaacuccuuuuuugauggaaucggagcagacgcuacccacauggacggagaccaaauagugguugagauacaggaggccguguuugugagcaacaucguggauagcgauaucacgguucacaacuuugugcccgaugauccugacaguguugucauucaagauguaguugaggauguggugaucgaggaagacguucaauguucugacauccuggaggaggccgaugucucugaaaaugugauuaucccggaacaaguccucgauucugacgugacggaggaagucucuuugccccacugcaccguccccgacgacguucuggcuucugauauuacgaguacauccauguccaugcccgaacacguccugaccucugagucuaugcauguuugcgacauuggacacguggagcauaugguucacgauucugugguagaagccgaaauaaucacugacccauuaacaagugacaucgugucagaagaggugcuuguggcagauugugccccagaggccgucaucgacgcuuccgggaucagcguugaucagcaggacaacgacaaggcauccugcgaggacuaccugaugauuucuuuggaugaugcuggcaagaucgagcacgacggguccacuggagugacaaucgaugccgaauccgaaauggaucccuguaagguugacuccacauguccugaggucaucaaaguauauauuuuuaaggcugacccuggcgaagacgaccucggaggaaccguggauaucguggagagugagccagaaaaugaucauggcguggagcugcuggaccagaacaguucaauucgaguaccucgggaaaagaugguguauaugacagugaacgauucgcagcaggaagaugaggauuugaacguagcugagauagcugaugaaguguauauggaagugauuguaggcgaggaggaugcugccguggccgccgcugcagcagccguccacgagcagcagauagacgaagacgagaugaagacuuuuguuccuauugcaugggccgcagcuuacgguaauaacagcgacgggauagaaaacagaaacgggacagcuagugcguuacugcacauagacgagagcgcaggucugggacgccucgcaaagcagaagcccaagaaaaaacggcggcccgacucaagacaguaccagaccgccaucaucauuggaccugauggucacccuuuaacuguguaccccugcaugaucugcgguaaaaaguucaaaucuaggggauuucugaaacgccauaugaaaaaccacccugagcaccucgccaaaaagaaguaucacuguacagauugugacuacacuacuaacaagaagaucagucuccauaaucaucuggaaagccacaagcuuacaucuaaggccgaaaaagcaaucgaaugugacgagugcgggaaacacuuuagccaugcuggggcucuauuuacccauaaaaugguccauaaggagaaaggcgccaacaagaugcauaaaugcaaauucugcgaguacgagacugcugagcagggacugcuuaaucgccaucuucuugccgugcauucaaaaaacuuuccucauauuugugucgaaugcgguaagggcuuccggcacccaagcgaguuaaggaagcacaugcgaauucauacuggugaaaagcccuaccaaugccaguacugugaguaccgcagugccgauaguagcaaucugaaaacacacaucaaaacaaagcauucuaaagaaaugccuuuuaaaugugauauaugucugcucaccuucuccgacaccaaggagguucagcagcauaccuugguucaccaagaaagcaagacccaucagugccugcacugugaucacaaaucuucaaauucaagcgaucugaagaggcaugugauuuccgugcacacuaaggauuauccccacaagugcgaaaugugugagaaaggauuucacagaccuuccgaacuuaaaaagcaugucgcaguucacaaaggaaagaagaugcaccaaugucgucauugcgacuuuaagauugcagaccccuucguauugagucgccacauauuaucugugcacacuaaggaucugccuuuuagaugcaagcgguguagaaaaggauuuaggcagcagaaugaacugaaaaaacacaugaagacccacuccgggcgaaagguguaccaaugugaguauugugaguacuccacuacggaugcuucuggcuuuaaaaggcacguuaucucuauccauacgaaagauuacccucaucguugcgaguacuguaagaagggcuuucgaagaccaagcgagaagaaucagcacaucaugagacaccacaaggaagugggacugccauag

SEQ ID NO: 248602 - RNA, 1419 nt, Artificial Sequence
  Description of Artificial Sequence: Synthetic coding sequence
augaaauuccuuaucuucgcauuuuucgggggaguucaccuguuaucacuuuguucaggcaaagcuaucuguaaaaauggcaucagcaaacgaacauuugaggaaauuaaggaggaaauagccagcugcggggauguggccaaagcaaucauuaauuuagcagucuauggaaaagcgcagaaucgcaguuacgagcggcuagcccuuuuaguggauacuguggggccgcgccugucaggcaguaaaaauuuggagaaagccauacagauaauguaccaaaaucugcaacaggauggccuggaaaaaguccacuuagagccaguucggaucccucacugggaacgcggggaggagagcgcgguuaugcuggaaccaagaauucacaaaauagccauacucggcuugggaagcucuaucgggacuccaccagagggaaucacugcagaggugcucguuguuacuaguuucgacgagcuucagagacgcgcuagcgaggcacgggguaagaucgucguuuacaaucagccauauauaaacuauucuaggacaguucaauaucgaacgcagggcgcaguggaagcugcaaagguuggcgcacuagccucuuugauucggucuguugccucauuuucuauuuacucaccacauaccggaauacaggaguaccaggaugguguacccaagauccccaccgcauguauaacaguggaggaugccgaaaugaugucacggauggcuagccaugguauuaagaucgucauucagcugaaaaugggcgcuaagacauauccagacaccgacucauucaauacgguugccgagaucaccggcucuaaauaccccgaacagguaguuuuaguaagcggccaccuggacagcugggauguggggcagggugcuauggaugacgggggcggugcauucaucaguugggaagcccucucccuuauuaaagauuuaggcuuaagaccaaaaaggacacugagguugguacuguggacagccgaagagcagggcggggugggcgcauuccaauacuaccagcuacacaaggugaauauaucaaacuacucucuugugauggagucugacgccggcacauuccugcccacuggcuugcaguuuacagguagugaaaaagcacgcgccauaauggaggaaguaaugagucugcugcagcccuuaaacauuacucaggugcugucacauggagagggcaccgauauuaacuuuuggauccaggccggagugccuggcgcuaguuuauuggaugauuuauacaaauauuuuuuuuuccaccauucccauggggauaccaugacaguaauggacccgaaacaaaugaacguagccgcagccguaugggccgucgucucuuaugucguggcugacauggaagaaauguuaccuaggagcuag

SEQ ID NO: 248603 - RNA, 5724 nt, Artificial Sequence
  Description of Artificial Sequence: Synthetic coding sequence
augcaguuuguuaguugggccacauuacugacucuucuggugcgagaucuggccgagauggguagcccugacgccgcagcagcgguucggaaagaucgccugcauccacgccagguuaaacuccuagagacucucucugaauacgagauuguaagcccaauaagagugaacgcuuuaggugagccuuuuccaaccaacguccacuucaaaagaacccgacgcagcaucaacuccgcaacagaccccuggccugccuuugccagcagcucuagcuccucuacuucaucucaagcccauuacagacugagcgcauucggacagcaguuccuguucaauuuaacugcuaacgcuggauuuaucgccccgcucuucacaguaacucugcuggggacaccggggguuaaccagacaaaauuuuacagcgaagaagaggcagagcuaaaacacuguuuuuacaaaggauacgugaauaccaauagcgaacacacggcugugauuuccuuaugcucagggaugcuuggaacuuuucgaucacacgauggggauuacuuuauugagcccuugcaaucaauggacgagcaagaggacgaagaagagcagaauaagccacacaucauuuacaggaggucagccccacaaagggaacccagcacuggaagacaugcaugugauacauccgagcauaaaaaucggcauagcaaggauaagaaaaagacccgugccagaaaguggggcgagagaauuaauuuagcaggggaugucgccgcacucaauaguggacuggcuacugaagcauucucagcauacgguaauaagacugacaacacaagggagaaaagaacacaucggcggaccaaaagauuucucagcuacccccgauucguagagguccuaguuguagcggauaaccgcaugguuuccuaucacggagagaacuugcagcacuacauccucacccucaugagcaucgauggaccaucuauaucuuuuaacgcgcaaacuacucugaaaaauuuuugccaauggcaacacucuaaaaauucaccgggcggaauacaccacgauaccgccgugcugcucacuaggcaggauauuugucgcgcccaugauaagugugacacccucggacuggccgaguugggaaccaucugcgaccccuaccguuccugcucaauuucugaagauaguggcuuaucgacugcuuucacuaucgcucacgagcuuggacaugucuucaauaugccgcaugaugauaauaacaaauguaaagaggaaggcguuaagucaccccagcacguaauggcucccacacugaacuuuuacacaaaccccuggauguggagcaaauguucaaggaaguacauaacugaauuucucgacacggguuauggagagugccucuugaaugagccggaaagcaggcccuauccccugccagugcaguuaccuggaauccuguauaacguuaacaagcagugcgaauugaucuucggcccggggagccaaguuugccccuacaugaugcaaugcagaagacuaugguguaauaacgugaauggcguucauaagggcugucgaacucagcauaccccaugggcugauggaaccgaaugcgaaccgggcaaacacugcaaguauggauucugcgugcccaaggagauggacgugcccgugaccgacgggaguugggggucauggagucccuucgguacuuguagucgaacauguggagggggcaucaaaacagccaucagagaauguaaucgccccgagccuaaaaauggcgggaaguacugcgucgggcggagaaugaaauuuaagaguugcaacaccgagccguguuugaaacaaaaaagggacuuuagggacgagcaaugugcucauuucgauggaaaacacuuuaacauuaauggccuucuccccaacgugcggugggugccaaaguauagcggcauucugaugaaggauagguguaagcuauucugucguguggcuggaaauacugccuacuaccaacuucgggaucgcgucaucgauggaacuccguguggacaggacacuaaugauauuugcguacaggggcugugucgccaggcgggaugcgaucacguccuuaauagcaaggcccgucgcgauaaguguggcguguguggcggugauaacuccuccuguaaaacggucgcagggaccuuuaacacaguucacuacggauacaacacuguuguucggauuccugccggagcaacaaauauagauguucgucaacauuccuuuagcggcgagaccgaugaugacaacuauuuggcacuauccucuaguaaaggugaauucuugcuuaacggaaacuuuguugucacgauggccaaaagagaaaucaggauuggaaaugccguagucgaguacuccggcucugagaccgccgucgaacggauuaacucuacagaucguaucgagcaggaacuguugcuccaaguccuaagcgucggaaaacuguauaauccggacgucagauauaguuucaauauuccgauagaagauaaaccucagcaguucuauuggaacucucacggaccauggcaggcuugcucaaaaccuugucaaggagaacgaaaaaggaagcucgucugcacgcgcgagagcgaucagcugacuguuagcgaucagaggugugacagacucccacagcccggccauauuaccgagccuuguggaacugacugcgaucugcguuggcauguugcgucgcggagugagugcagcgcucagugugggcuuggauaccgaaccuuggauaucuauugugcuaaauauucuagacucgauggcaagaccgaaaaaguggaugauggauucuguucaucucauccuaagccuaguaaccgggaaaaguguagcggagagugcaacaccggcggauggcgauacagugcguggaccgaaugcagcaagaguugcgauggaggcacccagagacggagagccauuugugugaauacucgaaaugacgugcuugacgauucaaagugcacacaccaggaaaagguuacaauucaaagauguagcgaguucccuuguccccaauggaaauccggugacuggagcgaaugccuugucacgugugggaagggacacaagcaccgacagguauggugccaguuuggggaagacagauuaaacgacaggaugugugauccugaaacuaaaccaacuucaaugcagacaugucagcaaccagaaugcgcaaguuggcaagccggacccuggggacaaugcagcgugacuuguggccagggguaccaguugcgagccgucaaguguaucauuggaaccuauaugagcguggucgacgacaaugacugcaacgccgcaacacggccgaccgauacucaagacugcgaacugccuaguugucacccacccccggcugcuccagagacucggagaaguacuuauucagcgccacguacccaauggagguucgguucuuggacaccuuguucugccaccugcggcaaagggacuaggaugagguauguuucuuguagggacgaaaacggaucaguugcagaugaguccgcaugugccaccuuaccacggccuguagcgaaagaagaaugcuccgugacuccaugcggacaauggaaagcccuggacuggucaagcuguucugugaccugugggcaagguagagccacaagacaggucaugugcguaaacuacagugaccauguuaucgaccgcucugaaugugaucaggauuauaucccagaaacagaucaggauuguucaaugaguccuugcccccagcggacuccagauucuggacuagcccagcaucccuuccaaaaugaggacuaccgacccagaagcgcuagcccaucccgaacucacgugcuugggggaaaccaguggcguaccggaccguggggggcguguucaucgaccugugcaggaggcucccagaggcgggugguagucugccaagacgaaaacggcuacacagcaaacgacugcguggagagaaucaaaccagacgagcagcgagcaugcgaguccggcccauguccgcaaugggcguacgggaauuggggugaguguacuaaacugugcggaggaggaauaaggacucgguuaguaguuugucaaagauccaauggggaacgguuuccugaccucucuugcgagauacuggacaagcccccagacagggaacagugcaauacucaugccuguccacacgacgcugcauggagcacaggaccuuggucuucuuguucaguaagcugugggcgcggucauaaacagcgaaauguguauuguauggcaaaagacgggucccaccuagaaagcgauuacuguaagcacuuggcuaagccacacggucaucggaagugcagaggaggucgguguccuaaguggaaggcaggggcauggucacaaugcagcguuucuugcggccgagguguucaacagcggcaugugggaugucagauaggaacccacaaaauugccagagaaacagaauguaacccauacacacggcccgagucagagcgggauugucagggcccaagauguccacuguacacauggagggcugaagaauggcaagaauguaccaagacauguggugaggggaguagauaucggaaaguggugugcguugaugauaacaagaacgaggugcacggagcaaggugcgacgugucuaagagaccgguggauagggagucuuguagucugcaaccuugcgaguauguauggauuaccggugaaugguccgaaugcucaguuacauguggcaagggcuacaagcaaagacuaguguccugcuccgagaucuauaccgggaaggagaauuacgaauauagcuaucagacgacgaucaacuguccaggaacucagcccccaagugugcacccuuguuaccuuagagauugcccagugucggccacauggagaguggguaauugggggucuugcagcgugucuuguggcguuggggucaugcagcguagcguacaaugcuuaacuaacgaagaccaacccucucauuuaugucacacagaucugaagccagaagaacggaaaacaugccgcaauguuuacaauugugaauuaccgcagaauugcaaggaagucaagcgauugaagggugcaucugaagacggagaauauuuucugaugauuagggggaagcuguugaaaauauuuugcgccgguaugcacuccgaccacccaaaagaauauguuaccuuagugcacggagacuccgaaaacuucucagaggucuacggacaucgccuucacaacccgaccgaaugcccuuauaacggcucacgccgagacgauugucaaugcaggaaagauuacacugcggccggcuuuucgagcuuucagaaaauaagaaucgauuugacaucuaugcaaauuauaaccacagauuuacaguuugcuaggacuagugagggucaccccgugccauuugcgacggccggagauugcuacucagccgcuaagugcccucagggucgauuuagcaucaaucucuauggcacaggcuuaucucugacggaaucugcuagauggaucucgcaggguaacuaugccguuucugacauuaaaaaaucaccagacggcacaaggguuguggggaaauguggaggcuacugugguaaguguacacccucuagcgguaccggacuugaaguacgcguuuuguag

SEQ ID NO: 248604 - RNA, 2976 nt, Artificial Sequence
  Description of Artificial Sequence: Synthetic coding sequence
ugagagugcagugcucagugcggguugggauacagaacgcuugacaucuauugcgccaaauauaguaggcuugaugguaagacagaaaagguggaugacgguuuuugcuccucgcauccgaagccuagcaaucgggaaaaaugcaguggagaaugcaacaccggggguuggagguacagugcuuggacagaauguucuaagucuugcgacggugggacacagaggcgacgugcaauaugugugaacacucgcaacgacguuuuagaugauucgaagugcacucaccaggaaaaagugaccauccaaagauguuccgaauucccauguccacaguggaaaagcggcgauuggucagagugucuggugacaugugggaaaggucacaagcauagacagguauggugccaauuuggcgaggaccgauugaaugaccggaugugugauccugaaacaaaacccaccucgaugcaaaccugucagcaaccggagugcgcguccuggcaggcuggaccaugggggcaguguagcgugacuugcggacagggcuaccaacucagagcaguaaaauguauuauugggaccuauaugucuguggucgacgauaacgauuguaacgccgcgacuaggccuacggauacucaggauugcgagcuuccuuccugucacccaccacccgcugcaccagagacgagacggagcaccuacagcgccccccggacacaguggagguuugggaguuggacaccaugcagcgcaaccugcggaaaggggacgaggaugagauacguuucaugucgggaugagaacggcaguguugcugaugagagugcuugugcgacccuccccagaccuguagcaaaagaagaauguuccgucacccccugcggucaauggaaggcacuagauuggaguuccugcagcgugacguguggucaaggcagggccacucggcaggugaugugugucaacuauuccgaccauguuauagaccgcagcgagugugaccaagauuacauccccgaaaccgaucaagauuguagcaugaguccauguccccaaaggacccccgacucuggucucgcucaacauccguuccagaacgaagacuaccgaccaagaagugcuagccccagccguacucacgugcucggagguaaucaguggagaaccgggccuuggggcgcguguaguucaaccugcgccggcggcucucagcgccguguuguggugugucaggacgagaaugguuacacugcuaaugauuguguagaacgaauuaagccagaugagcagcgugcaugugaaucagggccguguccucaaugggccuaugguaauuggggggaaugcaccaaguuauguggaggcgguauuagaacaagacucgucgugugucaaagauccaauggagaacgguucccagaucuuucuugcgaaauacuggacaagccaccggauagggaacaguguaacacucacgccuguccacaugaugccgcauggagcacuggaccuuggagcucuuguagcguguccugcggaaggggucauaagcagcgcaacguuuacuguauggcgaaagaugguucccaccuggaaagcgacuacuguaaacaccuggccaaaccucauggacaccgcaaauguagaggagggagguguccaaaguggaaagcaggcgccuggagucaguguagugucuccugcggucggggcguucaacaaaggcacguugguugucagaucggcacacacaagaucgcaagagaaacagaguguaauccuuauaccagacccgagagugagagagauugccaggggcccagaugcccgcuuuacacguggagagcugaagaauggcaagaauguaccaagaccuguggugagggcaguagauacagaaagguggucugcguagacgacaacaaaaaugaaguccacggagccaggugugacgucuccaaacgcccaguagacagagaguccugcucccuucagccuugcgaauauguuuggaucaccggagaauggagugaaugcuccgugaccuguggcaaagguuauaaacaacgauuaguuagcuguagcgaaauuuauacuggaaaagaaaauuacgaguacaguuaucagacuacaaucaauugucccggaacacaaccacccaguguccacccguguuaucugagagacugcccagugagcgcaacguggcgugucggcaauuggggguccugcagcgucucaugcgguguuggagucaugcagagguccguacaguguuugaccaaugaggaucaacccagccaccugugucauacagaucugaagcccgaagagaggaaaacaugcagaaaugucuacaauugcgaacuuccgcaaaauuguaaggaggugaagcggcugaagggggcaagugaggacggugaauauuuccugaugaucagagguaagcugcuuaagauauucugcgccgggaugcacuccgaccauccaaaagaguauguuacccucguacacggugauucugaaaacuuuagcgaaguguaugggcauagguugcacaauccuacugaaugcccuuauaacggaucgcgacgagacgauugccagugccgcaaagauuauaccgcugcuggauuuaguucauuccagaaaauucguauugaucuaacaaguaugcaaaucaucacuaccgaucuucaguuugcaaggaccagcgaaggacauccaguccccuuugcuaccgcgggcgauuguuacuccgccgcuaaaugcccacagggacgauuuucuaucaaccuguauggcaccggucucucucuaacugaaucugcccguuggaucucucaaggcaauuacgcuguuucugacauaaagaagucuccugacgguacaagaguugucggcaaguguggaggcuauugugguaaaugcaccccuucaucuggcacagggcuggaaguucgcgucuuauag

SEQ ID NO: 248605 - RNA, 5808 nt, Artificial Sequence
  Description of Artificial Sequence: Synthetic coding sequence
augcaguuugucucaugggccacacuccuuacacucuuggugcgggaccuggcugaaaugggcucuccagaugccgcugcugccgugaggaaagaccgccugcacccucgccaggugaagcuccuggaaacccucucugaguacgaaaucguauccccaauccgugucaaugcgcugggggagcccuucccaacuaacgugcacuuuaaaagaacccgacgauccauuaauucugcuacugaccccuggccugcuuucgcaaguuccucuucauccucgacaucaucccaggcacauuaucgcuuguccgcguucggccaacaauuccuuuuuaaucuuacggcaaaugcaggauucauagcaccccuuuucacugugaccuuguuggggacacccggaguuaaccagacgaaauuuuauucagaggaagaggccgaguugaagcacuguuucuauaagggcuauguaaauacuaacucagagcauaccgcuguuauuagucucuguucagggaugcucggcaccuuuagaagccaugauggugauuauuuuauugagccgcuacaguccauggacgaacaggaagacgaggaggaacagaauaaaccgcauauuaucuauagacgaagcgcaccccaaagggagccaagcaccggacggcaugcaugcgauacaucugagcacaagaaccgccacagcaaagacaagaaaaaaacacgagcuagaaaauggggggagagaauuaaucuggcgggggauguggccgcuuugaacucuggucuagccacugaggcauuuagugccuauggcaacaaaacagacaacacacgugagaaaagaacucaccgaagaacaaagagauuucugaguuauccucgguucguagagguucugguaguugcagacaaccgaaugguuucauaucauggagagaaccuucaacauuacauacugacccugaugaguauugucgccuccaucuauaaagauccuucaaucggaaaucucauuaacaucgugaucguuaauuuaauuguuauccauaacgagcaggacgggcccagcauuucguuuaaugcccagacaacucugaaaaacuuuugccaauggcaacauucuaaaaauucuccaggugguauucaucaugacacugcuguucugcucacuagacaggacauaugcagggcucacgacaaaugugauacccugggacuggccgaacugggaacaauuugugaucccuaucgaucuugcagcauuucggaagacucaggccucucuaccgcuuuuacaauagcacacgagcuuggccacguguuuaacaugccacaugaugacaacaacaagugcaaggaggaagggguuaaaucuccccagcacgugauggcaccuacccuuaauuuuuacacaaauccauggauguggucuaagugcagucgaaaguauaucaccgaguuccucgacacagguuacggagaaugcuugcuaaacgaacccgagucccgcccuuacccccuuccuguacagcugccggggauuuuauacaacgugaauaagcagugcgaacucaucuucgggccuggcucccagguaugccccuauaugaugcagugccgacgccuguggugcaacaaugucaauggaguucacaaaggcugcagaacacagcauaccccuugggcugauggcaccgaaugcgagccuggaaagcacuguaaguauggauuuugcguccccaaagagauggaugugcccgugacugauggaucuuggggaagcugguccccuuucggaacuugcagccggacaugcggcgggggcaucaaaacugccauuagagaguguaacaggccugaaccuaaaaauggaggaaaguacugcguuggaagaagaaugaaguucaaaucuuguaacacggaaccuugcuugaagcaaaaaagggacuuccgagacgaacagugugcccacuuugacgguaaacauuucaauaucaauggccuucugccuaauguccgaugggucccaaaguacucugguauccucaugaaagaccgguguaaacuguuuugucgggucgcaggaaauacagccuauuaccaacugcgugacagggugaucgacggaacucccuguggucaagauaccaacgacauuugcguccagggccucuguagacaagcaggaugcgaucacgugcugaauucuaaggcucgucgagauaaaugcgggguuuguggcggagauaauuccuccugcaaaacugucgccggcacauuuaacacagugcacuacggguacaauacgguugugaggauaccagcaggggccacaaacauugauguacgucagcacuccuucuccggggaaacggacgacgacaacuaucuggcucuaucuaguucaaagggagaguuucuucugaacggaaacuucguugugaccauggccaagcgggagaucagaaucgguaaugcugucguagaauacucuggauccgagacugccguggaacgaauaaauaguacagauagaauugagcaggagcucuugcugcagguucuuagugucgguaaacuguacaaccccgauguccgauacucuuuuaacaucccuauugaagacaaaccccagcaguucuacuggaacucacacgguccauggcaagccuguucaaagccaugucagggugagcgcaagcgcaaacugguaugcacacgcgagucugaucaguugacagugagugaccagagaugugauagacucccccagccaggccauaucacugaaccgugcgggacugacugcgaccuucgcuggcacgucgcaagccgcucagaauguucagcgcaguguggguuaggauauaggaccuuagacauuuacugcgccaaguacucucgacuggacggcaagaccgagaaaguugacgauggcuuuugcucuucacacccaaagccuuccaaccgugagaaaugcuccggugaauguaauacaggcggauggcgguauagugcguggacggaaugcuccaaguccugcgacggcgguacgcaaagaagacgggccauaugugucaauacgcggaacgauguacuggaugacuccaagugcacccaccaagagaaagucacuauucagagaugcucagaauuucccugcccucaguggaagagcggagauuggucagaaugucuuguuacaugcggaaaaggucacaaacauaggcaagucuggugucaguucggagaggacaggcucaaugaucggaugugcgacccagaaaccaaaccuacuucuaugcaaacaugucaacagccugagugugcaucuuggcaggccggcccguggggccaauguucagugaccugcggccagggauaccagcuccgagccgucaaaugcaucauaggcaccuacaugucuguugucgacgauaaugacugcaacgcagcuaccagaccuaccgacacgcaagauugugaacuucccucuugccacccuccaccugcagcaccugagaccaggaggucaaccuacuccgccccuaggacccaguggcgcuuugggucguggacuccauguucagcuacaugcgguaagggaacucguaugagauauguuuccugccgggacgagaauggaucgguugccgaugagagugcuugugcuacacuaccccgccccguggcuaaagaggaauguucagugaccccaugcggacaguggaaagcuuuggacuggucuuccugcucugucacaugcgggcaagggagggccacccgucaagucaugugcgugaacuacagcgaccacguaaucgacagguccgaaugcgaccaggauuacauccccgagacagaccaggauugcagcaugagccccuguccccaacggacacccgacuccgggcucgcgcagcaucccuuucagaacgaagauuaccggccaaggucagcuagcccuucuagaacacaugugcugggagguaaucaauggagaacaggaccauggggcgcauguuccucaacuugcgcuggugggagucagagacgugucgucguuugccaggacgaaaacggcuauacugcuaaugacugcguggaacgaaucaaacccgaugagcagcgugcgugugaaucagguccuuguccgcagugggcauacggaaacuggggcgagugcaccaaauugugcgguggaggaaucagaacacggcuugugguaugucagcgaucuaauggcgagagauuuccagaccugucaugugaaauacuggauaaaccgccagauagagaacaaugcaacacucacgcaugcccccacgaugcugcuuggaguaccggcccaugguccaguuguagugugucuugcgggcgaggccauaaacagcggaacguauacuguauggccaaggacggaagccaccucgaaagugauuacuguaagcaccuggcaaaaccucacggacaucggaaaugccgcggagguagaugcccuaaguggaaagcuggagcuuggagccaguguagcgucuccuguggcagaggcguccaacaacgccacguagguugucagauagggacccacaagauagcaagagaaacagaaugcaaccccuauacuagaccagaaucagagagagacugccaggggccccguugcccccuguauacuuggcgugcugaggaguggcaagaauguacaaagaccugcggugagggaaguagauacaggaaggugguauguguggacgauaauaagaaugaaguacauggggcacgaugcgacguuaguaaacggccuguagaccgagaauccuguucccuucagccuugugaauacguguggauaacuggugaauggucagaauguagugugacaugcggcaaaggcuauaagcagcgccuuguaucgugcucagaaaucuauacaggaaaggagaauuaugaauauucauaccagacaaccaucaacugucccggaacacaaccuccgagcgugcacccuuguuaucucagagauugcccuguuucugcuacauggcggguugguaauuggggaucaugcucaguuucuugugguguaggugugaugcaacgguccguucagugucucaccaaugaagaucaaccuagccaccugugucauaccgaucuuaaaccagaggaacggaaaaccuguaggaacguuuacaacugcgaacugccccaaaacugcaaagaggugaaaagacuuaaaggggccuccgaggauggggaguacuuccuuaugauacgggguaagcuucucaagauauuuugcgcuggcaugcauuccgaccaccccaaggaauacguaacucucguacauggcgacuccgaaaacuuuagugaaguguauggccauagauuacauaauccuacugagugccccuauaacggaucccgaagggaugauugucagugccgcaaagacuauacagccgcuggauucuccaguuuucaaaagauaaggauagaucuuacuagcaugcagauaauaacuacagaucugcaauuugccaggacaucagagggucaucccguucccuuugccacugcuggagauugcuauucugccgccaaaugcccccaaggucgauuuucuauuaauuuguaugggacgggacuuagccuuaccgaaagugcaagguggauaucacagggcaacuacgccgucucagacaucaagaaaagcccugauggcacacggguaguggggaaguguggaggauauugugguaagugcaccccgaguagcggcaccggcuuagaagucagaguccuauag

SEQ ID NO: 248606 - RNA, 2052 nt, Artificial Sequence
  Description of Artificial Sequence: Synthetic coding sequence
auggaaugcugcaggagagcgacaccaggaacucuccugcuauuucuggccuuccuacugcucuccaguagaacagccaggagugaggaagauagagauggguuaugggacgccuggggacccuggucugaaugcucccggacuuguggagguggcgcuaguuauucauuacggagaugucuaaguucaaagaguugugagggcagaaacauccguuauagaacgugcuccaacguugacugucccccagaagcaggugacuuuagggcccagcaaugcucugcacauaacgacgucaaacaccacggucaguucuaugaauggcuuccaguuucaaaugaccccgacaauccaugcucauugaagugucaagcaaaaggaaccacucuggugguggaacuugcccccaagguucuggacgguacuagaugcuauacugaaucuuuggauauguguaucuccggucuuugucaaauagugggaugugaucaucagcuggguuccaccguaaaagaagacaauugcggcgucugcaauggugacgggucaacuugucgccuggugaggggccaguacaaaucccagcuaucagcaacuaagucagaugauaccgucgucgcuauucccuacggcuccagacacauccgccuuguccucaagggaccugaccaccuauaucucgagaccaaaacucuucagggcacaaagggagaaaacagccucucaagcacuggcacauuccuaguugauaacucgagcguugauuuucagaaguuuccugauaaagaaauccugagaauggcggguccucugacagccgacuuuaucguuaaaauuaggaauucuggguccgcugacuccaccguacaguuuaucuuuuaccaacccaucauacauagauggcgcgagaccgauuuuuuuccuugcagugcuacuuguggcggcggguaccaguugaccagugccgaaugcuaugauuuaagguccaaccgaguagucgcugaucaauauugccauuacuaucccgagaauauaaaaccuaaaccuaaacugcaggaguguaaccucgacccauguccugcuagcgauggcuauaagcagaucaugcccuaugaccucuaucacccccuaccuagaugggaagcgacccccuggaccgcaugcuccucaucuuguggcggaggaauucagagcagggcagugaguugcguggaggaggauauucaaggacauguaaccagcguagaggaauggaagugcauguauacaccaaagaugccuaucgcccagccuuguaacauuuucgacugcccaaaguggcuggcccaggaguggagcccuugcaccguuacaugugggcagggccucagauauagaguuguacugugcauugaucaccgcgggaugcauaccggaggcuguagcccuaaaacgaaaccccacauuaaggaggagugcauuguucccacccccuguuauaaacccaaagagaagcugccuguggaagcgaaguuaccuugguucaagcaggcacaggagcucgaagaaggcgcugccgugagugaagagccguccuuuauucccgaggcuuggagugcuugcacagugaccuguggcguuggcacucaggugaggaucgugagaugucagguguuacucucauucagccagagcguugcugaucucccgauugacgagugcgaaggaccaaaaccugccucccaaagagcuugcuacgcuggcccuugcucuggugagaucccugaauucaauccagacgagacggauggacuguucggcggcuuacaggacuucgacgaauuguaugauugggaguaugaagguuucaccaaauguagugaguccuguggcggagguguccaagaggcagugguuaguugccugaacaaacagacaagagagcccgcggaagagaaucuuugcgugaccagucgcagacccccccagcuguuaaaauccuguaaccuggauccgugcccugcucgaucuagcaucgacagugccuggaaugcuuguaacgucuuguguuag

SEQ ID NO: 248607 - RNA, 1401 nt, Artificial Sequence
  Description of Artificial Sequence: Synthetic coding sequence
augugucugacugacgaaugggguuuuuucuuuuuuuuuuuccugggggugcccgaggcagaagugacaugguuucguaacaagucaaaguuaggcucuccucaccaccugcacgaagguucucugcuccugacaaacgugucuucuuccgaccaggggcuauacucaugccgagccgcuaaucuccauggugaguugacggaauccacccagcucuuaauauuagacccaccccaggugccaacucaauuagaagauauccgugcccugcuugcagccaccgggcccaaccugccauccguucugacguccccucucgggacccaguuaguucuagaucccggaaauagcgcacuacucggaugcccgaucaaaggucacccgguuccgaauaucaccugguuccacggaggacaaccuaucgucacagccaccggccuuacacaucacauccucgcagccggccagauucugcagguugccaaucucuccgguggcagccagggagaguuuuccugccucgcucaaaacgaagcugguguacugaugcaaaaggccucuuuagugauccaggacuauugguggucaguggaucgccucgccaccuguucggcgucaugcggcaauaggggggugcagcaaccaaggcuccgcugucuacuaaacucaacagaggugaaccccgcccacugcgccggcaaagugaggccugccguccagccaaucgccugcaauaggagagauugccccucccgguggauggucacuagcugguccgcuugcacgcgcuccugcgggggagguguccagacaagacgagugacaugccaaaaauuaaaagcuuccggaaucucaacucccgucucgaacgauaugugcacucagguugccaagagaccuguagacacacaagcuugcaaucaacagcucugcgucgagugggcguucucaucauggggccaguguaauggaccaugcauaggaccccaucucgcaguccaacaucgccagguguuuugucagacccgugacggcaucacccuccccucugagcaguguucagccuugcccaggccugugucaacccaaaauugcuggagugaagcuugcaguguacacuggagggucucccuauggaccuuaugcacagcaacauguggaaauuauggauuucaaucccgccgaguggaaugcguacaugcacgcaccaacaaagccguuccugaacaucuaugcucuuggggacccaggccagcgaauuggcagcguugcaacaucacuccuugcgaaaacauggaaugucgagauacuacgcgcuauugugaaaaagucaagcaacucaagcuuugucagcuaucccaauuuaagucccgcuguuguggaaccugcggcaaggcauag

SEQ ID NO: 248608 - RNA, 1578 nt, Artificial Sequence
  Description of Artificial Sequence: Synthetic coding sequence
auggaguguuguagacgagcgacccccggaacacuucuucuuuuucucgccuuccuacuccuuucuaguagaacagcgcgcucagaagaggaucgcgauggauuaugggacgcuuggggccccuggucagaguguucgcgaaccuguggaggaggcgcuucauacagccuucguagaugccucuccagcaagucaugcgagggcaggaauauaagauaccggaccuguaguaauguggauugcccaccagaagccggggauuuuagggcccaacaauguagugcucauaacgauguuaaacaccaugggcaauucuaugaguggcuacccguuaguaacgauccugauaacccauguucucuuaaaugucaggcaaagggcacuacuuugguagucgagcuggcaccaaaagucuuggaugguaccagguguuacacugaaagccuggauauguguauuagcggauugugucagauugucggaugugaccaucagcugggcucaacugugaaggaagauaauuguggcguguguaacggagaugggagcaccugccggcugguccgaggacaauacaaaagucaacugagcgcuacaaaaucugacgacacagucgucgcuauuccauacggcucccggcacaucagacucgucuuaaaagggccugaccaccuguaccucgaaaccaagacucugcaaggaacaaaaggagagaauagccugucuucgacaggaacuuucuugguagacaacucaagcguggauuuccagaaauucccagauaaagaaauucugcgaauggcuggcccuuuaacagcagauuucaucgugaagauuagaaauagcggaagcgccgacuccaccguucaauucauuuucuaucaacccauuauccaucgauggcgagaaacagacuucuucccuugcagcgcaacuugcggcggcggauaccaacugacuagcgccgaguguuaugacuugcgcaguaauagaguaguugcagaucaguacugccacuacuaucccgagaacauuaaacccaaaccuaagcuccaagaaugcaaucuggaccccugcccagccagcgauggauauaaacaaaucaugccauacgaucuuuaccauccccugccuaggugggaagccacccccuggaccgccugcucuuccucguguggcggaggaauacagucuagagcuguaaguuguguugaggaggacauacagggccaugugaccagugucgaagaauggaaguguauguacacaccaaaaaugccaaucgcccagcccugcaauauauucgauugcccuaaguggcuugcccaagaauggagcccuugcacgguuaccuguggucaggguuuaagauaccgggucgugcuauguaucgaucacagaggaaugcacacgggaggauguucuccaaaaacuaagccucacaucaaagaagagugcaucgucccuacaccuugcuacaagccgaaagagaaguugccuguugaagcaaaacucccaugguucaagcaagcucaagaacuggaagagggcgccgcgguuucugaagagcccaguuag

SEQ ID NO: 248609 - RNA, 786 nt, Artificial Sequence
  Description of Artificial Sequence: Synthetic coding sequence
augugccucaccgaugaauggggcuucuucuuuuuuuuuuuccucggagugcccgaagccgaagucacuugguucagaaauaaaucuaaacucgguucuccacaucaccuacacgagggaucucuguuauugacaaacgucuccuccucagaccaaggacuguauucaugccgggcggccaaccuucacggagaacugacagagucaacucaacugcuuauucuggaccccccccaaguucccacacaauuggaggacauccgagcgcuauuggcagcaacuggucccaaccuacccuccguacugacaucaccacuggguacccaacugguacuugauccugggaacagugcucuucuuggcugcccaauuaagggucacccagugcccaacaucacaugguuucacggaggccagccuauugucacugccacgggccugacccaccacauacucgcggccgggcaaauccuucagguagcaaacuugucaggcgggagccaaggggaauuuucuugccucgcucagaaugaagccggaguacucaugcagaaggcuucucucguuauucaggacuauugguggucaguugaucggcuggcuacuuguuccgcuuccugcggcaacagaggcguccaacaaccacggcuaagaugcuuauuaaauuccaccgaagucaaucccgcccacugcgcagguaagguucggccagcagugcagccaauugcguguaaucguagagauugcccgagcagagccaugggacuagcuucuggccugaccuag

SEQ ID NO: 248610 - RNA, 5289 nt, Artificial Sequence
  Description of Artificial Sequence: Synthetic coding sequence
auggagugcugucgaagagcuaccccugggacauuacugcucuuucucgcuuuucuccugcugucaaguaggaccgcaagaucagaagaggaucgcgauggacuuugggacgccuggggcccguggagugagugcucuagaacguguggaggaggugcuagcuacucccugaggcggugccugagcaguaagaguugcgaagggcgaaacaucagguauagaacuuguuccaauguggacuguccucccgaagccggugauuuccgggcacagcaaugcucagcucauaacgauguuaaacaccacgggcaguuuuaugaauggcucccaguguccaacgaucccgacaacccuuguagccucaagugucaggcuaagggcaccacccuagugguugagcuugccccaaaagugcuugacgggacuaggugcuacacggaaucacuagauauguguaucucuggccuuugccagauuguaggcugcgaucaccagcucggcucgacgguaaaagaggacaauuguggcguguguaacggggacggauccacguguagacugguuaggggacaguauaaaagccaacugagcgcuaccaagucagacgacaccgugguugcuaucccauauggcucaagacauauuaggcuuguacucaagggaccagaccacuuguaucucgaaacaaaaacacuccaaggcacaaagggggaaaacucacuguccaguacugguaccuuccucguggauaauucuucuguugacuuccagaaauuuccggauaaagagauacugcggauggccggaccccuaaccgcagauuuuauagugaaaauccgaaacagcgggagcgccgacucuacaguacaauucauauuuuaucagccuaucauccaccgcuggcgagagacggauuucuuuccuuguuccgcuacaugcgguggaggcuaucaacuuacuucugccgaguguuaugaccuuagguccaaccgcguuguugcugaccaguacugccauuauuaucccgaaaauauaaaacccaagcccaagcugcaggagugcaaccuggaccccugccccgcaucugacggguacaaacaaaucaugccguaugaccucuaccauccccugcccagaugggaagcuacuccauggacagccuguuccucuagcugcgggggcggaauccaauccagggcggucagcugcguggaagaggauauccagggucacguuaccucuguagaagaauggaagugcauguauacgcccaagaugcccaucgcucagccuuguaauaucuucgauugccccaaauggcucgcccaggaauggaguccgugcacagucacauguggucaggggcuucgcuacagggucguccuguguaucgaucaucggggaaugcauaccggcggcuguucaccaaaaacuaaaccgcacaucaaggaagaaugcauuguaccuaccccuugcuauaagccuaaggaaaaauugccgguggaggcgaaauugcccugguuuaagcaagcccaagagcuggaggagggugcggcuguauccgaggaacccucuuuuaucccagaagcauggagcgcuuguaccgugacauguggugucggcacacagguucggauuguccguugccagguccuguuaucauucucacaaagcguagcugaucuccccaucgaugaaugcgaagggcccaaaccugcuucucagagagccugcuacgcagguccauguuccggagagaucccagaauuuaauccagacgaaaccgauggcuuauucggaggccuucaggacuucgaugaacuauaugacugggaauaugaaggcuuuacaaagugcagcgaaucuugcggcgguggcguucaggaagcugucguuucuugccugaacaaacaaacucgggagccggcagaagaaaaucucugugucaccaguagacgccccccacagcuacuuaagucauguaaccucgauccaugcccagcaagaugggaaaucgggaaauggucccccuguucacugaccugcggaguaggccuccaaacacgggacguguucugcagccaccuccuguccagggaaaugaacgagacagucauauuggcugacgagcuuugcagacagcccaagcccagcacuguccaggccuguaacagguucaauuguccucccgcuugguacccugcacaguggcagccaugcagcagaacuugcggaggcggcgugcaaaaacgcgagguacuguguaagcagcgcauggcagacgguagcuuucuggaauugcccgagaccuuuuguuccgcgaguaaaccggcuugucagcaggcaugcaaaaaagacgacugccccuccgaauggcuacuaucagauuggacugaaugcagcacaaguuguggcgaggguacacaaacgaggucagcuauuuguaggaagaugcugaaaacaggccucucuaccgugguuaacucuacccuuugccccccccugccuuucuccucaucaaucagacccuguaugcuugccaccugcgcuagaccaggacgcccaucaacaaaacacaguccccauauugcagcugcgcguaagguguacauccaaacgagacgacaacggaaacuucacuuuguaguggguggcuuugcauaccugcugcccaagacugccguagugcucagaugcccagcucguagagugcggaagccccugauuaccugggagaaagauggucaacaccucaucuccucgacccacgucaccguggccccuuuuggauaucugaagauccaucgguugaagcccuccgacgccggcguguacacaugcagcgcuggucccgcacgcgaacacuucgugaucaaacugaucgguggcaaucggaaguuaguagcuagaccccugucuccccguucagaagaagaaguuuuggcaggacgcaagggcggaccuaaggaggcauugcagacacauaagcaucagaacggaaucuuuucuaauggaaguaaggcugaaaagagggggcucgccgcaaacccaggaucaagguacgacgauuugguuagcagacuucuggaacaaggggguuggccuggggagcuucuggccuccugggaagcacaagacagcgcugaacgcaauacuaccucugaagaagaucccggcgccgaacagguacuccuucaucuucccuucacuauggugacugaacagcggcgcuuagacgauauccucgguaauuugucacagcaacccgaagaguuacgcgaucuguacagcaagcaucuggucgcucagcuggcacaggaaaucuucagaucucaccuggagcaccaagauaccuuguugaaaccuuccgaaagacguaccucacccguuacccuguccccucacaagcacguuucaggcuucucaucuaguuuacgcaccaguucuacgggagaugcaggcggagggucucgcaggccacaucggaagcccacuauacuucgcaagauaagcgccgcucagcagcuauccgcguccgaggucguuacacaccuuggucagaccgucgcucuggccucuggcacacucagcgugcuguuacacugcgaagcaaucggacacccucgccccaccaucuccugggcccguaacggcgaagagguucaguucagcgaucgaauauuacuucaacccgacgauucacugcagaucuuggccccuguagaggcagacgugggcuucuauacguguaacgcuacaaacgcacuuggcuaugauucuguuucuaucgccguaacuuuggccgggaagccccuugugaagacauccagaaugacaguuauaaacacagaaaagcccgcaguaaccgucgauaucggcucaacuauuaagaccguucagggagucaacgucacaauuaacugucaaguugccggaguuccugaagccgaaguuaccugguucagaaacaagagcaagcuaggaucuccccaucaccugcacgaagggaguuuacuccucaccaaugucaguaguucugaccaagguuuauauuccuguagagccgcaaaucuccauggugaguuaacugagucaacacagcuccugauucucgacccuccacaggucccaacacagcuggaggacauccgcgcccucuuagccgccaccggcccaaaucugcccagcguuuugaccucaccccuggggacccagcugguucuugacccuggcaacagcgcacugcugggaugcccgauuaaaggucacccagugcccaauaucacgugguuucauggcggucagccaauugugacagcuaccggacugacgcaccauauucuggcagcgggccagaucuugcaggucgcuaacuuaagcgggggaagccagggugaauuuucaugucucgcacagaaugaagcgggaguucucaugcaaaaggccucacugguuauucaggacuacugguggaguguggaucgccucgcaacuugcucugccucaugcggcaacaggggaguucaacaaccccggcucaggugucugcuuaacucaacggaagugaauccagcccacugcgccggaaaagugcgcccagcuguucaacccaucgccuguaauagaagagacugccccucgagauggauggugacaucuuggucagcgugcacgcguuccugcggagggggcguacaaacucguagaguuacaugccagaaguugaaggcguccggaauuaguaccccagucucaaaugauaugugcacccaaguugccaagagaccuguggauacacaagcuugcaaccaacagcucugcguagaaugggcuuuuagcucauggggacaaugcaauggcccaugcauaggaccccacuuggcaguacagcaccggcaggucuucugccagacuagggaugggauuacgcuaccuucugaacaauguuccgcccucccccggccuguuagcacgcaaaauuguuggagcgaggcuugcuccguacacuggagagugagcuuguggacacuauguacagcgacaugcggcaacuacggguuccagagucgaagaguagaaugcguccaugccaggacgaacaaagcggugccagaacaucuguguucaugggggccgagaccagcaaauuggcaacggugcaacauuaccccuugcgagaauauggaaugccgugauacgacacgauacugugagaaggucaagcagcugaaauugugccagcucagccaguucaaguccagaugcugcggaaccugugggaaggcguag

SEQ ID NO: 248611 - RNA, 1320 nt, Artificial Sequence
  Description of Artificial Sequence: Synthetic coding sequence
auggaaugcugccgaagagccaccccugggacauugcuguuauuuuuggccuuccugcuccuuagcucucgaacugcccgauccgaagaggauagagauggcuuaugggaugccuggggcccauggagcgaauguucaagaacaugcggcggaggcgcgucuuacucuuugcgcaggugcuuaagcucaaagucuugugagggcagaaauauuagauaucgaacgugcucgaacguggacuguccaccugaggccggcgacuuuagagcccagcaauguagcgcccauaaugacguuaaacaccacgggcaguuuuacgaguggcugccagugucaaacgaucccgauaauccuuguuccuugaagugucaagcuaaggguaccaccuuaguagucgaacucgcccccaaggugcuggaugguacgcgguguuacaccgagagccuugacaugugcauuagcggccuuugucagauuguaggcugugaccaccagcugggauccaccgugaaagaggauaacuguggaguguguaacggagaugggaguaccuguagacuaguacgagggcaguauaagagccagcuuucagcgaccaaguccgacgacacugucguggcuauccccuacgguuccagacacaucagacugguguuaaagggccccgaccacuuguaccucgagaccaaaacacugcagggcacaaaaggagaaaacucccuaucaucuaccggcacguuccugguugauaauuccuccguugacuuccagaaguucccugauaaagagauccugaggauggccgggccacucaccgcugacuuuauagugaagauuagaaacagcggcucagcagauuccacuguccaguucauuuucuaucagcccauaauucaucguuggcgagaaacugacuucuuuccguguucugcaacaugcgguggcgguuaccaacugacaagugccgagugcuacgauuuaaggagcaaccgggugguggccgaucaguacugucacuauuauccggagaacauaaaacccaagcccaaacuucaggaguguaaccuugaccccugcccagcacgaugggaggccacaccauggacggccuguuccucuaguugcgguggcgguauucaaucuagggcaguaucuugugucgaagaagacauucaaggucacgugacuuccguagaggaauggaaauguauguauacaccuaaaaugcccaucgcucagccuuguaauauuuuugauuguccaaaauggcucgcccaggaguggucccccgucacaguuccgucuuucuucgugcacuag

SEQ ID NO: 248612 - RNA, 543 nt, Artificial Sequence
  Description of Artificial Sequence: Synthetic coding sequence
auggguuuaacugugagugcccucuuuucuaggauuuuugguaaaaagcagaugagaauucugauggugggccucgaugcugccgggaaaacaacaauucuguauaagcucaaacugggggaaauugugacaaccauaccgaccaucggguuuaaugucgaaacgguagaauacaagaacauuuguuuuaccgugugggacguugguggccaagauaaaauccgaccucucuggagacauuauuuucaaaauacucagggauugauuuuugugguugauucuaaugaccgugagagagugcaggaaucagccgacgaacugcaaaagaugcugcaggaagacgagcugagggacgccguguugcucgucuucgccaauaagcaagauaugccuaacgccaugccagugagugagcugacugauaaauugggacuacaacaccuccgaucuagaacuugguaugugcaagccaccugcgcuacacaagguacaggacuuuaugacggcuuggauugguuaucacacgaauuaagcaaacguuag

SEQ ID NO: 248613 - RNA, 7251 nt, Artificial Sequence
  Description of Artificial Sequence: Synthetic coding sequence
augacaacacuguuguggguuuucguuacacugcgggugauaaccgcggccguuaccguagaaacuuccgaucacgacaacucacuguccguuucaauuccccagcccagcccccuacgcguucugcugggaacaucccuuacaaucccuugcuacuucauugauccuaugcaccccguaacaacugccccuaguaccgccccccuggcuccacggaucaaaugguccaggguguccaaagaaaaagagguuguguugcugguagcgacagaggguagggucagagugaacagcgcuuaccaggacaaagugucccuaccuaacuacccugccaucccuucagaugccacacucgaaguacagucucugcguuccaaugauucggguguguaccguugugaagugaugcaugggaucgaagacucugaagcaacucuugaaguggucgucaagggaaucgucuuccacuacagagccauuagcacccgauauacguuggacuucgauagggcccagagagccugccuacaaaauuccgcaaucaucgcuacgccagaacagcuucaggcugccuacgaagacggauuccaccagugugaugcaggauggcucgcugaccagacuguaagguacccgauucacacgccuagagaaggcugcuacggugacaaagaugaauucccuggaguucggaccuacgguauccgcgacacaaacgagacuuaugacguguauuguuucgccgaggaaauggaaggugaaguauucuacgcgacgucgccugagaaguuuaccuuucaggaagccgccaacgaaugccgaaggcucggcgcccgauuggcaacgaccggccaauuauacuuagccuggcaagcugguauggauauguguagcgccggauggcucgcggaccgcucugugcgcuaucccauaucgaaagccagaccuaauugcggcggaaaccucuugggaguacggacaguauacgugcacgcuaaccagacuggauacccagaccccagcucgcgauacgacgcuaucugcuauacgggagaagauuuuguggacauuccugaaaacuuuuuuggagucgggggcgaggaagauauaaccguccagaccguuacuuggccugacauggagcucccgcuaccuagaaauaucacagagggcgaggccaggggcucuguaauauugaccguuaaacccauauucgaggucagucccuccccacuagagccugaggagcccuucacauucgcucccgaaaucggcgcgaccgcauucgcugaaguugaaaacgagaccggagaagcgacccgcccauggggcuuucccaccccuggcuuaggucccgcuacggcuuuuacaucagaagacuuagugguucaagugacagcgguaccagggcagccacaucuuccagguggagugguauuccacuacagaccagguccaaccagguauucauuaaccuucgaggaggcccagcaggccugucugcguacuggggcaguaauugcaucuccugaacaacuccaggccgcuuaugaggcagguuacgaacagugugaugcaggcuggcugcgagaucagacagugcgguacccaaucgugucaccccguacccccuguguaggcgauaaagauucgucuccugguguucgcaccuacggcguucggccuagcacugaaacuuaugauguguauugcuucgucgaccgucuugagggagagguuuucuuugcuacccggcuugagcaguucacauuccaggaagcccuugaguucugcgagucucacaacgccaccuuagccacaacagggcagcucuaugcugcauggucaagaggccucgauaaaugcuaugccggauggcuggcggauggaaguuuaagguauccaauaguuaccccccgccccgcaugugggggcgauaagcccggcgugcguaccguguaucuguacccaaaucaaacuggucugccagaucccuuaucuaggcaccacgcguuuugcuuucgggguaucagugcuguacccucaccaggugaagaagaaggcggaacuccuaccucacccucaggcguggaagaguggauuguaacucaaguagugccuggagucgcagcuguccccguagaagaggaaacuacggcugucccuuccggagagacgacagcuauucuggaauuuacaacggaaccagaaaaucagacugaaugggaacccgcuuauacgccgguuggaacaucaccacugccagggauucucccgacuuggccaccuacaggagccgccacugaggaaagcaccgaggguccaucugccaccgaagugccuucugccucugaggagcccagcccguccgaaguccccuucccuagcgaagagcccucaccaucggaggagccauuuccuucuguacgccccuuuccuagcguagaacuguuuccaagugaagaacccuuuccuucaaaggagcccucuccauccgaagaaccuagcgccucagaggagcccuauacaccguccccacccguuccaaguuggaccgagcugcccucaucuggugaagaaagcggugccccugaugugaguggugauuucacugguagcggggacguuagcggacaucuugacuucuccggccagcugucaggcgacagagcuuccgguuuaccgaguggugaucucgauuccagcggucugacauccacgguggggagcggucuuccaguggaaaguggacuuccuuccggcgacgaggaacgcaucgaauggcccucuacacccacagugggggagcuccccucaggggcugaaauuuuggaaggaucugcaucaggaguaggggaucugucgggucugccaucaggugagguuuuggagacaucugcgucgggcgugggugauuuaaguggccugccaagcggagaagugcuggagacuaccgcacccgguguggaagauauuucaggauugccuuccggggaagugcucgaaaccacugcuccuggcgucgaagacauauccggcuuaccuaguggagaaguucuggaaacaacagcccccgggguugaagacauuucuggccucccuagcggggagguccuugaaaccacugcaccugggguugaagauauaucuggccucccuuccggcgaagugcuugagaccacugcaccgggaguugaagacauuagcggccuuccuuccggcgaaguccuggagacugcagcgccgggcguagaggacauaaguggauugccaagcggcgagguccuugaaaccgcagcuccaggcguagaggauauauccggacucccgucuggagagguacuggagaccgcugccccagggguggaagauauuaguggcuugcccuccggagaaguucuggaaaccgcggcuccaggcguggaggauauauccggacuaccaagcggugaggugcuggaaacagccgcuccgggcguggaggacauuaguggucugccaucaggagaggugcuagagacugcagccccaggaguggaggacauaucaggguuacccaguggugaagucuuagagaccgcugcuccggguguggaagacaucucaggucugccuucuggggaggugcucgaaacggcggcccccggagucgaagauaucuccggauugcccaguggagaaguauuggaaacggcggcacccggcguggaggauauaagcggucucccgucuggagaagugcuagaaacggccgccccuggaguugaagacauauccggccuuccaagcggcgagguucuugagaccgcugcccccggcguagaggauaucaguggccugccuucaggagaggugcuagaaacuacugcuccaggaguugaagagauaaguggacuucccucuggagaaguucuugagaccacagcaccaggcguagacgagauuuccggccugccaagcggggagguguuagagacaacugcuccuggaguggaagagaucucuggguuacccucaggagagguucucgagacgucgacaucagcugugggagacuuaucagggcuaccuuccgggggagaaguucucgaaaucucugugucuggaguugaagauaucucuggacugccauccggcgaggugguggaaacaagcgcgucgggaaucgaggacgugucugaacugcccaguggagaaggacuggagacuucagccagcgguguugaagauuuaucgaggcucccuagcggugaagaaguguuggagauuucugcaucaggguuuggcgauuugucagggcuuccuucgggcggagaaggcuuggaaaccucggcauccgagguuggaacagaccucucaggcuuacccuccgguagagagggacuugagacguccgcgagcggagcggaagaccucagcggacuuccuucugggaaagaggacuuaguagggagcgccagcggggaucuggaccuaggaaaacugccauccgggacacuggguucaggccaggcuccugaaacauccggccucccaucuggcuuuagcggcgaauauaguggaguggaccucggaagcggaccccccagcggacugccugauuucucuggucuacccagcggguucccaaccguuucacuaguagacaguacacucgucgaaguggucacagcaagcacagcaagugagcucgagggcagaggaacuauugggauuucaggcgccggggagaucagcggacugccaucgagcgaguuagacauaucuggaagagcauccgggcugccuucggggacagaguuauccggccaggccuccggcagucccgacgucaguggagagauucccggucuguuuggagugagcggccagccaucaggauucccugacacuagcggugaaacaucaggcguaacugagcucuccggacuuagcagugggcagccagguauuagcggcgaggcaucaggcguccuguauggcaccucccagccuuucggaaucacagaucugucuggagaaacaucgggcgugcccgaccugucugggcaaccgucagggcucccaggauucaguggagccacgucaggcguaccugaccucguguccggcacaacaucagggucaggggaaagcaguggcaucaccuuugucgauacgucuuuaguggaaguggcaccgacaacauuuaaagaggaggagggacucgggucuguggaguuaucaggucugccuagcggcgaagcugaucucagcggcaagaguggaaugguggaugugagcggucaguuuucugggaccguggauuccucuggcuucacuagccaaaccccugaauucagcgguuuacccucaggaaucgcagaagugagcggcgaaaguucuagggcugagauuggguccucacuuccuagcggggccuacuacgggagcgguaccccauccucauuccccaccguuucacuugucgacaggacucucguggagaguguuacccaagcgcccacugcucaagaagccggggaaggucccucugguauccucgagcugucaggagcacacuccggagccccagauaugagcggcgaacacucgggcuucuuagaccugagcggucugcagucaggccugaucgaacccucgggcgaaccucccggaacaccuuauuucucuggcgauuuugcuagcacuacaaacgugucgggcgaauccucaguggcaaugggaaccaguggggaagccucaggucugccugaaguuacauugaucacaagugaauuuguggaaggcgucacggagccuacaauaagccaggagcucggccagcgcccuccugugacccauaccccucaguuauucgaaagcuccgggaaagugucaacagcaggcgacaucucaggcgccaccccaguccucccuggaagcggagucgaagucaguagcgucccugaauccagcucagagaccagugcuuaucccgaagcaggauucggugcuagcgcugccccagaggcaucccgggaagacagcggauccccugaucugucagaaacaacuucugcuuuucaugaagcuaaucucgagcguagcagcggacugggggugaguggcagcacccucacuuuucaagagggagaagcaagcgcagcuccggaagucucuggagaguccacgacaaccucugaugugggcacagaagcacccggccugccuagcgcuaccccgacugccuccggcgacaggaccgagauaucuggagauuuaagcggccacaccucccaacucggagugguaaucucaaccagcaucccggagagugaguggacccagcaaacacagcggccugccgaaacacaccucgagaucgaaucaucuucauuacuuuauaguggcgaggagacccauacaguggaaaccgcuacuaguccgaccgacgcuuccauccccgccagcccggaauggaaaagagaguccgaauccaccgccgccgcccccgccagaucuugcgcggaagagccuugcggcgcugguaccugcaaggagacugaaggccacgucauauguuuaugccccccugguuauacgggagaacacuguaauauagaccaagaagugugcgaggagggauggaauaaauaccagggacauuguuaccgacacuuuccugaccgcgagacguggguggacgccgagagacgaugcagggaacagcagagccaccuaagcaguauagugacaccggaggagcaggaguuugugaacaauaacgcgcaagacuaccaguggauugggcugaacgaucgaacgauugagggggacuuuagguggagugauggccaucccaugcaauuugagaauuggagaccuaaccaaccugacaauuucuucgccgccggcgaggacugcguggugaugauuuggcacgagaagggggaguggaacgacgucccguguaauuaccauuugccauuuacaugcaagaaaggaaccgucgcuuguggugagccccccguuguggagcacgcgcggacauuuggacaaaagaaagaucgcuacgaaaucaauagccugguacguuaccaguguacagagggauucguacagcgccacaugccaacaauucgaugucagccauccggacauugggaggaaccucagaucacuuguacagacccuaccacauacaaaagacgccuucaaaaacgaagcucuagacauccacgacgcucccgaccuagcaccgcacacuag

SEQ ID NO: 248614 - RNA, 7296 nt, Artificial Sequence
  Description of Artificial Sequence: Synthetic coding sequence
augaccacucuguuauggguguuugucacacuuaggguaaucacagccgccguaaccguugagacaagugaucacgacaauagccucuccguaaguaucccacagccuuccccccuccgaguccucuuagggacuagccucacuaucccauguuacuuuauugauccuaugcauccaguuacaacagcgccaucaacugcaccauuagccccgaggauuaaauggucgagaguguccaaagaaaaagagguggugcuccugguagcgaccgagggcagagugcggguuaacucagccuaccaagauaaggucagucugccaaacuacccagcgaucccaagugaugccacgcucgaaguccagagccugagaucaaacgacuccgggguuuaccgcugugaaguaaugcacgggauagaagacuccgaagcuacacuugaggugguagucaagggaauuguuuuucacuaucgcgccaucaguacaagauacaccuuggauuucgaccgagcgcagagagccugucuacaaaauuccgccauaaucgcaacccccgaacagcugcaggcggcguaugaagaugguuuccaucaaugugacgccgguuggcuggcagaucagacagucagauacccaauucauaccccacgcgagggcugcuacggggauaaagaugaauucccgggagugcgaacguacggcauucgggacaccaacgaaacguaugacguguacuguuuugcagaagagauggaaggcgaaguguuuuacgcgacuagcccagaaaaauucacauuccaggaagccgccaacgaaugcagacgucucggggccaggcucgcaaccaccggucagcuuuaucuugcuuggcaggcugggauggauaugugcucagcaggaugguuagcagaccggucaguccgcuacccaauuuccaaagcgagacccaauuguggcggcaaucuucugggagugagaacagucuacguucacgccaaccagacaggauacccugaccccucaucccgguacgacgccauuuguuauacuggcgaagauuuuguagacaucccugagaacuuuuuuggcgugggcggggaggaagauauuaccgugcagacugucacauggccagacauggaacugccccuuccaaggaacauuacugagggcgaagcuagaggaagcguaauucugacaguuaagccuauuuuugaagugaguccuagcccccuugaaccagaggagccuuuuacguucgcccccgagauuggagccacagccuuugccgaaguggaaaacgagacaggcgaggccacccgacccuggggcuuucccacccccggccucggcccugcuaccgcuuuuacuucugaagaucucgucguucaggugaccgcaguccccggacagccccaccuaccaggaggaguggucuuccacuaucggccuggcccuacacgauacucuuugacauuugaagaagcacagcaggcaugccugcgcacuggagccguuaucgcuuccccggaacaguugcaagcugcguaugaggccggauacgagcagugugaugcaggguggcuccgagaccagacgguaagauacccgaucgugucgccaagaacuccaugugugggcgacaaagacagcagcccaggcguaagaaccuauggcguaaggcccuccacugaaacuuaugacguuuacugcuucguggaccgucuugaaggcgaggucuuuuuugcaaccaggcucgagcaauuuaccuuccaagaagcucuugaauucugcgagagccauaaugcgacgcucgcaacaacuggacaacuguacgcagcguggucaagaggacuggacaaguguuacgccggguggcuagcggacggcucacugagauauccaaucgugacuccucgaccugcuuguggcggggauaaaccaggagugaggacugucuaucuguaucccaaucagaccggccugcccgauccacugucaaggcaccaugcguuuuguuuccgagggaucagugcaguaccaucaccuggagaggaggaggggggaacucccacuucaccgucuggugucgaggaguggaucguuacacaggucgugcccggcgucgccgccgugccagucgaggaagaaacuaccgcugugccgucuggagagacuaccgcaaucuuggaguucacaacugaacccgaaaaccaaacagagugggaaccagcauauaccccgguugguacuuccccccucccgggcauacugccuaccuggccucccacaggagcugccaccgaggaaagcaccgaggggccuagcgcaacugaagugccaucugcuagugaggagccauccccguccgaaguaccuuucccaagcgaggaaccuagcccuuccgaggaacccuucccuaguguccgccccuuucccucaguugaguuguuuccguccgaagaaccguuuccuagcaaagaaccuagcccgagugaagagccaagcgccagugaggaaccuuauaccccuagcccucccgugccgaguuggaccgagcuccccaguucuggcgaggaaaguggagcucccgacguaagcggagauuuuacuggauccggcgacguaagugggcaccuugacuuuucuggccagcugucaggggauagagcgaguggguugccuuccggcgauuuggacucuucgggacugacaucuaccguggggaguggccucccaguggagagcgggcugccaucaggcgacgaggagagaauagaguggccuuccacaccgaccgugggagaacucccgaguggagcugaaauccuggaagggagugccucaggcgugggcgauuugaguggacugcccaguggagaagugcucgagacaagcgcuagcggggucggagaucugagcggcuugccaagcggcgagguucuggagacuacagccccuggaguggaggauauuagcggcuuacccucuggagaaguguuggaaacaaccgcuccuggcguggaagauaucagcggacugccauccggagaggugcuugagacgaccgcaccagguguagaggauaucagcggacuaccaucgggcgaaguacuggagacuacggcucccggcguagaggacauaucaggcuuacccaguggggagguuuuggaaacaacagcuccuggcgucgaggacauaaguggacugccuucuggagaaguacuagaaaccacugccccaggcguggaggacauuagcggccugccaaguggggaaguucucgaaacagcagcacccggaguagaagauauuagcggguuaccguccggcgaaguucuagaaaccgcugcacccgguguagaagauaucucuggccugccaucaggugaaguuuuagagacugccgcaccaggaguggaagacauuagcggccugcccucaggagagguacuagagacggcggcgcccgguguggaggauauaucaggacugccuuccggggaaguguuggagaccgcagcgccaggaguggaggauaucucgggucugccuucaggggaaguccucgaaacggccgcgcccggaguggaagacaucuccgguuugccuucuggggaaguacuggaaacagccgcaccagggguggaggauauaagcggacucccgaguggugagguccuggagacugcugcuccuggcguagaagauauuucuggccugcccuccggagagguacucgaaacagcagcaccaggcguugaggacauaucugggcuuccgagcggcgagguccuggagacugcggccccuggaguugaagacauauccggacugccuucaggagaggugcuugagacagcggcaccagguguagaagacauuagcggccucccuucuggagaaguguuagagacugcagcuccaggcguggaagacaucucugggcugccaucaggcgaagugcucgagacagcugcucccggcguggaggacaucuccggcuugccaagcggcgagguccuggaaaccgcggcccccggcgucgaggacauuagcggccugccuaguggggaaguucuugaaacagccgccccuggaguugaggacauaaguggacugccaucgggggagguacuggagaccgcagccccagguguggaggauauuucagguuuaccaagcggcgaaguccuggaaacaaccgcaccuggcguggaagaaaucagcggccugccguccggcgaagugcuugagacuacggcccccggagucgacgaaaucaguggcuugccauccggcgaaguccuugaaacaacugcgcccggcgucgaagaaaucaguggccugcccaguggagaggugcuggaaacuucuaccagcgcggucggcgaccucagcggacuaccauccggaggagaggugcucgagaucucugugucaggcguugaagauauaucuggcuuacccuccggagaagucguggaaacaucagccagcgguaucgaggacgucagugaacucccgaguggcgaggggcuugagacaagcgcuucaggcguggaggacuuauccagacuuccgucuggggaagaaguguuagagauuagcgcgagcggguucggcgaucugagugguuuaccguccgggggagaggguuuggaaacgucagcaagugaagugggaacugacuuaucaggucuccccagugggcgugagggacuggagacaucagcguccggagcggaagaccugucuggacucccuucaggcaaagaggaccuuguaggauccgcaucgggcgaucuugacuuagguaagcucccuucuggaacacugggguccggccaagcuccugagacaucuggacugccauccggguuuaguggcgaguauucuggcgucgacuuaggguccgguccuccuucuggccuccccgacuuuagcgggcucccaucgggcuuuccaacagucucuuugguggacucuacacucgucgaaguggugacugcaagcacugcaucugagcucgagggccggggaacuaucggcaucagcggugccggcgagaucucugggcugccauccucugaguuggacaucuccggcagagccagcgggcuaccaagcggaacagaauugagcggccaagcauccggcucaccagaugucagcggugagaucccuggacuguuuggcgugucuggucagcccucaggguuuccugauacuagcggugagacaagcggcgugaccgaacuuagcggacuguccucuggccaaccaggaauaucuggggaggcauccgggguguuguaugguacuucacagcccuucggcaucaccgaccuaucuggugaaacuaguggcguccccgaccucucaggccagccuagcggacugcccggguucagcggggcaacuuccggcguucccgacuuggucucugguacaaccucugggucuggagaaaguagcgggauuacauucguggauacaagucuuguggaaguggcaccaacgacuuucaaggaggaggagggacuuggaagcguggaacugagcgggcuaccuucuggagaagccgaccuuucaggaaagagcgggaugguggacguuagugggcaguuuagcgguacggucgacucaucaggcuuuaccucacaaacucccgaguuuucuggccuaccuagcgguaucgcggaaguuagcggagagagcucacgcgcagagauuggcucuucccucccuuccggugcauauuauggaaguggaacaccuuccagcuuuccgacagucucucucgucgaucgaacccuugucgaaucugucacgcaagccccaacagcccaagaagcuggugaagggccgucuggcauucuggaacucagcggcgcgcacucgggagcuccugacaugucaggcgagcacucaggauuucuagaucuaucuggauugcagucuggacugauagaaccguccggggagccaccagggaccccuuauuucuccggcgacuucgcuucuacgacuaacguuucaggagaaucaucaguggcuauggggaccucaggggaagcauccggacuuccugaaguuacacugauuacuuccgaauuuguugaaggugugaccgaacccaccaucucccaagaacuuggccaacggccacccgugacccacacaccacagcuauuugagagcucuggcaaggucaguacagccggcgauauuucuggcgcuacacccgugcuccccggaucugguguggagguaucaagcgucccugaauccucaagugagacgucagcuuauccagaggcaggcuuuggcgccuccgcagcuccugaagcaagcagggaagauaguggaucccccgauuuaagcgaaacaaccucagcuuuccacgaagcuaaccuggagcgaucaucuggacuuggcguaucuggaucuaccuuaacuuuucaagagggagaggccuccgcugccccugaagugaguggggagagcacgacaacauccgacgugggcaccgaagccccaggucugcccuccgcuacaccuacagccucuggcgauagaacggaaaucaguggagaucugucgggacacaccucacagcugggcgucgucauuaguacaucuauaccagagucugaauggacgcagcagacacagcggccagccgagacacaccuugagauugagucauccucacugcuauacucuggcgaggaaacccauacuguagagaccgcgaccucacccaccgacgcuucuauccccgccucaccagaguggaagagagagagugagagcacagcggccgaccaagaaguuugcgaagaaggcuggaauaaguaucaaggacauugcuaccgccauuuuccagauagggaaacuuggguggacgcagaaagaagaugcagagaacagcaaucccacuugucaucgaucguuaccccagaagagcaagaguuuguuaauaacaacgcccaggacuaccaguggaucggccuuaacgacaggacaauugagggcgacuucagauggagcgacggacacccaaugcaguucgaaaacuggcggcccaaucaaccugauaauuuuuucgcagcuggugaagacugcgucguuaugauauggcacgagaaaggcgaauggaaugacgugccuugcaacuaccaccugccguucacuuguaagaaaggcacagccacuacauacaagcgaagacuacagaaacguucaagccggcacccucgacguucacgaccaucuaccgcccacuag

SEQ ID NO: 248615 - RNA, 7593 nt, Artificial Sequence
  Description of Artificial Sequence: Synthetic coding sequence
augacuaccuuacucugggucuucguuacacuucgggugaucaccgcagcugugacugucgaaacauccgaccaugacaauaguuugucuguuuccauuccucagccuuccccccuccgaguucuccuuggaacgucucugacaauccccugcuauuucauagauccgaugcacccggugacuacugcuccuuccacugcucccuuagccccccgcaucaagugguccagagucucuaaggaaaaggaagugguacugcucguggcuaccgagggacgaguucgcguaaauagugcauaccaagauaaagugagucuccccaauuacccagcuauccccuccgacgccaccuuagaagugcagagccugaggaguaaugacagcgggguguauagaugcgaggucaugcaugggauugaagacagcgaagcaacuuuggaagugguuguaaagggaauuguguuucacuauagggccaucucuacuagauacacacuggauuuugauagagcucaacgcgcaugccugcagaauagcgcuaucaucgccaccccugaacagcuucaggcagcauaugaagacggguuucaccagugugacgcagguuggcucgccgaucaaaccgucagguacccuauacauaccccaagagagggaugcuauggcgauaaggaugaauuucccggaguucggaccuacgggauuagagauacaaacgagacauacgacguguacugcuucgcagaagagauggagggggagguguuuuacgcuaccucaccugagaaauuuacuuuccaggaggccgccaaugaauguagaaggcucggugcucgccucgccacaaccgggcagcucuauuuagcuuggcaggcagguauggacauguguagcgcaggauggcuugccgauagaucuguucgauaucccauuucgaaagcaagaccaaacuguggcggaaaccuuuugggagugcgcacaguguacgugcacgcuaaccagaccggcuacccugacccaucuaguagguaugacgcuauuuguuauacuggcgaagacuuuguggauauuccugagaacuucuuugguguugguggagaggaagauauuaccguucaaaccgugacguggccagacauggagcuucccuuaccuaggaauauuaccgagggcgaagcuagggguucagugauccugacagucaagccgaucuucgaagugaguccaagcccuuuggagccagaagagccuuuuacauuugccccagagaucggugcuacagcauuugcggagguugaaaacgaaacaggagaggcuacccggccauggggguuccccacaccgggacuggguccagccaccgccuuuacaucagaggaucuugucgugcaaguuacagccguuccuggucagccacaccugccuggcggcguagucuuccauuauagacccggcccuacgcguuauucacugacuuuugaagaggcccagcaggcauguuuacgaacaggagccgugauugcuucuccugagcaacugcaggcagcauacgaagcuggguaugaacagugugacgcuggauggcugcgugaucaaacuguuagguacccuauuguaaguccccggacuccaugugugggcgacaaggacaguagccccggcgugcgaaccuacggagugagaccuucuacugagaccuaugaugucuauugcuuuguugauagauuagaaggagagguuuucuucgcuacgagacucgagcaguucacauuccaggaagcccuagaauuuugcgaaagucauaaugcaacucuagccacuacuggacaacuguacgccgcauggucuagaggccuugacaaaugcuacgccggauggcuagcagauggcucccucagauaucccaucgugacaccuaggccagccugcggcggcgacaaaccuggugugcguaccguuuaccuguaccccaaucagacuggccucccagaccccuuaucucggcaucacgcauucuguuuccgaggaauuagcgccgucccaucuccaggugaagaagagggggggacuccaaccuccccgaguggggucgaagaguggaucguuacacaaguagucccaggcguggcugcugugccagucgaggaggagacuacugcuguacccagcggcgagaccaccgcuauauuagaauuuacaaccgagccugaaaaucagacagagugggaacccgcauauacccccgucgggacuucuccacuaccugguaucuugccuaccuggccuccuacaggcgccgccaccgaggaaagcacugaaggacccucggcuacugaaguaccgagugccucugaagaaccaucucccucugaagugcccuuuccuuccgaagaaccuagcccuucugaagaacccuucccgagcguccgcccauucccaagugucgagcucuuuccuagcgaggagccauuccccuccaaggagccaucgccuagugaggaaccaagugccagcgaggagccuuacaccccuuccccccccgugccaucuuggacagaacugcccucuagcggagaagaaaguggcgccccagacgucaguggagauuuuaccggcucuggugaugugucaggucaccuugauuuuagcggucaguuaucuggcgaucgcgccuccggauugccgucuggcgaucuagauagcagcgggcugacuuccaccguggguucaggccucccaguggaauccggccuuccaaguggcgaugaggaacgcauugaauggccuaguacucccaccgucggggagcuuccgucaggcgccgagauacuggaaggguccgccucaggaguuggagauuugucuggauugccuucgggcgaggugcuggagaccucugcaagcgguguuggagaucucaguggucugccuaguggggaaguuuuagagacuacagcacccggcguggaagauauuucuggguugccguccggcgaggugcuagagacuaccgcuccuggagucgaagauauaagcggacugcccuccggagaaguguuggagaccaccgccccaggcgucgaagacauuaguggacugcccucaggugaagugcuagaaacuaccgcucccggugucgaggacauaucugggcuccccucaggcgaagugcuggaaaccaccgcgccuggaguggaagacauauccggccugccuagcggagaaguacuagaaacuacugccccaggggucgaggacaucucggggcuuccaucuggagagguacuggagacggcugcccccgguguugaggacauuuccggacuacccagcggagaaguguuagagacagcagcccccgguguggaggauauuuccgggcuuccuucaggagaggugcuggaaaccgcggcccccgggguggaagacauauccggcuugcccagcggagagguucuggaaacagcugccccuggcguggaagauauuucuggccuccccagcggugaaguucucgagacagcugcaccugggguggaggauaucaguggguuaccaucuggcgaggugcuugaaacugccgcaccuggcguggaggacauuagcggacuacccucaggcgaaguuuuggaaaccgccgcaccagguguugaagauaucagcgggcuaccgucaggagagguuuuggagacugcagccccaggcguggaggacauuagcgggcugccgucaggcgaaguccuggagacugcagcacccggaguugaagauaucucgggucugccuucuggcgaaguauuagagaccgccgcacccggaguagaggacaucuccggccugccaucaggggaggugcuggaaacugcagccccgggcguggaagacaucagcggacugccuaguggugaaguccucgagacggcagcuccuggcguagaggacaucucagggcuacccucaggggaaguacuagaaacugcugcaccuggcgucgaagacaucuccgguuugccuuccggugaggugcuugaaacugccgcaccaggcgucgaggacauuucuggccugcccagcggugaaguucuggagacagcagcaccugggguugaagauauauccggcuuaccuuccggcgaaguauuggaaacagccgccccaggaguggaagacauaagcggacugccaagcggagaagugcucgagacuaccgcgcccggcguugaagaaauaucuggccugccuuccggugaaguuuuagaaacuacugcuccuggcguggacgagauuucaggccucccuagcggcgagguucuagagacgacugcacccggcguugaagagaucaguggucugcccucuggugagguucuagaaacgucuacauccgcugucggcgaucuaagugggcucccgagcggcggagagguguuggaaaucagcgucucgggaguggaagacauuagcggauugccgucaggagaggugguugagacuuccgcaucuggcauagaagauguguccgaacuacccucuggggaaggauuagagacuagcgcaucagggguugaggaucuuaguagacucccgucuggagaggagguucuugagauuucggcaagcgguuuuggggauuugaguggccugccuagcggaggagaaggacuggagacaucagcaagcgagguagggacagaucucagcggucugcccucuggccgagaggggcuugaaacguccgcuucuggcgccgaggaucuuaguggcuugccaucaggcaaagaagaucugguugguucugcauccggcgaucuggacuuaggcaagcuccccagcggaacccucggcaguggccaggccccugagacauccgggcuuccauccgguuucuccggcgaguacagcggcguugaccugggauccggccccccuuccgggcuuccugacuucucuggacucccauccggcuuuccaaccgucagccugguagacaguacccugguggaaguugucaccgccucgaccgcuucugagcuggaaggaagagguacuaucgggauaucaggcgccggugaaaucagcgggcucccaucuuccgaacuagacaucuccggccgggccucuggacugccaaguggaaccgaguugucuggccaggcuuccggaucuccagacguuuccggagaaauaccuggauuauucggcguuucagggcagccaagcggcuuucccgauaccaguggggagaccucagggguuaccgaacuaaguggccugucgagcggacaaccggggauuagcggggaggccagcggugugcuuuacggcaccagccaaccauucggcaucacggacuuaucgggagaaacuucuggcguacccgaccugucuggacagccaucaggacugcccggcuuuucuggagcaacguccggcguacccgaucuggucucugguacuacauccgggucuggcgagaguucaggcauuacuuucguugacaccucacuaguugaaguagcuccuacgacguuuaaagaggaggaaggcuugggcucuguugaguugucuggucugccaaguggugaagccgaucugaguggaaaaucuggcaugguggacgugaguggacaguuuagcgggacuguugacuccuccggcuucacaagccaaacucccgaguucucuggccugccuucuggcauugccgagguaucaggugagaguucgagggcugagauugggagcucccugccgagcggagccuacuaugguagcggcacuccgucuuccuuccccacggucagucuaguugauaggacacucguugaaucggugacacaagccccuaccgcucaggaggccggagaggggccaagugggauacuggaauuaaguggagcucacagcggagcaccagacaugaguggagagcauuccggguuuuuagaucucucaggauugcaaagcggguugaucgagcccaguggagagcccccagggacuccuuauuuuagcggcgauuuugccaguaccacaaacgucucgggagagucuagcguugcaauggggacaucaggcgaggcaaguggguugcccgaaguuaccuugaucacauccgaguuuguagaaggugugaccgagccaaccauuucacaggaguugggccagcguccucccguuacucacacaccccagcucuuugagucauccggaaaagucagcacagcgggugacauuucuggcgcuaccccagucuuaccaggcagcggugucgaggugagcucaguaccugagaguagcagcgaaacgagcgccuacccugaggccggcuucggagcgucugcagcccccgaagcuucacgagaagauuccggcagucccgaccugagcgagacaaccagcgcuuuucaugaggcaaaccuggaacgaagcagcggacuuggcgugucagguaguacguuaaccuuucaagaaggugaagcaagugcugcucccgagguaagcggagagagcacgacaaccucugauguggguacagaagcccccgggcugccauccgccacuccuacugccucuggagaucgaaccgagauuagcggugaccugucaggacauacuucccaacuggggguagucauauccaccucuauccccgaaucagaauggacacaacagacgcagagaccggccgagacacaccuugagaucgaaucuaguucccugcuguacuccggugaggagacccauacaguugagacagcuaccuccccaaccgaugccuccauuccagcuucacccgaguggaagcgcgagagugaaaguaccgcugcugccccggccagaagcugugccgaagaacccuguggagccggaaccugcaaggaaaccgaaggacaugugaucugcuuguguccgcccgguuauaccggcgaacauugcaauaucgaccaagaaguaugugaagaaggcuggaacaaauaccagggacacugcuacagacauuuccccgauagagaaacaugggucgacgcagagcgacggugucgcgaacagcagucacaccugucuagcauugucaccccagaggaacaggaauucgugaauaacaacgcccaggauuaccaguggauuggucucaacgaucggacaauagaaggcgauuucagguggucugauggccauccaaugcaguucgaaaacuggagaccgaaucagcccgacaauuuuuuugccgccggagaggauugcguggucaugauuuggcaugaaaaaggagaauggaacgacgugcccuguaacuaccaucugccuuuuacuugcaagaaaggaaccguggccuguggugaaccuccgguggucgaacacgccagaacguucggacagaaaaaggacagauacgagauaaauagcuuggugagauaucagugcaccgaaggauuuguucaacgccacaugccuacaauccgcugccagccuaguggccauugggaggagccucagauaacaugcacagauccaacuacauacaaaaggaggcuacaaaaaagauccagucgacauccucgcagaagccgcccuaguaccgcccauuag

SEQ ID NO: 248616 - RNA, 7479 nt, Artificial Sequence
  Description of Artificial Sequence: Synthetic coding sequence
augacaacccugcuguggguguuugugacccuacgugucaucacugcagccgugaccguagaaacaagcgaccaugacaacucccuaagcgucucuaucccccaaccuaguccacuucgaguccugcucgguaccucacucaccauuccuuguuauuucaucgacccuaugcaucccguuacuaccgcgccgucuacagcuccccucgcaccucggaucaaguggagccggguguccaaagaaaaagaagugguucugcugguggccaccgaaggcagagucaggguuaacucagcguaucaggauaaaguguccuuaccuaacuacccagccauacccagcgaugcaacgcucgaggugcagaguuugcgauccaacgacucuggcguuuaucggugugaggugaugcacggcauagaggacucagaagccacauuggaaguggucgugaaaggcaucguauuccauuauagggcaauuucuaccagguauacacuugacuucgaucgagcccagagagcgugcuuacagaacuccgcaaucaucgccacaccugaacaacuccaagcugccuaugaagacggauuccaucaaugugaugcaggguggcuugcagaucagaccguaagguacccaauucacaccccaagagaagguuguuacggcgauaaagacgaauucccaggcgucaggacguacgguaucagggacacgaaugagaccuaugauguguacuguuucgcugaggagauggagggcgagguguuuuaugcuacaagucccgaaaaauucacguuucaagaggcugcuaaugaaugcaggaggcugggggcccgucuggccacuacaggucagcucuacuuggccuggcaagccggaauggacauguguuccgcagguugguuggcagauagaagugucagguaucccaucucuaaggcuaggcccaauugugggggaaacuuguugggggugcgaacuguguacgugcaugccaaucaaaccggauaccccgauccaagcucuagguaugaugcaaucuguuacacaggcgaggauuuuguggauaucccugaaaauuucuuuggcguggggggcgaggaagacaucacugugcaaacuguuacuuggcccgacauggagcucccucuacccaggaacaucaccgaaggggaagcgcguggguccguuauuuugacugugaaacccauuuuugaggugucacccaguccacucgagccagaggagccauuuacuuucgccccugagaucggagccaccgcauuugcugaaguggaaaacgagacaggugaggccacacggcccuggggguucccaacaccgggucugggaccggcaaccgccuuuacuagcgaagaccuagucguccaagugacagccguaccuggccaaccucaucuucccggcggcguaguguuccauuauaggccagggcccacuagauauucccugacuuucgaagaagcccagcaggccugccugcggacgggagccgugauugccagccccgaacagcugcaggcggcguacgaagcagguuacgagcagugugacgccgggugguuacgagaucagacgguccgguacccaaucgugaguccccgaaccccuugcgugggagauaaggauagcucccccggagucagaacauacggcguacggcccucuacagaaacauacgauguguacugcuucguggaucggcuugaaggcgaaguauuuuuugcuacacguuuagaacaguuuacauuucaggaggcgcucgaguuuugcgaaucccacaaugcuacccuggcuacaacuggacagcuuuacgcagccuggagucggggccuggauaaaugcuacgccgguuggcuggcagauggcagccuccgauauccuaucgugaccccucggccggcaugcggaggcgacaaaccaggaguccgaacuguuuaucucuauccuaaccagacagggcuaccugacccucucucacgccaccacgccuucugcuucagagguauuucugccguacccucccccggugaagaagaaggaggaacgcccacuuccccaucuggcgucgaggaauggauagucacucaggucguccccggcgucgccgcggugcccguagaagaggagaccacugccguaccaucaggcgaaacuacugcuauccuggaguuuacuacagagcccgaaaaucaaacggagugggaaccagcuuauacgcccguuggaacaucuccacuaccuggaauucugccuacuuggccaccaacuggagcugcaacugaagaaucgaccgaagguccuagugcuaccgaagugcccuccgccagugaagagcccuccccuucugagguuccauuuccuagcgaggagcccucuccgagcgaagaaccguucccauccgugcguccguuucccuccguagaacuguuuccauccgaagagccuuuuccuuccaaagaacccucuccguccgaggaaccuagcgccagcgaagagcccuauacacccaguccccccguuccaucauggacagagcuuccaucuucaggcgaggagagcggcgcacccgacgugaguggagauuuuacagggucaggcgacgucucugggcaccuagauuuuuccgggcagcuuaguggcgaucgagccagcggacugccauccggcgauuuagauaguagcggucucacuaguacuguggguucuggccugccaguugaaaguggacucccuaguggugaugaggaaaggaucgaauggccaucgacacccacggugggcgaacucccaaguggugccgagauucuggagggauccgcgagcggagucggugaucugucugggcugccgaguggagaggugcuggaaacaagcgcaucaggagugggcgaucugucugguuugcccaguggagagguucucgagacaacugcaccuggaguggaagauaucucuggacuucccucaggcgaaguccucgaaacuacagcaccuggcguggaagacaucagcggacugccaucgggagaagugcuugagaccacugcucccggcgucgaggauauuucagggcuccccuccggcgaggucuuggagaccacagcuccuggcgucgaggacauaucaggacuacccagcggcgaagugcuggaaacgacugcuccuggcguggaagauaucagcgggcuacccucgggcgaaguccuggaaacaacggccccugguguggaggacaucucuggacuccccuccggcgaaguauuagagacugcagcccccggaguugaagauauuucaggccucccuaguggggaagugcucgagacugccgcaccuggcguggaagauaucucuggccugccuagcggagaaguccucgagacagcagcuccgggcgucgaggauauuucuggucuuccgaguggcgaagugcucgagaccgcagcucccgggguugaggacauuagcggacuacccucaggugagguucucgaaacagcugcccccggcguggaagauauaucugggcucccaucaggagaggugcucgagaccgccgccccagguguugaggauauuagugggcuccccagcggugagguguuggagaccgcagcgccugguguagaggauauaagugggcucccaagcggcgaggugcuagagacagcugcuccuggaguggaggacauuucgggauugccaucuggugagguuuuggaaaccgccgcccccggugucgaagacaucagcggacuaccaucaggugaggugcuggaaacugccgcccccggaguagaggacaucagcggacugccuaguggcgaagugcuagaaacugccgcaccuggcguggaagacauuucuggccuucccucuggcgagguccuugagacugcugcacccggaguggaggauauuagcggacugcccuccggagaaguccucgagaccgcagcccccggaguggaggauaucucaggcuugcccagcggagaagugcuggagacugcugccccagguguagaggacaucucuggccugccaucuggcgaggucuuagaaacggccgcucccggcguagaggacauuucgggccugccguccggggaagugcucgagaccgccgcaccaggcguugaagacauaagcggccuacccagcggugagguacuggagacaacagcuccugggguggaggagauauccggucugcccagcggagaaguauuagagaccacggccccuggcguugacgaaauaagcggccugcccucuggagaaguucuugagacuacugccccaggcguggaggaaauuagcggcuuaccuagcggagaaguucuggagacuaguacuucugccgugggagauuuaucaggccugcccuccgguggugaaguucucgaaauuagcguuucuggcguugaagauaucagugguuugcccuccggugaggucgucgagacuagcgccuccggcaucgaggauguuagcgaguuaccauccggcgaagggcuugaaacaagugcuagcggcguagaagaccugucgagacugcccaguggcgaagaaguacucgagauuagcgcauccggcuucggggauuuaucaggacuacccaguggcggagaaggacuggagacaucagccagcgaaguggggacagaucugagcggacuucccuccgguagggagggucuggagacaucugccucuggggccgaggauuuaagcggccugccuucugguaaagaagaccuugucggaagcgcuucuggagaccuugaucuaggaaaacuaccaucgggcacacuuggcaguggucaagccccagagaccagcggacuacccuccggcuuuucuggcgaauauagcggcguggaccuuggcucaggaccccccagcggccucccagacuuuuccggcuugcccuccggcuuccccacagugagucucguagacuccacccuuguggaaguugugacugcuucaaccgcgagcgaacuggaggggagaggaacuaucggaauaagcggagcuggugaaaucucaggccugcccaguagcgaguuagauauuaguggacgugcaaguggcuuaccuagcggcacagaacucaguggccaggccucaggauccccagacguuaguggcgagauccccggacuauuugggguaagcggucaacccagcggcuuccccgauacaaguggagaaaccuccggugugaccgaauugucgggacugagcaguggacagcccggaauaagcggggaagccagcggagugcuguauggaacuucccaaccauucgggaucaccgaccuuucgggagaaacauccggagugcccgaccucagcgggcagcccagugggcuuccaggguuuaguggcgcaaccuccgggguaccugaucuggugagcgguacgacuucaggaucuggcgagucuaguggaauaacguucgucgacaccucucuggucgaaguugcaccaaccacauuuaaagaagaggagggguuggggucuguugagcuuagcgggcucccaaguggagaggccgaccugaguggaaagaguggaaugguugauguaaguggacaauuuagugggacaguugauucuuccggguucaccucucagacaccagaauucuccggccugccuucugggaucgccgaagucucuggugaauccucacgcgcugaaaucgguuccucuuugccuucuggggcguacuacgguucaggcacaccaucguccuuucccacagucagccuuguagaccggacgcuggucgaauccgugacccaagcacccacggcacaggaagcaggcgagggucccucagguauccuggaauugucuggagcucacaguggggcccccgauaugaguggagaacauucuggauuucuugacuugucgggacugcagagcggccuuaucgagccaagcggugagccucccggaacaccauacuuuaguggagauuucgcaagcacaacuaacgucucuggagaauccuccguggcaauggggacuucuggcgaagcuagcggacucccagaagucacgcucauuacaagcgaguucguugaaggaguuaccgagccuacuauaucccaggaacugggccaaagaccccccgucacucacaccccacaacuuuucgaguccucagguaagguguccacggcaggagacauuucuggggcuacacccguacuccccgggucuggaguugaggucucuuccgugccugagucgucuucugagacauccgcauaccccgaagcaggauucggggccucagcagccccagaggcaagucgagaagacuccggcaguccagaccugagcgaaaccacaagcgcauuucacgaggcaaaucuggaaaggagcagcgguuuaggugugucuggaagcacucucaccuuucaagagggagaggcuagcgccgccccagaagugaguggugaaucaacuacaacaagugacguggguacagaggcccccggauuaccaagcgcaacccccaccgcaagcggcgacagaacugagaucuccggggaccugagcgggcacacuagccaauuaggggugguuauaaguacgagcauucccgaaucggaguggacccagcagacacagcgcccagcggagacucauuuagagaucgaaucaucaagcuugcuguauuccggggaagaaacgcacacgguggaaacagcaacaagcccuacagacgcuucaaucccugccagucccgaauggaagagagagucagaaucuacugcugccgaucaagaagucugcgaggagggauggaacaaauaccagggacacuguuaccggcauuucccagaucgcgaaacauggguggaugcugaaaggagauguagggagcagcaaucucauuuguccucuauaguaacacccgaagaacaagaguuugucaacaacaaugcucaggauuaccaauggauuggccugaacgaccgcacaaucgaaggagauuucagguggagcgaugggcauccuaugcaguuugagaacuggcgacccaaucaaccugauaauuuuuuugcagcaggggaagacugcgugguaaugauuuggcaugagaagggugaguggaacgacgugcccugcaacuaucaccugccuuuuacuuguaaaaaggguaccgucgccugcggagagcccccugucguggaacacgcucgaacguucggacagaaaaaggauagguacgagauuaauagccuuguuagauaccagugcacagaaggauucguacagcgccacaugccgacaauccggugccaaccuucagggcauugggaagagccucagauuacguguacagaucccacuacauauaaacgccgccuccagaaaagaucuucucgucacccucgccggagccgccccuccaccgcgcauuag

SEQ ID NO: 248617 - RNA, 7593 nt, Artificial Sequence
  Description of Artificial Sequence: Synthetic coding sequence
augacaacccuccuguggguguuuguaacucuaagagucaucacugccgcaguuacagucgagacuucugaccaugacaauuccuuaucuguguccauuccacagccuucuccacuccguguucuucugggaacaagccugaccauccccuguuauuucaucgauccaaugcauccagucacuacagcuccaucuacagcucccuuagccccacguaucaaauggucacgaguuagcaaggaaaaggaagugguguuacugguagcuaccgaagggcgcguccgggucaauucagccuaucaggacaaggucucucuccccaacuaucccgcuauaccuucugaugcgacccucgagguacaaucucugcguucaaacgacagcgggguguauagaugugaagucaugcacgguaucgaagauagugaagcgacgcuugaaguagugguuaaggggaucgucuuccacuaccgcgcuauuagcaccagauauacauuggacuuugauagggcccagcgcgcaugcuuacagaauuccgcgaucaucgccacaccugaacagcugcaggcagccuacgaggacggauuccaccagugugacgcuggauggcuagcugaccagacaguccgcuacccuauacacacuccacgagaggguuguuauggugacaaagaugaguucccaggagugaggacuuacgguaucagagauacgaacgaaaccuacgaugucuacugcuuugcugaagaaauggaaggcgagguguuuuaugcuaccagccccgagaaauucacuuuccaggaggccgcgaaugaguguaggagacuuggcgcgagguuagcuacuacuggucaauuguaccucgcuuggcaggcaggcauggacaugugcucagcagguuggcuugccgacagauccguccgauacccaauuagcaaggcuaggccaaacuguggcggcaaucuucugggcgugaggaccguuuacgugcacgcgaaccaaaccggcuacccagacccuucaagcagauacgacgcuaucugcuauacgggagaggauuucguggacauacccgagaauuucuucggcgucggcggagaggaagacauuacagugcagaccgucacuuggccugacauggaacugccccugccucggaacauuacagaaggagaagcgcgcggcucaguaauucucaccgucaaacccaucuucgaaguuaguccaucuccccucgagccagaagaacccuuuaccuucgcuccugaaauaggcgcuacagccuucgcggaggucgaaaaugaaaccggcgaagcuaccagaccuuggggauucccaaccccaggcuugggcccggccacagcauucacaucggaggacuugguagugcaaguaaccgccgucccugggcagccacaccucccggggggaguugucuuucacuauagaccugguccuacacgcuauagcuuaaccuuugaggaggcucaacaagcauguuugcggacgggagccgugauugcuuccccugaacagcuucaggcugcauacgaagcaggguaugaacagugcgaugcaggauggcucagagaucaaacagucagauaucccaucguauccccucgaacaccuuguguaggugacaaagauucaucccccggagugagaaccuauggcgugagaccuagcacggaaaccuacgaugucuacugcuuugucgaucggcuggaaggagaagucuuuuuugcuaccagguuagaacaauuuacauuccaagaggcccuggaguuuugugaaucacacaaugccacauuggcuacaacgggccaacuauacgccgcauggucaagaggacuggacaaaugcuaugcuggauggcuugcagacgggagccuucgcuaucccaucgugacuccuaggccugcgugcggcggugauaagccaggcguuagaaccguuuaucuguacccaaaucagacuggccugccugauccccugucaagacaucacgcauucugcuuucgugggauaucggcaguaccaucaccaggugaagaagagggaggcacaccaacaucuccaagcgguguggaggaauggauuguaacccagguggucccaggcgucgccgcuguuccuguggaagaggagaccacugccguaccuucuggagagacaaccgcaauccuggaguuuaccacggagcccgagaaccagacugaaugggaacccgcuuauacacccgucggaacauccccccuccccgggauauugccuacauggccuccgaccggagcagccacagaagagaguacggagggaccuucugcaacagagguacccagcgcauccgaagagccuucccccuccgaaguccccuuccccagugaagaaccuagcccaucugaagaaccuuuucccucugugagacccuucccuucaguagaacucuuuccauccgaggaacccuuccccucgaaggaaccaucccccuccgaagagcccucagcaucugaggagccuuacacaccuucccccccagugccaaguuggaccgagcugccaucuucaggcgaagaguccggggcuccugauguuaguggggauuucacagguucaggcgaugucagcggacaccuagauuucucuggacagcugagcggugaucgcgcuucaggucugccguccggcgaucucgacagcaguggacucaccucuacagucggcucagggcugcccguagagucaggauuaccuaguggugacgaggagaggauugaauggccuaguaccccuacagugggcgagcugcccuccggcgccgaaauccuugagggauccgccuccggagugggcgaccugucaggccugccuucuggagaggugcucgagacgucugccagcggagucggugauuugaguggacuacccuccggagagguucuggagacaaccgcaccuggcguagaggacauaaguggucugccgagcggcgaagugcuugagacuaccgcuccaggagucgaagacaucucaggucucccuuccggggaaguucuggagacaacagcucccgggguggaggacauuagugggcuuccgucaggggaagugcucgaaacgacugcaccugguguggaggacauauccggucugcccagcggagagguacuggaaaccaccgcacccggcguggaagauauaagcggacugcccagcggagagguacuagagacuaccgcccccggcgucgaggacauuaguggcuugcccucuggcgaaguucuugagacugccgcacccggcguagaagauaucaguggacugcccuccggcgaagugcuagaaaccgcagcucccggcgucgaagacaucucgggacuaccgucgggagaggugcucgaaacagcugcacccggaguggaagauauauccggguugccuucuggcgaaguucuugagaccgcagcaccgggaguugaggauauauccggccugccaucuggugaggucuuggagacugcugcccccgggguggaagacaucucuggccugcccucaggagaaguuuuagagaccgcagccccagggguugaagacaucucaggccugccauccggggagguccuggaaaccgcugccccuggcgucgaagacaucagcgggcuacccaguggagaagugcuagagacagcugccccaggaguggaggacaucucaggucugccauccggugaaguguuagaaacugcagcuccaggcguggaggacauaaguggucugccuucaggcgaaguauuggagaccgcugccccugggguugaggacaucaguggguugccaucaggagaggugcucgagaccgcugcgcccgguguggaagauaucucuggauugcccucgggggaggugcuggaaaccgcugccccgggcguggaagacaucagcggauugccaucgggugagguccuggaaacagcugccccaggcguugaggacauuucaggacuuccgaguggugagguauuagaaacagcggcuccaggcguggaagauauuuccggucugcccuccggagaaguccuugaaacagcggcuccuggaguggaagauauaucgggguugccaagcggagaaguccuugagacggcagcucccggcguugaagacauaucaggccugccuagcggugagguguuagaaaccacagcacccggcguggaagagaucuccgguuugcccuccggagagguguuagagacaaccgcacccgguguggacgagauuuccggacucccauccggugagguccuugaaacaaccgccccgggcgucgaagaaaucagcgggcugcccaguggggaagugcucgagaccaguacaagugcggugggcgaucucucaggucuuccuucaggcggagagguccuagaaauaagugugagcggaguugaggacauaagugggcuuccauccggugaagugguagagaccagugccagcgggauugaggauguaagcgaacuaccuucgggggaaggccuagagacgagcgcaaguggcguggaagaucuaucucggcuccccagcggagaagagguguuagagaucucagcaagcggauuuggggacuuaucaggacugccuagcgggggugaaggacuggaaacuagugccagugaagugggcacagaucugagcggacugccuucugggagggaggguuuggaaacaucugccaguggagccgaagacuugaguggucuccccuccgguaaagaggaccuagucgggucugccuccggagaccuugaucucggaaaacugcccucuggaacccucggauccggucaggcaccagagaccucagggcuuccuaguggauuuaguggcgaauauucagggguagacuuagggagugggcccccaucuggacuucccgacuuuuccgguuugccaucuggcuuucccacagucuccuuaguggacucaacuuuggucgaaguggucaccgccaguacugcuagcgaacuggaaggccgcgguacaauugggaucucaggagcgggugagauuuccggacugccuagcuccgaauuagauaucucgggacgcgcuuccggacucccaucuggcaccgagcuuuccggucaagcgagcggcaguccugacgucaguggagaaauucccggccucuuugguguaagcgggcagcccucaggauuuccugacacuaguggagaaaccucaggaguaacggagcuaucagguuugucuagcggacaacccgggaucucuggggaagcaagcggaguguuguacgggacaagccagccuuucgggaucacagacuugucuggcgaaacaagugggguucccgaccuaucugggcaaccuucuggcuuaccaggcuucucuggcgcuacgagugguguaccugaucucguuuccggcacaaccuccgggucaggugagucauccggaauuaccuucguugacaccagcuugguagagguggcaccgacuacuuuuaaggaagaggaaggucucgguucaguagagcucuccggacuuccgagcggcgaagccgaccuuucaggaaaaaguggcauggucgacguguccggucaauuuagugguacugucgacagcagcgguuuuacuucccagaccccugaauucagcggacugcccucugggaucgcugaagugaguggagagagcagccgcgcagaaauuggcaguaguuugccuucuggcgccuacuacggaucggggaccccuaguaguuuccccacagugucacuuguggaucggacacuuguugagaguguuacccaggcuccaacagcucaagaggcuggcgaaggaccgagcggaauccucgaguuaucuggugcccauuccggagcccccgacaugucuggcgagcacagcggguuuuuggaccucaguggguugcagaguggccugaucgaacccagcggggaaccaccagguaccccauacuucucuggcgacuucgcgucaacuaccaauguuaguggcgaaagcaguguggcuaugggcaccucaggagaggccuccggauuaccugaagugaccuuaauuaccucagaauuuguugaaggcguaacugaacccaccauuagccaagaacucgggcaacgccccccugucacccauacaccacagcucuucgagucuucaggcaaggucucaacugccggugauauuucaggugccaccccaguucugccgggaagcggggucgaggugucaucaguuccagagagcagcagcgagaccagcgcauacccggaggcaggauuuggcgcauccgcugccccugaggccucccgcgaagacucuggcuccccagacuuaagugagacgacaucugcuuuccaugaagcuaaucuggagcgaucuucuggccugggcgucagcggguccaccuuaacauuccaagaaggcgaagccucagcagcccccgaaguuagcggugaaaguaccaccacuucagacguggguaccgaagccccuggccucccgucagccaccccaacagccagcggcgaccgcacagaaauuagcggagauuugagcggccacacuagucaacucgguguuguuaucucuacuuccaucccagaaucagaauggacacagcagacacagcgucccgcagaaacacaccuagaaauugagucauccucacuauuauauuccggugaggaaacacacacaguggaaacggcuaccuccccgaccgaugccagcauaccugcgucuccugaguggaaaagagagucugagagcacugccgcugcccccgcuagguccugcgcagaagagccauguggcgcaggaacaugcaaagagaccgagggccacgucauuugccugugcccgccagguuauacaggagagcauugcaauauagaccaggaaguaugugaagagggcuggaauaaguaucagggucauugcuaccgacacuucccugaucgagaaacauggguugacgccgaaagaagauguagagagcagcagagccauuugucuucaaucgugacucccgaagagcaggaguucguuaacaacaaugcacaggacuaucaguggaucggcuuaaaugauaggaccaucgaaggcgauuuuagauggagcgauggacacccuaugcaauuugagaacuggcgacccaaccaaccugacaacuucuucgcagccggggaggacugugugguuaugauauggcacgaaaaaggcgaauggaacgaugucccuugcaauuaucaucugcccuuuaccuguaagaaagguaccgucgccuguggagagccccccguaguggaacacgcuagaaccuuuggucagaaaaaagauagauacgagauuaauagcuuggugagauaucaguguacugaaggcuuuguccaacggcacaugccuacaauccggugucagcccaguggucacugggaagaaccccagauuacauguaccgaccccacaacauacaagaggagacuccagaaacgauccucacgccacccucguagaagccgacccuccaccgcccauuag

SEQ ID NO: 248618 - RNA, 1758 nt, Artificial Sequence
  Description of Artificial Sequence: Synthetic coding sequence
auggccgccguggaacucgaguggaucccugaaacucuuuauaacacugccauuagugcggucgucgacaauuauauaagaagcaggcgcgauaucaggagucuuccagaaaauauccaguucgacguuuauuauaaacuuuaccagcaaggaagguuaugucagcuaggaagugaauucugugagcuggaggucuucgcuaaaguacugagagccuuggauaagaggcaucugcuucaccauuguuuccaggccuugauggaccacggagugaaaguugcgucagugcuggccuauucuuucucacguagguguucuuacauugccgaaagugacgccgccguaaaagaaaaagcuauucagguuggauucgugcugggcggguuccuuagcgacgccggaugguauuccgacgccgaaaaaguuuuucugucuugccugcagcuuuguacacugcaugaugagauguuacacugguucagagcuguggaauguugcgugagacucuuacacguucgaaauggaaauuguaaauaucaccuuggcgaagagacguucaaacuugcccaaacuuacauggauaagcugucaaagcacggacaacaagccaacaaggcagcacuguacggggaacuuugcgcacugcuguuugcuaaaucccacuacgaugaagccuacaaauggugcauugaagcuaugaaagaaauaacagcaggacuacccgugaaaguggugguggacguguugcgccaggcaagcaaagcuugugucgugaagagggaguucaaaaaggccgagcagcucauuaaacaugccguguaccucgcgagggaucauuucggaucaaaacauccaaaauacucagauacucuacucgauuacggcuucuaucuucuuaauguugacaacauuugccaguccguugcuauuuaccaagcugcucucgauauucggcaaucuguguucggaggcaagaauauccauguagcuaccgcucaugaggaccuggccuauucuuccuauguccaccaguacagcaguggcaaguucgacaaugcucuguuucaugcggaaagagcuaucggcaucauaacccacauacucccugaagaucaucucuugcuugcuuccucaaaacgagugaaggcccuuauuuuggaagagaucgcuauugauugucacaacaaagagacagaacagcgacuccugcaagaggcccaugaccuacaccugucuucccugcagcuggcuaaaaaagccuucggagaauucaacguccaaacggccaaacacuacgguaacuuaggacgcuuauaucagucaaugagaaaguuuaaagaagcggaagaaaugcacauuaaagcaauccaaaucaaagaacagcuccugggacaagaggauuacgagguggcucugagcgucggccaccuagccagccuguacaacuaugacaugaaccaguaugaaaacgccgagaaacuguaccuacgaucaauugccauuggcaaaaagcuguuuggcgagggcuacucagggcuugaauaugauuauagaggcuuaauuaagcuguauaauaguauuggcaacuaugagaagguguucgaguaucauaauguguuaucuaauuggaaccgacugagggauagacaauacuccguuacagaugcccuugaagacgucucuacaaguccccagucuaccgaagaaguuguacaguccuuucugauuucccaaaauguggaggggccuaguuguuag

SEQ ID NO: 248619 - RNA, 354 nt, Artificial Sequence
  Description of Artificial Sequence: Synthetic coding sequence
augggaaccuggggcgccccacaucggacccugccaugcagaaaucgcggcgcuaugcagccgcgugucuuacuagugguggcccuccucgcccuucuugcuucugcuagggccagugaagcggaggaugcgucccuuuuaucguucaugcagggcuacaugaaacaugcuaccaagaccgccaaggaugcuuugagcuccguccaggagucacaagucgcgcagcaggcuagaggauggguaacagauggcuuuucuucccugaaagauuauuggucuacuguuaaggacaaguucuccgaguuuugggacuuggauccagagguuagacccaccuccgcaguggccgcauag

SEQ ID NO: 248620 - RNA, 168 nt, Artificial Sequence; identical to SEQ ID NO: 248014
  Description of Artificial Sequence: Synthetic coding sequence

SEQ ID NO: 248621 - RNA, 954 nt, Artificial Sequence
  Description of Artificial Sequence: Synthetic coding sequence
augaaaguucugugggccgcucuguugguaaccuuucuggccggaugucaagccaagguugagcaagcuguggaaaccgaaccagaaccagaacuuagacagcaaaccgaguggcaaucgggacagcgcugggagcuggcccuuggccgcuuuugggacuaucuacgcuggguacagacccuaucagaacaggugcaagaagaacugcuuagcucccaggugacacaagaacugagagcccugauggaugagaccaugaaagagcugaaggcauauaaaucugaauuggaggagcaacuaacgcccguagccgaagagacacgggcuagacucagcaaggagcuacaggcugcccaagcgagguugggggcagauauggaggauguuuguggacgacuggugcaguauagaggagaagugcaggcuauguugggacagucuacugaagaauugcggguaagacucgccagccaccucagaaaacugcggaagagacuguuaagagaugcagaugaucuccagaaacgcuuggcugucuaccaggccggggcacgggaaggcgccgaacgcggcuuaagugcuaucagagaacgcuuagggccuuugguggagcagggaagaguuagagcagcgaccgugggaucgcucgcgggacagccucuccaggagagagcccaggccuggggugagagauuacgggccaggauggaggagaugggcagccggacaagagaucgcuuggacgaagugaaggagcaggucgcggaagucagagcuaaauuggaagagcaggcucagcagauuaggcuacaggccgaagccuuucaggcgagacugaaaaguugguucgagccccuuguggaggacaugcagagacaaugggcuggauuaguggaaaaaguucaagccgccguagguaccuccgcagcacccgugccaagugacaaucauuag

SEQ ID NO: 248622 - RNA, 660 nt, Artificial Sequence
  Description of Artificial Sequence: Synthetic coding sequence
augaagguacuuugggcagcauuauuaguuacguuccuggcgggaugccaggccaaggucgaacaagccguugagacagaaccggagccagaacugcgucagcagacugaauggcagaguggucagcguugggagcuagcacuaggcagauuuugggacuaccugcgcugggugcagacuuuaucggaacagguccaggaggagcucuuauccucacaagucacccaggaacucagggcccugauggacgagacaaugaaggaacugaaggccuauaaauccgaacucgaggagcaacuuacaccuguugccgaagaaacacgagccagacucaguaaagagcugcaagcugcacaggcccgacuuggagcagacauggaggacgugugcggucgucuaguacaauacagaggcgaaguucaagcaaugcugggucagagcacagaagaguuacgagugagacuggcuucucaccugcggaagcugcgaaaaagacuucugcgcgacgccgacgaccugcaaaagaggcuggcggucuaccaagcaggagcgcgggaaggugccgagagaggguuaagugcaaucagggagcggcugggcccacuuguggagcagggaaggguaagagcagcaacagugggaucucuagcugggcaguag

SEQ ID NO: 248623 - RNA, 867 nt, Artificial Sequence
  Description of Artificial Sequence: Synthetic coding sequence
gaaguuaaggaugugcugccacaggaacccguccggagugcaguuggcgggacaggcauguccuccggcgcuucaagaaaguccugggacccugggaauccuuggcccccagauuggccuaucaccgggcgcaaaaugaagguguugugggcugcgcuccuggugaccuuccuugccggaugucaggcuaaggucgaacaagcugucgagacagaaccggaaccugaauugcgucaacagaccgaauggcaaucaggccagaggugggaacucgcucuuggaagauuuugggacuaccugcgauggguacagacauugagugagcaggugcaagaagagcucuuguccagccagguuacccaagagcuuagggcuuuaauggaugaaacaaugaaagaacuuaaggcauacaaauccgaacuugaggaacagcugaccccugucgcagaagaaaccagagcccggcugaguaaggaacuccaggcugcacaggcaagacugggggcugauauggaagacgugugcggucgacucgugcaauaucguggagagguucaagcgaugcugggacagucuaccgaggaguuaaggguacgccucgcuucccacuugcgcaaacuaaggaaacgucuucucagagacgccgacgacuuacaaaagcgacucgccguguaucaggccggagcccgagagggggcugagcgaggccugagcgcuauucgggaaagacugggacccuugguagaacaagggagggugcgcgcugcaacuguagggagccuggcuggucaacccuuacaggaaagagcacaggcauggggggagagacuuagggcacggauggaggaaauggggucacgcacuuag

SEQ ID NO: 248624 - RNA, 651 nt, Artificial Sequence
  Description of Artificial Sequence: Synthetic coding sequence
augaaagugcugugggcagcccuguugguaaccuucuuggcaggcugucaggccaaggucgaacaagccgucgaaaccgaacccgagcccgaacuccgacagcagacugaguggcagaguggacagaggugggaacuagcccugggacgcuuuugggacuauuugagauggguacagacccugucagaacaaguccaggaagagcuccuaagcucucaggugacgcaagaacugagagcucugauggaugagacaaugaaagaauugaaagcauauaaaagugaacuagaagaacaguuaaccccuguggccgaagagacgagggccaggcugucuaaagaauuacaggccgcccaggccaggcucggggccgacauggaggacgucuguggccguuuaguccaguauaggggcgaagugcaggcgauguuaggccaaucuacugaggagcugcgcguaagguuggcuagccaccucagaaaacugcggaaaagacucuugcgcgacgcugaugaucugcagaaacgacucgcuguauaccaggccggugcuagagagggagcagagagagggcuguccgcgaucagggagagacuuggcccucuuguagagcagggccgcgugagagccgccaccguuggaucauuguag

SEQ ID NO: 248625 - RNA, 1245 nt, Artificial Sequence
  Description of Artificial Sequence: Synthetic coding sequence
augcgguucaagucucacacuguugagcuucggaggccauguucugauauggaaggcgccgcacuuuuacgaguauccgugcuaugcaucuggaugagugcguuguuucuaggggugggcgugagagccgaggaggcaggggcacgcgugcagcagaacgugccuucaggaacugacaccggagacccacagucaaagccccuuggggauugggcggcaggaacaauggacccggaaucuaguauuuucauugaggacgccauaaaauauuucaaagaaaagguaagcacccaaaauuugcuacuucuacuaacagauaaugaggcauggaauggauucguugccgcugcagaacuccccagaaacgaggccgacgagcuucgcaaggcucuagauaaucucgcuagacaaaugauuaugaaggacaagaauuggcacgauaaaggucagcaguacagaaauugguuuuuaaaagaauuuccacgccugaagucugagcuagaagacaauauucgucggcugagagcccuugccgauggggugcaaaagguccacaaggggacaaccauugcuaauguugucagcgggucacugucaauuucuucuggcauacuaacgcuggucggaaugggacucgcaccauucacggaaggugguagccuugugcugcuagagccgggaauggaguuggguauuacugcugcccugacugguauuaccuccuccacgauggacuacgggaagaaaugguggacucaagcacaggcgcacgaucuggucaucaagaguuuagauaagcugaaggaaguacgcgaauuucucggggagaauaucucuaauuuccucucacuugccggaaacacauaccagcugaccaggggcaucgggaaggauauucgugcacuuagacgagcgagagcaaaucuacagucggucccccacgcaagugcauccaggccccgagucaccgagccuauaagugcagaauccggugagcagguagaaagaguuaaugagcccuccaucuuggaaaugagccguggcgucaagcugacagaugucgcaccugucuccuucuuccucguccuggaugucguguaccuggucuacgaaucaaaacaccuacaugaaggugcuaaauccgaaaccgccgaggagcugaagaaggucgcccaggagcucgaggagaaacugaauaucuuaaacaauaauuacaagauucugcaagccgaccaagaacuauag

SEQ ID NO: 248626 - RNA, 834 nt, Artificial Sequence
  Description of Artificial Sequence: Synthetic coding sequence
augauuaugaaagacaaaaauuggcacgacaagggccagcaguacagaaacugguuucuuaaagaauuucccagacugaaaagugaguuggaagacaauauaaggcgucuuagggcacuggcagacgggguucagaaggugcauaaggggacuaccauugccaacgucgugucgggcagccugaguaucucuucaggaauucucacucugguuggaaugggccuugcaccauuuacagaagguggaucccugguucuauuggagccgggaauggaacugggcauuacugccgcucugacaggcauaacuucaagcacaauggauuacggcaaaaaaugguggacccaggcccaagcgcaugaccuugugaucaaaucucuagauaaacugaaagagguacgggaguuccuuggcgaaaauaucuccaacuuucuaucccuggcaggcaauacguaccagcugacaagaggcaucgguaaagacauccgcgcccuccggagagcucgggcuaaccuacaguccgugccgcaugcuagugcgucuagaccacguguuacugaacccaucucagcagaauccggcgaacagguugaacggguaaacgagcccagcauauuagagauguccagggggguuaaacuaacugacguggcaccuguaucuuuuuuccuuguauuggaugugguauaccugguuuacgaguccaaacaccuucaugaaggcgccaagucugaaaccgccgaagagcuaaaaaaggucgcacaggaacuggaggagaaauugaacauccuuaauaauaacuacaagauccugcaggcugaucaggaacuguag

SEQ ID NO: 248627 - RNA, 1197 nt, Artificial Sequence
  Description of Artificial Sequence: Synthetic coding sequence
auggaaggagcagcuuuauuacgggugagcguguuaugcaucuggaugucugcccuuuuucugggcguuggcgugcgcgcagaggaggccggugcccguguucagcaaaacguucccucuggcacugacaccggagacccccaaagcaaaccccuaggagauugggcagcgggaacgauggacccugaaucuagcaucuucauugaagaugccaucaaauacuucaaagagaaagugaguacacaaaaucugcucuuguugcuuaccgacaaugaagcguggaauggauucguagcagcggccgaauuacccagaaaugaagcggaugaacugaggaaagcauuggauaaccuugcacggcagaugauaaugaaggacaaaaauuggcaugauaaagggcaacaguaccgcaacugguuccuaaaggaguucccuaggcugaaaagcgaguuggaagauaauauccgaagacugagagcccuugcugacggagugcagaaaguccacaaagguacaacuauagcgaacgugguuucagguucccuuucaaucaguuccggaauccuuaccuugguaggcaugggguuggcgcccuucacggaaggaggaucauuggugcugcucgagccugguauggaauuagggauuaccgccgcccugacaggcaucacuagcucgacuauggauuaugggaaaaagugguggacucaagcccaggcacacgacuuggugauuaaaucguuagauaaguuaaaggaagugagagaauuccucggcgagaacauuaguaacuuccuuucacucgccggaaauacuuaucagcuuaccagaggcauuggcaaagauauccgagcuuugcgaagggccagagcaaaccugcagucuguuccgcaugccucggcgagcagaccccgagugaccgaacccaucucagcugaguccggugaacaggucgaaagagugaaugagccaagcauccucgaaaugucuagaggcguuaagcucaccgacguggcuccagucagcuucuuucucgucuuggauguggucuaucuggucuaugaaucgaaacaccuccaugaaggcgccaaaagcgagacagccgaagagcuuaagaaaguggcccaggagcuggaagagaaacugaacaucuugaauaauaacuacaaaauuuuacaggcggaccaagagcuguag

SEQ ID NO: 248628 - RNA, 1197 nt, Artificial Sequence
  Description of Artificial Sequence: Synthetic coding sequence
auggagggagcagcacuccuuaggguuucagugcuauguauauggaugucugcacuuuuccuuggcgucggcgugcgcgcagaagaggcuggugccaggguacagcaaaaugucccgucagguacagacaccggugauccacagagcaaaccuuuaggagacugggcugccggcacuauggacccagaguccucaauuuuuaucgaagacgcaaucaaguacuuuaaggaaaagguauccacccaaaaucuucuauuauugcugaccgacaaugaggccuggaauggauuuguugccgccgccgaacugccuaggaacgaagcagaugagcucagaaaggcccucgauaauuuagcccggcagaugauuaugaaagacaagaauuggcacgacaaaggacaacaauacagaaacugguuccugaaggaguucccgaggcuuaaaucugaauuggaggacaacauacgcagacuaagagcacuggccgacggaguccaaaaagugcacaagggcacgacuauugcaaacgucgucagcggcagucugucaaucucgucuggaauucugacccucguggggaugggacuggcccccuucaccgaagguggcucauugguucuacuggaacccggcauggaacugggaauuacggcagcacuuacaggcauaacuucuucgacuauggacuacgggaagaagugguggacacaggcacaggcacacgaccucgucauuaagucccuggacaagcugaaagaaguacgggaauucuuaggagaaaauauuucgaacuuccucucucuugccggaaauaccuaccagcucacucgcggaaucggaaaggauauuagggcccuucgucgagcucgcgcuaaccuucagucaguuccccacgccucugcuucacgcccccgggucacugagcccauuucagcugagucuggugaacaggucgagaggguuaacgaaccgaguauucuggaaaugucgcggggcgucaaacugacagacguggcuccaguaagcuuuuuucuggugcucgaugucguguaucuggucuacgaaucuaagcacuugcaugagggagcaaaguccgagacagccgaagaacugaaaaaggucgcccaagaacuggaagaaaagcucaauauucuaaauaacaacuacaagauacuccaggcugaccaagaacucuag

SEQ ID NO: 248629 - RNA, 1197 nt, Artificial Sequence
  Description of Artificial Sequence: Synthetic coding sequence
auggaaggugcagcauuacuacgcguuaguguuuuauguaucuggauguccgcucuauuucugggcgucggcgugcgggcagaggaggccggcgccagaguccagcagaauguuccuaguggcaccgauacuggggacccacaaucaaaaccucugggagacugggccgcggguacgauggacccggaaucuucaauuuucaucgaagaugcaauuaaauauuucaaagaaaaggugaguacucagaaucuucuguugcuguuaaccgacaaugaggcauggaaugguuuuguggccgcagcagaacuuccucguaaugaggcugaugagcuacggaaggcccuggauaaucuggcacggcagaugauuaugaaggauaagaauuggcaugacaaagggcagcaguauaggaacugguuccugaaggaauuuccaagacuuaagagugagcuugaagauaauaucagacggcugcgggcacuggcagauggaguacaaaagguacauaaagggacgacgauugccaaugugguuagcgggagccucucgaucaguagcgggauccucacgcucgugggcaugggcuuagccccuuuuacagaagguggcucucugguccugcuugaaccagggauggaacucggcaucacagccgcccugacaggaaucacgucuuccacuauggauuacgggaagaaaugguggacacaggcccaggcacacgacuuagugauaaaaagcuuagacaaacuuaaggaaguccgggaauucuuaggcgaaaacaucucuaauuuuuuaucccuggcggggaacacauaucagcugacgcgcggaauuggaaaggacaucagagcgcuuagaagagcccgcgcuaaccuccaguccgucccccaugcuagcgccagucgcccacgcgucaccgaaccuauuucagcggagucaggcgagcagguagaacggguuaacgaaccuuccauacuggaaaugucaagaggcgugaagcugacagacguugcuccagucaguuucuuccugguuuuggacguaguguaccuggucuaugaguccaaacaucuccacgagggugcaaaaagugaaacugccgaagaguugaagaaggucgcacaagaguuggaggagaaguuaaauauacugaauaacaauuacaaaauuuugcaggcugaucaggagcuguag

SEQ ID NO: 248630 - RNA, 1197 nt, Artificial Sequence
  Description of Artificial Sequence: Synthetic coding sequence
auggagggcgcugccuuacucagggugagcgucuuauguauuuggaugucggcauuguuucugggaguagguguccgagcggaagaagcaggugcccgagugcaacaaaacgugccaucugggaccgauacgggagauccucagagcaaaccacugggugacugggcugcuggaacaauggacccugaaaguucuauuuuuaucgaggacgcaaucaaguauuuuaaggagaaaguauccacucagaaccuucuauuauuguugacugauaacgaggcauggaacggguuuguagccgccgcugagcugcccagaaaugaagcugacgaauugcguaaagcccuugacaaucuugcucgccaaaugaucaugaaggauaagaauuggcacgacaaaggccagcaauaucgaaacugguuucugaaggaguucccaagauuaaaaucugaguuagaagacaauauucgucgucuuagggccuuggccgacgggguucaaaagguccacaaagggacaacaaucgcuaacgucgucuccggaucacuaucuaucagcagcgguauccugacacuugugggcauggggcuugcacccuuuacagagggaggcuccuugguacuauuagagccggggauggaacuagguaucacugccgcucucacagggaucacaagcagcacaauggacuaugggaaaaagugguggacccaggcccaagcacacgaucuugucauuaaaucccucgauaaacugaaggaggugcgggaguuucucggcgagaacauuagcaauuuucucuccuuagcaggaaauaccuaccagcuuacaaggggcaucggaaaggauauucgcgcccuuagaagggcuagagccaaucugcagucagugccacacgccagugcuagccgcccaagaguaaccgaaccuauuagcgcagagucaggcgaacaaguggagcgaguaaaugagccaagcauacuagaaaugagccgcggcgugaagcugacugacguggcuccugugagcuucuuucucgugcuggauguaguguaccuuguauaugaauccaagcaucuucacgagggcgcaaagagugagacagcggaagaguugaaaaagguggcacaagaacuggaagaaaagcugaauauccugaauaacaacuacaagaucuugcaagccgaucaggagcuguag

SEQ ID NO: 248631 - RNA, 1143 nt, Artificial Sequence
  Description of Artificial Sequence: Synthetic coding sequence
auggaaggugcugcuuuacuuagaguuucuguauugugcauuugggugcagcaaaacguucccucugguacagauaccggcgacccucagucaaaaccucugggcgauugggccgcugguacgauggaccccgaaagcucaaucuucaucgaggacgcuaucaaauacuucaaagaaaaggucagcacccagaaucuuuugcugcuacugaccgauaacgaagcuuggaauggguucguagcugcagcagagcucccuagaaaugaagccgaugagcugcgcaaggcccuggauaaccuagcccgccaaaugauaaugaaagauaaaaacuggcaugacaagggccagcaauaucguaauugguuucugaaggaauuuccuagacucaaaagcgaacucgaggauaauaucagacgauuaagggccuuagcugacgggguccagaagguacacaaagguacaacaauugcuaacgugguuaguggcucacuuucgauuucaaguggaauucucaccuuagugggcaugggauuagcaccuuucacugaggguggcagccucgugcugcuggaaccagguauggagcucggcauuacagcugcccucacuggaaucaccagcagcaccauggacuacggcaaaaagugguggacccaagcucaagcucacgaccucguaaucaaaucacuggauaaacucaaagaagucagagaauuccuuggagaaaauauuucgaauuucuuaagccuggcuggaaauaccuaccaacucacacguggaaucggcaaagauauacgagcgcugcgccgagcaagggcaaacuugcaaagcgugccccaugcaagugcuaguaggccaagaguaacggagccaauuucggcggagaguggggaacagguugaacgcgugaaugagcccucuauuuuagaaaugucccgaggcguuaagcucaccgacguggccccagugucguuuuuuuuagugcucgauguagucuaccugguguaugaaagcaaacauuuacaugaaggcgccaaaagcgagaccgcagaagagcucaaaaaggucgcucaggaauuggaggagaagcuuaauauacucaauaacaacuauaagaucuuacaggcugaucaggagcuguag

SEQ ID NO: 248632 - RNA, 483 nt, Artificial Sequence
  Description of Artificial Sequence: Synthetic coding sequence
auggagggcgccgccuuguugagggugucaguccugugcauuuggaugucagccuuguuucuaggggugggugugagagcagaagaagcaggagcucgaguccagcaaaacgugccauccgguaccgacacuggcgauccucaauccaaaccccugggagacugggcagccgggaccauggaucccgaguccagcauauuuauagaagacgcaauuaaauacuucaaagaaaaagugagcacacagaaucugcuuuugcuccugacagacaacgaagcuuggaacggauuuguggcugccgcagaacugccacggaacgaggcugaugagcuaagaaaggcucuggauaaucuugcacggcagaugauaaugaaagauaagaauuggcaugauaaggggcagcaauauagaaacugguuucugaaagaauucccgcgccugaagucagaauuagaagauaacauuagaaggcucagagcauag

SEQ ID NO: 248633 - RNA, 426 nt, Artificial Sequence
  Description of Artificial Sequence: Synthetic coding sequence
auggaaggagcugcguuauugcguguuuccgugcugugcauauggaugagcgcucuauuucucggggucggcgugagggcagaagaagcaggggccagagugcagcagaauguucccuccgggaccgauaccggagauccgcagaguaaaccucugggagacugggccgcaggcacaauggaucccggacccgcagggucucgaggugacucaggcgaaccguguacauugaggccugcaugccguggacagagacagcacggcggggcuucgcguaucagugccgaaggaccagccccgaugccucgacgccgaaccccuuccacggcccaccuccguguccccaagacaucccgcaggaacuugcucuguaugcgcgccguaucccucuuacgaaugccacuauccauaagucggaaaaaguag

SEQ ID NO: 248634 - RNA, 357 nt, Artificial Sequence
  Description of Artificial Sequence: Synthetic coding sequence
augagauucaagagucauacaguagaacuccgauccacucuaucacaaccgcuuuucucuuguagucguagacggccaugcucagacauggaaggcgccgcuuugcuccgggucucagugcuguguauuuggaugagugcacuguuccuuggggugggcgugcgggccgaagaagccggagccagaguccagcagaaugugcccucugggacagacacuggagacccacaaucaaagccauugggcgacugggcugccggaaccauggacccugagagcagcauuuucauugaagacgccaucaaguauuuuaaagaaaaagucucgacucaaaaccugcuacuuuuauuaaccuag

SEQ ID NO: 248635 - RNA, 426 nt, Artificial Sequence
  Description of Artificial Sequence: Synthetic coding sequence
auggagggcgcugcauugcuccgcgugagcguccuguguauuuggaugagcgcacuauuucuuggagucggaguccgagcagaagaagcuggcgcuagagugcaacagaacguuccaucuggcacugauacuggagacccccaaagcaaaccccuaggugauugggccgccggcaccauggaccccggaccagcgggcucucggggagacaguggugaacccuguacacugcggccagccugccgaggucagcgacagcacggaggcgcaagcagaauuagcgcugaaggccccgcucccaugccacggaggcgcacacccaguacagcccacuuacgcgucccaaaaacaagucggaggaaccugcuaugcaugcgggccguaucauugcucagaaugccccuguccauaucucgcaagaaauag

SEQ ID NO: 248636 - RNA, 1014 nt, Artificial Sequence
  Description of Artificial Sequence: Synthetic coding sequence
augaacccugaguccuccaucuucaucgaagauuaccuuaaauauuuccaggaccaggucucucgcgaaaaccuguuacagcuguuaacugacgacgaagcauggaacggauuuguggccgccgccgaacuuccccgggacgaagccgaugaacugagaaaagcacugaacaaacuggccagucauauggucaugaaggacaagaauaggcaugauaaagaccagcaacacagacaaugguuccugaaggaguuuccacgccucaaacgugaacuggaagaucauauccgcaaauugcgagcccuagcugaggagguagagcaggugcaucgcgguaccaccaucgcuaaugucguaucuaauagcguugguacaacaucgggcauccugacucugcugggauugggccuggcccccuuuacagaaggcauuucauucguauuguuggacacugggaugggcuuaggagcugccgcugccguggcugggauuacauguucagugguggaauugguaaauaagcuccgcgcacgagcccaagcacgaaaucuggaccaaagcggaacaaauguugcaaaagugaugaaagaguucguaggcgguaauacuccuaaugucuugacauuaguggauaacugguaccaaguaacgcagggcauuggacgaaauauucgagccaucagacgagcaagagccaacccgcaguugggagcauacgcucccccaccccacaucaucggaaggauaucugcagaaggcggggagcagguugaaagggugguugaagguccagcucaagcuaugucaagaggcacaaugaucguuggcgcugcuaccggggggauccuacugcuguuggacguggugucacuggccuaugaaucuaaacaccugcuugagggagcgaaaucagaaagugccgaggaauuaaaaaaacgggcucaagaacuugaagguaaguuaaauuuccuuacgaaaauccacgagauguugcaacccggccaggaccaguag

SEQ ID NO: 248637 - RNA, 1014 nt, Artificial Sequence
  Description of Artificial Sequence: Synthetic coding sequence
augaacccagagagcucuaucuuuaucgaggacuaucugaaauauuuccaagaccaagugaguagagaaaaccuuuugcagcuccugacugaugaugaggcauggaacgguuuugucgcagccgccgaguugcccagagaugaagccgaugagcucagaaaggccuugaauaaacuugcaagccacaugguaaugaaggacaagaacagacaugacaaggaccagcaacaccgccaaugguuccuaaaggaguuccccaggcuaaaacgggaacuggaggaucauaucaggaagcuccgcgcgcuggcagaagaaguagaacaaguccauagagggaccacuauugcuaacgucgugucaaauuccgugggaaccaccagcgguauucugacucuucucggacugggauuggccccuuucacugaagguauuaguuucguucucuuggacacgggaaugggacuaggcgccgccgccgcugucgccgggaucacaugcagcgucgucgaacuggugaacaagcuuagagcccgagcccaagcccggaaucucgaccaaucggguaccaacgucgcuaaagucaugaaagaguucgugggcgguaacacgccaaauguuuuaacauuaguugacaauugguaccagguuacacagggaauaggcagaaauaucagagccauacggcgcgcuagagcaaacccacaguuaggagcauaugcaccgccaccccauauuauuggaagaauuucugcagaagguggagagcaaguggagagagugguggaggggccugcucaggccaugagccgcggcacaaugauugugggcgccgccacaggugggauacuccuccugcucgauguugucucacucgcauacgaauccaaacaucugcucgaaggagcaaagagcgagucugcugaggaauugaagaaaagggcacaagaacuggaggguaagcucaacuuucugacuaaaauucacgagaugcugcaaccaggccaagaccaguag

SEQ ID NO: 248638 - RNA, 1350 nt, Artificial Sequence
  Description of Artificial Sequence: Synthetic coding sequence
augcacuccuggacgugggacccucacaguucagagcaacuugaccuggcccagagccuuucugaagaagauccacucaguagccucagagggucaauucagccccagccgccugccgaagcaccugauaaagggggaagucaagcuaacaaugacccugggggaugggauccuggaugcagcagcucucaggucuuaggacgaacacgcggccccugucuuggagugcggguacgggaagaggaagccgguaccagggugaaggagaaccuccccguguggacagucacaggcgaacuacaaggcaaaccgcuugguaacccugccgccggcacgaugaauccugagucuuccauauuuauugaggacuacuuaaaguacuuccaggaccaagucuccagagagaaucuucugcagcuuuuaacagaugacgaagcuuggaauggauuuguugccgcagccgaauugccuagagaugaggccgaugaacugcggaaagcacugaacaaacuagcuagucacauggucaugaaagauaaaaacaggcacgauaaggaccagcagcaccggcagugguuccuaaaagaauuuccccgcuugaagagagaguuggaggaucauauuagaaagcuaagagcccuggccgaagaggucgaacaggugcaucggggcacaacaauagccaaugugguaagcaauaguguuggaaccaccucugguaucuuaacguuacuggggcugggccuugccccuuucaccgagggcaucuccuuugugcugcuggauaccgguauggguuuaggagcagcugcagccguggcagguauaacuuguucagucguugagcucguaaauaaacugcgcgcacgcgcucaggcccggaauuuggaucagucugggacuaacguggccaaaguuaugaaagaguuugucgggggcaauacaccuaaugugcucacuuugguugauaacugguaccaggucacacaaggcaucgggaggaacauacgggccaucaggagagcacgugcuaauccucagcugggcgccuacgcacccccgccucacauaaucggacgcauuucugcagagggaggagaacaagucgaaagagucguggagggaccugcucaggcaaugucuaggggcacuaugaucguuggcgcagccacugggggaauacuccuacugcuggacgugguuagccuugcauaugagagcaaacaucuccucgagggcgcaaaaagugaguccgcugaagaacugaaaaaaagagcccaagaacuggaggguaagcugaauuuucugacuaaaauucaugaaaugcuacagccaggacaagaucaguag

SEQ ID NO: 248639 - RNA, 225 nt, Artificial Sequence; identical to SEQ ID NO: 248033
  Description of Artificial Sequence: Synthetic coding sequence

SEQ ID NO: 248640 - RNA, 387 nt, Artificial Sequence
  Description of Artificial Sequence: Synthetic coding sequence
augaacccagaguccaguaucuuuaucgaagauuaccucaaguauuuccaggaccaggugucacgagagaaccuccuacaauugcugacagaugaugaggccuggaauggauuuguugccgcagccgaacugccccgugacgaagccgacgaacuccguaaagcccucaacaagcuggccagccacaugguaaugaaagacaagaaccgccacgacaaagaccagcagcacagacaaugguuuuugaaggaauuuccccgccucaagcgagaacuggaagaucacauccguaagcugcgagcucuggcagaagagguugagcagguacauagggguaccaccaucgcaaacguaguuucaaauagugucggcaccaccuccggguag

SEQ ID NO: 248641 - RNA, 324 nt, Artificial Sequence
  Description of Artificial Sequence: Synthetic coding sequence
augggauccuggguucagcucaucaccucagucggcacgagcgggcucuuucuaggcguacgcguccgggaagaaggcgcgggaaugcgauguucgaaaaccauacaggcgggccaauggcuggacaguaguaaaggcccacuugguccuuccccccccccuguucccaccgcagguuacuccagcuccuuuugcgugcacuacgucaacuugcuccccggcguacuuguccugucaguuaccucucaguacccacaucucucgauggcucuuugccaguuagccgcccacgacuggcccagguugucuugugugugcgucuag

SEQ ID NO: 248642 - RNA, 1044 nt, Artificial Sequence
  Description of Artificial Sequence: Synthetic coding sequence
auggguucauggguacagcuuaucacaagcgucggaguacaacagaaucaucccggguggacaguugccggccaauuccaggaaaagaaaagauucacagaagaggugauugaguauuuccagaagaaagugagucccguucaccugaaaauccuucuuacuuccgaugaagcauggaaacgguuuguccgcguggccgaauugccuagagaagaggccgaugcccucuaugaagcccugaagaacuugacucccuaugucgccauugaagauaaggauaugcaacagaaagagcagcaguuuagagaaugguuuuugaaguucccacaaauucgguggaagauacaggagucaaucgagcgacugagaguuaucgcaaacgaaaucgagaagguucauagagggugcguaaucgccaaugucguaagcggaucgacugguauccugagcguaaucggcgugaugcuggcccccuucacagccggcuugaguuuguccauuacagccgcaggagucggguuagggaucgcauccgccacggcgggcaucgcuagcucaauuguugagaauacauacacacggucugcugagcucaccgcuagcagacuaaccgcaaccaguaccgaccagcucgaagcccuuagagacaucuuaagagacaucacgccgaaugugcuuuccuucgcccuugacuuugacgaagcuaccaagaugaucgcuaacgauguccacacccugcggcgcuccaaagcaaccguuggcagaccucuuaucgcuuggcgcuacguccccaucaacguggucgagacacuaagaacccgcggcgcucccacacgaaucgugaggaaaguagcccgcaaccugggcaaggcaacuuccggaguucugguugucuuggauguugucaaccuuguucaagacagucucgaucuacacaagggcgcuaaguccgagucugccgaaucucucaggcagugggcacaggagcuggaagaaaauuugaacgaacucacccacauucaccaaagccuaaaggcagguuag

SEQ ID NO: 248643 - RNA, 1053 nt, Artificial Sequence
  Description of Artificial Sequence: Synthetic coding sequence
auggagggagccgcccuucugaaaaucuucguaguauguauuuggguucagcaaaaccauccuggauggacuguggccgggcaguuccaggaaaagaagcgcuucacggaagaggugauagaauauuuccaaaaaaaagucucgccagugcacuuaaagauacuccugacaagugacgaagccuggaaaagauucgucagaguagccgagcuaccaagagaggaagcagaugcucucuacgaagcauugaagaaucucacaccuuauguggcuauugaagacaaggauaugcaacagaaagagcaacaguuucgugaaugguuucugaaauuuccacagauuagguggaaaauucaggaaagcauagaaagguuacgaguuaucgcuaaugaaauugagaaagugcaucggggaugcgugaucgccaaugugguguccgggagcaccggcauccuuuccgugauuggagucauguuagcacccuuuaccgccggucugagucugagcaucaccgcugcuggagugggcuuggguauugccagugcaacugcaggaauugcaucauccaucguagagaacaccuauacaagaagcgccgaacugacugccucuagauuaacagcaacgagcacagaccagcuggaggcguuacgagauaucuuaagagacaucacacccaacguucuuucuuuugcucucgauuucgaugaggccaccaaaaugaucgcgaaugauguacacacauugagaaggagcaaagcuaccguuggcagaccacugaucgcuuggagauacgugccaaucaauguuguggaaacacugcggacuagaggggccccuacgcggauuguccgaaagguggcaagaaaucugggcaaagccacaagcggcguccucguuguucuggauguuguuaaccuggugcaggauucuuuggaccuucauaagggagcaaaaagugagucagccgagucccuuaggcaaugggcgcaagagcuggaggaaaaucuaaaugaacuaacucauauccaucagagccucaaagccgguuag

SEQ ID NO: 248644 - RNA, 393 nt, Artificial Sequence
  Description of Artificial Sequence: Synthetic coding sequence
auggaaggggccgcucucuuaaaaauauuuguggucuguaucugggugcagcaaaaucacccuggauggaccguggcagggcaauuucaagaaaagaaaagguuuaccgaagaaguaaucgaguacuuucagaaaaaaguguccccaguacaucugaagauccucuuaacuagugaugaggcauggaagagauucgugagagucgcugaacucccacgugaggaggcagacgcucuguaugaggcuuugaaaaaccugacccccuaugucgcaauugaggacaaggacaugcaacaaaaggaacaacaauuucgcgaaugguuccugaaagucaguagcaaucagauggaagacucaggcguacacagaaaagcaucuugccacugcaaauag

SEQ ID NO: 248645 - RNA, 384 nt, Artificial Sequence
  Description of Artificial Sequence: Synthetic coding sequence
auggguaguuggguccagcugauuaccuccgugggugugcagcaaaaucaccccggcuggacaguggccggucaauuccaagagaagaagcgauuuacugaggaggucaucgaauacuuccagaagaagguuagccccgugcaucugaaaauccugcucacaagugaugaggccuggaaaagauuuguccgcguggccgagcuaccacgggaagaagccgacgcauuguaugaggcucugaagaaucuaaccccuuacgucgcaauagaagauaaagacaugcagcaaaaggaacagcaguucagagagugguuucuaaaggucagcucaaaucagauggaagauucagguguucacaggaaagcuaguugccauuguaaguag

SEQ ID NO: 248646 - RNA, 198 nt, Artificial Sequence; identical to SEQ ID NO: 248040
  Description of Artificial Sequence: Synthetic coding sequence

SEQ ID NO: 248647 - RNA, 384 nt, Artificial Sequence
  Description of Artificial Sequence: Synthetic coding sequence
augggcagcuggguacagcucaucaccagcguaggugugcagcaaaaccacccuggauggacuguggcuggucaguuucaggaaaagaagagguucacugaggaggucaucgaauacuuucagaaaaaaguuaguccgguucacuugaagauacuuuugacgucugaugaagcuuggaagagguuugucaggguggccgaacugcccagggaggaagcugacgcccuguacgaagcuuugaagaaccuuacacccuauguggcuauagaagacaaggauaugcagcagaaagaacaacaguuuagagaaugguucuugaaggucucuaguaaucaaauggaagacuccggugugcaucgaaaggccagcugucacugcaaauag

SEQ ID NO: 248648 - RNA, 183 nt, Artificial Sequence; identical to SEQ ID NO: 248042
  Description of Artificial Sequence: Synthetic coding sequence

SEQ ID NO: 248649 - RNA, 219 nt, Artificial Sequence; identical to SEQ ID NO: 248043
  Description of Artificial Sequence: Synthetic coding sequence

SEQ ID NO: 248650 - RNA, 213 nt, Artificial Sequence; identical to SEQ ID NO: 248044
  Description of Artificial Sequence: Synthetic coding sequence

SEQ ID NO: 248651 - RNA, 2223 nt, Artificial Sequence
  Description of Artificial Sequence: Synthetic coding sequence
augaccgugaaacuggauuuugaagagugccuaaaagacuccccacgcuucagggcuuccaucgagcuaguggaggccgagguaucagaacucgagacacggcuggaaaagcucuuaaaacuggguacaggauugcuggagaguggaagacauuaccucgccgccagccgagccuucgucgugggcauuugugaccuugcccgccucggucccccagaaccaaugauggccgagugcuuggaaaaguucacugugagccugaaccacaaguuggacucacacgcagaauuacucgaugccacccagcacacguuacaacaacaaauccagacucuuguuaaagaaggcuugaggggauuucgagaggcacggagagauuuuuggagaggagcugaaagccuggaggcggcccugacacauaaugccgaaguuccuagaagaagagcucaggaggcugaggaagccggagcugcucuuagaacggcucgggcaggauaccgggguagagcacucgauuacgcucugcagauaaaugucauugaagauaagagaaaauucgacauaauggaguucgucuugagacugguugaagcucaggcuacucacuuucagcagggacacgaagaacuuucuaggcucagccaauaccgcaaggaacugggcgcacaguuacaccagcugguccugaauucugccagggagaaaagagacauggaacagagacacguguuacugaagcagaaagaacucggcggcgaggaacccgagccgagucucagagaagggccuggugguuuggucauggaaggccaccucuucaaaagggccucaaaugcuuucaagacauggaguaggcggugguucacaauucaauccaaccaguuaguuuaucaaaaaaaguacaaggacccagugacaguuguuguggacgauuugagacucugcaccgugaaauugugccccgacuccgagagacgauuuuguuuugaagugguuaguaccaguaagucuugccugcuacaggccgauagugaacgccuccuucaacuuugggucucagccgugcaguccaguauugcaucugcuuucagccaagcgagguuagaugacagcccccgggggccuggccaggguucuggacauuuggccaucgggucggcugcuacacuuggcagcggcgguauggcacgcggacgggaacccggaggaguuggccaugugguagcccagguucagaguguugacggcaaugcucaguguugcgauuguagggaacccgcaccagagugggccaguauuaauuuggguguaacccugugcauucaguguucgggcauccaccgaucccucgguguucacuuuaguaaggucaggucguuaacccuggacaguugggaacccgaacuaguaaagcuaaugugugagcucgguaacguaaucauaaaucaaaucuacgaggccaggguggaagcaauggccguuaagaaacccgguccuagcugcucucgacaggagaaagaggcuuggauccaugcaaaguaugucgaaaaaaaguuccucaccaagcucccagaaauuaggggccgucgcggcggacgcgguagaccaaggggccagccaccugugccaccaaaacccucgauccgcccuagaccgggaucacugagaucuaaaccugaaccuccguccgaagaccugggcagucuccauccgggggcauugcuauuccgagccagcgggcacccaccaagccugcccacuauggccgacgcucucgcucauggagccgaugucaacuggguuaacggaggccaggauaaugcaacaccacucauccaggccacagcagccaacagccucuuagcaugugaauuccugcugcaaaacggagcaaaugugaaucaggccgacagugcaggcagaggcccucuacaucacgccaccauucugggucacacuggacuggcuugcuuauuucugaagaggggcgcagaccugggcgccagggacucagagggaagggacccuuugacuaucgccauggagacugcaaacgcugacauugugacauuguuacgacuagcaaagaugcgcgaagcugaggcugcccagggucaagcaggagaugaaacauacuuggauauuuuuagagauuucagcuuaauggcauccgaugacccagagaaacuguccaggagaucccaugauuugcauacucuguag

SEQ ID NO: 248652 - RNA, 1290 nt, Artificial Sequence
  Description of Artificial Sequence: Synthetic coding sequence
augcagcugcgaaauccugaacuucaucucgggugugcccuugcacuuagauuccuugcauuagugagcugggacauaccaggggcccgcgcucucgacaauggauuagccaggacacccacuaugggaugguuacauugggagagauuuauguguaaccuggauugucaggaagagccggacucuuguaucagcgagaagcucuucauggaaauggccgagcugauggugucagagggcuggaaagaugccggauaugaauauuuguguauugacgauugcuggauggcuccacagcgggacuccgaaggcagacuccaggccgauccacaaagguuuccccaugggauuagacagcucgcuaacuacguucacaguaaaggacugaagcugggcaucuacgcagacguugguaauaaaaccugcgcugguuuuccaggcuccuuuggcuauuaugacauugaugcacaaaccuucgcggacuggggaguagaccuauugaaguuugacggguguuauugcgauucccucgagaacuuggcugacgguuacaaacacaugucccuugcccugaaccgcaccggccgcaguauaguuuacaguugcgaauggccucucuacauguggcccuuucaaaagcccaacuacacagaaauacgacaguauuguaaccacuggagaaauuucgcugauaucgaugacuccuggaagaguaucaaguccauuuuagacuggacaucauuuaaucaagaaaggauaguugauguugccgguccuggcggguggaaugauccagauaugcuagucauugggaauuuuggccuauccuggaaccaacaggucacgcagauggcacugugggcgauuauggccgcuccccuauuuaugaguaacgaccuucgacacauaucuccucaggcuaaagcauuacugcaggacaaggacgucauugccaucaaucaggaucccuuaggaaagcagggauaccaguugagacaaggggauaauuuugaagucugggaaaggccccugucaggcuuggcaugggcaguggcuaugauuaauaggcaagaaaucggcgguccgcggaguuauacuauugcuguggcgucucuagggaagggaguggcuugcaacccggcaugcuucaucacccaacuccucccagugaagcggaaacuuggcuuuuaugaauggacaucuagacucagaagccacauuaauccaacaggcacaguacugcugcagcucgagaacacuaugcaaaugucacucaaagaccugcuuuag

SEQ ID NO: 248653 - RNA, 1386 nt, Artificial Sequence
  Description of Artificial Sequence: Synthetic coding sequence
augcagagaguuaacaugaucauggcggaaaguccaggguugauaacaauuuguuugcuaggcuaccuguugagugccgagugcacgguguuccucgaccacgaaaaugcaaacaagauccugaauagacccaaaagguauaacaguggaaaguuggaggaauucguacaaggcaaccuggagagagaauguauggaagaaaaauguagcuucgaggaagcucgggaggucuucgagaacaccgaacguacaacggaauuuuggaagcaguacguggauggagaccaaugcgagagcaaucccugccuuaacggcggauccuguaaagaugacauuaauucguacgaaugcuggugccccuuuggguucgaaggcaagaauugugaauuggaugugaccugcaauauaaagaaugggcgaugugaacaguucuguaagaauuccgcagauaacaagguggugugcagcuguaccgagggcuacagacuggcugagaaccagaaaucuugugagccagcagugccguuucccugcgguagagugagugugucccagacaaguaaauugacuagggccgagaccgucuuccccgauguugacuacgugaacagcacagaggcggagacgauacucgauaacaucacacagagcacucagucauuuaacgauuuuacaaggguaguaggaggugaggacgcaaaacccggacaguuuccuuggcagguuguacugaaugggaaaguagaugcguuuugcggugguucaaucgugaacgaaaaauggauugugacagccgcucauuguguggaaacuggagugaaaauaaccguagucgccggagaacacaacauugaagagaccgaacauacagagcaaaagcgcaacguuauacggaucauuccccaccacaacuacaaugcagccaucaacaaauacaaccaugauauugcgcuguuagaacuugacgaaccccucguccuuaauaguuauguaacaccuauuuguauugcugacaaggaauacacaaacaucuuccugaaauucggcucuggauacgugucaggguggggaaggguguuccacaagggccggucagcucucguucuacaauaucugcgagugccacuuguugacagagccacaugucuccgcuccacuaaguucacuauuuauaauaacauguucugcgccggauuccaugagggagggcgagauagcugccagggggauucaggcggcccacacguuacagagguugaagguacaucauuucugaccggcauuaucucauggggcgaagaaugugcaaugaaaggcaaguaugggauuuauaccaaggugagcagauacguuaacuggauaaaggagaagacuaagcugacguag

SEQ ID NO: 248654 - RNA, 1365 nt, Artificial Sequence
  Description of Artificial Sequence: Synthetic coding sequence
augccaagaugucccgcuggcgccauggacgaggguccaguggaucugcgcacacggcccaaggcagccggacucccaggggccgcacugccccugagaaagagaccccuaagagcgccuagcccugagcccgcugcaccacgaggagcugccggucuugucgugccacuugauccacucagagggggaugcgacuuaccugcuguucccggcccuccccauggcuuagcccgccccgaggccuuguauuacccuggcgcucuucuuccacucuaccccacucgagccaugggcucucccuucccauuagugaaucuaccuacgccucuguauccaaugaugugcccaauggagcauccccuuagcgcggauauugcaauggcgacaagagccgacgaagacggagacacuccccuccacauugccgugguccaaggcaaucucccugcugugcacagacuugucaaccuauuucagcaggguggacgcgagcuagacauuuauaacaacuugagacaaacaccucuacaccuugccgugauuaccacccucccuagcgucgugagacuccugguaaccgccggagccucuccaauggcuuuggaucggcacggccaaaccgccgcccaccuggcaugcgaacaccgcucuccaaccugucugcgcgcucugcuggauucagccgcaccugguaccuuggacuuagaagcaagaaacuaugauggucugaccgcccuccaugucgccguuaacaccgaaugucaagagacgguccaguuacuguuggagcggggagcagauaucgaugccguugacauuaaaagcgggcggucuccuuuaauucacgcagucgaaaauaauagcuugaguauggugcaacuauuauuacagcacggagcaaacguuaacgcacagauguauuccgguucuucagcccugcauuccgcauccggccguggccuucugccuuuagugcguacgcucguucgaucaggggccgacuccucacugaaaaauugccauaaugacaccccacucauggucgcucguucccgucgagucaucgacauucugcguggaaaagcuacccggcccgcaagcaccucgcaaccagauccuucccccgaucgcucugccaauacuuccccagaauccucuuccaggcuuuccaguaauggccuucuaagcgccaguccuaguuccucccccucacaguccccaccgcgcgauccacccggauucccuauggccccgcccaacuucuuuuuaccgagcccaucacccccagccuuccuaccauucgccggcgugcugcguggccccggucgcccaguuccacccucuccugcuccaggcgguuccuag

SEQ ID NO: 248655 - RNA, 417 nt, Artificial Sequence
  Description of Artificial Sequence: Synthetic coding sequence
augaaggaauacucagguuuugccggggucaguaggcccagaggaacauucuuucggaucagagggcgggggcgagcucgagguguguucgcgggcacuaauacagguccuaacaauaguaauaccacuuuucaaaaacggccaaaggaagaagagugggauccagaauauacucccaaaucuaaaaaguacuuccuccacgacgaucgagacgacgguguagauuauugggcuaaaagagguagaggcagagggacauuccagcgaggaagggguagauuuaauuucaagaagagcggaaguagcccgaaguggacgcacgacaaauaucaaggcgaugguauaguugaggaugaagaagagaccauggaaaacaacgaagaaaagaaagaccgcagaaaagaggaaaaggaauag

SEQ ID NO: 248656 - RNA, 1530 nt, Artificial Sequence
  Description of Artificial Sequence: Synthetic coding sequence
augacaguuaccuauacagccagaguggcgaaugcaagauucggcgguuucagucagcuucuguuacuauggcgaggcucuaucuacaagcuucuuuggcgcgaguuguugugcuuccuaggguucuacauggcuuuaucugcugcauacagguucguucugaccgaggggcagaagcgguauuuugaaaaguugguaaucuauugugaucaguacgcaucccugauuccugucagcuucguucugggauuuuacgucacccugguaguuaaccgcugguggucacaguaucuguguaugccccuuccagaugccuugaugugugugguggccgguacuguccacgguagagacgaucggggccgauuauaucggcggacauugaugcguuacgcuggacucucugccguucucauccugcggaguguguccacagccgucuuuaaaagauuuccuacaaucgaccacguuguggaagcuggauucaugacaagagaagagaggaagaaauuugaaaaucuaaauaguucuuacaauaaguacugggucccuugugugugguucuccaacuuggccgcgcaggcucgccgcgaaggccgaauucgggacaacucagcccugaaauugcugcuggaagagcucaacguguuuagaggaaaauguggaaugcuguuucacuaugauuggaucucggugccuuuaguguauacccagguggucacgauugcucucuauaguuacuuccuugcuuguuuaaucgguagacaguucuuagauccugcucagggauauaaagaucaugaccuagaucugugcgugccgaucuucacucuccuccaguuuuuuuuuuaugcuggcuggcugaaaguugcggagcagcugauuaaccccuuuggagaagacgacgaugacuuugaaacaaacuuuuuaauugaccggaauuuucaggugucaaugcucgccguggacgaaauguaugaugaccuugccguucuagaaaaagacuuguacugggacgcagcagaagcacgcgccccuuacaccgccgcuacugucuuccaacugagacaaccaucuuuucagggcagcaccuucgauaucacauuggcuaaagaagacaugcaauuucagaggcuggacggacuggacggcccgaugggcgaggcuccaggugauuuccugcagcgacugcucccugccggugcuggaauggucgcuggcggcccacugggcagaaggcuguccuuccuccugagaaagaauucaugugugagcgaggcuucuacuggagcuagcugcaguugcgccgucgugcccgaaggggcugcccccgagugcucauguggugauccccuguuagacccaggguuaccagagcccgaagccccgccucccgcagguccagagccacucacccucauccccggcccuguugagccuuuuagcauagugacuaugcccgguccuagaggcccugccccccccuggcuuccgucacccauuggggaagaggaagagaaucuggcauag

SEQ ID NO: 248657 - RNA, 306 nt, Artificial Sequence; identical to SEQ ID NO: 248051
  Description of Artificial Sequence: Synthetic coding sequence

SEQ ID NO: 248658 - RNA, 369 nt, Artificial Sequence
  Description of Artificial Sequence: Synthetic coding sequence
auguccagauccguggcacuugccgugcucgcauuacucucccugucaggccucgaggcuauccagagaacgccgaaaauccaggucuacagucgacauccggcggagaacggaaaaucaaacuucuugaacugcuacgucucaggauuucauccaagcgacaucgagguggacuugcuuaagaauggagaacgcauugaaaaagucgaacacagcgaccuaaguuucucuaaagauuggucauucuaucugcuuuauuauacagaauuuacgccaacagaaaaagacgaguacgcaugucgggucaaucacguuacccucagccaaccuaagaucgugaaguggggaaagucauauauauugcuguag

SEQ ID NO: 248659 - RNA, 360 nt, Artificial Sequence
  Description of Artificial Sequence: Synthetic coding sequence
augucacgcucuguugcccuggccguauuggcccuccucucccucuccggccuggaagccauacaacgaacuccgaagauucaagucuacagucgucauccagcagagaacgggaaguccaauuuucugaauugcuaugucucuggguuccaccccuccgauaucgagguggaccuucuuaaaaauggggaacggaucgaaaaaguggaacauucugaccugucauucucuaaagacuggagcuuuuauuuacuguacuacacugaauucacacccacggaaaaggacgaguaugcuugccgagucaaccacguaacuuuaagucagccaaaaaucgugaaaugggacagagacauguag

SEQ ID NO: 248660 - RNA, 369 nt, Artificial Sequence
  Description of Artificial Sequence: Synthetic coding sequence
augucgaggucaguggcccuggcugugcuagcccugcugucccuuuccggacuagaagcuauccaaaggacgccaaagauucaggucuauucacgacauccugccgagaacgggaaaucuaacuuuuuaaacuguuaugugaguggauuccauccauccgauaucgaagucgaccuucucaagaauggagaacgcauagagaaagucgagcacuccgaucugaguuuuucuaaggacugguccuucuaucuccucuacuauaccgaguucacccccacugagaaagaugaguacgcaugccggguaaaccauguuacacuaucccaaccaaaaaucguuaaguggggaaaaaguuauauacuucuuuag

SEQ ID NO: 248661 - RNA, 360 nt, Artificial Sequence
  Description of Artificial Sequence: Synthetic coding sequence
augagucgaagugucgccuuggcggugcuggcuuuacuaucacucucuggccucgaagccauucagagaaccccgaagauccagguuuauucgaggcacccagccgagaauggaaaaagcaauuuucugaauuguuacgugaguggauuucauccuuccgauauagagguagauuugcugaaaaauggggaaagaauugaaaaggucgagcacucagaucucaguuuuucuaaggacuggucuuucuacuuacuuuacuacacagaguuuaccccuaccgaaaaagaugaauaugcaugcagaguuaaccacguuaccuuaagucaaccuaagaucguuaaaugggacagagauauguag

SEQ ID NO: 248662 - RNA, 360 nt, Artificial Sequence
  Description of Artificial Sequence: Synthetic coding sequence
augucacgcuccguugcacucgcaguccuugcauugcugagccuguccggcuuagaggcaauucaacgaacgcccaaaauccaggucuauagccgacauccugccgagaacggaaagaguaauuuuuuaaauuguuacgugaguggguuccacccuuccgauauugaaguggaucugcucaagaauggagaacgcaucgaaaaggucgaacauucugaccugaguuucucuaaggacuggucguuuuaccuuuuguauuacacugaguuuacccccacugagaaagacgaguacgcuugccggguaaaucauguaacacugagucagccaaagaucgucaaaugggacagagauauguag

SEQ ID NO: 248663 - RNA, 1536 nt, Artificial Sequence
  Description of Artificial Sequence: Synthetic coding sequence
augucuagaggcccagaggaaguaaaucgccugacagaaucuacuuauagaaaugugauggaacaguucaauccuggccugcgcaaucugaucaaccucggcaagaacuaugaaaaggcugucaacgccaugauacucgccggaaaagccuacuaugacgggguggccaagauuggugaaaucgcuaccggaucaccuguuucuacugagcuaggacacguguuaaucgaaaucucuucuacgcacaagaaacucaacgaaucacuggacgaaaacuucaaaaaauuccacaaggagaucauucacgagcuugaaaagaaaauagagcuggacgucaaguauaugaacgccacccuuaaacgguaucagacagagcacaaaaauaaauuggagagccuggaaaagagucaagcugaacugaaaaaaauucgcagaaagucccaaggcagucgcaacgcacugaaguaugaacacaaggagauugaauauguugaaacuguuacaaguaggcaaagugaaauacaaaaguuuaucgcagaugguuguaaggaagcacuucuagaagaaaagcggcgcuuuuguuuucuaguggacaaacacugcggauucgccaaucauauccacuacuaccaccuccagagcgccgaacuccucaauucuaagcuuccaagauggcaggaaacauguguugaugcaauuaaagucccugagaagaucaugaauaugaucgaagagauuaagacaccagcuucuacccccguuagcggcacuccucaggccuccccaaugauugagagaucaaauguggucagaaaagauuaugacacucuuuccaaaugcucaccaaaaaugccaccagcuccauccggaagagccuauacaucaccgcucauagauauguuuaacaauccggcgaccgcagcaccaaacagucagagagugaauaauucuaccgggacaagugaggaucccucccugcagcggucagugagcguugccaccggccuaaauaugaugaaaaaacagaagguaaaaacuauauuuccucacacugccggguccaauaaaacacugcuuucuuucgcgcaaggagaugucaucacucucuuaauucccgaagagaaggacgguugguuauacggagaacaugacgucucuaaggcucgaggcugguuccccuccuccuacacaaaacuucuggaagaaaaugaaacagaagccgucacugugcccaccccuaguccaacaccagucagaaguauaagcaccgucaaccuaagcgaaaacagcucaguugugaucccucccccugauuaucuugaaugucugucaaugggagcugccgcagaucguagggccgacucagcaagaacuaccucgacuuucaaggcuccggcaucuaagccugagacagcugcaccaaaugacgcuaacggcacagcuaagccgcccuucuuguccggugagaauccauuugccaccguaaaauugcgaccuacaguuaccaacgaccgcagcgcacccaucaucagauag

SEQ ID NO: 248664 - RNA, 1809 nt, Artificial Sequence
  Description of Artificial Sequence: Synthetic coding sequence
augcacuccaaaguaacaauaaucuguaucagauuccuuuuuugguuccugcuucuguguaugcucaucgggaaaagucauaccgaggacgacaucaucauugcaacgaagaauggcaaggugaggggaaugaaucuuacaguuuuuggcggcacagugacagcuuuucugggcauaccuuacgcacaaccaccccugggacggcucagauuuaaaaaaccucaguccuugaccaaguggucagacaucuggaacgcuacuaaauacgcuaauaguugcugccaaaacaucgaccagucguucccgggcuuucauggaagugagauguggaauccuaauacugaccuuuccgaggacugucuguaccugaacguauggauacccgcaccgaaacccaagaacgcuacugucuuaauuuggauuuacggcgggggauuucagaccggcacaagcucacuccauguauacgauggaaaauuucuggccaggguggaacgugugauuguuguuuccaugaacuacaggguaggagcucuaggcuuucucgcccuucccgggaaucccgaggcccccggaaauaugggucuguucgaucagcagcuggcucugcaguggguccagaagaacauugcagcuuuugguggcaacccaaagucaguaacccuuuuuggugagucagccggggcggcguccguuucccuccauuugcuauccccuggcagucauagccuguuuacccgcgcaaucuugcagucugggucauuuaacgcuccuugggccguaaccucacuauacgaagcccgcaacagaacacuuaaccucgcaaaacugacgggaugcaguagggaaaaugaaaccgaaaucauuaaaugccuccgaaauaaggauccccaggagauucugcugaaugaagcuuuugucgugcccuacggaaccccucuuagcguaaacuucggaccaacaguagacggagauuucuuaacagacaugcccgacauccuucuggagcuuggccaguuuaaaaaaacucagauccuagucggaguaaauaaagacgaagggacagccuucuugguguauggcgcaccaggcuucucuaaggauaauaacuccaucauaaccagaaaagaguuccaggaaggccugaagaucuucuuucccggcgugucugaauucggaaaagaaagcauccuauuucacuacacagauuggguggaugaccaaaggccagagaauuaucgagaagcacucggcgacguggugggcgauuacaacuuuaucuguccagcucuagaauucaccaagaaauuuagcgaaugggggaacaacgccuuuuuuuacuacuuugagcaccguagcuccaagcuucccuggccugaguggaugggagucaugcauggauacgaaauugaguucguuuucggauugccccuagagagacgagacaacuacaccaaggcugaggaaauucucuccagaaguauuguaaagaggugggcgaacuuugccaaauauggcaacccaaacgagacccagaacaauagcacgagcuggcccguauuuaaguccacagaacagaaauaccuaacacugaauaccgagucuacaaggauaaugaccaagcucagggcucaacaaugcagguuuuggacgaguuucuuuccaaagguacuggagaugacgggaaauauugacgaagcagagugggaauggaaggcugguuuccacagauggaauaauuacaugauggacuggaagaaucaguuuaaugacuacacaagcaaaaaggaaucaugugucggacucuag

SEQ ID NO: 248665 - RNA, 399 nt, Artificial Sequence
  Description of Artificial Sequence: Synthetic coding sequence
gccguccaauucacaggcuggagcucauccugcauuuuacacuuuccugaaguccugcaugauuuucacagcuugcagacccugccuagucuccuccaaagaauaggcaacccuaacgagacgcagaauaauucuacauccuggcccguauuuaaauccacugaacagaaauaccugaccuugaauacugagagcacucgcauuaugacaaaacuccgcgcacagcaaugccgauucuggacaaguuucuuucccaaaguucuggagaugacagggaacaucgaugaggccgaaugggaguggaaagcuggguuucacagauggaacaauuauaugauggacuggaagaaucaauucaaugacuacacauccaaaaaggaaaguugcguuggcuuguag

SEQ ID NO: 248666 - RNA, 195 nt, Artificial Sequence; identical to SEQ ID NO: 248060
  Description of Artificial Sequence: Synthetic coding sequence

SEQ ID NO: 248667 - RNA, 2499 nt, Artificial Sequence
  Description of Artificial Sequence: Synthetic coding sequence
augauucuucaggcccaucuccauucuuuaugccuucugauguuauauuuagcaacuggcuauggccaggaggggaaguucucagguccccuuaaaccaaugacauuuucuauuuacgagggccaagaaccgagccagauuaucuuucaauucaaggcuaacccaccagcaguaacauucgaacugaccggcgaaacagauaacaucuuugugauagagagagaaggacuacuguacuacaaccgcgcucucgaucgggagacuagaaguacacauaaucuacagguagcagcccucgaugcgaauggaaucaucguagaaggccccgugcccauuacuaucaaggugaaagauaucaacgauaaccguccuacuuuccugcaguccaaguaugagggcagcgugcgccaaaauucccgucccggcaagccauuucuuuacguuaaugccacagaccuggaugacccugcgacucccaacggccaacucuacuaucaaauugucauucaacuuccaaugauuaacaacguuauguauuuccaaaucaacaacaaaacaggagcaauuagucugacuagggaaggcucucaggaacucaacccagccaaaaacccuucuuauaaucugguuaucagugucaaggauaugggggggcaaagcgaaaacucuuuuucugauaccacuaguguugauauaauuguuacagagaacaucuggaaagcgcccaaacccguggagauggucgaaaacagcacagacccgcacccgaucaagaucacccagguucgauggaaugaccccggagcccaguacucccuuguagauaaagagaaacugccucgguuuccguuuucuaucgaccaggaaggggauauuuaugugacgcaaccucucgaccgggaagagaaggacgcuuauguguuuuacgcaguugcaaaagacgaauaugggaagccacuaaguuacccccuagagauucaugugaaagugaaagacaucaaugacaauccccccacauguccgaguccaguaacgguguuugaagugcaggaaaaugaaagacucggaaauucaaucggaacacugaccgcccaugauagggacgaggaaaauacagcuaauucuuuccugaacuaccggauuguugaacagacacccaagcugccuauggacggccuguuccugauccagacuuaugcgggcaugcuucaacucgcaaaacagagccucaagaagcaggauacaccccaguacaaucugacaauagaaguuagcgauaaagauuucaagacccugugcuucguccagaucaacgugauagacaucaaugaccaaauccccaucuuugaaaaaucagauuacgguaaucucacacucgccgaagacacuaauauuggaagcacaauacucaccauucaggccacagaugccgacgagccuuuuacuggaaguagcaagauccucuaccacauuaucaagggcgauucugaaggacgcuuggguguggacacagacccucauaccaacacaggcuaugugauuauaaaaaagcccuuggacuuugagacggcugcagugagcaauaucguauucaaagcugaaaacccugaaccucucguguucggcguuaaauacaaugcuaguucauuugccaaauuuacucugaucgugacugacgugaacgaggccccgcaguuuagccaacauguauuccaagcuaagguguccgaggacgucgcaauugggacuaaagugggaaaugugacagccaaagauccugaaggccuugauaucagcuauagucugagaggggauacccgcggauggcuuaaaaucgaucauguaacaggagaaauauuuagcgucgcaccucuugaccgggaagccgguucaccauaccgugugcaggucguggccacagaagucggaggguccagucuuagcucugugucggaguuucaccucauccugauggacguuaaugauaacccuccaaggcucgccaaagauuauacagguuuguuuuucugccaccccuuaucugcccccggcucgcugaucuuugaagcuaccgaugacgaccaacaccuguucagagguccucacuuuacauuuagccuaggcucuggcagccugcaaaacgauugggaaguguccaaaaucaacggcacacacgcaagguuaucaacccgucacacagaguuugaggaacgugaauacguggugcucaucagaaucaaugauggcggcagaccaccccuggaaggcauuguuagcuuacccgugacuuuuuguucuugugucgaagguucaugcuuucgucccgccggccaccagacgggcauaccuacagugggaauggcagugggaauucugcugaccacucugcuugugaucgggauaauucuagccguagucuuuauaagaauuaagaaggacaaaggaaaagacaauguugaaucugcccaagcuuccgagguaaagccacuucgcucuuag

SEQ ID NO: 248668 - RNA, 795 nt, Artificial Sequence
  Description of Artificial Sequence: Synthetic coding sequence
augacaaaguucucguccuuuucuuuguucuuccugaucguuggggccuauaugacgcacguuugcuuuaacauggaaaucauuggcgggaaagaggugagcccccauuccagaccuuuuauggcuagcauacaauacgggggucaucauguaugugguggaguucuuaucgauccacagugggugcugaccgcugcacauugucaguacagguuuacuaagggacagagcccuaccgugguccuuggugcacacucccuuagcaaaaacgaagcaucgaagcaaacucucgaaauuaagaaauuuauccccuucucccgggugaccagcgauccacaaucuaaugacauaaugcucguaaaguuacagacagccgccaaacuuaauaagcacgugaaaaugcuccauauccgaucuaaaacaagucugaggucaggaacgaagugcaaggucaccgguuggggagcgacagaccccgauucccuucguccuagcgauacccuccgggaagucacugugaccguccuaucuagaaaacuguguaauucccagucguacuacaacggagacccauuuaucaccaaagacauggugugugcuggagacgcuaagggacagaaagauagcuguaagggagacucuggggggccgcugauuuguaaaggcguuuuccaugccauuguuucuggcggacaugagugcggcgucgccacaaagcccgggauauacacauuacugaccaaaaaguaucagaccuggaucaaaucgaauuuggugcccccccauacaaauuag

SEQ ID NO: 248669 - RNA, 9939 nt, Artificial Sequence
  Description of Artificial Sequence: Synthetic coding sequence
augauggcccguagaccaccguggcgaggucugggaggccggagcacacccauucuccuuuuacugcucuuaagucuguucccccugagccaagaagaauuaggaggaggagggcaucaggguugggacccaggauuagcugcuaccaccggaccgagagcacacaucggagggggagcccuggcgcugugcccagaaucuucuggagugcgcgaagauggcggaccugggcuugggguuagagagccaaucuucguagguuuaagaggccgacggcagucagcucguaauucacgcgggccaccagaacagcccaaugaagaacuaggaaucgaacaugguguccaaccccucggcucucgggagcgcgaaacaggacaaggacccggaagcgugcucuacuggcggccagaggucucgucuuguggcagaacuggcccucuacagcgaggaagcuuaagcccuggcgcccucuccucuggcguccccggcucagguaauaguuccccccuacccucagauuuccugauucgccaucacggacccaagccugucagcagccagaggaaugcuggaacgggaucacgcaagagagucggaacugcccgaugcuguggcgagcucugggcuaccggcaguaaaggucaaggagagagggcuacaaccaguggggcugaacggaccgcccccagacgaaacugcuuaccaggcgccucuggaucuggaccagagcuggauagugcuccgcggacagcgaggaccgcuccugccucaggcucggcuccuagagagagcagaaccgccccugaacccgcccccaagcgcaugcggagucgcgggcuguuucggugccguuuuuuaccacagcgaccagggccccgucccccaggguugccugcuaggcccgaagccagaaaggucaccucagccaacagagcccgcuuucgacgagcagccaaccgacauccacaguuuccccaauauaacuaucaaacacugguaccagagaaugaagccgccgggacugccguccuuagaguggucgcacaggaucccgacgccggcgaggcaggaagacucgucuacagcuuagcugcucugaugaauuccagaagucuggaacucuucucuauugacccacaguccggccugaucaggaccgccgcugcccuggauagagaaagcauggagaggcauuaccuucgggugaccgcacaagaccacggguccccaagacugucugccaccaccauggucgcuguuacugucgcagaucguaaugaccacucgccugucuuugagcaggcacaguacagagaaacacugcgcgagaacgucgaagaagguuaccccauccuucagcuuagggcuacggacggugaugccccaccuaaugcaaaccuucgcuaucgguuuguugggcccccagcugcuagagccgccgcagccgccgccuuugaaaucgacccuagaucugggcuuaucucaaccucaggccggguggaucgcgaacauauggagucuuacgaacugguaguggaggccucggaccagggacaggagcccggcccaagaagcgccacggucagaguacauauuacaguauuggaugaaaacgacaaugccccacaauucagcgaaaaaagauacguagcacaagucagagaggaugugagaccccauaccguuguguugcgcgucaccgcgaccgacagggacaaggaugcuaacggguuaguccacuacaacauuaucucugggaauucucgaggccacuucgccauugauuccuugacgggagaaauccaaguuguggccccucuggauuucgaggcagaacgagaauacgcacucaggauccgcgcgcaagaugcagguagacccccucuuucuaacaacacgggucucgccagcauucaggucguagauauaaaugaccacauacccaucuuuguuuccacacccuuucagguaaguguucuagaaaacgcuccacuggggcacucagugauccacauccaagcuguugacgccgaucauggggaaaacgccaggcuggaguacucuuuaaccggagucgcgccugacacacccuuugucauaaauucugccaccggcugggugaguguuucgggaccccuugaucgggaaucaguggagcauuacuucuucggagucgaggcccgcgaccauggaucucccccacucuccgcaagugcuucugugaccgugaccguauuggacguuaaugauaaucggccugaauuuacaaugaaagaguaccaucucagauugaacgaggaugcggcugugggcacaagcguuguuuccguaacagcgguggaucgcgacgccaauucugcgauuucuuaucagauuacagguggaaacacgcgcaaccgcuuugcuaucaguacacagggaggagugggucugguuacucucgcccugccacuagauuacaaacaagagcgcuacuucaaauugguacuuacagcuuccgauagagcucugcaugaucauuguuacguccacauaaauauuacugacgccaacacccauagaccgguguuccaauccgcucacuauucaguuagcguaaaugaagauagaccaauggggucuacaaucguagugaucagcgccagcgacgaugaugugggagaaaaugcacggauaaccuaucugcucgaggacaaccuuccacaauuucgcaucgaugccgacuccggcgcuaucacucugcaggccccacuggauuacgaggaccaaguuaccuacacucucgcaaucaccgcccgugacaacggaaucccacagaaagccgacaccacuuaugucgaggucaugguaaacgacgugaacgauaacgcaccucaguucguggcgagucauuauacaggacucguguccgaagacgcucccccuuuuaccuccgugcugcagaucuccgcaacagauagggaugcacaugcuaaugggcgaguccaguacacguuucagaacggagaggauggagauggagacuuuacuaucgagccaacaucaggcauugucaggacuguuagaaggcuugauagagaggccguaucaguguacgagcuaacagcuuacgcgguggaucgcgguguccccccccugagaacgcccgucagcauacagguaaugguccaggacgucaacgauaacgcaccuguguucccagccgaagaauucgagguuagagucaaggagaauagcaucgucggcucaguaguugcucagaucaccgcuguugacccagacgagggcccaaaugcacauauaauguaccaaauuguggaaggcaacaucccggagcuguuucagauggacauuuucucaggcgaacugacagcucucauagacuuggacuacgaagcgaggcaggaauauguuauaguugugcaagcgacaagcgcaccucucgucucccgcgccacaguacacguuagacugguggaccaaaaugacaacucccccgugcucaauaauuuucagauacuguucaauaauuacgucaguaaccgcuccgauacguuucccaguggcaucaucggcaggauaccagcauaugauccagaugucucugaucaucuauuuuacuccuucgagcgcggcaacgaacugcaacucuugguggugaaucagacaagcggagaacuccgacuuagucggaagcuagacaacaacagaccuuuggucgcaucaaugcuuguaaccgucacggacggccugcacuccgucaccgcacaaugcguacugcgcguggucauaauaacugaagaacuucucgcaaacagccucacaguucgccuugaaaauauguggcaggagcgguuucugagcccgcugcugggucgguuucucgaggguguugcugcaguucuggccacccccgccgaggauguauuuauauuuaacauucaaaaugacacagaugucggaggaacagucuugaacgugaguuuuucugcucucgcuccacggggagcaggagccggagccgccgggccaugguucaguagcgaagagcuucaggagcaacuguacgugagacgcgccgcacuggcugcacggagucugcuggacguacugccuuuugacgacaauguaugccucagggagccuugugaaaacuacaugaaaugcguguccgugcuucgauucgacaguagcgccccuuuccucgccagcgcuucgacccucuuucgucccauacagcccauagccggcuugcgauguaggugcccuccuggauucaccggagacuuuugugagacugaguuggaucuuuguuacucuaauccgugccggaauggcggggccugcgcgagacgugaggguggguacacuugcguaugucggccaagguuuaccggagaagauugcgaacucgauacugaagcaggccgauguguucccggcguuugcagaaauggagguacuuguaccgacgcuccaaauggcgguuuccggugccaguguccugcagggggugcuuuugaaggcccuagaugugagguugcugcucgcucuuuuccuccuaguucguuugugauguuuagaggucucaggcaacgguuucauuuaacccuuucucucuccuucgcuaccgugcagcaguccggucuacuguucuacaaugggagacugaaugagaaacaugacuuucuggcucuggaacucguugcuggucaaguacgccucacuuacaguacaggagagucgaacacuguggugaguccaacgguuccugggggauugagugacggccaguggcauaccguacauuugcgcuacuauaacaaaccacgcaccgaugcacugggcggagcucagggaccuagcaaggauaaagucgcggugcugagcguagacgauugugauguggccguggcacugcaguuuggggcugagauugggaauuauuccugugcagcugccggcguucaaacuagcagcaaaaaaucacucgaccugaccggcccucuccugcucgguggaguuccaaacuugcccgagaauuuucccguaucccacaaggauuuuauuggcugcaugagagacuugcauaucgacggcagacgcguggacauggcggcauucgucgcuaacaaugggacaauggccggaugucaggcaaaacuccacuuuugcgacucaggaccgugcaagaacagcggauucugcuccgaacguuggggcuccuucuccugugacuguccggugggauucggcgggaaagauugucagcuuacaauggcacacccacaucauuucaggggaaacgguacacugaguuggaacuucgggagcgauauggcugucuccgucccaugguacuuagggcuugcuuuucgaacccgagcgacucaaggaguguuaaugcaaguucaggccgguccucacuccacacuccugugccaacucgacagaggauuguuaagcgugacugucacccgaggaucuggacgagcuagccaccugcuccuggaccaaguaaccgugagugacgggcgguggcacgaucuacggcuggagcuucaagaagaacccggggggaggcgaggucaccacguacucauggucagucucgacuuuucuuuauuccaggacacuauggccguggguucggaacuccaaggacuuaaagucaaacaacugcacgugggaggcuuaccuccaggcucugccgaagaggccccgcaaggucuggucggcugcauccagggaguguggcuuggauccacucccucaggcucucccgcccugcuaccuccuucccaucgcgugaaugcagaacccgggugugucgucacuaaugcaugcgccucuggaccuugcccaccccacgcugacugucgagaucucuggcaaacauucuccuguacuugccagccaggguauuacggcccuggauguguagacgccugccuucuaaauccaugccagaaucaggguucaugcagacaucugccaggggcuccucaugguuacacgugcgauuguguaggggguuacuucgggcaccauugcgaacauaggauggaucagcaauguccccguggcugguggggcagcccaacaugcggaccaugcaauugugauguucauaagggcuuugacccaaacugcaacaagaccaacggucagugucauugcaaagaauuccacuaucgaccucggggcucugauuccugccugcccugcgauuguuauccaguaggcucaacaucccgcagcugcgcuccucacucuggacaguguccuugcagaccaggcgcucuugggcggcaauguaauagcugugacuccccauucgcagaagugacagcauccggaugucgaguucuuuaugacgcuugucccaaaucccuuagauccgguguaugguggccucagacaaaguucggcguucuggcuacuguuccaugcccuaggggagcgcuuggggcggcagugcgccugugugaugaggcccagggauggcuugagccagaucucuuuaauugcacaucuccagcauuccgagaacuaagucugcuccuggacggacuggagcuuaacaagacagcccucgacacuauggaagccaagaaauuagcacagagacuccgugaggucaccggacacaccgaucauuacuuuucccaggacgugaggguaacagcccggcuuuuagcccaccugcuugccuucgagucucaucaacagggcuucggacugacggcaacacaagacgcacacuucaacgaaaaccuacugugggcuggauccgcacuacuggccccugagacuggcgaucugugggcugccuugggacaaagggcccccgggggcagucccggcagcgcaggccugguucgucaucucgaggaauaugccgccacucuugcucguaacauggaacucaccuaccuaaacccuaugggcuuggugaccccaaacaucaugcugucaaucgaccgaauggaacaccccucuucuccucguggagcccgaagauauccccgcuaccauuccaaccuguuccguggacaagaugccugggacccucacacccacgugcuguuacccagccaguccccucgaccaucuccauccgaaguguuaccuaccuccucgucuaucgaaaauagcaccaccuccuccguuguuccaccaccugccccuccagagccagaacccgguauaucaauuauuauacuacucguguaccgcacuuuagguggauugcuuccagcacaguuucaggccgagcgccgaggggcacgacuuccacagaaccccgucaugaauucgccagugguuagugucgcuguguuccacggacguaauuucuugagaggcauccuugaaucccccaucucucuggaauuucggcuguugcagaccgcaaacagauccaaagcaauaugcgugcaaugggacccuccagggcuggccgagcagcacggcgucuggaccgccagagacugugagcuggugcaucggaauggaagucacgcacgaugcagauguaguaggaccgggacauucggcguuuugauggaugcuucgcccagggagcgccuggaaggagacuuggaauugcuugccgucuuuacucacguuguggucgccguguccguagcugcgcugguccugaccgccgccauucuacuuagccuaagaucauugaaaaguaacgugaggggcauucacgccaacgucgcagcugcucucggugucgccgaacugcucuuucuccuggguauucauagaacacacaaucaguugguaugcacugccguggcgauucugcuccacuacuuuuucuugagcacuuuugccuggcuguuugugcaaggacuucaccucuaccgaaugcaaguugaaccuaggaaugucgaucgcggugccaugcguuuuuaucacgcucugggguggggcgugcccgcaguguuauuaggccuggccguuggauuagacccagagggcuauggcaauccugauuucugcuggauuucugugcaugaaccacuuaucuggaguuucgcaggcccagucgugcuugucaucguuaugaacggaacaauguuucugcuggccgcacgcacaucaugcucaaccggccagcgugaggcuaagaaaacuuccgcuuugacacugcgauccucuuuucuucuucugcuacuugucucugcgucauggcuuuuugggcugcuugccgucaaucauucgauucuggccuuccacuaccuccacgccggucugugcggucugcaaggccuagcagugcugcuccucuucuguguccucaaugccgaugccagagccgccuggaugcccgccugucucggucggaaagccgccccagaggaggcucgccccgcuccuggauuggggccuggagcuuauaacaacacugcuuuauuugaagagucaggacugauucgaaucaccuuaggcgcguccacugugucaucugucucgagcgcacgcuccgguaggacgcaggaucaagacagucagcgggguaggaguuacuuacgugauaauguucuuguccgccacggaucugcggccgaucacaccgaccacucauugcaggcucacgcuggaccaaccgaccuggauguggcuauguuccaucgagaugcaggagccgauagugauucugauagugaccucagccuggaggaggagaggaguuugaguaucccaucuucggaaucugaagauaaugguaggacgagaggcagguuccagcgcccucugugccgugccgcucagagugagaggcuuuuaacgcauccuaaagacguggauggcaacgaucucuuaagcuacuggccagcccucggagaaugugaagccgccccuugugcacuucaaaccuggggaucugagcgccguuugggucuggacacuucuaaagacgcagccaacaauaaccagccugaucccgcgcugaccuccggcgacgaaacgagccuuggccgggcacaaagacaaagaaaaggaauucucaaaaaucgccuucaguauccacuaguaccacagaccagaggggcgccagagcugucguggugccgggcugcuacucuggggcaccgggcaguuccagcugcuucuuacggacgcaucuaugcagggggaggaaccgggucucugucccagcccgcgaguagguacaguuccagggagcaguuagaccuccugcugaggcgccaauugucucgggaacgcuuagaggaggcccccgccccugugcuucgaccauuguccagaccaggaucccaagaauguauggacgcagcacccggacgccuggagccuaaagaccggggaagcacacugccacggagacagccaccccgcgauuauccuggcgcaauggcuggacgguuuggaucuagagacgcccuggaccuuggcgcaccuagagaaugguuauccacgcugccaccuccacgccgcacuagagaccucgacccccaacccccgccccugccauugaguccacagagacagcuuucuagggacccccugcugccaagcagaccacuugauucacucucucggucuuccaacucacgugagcagcuggaucaggucccgucacggcauccauccagagaagcucugggcccccucccacaguugcugagggcccgcgaagauagugugucagguccaucccacggcccuucuaccgaacaguuggauauccugagcuccauucucgcgucuuucaauuccucugcucugaguucuguccagucuuccucaacaccccucggcccgcauacuaccgcaacuccgucagcuaccgcauccguccucgggcccucuacaccucgcagugcuacaucacauucaauaucugagcugucaccugauucagaaguaccacgauccgagggccauaguuag

SEQ ID NO: 248670 - RNA, 384 nt, Artificial Sequence
  Description of Artificial Sequence: Synthetic coding sequence
augggcuucaggaaguucucgcccuuuuuggccuugucuauccucguacuauaucaggccgguagucuccaggcugccccauuuagaucagcccuugagagcagcccagaucccgcuacacucucuaaggaggaugcccguuuguuacuggcagcucuuguccaggauuauguccaaaugaaagcuucggaacugaaacaagagcaagagacacaggggagcucuucugccgcccagaagcgagcaugcaauaccgccacgugcgucacucauagguuggccggccuccucucccguucuggugggaugguaaagaguaauuucgugccaacuaacguggguucgaaggcguucgggcggcggagaagggauuugcaggcauag

SEQ ID NO: 248671 - RNA, 417 nt, Artificial Sequence
  Description of Artificial Sequence: Synthetic coding sequence
augaagaaggaggccaaccugcagagaggaggcaugggcuuucggaaguucucuccauuccuggcguuaagcauacuaguuuuguaucaggcuggcucacuccaggccgcaccauuccgguccgcccucgagaguucaccugauccagccacuuuauccaaagaagacgcacgucuacugcucgccgcucuggugcaggauuaugugcagaugaaagcaagcgaacuuaaacaggagcaggaaacacaagguucaaguucagcagcccagaaacgugcauguaacacagccacaugcgugacccacagacuugcuggauugcugucucgaagcggagggauggucaaauccaauuucgugccuacaaauguugggaguaaggcuuuuggacgacggcggagagaccuucaagcauag

SEQ ID NO: 248672 - RNA, 384 nt, Artificial Sequence
  Description of Artificial Sequence: Synthetic coding sequence
augggauuuagaaaauucucgcccuuccuagcucuguccauccuggucuuauaucaggccggcucacugcaggcagcgccguuccguucagcacuggaaucuucucccgaccccgccacccuaagcaaagaagaugcaagacuucugcuggccgcccuuguacaggauuacgugcagaugaaagcguccgagcugaaacaagaacaagagacccaaggcucaagcuccgcggcacaaaagagggcgugcaauaccgcuaccugugucacacauagacuugcaggucuacucucucggagcggaggcauggucaaaucuaacuucguuccuaccaacguuggcagcaaggccuuuggacgccgcagacgggaucuacaagcuuag

SEQ ID NO: 248673 - RNA, 948 nt, Artificial Sequence
  Description of Artificial Sequence: Synthetic coding sequence
augagaaugugcgaucgugguauccagaugcuaaucacaacuguaggcgccuuugccgcguucucccugaugacuaucgccgugggcaccgacuauuggcucuacucaaggggcguuugucguaccaagucaacauccgauaaugaaacuucuaggaaaaaugaggaaguaaugacacacuccggucuuuggcggacaugcuguuuagagggagccuuuagaggcguguguaagaaaauugaccacuuuccugaagacgcugauuacgaacaggacaccgcugaauaucuauuacgcgccgucagagcuucaaguguauuuccuauccuguccgugacccugcuguuuuuuggagggcugugugucgccgcuuccgaauuucauagaucccgacacaauguuauucugucagccggaaucuucuuugugucugcggguuugucuaacaucauugggaucaucguuuauaucagugccaacgccggagacccugggcaaagagauuccaagaagucguacucuuauggauggucuuucuacuucggagcuuuuucauucaucauugcggaaaucguaggugugguagccgugcauauuuauaucgagaagcaucagcagcuccgcgcuaaaucccauucagaauucuugaaaaaaagcacauucgcacgcuuaccacccuaccguuacagguucaggagacgcuccaguaguagaucuaccgaaccccgaucccgcgaccucucucccaucaguaaaggguuccauacgaucccaucuaccgacauuuccauguucacccugucccgugauccaaguaaaaucaccaugggcacgcuccucaacuccgaucgcgaucaugcguucuugcaguuccacaauucaacuccaaaagaauucaaagagagccuccauaacaauccugccaaucgaagaacaaccccagucuag

SEQ ID NO: 248674 - RNA, 891 nt, Artificial Sequence
  Description of Artificial Sequence: Synthetic coding sequence
augucugcguguggucgaaaagcucuuacuuugcuguccuccguuuucgccgucuguggccugggccuucuggggaucgccguuuccaccgacuauuggcuuuaccuugaggagggggugauagucccacaaaaucagagcacagagauuaaaaugucgcugcauagcgggcuguggcgcgucuguuuccuagccggugaagagcgagggagauguuucacgaucgaauacguuaugcccaugaacacacaacugaccucugaaucaacuguuaauguguugaaaaugauuaggagugccacgcccuuuccgcuugugagucuuuuuuucauguuuaucggcuucauucucaacaacauuggucacauccgaccccaccgaacuauucuggcuuucgugucuggcaucuucuuuauccuuucgggacucagucuugugguuggacuuguacuauacauuagcagcauuaaugacgaaaugcucaacagaaccaaggaugcggagaccuauuucaacuacaaguacggcuggagcuucgccuucgcagcaaucucauuccuuuugacagaagucaaacccgugacccucucuauggacaggcuuggucuuggcacugccccacugucuagaggugaauggggcugggggagacgggauauuccgcaacccuuuuggacucccgaucacccacuguacuucccuucauccucccagaauguaucucuuaguuaccugagcggaucgccaccagcacguaugucaccaggaccguguagcugcccucauguucauuuuccaccacacucaagcuguguguuguguagaccucagccacgugaaaugcggcaagcaccugcugcaagcccauccucugcuguguucuccuuguag

SEQ ID NO: 248675 - RNA, 948 nt, Artificial Sequence
  Description of Artificial Sequence: Synthetic coding sequence
auggaucugaggcaguuucugaugugucucucccugugcacugcguuugcacuuaguaaaccgaccgaaaagaaagaucggguccaccacgagccacaacucuccgauaaagugcauaacgaugcccaaaguuuugacuacgaccacgaugcauuccuuggagccgaagaggcaaagacauucgaucagcugacccccgaggaaucuaaagagcgcuuaggcaagauugugaguaaaauagacggagauaaagacgguuucguaacuguggacgagcugaaagacuggauaaaauuugcccagaagcgcuggauauacgaagacguggaacgccaguggaaaggccacgaccuaaaugaagacgggcuaguguccugggaagaauacaaaaacgcgacauacggcuacguccucgacgacccagauccagaugacgguuuuaacuacaagcagaugaugguuagagacgagagaagauucaagauggcagauaaagacggagaccugaucgcgaccaaggaggaauuuacagcuuuccugcauccugaggaguaugauuacaugaaggacauuguaguacaggagacaauggaggacauugauaagaacgcagacgguuucaucgaccuugaagaauauaucggcgacauguacucucacgacggaaauacggaugaaccugaaugggugaaaacagaaagagaacaauuuguugaguuuagagauaagaacagggauggcaaaauggauaaggaggaaaccaaggacuggauauugccaagugacuacgaccacgccgaggcugaagcaagacaucuuguuuacgagucggaccagaacaaagacggcaagcucacuaaggaggaaaucguugauaaguaugaccuguuugucgggucucaggcaacagauuucggggaagcacugguccggcacgaugaauucuag

SEQ ID NO: 248676 - RNA, 465 nt, Artificial Sequence
  Description of Artificial Sequence: Synthetic coding sequence
auggaucucagacaguuucuaaugugccugagccuguguacagcuuucgcccucucuaaaccaacugaaaagaaagaccggguccaccacgagccccagcugagcgauaaagugcauaaugacgcgcagaguuucgacuacgaccaugaugccuuucugggugcugaagaagcuaaaaccuuugaccagcuaacccccgaggaaagcaaagagcgcuuaggcaagauugucucaaaaauagacggggauaaggauggauucguaaccguggaugaacugaaggauuggauacugcccucugauuaugaccacgccgaggcagaagcaagacaccucguauacgagagcgaccagaacaaggacggaaagcugaccaaggaagaaaucguugacaaauaugaucuguuuguggguucacaggcgaccgauuuuggcgaagcacuggugagacacgaugaguucuag

SEQ ID NO: 248677 - RNA, 948 nt, Artificial Sequence
  Description of Artificial Sequence: Synthetic coding sequence
auggaucuccgccaguuccucaugugucugucacugugcacugcuuuugcccuuuccaagccuacugagaaaaaagaccgcguacaccaugaaccacaauuguccgauaaagugcacaacgaugcccagucauucgauuacgaucacgacgcuuucuuaggcgccgaggaagccaagacuuucgaccagcugaccccggaagagaguaaagaaagauugggaaugauugucgauaaaaucgacgcagacaaagauggcuucgugaccgaaggcgaacugaagucuuggauuaaacaugcacagaagaaguauauuuaugacaacguagagaaccaguggcaggaauuugauaugaaucaggacggacuuaucagcugggaugaguauaggaacgugacguacggcaccuacuuagaugauccagauccagacgacgguuuuaacuauaaacagaugauggugagagacgagaggagguuuaagauggcagauaaggacggcgauuugaucgcaaccaaagaagaguucacagcuuuuuugcaucccgaagaguaugauuacaugaaagauauaguggugcaggagacuauggaagacaucgacaagaaugccgacggguuuauugaccucgaagaguauaucggcgauauguauucacaugacggaaauacggaugaaccggaaugggugaagacagagagagaacaguuuguggaauuucgagauaagaaucgggaugguaagauggacaaagaagaaacaaaagauuggauacugccuagcgacuacgaccacgccgaggccgaagcucggcaccugguauaugaaagcgaccaaaacaaagauggcaagcuaacaaaggaggagauuguggacaaguacgaccuguuugucgggucacaggccacagacuuuggagaagcuuuagugcgacaugacgaauuuuag

SEQ ID NO: 248678 - RNA, 972 nt, Artificial Sequence
  Description of Artificial Sequence: Synthetic coding sequence
augaaggagacagaucuaauuauaauggaccugaggcaauuucugaugugcuuaucucuaugcacugcuuucgcuuugucaaaaccaacugaaaagaaagaccgaguccaucacgagccccagcucucagacaaagugcauaacgaugcccaguccuucgacuaugaccaugacgccuuucugggcgccgaggaggccaaaacauucgaccaacuuacccccgaggaaaguaaagaacgcuuaggaaaaaucguauccaaaaucgauggagauaaagauggcuucgucacaguugaugaacugaaagacuggaucaaauucgcacagaagcgcuggauuuacgaggacgucgaaaggcaauggaaaggacacgauuuaaaugaggauggauugguuaguugggaagaauauaaaaacgcaaccuauggauacgugcuggacgaccccgauccagacgacggcuuuaacuauaaacagaugauggugagagaugaaaggcgguuuaagauggccgauaaggauggagaucucaucgcuacuaaagaggaauuuacagcuuuccugcauccugaggaauacgacuacaugaaggauauugugguucaagagacuauggaagacaucgacaagaacgccgacggauuuaucgaccuggaggaguauaucggagauauguauucacaugauggcaacacagacgaacccgagugggugaaaacugagcgagaacaguuuguagaauucagagacaagaaccgugauggaaaaauggacaaagaagaaacuaaagacuggauacugcccucugauuaugaccacgcugaggcugaggcuaggcacuuaguguacgaguccgaccaaaauaaagacggcaaguuaaccaaagaagaaaucguggacaaguacgaccucuuuguuggcucacaagcuacugauuucggcgaagccuuaguucgacaugaugaguuuuag

SEQ ID NO: 248679 - RNA, 444 nt, Artificial Sequence
  Description of Artificial Sequence: Synthetic coding sequence
uagaucgccaccaaggaagaauuuaccgcauuucugcauccagaggaauacgauuacaugaaagacaucgucguucaggagacuauggaagauauugauaaaaaugcugauggcuucaucgaucuagaagaguauauuggcgacauguacagucacgacggcaacacagaugagccggaauggguuaagaccgagcgggaacaauuugucgaguuccgggacaaaaaccgagauggcaaaauggauaaggaggagacaaaagacuggauacucccaagcgacuacgaccaugcugaggcugaggccaggcacuuaguuuacgaaucagaucagaauaaggacggaaagcuaacuaaagaagagauuguagauaaguacgaucuauuugugggaucacaagccaccgauuuuggggaagcuuuaguacgccaugaugaauucuag

SEQ ID NO: 248680 - RNA, 675 nt, Artificial Sequence
  Description of Artificial Sequence: Synthetic coding sequence
auggaucugagacaguuccucaugugccugucuuuaugcaccgcuuucgcauuauccaaaccuacagagaaaaaggacagaguucaucacgagccccaguuaucagauaaaguacauaacgacgcacaaucauucgauuacgaucacgacgcuuuccuuggggcagaggaggcaaagacauucgaucaacuuaccccugaagagucuaaagagcgacucggcaagaucgucucuaagauugacggcgacaaggacggcuuugucacugucgacgaacugaaagauuggaucaaguucgcgcaaaagcgcuggauauacgaggacguagagagacaauggaaaggucacgaccuaaaugaagauggacugguaagcugggaggaauauaagaacgcuaccuacggauacguauuagaugacccagaccccgaugauggguucaauuauaagcaaaugaugguucgcgaugagcggcgauucaaaauggcugacaaagacggcgaucucauagcaaccaaggaggaauuuacugccuuucuucacccagaagaauaugacuauaugaaagacauuguggugcaggaaacaauggaagacauagacaagaacgcagauggauuuauagacuuggaggaguauaucgguuggcaggcauaucaggggggggauagauag

SEQ ID NO: 248681 - RNA, 444 nt, Artificial Sequence
  Description of Artificial Sequence: Synthetic coding sequence
augaaagaaaccgaccugauaauaauggacuugagacaauuucuuaugugccucucgcugugcacagcguuugcucugagcaaaccuacugaaaaaaaagauagggugcaccacgaaccccaacucucagauaaaguacacaaugaugcccagucuuucgauuacgaccaugacgcuuuccuuggagcagaagaagccaagacauucgaccaacugacccccgaagaaagcaaagagcggcuuggcaagauagugucgaagaucgacggagacaaggauggcuuuguaacagucgacgaacucaaggacuggauuaaauucgcgcaaaaacgguggaucuaugaagauguggaacgucaauggaaagggcacgaucuaaaugaggauggccuggugagcugggaggaauauaagaaugccacauacggauauguacuggaauag

SEQ ID NO: 248682 - RNA, 513 nt, Artificial Sequence
  Description of Artificial Sequence: Synthetic coding sequence
auggaucugcgacaguuucugauguguuugucucugugcacagccuucgcuuuaucaaaacccaccgaaaaaaaggacagaguacaccaugagccacaauuguccgauaaaguucauaaugaugcccaaucauuugacuacgaccaugacgcauuccugggugccgaagaggccaagacuuuugaucaguugaccccugaagaguccaaggagcgccucggaaugauugucgacaaaauugaugcagauaaagacggcuucguaaccgagggggaacuuaaaucuuggauaaaacaugcucagaagaaauacauuuaugacaacguggaaaaccaauggcaggaguucgacaugaaucaagacggacuuaucagcugggacgaguauagaaaugugacauacgggaccuaccuagacgacccugaccccgacgacggcuucaauuauaaacagaugauggugagggaugagagaagauucaaaauggccgaucgcgcucgagccguuugcuag

SEQ ID NO: 248683 - RNA, 606 nt, Artificial Sequence
  Description of Artificial Sequence: Synthetic coding sequence
auggaccugcggcaauucuugaugugucugucccucuguaccgcauucgcccugucuaagccgaccgaaaagaaggaucgaguacaucacgagccucaacuaucagauaaggugcacaaugacgcucagagcuuugacuaugaucaugaugcauuucugggagccgaagaagccaaaacauuugaccagcugacaccagaagagaguaaggaacgacuggggaugauugucgacaaaauugaugcugacaaggaugguuuugucacggaaggcgagcugaagucauggaucaagcaugcucagaaaaaauauauauacgacaaugucgagaaccaauggcaggaguucgacaugaaucaggacggccuuauuucaugggaugaauaucgcaacgugacguacggcaccuaccuugacgacccagauccugaugacggcuuuaauuauaaacagaugauggugagggacgaacggagauuuaaaauggccgacaaagacggagaucucauagccacuaaagaggaaauugucgacaaguacgaucuuuucguggguagccaggcaacagauuucggcgaggcacuagugcgucaugacgaauucuag

SEQ ID NO: 248684 - RNA, 798 nt, Artificial Sequence
  Description of Artificial Sequence: Synthetic coding sequence
auggaucuacgucaguuucucaugugcuugagccugugcacagccuucgcucugucuaagcccaccgagaaaaaggacagggugcaccaugaaccccaauuaucagacaaaguacacaacgaugcucaaaguuuugacuaugaucacgaugcauuccugggcgccgaagaggccaagacauuugaccagcugacucccgaggagagcaaggagcgucugggaaaaauaguuaguaagaucgauggagauaaggauggcuucguaacuguggaugagcugaaggacuggauuaaauucgcccagaaaagauggauuuaugaagacguggagagacaguggaaggggcaugaccuuaaugaggacggcuuggugucaugggaagaauauaagaaugccaccuacgguuacgugcuggacgauccagacccagacgauggauuuaacuacaaacaaaugauggugcgagacgaacggagauuuaagauggcugacaaggauggagaucucauugccacaaaagaagaguucacagcuuuuuugcauccggaagaauacgauuacaugaaagacauaguugugcaagagaccauggaagacauugauaaaaaugcagacggcuuuauugauuuagaggaguacaucggagauauguauucacaugauggaaauacugacgagagcgaucagaauaaagacgggaaauugacuaaggaggagauuguugacaaauaugaccuauucgugggcagccaagcgaccgacuucggagaggccuuagugcgccacgacgaguucuag

SEQ ID NO: 248685 - RNA, 495 nt, Artificial Sequence
  Description of Artificial Sequence: Synthetic coding sequence
augaugguccgcgacgaacggcgcuuuaagauggcagauaaagacggggaucuuauagcaaccaaggaagaauuuacagccuuccugcaccccgaggaauaugacuauaugaaggacauuguaguacaagagaccauggaggauauugacaagaacgcugauggauuuauugaccucgaagaguacaucggagacauguacagccacgacgggaauacugacgaaccggaaugggucaagacagaaagagaacaguuuguagaauuuagggacaaaaaucgagacgggaagauggacaaggaagagacgaaagacuggauccucccgucagacuacgaucaugcugaggcagaagcccgccaccuuguguaugaaagugaccaaaauaaagauggaaagcucaccaaagaggagaucguugacaaguaugaccuuuucgucggcucucaggccacagauuuuggagaggcucucgugcgccacgaugaauucuag

SEQ ID NO: 248686 - RNA, 972 nt, Artificial Sequence
  Description of Artificial Sequence: Synthetic coding sequence
augaaggagaccgacuugaucaucauggauuuacgacaauuuuuaaugugccugucccugugcaccgcuuucgcucuaaguaagccgacagaaaaaaaagaucggguucaucacgaaccacaguugucugacaaagugcacaacgacgcucagucuuuugacuaugaucaugacgcuuuucugggagccgaggaagcuaaaacguucgaccaguugacaccugaggaguccaaagaacgucuuggaaugauuguggauaaaauagacgccgauaaagacggcuuuguaacggaaggagaauuaaaaagcuggaucaaacaugcccaaaaaaaguacaucuaugacaaugucgaaaaccaguggcaagaauucgacaugaaccaggacggccugauuagcugggacgaguaucggaacguuacauaugguacguaccuggacgaucccgacccggacgacgguuuuaauuauaaacagaugauggugagagacgagaggagguucaagauggcugauaaggauggugaucucauagcaacaaaggaagaauucaccgcauuuuugcauccugaagaguacgacuacaugaaagauauuguugugcaggaaaccauggaagauauagauaagaacgccgauggcuuuauugauuuggaggaauacauaggcgauauguauucucacgaugggaacacugacgaacccgaauggguaaaaacagagagagaacaguuugucgaguuccgcgacaagaaucgcgacgggaaaauggauaaggaagaaaccaaagauuggauccugcccucagacuaugaccacgcagaagccgaagcuaggcaucuuguguaugagagugaucagaauaaggauggaaaacugaccaaagaagaaauaguggacaaguaugaccucuuuguuggcucccaggcuacugacuucggcgaggcacuaguuagacaugacgaauucuag

SEQ ID NO: 248687 - RNA, 1386 nt, Artificial Sequence
  Description of Artificial Sequence: Synthetic coding sequence
augaacacagacuuggcugcuggaaagauggcuagugcggccuguaguauggacccuaucgacucguucgaacuccuagaccugcucuucgaccgacaggauggcauucugcgacaugucgaacuuggugaggguuggggccacguaaaagaucaacaggucuugccaaacccagacagcgaugacuuccuguccagcauucuuggaucuggagauucauugccuucguccccacuguggaguccagaaggauccgauuccgguauuagcgaggaucuuccaucagacccucaggauaccccuccuagaucuggcccggcgacuucuccagcuggaugucaccccgcucaaccugggaagggaccauguuuguccuaucacccugguaacaguugcagcaccacaaccccuggcccggugauccaagugcccgaagcaucugucacaauugauuuggaaauguggagcccugggggcagaauuugcgccgaaaagccugccgaccccgucgaccuuucaccucgcuguaaccugaccguaaaagauuugcuccugucgggcuccucuggagaucugcaacagcaccaccucggagccagcuaucuccuucggccaggagccggucacugccaagagcugguacuuaccgaggaugagaaaaaacuucucgcuaaggaaggaauuacuuugccaacccaguugccccucaccaaauaugaagaacgcguguugaaaaagaucaggagaaagauacgcaacaaacaguccgcccaggaaucucggaagaaaaagaaagaauacaucgacgggcuugagacccgaauguccgccuguaccgcccagaaucaggagcuucagcgaaaaguccuccauuuagaaaaacagaaccugucucucuuagagcaacuuaaaaaacugcaggcgauagucguccagucuaccucgaaaucagcacagacagggacuuguguagccguucugcuccuauccuuugcccucauaauucuuccaucaauuucaccauuuggucccaauaaaaccgagagcccaggggauuuugcucccgucagaguguucucaaggacccugcauaacgaugccgcaucuagaguggccgcagacgccgugcccgguagugaagcaccuggcccacgaccagaggccgacacuacuagggaagagucgccaggcagcccaggcgcugauuggggguuccaggauacugccaaccucaccaauuccacagaagaauuagauaacgccacguuggugcuuagaaacgcaacugaaggacugggccaagucgcuuuacuggauugggucgccccagguccaucuaccgguagugggagggccggacuggaagcugcaggagaugaauuguag

SEQ ID NO: 248688 - RNA, 4827 nt, Artificial Sequence
  Description of Artificial Sequence: Synthetic coding sequence
auguauuccgcccaucgcccacugaugccugcuucaucugcagcuucuaggggacucggaauguucguuuggacaaacguggagccccgauccguggccguauucccuuggcacagucucguucccuuucuggccccaagccaacccgauccauccgugcagccuagugaagcucagcaaccagcaucacacccagucgcgucgaaccaguccaaggaacccgcagagagugccgcaguugcucacgagagaccccccggggggacaggcucugcugauccggaacgcccccccggagccaccugcccugagucucccggacccggcccuccucacccacucggaguuguagaaagcggcaaagguccaccuccaacuacugaagaagaagcaaguggaccgccaggagaaccccgauuagauucugagacugaguccgaccaugacgaugcuuuuuuaagcauaauguccccugagauucagcugcccuuacccccuggcaaaagaagaacacaaucccuguccgcauugccgaaggagcgggauuccucuuccgagaaggauggacggucacccaacaaacgugaaaaagaccacauucgaagacccaugaacgcuuucaugauauuuaguaagaggcacagagcccucguucaucagcgucacccgaaccaggacaauagaacgguuucuaaaauccuaggagaauggugguacgcccucgguccgaaggagaaacaaaaguaucacgaccuugcuuuucaagugaaagaggcccauuuuaaagcacauccggauuggaaaugguguaauaaagaccguaagaagucgucuagcgaggcuaaaccaacaucucucggccuggccggcggccacaaggaaacucgcgaacgcuccaugucagaaacaggcaccgcugcagccccuggugugagcucagaacuguugagugucgcugcgcaaacacugcuaucauccgacacaaaggccccugguaguucuucauguggagccgagcgacuccacaccgugggaggccccggcuccgcccgucccagagccuuuagucauucuggugugcacucccuggaugguggcgagguagauucucaggcacuccaggaauuaacgcaaauggugucaggccccgccucauauucaggaccgaaaccuagcacacaguacggcgcaccuggaccauucgcggcccccggagaggguggugcucuggccgcuacuggcaggccgccucugcugccuacaagagccucaagaucacagcgugccgcgagugaagacaugacuagcgaugaagaaaggauggucauuugugaggaggagggagaugacgacgucauagcugacgacggguucggaacuaccgauauugaccugaaauguaaagagagaguuacugauucugaaagcggagacagcucuggcgaggauccugaaggcaauaaaggcuucgggagaaagguauuuagcccuguaauccgguccucauucacccauugucgacccccccuugaucccgagccccccggacccccagauccucccguggcauucggcaaaggauaugguagugccccuucuucuucugcaaguucccccgcuucuucuagcgccagcgccgcuacgucuuucucacugggcucuggcacauuuaaagcucaagagaguggccagggcuccacggccggccccuugagaccccccccacccggcgcaggcggcccagcaacacccuccaaagccacuagauuccuccccauggaucccgccacuuucaggcguaagagaccggaauccguggggggacuggaaccuccuggaccuagugugauugcugcacccccuaguggcggagggaauauauuacaaacuuuaguguugccccccaauaaagaggagcaggaaggggggggagcaaggguaccuagcgcaccagcccccucuuuagccuacggagcuccagcggcccccuuaaguaggccugcugccaccauggucaccaacgucgugagacccgucuccuccacacccguccccaucgcuagcaaaccauuuccaacgucggguagagcggaagccagcccuaacgauaccgcaggagcacggacugaaaugggaaccggcucacgugugccuggagguuccccccugggugugagccuggucuauagcgauaagaaaagugcugccgcgacaucuccugcuccucauuuagucgcuggcccccuccucggcaccguaggcaaagcuccagccacagugaccaacuuacuggugggcacaccugguuacggagccccugccccuccagccguucaguucaucgcacaaggcgcuccagguggcggcacaacagccggaucaggagcaggggcaggcuccggcccuaauggaccggugccucuugggauccuacaaccuggcgcccuaggaaaggcaggcggaauuacccagguacaguacaucuugcccacuuugccccagcagcugcaagucgcccccgcgccggccccagcccccgguacaaaagcggccgccccuucagggccagcgcccacaacaaguauccgguuuaccuuacccccaggaacaaguaccaauggaaaaguguuagccgcuaccgcaccuaccccuggaaucccaauccugcagagcgucccguccgcccccccaccaaaggcacaaucagugaguccuguucaggccccaccaccuggaggaagcgcccaguugcugccaggaaaagugcuggucccccuggccgccccgaguaugucaguacgcggcggaggugccggucaaccccucccacuuguuuccccccccuuuucaguuccuguacaaaacggugcccaacccccaagcaaaaucauucagcuuacaccaguucccgucagcacacccucuggacucgugcccccacucagucccgcgacgcucccuggaccaaccagccagccacagaagguucugcugccauccuccacucggaucacauacguacaaagcgcuggaggucaugcacuuccccugggaacgucaccggcaucuucacaagccggaacuguuacaaguuacggcccuacuucaaguguggcgcuuggcuuuacaagucucgguccuagcggucccgcuuuuguccagccuuugcugucugccggucaggccccccugcuugcucccggacagguggggguaucacccgucccuaguccccagcugcccccggccugcgcagccccuggaggcccuguuauuacggcauuuuauuccggaucaccugcuccaacaagcagcgcuccccucgcucagccgucccaggccccaccaagucucguauacaccguagccacuaguacaaccccccccgccgcaaccauacuccccaaaggcccucccgccccagccacagcgacuccagcccccacgagccccuuuccuuccgccacugccggcucaaugacuuacagccucguagcucccaaagcccaacggccaagccccaaggcuccccagaaagucaaagcagcgauagccucuaucccugugggauccuuugaagccggcgccuccggcagacccggccccgccccccgacagccucucgagccaggaccuguacgcgaaccaacugcccccgagucagagcucgagggucaacccacaccacccgcccccccuccuuuaccugagacuuggacaccuacggccagauccucaccaccccucccaccacccgccgaagaaaggaccagcgcgaaaggacccgagaccauggcaucaaaguuucccucuucaucuagcgauuggcgagugccggggcaaggacuggaaaauaggggcgaacccccuacacccccuucucccgcuccugcucccgccgucgcgccuggcggcuccucagagucuucuagcgggagggccgcgggggauacuccagaacggaaggaagccgcagguacagguaaaaaggucaaggugcgcccucccccacugaagaagacuuuugacuccgucgacaaucgugugcuuagugaaguugacuuugaggaacgguucgcagaacugccagaauucagaccugaagaaguguugccuaguccuaccuuacagucucuugcuacaucuccuagagcaauuuuaggcuccuacaggaaaaagcggaaaaauucuacugacuuggacagugcuccagaggacccuaccuccccuaagagaaagaugagaaggcgaaguagcuguucauccgaaccaaauaccccgaagagugccaagugugagggagacauauuuaccuuugacagaacugggacugaggccgaagauguguugggggaacuggaauaugacaaaguaccuuauuccucacugagacggacauuggaucagaggcgagcccuggugaugcagcuuuuccaggaucacggguuuuuuccaucugcccaggcaacugcagcuuuccaggcuagauaugcugacaucuuccccucaaaagugugccugcaacuuaaaauccgggaaguucgccagaaaauaaugcaggcagcuacuccuacugaacagccaccaggcgccgaagcucccuuaccagucccuccaccgaccgggaccgccgcagcccccgcacccacaccaagcccagccggcggcccugauccuacuagccccucaucugacuccggcaccgcacaggccgccccuccacuuccccccccaccugaguccggcccgggccagccggguugggaaggagcuccgcaaccuucuccgccuccaccaggccccucuacagcugcuacaggucgauag

SEQ ID NO: 248689 - RNA, 540 nt, Artificial Sequence
  Description of Artificial Sequence: Synthetic coding sequence
augcgggcucugguacuucugcugucccucuucuuguuaggcgggcaagcacaacacguguccgauuggaccuauagugagggugccuuagaugaagcucacuggccccagcacuauccugcuuguggaggucagcgacagagcccaaucaaucugcagagaacuaaaguacguuacaauccaucauuaaagggacucaauaugacuggguacgaaacccaagcuggugaauuuccaauggucaauaauggacacacagauuggcaggccgaacucuuccucccuucucucuccucccccugcggggaaggcgcaaagcacaaaggucagcgacaguggcucuguucuccuucucucgauuccuggugggaggccauuauagacgguggaucccugugggcaacauuagcugaaugcgggcuaagggcggaagggcccgaagaaggcaggcauauggaggaaaaaagcccagccucucagggggcguguuccggcagucgacuucccauaucaagaggaccguguaccuuuuuuuuauag

SEQ ID NO: 248690 - RNA, 942 nt, Artificial Sequence
  Description of Artificial Sequence: Synthetic coding sequence
augcgagcacucguucucuugcuuucccuguuucuacuuggaggacaggcgcagcaugucagcgauuggacauacagugaaggugcccuugacgaggcccacuggccacaacacuauccggccugcgggggccagcggcagucucccauaaaccuccagcguacuaaaguucguuacaaccccaguuugaaagggcucaacaugacuggauaugaaacccaagccggcgaguuucccaugguaaacaauggccauaccgugcaaauuucucuucccucuacuaugagaaugaccguggcugauggaacgguuuauauugcucagcagaugcauuuccauugggguggggcuucgagugagauaagugguucggagcauacggucgauggaauccggcacguuaucgaaauccauauaguccacuauaacagcaaauauaaaagcuacgacauugcccaggaugcaccugauggccuugccgugcucgcagcuuuuguggaaguuaagaacuacccugaaaauaccuacuauagcaauuuuauuucucaccuugcuaacauuaaauaucccggacaacguacaacucugacaggccucgacguacaagauauguugccucgcaaucugcagcacuacuacaccuaucacggaagucucaccacuccgccaugcacugaaaacguucauugguuuguacuugcugauuucguuaagcugagccgcacucaaguuuggaaacuagaaaacagccuccucgaccauaggaauaaaacaauacacaaugacuaccgacgaacacagccccuaaaccacagagucguugagucgaauuuccccaaucaggggaaaggucacggagggcaccgaggucgaucacagaacccacggguccagccgaccagcacccgacacccacuugcucucgguagucucgaagcuuag

SEQ ID NO: 248691 - RNA, 927 nt, Artificial Sequence
  Description of Artificial Sequence: Synthetic coding sequence
augcgcgccuugguucuacuccuaucccuguuucuucuuggcggccaagcccagcacgugucugacuggacuuacagcgaaggugcccuggaugaggcacauuggccacagcauuacccagcguguggcggccagcgucagagcccuaucaaccuccagagaacaaaagugagguauaauccaucacugaagggacuuaacaugaccggguacgaaacacaggccggcgaauuccccauggugaauaacggacauaccguccaaaucucauugccuagcacaaugagaaugacuguugcagacgggacaguauauaucgcgcaacagaugcacuuccacuggggcggggcuucauccgaaauuagcggcucagagcauacaguugauggaauaaggcacgucauagagauacacaucguacacuacaauucuaaguacaaguccuacgacaucgcccaagacgcuccugauggcuuggcuguccuggcugccuucguggaggucaagaauuacccggaaaacaccuauuauuccaacuucauaucucaucuagcuaauauuaaauacccgggccaacgcacuacccugacuggcuuagaugugcaggacaugcucccccggaaucuccagcauuacuacacauaccacggaucucuuacuacaccuccuugcaccgaaaauguccacugguucguguuagcagacuuugugaaacuuaguagaacucaggucuggaagcuagaaaauucccugcuggaccauagaaacaagaccauccauaacgacuacagacgcacgcaaccucucaaccaccgggugguggaauccaacuucccaaaucaggaauacacucuaggaagugaauuccaauucuaccuccacaaaaucgaggaaauacuugacuaccuccgccgcgcccugaacuag

SEQ ID NO: 248692 - RNA, 987 nt, Artificial Sequence
  Description of Artificial Sequence: Synthetic coding sequence
augggcgcagcugcacggcuuucugcaccaagagcccucgugcugugggcugccuuaggcgccgccgcccacauuggcccagcccccgacccagaggacugguggaguuacaaggacaaucugcaggggaauuucgugcccggcccuccauucuggggcuuagucaaugcugcuuggucucuuugcgcggucggaaaacgccagagucccguugaugucgaguugaagagagugcuguaugauccuuuucugccaccgcuccggcucuccacgggcggcgagaaacuuagaggaacuuuguacaacacugggcgacaugucagcuuucugccugccccccggcccguagucaacguuaguggcggccccuuacuguauagucaucgacugagcgaacugagguuacuguuuggcgcaagggacggugcagggucugagcaucaaaucaaccaccaggguuuuucggcagaaguacagcuaauucacuuuaaucaggagcucuacggaaauuucuccgcugcuagccgcgggccuaacggacucgcaauccuuagucuuuucgucaacguggccaguacuaguaauccauuucugagcaggcuccugaauagagauacaaucacaagaaucaguuauaaaaacgacgcuuauuuccuccaggaucucagucucgaacuucuguuccccgaauccuuuggauuuaucacuuaccagggaucacugucaacuccaccguguuccgaaaccgugacauggauuuugaucgaucgugccuugaacauuacgucccugcagaugcacucucuuagacuucucucacagaacccacccucccagaucuuucagucccuuagugggaacagucgaccauugcaacccuuggcacaucgggcccuccgcggcaaucgcgaucccagacauccugaaagaaggugcagaggacccaacuauaggcuccacgucgauggagugccccaugguagauag

SEQ ID NO: 248693 - RNA, 1260 nt, Artificial Sequence
  Description of Artificial Sequence: Synthetic coding sequence
augagggggcugcuuguacugagugucuugcugggcgccguguuugggaaggaagacuuugucgggcaccagguacugcgaauuuccgucgccgacgaagcacaggugcaaaaagucaaagaauuagaagacuuggaacaucugcaauuagacuuuuggagaggccccgcccacccaggcucucccauagacguccggguucccuuuccauccauucaggcuguuaaaaucuuccuagagucccacggcauuucauaugaaaccaugaucgaagauguccagagucuguuggacgaggagcaggagcagauguuugccuuuaggagccgggcccgcucuacagauacauucaauuacgcaacuuaccacacguuggaggagaucuacgacuuucuggaccugcuaguugccgaaaacccacaccuggucagcaaaauucagaucggcaacaccuacgaaggccggccaauuuacgugcugaaauuuuccacaggcgguucuaaacgaccagcuauuuggaucgauaccggaauucauucucgcgagugggugacucaggccucaggaguuugguucgcuaagaaaaucacacaggacuauggccaggacgcggcuuucacagcuauccucgacacucuggauauauucuuagaaaucgugacuaauccugacggcuucgcuuucacacacagcacuaaucgaauguggagaaaaacacgaucacacacugcaggcucucucugcauuggcguggacccuaaccguaacugggacgcuggguuugggcucuccggcgcaucgucgaaucccugcagugaaacuuaucaugggaaauucgcaaauucugaaguggaagugaagaguaucguugacuucgugaaagaccaugggaauaucaaagccuuuaucuccauccacaguuauagccaacugcugauguauccuuacggcuacaaaaccgaaccuguccccgaccaagaugaauuggaccaacucucuaaggccgcagucaccgcacuugcaucccuauacggcacuaaguucaacuacggcuccauuauuaaggccauuuaucaggcaucaggaucaacuaucgauuggacauacucccaagguauaaaguacuccuucaccuuugaguuaagagacacaggaagguacggcuuucugcuccccgcuucccaaauaauuccuacagcgaaagaaaccuggcuagcccugcugacaauuauggaacacacccuaaaccaucccuauuag

SEQ ID NO: 248694 - RNA, 1098 nt, Artificial Sequence
  Description of Artificial Sequence: Synthetic coding sequence
auggaccgagcagcccuucugggacuggcaaggcuuugcgcccuuugggccgcacuucucgugcuguucccauauggcgcucaggggaauuggauguggcucggaauugccagcuucggugugccagagaaacuuggaugugcgaacuugccgcugaauucaaggcaaaaggaacuuuguaagcggaaaccuuaucuauugccuagcauucgugagggggcccgacuagggauccaggagugcggaucucaguuuagacaugagagauggaauugcaugaucacugccgcagcaacuacugcacccaugggagcaucaccuuuauucggcuacgagcugagcucuggaacaaaggagaccgccuuuauauacgcugugauggcagcuggacuggugcacucuguuacucgaagcugcucugccggcaacaugacagaaugcucuugcgacacgacacuacaaaacggagguucagccucugaaggauggcauuggggugggugcucggacgaugugcaguacgggaugugguucagccguaaauucuuagauuuuccuaucgggaacaccaccggaaaggagaacaagguccuccuugccaugaaucuccauaacaacgaagccggccgacaagccguugccaaacuuaugagcguagacuguaggugucacgguguuaguggguccugugccgugaagacuuguuggaagacuaugagcaguuucgagaagaucggucaccugcugaaagacaaguaugaaaauagcauccagaucucggacaaaacuaagagaaagaugcggcgaagagaaaaggaccagcggaaaauccccauccacaaagacgaucugcuguauguuaacaaaucuccgaauuacugcgucgaggauaagaaauuggggaucccuggaacgcaaggucgcgaaugcaauaggacaagcgaaggggcggacgguugcaaucuccugugcugugggaggggcuacaacacucacguuguucggcaugucgagaggugugaauguaaauuuaucuggugcuguuacguacgaugccgccggugugagagcaugaccgacgugcacaccuguaaguag

SEQ ID NO: 248695 - RNA, 1581 nt, Artificial Sequence
  Description of Artificial Sequence: Synthetic coding sequence
augggacaccuuuccgcgccucuccaucgaguucgggugccuuggcagggacuacugcuuacagcuucacuccuaacauucuggaacccacccacaaccgcucaacucacuacagaaucaaugccauuuaacgucgcggaaggcaaggaaguucugcugcugguacauaaucugccccaacaguuauucggcuacagcugguacaagggcgaaagaguugaugggaaccggcaaauuguaggcuacgcaaucggaacacagcaagccaccccugguccugcaaauuccggucgggaaacgaucuacccuaaugccagucuccucauccagaacgucacacagaacgacacaggauucuauaccuugcagguuaucaaaucagacuuagucaaugaagaggcaacaggucaguuucacgucuauccagagcuccccaagcccagcauuucgucaaauaacuccaacccuguggaagacaaagacgcgguugcauucaccugugaacccgaaacccaggauaccacuuaucuuugguggauaaacaaucagagccuaccugugagcccaagacuacaauuaagcaaugguaaucggacacuuacacugcuuagcgucacccgaaacgacacagggccuuacgaaugugagauucaaaacccagugagcgccaauagaagugacccuguaacccuuaacgucacguacgguccggauacgccuacuauaagccccagcgauaccuacuaccgccccggagccaaccuuucucugucuugcuacgcugcuuccaauccaccggcccaguacuccuggcucaucaacggaacuuuucagcaaagcacacaagaacuguuuaucccuaauaucacugucaacaauucuggauccuacacaugucacgcuaacaauaguguaacgggcugcaauaggaccaccguaaagaccauaauugugaccgaacugucgccaguaguggcaaaaccccagauaaaggcuaguaaaaccaccgugaccggagacaaagauuccguuaaccucaccugcuccacaaaugacacagggauuucaaucagaugguucuucaagaaccagagccuccccucguccgaacggaugaagcugucccaaggaaacacaacccugucuaucaauccagugaaacgcgaggaugccggcacauacuggugcgagguguuuaauccuauuucuaagaaccagagcgacccaauaaugcugaacguaaauuacaacgcacucccacaagagaaugggcugucacccggggccaucgcaggcaucgucauugguguugucgcucucguugcccuaauagcagucgcacuggccugcuucuugcauuucggcaagaccggacgcgccucugaucagcgcgaccucaccgaacacaaaccauccgucucuaaccacacccaggaccauucuaacgauccaccaaacaaaaugaaugaagugacauacagcacccuaaauuuugaagcacagcaaccgacacagccuacaucugccucccccucccugaccgccaccgaaaucaucuacagcgaaguaaagaaacaguag

SEQ ID NO: 248696 - RNA, 2115 nt, Artificial Sequence
  Description of Artificial Sequence: Synthetic coding sequence
auggucccugauacagccuguguccuacuguuaacucuggccgccuuaggugcaucuggccaaggucagucuccacugggcagcgaucuggguccccaaaugcucagagaacugcaagagacuaaugccgcccuacaggacguacgagagcuucuacgccagcaagugcgcgaaauuacuuuccugaaaaacacagugauggaaugcgacgcuuguggaaugcaacaaucagugcggacagggcucccauccguuagaccacuccugcauugcgcaccugguuucugcuuuccagggguagcaugcauucagacugaaagcggagcucggugcgggccuuguccugcaggauucaccggcaacgggucacauugcaccgauguuaaugaaugcgagaccggucagcauaacugugucccuaauucggucuguauuaacacacgaggaagcuuccagugcgguccuugccagcccgguuuugugggagaucaggcaagugguugccaacgacgcgcucagagauuuuguccugacggcuccccauccgagugccacgaacaugccgauugcguucucgaacgagauggaucccgaagcugcguaugugcgguggguugggccgggaaugguaucuuguguggaagagacacugaccucgacggguucccugaugaaaaguugcgaugucccgagcggcagugucguaaagauaauugugugaccguuccgaacagugggcaggaggacguggaucgcgaugguauaggagaugccugugacccugacgccgacggcgauggcgugcccaacgagaaggacaauugcccccuagugcggaacccagaccaaagaaacacagacgaagacaaauggggggacgcuugcgauaauuguagaucacagaagaaugaugaccagaaagacaccgaccaggacggacggggagaugcuugugacgacgauauagacggagacagaauccgcaaccaggccgauaacugcccucgagugccaaacucugaucagaaagacucugauggcgaugguauuggagacgcuugugauaacugcccccagaaaagcaauccugaccaggcggacguggaucaugauuuugugggcgacgcaugugacagcgaccaagaucaggauggcgacgggcaccaggacuccagagacaauugcccaacaguuccuaacucagcacaggaagacagugaccaugauggacagggagaugcuugcgacgaugaugaugacaacgauggagugccugacucccgagacaacuguagacucgugccuaacccuggccaagaggacgcugaccgagacggggucggcgacgugugccaagacgacuuugacgcggauaagguggucgacaagauagacguguguccagagaacgccgaagugacuuugaccgacuuccgagccuuccagaccguuguacuggaucccgaaggugaugcacagaucgaucccaacuggguaguccugaaccagggcagggaaaucgugcagacaaugaauucugacccaggacuggccguaggguauacugcguuuaacgggguggacuucgaaggcaccuuccauguuaauaccgugaccgacgacgacuacgccggguuuaucuuugguuaccaagacucaucguccuuuuacgugguuauguggaaacagauggagcagacauauuggcaggcgaauccuuuccgcgccguugcugaaccaggcauccagcucaaggcaguaaagagcucaacuggacccggagagcaacuuaggaacgcauuguggcauacaggagauaccgaaagccaagugcgccugcuauggaaagauccuaggaacgugggcuggaaggacaagaagagcuaucguugguuucugcagcaccggccccagguuggcuacauuaggguuagauuuuacgaaggcccagaacugguugccgauucaaacguugugcuggacacaacuaugagagggggaagacuggguguguuuugcuucagccaggagaauaucauuugggcgaauuuacguuaccgcugcaacgacacuauccccgaggacuacgaaacccaccagcugagacaggccuag

SEQ ID NO: 248697 - RNA, 2235 nt, Artificial Sequence
  Description of Artificial Sequence: Synthetic coding sequence
augguccccgacacagccugcguccuccugcuuacccuugccgcucucggcgccuccggacagggacaaaguccgcugggauccgaccugggcccacagaugcugagagagcuucaggaaaccaacgccgcucuccaagacgugcgggaauugcugaggcaacagguacgggaaauuaccuuucucaaaaacaccguuauggaaugugaugccugugggaugcaacagucuguuagaaccggccugccaaguguucggccccugcugcauugcgcuccuggcuucuguuuucccggcccuugccccgcaggauuuacuggcaacggcucucauuguacggaugucaacgaaugcaaugcccacccaugcuucccaagaguccguugcauaaacacuagcccuggguuccggugcgaagcaugucccccaggcuacuccggacccacacaccaggggguuggucuugcuuucgccaaggccaauaaacaggucugcacagauaucaacgagugcgaaacaggucagcacaacugugucccaaauuccgucugcauaaacacgcgcggcuccuuucagugcggcccuugucagccaggauucgugggcgaucaggcaucuggaugccagagaagagcccagcgauucuguccugacgggucucccagcgaaugucaugaacacgcggauugcguccuggaaagagacggaucaagaaguugcgucugugcagugggaugggcggggaacggcauuuuaugcggccgagauacagaccucgacggguuuccagacgagaaacuuagguguccagaaaggcaguguaggaaagacaacugugugaccgugccuaacucaggacaggaggacguggauagagauggcaucggugacgcaugcgauccggacgcugacggagacgguguuccaaacgagaaagacaacugcccguuaguacgcaaccccgaucaacgaaacacugacgaagacaaauggggggaugcuugcgauaauuguagaagccaaaagaacgacgaucagaaagauacugaccaggaugguaggggugaugccugugacgacgauauagauggggauagaaucagaaaccaagccgauaacugcccgcgggugccgaauucagaccagaaggauagcgauggggacggaauuggagaugcuugugacaacugcccucagaagaguaacccugaccaggcggauguugaccaugacuuugugggcgacgccugugauagcgaccaggaccaggacggcgauggacaccaggauuccagagacaacugucccacgguaccaaauuccgcacaggaggauucggaucaugauggacaaggagaugcaugcgacgacgacgaugacaacgaugggguuccugacucacgcgauaacugccgacuagugcccaacccuggacaggaggacgcggaccgagacggcgucggcgaugucugucaagaugacuuugacgccgacaaagugguggauaaaaucgaugugugcccagaaaacgccgaggugacgcugaccgauuuucgcgcauuucagacagucgucuuagacccggagggugacgcccaaauugacccaaauuggguuguucugaaccagggaagagagaucguccagaccaugaauucagacccaggacucgcagucggauacacagccuuuaauggaguagacuuugagggcaccuuucacguaaacaccgugacagacgacgauuacgcgggcuuuaucuucggcuaucaggauuccuccagcuucuaugugguaauguggaagcagauggagcagacauauuggcaggcgaacccuuuuagggcaguggcagagccaggaauucagcuuaaagcagucaagucuagcaccgguccaggcgagcaacuaagaaacgcccuauggcacacaggagauacugaaucgcaaguuagauugcuauggaaagauccacgaaacgucggcuggaaagauaaaaagucuuaccguugguuccuccaacacagaccccagguggguuacauacgagugagguuuuacgagggcccugaacuuguugcagacucuaacgugguacuggacaccaccaugcgcgggggaagauuaggcguguucuguuuuucucaagaaaauauuauaugggccaaccucagauacaggugcaaugauacuaucccagaagauuacgagacucaucaguuacggcaagccuag

SEQ ID NO: 248698 - RNA, 387 nt, Artificial Sequence
  Description of Artificial Sequence: Synthetic coding sequence
augggcauacagggugguuccguacucuuuggccuccuccucgugcuggcgguuuuuugccacuccggccauucucugcagugcuauaauugucccaacccaaccgcugacuguaaaacggcuguaaacuguuccucugauuuugaugcaugcuugauuaccaaggcaggacugcaagucuacaauaaaugcuggaaguucgaacauuguaacuuuaacgaugucacaacccggcugcgggaaaaugagcuaaccuauuauuguuguaaaaaagacuuauguaacuuuaacgagcagcuggaaaauggaggcacaucacucucugagaaaacuguccugcugcuggucacaccuuuucuugcagccgcauggucucuucauccauag

SEQ ID NO: 248699 - RNA, 387 nt, Artificial Sequence
  Description of Artificial Sequence: Synthetic coding sequence
auggguauucagggcggauccguguuauucggcuugcuuuuaguuuuagccguauuuugccacuccggccauucgcuucaguguuacaauugucccaaccccaccgcagacugcaagaccgccgucaacugcuccagcgacuucgacgcuugucugaucaccaaggccggacugcaaguauauaauaaaugcuggaaauucgaacacugcaauuuuaacgacgugacuacuaggcugcgggagaaugagcugaccuacuauugcugcaagaaagaucuguguaacuucaacgagcagcuggagaacggaggcacuagcuuguccgagaaaaccguucuguuacucguuacuccauuucuugcugccgcauggucccuacaucccuag

SEQ ID NO: 248700 - RNA, 387 nt, Artificial Sequence
  Description of Artificial Sequence: Synthetic coding sequence
augggcauacagggaggaaguguacuuuucggccuguuguuaguccuggcuguguuuugccauucuggccacagucuacagugcuacaauuguccaaaccccacugcugacugcaaaacagccgugaacugcucuagugacuucgaugcauguuuaauuaccaaggcaggacuucaaguguacaauaaaugcuggaaauuugaacacugcaauuucaaugacgucaccacacgccuucgcgagaacgaacucacguauuauugcuguaagaaagaucuuuguaauuuuaaugaacaacuggaaaauggcgguaccucccuuuccgaaaaaaccguuuugcuucuuguuacacccuuccuugcugcggcauggagccugcaucccuag

SEQ ID NO: 248701 - RNA, 387 nt, Artificial Sequence
  Description of Artificial Sequence: Synthetic coding sequence
augggaauucaaggcggauccgucuuguuuggccugcugcuugugcuggcaguguuuugccauucugggcacucccugcagugcuauaauugcccaaacccuacugcagauuguaagacugcuguaaacuguucuuccgauuuugaugcuugccuuaucaccaaagcuggccuacagguguacaauaaaugcuggaaguuugaacauugcaauuuuaaugacguuacaacccgccucagggagaaugagcugaccuacuacugcugcaaaaaggacuuguguaacuucaaugaacaacuggaaaauggcggcacuucacucuccgaaaaaacaguccuucugcuuguaacccccuuucuggcggcugcuuggucacuccauccuuag

SEQ ID NO: 248702 - RNA, 387 nt, Artificial Sequence
  Description of Artificial Sequence: Synthetic coding sequence
auggguauucaaggagguagugugcucuucgggcuguugcuaguauuggccguuuucugucacucuggacacucauuacagugcuauaacuguccaaacccgacugcugacuguaaaaccgcugugaauugcaguucggauuucgaugcuugucuuauuacaaaagcaggacuccaagucuacaauaagugcuggaaauuugaacauuguaacuucaacgauguuacaacucgacugagagaaaaugaacugaccuauuacugcugcaagaaagaucuauguaauuucaaugaacagcucgaaaacggcgguacaucacucagcgaaaaaacuguucugcuucuuguaacaccauuccuggcagcugcauggagucuucacccauag

SEQ ID NO: 248703 - RNA, 387 nt, Artificial Sequence
  Description of Artificial Sequence: Synthetic coding sequence
augggcauacaagguggaucuguccucuuuggccugcuucucguccuugccguuuuuugccacucaggucacagccuccagugcuauaauugccccaaccccacggcugauuguaaaaccgcuguuaacuguucaagcgauuuugacgccugucuuauuacgaaagcuggucugcaaguguacaauaagugcuggaaauuugagcauuguaauuuuaacgaugugacuaccaggcuuagagaaaaugaauuaaccuauuacuguuguaaaaaggaccuuugcaauuuuaaugaacagcuugagaacggcggaaccucucuaagugaaaaaacugugcuccuccuugucaccccuuuccuggcagcugcuuggaguuuacaucccuag

SEQ ID NO: 248704 - RNA, 387 nt, Artificial Sequence
  Description of Artificial Sequence: Synthetic coding sequence
auggggauccaaggaggcucuguguuguuuggacugcugcucguguuggccguuuuuugccauucuggacauucucugcaaugcuauaacugucccaaucccaccgccgauugcaagaccgccgugaauuguagcucagacuuugacgcuugucucaucacgaaagccgggcugcagguauacaauaagugcuggaaauuugaacacugcaauuucaaugacgugacuacuagacuucgggaaaaugaguugaccuacuacugcuguaagaaggauuuguguaacuucaacgagcaacucgaaaauggagguacgucccuuucagaaaaaaccguccuauuacugguuaccccguuccuugcugcugcuugguccuugcaucccuag

SEQ ID NO: 248705 - RNA, 387 nt, Artificial Sequence
  Description of Artificial Sequence: Synthetic coding sequence
augggcauucagggcgguaguguuuuauucggacuguuguuagugcuggccguuuuuugccacuccggacauucccugcagugcuauaacugcccaaauccaacugccgauugcaagacagcuguuaauuguucauccgauuucgaugcaugccuuauuaccaaagcuggucugcagguuuacaauaaaugcuggaaguucgagcauuguaacuucaacgacgucacgacccgauugcgcgagaacgagcuuaccuauuacuguuguaaaaaggauuugugcaauuucaaugaacaacucgaaaauggaggaacaagccucagugaaaaaacaguacuccugcucguuacccccuuucuugccgcugccuggucauugcauccguag

SEQ ID NO: 248706 - RNA, 387 nt, Artificial Sequence
  Description of Artificial Sequence: Synthetic coding sequence
augggcauccagggcggcaguguacucuucgggcugcugcuuguguuggccguuuucugccauucuggacauucucugcaaugcuauaauugucccaauccaaccgccgacuguaagaccgccguaaacugcucuucggacuucgacgcaugucucaucacaaaggcaggacugcagguguauaauaaaugcuggaaauucgaacacuguaacuucaacgacgugacaacacgacugcgcgaaaaugaacucacauacuacugcuguaagaaggaucuauguaacuucaacgagcaauuggaaaacggcggaacaucccuuucggaaaagacuguccuuuuacuuguuacacccuuucucgcugcugcauggagccuucaccccuag

SEQ ID NO: 248707 - RNA, 891 nt, Artificial Sequence
  Description of Artificial Sequence: Synthetic coding sequence
augcacagacgcaggucgcggaguugccgagaagaucagaaaccuguaauggacgaccaacgagaccucauuuccaauaaugaacagcuaccaaugcuaggaagaagaccaggugcuccagaaucaaaaugcagccggggcgcccuguauacuggauucagcauccucgugacauugcugcuugcaggucaggcuacuaccgcuuauuucuuguaucagcagcagggccgauuggacaagcucacagucacgucccaaaaucugcaauuggagaaucucagaaugaagcugcccaaaccucccaaaccagugucuaagaugagaauggccacaccacugcugaugcaggcccugcccaugggugcccucccccaagguccaaugcagaacgccacuaaguacgggaauaugacggaagaucacgugaugcaccuacuccaaaaugcggacccucucaaagucuaccccccacucaaaggcagcuucccugaaaaucugcggcaccucaagaacacuauggaaaccauagacuggaagguuuuugaaaguuggaugcaccacugguuauuguucgaaaugucgcgccacucgcucgaacagaagccaaccgacgccccaccaaagguucugacaaagugccaagaagaagucucgcauaucccugccguucacccuggcucuuuucgcccaaaaugugacgaaaauggaaacuacuugccgcuucaguguuauggcaguaucggcuacuguugguguguauuuccuaacggaaccgagguucccaauacucgaagccgggggcaccauaauugcucagagucccuggaauuggaggauccaucuagcggucucggcguaacuaagcaggacuugggcccaguccccauguag

SEQ ID NO: 248708 - RNA, 690 nt, Artificial Sequence
  Description of Artificial Sequence: Synthetic coding sequence
auggccaggcuggcucuguccccaguuccaucucacuggauggucgcucuucugcuguugcuuucagccgaaccagugcccgccgcacgcucugaggauagauacaggaaccccaagggcagcgcuugcagccgcauuuggcaaucaccuagauucauugcgcggaagagggguuucacugucaaaaugcauuguuacaugaacagcgcguccggaaacguuucgugguuauggaaacaggaaauggaugagaauccccaacaacuaaaacucgaaaaaggucgaauggaagagagucaaaaugaaagccucgcaacauugacgauacaagguauacgguucgaagauaacggaaucuacuuuugccagcagaaaugcaauaacacaucugaaguuuaucaaggauguggcacagaauuacgggugauggguuucucaacacuugcacaacugaagcagaggaauacacugaaagacggaaucaucaugauucagacccugcugaucauacucuuuaucaucgugcccauuuuccuucugcuggauaaggacgauucuaaggcuggaauggaggaggaccacacguacgagggacuugauauugaucaaacagcaaccuaugaagacauaguaacgcuuagaacaggagagguaaaauggagugugggggaacauccaggacaggaauag

SEQ ID NO: 248709 - RNA, 687 nt, Artificial Sequence
  Description of Artificial Sequence: Synthetic coding sequence
augcccguaaaaggugggaccaaaugcauuaaguaucuuuuauuuggauucaauuuuauuuucuggcucgccgguaucgccguccucgccauuggccugugguuacgauuugacucccagacuaagagcaucuuugaacaggaaacaaacaauaacaauagcaguuucuacaccgguguguacaucuuaauaggagcgggcgccuugaugaugcucguggguuuucuuggcuguuguggggccgugcaggaaagccaaugcaugcucggcuuauuuuuuggcuuuuuacuugugauauucgcaauugaaaucgcugcagcuaucuggggguacucucacaaggacgaggugauuaaggaggugcaggaauuuuacaaagacacauacaacaaguugaagacuaaggacgaaccucaacgcgaaacucucaaagcuauccacuacgcccucaauuguuguggccucgcagguggaguagaacaauuuaucuccgauauuugucccaagaaagacguacucgagacguucacuguuaaaagcugcccggacgcaauuaaagaaguguuugacaauaaauuucacaucauuggggcaguugguauugguauugcuguuguaaugauauuuggcaugaucuuuucuaugaucuuauguugcgccauccgaaggaacagggaaaugguuuag

SEQ ID NO: 248710 - RNA, 2475 nt, Artificial Sequence
  Description of Artificial Sequence: Synthetic coding sequence
augacuguccuacaagaacccguccaagccgcuauauggcaagcacugaaucauuaugcuuacagagacgccguguuccucgcggaaagguuauaugcagagguacauagcgaagaggccuuauuccuacucgcuaccuguuauuacaggucuggcaaggccuauaaggcauauagacuccugaaaggucauuccuguacaaccccacagugcaaauaccuccucgccaaaugcugugucgaucugucuaagcuugcugaaggagaacagauucucucuggcggcgucuuuaacaaacaaaagagccacgacgacauuguaaccgaguucggagacucugccuguuucacucugucacuguuaggacacgucuacuguaagacggaccgccucgcuaagggcagcgaauguuaccaaaaaagcuugucucuuaacccuuuccuguggucucccuucgagucccucugcgagaucggugagaaaccugauccggaucaaacuuucaaauucacuucccuccaaaauuuuaguaauugucuccccaauaguugcacuacacaggucccaaaucauucccucagucaucgccagcccgaaacugugcucacagaaacuccacaggacaccauugagcucaauaggcugaacuuagagagcuccaacuccaaguauucccucaacacugauuccuccguguccuauaucgauuccgcuguuaucagcccugacaccgucccguugggcacugguacaucaauucuuucuaaacagguacagaauaagcccaagacaggccgcucccugcucggaggcccugcugcacuguccccucugacucccucauucggaauccucccacuggaaaccccaagccccggcgacggaagcuacuugcagaacuauacuaauaccccuccuguaauugaugucccuagcaccggcgcccccucuaagaagagcguugccaggauuggccaaacugggaccaaaucagucuuuucgcagucugggaauuccagagaggugacaccaauucuugcccagacacagucaucaggaccccaaacaucgacgacaccccagguacuuucacccacaauuacaucuccgcccaacgcccugccacgccgaagcagcagacuuuucacaagugauucuucuaccaccaaagaaaacaguaaaaaacugaaaaugaaauuuccucccaagauacccaauagaaagacgaagucaaagacaaacaaaggagguauuacucaacccaacaucaacgauucccuggaaaucaccaagcuugacagcaguauaauauccgaagguaaaauaucaacuauuacgccucagauucaggcuuuuaaccuucagaaagcagccgcugagggacugaugucccuucugcgagagaugggaaaagguuaccuugcccucuguagcuacaauuguaaagaagccauaaacaucuugucccaccuaccaucacaucauuauaauacaggauggguauuaugccaaaucggacgggccuauuuugaacucagugaguacaugcaggccgagcguaucuuuucagagguaagacgaauugagaacuaccgcgucgaaggcauggaaaucuauucuacaacacuguggcaucuacaaaaagacguggcgcugagcguccugucaaaagaccuaacugauauggacaaaaauagcccagaagcauggugcgcugccggaaacuguuucucccugcagcgggagcacgauauagccauuaaguuuuuccaacgagcgauucaaguggaccccaacuacgccuacgcuuacacccuccugggucacgaguucguccugacagaagagcuugacaaagcgcucgccugcuucagaaacgccauuagagucaauccgcgccauuauaacgcuugguauggccuggggaugaucuauuauaaacaagagaaauucucccuugcugagaugcacuuccaaaaggcuuuggauaucaacccucaaucgagcgucuuacugugccauaucggcgucgugcaacacgcccuaaaaaaauccgaaaaagcacuugacacccuaaauaaagccauuguaauugaccccaaaaauccacucuguaaauuucaccgcgcuuccguuuuguuugcuaacgagaaauacaaaagugcauugcaggaauuagaagagcugaagcagaucgugccuaaagagucacuaguauacuuccugauaggaaaaguguacaagaaacucggacagacccaucuugcgcucaugaacuucuccugggcuauggaccuggacccuaaaggugcuaacaaccagauuaaggaagcuauagacaagagauacuugccggacgaugaggagccuauaacacaagaggagcagauuauggggacagacgaaagccaagagaguaguaugaccgacgcagacgacacucaacuccacgccgcagaaucagaugaauuuuag

SEQ ID NO: 248711 - RNA, 342 nt, Artificial Sequence
  Description of Artificial Sequence: Synthetic coding sequence
augaaaguuuccgucgcugcccuuucuugucucaugcuggucgccguucugggcucccaggcacaguuuaucaacgacgcugagaccgagcugaugaugagcaaacugccucuggaaaaccccguggugcuaaacuccuuccauuuugcugccgacugcugcaccuccuauauuucccaaucaauuccuuguucucugaugaaaaguuacuucgaaacgaguuccgagugcuccaagccaggaguuaucuuccucacaaaaaaagguagacaggucugugcaaaacccagcggccccgggguccaggauugcaugaagaaacuuaaacccuacucaauuuag

SEQ ID NO: 248712 - RNA, 186 nt, Artificial Sequence; identical to SEQ ID NO: 248106
  Description of Artificial Sequence: Synthetic coding sequence

SEQ ID NO: 248713 - RNA, 342 nt, Artificial Sequence
  Description of Artificial Sequence: Synthetic coding sequence
augaagguaucuguggcugcucucuccugccuuaugcucgucgcggugcuaggcucccaggcucaguucaucaaugaugccgaaaccgaacuaaugauguccaaauuaccacucgaaaacccagucguguuaaauucuuuucauuucgcugccgacuguugcacaucuuauaucucacagucuauccccugcucacucaugaaguccuacuucgagaccucgucugaguguaguaagccagggguuauuuuccugacgaagaagggacgucaagugugugcuaaaccaucagggcccggcguccaagauugcaugaaaaaguuaaagcccuauagcauauag

SEQ ID NO: 248714 - RNA, 342 nt, Artificial Sequence
  Description of Artificial Sequence: Synthetic coding sequence
augaagguaucaguggccgcucuaaguugccuuaugcuagucgcgguccucggcagccaggcccaguucaucaacgacgcagaaacagagcuuaugaugaguaagcugccacuggagaaccccguuguccuaaauucguuccacuucgccgcagauugcuguacuuccuacaucucgcagucuauccccuguucacuuaugaaaagcuacuucgaaaccucuucugaaugcucuaagccaggagucaucuuucucacaaagaaggggagacaaguaugcgccaagccuuccgguccgggcguccaagauugcaugaagaaacugaagccguacuccauuuag

SEQ ID NO: 248715 - RNA, 270 nt, Artificial Sequence; identical to SEQ ID NO: 248109
  Description of Artificial Sequence: Synthetic coding sequence

SEQ ID NO: 248716 - RNA, 285 nt, Artificial Sequence; identical to SEQ ID NO: 248110
  Description of Artificial Sequence: Synthetic coding sequence

SEQ ID NO: 248717 - RNA, 384 nt, Artificial Sequence
  Description of Artificial Sequence: Synthetic coding sequence
augcagcagcgcggacucgccaucgucgcucucgcaguaugugcugccuuacacgcuagcgaagcaauccucccaauugcgucgucuugcuguacagaaguuucucaccacauuucgagaagacuccuugagagagugaauaugugcaggauacagagggccgacggagauugcgaucuugccgcggugauccuccaugucaagcgaaggagaauaugcguuuccccccauaaccacacagugaaacaguggaugaagguccaggcggcaaagaagaacgggaaagguaaugugugccauagaaagaagcaccacggaaagaggaauaguaaucgagcucaccagggaaaacaugagacguacggacacaaaacaccauacuag

SEQ ID NO: 248718 - RNA, 384 nt, Artificial Sequence
  Description of Artificial Sequence: Synthetic coding sequence
augcagcagcggggacuagcuauagucgcacuugccgugugugcagcccuccaugcuuccgaagcuauacuucccauagccaguagcuguugcacugaggucucccaccauaucucaagaaggcuguuagagagggucaauaugugucgaauucagagagcagacggggauugugaucucgccgccguaauuuuacacguaaaacgucgaagaaucugcguaucaccucauaaucauacaguuaagcaguggaugaaaguacaagccgcaaagaagaacgguaaaggcaacgucugucauagaaaaaagcaccauggcaaaagaaacucaaacagagcccaucaaggaaagcacgagacauacggccacaagaccccuuacuag

SEQ ID NO: 248719 - RNA, 243 nt, Artificial Sequence; identical to SEQ ID NO: 248113
  Description of Artificial Sequence: Synthetic coding sequence

SEQ ID NO: 248720 - RNA, 354 nt, Artificial Sequence
  Description of Artificial Sequence: Synthetic coding sequence
augcaacagagagggcuagcaauuguggcucucgccguuugcgccgcacuacacgcguccgaagccauccugccaaucgccuccuccuguuguacagaaguaucucaucauaucucccgaaggcugcuugagagagugaauaugugcagaauccaacgcgccgauggugacugugaucucgcggccgugaugcuggaauguagcgauaugaucuccgcccauuauaaucuucaccucccagguuccaaugacucuccgaccuccgccuuccagguggccggaauuaccgcuuucaugagcucugccgaagaauccguuucagcucgaaccaccauacuccucucuucuggguag

SEQ ID NO: 248721 - RNA, 1194 nt, Artificial Sequence
  Description of Artificial Sequence: Synthetic coding sequence
auggcccccauaucauuauccuggcugcuuagacuggcuacauuuugccaucuuaccguucuuuuagccggccaacaucauggggugacaaaaugcaauauuaccuguuccaagaugacaucgaagauacccgucgcacuacucauccauuaccagcagaaucaggccagcugcgguaagcgagcgauuauccuggagacccgacagcauaggcucuucugugcagaccccaaggagcagugggugaaagaugccaugcaacaccuagacagacaggcugccgccuugacucggaauggagggacauucgaaaaacagauaggugaagugaagccaaggaccacccccgccgcuggcggaauggacgagagugugguacuggaaccggaagcgaccggggaaucuuccagucuggaaccaaccccuagcucccaagaggcccagagagcucucggaacuaguccugaguugccuacuggagugacaggaucaaguggcacccggcugccuccaacccccaaagcccaggauggcgggccuguggguacagaacucuucagagugccccccgucuccaccgccgccacauggcaaucauccgcuccccaucagccaggaccuagucuuugggccgaagcuaaaacuuccgaagcaccaagcacccaagacccgucgacucaggcuucuaccgccuccagcccagcgcccgaggaaaaugcuccauccgaaggucagagagucuggggacagggacagucuccuagacccgaaaauagcuuggagagagaagagauggguccugugccugcucauacugaugcuuuccaggacuggggccccgguagcauggcacacguuucuguggugccugucucgagcgaagggacuccaucuagagaaccugucgcuagcgguucuuggacaccaaaagcugaagaacccauccacgccacuauggauccccagcggcucggaguucugauuacucccgugccugacgcccaagccgcgacucgcaggcaggcugucgggcuucuagcauuucugggucugcuguucugucucgguguagcaauguucaccuaccagucgcuccaagggugcccuagaaaaauggcaggcgaaauggcugaaggucuucgauacaucccacgcuccugugguucaaauaguuacguccugguucccguguag

SEQ ID NO: 248722 - RNA, 285 nt, Artificial Sequence; identical to SEQ ID NO: 248116
  Description of Artificial Sequence: Synthetic coding sequence

SEQ ID NO: 248723 - RNA, 285 nt, Artificial Sequence; identical to SEQ ID NO: 248117
  Description of Artificial Sequence: Synthetic coding sequence

SEQ ID NO: 248724 - RNA, 1431 nt, Artificial Sequence
  Description of Artificial Sequence: Synthetic coding sequence
augacuaagcucauucucuugacaggacugguccugauacugaaucuccagcucggcagugcauaccaacuaaccuguuacuuuacuaacugggcucaauacaggccuggccugggccguuucaugccugauaauauugacccuugccuuuguacacacuugauuuaugcuuucgcgggcagacaaaauaaugaaaucaccacgaucgaauggaaugacgugacccuguaccaagccuucaacggucugaagaacaaaaacucucagcucaagacgcuucucgcaauuggcggguggaacuuugggaccgcgccuuucacagcuaugguuuccacacccgagaaucgccaaacuuucauuacauccguaauaaaauuuuugcgccaguaugaauuugacggccuggauuucgacugggaguacccugguaguagaggcucuccaccccaggacaaacauuuguuuacuguacuaguccaagaaaugcgggaagccuuugaacaggaagccaaacaaauaaauaaaccccgucucauggucaccgccgcgguugcugccgggauuagcaacauucagagcggauaugaaaucccucaacugucccaauaccuagacuauauacacgugaugaccuacgaccuucaugguaguugggaagguuacacaggcgagaacucaccacuguacaaguacccgacugacacuggauccaacgccuacuugaacguugacuacgugaugaacuacuggaaagauaacggcgcaccugcagaaaagcuuaucguaggauuucccaccuauggucacaauuuuauucucaguaauccaagcaauacaggaaucggggcacccacaagcggagccggccccgccgggccuuacgcgaaggaaagcgguauaugggcuuacuacgagaucugcaccuuucuaaaaaacggcgcaacacagggaugggaugcuccacaagaagugccauaugccuaccagggcaaugugugggucggcuacgauaauauuaaaaguuuugauaucaaggcucaauggcuaaagcacaauaaguuuggcggagccauggugugggcaauugaccucgaugauuucaccggaaccuucugcaaccagggcaaauuuccuuuaauuucuacguugaaaaaagcacugggcuuacagagugcuagcuguaccgcucccgcacagccaaucgagccgaucaccgcagcaccuucgggaucugggaaugggagcggauccuccaguuccggugguucuucugggggauccgguuucugcgccguacgagcuaauggucucuacccugucgcgaacaauagaaacgcguuuuggcacuguguuaacggagucaccuaccaacaaaauugucaagcaggucugguguuugacacaucuugcgauuguugcaacugggccuag

SEQ ID NO: 248725 - RNA, 948 nt, Artificial Sequence
  Description of Artificial Sequence: Synthetic coding sequence
augcgcgaggccuuugagcaagaagccaagcagauuaauaagccgcgccucauggugaccgcugccguagccgccggaauaucuaacauucaaucuggauacgaaaucccgcaauuaucucaauaccuugauuacauccacgugaugacauacgaccuucauggcagcugggaaggcuacacgggagaaaacuccccauuguacaaauaucccacagauacaggcucaaaugcuuaccugaacguugauuaugugaugaacuacuggaaagauaauggcgcccccgcagagaaacugaucgugggauuuccaaccuacggucauaauuuuauccugagcaauccaucaaacacuggcaucggagccccaacuagcggggccgguccggcaggcccuuacgccaaggaaucaggaaucugggccuauuacgaaaucugcacuuuuuugaaaaauggcgccacacaggggugggaugcaccgcaggaagugccuuaugcauaucaaggaaacguuuggguggguuacgacaacauuaagucuuucgauauuaaagcacaaugguuaaaacacaacaaauucgggggagcuauggucugggcuaucgaucuggacgacuucacuggcaccuuuuguaaccaaggaaaauuuccacuuaucaguacgcucaagaaggccuuaggauugcagucugcaucauguaccgcccccgcucaaccaaucgaacccaucaccgcagcacccagcggcaguggaaacggguccggauccagcagcucuggggggagcuccggagggagcggcuuuugugcuguccgugcgaauggcuuauaucccgucgcuaauaaucgaaaugcuuucuggcauuguguuaaugguguuaccuaucagcagaauugccaagcugguuuggucuucgauaccucaugugauugcuguaacugggcauag

SEQ ID NO: 248726 - RNA, 1431 nt, Artificial Sequence
  Description of Artificial Sequence: Synthetic coding sequence
augaccaaacuaauucugcugaccggacucgugcugauucucaaccuccaacuugguagcgcauaccaguugaccuguuacuucacaaacugggcucaauaccggcccggacuggggagauuuaugcccgauaauauugacccaugucuauguacccaccuuaucuaugcauucgccggacgacagaauaacgaaaucacaacaauugaguggaacgacgugacccuuuaucaagccuuuaauggacugaagaauaagaauucccagcuuaaaacccuccuggccauugguggauggaacuucgguacagcucccuuuaccgccauggucagcacgccugaaaaucgucaaaccuuuaucacuucagugaucaaguucuuaaggcaguacgaguucgacggucucgauuucgacugggaguauccggggucacguggcucacccccacaagacaaacaccucuuuaccguguuggugcaggagaugcgcgaggcauucgagcaggaggcgaagcagauaaacaagcccagacuaaugguuacagcagcuguugcagccgggauuaguaauauacaaucaggauacgaaauuccacaguugucucaguaccuggacuauauacacguuaugacauaugaucuccacgggagcugggagggcuauacaggcgagaacagccccuuguacaaauaccccacagacacuggaagcaaugccuaucuaaacguugauuaugugaugaacuauuggaaagacaacggcgcaccugcagagaaguuaaucgucggguuuccuacauauggucauaauuuuauccugucaaaucccuccaacacuggcaucggugccccaacaucuggcgcagguccugcugguccuuacgccaaagagucaggcauuugggcguacuaugaaaucugcacauuuuugaaaaacggcgccacacagggcugggaugccccacaagaaguuccuuacgccuaccaagggaacguuuggguuggauaugauaauaucaaguccuucgauaucaaagcacaauggcugaaacacaauaaauucggcggcgccauggugugggcuauagauuuggaugacuucaccggaaccuucugcaaccaaggcaaauucccacuaaucuccacccuuaaaaaagccuugggccuccaguccgccagcuguacugcuccagcccagcccaucgagccaaucacagcagccccaagcggcucuggaaacggcuccgguucuucuagcucuggaggaucuucugggggaucuggguuuugugcagugcgagcaaauggauuguauccaguagcaaacaacaggaaugcauuuuggcacuguguuaauggagugacuuaucagcaaaauugucaggccggauuagucuucgacacuucaugcgacugcuguaacugggccuag

SEQ ID NO: 248727 - RNA, 1263 nt, Artificial Sequence
  Description of Artificial Sequence: Synthetic coding sequence
gaaacuucuucaagcgugcacgaacagguugcagauucaggggcccaggcgguagcuuuccagagugguggcgaauccucaaucguuuggaacucucagcugaaaacucugcuugcuauuggcggauggaauuucggcacagcuccauucaccgcuaugguguccacccccgaaaaccgacagaccuuuauuaccagugugauuaaauuccugcgacaauaugaguucgacgguuuagauuuugauugggaguaucccggaagucgcggcucaccuccucaggacaagcaccucuucacaguuuugguccaagaaaugagagaagccuucgagcaagaggccaagcaaauuaacaaaccccgucuaaugguaacagccgccguggccgcaggcauuagcaauauucaguccgguuaugaaaucccccaguugucccaguaucuagacuacauacacguaaugaccuaugaucugcacgggucgugggaaggguacaccggggaaaauaguccucucuauaaguacccuacagacacggggagcaacgcuuaucucaauguagacuauguuaugaauuacuggaaagacaauggcgcacccgccgaaaaacugauuguggguuuucccacguauggacauaauuucauacuuucaaacccgucuaacacaggcaucggcgcaccaacuuccggcgcagguccggccggcccuuaugcuaaggaaucaggaaucugggcauauuacgagaucugcacguuuuuaaaaaauggagcuacccaaggcugggaugcaccucaggaaguucccuacgcauaccagggaaauguauggguuggcuacgacaacauuaaaaguuucgauaucaaggcgcaguggcuuaagcauaacaaauucgguggggcaauggugugggccaucgaucuggaugacuucaccggaacauucuguaaccaagguaaguucccacuuauaucuacacugaaaaaagcucucggcuugcaguccgcguccuguacagccccagcccaaccaauugagccuaucacagccgcccccucuggaagcgggaacggaucuggcucuuccucaucaggaggcagcagcggcgguuccggcuucugcgcagucagggccaauggacuuuacccaguugcaaacaaccgaaaugccuucuggcacugugucaacggggucaccuaccaacaaaacugccaggccggccucguauuugauacaucuugugacuguuguaacugggccuag

SEQ ID NO: 248728 - RNA, 1107 nt, Artificial Sequence
  Description of Artificial Sequence: Synthetic coding sequence
augguuucuacaccagagaacagacagacuuuuaucaccucuguaauuaaauuccucagacaguaugaauuugacggucuggacuucgauugggaguauccaggcucccgggguagcccaccacaggauaagcauuuauucacaguucugguacaggagaugcgcgaagcguucgagcaggaagcgaaacaaauuaacaagcccagguugaugguaacagccgcagucgcugccggaaucuccaacauccagucagguuaugagaucccgcagcucagccaauaccuggauuauauucacgucaugaccuacgaucuucacgguaguugggagggguauacuggagaaaauaguccgcucuauaaguacccuacugauaccggaagcaaugccuauuuaaaugucgacuacgucaugaauuauuggaaagauaauggcgcccccgcugagaaacugauuguugguuucccaaccuauggccauaacuuuauuuuguccaauccgucuaacacuggcaucggugccccaacgucaggagcuggacccgccgggccuuacgcaaaggaaucagguaucugggcauacuacgaaauuuguaccuuccuuaaaaauggcgccacccaggguugggaugcaccucaggaggucccuuaugcuuaucagggcaacgucuggguggguuacgauaauaucaagagcuuugacauuaaggcacaguggcucaagcauaacaaguuuggcggggcgaugguuugggcaaucgacuuggaugauuuuacugguacuuucuguaaucagggaaaguucccccucauuuccacacucaagaaggcuuuaggccugcagucagccucaugcaccgcuccugcucaaccuauagaaccaauuacagcggcccccuccggaucagguaauggaagcgggucaucguccaguggcgggucaucaggcgguaguggguuuugugccguccgagcuaacggccuuuacccaguggcuaacaaccgaaacgcuuuuuggcacugugugaauggugucacuuaccagcagaacugccaagcaggacuuguuuuugauacaucaugugacugcuguaauugggccuag

SEQ ID NO: 248729 - RNA, 948 nt, Artificial Sequence
  Description of Artificial Sequence: Synthetic coding sequence
augcgcgaagccuucgagcaggaagcaaagcagaucaauaaaccccgucugaugguaacagccgcggucgcugcagggauuucgaauauacagucuggcuaugagaucccacaacuuagccaguaccuagacuauauccacguaaugacauaugaccuccacgggaguugggaaggauauaccggcgaaaacuccccacuguacaaauaccccaccgauacaggaucaaacgcguaccugaaugucgacuaugugaugaacuauuggaaagacaauggagcaccugccgagaaacugauugugggguucccaacauacgggcacaacuucauucuuagcaauccgagcaauacagguaucggcgccccaacuagcggagcagggccagcaggccccuaugcgaaggagucaggaauuugggcuuacuacgagauuugcacuuuccuuaaaaauggagcuacacagggcugggacgcaccacaagaagugcccuacgccuaucaagguaacguaugggugggguacgauaacaucaaauccuucgauauaaaagcacagugguugaagcacaacaaguuuggcggcgcaaugguuugggcaauugaccuugacgauuuuacaggcacauucuguaaccagggcaaauuuccacugauaucuacccuaaaaaaagcacugggauugcagagugcuaguuguacagcgccagcucagccaaucgaacccaucaccgcagcuccuagcggaucuggaaacggcuccggcucgaguucaucuggaggaucaagcgggggaucuggauucugugccguacgcgccaauggacuauacccaguugcaaacaauagaaaugcuuucuggcauugcguaaauggagucacauaccagcagaauugccaggccggauuaguuuucgauacauccugugacuguugcaacugggcuuag

SEQ ID NO: 248730 - RNA, 948 nt, Artificial Sequence
  Description of Artificial Sequence: Synthetic coding sequence
augagagaagcauucgagcaggaggcaaaacagauaaauaagccccgucugaugguuacggcggccgucgcugcuggcauauccaacauccagagcggcuacgagauuccgcaguuaagccaauaccucgauuauauacaugugaugacuuacgauuuacacggcagcugggagggcuacacuggcgagaacuccccauuauacaaguacccaacugacacuggcuccaacgccuaucugaaugucgacuacguaaugaauuauuggaaagacaacggugcccccgcagaaaaguugaucgucgguuuuccgacauauggacacaauuuuauccugagcaacccuucaaauacuggaauaggagcuccuacgucgggagcaggaccagccggaccauaugcaaaggaaucugggauaugggcuuauuaugaaaucugcaccuuccuuaagaauggagcuacucaaggcugggacgcaccccaagaagugcccuaugcauaccaagggaauguauggguaggcuacgauaacaucaaaucauucgacaucaaagcgcaauggcugaagcauaacaaguuuggcggggcuaugguuugggcaauugaucucgaugacuuuacugguaccuuuugcaaucaggguaaguuuccacuaauuuccacacugaagaaagcacugggcuuacagucagccucuuguaccgccccagcccaaccgaucgaaccuaucacagcugccccuucaggcucuggcaacggcucagggucgucgucuucaggugguuccucuggcggaucuggguucugcgcuguaagagcuaauggccuguacccugucgcgaacaaccgcaaugcauuuuggcacugcguaaauggcgucaccuaccagcagaauugucaagcgggacucgucuuugacaccucuugugacugcugcaacugggcuuag

SEQ ID NO: 248731 - RNA, 864 nt, Artificial Sequence
  Description of Artificial Sequence: Synthetic coding sequence
augagagaagcuuucgagcaggaagcaaaacagauaaauaaaccccgacugauggucaccgcagccguggccgcuggcauuaguaauauucagucuggcuaugagaucccccaacugucucaguaccuugacuacauucacgugaugacuuacgaccuucacggaucaugggaaggcuacaccggagagaacaguccucuguacaaguacccaaccgacacaggauccaacgcauacuugaacguagacuacgugaugaacuacuggaaggacaauggagcccccgccgaaaaauuaauaguggguuucccuacauacgggcacaauuuuauucucagcaacccauccaacaccggcaucggugcgccuaccagcggcgccggccccgcuggccccuaugccaaagaaagcggaauuugggcauacuacgaaaucuguaccuuccugaagaauggagccacccaggguugggaugcaccucaagaggucccuuaugcauaccagggcaacguaugggucgguuacgauaacaucaagucguuugauaucaaagcucaaugguuaaaacacaacaaauucggaggagcuauggucugggcuaucgacuuggacgauuuuacagggacuuuuugcaaucagggaaaguuuccgcuaauaucuacccuaaagaaggcauuagggcuucaaucagccaguuguacagcaccugcucagccaaucgaacccaucaccgcagcgcccagugggaguggcaauggauccggaucaaguagcagcgguggaucgucugggggcuccggauucugcgcaguacgggcuaacgggcuguauccggucgccaacaacagaaacgcguuuugguag

SEQ ID NO: 248732 - RNA, 2319 nt, Artificial Sequence
  Description of Artificial Sequence: Synthetic coding sequence
augagacuguccucccuccuggcucucuuaagaccugcacugccguugaucuugggauugagucuuggaugcucccuuucccuacugcgcguuagcuggauucagggcgaaggcgaagacccuugcguagaagcgguuggggagagaggagguccccagaacccagacucacgagcuagacucgaccagucugacgaggacuuuaagccccguaucgugccauauuaucgagauccuaacaaacccuacaagaaggugcucaggacccgguacauucagacagaacuuggcucuagagagcgccuccuuguggccgugcugaccucccgcgcaacccugucuacucuugcuguggccgucaaucggacaguugcucaucacuucccccgucuccucuauuucaccgggcagcguggcgcaagagccccagcuggcaugcagguggugucccacggagaugaacgccccgccuggcugauguccgagaccuuacgccauuuacauacacacuucggcgcagacuacgacugguucuucauaaugcaggaugacacguaugugcaagcaccgcgacucgcugcacucgcaggucaucugaguaucaaucaggaucuuuacuuagguagggcggaagaguuuauuggcgccggagagcaggcaagguacugucauggcggguucggauaccuacucucaagaagucuacugcugcgucuuagaccacaccuggauggcugcagaggagacauacucucagcucgccccgacgaguggcuuggcagaugccugauagauagucugggagucggcugcgugucacaacaccaaggucagcaguaccguuccuucgagcuagcgaagaaccgcgauccugagaaagaaggguccucggcuuuccugucagccuucgcuguucauccaguguccgaagguacacugauguaccgcuuacacaaacgguuuucggcccucgaacuagaacgcgcauacuccgagauugaacaacuucaggcacagauuaggaaucugacaguguugacacccgaaggggaagccggccuaaguuggccugucggccuuccagcgcccuucacgccacacucccgguuugaaguuuuaggaugggacuacuuuacugagcagcacacauucucuugcgccgauggugcaccuaaguguccacuccagggagcuagcagagccgacguuggcgacgcucuagagacagcacucgagcaguugaaccggcgcuaucaaccaaggcugagguuccagaaacagagacuucuuaauggcuaccggagauucgaucccgcaagggguauggaguauacccucgacuugcugcuugaaugcguuacacaacgcggccauagacgugcguuggcccguagagucagccugcuuagaccgcugagucgcgucgaaauccucccuaugcccuaugucaccgaggccacacgaguccaacucguccuaccccugcuggucgccgaagcagcugcagcaccugcauuucuggaagcauuugcugcaaacgugcucgaaccucgggaacaugcccugcugacccuguugcugguauacggcccgcgcgagggaggccgaggcgcaccugacccuuuuuugggcguuaaagccgcugcugcugaacuggaaaggcgauacccuggaacacgacuggcauggcuggcagugcgcgccgaagcuccgucccagguuagguugauggacguugugaguaaaaaacacccuguggacacacuuuuuuuucuaaccacggucuggacccggccgggaccagagguacugaaucguuguaggaugaacgccaucucugguuggcaagccuuuuuccccgugcauuuucaggaauucaaccccgccuugaguccgcagcguagccccccuggaccacccggcgccggacccgaccccccuagucccccaggugcugacccaucccguggagccccaaucggagggcgcuucgacaggcaggcuagugcagagggaugcuucuacaaugcagacuaucucgccgcccgcgcacggcucgccggggagcucgccggucaggaagaggaggaagcacuagagggucuggaagugauggacgucuucuugagauucagcggucuucaucucuuucgggcaguugagcccggcuugguucagaaauuuucucuacgcgacuguagcccacguuugagcgaagaacuuuaucauaggugucgucuuaguaaucuagaaggacucgguggacgagcccaacuggcuauggcucucuucgagcaggaacaagccaauuccaccuag

SEQ ID NO: 248733 - RNA, 654 nt, Artificial Sequence
  Description of Artificial Sequence: Synthetic coding sequence
auggcucccgggucucgaacaucccuucuacuggccuucgcucugcuuugucugccauggcugcaggaggcaggagcaguccagacaguaccauugagcaggcuguuugaccaugccaugcuacaggcacaccgagcucaccaguuggccauugacacauaucaagaauucgaagaaaccuauauccccaaggaccagaaguauagcuuccugcacgauucucaaaccuccuuuugcuuuagugauuccaucccaaccccgucuaauauggaagagacacaacaaaaaucaaaucuggaacugcuccguauaucucugcuacugaucgagaguuggcuggaaccuguucguuucuuacguucuauguucgccaauaaucugguuuaugacaccucagacagugacgacuaucaccuauuaaaggaucuggaggaggggauccagacucucaugggacgcuuagaagauggcucacggagaacaggucaaauacugaaacaaacauauaguaaauucgacacaaauucacacaaucacgacgcacuauuaaagaauuauggucugcucuacuguuuucgcaaggauauggacaaagucgagacuuucuuaaggaugguucaauguaggucuguggaaggaucauguggguuuuag

SEQ ID NO: 248734 - RNA, 771 nt, Artificial Sequence
  Description of Artificial Sequence: Synthetic coding sequence
auggcuccuggcaguaggaccucucuucuucucgcauuugcucucuugugucuuccuuggcuucaagaagccggugccgugcagaccgugccucugagccgccuguucgaccaugccaugcuccaggcccaccgugcccaucagcuggcuauugauacguaucaggaauuugaagaaaccuacaucccuaaggaccagaaguacuccuuccuccaugacucccagacguccuuuugcuucagcgacagcaucccuaccccuucuaauauggaagagacccagcagaaaaguaacuuagaacuguugcguauuucucuccugcuuaucgaaagcuggcuggaaccagugcgauuccugcgcucaauguuugcaaauaaccugguguacgauacuucugacuccgacgauuaccauuuacuuaaggaucuggaggaaggcauucaaacucucaugggugugcgcguggcaccaggaguuacaaacccuggcacgccuuuagcuucaagagcaggcggagagaaguacugcuguccucucuuuaguuccaaagcccucacacaagaaaacuccccauauuccucauuuagacuggucaacccgcccgggcugucccugcauccugaaggagaaggaggaaaguggaucaacgaacgcgguagggaacaauguccuucagcguggccacuucuuuuauucuugcauuuugcugaagcgggccgcaggcagccgccagacugggccgauccccaggccgauuugcagcaggucuag

SEQ ID NO: 248735 - RNA, 369 nt, Artificial Sequence
  Description of Artificial Sequence: Synthetic coding sequence
auggcacccggcaguagaacuagccuccugcucgccuuugccuugcugugucuccccugguugcaggaagcuggcgccguacagacaguuccguugucacgucuauucgaucacgcaaugcuccaagcacaucgggcucaccaacuggcgauugacaccuaucaggaauuccgccuugaagacggcagcaggcgcacuggacagauacuuaaacagacuuauucaaaauucgacaccaauucucauaaucacgacgcucugcugaagaauuauggacuccuguauugcuuuagaaaggauauggauaaaguggagacguuccugagaauggugcaaugcagaucuguggaggggagcuguggauuuuag

SEQ ID NO: 248736 - RNA, 552 nt, Artificial Sequence
  Description of Artificial Sequence: Synthetic coding sequence
auggcucccgguucucgaaccaguuuauugcuggcuuuugcucugcugugccugcccuggcugcaagaagccgagaccuacaucccuaaagaucagaaguauucuuuucuccacgacucucaaacauccuucugcuuuuccgacuccauuccuacgccuucaaacauggaggagacccagcaaaaaagcaaccuggaacuucugcggaucucucucuugcucauugaauccugguuggaacccguccgauuuuuacgcagcauguucgcuaacaaccugguuuaugacacaagcgacuccgaugauuaccaucugcugaaggaccucgaagagggaauucaaacucucaugggacggcuugaagauggcucacgcagaaccggacagauacucaagcaaacuuacucuaaauuugacaccaacucccacaaucacgacgcccugcuuaagaacuauggauuacuauauugcuuucggaaggauauggauaaaguugagacguuucuccguauggugcaaugucgcucaguggaggggucuuguggcuucuag

SEQ ID NO: 248737 - RNA, 504 nt, Artificial Sequence
  Description of Artificial Sequence: Synthetic coding sequence
auggcagcuggaaguagaacauccuuacucuuggcuuuugcccuauuaugucucccuuggcuacaagaagcaggagccgugcaaaccgucccucugagucgccuuuuugaucaugccaugcuucaagcgcaucgcgcucaccagcucgccauugacacauaucaggaauucgaggaaacuuauauccccaaagaucagaaauacuccuuucuucacgacucccaaacguccuuuugcuuuagugacuccauccccacccccuccaauauggaagagacccagcagaagucgaaucuggaacuguugcgaaucucccuccuguuaauugaaagcuggcuggagccggugcgcuuuuuacggucaauguuugccaacaaucuaguguaugauacauccgauagcgacgauuaucaucugcucaaagacuuggaagaggggauccaaacacuuaugggaguuaggguggcaccaggcguggcuaaccccggcacaccuuuggcguag

SEQ ID NO: 248738 - RNA, 369 nt, Artificial Sequence
  Description of Artificial Sequence: Synthetic coding sequence
auggcugcaggcucacgaacaucacuccuguuagccuuugcgcuucuaugcuuaccaugguugcaagaagccggagcugugcaaacagucccccuguccagauuguucgaccacgcuaugcugcaggcacacagggcacaucagcuggcuaucgacaccuaucaagaauuccgguuagaggacgggucuagaagaacagggcaaauccugaagcagacuuacucuaaauuugacacgaacucccauaaccacgacgcacuccugaagaauuauggucucuuguauugcuuuagaaaagacauggacaagguagaaacuuuuuuacguaugguacaguguagaucugucgaaggcagcuguggguuuuag

SEQ ID NO: 248739 - RNA, 654 nt, Artificial Sequence
  Description of Artificial Sequence: Synthetic coding sequence
auggcagcaggaucgcgcacaagucuauuauuggccuuugcuuuauugugccucccauggcuucaggaggccggcgcuguacagaccguccccuuguccagacuauucgaucaugccaugcugcaggcccacagagcacaccaguuagccauugauacauaccaagaguucgaggagaccuacauaccuaaagaccagaaauauagcuuucugcaugacucacagacuaguuucugcuucagugauaguaucccuaccccuaguaauauggaagagacccagcagaaaucgaaucuggaguugcugcggauaucucuauugcuuaucgagucauggcuugagcccgugcgguuccugagaaguauguuugccaacaacuuaguauacgacacaucggacagugaugacuaccaccugcuuaaagaucuggaggagggcauucagacgcuuaugggacggcuggaggacgguagccgcagaaccggacaaauacucaaacaaacauacucuaaauucgacaccaauucucacaaucacgacgcucugcucaaaaacuacggccugcucuacuguuuucguaaggauauggacaaaguugagacauuucugcgaaugguacaguguagaucagucgaggguuccuguggguuuuag

SEQ ID NO: 248740 - RNA, 483 nt, Artificial Sequence
  Description of Artificial Sequence: Synthetic coding sequence
auggcggcuggaagucgcacuucucuccucuuagcauucgcgcugcugugucucccuuggcugcaagaagcagacucuauuccaacccccagcaacauggaggagacccaacagaagucgaacuuagaacugcugcggaucucucuguugcucaucgagucauggcuggagcccguucguuuuuuacgauccauguuugcgaacaaucuggucuacgacacuagcgacucugaugauuaccacuuauugaaggaccuagaagaagguauccagacccugaugggcagacuugaagacggcucucgucgaacaggacagauacuuaagcaaacuuacagcaaauuugacacaaauucccacaaucacgaugcgcugcugaagaacuacggccuacuguacuguuuccgaaaagacauggacaaagucgaaaccuuucuacgcauggugcaguguagaucagucgaaggaucuugcggguuuuag

SEQ ID NO: 248741 - RNA, 498 nt, Artificial Sequence
  Description of Artificial Sequence: Synthetic coding sequence
ugaggcucccguacuucucuuuugcucgcuuuugcucuccuuugucugccguggcugcaggaggccggagcuguccagacuguuccuuugucucgccuuuuugaucaugccaugcugcaggcccaucgggcacaccaguuagcaauugacacauaccaagaguuugaggaaaccuacaucccaaaagaccaaaaauacaguuuccugcaugacucccagacauccuuuugcuuuuccgacucuauccccaccccaucaaacauggaagaaacccaacagaagucuaaccucgaacugcuacgcaucucacugcuccucauagaaucauggcuugaacccguucgcuuccuacgcagcauguucgcaaauaaccugguuuacgauacauccgacucugacgauuaucaccugcugaaagaccucgaagaaggcauccaaacgcugaugggagugcgcgucgcucccgggguugcuaacccuggaacaccacuagcauag

SEQ ID NO: 248742 - RNA, 786 nt, Artificial Sequence
  Description of Artificial Sequence: Synthetic coding sequence
augguaguuguggccgccgcccccaaccccgccgauggaacgccaaagguucuguugcugucaggccaaccagcaucagccgccggcgcucccgccggacaggcccucccccucaugguucccgcccaaaggggugccucuccugaagcggccucaggcggacugccccaggcaagaaagcggcaaaggcugacccaucucuccccagaggagaaagcucuuagacgcaaauugaaaaaccguguugcagcucaaacagcuagggaucggaaaaaggcaagaaugucugaauuagaacagcaaguuguggaucuggaagaagagaaucagaagcugcuccuggagaaccaauuguuacgcgaaaaaacucauggacugguugucgagaaucaagaguuaagacagcgacuuggaauggacgccuugguggccgaggaagaggccgaggccaagggaaacgaagucagacccguugccggauccgcugaauccgccgcccugaggcucagagcgccucuacagcaagugcaggcccagcucaguccacugcaaaacaucagcccuuggauccuagcggucuuaacccugcaaauccagagucugauuagcuguugggcuuucuggaccaccuggacucaaagcugcagcagcaaugcucuaccucagucucucccggcauggcguucaagucaacgcaguacccaaaaagaccccguuccuuaccaaccuccuuuccuuugccagugggggcgucaucaaccaucauggaaaccgcugaugaauuag

SEQ ID NO: 248743 - RNA, 2853 nt, Artificial Sequence
  Description of Artificial Sequence: Synthetic coding sequence
augaccuggcgaaugggcccuagauuuacaaugcugcuugcgauguggcuuguguguggaucagaaccccacccccacgccaccauuagagguagucacggaggacgcaaagucccccuugucucccccgacucgucuagaccugccagauuccuucgccacacugggcgcucaagagggauugagcggagcacauuagaggagccuaaccuucaaccucugcaaagacggagaagcguaccuguguugcgucucgccaggccuacagagcccccagcccgguccgacaucaacggugcugccguacgcccagagcagagaccugcugccaggggcaguccaagagagaugauuagagaugaggggucauccgcgagaaguagaauguugagauuuccuuccggaucuagcucaccaaacauucuggccucauucgccggaaaaaaucggguauggguuauuagcgcuccucacgcuuccgaaggguacuaccggcuaaugaugucccuuuuaaaagaugacguauacugugaacuugccgagcgccacauccaacagauuguccucuuccaucaggcuggcgaggagggagggaaaguaagacgcauuacuagugaagggcagauccuggaacagccacuggaccccucccuaauuccuaagcugaugucuuuccucaagcuggaaaaaggcaaauuuggaaugguccugcuuaaaaagacacuccagguggaagaacguuaucccuaucccguaagauuggaggccauguaugaagugauagaucaggguccuaucaggagaaucgagaagaucagacagaaaggauucgugcaaaaguguaaagccucgggagucgagggccaggugguagcugaaggcaacgaugguggaggaggagccggccggcccucccucggauccgagaaaaagaaagaggacccaagacgagcacaaguaccucccacccgagagagccgugucaagguguuacgaaagcucgccgcuaccgcgcccgcccuuccacagcccccuucuacaccgcgagccacaacauuaccccccgccccugccacuacagugacccgauccacuucccgagcugucaccguggcagcuagaccaaugacaacaacugccuuccccacaacgcaacgaccguggacacccaguccaucacaccgaccuccuaccacgacagaaguaauuacagcgcgacgaccuucaguguccgagaaccuauaccccccuucaaggaaggaucagcauagagaaaggccccaaacuaccagacgcccuagcaaggccacaucgcuggaaucauuuacuaaugccccaccaacaacuaucagcgagccauccaccagagcugccggaccaggaagguuucgggacaacagaauggaucggcgcgagcauggccacagagacccaaaugucguccccggccccccuaaacccgcaaaagagaaaccaccuaagaaaaaggcucaagauaaaauuuuaucuaaugaguaugaagaaaaguaugaccugagccguccuacugccucucagcuggaagaugaacugcaggugggcaacgucccgcucaagaaggcaaaagaguccaaaaagcacgaaaagcuggagaaacccgagaaagagaagaagaagaaaaugaagaacgagaacgcagauaaauuacuaaagagcgagaaacagaugaagaaaagcgaaaagaaaaguaagcaggagaaggaaaaaucaaagaagaagaaagggggaaaaacugaacaggauggcuaccaaaaaccaacuaacaaacacuuuacccagagcccuaagaaaucaguggcggaucuguugggcuccuucgaaggcaaacgacgccuguuacuaaucaccgcucccaaagcagaaaauaauauguaugugcagcagcgggaugaguaucuagagucuuucuguaagauggcaaccagaaaaauuucaguaaucaccaucuuuggccccgucaauaauucuaccaugaagauagaccacuuucagcuugacaacgaaaaaccgaugagggucguggacgacgaagaucugguugaucaacgccuaauauccgagcuuaggaaagaauacgguaugacauauaaugauuucuuuaugguccugaccgauguagaucugagagugaaacaauauuacgagguaccgaucacuaugaagucuguguuugaucugauugacaccuuucaguccagaauuaaagacauggagaaacaaaaaaaggaaggaauuguaugcaaagaggauaagaaacaaagcuuagaaaacuuucugucgagauuucgguggcggcggcgguuacugguuauuucugcccccaacgaugaagacugggcauauagucaacaguugagugcauugucaggucaagccugcaauuucggacugaggcacaucacuauccucaagcugcuggggguaggagaggaagugggaggcguuuuagaacuuuuuccaauuaacggguccucagucgucgaacgcgaagauguuccagcacaucuggugaaggauauaagaaacuacuuucaggucuccccggaguacuuuagcauguuacuuguuggaaaagacggaaaugucaagagcugguacccaaguccaaugugguccauggugauugucuacgaccugauugacaguaugcagcuuagaagacaagaaauggccauacaacaaagccucggaaugagaugccccgaagaugaguacgcaggguauggguaccauaguuaucaucagggauaccaggacggcuaccaggacgacuaucggcaccaugaaucauaucaucacggauaccccuacuag

SEQ ID NO: 248744 - RNA, 624 nt, Artificial Sequence
  Description of Artificial Sequence: Synthetic coding sequence
auggucgcgaccugccuccaagucgugggguuugugaccucuuucgucggguggaucggagugauugugaccaccucuacgaacgacuggguggugacaugcggcuacaccaucccaacguguaggaagcuugaugaauuggggucuaagggauuaugggccgacugcgugauggcaacuggguuguaccacuguaagccacuggucgauauccucauccuaccuggcuacguucaagcuugcagagccuuaaugaucgcugcaucugugcuaggguugccugcuauucuccuucuuuugacaguucugccuugcaucagaaugggccaggagccaggagucgcuaaauaccgccgcgcacagcucgcgggagugcuuuugauucugcucgcccuuugcgcccuuguagcuacaaucugguuccccguuugugcccaccgugaaacaacgaucgucaguuuuggcuauagccuauacgccggcuggauaggugcaguccucugccucgucgguggcugcgugauccuguguugugcaggugaugcgcaggcguuuggugagaaucgcuucuacuauaccgccggaucauccucacccacacaugccaaaucugcucacguauag

SEQ ID NO: 248745 - RNA, 1350 nt, Artificial Sequence
  Description of Artificial Sequence: Synthetic coding sequence
augaugaaaacucuucugcuauuugugggcuugcugcugaccugggaaagcggccagguguuaggugaccaaacuguuuccgauaacgaauuacaggagaugucuaaucagggcagcaaauauguuaacaaagagauacagaaugcagucaacggggugaagcagaucaagacucugauagagaaaacaaaugaagagcggaagacuuuguuauccaauuuagaagaagcaaaaaagaagaaggaagacgcacugaaugaaacuagagagagcgagacuaagcugaaagaacucccgggugucuguaaugaaacuaugauggcucucugggaggaaugcaagccaugccugaagcaaacguguaugaaguucuacgcccgagugugccgaucaggaaguggccuuguggggcgacaauuggaagaguuucugaaucaguccagcccauuuuacuuuuggaugaacggugauagaauagacagccuucucgagaaugacagacagcagacccacaugcuggacgugaugcaggaucacuucagccgagcaucuucaaucaucgacgaguuguuccaggaccgauuuuuuacccgggaaccucaagauaccuaccauuaucuuccauuuucucugccucaucgcaggccacacuuuuuuuuccccaagucaagaaucgugaggagucuuaugccauuuagcccguaugaaccucuuaacuuccacgccauguuucagcccuuuuuagagaugauucacgaagcucagcaagccauggacauccacuuccauucaccugcauuccagcaucccccuacagaguuuauccgagagggagacgaugaucgcaccgucugucgagagauucgacacaacuccacagguugucucagaaugaaagaccagugugacaaaugccgcgaaauccuguccguugauuguucaacgaauaacccuucccaagcgaaauuaaggcgcgaacuagaugaaucucugcaaguugcugaaagacuaacccgcaaguauaaugagcugcuuaagagcuaucaguggaagauguugaauaccucuagccugcuggaacaacugaaugaacaguuuaauuggguaucccgccuggcaaacuugacucagggagaagaccaauacuauuugagaguaacuacagucgcaagccacaccagcgauagugacgugccaucaggcgugaccgaggugguaguuaagcuguuugauagugaccccauaacaguuacuguucccguugagguuagucgaaaaaaucccaaguuuauggagaccguggccgaaaaagcacuacaggaguacaggaagaaacacagagaggaguag

SEQ ID NO: 248746 - RNA, 825 nt, Artificial Sequence
  Description of Artificial Sequence: Synthetic coding sequence
augcaggaccauuucagccgugccucuagcauuauugaugaauuguuccaggaucgcuucuuuacaagagagccccaggacacuuaucacuaucuccccuucagccugccgcaccgucgcccucauuucuucuuuccgaaaucccguauagugaggucccucaugccuuuuucuccguacgaaccccuaaacuuucacgcaauguuccaaccuuuccuggagaugauccacgaagcacaacaagccauggacauucacuuccacucaccagcauuucaacauccacccacagaguuuauucgggagggugaugaugaucguaccgucuguagagagauuaggcauaacaguacaggcugccugcgaaugaaggaccaaugugacaaguguagggaaaucuuaaguguagauuguaguacgaauaacccaagccaagcuaaacugcgacgggagcuagaugaaucacugcagguggcagaacgauugacucggaaauauaacgaacucuugaaaucauaccaguggaagaugcucaacacaagcagccugcuggagcagcuuaacgaacaauuuaacugggugagccgacucgccaaccugacacaaggagaggaccaauacuaucugcgcguuacaaccgucgcuucucauacguccgacagugaugucccaucgggcgugacagaggugguagugaaacuguucgacuccgaucccauaaccgugacagucccaguugaagugagcaggaagaauccgaaguuuauggaaaccguagcagaaaaagcauugcaggaguauagaaagaaacaccgggaagaguag

SEQ ID NO: 248747 - RNA, 1350 nt, Artificial Sequence
  Description of Artificial Sequence: Synthetic coding sequence
augaugaaaacacuacuucuguucgugggcuuauuguuaaccugggagagcggucaggucuugggcgaucagacugugagcgacaaugaguuacaagaaaugagcaaccaaggcucaaaguaugucaauaaggagauacagaacgccguuaaugguguaaagcagauuaaaacccuuaucgaaaaaacuaaugaagaaagaaagacauugcuaucaaaucuggaggaagcaaagaagaaaaaggaagacgccuuaaacgaaacacgugaaagugaaacuaaacuaaaagaauuaccaggaguguguaaugagaccaugauggcacugugggaggaaugcaaaccuugcuugaaacagacaugcaugaaguuuuaugcucgggucugcaggagcggcucagggcucgugggacggcagcuugaagaauuucugaaccaauccucacccuucuauuuuuggaugaacggugauagaauagacagcuuacuagaaaacgaccgucagcaaacucauaugcucgaugugaugcaggaucacuucagcagggccucaucaaucaucgacgaacucuuccaggaucgauucuucacacgagaaccacaagacaccuaucacuaucuacccuucaguuugccacaucgcaggccacacuuuuucuucccaaaaucccgcaucguacgaagcuugaugcccuuuagcccauaugaaccccucaauuuucacgcgauguuccagccguucuuggaaaugauucacgaggcacagcaggcuauggacauccacuuccacucucccgccuuccaacauccacccacagaauuuaucagagaaggagacgacgacaggaccgugugcagagaaauccgccauaauaguacuggcuguuuaagaaugaaggaccagugcgauaaaugccgcgaaauucuaucaguggacuguuccacaaauaacccaucccaagcuaaauuacggcgagagcuagaugagagucuucaaguugcagagcggcuaacccguaaauauaacgaauugcugaagucuuaucaguggaagaugcugaacacguccucacuucucgagcaacugaaugaacaguucaauuggguguccaggcuggccaauuugacccaaggagaggaccaguauuaccuaagaguuacaacggucgccucucauacuuccgauagcgaugugccaucaggagugacagaggugguggugaaacuguucgauagugauccaauaacuguuacaguacccguggaagucucgagaaaaaaccccaaauucauggaaaccguggcugagaaagcucuccaggaauacagaaagaagcaccgugaagaguag

SEQ ID NO: 248748 - RNA, 615 nt, Artificial Sequence
  Description of Artificial Sequence: Synthetic coding sequence
augaugaaaacucuacuccuguuugugggacugcugcuaacuugggaaucuggacaggugcucggugaccagaccgugagcgacaaugagcuucaggaaaugagcaaucaggggagcaaguacguuaacaaggaaauucaaaacgcagugaacggagugaaacaaauuaagacauugaucgagaagacaaacgaagagaggaagacgcuucugaguaaucuggaggaggccaaaaagaagaaggaagacgcacugaaugagacucgggaauccgagacaaaguuaaaggagcugccuggcguguguaacgagaccaugauggcauuaugggaggaaugcaagccauguuuaaaacaaacaugcaugaaguucuaugccagaguguguaggagcgggaguggccucguugggagacagcucgaggaauuccugaaccaguccagcccuuucuauuuuuggaugaacggcgauagaaucgacagccuccucgaaaaugauagacagcagacucauauguuggacguuaugcaagaccacuuuucacgcgcuucaucaauuaucgacgaacuauuucaagacagguuuuucacccgcgagccacaggauacuuauuag

SEQ ID NO: 248749 - RNA, 1350 nt, Artificial Sequence
  Description of Artificial Sequence: Synthetic coding sequence
augaugaaaacacugcugcuguucgucggacucuuacuuacgugggaaaguggacagguccugggugaucaaacgguuagcgauaacgaacuccaggagaugagcaaucagggaaguaaguacgucaacaaagaaauacagaacgcagucaacggaguaaaacaaaucaagacgcuaaucgaaaaaacaaaugaagaaaggaagacacugcugucaaauuuagaggaagcaaaaaaaaagaaagaggaugcacuuaaugaaacgagggaauccgagacaaagcugaaggaguugccugggguguguaaugagaccaugauggcguugugggaagaaugcaagcccugccucaaacaaacaugcaugaaguucuacgcucggguuugucggagcgguagcggauuggugggcaggcaguuggaggaauuucuuaaucagagcucuccauuuuauuuuuggaugaacggugauaggaucgauucccuguuggaaaacgacagacagcagacacacaugcuagauguuaugcaagaccacuuuucacgggcaagcuccaucauagacgaguuguuccaggaucgauuuuuuaccagagagccucaggauacuuaucauuaucuccccuucucauuaccccaucgacgaccucacuucuucuuuccgaagucacgcauuguccguucauugaugccauucucuccuuacgagccacugaauuuccaugccauguuccagcccuuccucgagaugauacaugaagcacaacaggcaauggauauccacuuucacuccccugcuuuucagcaccccccaacagaguuuauacgggaaggagaugacgacagaaccguguguagggagauacggcacaacucuacuggaugccugcgcaugaaagaccagugcgacaaguguagggaaauccucagcguugauugcucuaccaacaacccaagucaggccaaguugcgccgugaacuagacgagucacugcagguugccgaacgcuugacaaggaaauacaaugaacuucugaaaagcuaucaguggaagauguuaaacacgucaucccuguuggaacagcuuaacgagcaguucaauugggugucccggcuagcaaaucucacccagggagaggaccaguacuaccucagagugacaaccguagcaagucauaccucagacucggauguaccuuccggaguuaccgaaguggucguuaagcuuuucgacucugauccuaucaccguuacagugcccguugaagugagccgaaaaaacccuaaauuuauggaaaccgucgccgagaaagcacuccaagaauacagaaagaaacaccgggaggaguag

SEQ ID NO: 248750 - RNA, 816 nt, Artificial Sequence
  Description of Artificial Sequence: Synthetic coding sequence
augaugaagacauugcuacucuuugucgggcugcugcucacaugggagucuggccaggugcucggagaucagaccguuagugauaaugagcuucaggagaugucuaaucaaggaaguaaguacgucaacaaagagauucaaaaugcuguaaacggaguaaaacagauuaagacacugauugaaaagacgaacgaagagcgaaaaacucucuuaucaaaucuagaggaagcgaagaaaaagaaggaggaugcacugaaugagacaagggagucugagacaaagcugaaagagcugccaggugugugcaacgagaccaugauggcacugugggaagagugcaagccaugucugaagcaaacuuguaugaaguucuaugcacgggugugccgaagugguucuggacugguaggcagacagcuugaagaauucuugaaucaaucuaguccauucuauuuuuggaugaauggugaccgcauugacuccuugcuggagaacgaccgccaacaaacccacaugcucgacgugaugcaggaccauuucucaagagccagcucuauuaucgaugaacuguuucaggacucacugaugccuuuuucucccuacgagccgcucaauuuucacgcaauguuucaaccuuuccucgagaugauccacgaagcccagcaagccauggauauacacuuccacuccccugcuuuccagcacccgcccacagaguuuaucagagagggcgaugaugauaggacagucugcagagaaauucggcacaauuccacaggcugucuucggaugaaagaucagugcgauaaauguuag

SEQ ID NO: 248751 - RNA, 1383 nt, Artificial Sequence
  Description of Artificial Sequence: Synthetic coding sequence
auggaagcaugcaaagacagccgaaucgguggaaugaugaagaccuugcuuuuguucgugggacugcuucucacuugggaaucgggucagguacucggcgaucagacuguguccgacaacgaacuccaagagauguccaaccagggcaguaaguaugucaauaaggagauacagaaugcugugaauggcgugaaacagauuaagacccugaucgaaaagacaaaugaagagcguaaaacacuccuauccaaucuagaggaagcuaagaagaagaaggaagaugcccuaaaugaaacgcgggagucagaaacuaagcuaaaagaacugcccggggugugcaacgagacaaugauggcuuuaugggaagaauguaaaccaugccugaagcagacauguaugaaauucuacgcacgcgugugccgcagcggcucgggucuugugggccgacaauuggaagaguuccugaaucaguccagccccuuuuauuucuggaugaacggcgaccgcauugacucacucuuagagaacgaccgacaacagacccacaugcucgacgugaugcaagaucacuucucccgcgccucuuccauuaucgaugaacuuuuccaagaccgguuuuucacucgggagccacaggacaccuaccacuacuugcccuuuuccuugccucauaggagaccacacuuuuuuuuccccaagucucggaucgugcgaucccucaugcccuuuucuccuuacgagccucucaauuuucacgcaauguuucagccuuucuuagagaugauucacgaagcccagcaggcuauggacauccacuuccacuccccagccuuccagcaccccccaaccgaauucauccgcgaaggugaugacgauaggaccgucugccgugaaaucaggcacaauucaaccggcugccugcguaugaaggaucagugcgauaaauguagagaaauccugucuguugacuguaguacuaacaauccuagucaggcgaaacugaggagagagcucgaugagucccuucaaguugcugaacggcucacaagaaaguauaacgaacuuuugaaguccuaccaauggaaaaugcucaauacuagcuccuuauuagaacaacucaacgagcaguucaacuggguuaguaggcucgcuaaucucacgcagggcgaagaccaguacuaccucaggguuaccaccgucgcuucccauacgagcgacucagacgugccaucuggugugaccgaaguaguggugaaauuauuugacagugaucccauaacugucaccgugccaguagaggugagcaggaaaaaccccaaguuuauggagaccguggcagagaaggcccugcaggaguacagaaaaaaacacagagaggaguag

SEQ ID NO: 248752 - RNA, 1506 nt, Artificial Sequence
  Description of Artificial Sequence: Synthetic coding sequence
augcaggugugcucucagccgcagcggggaugcgucagagaacaaucagccaucaauaccgcccccccaagugcucauaacgcagcuucuccuggaggcgcgagagggcaccgagucccucugaccgaggcaugcaaagauucccgcauuggagguaugaugaaaacgcugcuccucuucgugggacugcuguugacaugggagaguggucagguucuaggugaccaaacugugucugauaacgagcugcaggagaugucuaaccagggcagcaaguauguuaauaaagaaauccagaaugccgugaauggagugaaacagaucaaaacucuuauugaaaaaaccaaugaggaaagaaaaacgcuacugagcaaucuggaagaggcaaaaaaaaagaaagaagaugcccucaaugaaacucgugaguccgagaccaaacugaaagaacucccuggagucugcaaugaaaccaugauggcacugugggaggaguguaagcccugucucaaacagaccugcaugaaauuuuacgcuagaguaugccgaagugguuccggccucguggggagacagcuggaagaguuucugaaccagucaucuccauuuuacuucuggaugaacggugaccgaaucgacagucuacuggaaaaugacagacaacagacccacaugcucgacgucaugcaagaccacuucucccgggcaucuucgaucauagacgagcuguuucaggaccgauuuuucacgcgggaaccccaagauaccuaccauuaucuuccuuuuucucuuccucaucgacguccacacuuuuucuuuccaaaaucgaggaucguucguagccucaugccuuuuucucccuaugaaccuuuaaacuuccaugccauguuccaacccuucuuggaaaugauccacgaggcucaacaggcaauggacauccacuuccacucccccgcauuccagcauccccccacagaguuuauuagagagggcgacgacgaccggacaguuugcagggaaauaagacauaacucuacaggcugucugagaaugaaggaccaaugcgacaaaugcagagagaucuugucaguagacugcagcacuaauaaucccagccaagccaaacuucggagagagcuggaugagucccuacagguagcagagagacucacgcgcaaauauaacgagcugcucaaaaguuaccaguggaaaauguugaacacaaguucucuucuggagcaacugaaugagcaauuuaacugggugagcaggcuggccaaccuaacgcagggcgaggaccaauacuaccuucgcgugaccacuguggcaagccauaccuccgacucagacguaccauccggaguaacugagguuguggugaaguuguuugacuccgacccaaucaccguaacagugccagucgagguauccaggaaaaauccuaaauucauggagaccguggccgagaaagcucuccaggaauaucgaaaaaagcauagagaggaguag

SEQ ID NO: 248753 - RNA, 894 nt, Artificial Sequence
  Description of Artificial Sequence: Synthetic coding sequence
auggaagcaugcaaggauuccagaaucgguggcaugaugaagacgcugcugcucuucguggguuuauugcuaacuugggaaaguggacaagugcucggugaccaaaccgucucugauaacgagcuacaagaaaugucuaaucagggaucuaaauacgugaauaaggaaauccagaacgccgugaaugggguaaagcaaauaaagacccugaucgaaaaaacgaacgaagaaagaaagaccuuacugucgaaccucgaagaggccaagaaaaaaaaagaagaugcacugaacgaaacuagggagagcgagacuaaguugaaggaacugcccggggucuguaacgagacaaugauggcccucugggaagaguguaaaccgugccugaagcaaacuugcaugaaauuuuaugcucgagucuguagaaguggcaguggccuuguuggcaggcagcuugaagaauuucuaaaccagagcagccccuucuacuuuuggaugaacggagaucgcauugacagccugcuugaaaaugaucgccaacaaacucacaugcuugacgugaugcaagaccauuuuucuagagcaaguagcaucauagaugaacuguuucaggaucgauucuucacaagagagccccaggacaccuaucacuacuuaccuuucucacuaccccaccgccgcccccacuucuucuucccuaagaguagaauugucagaucgcugaugccuuuuucucccuaugagccacugaacuuucacgccauguuucagccauuccucgagaugauucacgaagcucagcaagcgauggauauucauuuucacucacccgcuuuucagcacccaccuaccgaguuuauuagagaaggggaugacgaccggacagucuguagauag

SEQ ID NO: 248754 - RNA, 2259 nt, Artificial Sequence
  Description of Artificial Sequence: Synthetic coding sequence
augggcccccuuaugguuuuguucugccugcuguuuuuauaccccggucucgcugauucugcccccagcugcccacagaacgucaauauuuccggaggaaccuuuacucugucacacgggugggcaccagggagccugcuuaccuacuccugcccacagggucuguaucccaguccugcuucacgacucugcaaauccagcggacaauggcagacuccaggagcuacaaggucucuuucgaaagcgguguguaagccagucagauguccagcgcccguuaguuucgagaauggaaucuacaccccccgucugggcucauaccccguuggcgguaauguuucauuugagugcgaggaugguuuuauucuaaggggcucuccagucagacagugcagaccuaacggcaugugggauggugaaacggcagucugugauaauggagccggccauugccccaacccugggaucucucuaggagcuguucgcacugguuucagauuuggccauggcgauaaagugcgauaccgcugcucaagcaauuugguccucaccgguagcagcgaaagggaaugccaagggaaugguguauggucuggcaccgaaccaaucugucgacagccuuacuccuaugauuuuccagaggauguagcucccgcccuuggcaccuccuucucacacaugcugggagccacuaaucccacacagaaaacgaaagagucccucgggaggaaaauccaaauccagagauccggccaccugaaccuguaccuucuccucgacuguagccagagcgugucagaaaaugacuuuuugaucuuuaaggaaucugccucccuuaugguagaccgaauauuuagcuucgagauuaacguguccguggcgaucaucacuuuugccucugaaccgaagguccuaaugaguguuuugaaugauaauagccgugacaugaccgaagugaucucaagccuggaaaacgccaacuauaaggaccacgaaaacggaacuggcaccaacacauacgcagcucugaauuccgucuacuuaaugaugaacaaccaaaugagacuccugggaauggaaacgauggccuggcaggagaucagacaugcuaucauccuccuuacugacggaaagucaaauaugggaggcucaccgaaaaccgcaguugaucacauuagagagauucugaauauuaaucagaaaagaaacgacuaucuagauaucuaugcaauuggagugggcaaacuggauguugacuggagagagcucaacgaguugggaucaaaaaaggacggcgagagacaugcuuuuaucuugcaagacacuaaggcgcugcaccagguguucgaacauauguuagacgugucaaagcucacagacaccaucugcggaguuggcaauaugucagcaaaugcuucagaucaagaaaggaccccauggcacgucacuaucaaaccaaagagucaagagacuugcaggggugcccugaucucugaccaauggguucuuaccgccgcccauugcuuccgagacggaaacgaccacucuuuauggaggguaaaugucggcgacccaaagagucaauggggaaaagaguuccuuauugagaaagcaguuauuucacccggguucgacguguucgcuaagaaaaaucagggcauccucgaauucuauggggacgauaucgcacugcugaagcuggcucaaaaaguuaagaugaguacccacgcuagaccuauuugccuccccuguacaauggaagcuaaucuggcucuucgccgcccacaaggcucaacguguagggaucacgaaaaugagcuccuuaauaagcaguccguacccgcacauuucgucgcauugaacggguccaaauuaaauaucaacuugaagaugggagucgaauggacuagcugugccgagguugugagccaggagaagaccauguucccgaauuuaacugaugugcgugaggucgucacagaucaauuccuaugcuccggcacucaagaggacgaguccccguguaaaggcgaauccgguggugccguguuccuagaacggcgguuuagauucuuucaggugggucuuguguccuggggacucuauaacccaugccuugggucugcugacaagaauuccagaaagagagcuccuagaucaaaagugccaccccccagagacuuucacauaaaccuguuucgcaugcaaccuuggcuccggcaacaccucggcgacguguugaauuuucugccacuauag

SEQ ID NO: 248755 - RNA, 1134 nt, Artificial Sequence
  Description of Artificial Sequence: Synthetic coding sequence
augaccgaagucaucucaaguuuagaaaacgccaacuauaaagaccacgagaacgguaccgguacaaacacauacgccgcacugaauagcguauauuugaugaugaauaaccaaaugcgacuacuggggauggaaacuauggcuuggcaggagauaagacaugcuauuaucuuacucacagaugggaaaagcaacaugggcgguucacccaagacagcgguagaccauaucagggaaauucucaauauuaaucagaaaagaaacgauuaucuugacauauaugccaucgggguaggcaagcuggacgucgauuggagagaauugaaugaguuaggcagcaaaaaggacggcgaacgucaugcauucauccugcaggauaccaaagcccuccaucaaguauuugagcacaugcucgacgugagcaagcugaccgacaccauaugcggaguuggcaauaugagcgccaaugcaucggaucaagaacgaacucccuggcacgugacaauuaaaccuaagagucaggagaccugucgcggugcucugauuagugaucaauggguguugaccgcugcccacugcuuuagagacgggaaugaccacucucuguggcgggugaauguuggagacccaaagucccagugggggaaggaauuuuugauugaaaaggcuguuaucucuccuggcuuugacguguucgcaaagaagaaucaaggaauauuggaguucuacggugacgauauugcccugcuuaagcucgcacaaaaggugaagaugucaacccaugcacggccaaucugucuuccuugcacaauggaagcaaacuuagcacugagacguccccaagguaguacuuguagagaccacgagaaugagcuccuuaacaaacagaguguucccgcacauuuuguugcccugaacggauccaagcuuaacauuaaccucaaaauggggguagaguggacguccugugcugaagucgugagccaggagaaaacuauguuuccuaacuugacagacguucgagaggugguuaccgaucaauuccuuugcagugguacccaggaagacgaaagcccuuguaagggagguucuggggaauuaggcagccuccagccccuuccauggcugugcuag

SEQ ID NO: 248756 - RNA, 420 nt, Artificial Sequence
  Description of Artificial Sequence: Synthetic coding sequence
auggggccccucauggugcuguuuugccuccucuuuuuauacccaggucuggccgauucagcaccaaguuguccacagaaugucaacauaucugguggcaccuucacucugagucauggcugggcuccuggcucgcugcuuaccuacucuuguccccaaggacuuuaucccucccccgcuucacgacuguguaaaucuucugggcaauggcaaacaccuggugcgacccgcucuuugucuaaagccgugugcaagccaguucggugcccagcuccagugucauuugaaaauggaaucuauacaccuagacuuggauccuauccuguggguggcaacgucucuuucgaaugcgaggauggauuuauauugagggggucuccggugcggcagugcagaccgaaugguaugugggaugguuag

SEQ ID NO: 248757 - RNA, 978 nt, Artificial Sequence
  Description of Artificial Sequence: Synthetic coding sequence
augggaacacgcuccgcuaucgcugccccgagaauucucugcagccgagguuuacggucuggguccgcacgcgccacaggcucuggggucgagcguucaccaucugcugcaaacccaacccuuaugacuucccugcgaacuuggccucuccccugggcacucccgucccccacgugucuuggcccgccaauuccacccagaagacagcggaucuuuucuuuugaaauuaaugugucuguggcaaucaucacuuucgcuuccgagccuaagguacugaugagcguccuuaacgacaauucacgcgauaugacugaggugauuagcucguuagaaaaugcuaacuacaaagaccaugaaaacggaaccggaacaaauacuuaugcagcccugaacuccguuuaccuuaugaugaacaaucagaugagacuucugggaauggagaccauggcuuggcaagaaaucaggcaugcaauaauccugcugacggaugggaagucaaacaugggcggcucuccaaaaacagccguggaucacauccgcgaaauacucaauaucaaucagaaacguaacgauuauuuagauaucuacgccauuggaguggggaagcucgacguggauuggcgcgagcugaaugaacucggaaguaaaaaagauggcgaaaggcaugcauuuauccugcaagacacgaaggcacuucaccaaguuuucgagcacaugcuggacguaagcaaguuaaccgauaccaucugcggcgugggaaauaugucagccaaugcauccgaucaggaacgcacaccguggcacguuacaauuaaaccaaaaucccaagaaaccugucguggagcguuaaucucagaucaaugggucuugaccgccgcucacugcuucagggacggaaacgaucacagucuguggaggguuaacgugggcgauccaaaaagccagugggguaaagaauuucugauugagaaggccuag

SEQ ID NO: 248758 - RNA, 1863 nt, Artificial Sequence
  Description of Artificial Sequence: Synthetic coding sequence
auggggccccugaugguacuguuuugucugcuguuucuguaucccgcuggacacugccccaacccugggauuagccuaggcgccguccgaaccggauuccgauucggccauggcgacaagguuagauacagaugcucuagcaaucucguacucacagggucgagugaacgcgagugucaaggcaacggaguauggaguggcacugaacccauuugccgacaacccuauucauacgauuuuccagaagauguggcaccagcucuagguacaagcuucucucauaugcugggcgcaacuaaccccacacagaagacuaaggagagcuuaggaagaaaaauccaaauccagagauccggccacuugaaccuguaccuuuuacuggauuguagccaguccgugucugaaaacgauuuuuuaauauuuaaggaaucagcuucucugaugguugaccgaauuuuuagcuuugagauaaaugugagcguggcaaucaucaccuucgcuagcgagcccaaaguacugaugagugugcugaaugacaacaguagagacaugaccgaaguuauuaguucccuugaaaacgcuaacuauaaggaucaugaaaauggaacggggacgaacacauacgccgcuuuaaacaguguuuaccucaugaugaacaaccaaaugcgauuguuggguauggaaacuauggcuuggcaagaaauacggcaugcaauuauccuuuuaaccgacggaaaguccaauaugggcggaucacccaaaaccgcuguggaucacauuagggagauucuuaacauaaaucagaaacggaacgauuaucucgauauuuaugcgauaggugugggcaaacuggauguggauuggcgggaacugaacgaacuggggucaaaaaaggauggcgaaagacaugcuuuuaucuugcaggacaccaaagccuuacaccaaguauuugaacacauguuggacgucagcaagcuaaccgauacaauuuguggugucggcaauaugucggcgaacgccucugaucaagagcggacuccuuggcacguuacaaucaaacccaaaucacaagagaccugccgcggagcuuuaauuucagaucagugggugcuaacggccgcacauugcuuuagggacgggaaugaucauucacucuggagagugaacgucggugacccaaagucucaguggggcaaagaauuucugauugagaaagccgucauuuccccuggcuucgauguauucgccaagaaaaaucaaggcauauuggaauucuacggcgaugacaucgcccugcugaaacucgcccagaaagugaaaaugagcacgcacgcccggccgaucugucugcccuguacuauggaagcuaaucucgcucugaggcgaccucaaggauccacgugccgcgaucaugagaaugagcuccuaaacaaacaauccgucccagcacacuuuguugcccugaacggcucaaaacuuaauauaaaucuuaaaaugggagucgaguggaccagcugugcagaaguggugagucaagaaaagacuauguuccccaaucuuacugacguacgagaaguggucacggaucaguuccuuuguucggggacccaagaggaugaauccccaugcaaaggugaaucaggcggcgcgguauuucuugagcgcagguuccguuucuuucaggucggacugguuagcuggggccuguacaauccuugccucggaucugcggacaaaaacucacggaaaagggcgccaagaagcaaaguacccccacccagagauuuucacauuaacuuauuucguaugcagcccuggcuuagacaacaccuaggcgacguccucaacuuucugccauuauag

SEQ ID NO: 248759 - RNA, 5235 nt, Artificial Sequence
  Description of Artificial Sequence: Synthetic coding sequence
augcgccugcuuuggggccugauuugggcaucuaguuucuuuacacuuucucugcaaaagccccgcuuauugcuguuuucuccuucugucgugcauuuaggcgucccucugagcguuggcgugcagcuccaggacgugccuaggggucaggucgugaagggaaguguguucuuacgaaaucccagcagaaauaacgugccuugcucaccgaaagucgauuuuacucucucgagcgagcgggauuuugcucuacucucauuacagguaccacucaaagacgcaaagaguugugggcuucaucagcuccuccguggcccugaaguccaauuagucgcccauucacccuggcucaaggacagucuuagccggacgaccaauauacagggcauaaaccugcucuucucuucgcggagaggccaccuuuuccuucagaccgaucagccuauuuauaauccuggacagagagugagguaccgcguguuugcguuagaucagaagaugaggccgaguacugauacaaucacugugaugguagaaaacucacauggacugagaguacguaagaaggaaguuuacaugccuagcaguaucuuucaggacgacuuugugauccccgauauuucagaaccugggaccuggaagaucuccgccagauuuagugacgggcuggaaucuaacaguagcacgcaauucgaggugaaaaaguauguucugccgaauuuugaggucaagaucaccccaggcaagcccuacauuuuaacgguucccggccaucucgaugagaugcaguuagauauccaggcacgauacauuuacggaaaaccuguacagggaguggcauacgugcgauuugggcugcuggacgaggaugggaaaaagaccuucuuuagaggacuggagagucagacaaagcuugugaauggucaaucgcauaucucccuuucuaaagccgaauuucaagaugcacuggaaaaguuaaauaugggcaucaccgacuuacagggucuccgacuuuauguugccgccgcuaucaucgaauccccaggcggggagauggaggaagccgaauugacaucgugguauuucguuucuucacccuucagucucgacuugucuaaaacaaaacgucaccucgugcccggcgccccuuucuuguuacaggcccugguccgggaaaugagugggucaccugcuagugggaucccagugaaaguguccgccaccgugucaaguccagguagcgugcccgaaguccaagacauccagcagaacacggauggguccggacagguaaguauuccaaucaucauuccacaaacaauaagugaacugcaacucuccgucagugcugguagcccccauccagcuaucgcaagauugaccguugcagcccccccgaguggcggacccgguuuccugucuauagagcgcccugauagcaggccuccaagggugggcgacacucugaacuuaaauuugagagccgucggauccggagccacguuuucacacuacuacuacaugauucuuuccaggggccaaauuguuuucaugaaccgggagccuaagcguaccuuaacuucagucaguguuuuugucgaccaccacuuagcuccuucguuuuacuucguagcuuucuacuaccacggggaccauccagucgcaaacucgcuacgcguggauguucaggccggagccugugaagguaaacuugaauugaguguggacggggcuaagcaauaccgaaacggggaauccguaaaacugcacuuggaaacugacucuuuggcccuaguugcccucggagcguuagacacggcacucuacgcagccgguagcaaaagccauaagccacugaacaugggaaaaguuuucgaagcaaugaacucauaugacuuaggaugcggcccuggaggcggagacagugcccugcaaguguuccaagcagccggacuggcauucagcgacggagaucaguggacgcucucucguaagagacuuucuugcccaaaggagaagacgacaagaaagaaacggaacguaaacuuucagaaagcuauuaaugaaaagcucggccaauacgcgucgccaaccgccaagagaugcugccaggauggugugacccgacugcccaugaugcguuccugugagcagcgagccgcacguguccagcagcccgacugucgugaacccuucuugucuuguugucaauuugccgagucccugagaaagaaaagcagagauaagggucaggcuggccugcagcgcgcccucgagauacugcaagaggaggauuugauugacgaagaugauauucccgugcgcucguucuuuccggagaauuggcucuggcggguggaaacgguagacagguuccagaucuuaacccuuuggcuccccgacucacugaccaccugggagauccacggccugucacuaucuaagacuaagggacucugcgucgccacuccagugcaacugagggucuuucgugaauuccacuuacauuugaggcuaccaaugucagucagaagauucgaacagcuugagcuccggcccguacuauacaauuaucuggacaaaaauuuaacaguguccguucacgucagcccaguggaaggccugugucucgcaggaggggguggcuuggcacagcaaguccugguaccugcuggcucugcccgaccgguagccuucagcguagugccaacagcagcugcugccgugucacucaaagucguagcccggggaagcuucgaguuuccaguuggagaugccgucuccaaagugcuucaaaucgagaaagagggcgccauccacagagaagagcuuguguacgaauuaaacccccuggaccaccgcggaagaacacuugaaauuccuggcaacagugacccuaauaugauuccagauggagacuucaauucguacgucagggugaccgcuucagacccucuggacaccuugggcagugagggagcuuugucucccggggguguugcaagucuacugcgacugccaaggggaugcggcgaacagacaaugaucuaucucgccccuaccuuagccgccucaagauaucuggauaagaccgaacaauggucaaccuugcccccagaaaccaaagaucacgccgucgaucugauccagaaaggauacaugcgcauacagcaauuucggaaggcugacggauccuacgccgcauggcucagccgagacucuuccacauggcuaacugccuucguacuuaaaguccuuaguuuagcacaagagcaaguuggcgguucucccgagaaacugcaggaaacauccaauuggcuucuuagccagcaacaggcggacggcucauuucaagaccccugcccuguguuagacagguccaugcaagguggacugguugguaacgacgagaccguggcuuugacagcuuuuguaaccaucgcccuccaccacgggcuggcaguguuccaggaugagggcgcugagccacugaaacagcgcguggaagcaucaaucucgaaggcuaacucuuuccuaggugagaaggccucugcaggccuauugggcgcucaugcugcagcaaucacugcauaugcucugacucucacaaaagcgccaguggaucuccugggagucgcccacaacaaccugauggcuauggcacaagagaccggugacaaccucuacuggggcucagugacaggcucucaauccaacgcagugucuccaacucccgccccccguaaccccuccgacccaaugccucaggcucccgcucuguggauagaaacgacggcauacgcauugcugcaucuccuacugcaugaaggcaaagccgaaauggccgaccaagccagugcuuggcugacgcgccagggaucauuucaggguggguuccggagcacgcaagauacagugauugcccuagaugcuuuaucagccuauuggaucgccucucauaccaccgaggaaagaggguuaaauguuacucugaguucuacaggccggaauggcuucaagucucaugcacugcaauugaacaauagacagauacggggccuagaagaagaacuucaauucagcuuggggucaaagaucaacguuaaggugggugguaacuccaagggcacauugaaggucuuaagaaccuauaacguguuagacaugaaaaauaccaccugucaggaccugcagaucgagguuacugugaaaggacacguugaauauaccauggaggccaaugaggauuaugaagacuacgaguaugacgaacuuccagccaaggaugaccccgacgcuccccuucagcccgugacaccuuugcagcuuuuugaaggccggcgcaauaggcguagacgagaagcaccuaaagugguggaagaacaggagucaagaguccauuauacuguguguaucuggagaaacggcaaggugggccuguccggaauggccauugccgacgugacauugcucucuggguuccacgcccugagagcagaucuggagaagcucaccucgcucagugaucgguacgucagccacuucgaaacggaggguccccauguguuacuguacuucgauucggucccaaccaguagagaguguguggguuuugaagcaguccaggaaguaccagugggccucguacaaccugcaagcgcuacuuuguaugacuacuauaacccagaaagacguugcuccguguuuuauggcgccccaucuaaaucucggcuauuggccacacuguguucagccgaggugugucaaugcgccgaagguaaauguccgagacaaagacgcgcuuuagaaagaggauuacaggacgaagacggguaucgcaugaaguuugccuguuauuauccccggguggaguacgguuuucaaguuaagguucuaagagaggacucccgcgccgccuuucgacuauucgagaccaagaucacacagguuuuacauuucacaaaagacgucaaagcugcugccaaucagaugcggaacuuccuggugagggcuagcugcagacugcgucuggagccuggaaaggaguaucuuauuaugggccucgauggugcaacuuacgaccuagagggucauccacaauacuugcucgauuccaacagcuggauugaagaaaugcccucugagcgccuauguaggucuaccagacagagagcagcaugcgcccagcugaaugacuuucuccaagaauacgguacccagggcugccaggucuag

SEQ ID NO: 248760 - RNA, 5097 nt, Artificial Sequence
  Description of Artificial Sequence: Synthetic coding sequence
augagacugcuguggggccuuauaugggcuucuucuuuuuuuaccuuaucccuccagaagcccaggcuacuccuguuuucucccuccgucguccaccugggcguuccacucucaguuggugugcagcuccaagacguuccaagaggucaagugguuaaaggaucgguauuccuucgaaacccaucccgcaauaauguaccuugcuccccaaaaguggacuuuacacugucguccgagcgcgauuucgcccugcuuagucugcaagugccccugaaagaugccaaguccuguggacugcaccagcuccucagggggccagagguacagcuuguagcgcauagcccguggcuuaaagacucccugucacgcacuacuaauauccaaggaaucaacuuauuguucuccagcagacgagggcaucuuuuccuccaaaccgaccagccaauuuacaaucccggccagagaguaagauaccgugucuucgcuuuagaccagaaaaugagacccucuacugacacuaucacugugaugguggaaaacagccauggcuuaagagucagaaagaaagaagucuauaugcccagcucuauuuuccaagacgauuucguaauacccgauaucucugaacccggaacauggaagauuucagcgagauuuagcgauggacuggagagcaacagcaguacacaguucgaagugaagaaauaugugcucccuaacuucgaaguuaaaaucaccccaggcaagcccuacaucuuaaccguucccggccaccuagacgaaaugcagcuggauauucaggcucgcuacauauauggaaagcccgugcagggcguggcuuacgugagauuuggacugcuagaugaggacgguaagaaaacauuuuuuagaggucucgaaucgcaaacuaagcuugucaacggccagagccacaucagccucucuaaagccgaauuccaggacgcucuugagaaguuaaacaugggaaucacagaccuccagggcuugagacucuacgucgcugcugccauuauugagucaccaggaggagaaauggaggaagcugagcugacaaguugguacuuugugucgucacccuucagucuugaucugucuaaaacuaagcggcaccucguucccggcgccccuuuccuccugcaggcguuaguccgugagaugaguggcuccccugcauccgggaucccagugaagguuuccgccacagucaguagucccggguccgugccagaaguccaggauauucaacagaacaccgauggaagcggccagguaucuaucccuaucauuauaccccaaaccauuucagaacuccagcuuucagugucugccggguccccucauccugcaaucgcccgccuuacggucgcugccccccccaguggaggacccggguuccugagcaucgagcgaccagauaguagaccaccccgcguaggggacacacuaaacuugaaucucagagccgugggcuccggagccacuuucucucauuauuauuacaugauccucagccgcggccagauagucuucaugaauagagaaccaaaaaggacauuaacuagugugucaguuuuugucgaccaucaucuggcuccaucuuuuuauuuugucgccuucuauuaucauggugaucauccuguggcaaacagucucaggguagauguccaagcuggagcaugcgaagguaaacuggaguugucaguagauggcgcuaaacaguaucgcaacggcgagucugugaaacuccauuuggaaacagauagcuuagcacucguagcccugggcgcucucgacacugccuuguacgcagcugguucgaaaucucauaagccucuuaauaugggcaagguguuugaggccaugaacucauaugacuuaggaugcggcccuggcgggggcgauagugcucuccagguauuccaggcagccggauuagccuucagcgauggagaucaauggaccuuaucaagaaaacgccugucuugccccaaggaaaagacuacaaggaagaaaagaaacgucaacuuucagaaagccaucaacgaaaagcuggggcaguaugccuccccgaccgcuaaaagaugcugucaggacggggugacaaggcuccccaugaugagaagcugcgagcaacgagcugcuagaguccagcagccagacugcagagagccguuucugucauguugucaauucgcugagucguuacgcaagaagucaagggauaaggggcaggccggacuucagagagcacuggagauacuucaggaggaggaccuuauugacgaagacgauauccccgugagauccuucuuuccagaaaacuggcuuuggcgcguugaaacaguagacagguuccaaauucugacacuguggcugccagauagccugacuacuugggaaauucauggacuuucacucaguaaaacaaaaggacuaugugucgcgacgccagugcagcugagaguguuucgcgaguuucacuuacacuuacgacugccuaugagcguccguagauuugagcaguuagaauugcggcccgugcuguacaauuaucuggacaaaaaucugaccgugucggugcacgugucaccuguugaaggauugugucucgccggaggaggugggcuggcucagcagguucugguuccagccgggucugcgcgcccuguggcuuuuagcgucgugcccacugccgcugccgccgugucucuaaagguagucgcucggggguccuucgaauuuccagucggcgaugcagucuccaaaguccuacaaaucgaaaaagaaggugcuauucacagggaagagcuuguguaugagcugaauccauuagaccauagggguagaaccuuagaaauaccgggaaacucugacccuaauaugauccccgacggagacuucaauagcuacgugcgcgugaccgccagugaucccuuagacacucucgggucugaaggcgcccugagucccggaggaguggcaucucugcugagacuaccgagaggcugcggcgagcaaaccaugauauaucuggcccccacacuugcugccucacgauaccuggauaagaccgagcaauggaguacccucccgcccgagaccaaggaucacgccgucgauuuaauucagaaggguuacaugcgaauacaacaauuuagaaaggcugacgguucuuacgcugcauggcugucacgcgauagcucaacuuggcucacagccuucgugcucaaagugcugucacuggcucaggaacaggucggcggaucaccugagaagcugcaggagacuucuaauuggcugcucucccagcagcaagcagacggcucuuuucaagauccaugucccguccuugacagaucaaugcagggaggacuugucggcaacgaugaaacuguugcucucaccgcauuuguaaccauagcacuucaucauggucucgcaguauuucaggacgagggugccgagcccuugaagcaacgaguugaggccuccauaaguaaagccaauucuuuucugggggagaaggccucggcaggacuccucggagcccaugcagcagccauuacagccuacgcccucaccuugacgaaagcacccgucgaccugcuggggguggcacauaacaacuuaauggccauggcacaggaaaccggugauaauuuguauuggggcuccguaacuggcucucagucgaaugcagucuccccuacuccagcgccuaggaaccccuccgaucccaugccacaagcaccugcacuuuggauagagacaacagccuaugcccuccugcauuuauugcuccacgaaggcaaagcggagauggcugaccaagccuccgccuggcuaacaagacaggguaguuuucaaggcgguuuucgaagcacucaggauaccgugauugcauuggacgcccuaucagcuuauuggauugccucccacacaaccgaagagcgcggccuaaacguuacucucuccuccacugggcgcaacggcuucaagagucaugccuuacaguugaacaauagacagauuaggggacucgaggaagaacugcaauuuagucuuggcucuaaaauuaaugugaaaguuggcggcaauucuaaagggacgcuuaagguacugcgcacauacaacgugcuggauaugaaaaauacuaccugccaagaucuccaaauagaggugaccgugaagggacacguggaauacacaauggaggccaaugaagacuacgaggacuaugaauaugaugaguuaccugcuaaggaugacccugacgccccguuacaaccugucacucccuugcaacuguuugagggcagaaggaaccguagaagaagagaagcccccaagcugacuagucucuccgaucguuaugugagccacuuugaaacugaggguccccauguucuucuuuauuuugauagugugccaacaagucgagaaugugucggguuugaagccgugcaagaaguuccuguggggcuuguacagccagcuucugcuacauuauaugacuauuauaauccugaaaggagguguucugucuucuauggggccccuagcaaaagucgguuacuagcuacccugugcucagccgaaguaugucagugugcugaaggaaaauguccucgucagagacgggcccuggagcgcggacuucaagacgaagaugguuaccgcaugaaguuugcuuguuacuauccuaggguggaguauggcuuucaggugaagguccuucgggaggacagcagggcugcauuuagacuauuugaaacuaaaauuacccagguccugcacuucaccaaggacgucaaggcugccgcaaaccagaugaggaauuuccuagugcgagccaguugccgccugagacuggagcccggaaaagaauauuuaaucaugggguuggacggagccacuuaugauuuagaggggcacccacaguaucuguuagauuccaauaguuggauagaggaaaugccaucagagagacucuguagguccacccgccagagagcagcaugcgcccaguugaaugacuucuuacaagaauacgguacucaaggcugucagguguag

SEQ ID NO: 248761 - RNA, 813 nt, Artificial Sequence
  Description of Artificial Sequence: Synthetic coding sequence
augugucccgaagauucgcugcaggucccccugaaggaugccaaaagcuguggcuuacaccagcuccuccgcggaccagagguccagcuaguggcccacucgccauggcucaaagacucgcuuagucggaccacuaauauucaaggaauaaauuuacuuuucuccucuaggcgcggucauuuguucuugcaaaccgaucagccaauuuauaacccaggccagagaguaagguauagaguguuugcauuagaccagaaaaugcgacccaguaccgauaccaucaccgugaugguugagaauagucacgggcugagggugagaaagaaagaaguguauaugccuagcagcaucuuucaggacgacuuugugauacccgacauuagugaaccagguacuuggaagauuucggcuagauucucugaugggcuggagucaaacucaagcacccaauuugaggugaaaaaauacguccugccaaauuucgagguaaaaaucacucccggaaaaccuuacauccucacaguccccggucaucucgacgaaaugcagcuggacauucaggcucgauacauuuacggcaagccugugcagggaguagccuaugugagauuuggacuguuagaugaagauggcaagaagacuuuuuuccggggccuggagucacagaccaagcugguaaauggccagucgcauauuucucugucaaaggccgaguuccaggaugcgcuagagaagcugaacaugggcauuaccgaucugcaaggacugcgacuguacguagcggcagccaucauagagucacccgggggguag

SEQ ID NO: 248762 - RNA, 675 nt, Artificial Sequence
  Description of Artificial Sequence: Synthetic coding sequence
auggccacccaccacacucuuuggaugggcuuagcgcuguuaggcguacugggagaucuucaggcggcgccagaggcacagguguccgugcaacccaauuuucagcaagauaaauuccugggcagaugguuuuccgccggccucgcaucaaauucuuccuggcuccgcgagaaaaaggccgccuugucuauguguaagagugucguugcacccgcuaccgacggagggcugaaccucacauccacuuuccuccggaagaaccaaugugaaacgaggaccaugcuguuacagcccgcagggucacucggauccuacucuuauagguccccaagggaauggggccugcaccgaccgccgggaccaucucucggagcaacauuggccgggaccacccuuggccagcccccugcagcagaaauccacgguguaggagacuggggcagcacuuauucagugucuguuguggaaaccgauuacgaccaguacgcucugcuguacucacaaggaucaaaaggaccaggugaagauuucaggauggccacucuuuauagccggacccagacaccucgagcagaacugaaagagaaauuuaccgcuuuuugcaaagcacagggcuuuaccgaagacacaauuguauuuuugccucagacugacaaaugcaugaccgaacaauag

SEQ ID NO: 248763 - RNA, 4992 nt, Artificial Sequence
  Description of Artificial Sequence: Synthetic coding sequence
auggccacagauggagcaagcugugaacccgaucugucccgggcaccagaagaugcagcuggagccgcagcagaagcagccaagaaggaguucgacguugacacccugagcaagagugagcuucgcaugcuccucuccgucauggagggugaguuagaagcgcgcgaccugguuaucgaagcacuccgcgcccgacggaaagaaguauucauccaggagagguauggaagguuuaaccucaaugacccauuccucgcccuccaaagagauuacgaagcaggcgccggcgauaaagagaaaaagccugucuguaccaacccacugucaauuuuggaagcagucauggcacauuguaaaaaaaugcaggagagaaugagcgcccagcucgcggcagcugaaucccggcagaagaaacuggagauggaaaagcuacagcuucaggccuuagaacaggagcauaaaaaacucgccgcacgacucgaagaggaaagaggcaaaaacaaacaaguuguacugaugcuggucaaagaaugcaaacagcuuuccgggaaggugaucgaagaggcacagaagcuggaggacgugauggccaaacuagaggaggagaagaaaaagaccaacgagcuggaggaagaguugucagcggaaaagcggagaucuacugaaauggaagcccaaauggaaaagcaacuuucggaguuugauacagagagagagcagcugcgagccaaauugaaccgggaggaagcccacacuaccgaccugaaagaggaaauugauaagaugagaaagaugauagaacagcuaaagcggggaucugauagcaaaccgaguuugaguuugccacgaaagaccaaggaucgcagacugguauccauuuccguugggacagaggggaccguaacccgcucugucgccugucagaccgaccuggucacugagaacgccgaccacaugaagaagcucccccuuacuaugcccgucaagccuucaacaggcucgccucuggucuccgcuaaugccaagggcagugugugcaccuccgcgaccauggcacgcccgggaaucgauagacaagccucauacggagaccuaauuggcgcauccguaccagcuuucccuccgcccucugccaauaagaucgaagaaaacggccccucaacugguucaacccccgacccaaccucuaguaccccuccuuugccgucuaacgccgcucccccaacugcucaaacccccggcauugcuccccagaauucacaggcccccccaaugcacucccuccauagcccuugcgcgaacacaucacuacaucccgguuuaaacccacggauucaagcugcacgguucagguuucaagguaaugcuaaugauccagaccagaacggaaacacuacgcagucaccacccagucgagacgugagcccuacauccagagacaaccuuguggccaaacagcuugcuagaaacaccgugacccaagcccugagccgguucaccaguccacaagcaggagcucccuccagacccggggugccccccacaggcgacgucggcacacaccccccugucggaagaacaucccucaaaacccacggaguagcucgcguugaucggggcaacccaccucccaucccacccaagaagccgggccuuucacaaacuccaucacccccccacccccaguugaaggugaucaucgacagcagccgcgcaucuaauaccggagcuaaagucgauaacaaaacagucgcuuccacaccuucuucccucccucaaggcaaucgggugauuaacgaggaaaauuuacccaagagcucuuccccccagcugccucccaaaccaagcaucgaucucacagucgcccccgcaggaugugcugugagcgcacuugcuacaucacaggugggagccuggccagcugccacaccuggacuuaaucaaccugcauguucagacucaagccucgugaucccuaccaccaucgcauucuguucguccaucaacccagugucugcuucaucuuguagacccggcgcuuccgacucgcuccucguaacagccuccggcuggagcccuucccugaccccacuccugaugagcggcggacccgccccacucgccgggcgcccaacgcuccugcagcaggcugccgcucagggaaaugugacacuucucuccauguuauuaaaugaggaagggcuggacauaaacuacucuugcgaagacggacauucugcccucuacuccgcagccaaaaauggacauacugacugcgucagacuguugcucagcgcagaggcccaggugaacgccgccgauaagaacggauuuacuccccucugcgccgcugcugcucaaggucauuucgaaugcguggagcucuugaucucauacgaugcuaacauuaaucacgcugccgaugggggccagacaccuuuauaccuagcuugcaaaaauggcaauaaggaguguaucaaacugcuguuagaagcgggcacaaacaggagcguaaagacaaccgacggauggacaccaguucaugcggcgguagacaccgguaauguugacucucugaaauuacuuauguaccaccgcauccccgcccauggaaauagcuucaaugaagaggagucggagagcuccgucuuugacuuggaugguggcgaggagagccccgagggaauuucaaaacccguugugccagcugaccuaauuaaucaugccaaccgggaagguuggacggcugcacauaucgccgcuaguaaaggauucaaaaauugucuggaaauucugugcagacacggggggcuugagccagaacggcgagauaaguguaaccggaccguucaugacgucgccacagacgauuguaaacauuugcuagaaaacuuaaacgcuuugaaaauaccccugcggauuagugugggagagaucgagccgucuaacuaugguagugacgaccuggaaugcgagaauacaauuugugcccuaaacauaagaaagcagacuucaugggaugacuucucuaaggccgugucucaagcccugacuaaccauuuccaggcuauuucuucugacggcugguggucacucgaggacguuacuugcaauaacacaacugacucuaacauagguuugucugcacgaagcauacgcucuaucacccuggggaaugugcccugguccgucggucaauccuuugcccagagcccaugggauuuuaugaggaaaaauaaggcagaacacaucacaguacuccugucagggccucaagagggcuguuugucuucgguaacuuacgcaucaaugauuccacuccaaaugaugcagaauuaucugaggcuugucgagcaguaucauaaugucauauuucauggaccagaagggucucuccaagacuacauaguucaucaacuggcucugugucucaagcacaggcaaauggcugccggauuuucuugcgagauagugcgcgccgaaguggaugcuggauuuaguaaggaacagcugcuggaucuguucaucaguagugcuugucugaucccuguuaagcagagcccaucaaagaagaagauuauuaucauccucgaaaaucuggaaaaauccucauuauccgagcucuugcgggacuuuuuggcaccccuggagaauaggaguacagagagccccugcaccuuccagaaggggaacggccuuagcgaaugcuacuauuuccacgaaaacugcuuccuaaugggaaccaucgcaaaagcauguuuacaaggaucugaucuucuuguacagcagcacuuucgguggguacaacucagaugggacggcgaaccaaugcagggucuucugcagcgcuuccucaggagaaaggucguaaacaaguuuaaaggccaggcucccucuccuugugauccuguuuguaaaauuguggacugggcucuguccguguggagacagcugaauucgugucuugcccggcuaggcacaccagaagcccuuuuaggccccaaguauuuucugaguugcccaguagucccaggccacgcucagguaacagugaaauggaugucgaaacuuuggaauggugugaucgcaccucgcgugcaggaggccaucuuaucccgagcgucagugaagcgccagcccggauucggacaaaccacggcaaagcgccacccuucucaggggcaacaagccguuguuaaagccgcgcuuucuauacuccugaauaaggcugugcugcacggcugcccucugccucgcgccgaacuugaccagcauaccgccgacuuuaaagggggaucuuuuccuuuaagcaucgugagcucauacaacacuugcaauaaaaagaagggagaaucuggagccuggcggaaagugaacaccucacccagacgaaaaucaggccgguucucacugccuaccuggaauaagcccgaucucagcacugaagggaugaaaaacaagaccaucucucaacuuaauuguaauagaaaugccagucugucuaagcagaagagccuugagaacgaucucucccugacccuuaauuuagaucagagacugucauuggguagcgacgaugaagcugauuugguuaaagagcuucagaguaugugcagcuccaaguccgagagugacaucucuaaaauugccgacagccgcgacgaccuucggauguucgacucgucaggaaauaacccuguccuguccgccaccauuaauaaccuuaggaugccugugagccagaaagaagucaguccauuaucaagucaucagacaacagagugcucuaacucgaagaguaaaaccgagcuaggggugagucgcgugaagagcuucuuaccagugccccggucuaaaguuacccagugcucacagaauaccaaaaggagcagcucaucaagcaacaccagacagaucgaaaucaauaauaauaguaaagaagugaauuggaaccugcauaagaacgagcaucuugaaaaacccaauaaauag

SEQ ID NO: 248764 - RNA, 1233 nt, Artificial Sequence
  Description of Artificial Sequence: Synthetic coding sequence
augcagagacuccuguuuccaccacugcgugcacucaagggccggcaauaucugccuuugcucgcuccuagggcagccccacgcgcccagugcgauugcauucgccgaccauugagaccagggcaguacuccacaaucagcgagguugcauugcaguccggcagaggaacgguaaguuuaccgagcaaggccgccgagcgagugguuggaagguggcuucuaguuuguuccgguacugucgcaggcgcggugauauuaggcggcgucacaagacuuacugagucagggcuuucuaugguggauuggcacuuaaucaaagaaaugaaaccuccaacuucucaagaagagugggaagcugaauuccaacgguaccagcaauuuccugaguuuaaaauuuugaaccaugacaugacguugacagaguucaaauucauuugguacauggaauauucucauaggauguggggacgacugguaggacucguguacauccugccggccgcauacuuuuggcgcaagggcuggcuuucacgaggaaugaaggguagaguucuggcucucuguggacucgugugcuuucagggccuccucgggugguauaugguaaagucgggacuggaagaaaaauccgauagucaugacaucccccguguaucucaauacagacuggccgcacaucucggauccgcauuggucuuguacugcgccucucuauggacuaguuuaucuuugcuacuaccaccacauaagcugcccgagacacaccaguugcuacagcugagacgcuucgcacacggaacagccggccugguguuccugacagcccugucgggugcuuuuguggcuggccuagacgccggguugguguauaauucuuuucccaaaaugggugaaaguuggauucccgaagaccucuuuacuuucagcccaauccugcgcaacguguuugagaauccaacaaugguccaguuugaccaccguauccucggaaucacaaguguuaccgcuaucacugugcuguauuuucuuucgagaaggauccccuuaccucgucggacaaaaauggcugccguaacucuccuggcccuagccuacacucaggucgggcucggcauuucgacccuccucauguacgucccaaccccucuggccgccacccaucagucuggaucgcucgcucugcucacgggagcacuguggcucaugaacgaacugcgccgcguaccaaaauag

SEQ ID NO: 248765 - RNA, 2604 nt, Artificial Sequence
  Description of Artificial Sequence: Synthetic coding sequence
auggaggugccagccgcaggccgggugccggcagaaggugccccaacagccgcagucgcugaaguuagguguccagguccagccccccugaggcuauuggaguggcguguugcggcgggggcagccguaagaaucggcagcguacuggcagucuuugaggcugcagcaagugcccagucauccggggcaagucagucaaggguagcgucugguggauguguccgucccgcuaggccagaaagaagacugcguagcgagcgcgcuggcgucguaagggagcuaugcgcacagccaggucaggucgucgcccccggagcgguauuggugcgucuugaaggcuguagucauccaguggugaugaagggcuugugugcggaaugcggacaggaucugacgcagcugcagaguaagaaugggaaacaacagguaccucucaguacugcaaccguuuccauggugcacagcguuccugagcuaaugguuuccagcgagcaagccgagcaauuaggaagggaagaccaacagcgguugcacaggaacaggaagcugguguugaugguagaccucgaccagacacugauacauacaaccgagcaacacugccagcagaugucuaacaaaggcaucuuucauuuucagcucggccgcggggagccuaugcuacacacuagacugcggccgcauugcaaagacuucuuggagaaaaucgccaagcuuuacgaacuucauguauucacauuuggcucacgccuuuaugcucacacuauagccggcuuuuuggauccugaaaaaaaacuguuuucucaccgcauauugucccgugaugaauguauugaucccuuuagcaaaacuggaaaucuucgcaaccuuuuuccaugcggagauucgaugguuuguauuauugaugauagggaggacgucuggaaguucgcacccaaccugauaaccgugaaaaaguacgucuacuuucaggggacuggcgacaugaaugccccuccaggcucacgggagagucagacuagaaaaaagguaaaucauucccgcggcacagaggucagugaaccaagcccccccgugagagaccccgagggagugacacaagcacccggcguugaaccuuccaauggacuagaaaagccugcgcgggaauugaacggaucugaagcagcaacccccagggacuccccucggccagguaaaccugacgaaagggauaucuggcccccugcucaagcgccaaccaguucacaggagcuugcgggggcaccugaaccccaaggcagcugugcacagggcggccgugucgcaccaggccaaagaccggcucagggcgcuaccggaaccgaucuggauuucgaccuuagcagugacagcgagaguucuuccgagagcgagggcacaaaaucgucaucuagcgcaucagacggggagagcgaagguaagagaggaagacagaaaccuaaagcagcacccgaaggugccggcgcuuuagcgcagggaucuagcuuggagcccgggaggccagcagcccccagucugcccggagaagcggagcccggagcacaugcccccgauaaggagccagagcugggugggcaggaagagggagagcgcgaugguuuguguggacuuggcaacggaugugcugaucgaaaggaagcugagaccgaaucucagaacagcgaacugaguggagugaccgcuggggagagccuggaccagucaauggaggaagaggaagaagaagacaccgaugaggaugaccaccuaauuuaccuugaggaaauacuggugagaguacacacugacuauuacgcuaaauacgacagauauuugaauaaggaaaucgaagaagcaccugacaucaggaaaauugucccagaguugaaaaguaaaguacuugccgaugucgcaauuaucuucucuggcuugcacccaacuaacuuuccuauagaaaagacuagagaacauuaccacgcaaccgcccuuggugccaagauacugacucggcuggucuuaucuccugaugcuccugaucgagcuacacacuuaaucgccgcccgcgccggcacagagaagguccuacaggcucaggagugcggucaccuccacguugugaauccugauuggcuguggucaugccuugaaagaugggacaaaguggaagaacagcuguuucccuuacgcgacgaucauacaaaagcucagagagaaaacucaccagcugcauuuccugaccgcgaaggagugccccccaccgcccuguuucacccuaugccgguucucccuaaggcacagccaggcccugaaguuagaauauaugacagcaacacagguaagcugaucagaaccggcgcaagagggccaccugccccuagcagcucacuaccaauucggcaggagccgucaagcuuuagauggaccacaucucuugaaaaggcugccacaacugcaacagcucgcaggggaggauuacgguccaggagaagaagucccaguccuggcucucaggggccugcagguagugguagguccgggcauuuaaggccagcacggggugcacggcagggcgccggaggccccgaagcuacccguggaagcuag

SEQ ID NO: 248766 - RNA, 606 nt, Artificial Sequence
  Description of Artificial Sequence: Synthetic coding sequence
auggcaagggacuacgaccaucuauuuaaacugcucaucaucggggauuccggugucggaaagagcucacugcugcuccguuuugcugauaauacauuuucaggcucuuauauuacaaccauuggaguagacuucaagauaaggacaguggagaucaacggcgaaaaagugaaacuccagauaugggacaccgccggccaagaacgguucagaacuauuacgaguacuuauuaccguggcacucaugguguuauuguggucuaugaugugacaucugccgagaguuuuguaaacgugaagagguggcugcacgaaaucaaccagaauugugacgacgugugcagaauucuugugggcaauaagaacgaugaucccgaaagaaaggugguagaaacugaagacgccuauaaguuugcuggccaaauggguauacagcuguuugagacauccgcaaaggaaaacguaaacguggaagagauguuuaauugcauuaccgaacuugucuugagagcaaaaaaagauaaccuggccaagcagcaacagcagcaacagaaugacguggugaaauugacaaagaauaguaagagaaaaaaacggugcuguuag

SEQ ID NO: 248767 - RNA, 1530 nt, Artificial Sequence
  Description of Artificial Sequence: Synthetic coding sequence
auggcagcagcugcuggaaugcugcuucuaggauugcuccaggccggaggaagugugcucggucaggccauggagaaagugacugguggaaaucuccucuccaugcuccuuauugccugugcauucacccugagucucgucuaccugaucaggcuagccgcaggacaucucguucaguugccagccggagucaagucuccgccauacauuuucucaccuauuccuuuucugggacacgcaauagccuuugguaagucucccaucgaguuuuuagagaacgcguacgaaaaauacggcccagucuuuagcuucacuaugguggguaaaacauuuacauacuuguugggguccgacgccgcagcacugcuuuucaauagcaagaacgaggauuuaaaugcugaagacguguauagccgccuuacaaccccugucuuuggaaaaggaguggcuuacgauguaccaaaucccguauuucuggagcaaaagaagaugcuuaagucuggacuaaauauugcgcacuuuaaacaacacgucucuaucaucgagaaagaaacaaaggaauacuucgaauccuggggggaaagcggagagaagaauguguucgaagcacuauccgagcuuaucauucucaccgcgucucacugccuucacggcaaagaaauaagaucucaauugaacgagaagguggcccagcucuacgcagacuuagauggcggguucagccacgcagcguggcugcugccugguuggcuuccauugccuagcuuccgacggagagaccgcgcucacagagaaauuaaggauauuuucuauaaagcaauucaaaaaaggagacaaucacaggagaagauugacgauauacuacagacauugcuagaugcuaccuauaaggauggacgcccgcuuaccgacgacgagguggcuggcauguugauaggccuauugcuugcuggucaacauaccagcuccaccacuucagccuggaugggauuuuuccuggcacgugacaagacucugcagaagaagugcuaccuggaacagaaaacaguguguggcgagaaccuaccaccucucaccuaugaucagcuuaaagauuuaaacuuacuggauagaugcaucaaggaaacacucagacuccgaccgccuaucaugauuaugaugcgcauggcuagaacuccccaaacuguggccggcuauaccauuccaccagggcaucaaguauguguuagcccaacugugaaccagcgccuaaaggacagcuggguagaaagacuugauuuuaaccccgauagauaucuccaggacaacccagccucuggggagaaguucgcguacgucccauucggcgcuggcagacaccgaugcaucggggaaaauuucgcauacgugcagauaaaaaccaucugguccacaauguuaagacuguacgaguucgaccugauugauggcuacuucccuacaguaaacuauaccaccaugauucauacgccagagaaccccguuauuagauauaagcgccguuccaaauag

SEQ ID NO: 248768 - RNA, 1080 nt, Artificial Sequence
  Description of Artificial Sequence: Synthetic coding sequence
augaaggcaaccauuauucuacuguuguuagcucaggucagcugggcugggccauuccaacaaaggggccuuuucgacuucaugcuggaagacgaagcaagcgguauuggcccggaaguucccgaugaucgcgacuucgaacccucccugggcccaguuuguccauucagaugucagugccacuugcgggucguacagugcagcgauuuaggccuagauaaaguacccaaagaucucccuccugacaccacuuuguuggacuuacaaaauaauaaaaucaccgaaauuaaggauggagacuucaaaaaucugaagaaucuccacgcacugauccugguuaauaauaaaaucucuaagguuucccccggcgcauuuaccccacuugugaaguuggaacggcuuuaucugucuaaaaaccagcuuaaggaguugccugaaaaaaugcccaaaacucuccaggaacugagagcccacgaaaaugaaauuacaaaagugcgaaaagucaccuucaauggacugaaucaaaugauugucaucgaacucggcacaaauccacugaaaucaagcgguauugaaaacggcgcauuucaaggcaugaagaaacucucuuacaucaggaucgccgauacgaauauuaccuccauaccucagggccugccuccuagccucaccgagcuccaucuugauggaaauaagaucucacgaguagaugccgcuagccuuaaaggacucaacaaccucgcaaagcuuggacuuuccuuuaauagcauaagugcaguggacaauggcagccucgcaaauacuccucaccuacgggaacuucaccuggacaauaauaaacuaacucggguuccaggcggacuagccgagcauaaauauauccaaguaguguaccuucacaacaauaauauuucugucguaggaucuagugauuucugucccccaggacacaacaccaagaaggccucuuacucuggcgucagucuauuuucaaaccccgugcaguauugggagauccaaccgucaacuuuucgaugcgucuauguccgcucagccauucaacugggaaacuacaaauag

SEQ ID NO: 248769 - RNA, 909 nt, Artificial Sequence
  Description of Artificial Sequence: Synthetic coding sequence
augcacuaccccacagcucuuuuguuccugauacuugccaauggggcacaggccuuuagaauuugcgcuuuuaaugcccagagauugacccuggcuaaaguggcacgcgaacagguuauggauacauuaguccgcauucuugccagaugugacauuaugguccugcaggaagugguugacagcuccgguagcgcuaucccccuacugcugcgggaacugaacagauuugacggaucaggccccuauucuaccuugagcucuccccaguuagggcggucgaccuauauggagacuuacguuuauuuuuauagaucccauaaaacccagguccugagcuccuauguauacaaugaugaagaugacguauucgcuagggaacccuucguugcgcaauucagccugcccuccaauguccucccaucuuuaguauuaguaccgcuucauaccacuccuaaagccguagagaaagagcugaacgcucuuuacgaugucuuucuggaggugagucagcacuggcagucaaaagaugucauucuacuuggggauuucaaugcugacugugccucacuuacuaagaagagacuugacaagcuggaauugagaaccgaaccuggcuuucacuggguuauagcagauggugaggauacuacaguacgcgcaagcacacauugcacauaugauagagugguacugcacggcgagcguugccguucccuccugcacaccgcugcagcauuugacuuucccacaucuuuccagcugacagaagaggaggcccucaacaucucggaucacuacccaguugaaguggagcuuaaauuaucucaagcucauucuguacaaccauuaucucugaccguccuucuccugcugucgcugcucuccccccaacugugccccgccgcauag

SEQ ID NO: 248770 - RNA, 282 nt, Artificial Sequence; identical to SEQ ID NO: 248164
  Description of Artificial Sequence: Synthetic coding sequence

SEQ ID NO: 248771 - RNA, 1689 nt, Artificial Sequence
  Description of Artificial Sequence: Synthetic coding sequence
auggacgccaugaaacgaggcuuauguugcguucuccuauugugcggugccguguuugugagcccaucccaagagauucacgccagauuuagacguggcgcccgauccuaccaggugaucugcagagacgaaaaaacccagaugaucuaccaacaacaccagagcuggcugagacccgugcuccggagcaaccggguggaguacuguuggugcaauuccgggagggcgcagugccacucaguucccgucaagucguguucggagccacgauguuuuaauggagggacaugucagcaagccuuguacuucuccgacuucguuugccaauguccugaaggcuucgcaggaaagugcugcgagauugacacccgugccacaugcuaugaggaucaagggaucuccuaccggggcaccuggucuacagcagagucuggagcagaaugcaccaauuggaacucuagcgcacucgcucagaaacccuacucuggcagaagacccgacgcaauucgacuuggccugggcaaucauaacuacuguagaaauccugauagggauucaaagccuuggugcuacguuuuuaaagcugguaaguauagcucugaguucugcucuacaccugccugcucagagggcaauuccgauuguuacuucgggaauggguccgcauacagaggcacacauagucuuacugaauccggugcuagcugucuuccuuggaauagcaugauccuuauugguaaaguauacaccgcacaaaacccaagcgcacaggcuuuagggcucgggaagcacaacuacugucgaaacccugacggcgacgcgaaaccuuggugccacgugcucaagaaucggcgccugacuugggaguacugcgauguacccagcugcucaacauguggguuacggcaauauucgcagccucaauuccguauuaagggggguuuguucgcugauaucgcuucucacccuuggcaggcugccauauucgccaaacaccgacgguccccaggagaaagguucuuguguggagggauccugauuaguaguuguuggauucugucugccgcucauugcuuccaagaacgcuuuccaccucaccaucuuacugugauccuaggaaggacguaucgaguagugccuggagaagaagaacagaaauucgagguggaaaaguauaucguccauaaagaguuugaugacgauaccuacgacaacgacauugcacuguuacagcugaaaucugauucaucucgcugugcccaggagucuagcgugguacgaacaguauguuuaccuccugccgaccugcagcugccagauuggacugagugcgaacuaagcggcuauggaaaacacgaagcccugucacccuucuacucagagcgccuuaaggaagcacacguaaggcucuaucccuccucucgcuguacaagccagcaccuucuuaaccgaaccgugacggauaacaugcuuugcgccggugacacaagaucugggggaccacaggcaaaccuucaugacgcuugucagggcgacaguggcggccccuuaguuugcuugaaugauggaagaaugacacuuguggggauuauaaguuggggucuugguugcggccagaaggaugucccaggcguguacacuaaggugacuaacuaccuugacuggauucgugauaauaugcggccuuag

SEQ ID NO: 248772 - RNA, 5286 nt, Artificial Sequence
  Description of Artificial Sequence: Synthetic coding sequence
augcaguuccaguuaacccucuuucugcacuuaggauggcugaguuacuccaaggcccaggacgacugcaaccgaggugcuugccacccuacuaccggagaccuccucgucgggagaaauacccaguuaauggcuucauccacuugcggacuuucuagggcucagaaguauugcauacugucuuaucuggagggagaacagaaguguuuuauuugugauagcagauuuccauacgaccccuacgaccagccuaauucccauaccauugaaaauguuauuguaaguuucgaacccgaucgggagaaaaaaugguggcagucagagaacggguuggaucacguuagcauucgauuggaucuggaggcacuuuuccguuuuucccaucucauccucacuuuuaaaacuuuuaggcccgccgccaugcugguggagagaaguacagauuacgggcauaacuggaaggucuuuaaguauuuugcaaaagauugugcgacuucuuucccaaacauaaccucgggccaagcucagggugucggcgacaucguaugcgacuccaaauacagcgauaucgaaccaucuaccgggggcgaaguuguccuaaaaguauuggacccuuccuuugagaucgagaaccccuauucgccauauauacaggauuugguuacucuuaccaaccuccggaucaacuuuaccaaacuccauaccuugggugaugcucuauugggccggcgucaaaaugacucccuggacaaauauuauuacgcgcuguaugaaaugaucgugcgugguucauguuuuuguaacggucacgcuucagaaugccguccuaugcagaaaaugcggggagacgucuuuaguccucccgggaugguccauggacagugcguaugccagcauaacaccgauggaccuaacugcgaacgaugcaaagauuucuuucaagaugcucccuggcggcccgcagcagaucugcaggauaacgcuuguagguccugcaguuguaacagucacuccagccgaugucauuuugacaugaccaccuaucuugcuagcggaggucugagcggcggcgugugcgaggauugucagcacaauaccgaaggacagcacugcgacagaugucggccucuuuuuuauagagauccccuaaagacuauaucagacccauaugcguguauaccaugugaaugcgacccugauggcaccauuuccgggggcaucugcgugagccacagcgaucccgcacugggcuccguagcuggucagugucucuguaaagagaacgucgagggggcuaaaugcgaucaauguaaaccuaaucacuacggcuugucugcgaccgauccacuaggcugucaaccgugcgauugcaacccacuggggaguuugccauucuuaacuugugacguggacacagggcaguguuugugccugagcuacgugacuggagcucacugugaagaauguacuguugguuauuggggucuggggaaucaccuucauggcuguuccccaugugauugcgauauuggcggcgcuuacaguaacgugugcucccccaagaauggccagugcgaaugccgcccucacgucaccggacggaguuguuccgaacccgcuccuggauacuucuucgccccccugaacuuuuaucuguacgaagcugaagaagcgaccacccugcaaggauuagcuccgcugggcucagaaaccuucggucagucacccgcuguccacguagugcucggugaaccaguacccggaaacccagucaccuggaccggccccgguuucgcccgggugcuucccggcgcaggccugcgcuuugcaguuaauaacauacccuucccaguugauuuuacaauagccauacacuacgagacccagagugccgcggauuggaccguccaaauugucgugaaucccccaggcggcuccgagcacuguaucccaaaaacccuccaaaguaagccccagucauuugcuuuaccugccgcuacgcgcauaaugcuucugccuacacccaucugcuuagaaccugaugugcaguauaguaucgauguauacuucagucagcccuugcagggggagucucacgcacauagucacguacucgucgauucccucggacugaucccacagaucaauuccuuagaaaauuuuuguuccaaacaggacuuagaugaauaccagcuacacaauuguguggagauugccagcgcuaugggcccacaagugcugccuggagcuugugaacgucugaucauauccaugagugcaaaacugcaugauggugccguggcuugcaaaugccauccucaagguucagucgguaguucauguucgaggcuaggcggucaaugccagugcaaaccacucguagucggccgcuguugugaucgguguucaacggguucuuaugacuuaggucaccacgguugucacccuugucauugccacccacaagggucaaaagacacagugugugaucaggucaccggucaguguccuugccacggugagguuucugguaggagaugugaucguugcuuagcagguuauuucgguuuccccuccugucacccuuguccgugcaauagguuugccgagcuuugcgaccccgagacugguucuugcuucaauugcggcgguuuuaccacuggaagaaauugugagcgaugcauugauggcuacuauggaaacccguccucgggucagcccuguaggccaugucuaugcccagaugacccuucuucuaaucaauacuuugcccacuccugcuaccagaacuuguggagcuccgacgugauuuguaacuguuuacaagguuauacuggaacacaguguggcgaguguagcaccgguuuuuacggaaacccuagaauaagcggcgcccccugccagccaugcgccuguaauaacaauauugaugugacagaccccgaaucuugcucgcgagugacaggugaaugccugcguugucugcauaauacucaaggcgcuaacugucagcuauguaaaccuggacauuacggcucagcccugaaucagaccugcagaagguguucuugccaugcuuccggaguuagcccgauggaauguccaccaggaggaggagcuugccucugcgacccaguaacgggugcuugcccguguuuacccaauguuacagguuuggcuugugaucguugugccgacgguuauuggaauuuggucccuggccgagguugccaaucgugcgacugugacccgcgcaccucccagaguucucauugcgaccagcucacagggcaguguccauguaaacucggauacggugguaagcgauguucagaaugucaagaaaauuauuacggggaucccccaggaagaugcauucccugcgacugcaauagagccggcacucaaaagccaaucugugacccugacacaggcaugugccgcuguagggaaggcguuaguggccagagaugcgaccggugcgccaggggccauagucaagaauuuccgacaugcuugcagugccaccucugcuucgaucaaugggaucauaccaucagcucacuuaguaaagcuguucagggacuaaugaggcuggccgcaaacauggaggacaaaagagaaacccugccagugugugaagcugauuuuaaagaccucagagguaaugugagugaaauugaacgcauauuaaaacacccuguuuuucccaguggaaaguuccugaaggugaaagacuaccacgacucaguucggagacagauuaugcagcuaaacgagcaacugaaggccguguacgaguuucaggaccugaaagauacaaucgagcgagccaaaaaugaagcugaccuacuucucgaggauuuacaggaagaaauugacuugcaauccucugugcugaacgcaucaauagccgauaguucugagaauauaaaaaaauacuaccauaucucaaguuccgcggaaaagaagaucaacgaaacuucaagcaccauaaacaccagcgcgaacaccagaaacgaucuccucacaauccuugacacguugacaucuaaagggaaucugagccuggaacgucuuaagcagaucaaaauccccgauauucaaauacugaaugagaaaguauguggcgauccggggaacgugccgugcguuccucugccuuguggaggcgcucucugcacuggaagaaagggccaccguaaguguaggggaccugguugucauggaucgcucacucuaucaacgaaugcucugcaaaaagcccaagaggccaaaagcaucauacgcaaccuggauaagcaggucagggggcugaagaaucaaaucgagagcaucucugaacaggcggagguaagcaagaauaaugcucugcaacuaagagaaaaacugggaaacaucaggaaccaguccgacagcgaagaggagaauaucaaccuguuuaucaagaaagucaaaaauuuucuuuuggaggagaacgugccaccugaggauaucgagaaaguagcaaauggcgugcuugauauucaccuccccaucccaagccagaacuuaaccgacgaacugguuaagauacagaaacauaugcaacucugcgaagacuacagaacugaugagaaccgguugaaugaagaagcagauggggcgcaaaaacuucuggucaaggcaaaggccgccgaaaaagccgcaaacauccuauuaaaccuagauaaaacacugaaccagcugcagcaagcacagaucacucaaggucgagcuaacucaaccauuacccagcugacggcuaauauuacgaagauuaaaaagaacguucuucaggcagaaaaccagaccagagagaugaaguccgagcuggaguuagcaaaacaacgcaguggccuggaagauggauugagcuuacugcagacaaagcugcagcggcaucaggaucaugcaguuaacgccaaagugcaggcagaguccgcccaacaccaggcaggaaguuuggaaaaagaauuuguggaauuaaagaaacaguacgccauccuacaaagaaagacuaguacaacuggccuuacaaaagaaacgcugggaaaagugaagcagcucaaggacgcagccgaaaaauuagcgggcgacacagaagcaaagaucagacgcaucacagacuuggaacgaaaaauucaggacuugaaucuaucucgccaggcuaaagcagaccaguugcgcaucuuggaagaucagguuguagcgaucaaaaacgaaaucguggaacaggagaaaaaauaugcccgauguuacuccuag

SEQ ID NO: 248773 - RNA, 798 nt, Artificial Sequence
  Description of Artificial Sequence: Synthetic coding sequence
augaugaccaugacuacaauggcagauggacuugaaggucaagauagcucuaaaucugcuuuuauggaguuuggacagcaacagcagcaacagcacucuccugcgauggcaggugcacauuacccucugcacugucugcauucugcagcugccgcagccgccgcagggucucaccaccaucaucaccaccaacaucaucaucauggcucaccuuaugcuuccggaggugguaauuccuauaaccaccggucccuggcagccuauccauacaugucacacucacagcacaguccuuaccugcaaucauaccauaauucuuccgcugccgcucagacucgaggcgacgacacagaccagcagaagacaacagucaucgagaauggagaaaucagauuuaacggcaagggaaagaagauacgaaagccacguacaauauacaguucuuuacaacugcaggcucucaaccauagauuccaacaaacacaauacuuagcucuuccugaacgagccgaguuggccgccagccuuggauugacucagacccaaguuaagaucugguuccagaacaaaagaaguaaauucaagaagcuucugaaacaggguucuaauccucacgagucagacccucuacagggaagcgcagcccucucuccaagguccccagcacuuccacccguaugggauguuuccgccagugccaaaggagugucgaugccccccaacucauauaugcccggcuacagccacugguacaguucaccccaucaggacacuaugcagcggccucagaugauguag

SEQ ID NO: 248774 - RNA, 1563 nt, Artificial Sequence
  Description of Artificial Sequence: Synthetic coding sequence
augccugcuagcgagcucaaggcuagugagaucccauuucauccaucuaucaaaacccaagauccgaaagcagaggaaaagucuccuaaaaaacagaaagugacauuaaccgcagccgaggcacugaaacuauuuaaaaaucaguuguccccauaugagcagagcgagauccuuggcuacgcagagcuaugguuccugggguuggaggccaaaaaguuagauaccgcccccgagaaauuuucaaagacgucauuugaugacgagcacggauuuuaucugaaaguacuacaugaucauaucgccuaucguuacgaggugcuggagacaaucgguaaggguucuuuuggacagguagcaaagugucuagaccauaaaaauaacgaguuaguugcauuaaagaucauccgcaacaagaagagauuucaccaacaggccuugauggagcugaagauacucgaggcuuugagaaagaaagauaaggauaauaccuacaacguaguacauaugaaggauuuuuuuuacuuccgaaaccauuucuguaucaccuucgaacugcuuggcauuaaccuuuaugaacuuaugaaaaauaacaauuuccagggcuuuucucuuucaaucguucggagauucaccuuaucugugcugaagugccuacaaaugcugucgguggaaaaaauuauucauugcgaucuuaagccugaaaacaucgugcuuuaccaaaaggggcaggccucugugaagguuaucgacuucgguucuaguuguuacgagcaucaaaaaguguauacuuacauccaaucgcgguuuuacagaaguccugaagugauccugggacaccccuaugacguugcuauagacauguggucccuggguuguaucaccgcagagcuauauaccggguauccucucuuucccggcgaaaacgagguagagcaauuagcuuguauaauggaagugcucgggcucccucccgcugguuuuauucaaacagcuuccagacgacagacauuuuucgauuccaaaggcuucccgaagaauauuaccaauaauagggguaagaaaagguaucccgacuccaaagaccucaccauggugcuuaagacauaugacaccuccuuuuuagacuucuugcguaggugccuagucugggaaccuucucucaggaugacucccgaccaagcgcugaagcaugcuuggauccaccagagccgcaaccucaaaccccagccccggccucagacccugagaaagucaaacucauucuucccuuccgagacacgcaaagauaaagugcagggaugccaccacuccaguagaaaagcggacgaaauuacaaaagaaaccacagaaaagacaaaggacucaccaaccaaacauguucagcacagcggcgaucagcaggacugucuccagcauggggcagauacgguucagcucccucagcucguugacgcccccaaaaagucagaggcagcugugggugcugaaguaucaaugacuaguccuggccaguccaaaaacuuuucucugaaaaacaccaacguucucccacccauuguguag

SEQ ID NO: 248775 - RNA, 2619 nt, Artificial Sequence
  Description of Artificial Sequence: Synthetic coding sequence
auguccuccaaagccgagaagaagcagagauuaaguggaagggggaguucucaggcuucaugguccgggagagcuacgcgcgccgcagucgccacucaggagcaaggaaacgcucccgcugugagcgaacccgaguuacaagcugaguuaccaaaggaagaacccgaaccaagauuggagggcccccaggcccagucugaggaaucuguggagccugaagcugacgucaagccucucuuuuuaucccgggcugcucugaccggacucgcugacgcaguguggacacaggaacacgacgcuauucuggaacacuucgcacaggacccaaccgaaagcauccucacaauauuuauugaucccugcuucggguuaaaauuagaacuuggcaugccugugcaaacccaaaaucaauuaguuuacuuuauccgccaggcuccuguuccuaucaccugggagaacuuugaggcuacugugcaguuuggaacggugagaggaccauauauaccugcccuccugcgccugcuagggggaguuuuugcuccucagaucuuugccaauaccggcuggccagagucuauccgcaaccacuuugcuucccacuuacacaaguuucucgccugucugacagauacacgauauaagcuugaaggacacaccguguuguacauucccgcggaagcuaugaacaugaaaccggagauggugauuaaagauaaagaacugguacagcggcuugagacuaguaugauccauuggacucgacagauuaaagagaugcugagugcucaggagacaguagaaaccggagagaaccugggcccccuugaggaaaucgaguucuggcgaaauagauguauggaccugaguggaauaagcaagcagcuuguaaagaaaggugucaaacacguggaauccauuuugcaccucgccaaaagcaguuacuuagccccauuuaugaaauuggcucagcagauucaggaugggagcagacaggcacaguccaaucugaccuuccuuagcauacugaaagagccguaucaggaacucgcuuuuaugaaacccaaagacaucagcuccaaacuuccgaagcucauuucucucauuagaaucaucugggugaacucuccucauuacaauacccgugagcgacucacaucucuguucaggaagaugaguaaugaaaucauacgucucuguugccacgccauuucucucgaccggaucuuugaggguuacgucucuucguccaaggaagaccuacagggguguauacuuugcugccacgcuuggaaggaccauuauguucaggccgugcagaugcacauacaguuuagcucgagaggcuggguucuggaccaaacaucuaucuuugcccaagucgaugccuucgugcaacgauguaaagauuuaaucgaggucugcgauugucaauaccauuucgcucggugggaagaugguaaacaaggcccgcucccguguuucuuuggggcucagggcccucagaucacaagaaauuugcuggaaauugaagacauuuuucacaagaauuugcacacgcuuagggccgugagaggggggauucuggacguaaagaauacauguuggcacgaggauuacaauaaauuuagagcaggcauaaaggaccuugaagugaugacccaaaaucucauaacauccgccuucgaguuggugcgggacgucccucauggagugcugcugcuggacaccuuucacagacucgcauccagagaagcgauuaagcggacauaugacaaaaaggcugucgaccuguacaugcuuuucaacucugaacuggcucucgugaauagggaacggaacaagaaguggcccgaccuagagcccuacguagcacaguacuccggaaaggcucgauggguacacauccugagaaggagaaucgacagagucaugaccuguuuggccggugcacauuuucuaccacgcauuggcaccggaaaggagagcguacauacuuaccaacagaugguacaggcaaucgaugaacuggugaggaagacauuucaagaauggacgaguucacucgacaaagauugcauucgccggcuugacaccccuuuauuacgaaucagucaagaaaaagccggaaugcucgacguaaacuuugacaaauaucgcucucaucucgcacccuuucccuacacaccguugcuccaacugucucaagaguuccacucccaccuccuuaccccacuguucauaauccucucacugucacauaccauaugccuucuuagcagcuuuuacuuuuucuucaguucauuuauuuucgugucgccccaccucccccccugcuaucagcauuuuaauuucaccacauaccuaaagacccagcagaauaagaccaugauugggcaagccaggugguugaccccugugaucccagcacugugggaggcugaggugggggccagccucgagccacgaucucuuagaacagcaugggccacuuggcagaaucccguuucagcaaaaaacacaaagauuucaugggcaugguggcacaaaccuguggucuccgcaacuugggagggugaggugggggguuccccggagccuggaagacaaaggcugcaguag

SEQ ID NO: 248776 - RNA, 2592 nt, Artificial Sequence
  Description of Artificial Sequence: Synthetic coding sequence
auggcacgccgaagcagcuuucaguccugucagaucauuucacuauuuacauuugccguaggagucaauaucugcuugggauucaccgcccacaggauuaaacgcgccgaaggaugggaggaaggcccaccaacuguauugucugauucucccuggacgaauauuuccgggagcuguaaaggaagguguuucgaacugcaggaagcaggacccccugauugucgaugcgacaaucucugcaagaguuacaccagcuguugccacgacuucgaugaacugugucuuaaaacugcucggggcugggaauguaccaaagacaggugcggcgaggugagaaacgaggagaaugcaugccauuguagugaagauugcuuagcccgaggcgacuguugcaccaacuaccaggucguaugcaagggagagagucauuggguggaugacgacugcgaggaaauuaaagcugcagagugcccagcaggguuugugaggccaccgcucaucauauuuuccgucgacggcuuuagagcuagcuacaugaaaaagggcaguaaggugaugccaaacauugagaaacucagaucuugugguacccacagcccuuauaugcgccccgucuacccuacaaagacauuccccaaucucuacacauuagccaccgguuuguauccggagagccacggaauagugggcaauuccauguacgacccagucuucgaugcuacauuucacuugagagggcgugagaaguucaaccacagaugguggggaggucagccucuuuggauaacugcuaccaaacagggggugaaagcugguacuuuuuucuggucaguggugauuccccaugagagacgcauccugacgauauugcagugguugaccuugccugaccaugaacggccaagcguguacgccuuuuauuccgagcagcccgauuucucuggccacaaguacgggccauucggaccugagaugaccaacccucugcgggaaauugacaaaauugugggccagcugauggacggucugaaacagcuuaagcuccaucgcugugugaaugugauuuucgugggagaucaugguauggaagauguuaccugugaccggacagaguuucuaagcaacuaucuuacuaauguggacgacaucacccuggugccuggaacccuugggagaauuaggaguaaauuuagcaacaaugccaaguacgauccuaaagccauuaucgccaaccuuacuugcaagaagccagaccaacacuuuaaaccguaucucaaacagcaccuucccaagcgccugcauuaugcuaacaaccgccgcauagaagacauccaucugcugguggaaaggagguggcacguagcgcggaaaccucuggauguguacaagaaaccuagcggcaaauguuuuuuucagggggaucaugguuucgauaacaaggugaauucuaugcaaacuguuuucgucggguacggcucaacuuuuaaauacaagaccaaagugcccccuuuugagaacaucgaguuguacaacguuaugugugaccugcucgguuugaaaccagcgccgaacaaugggacucacgguuccuuaaaucaucugcuaagaacaaauacuuuuagaccaacuaugccagaggagguaacucggccaaacuaucccgggaucauguaccugcagagugauuuugauuuaggcugcaccugugacgauaaaguugaaccuaagaauaagcuagacgaacuuaauaaacggcuucacaccaagggcagcacagaagaaagacaucuccucuacgguaggccugcaguccuguauaggacccgguaugauauacucuaucacacagacuucgaaucaggcuacucugagauuuuucugaugccccuuuggaccagcuacacugugagcaaacaggccgaggucagcagcguuccggaucacuuaacuucuugcguucguccugacguccgaguaucuccuuccuuuucacaaaauugccuagcauauaagaacgacaaacagaugaguuacgguuuuuuauuuccuccuuaucuuucuagcuccccugaagccaaauacgaugcauuccuggucacgaauauggugccuauguaucccgccuuuaaaagaguuuggaacuacuuccagcgagugcucgugaagaaguacgcuucugagagaaacggcguaaacgugauuucuggccccaucuucgauuacgauuaugacggacugcaugacaccgaagauaagauuaagcaguacguugaaggcucuaguauacccgucccaacucacuauuacuccauuaucaccagcugucuggacuucacacagcccgcugacaagugugauggccccuuaucagucaguucauucauucuaccucaucgaccagacaacgaagaguccugcaauucuagcgaggaugaauccaagugggucgaagagcuuaugaagaugcauacugcaagagugcgcgauaucgaacacuuaacuagccucgauuucuucagaaaaacaagucggaguuaccccgaaauucucacacuaaaaaccuaccuccauacuuacgaguccgagauauag

SEQ ID NO: 248777 - RNA, 1332 nt, Artificial Sequence
  Description of Artificial Sequence: Synthetic coding sequence
augcuucccugugcuucaugucugcccggaucccuucuccucugggcucuucuucugcugcuguugggguccgcaucuccccaagauagugaagaaccugacuccuauaccgaauguacagacggcuacgaaugggacccugauucucaacauugcagggacgugaacgagugucugaccauccccgaagcuugcaagggugaaaugaaaugcauaaaucacuacgguggguaucuuugucucccacgguccgccgccguuaucaaugaucuacacggugaaggcccaccucccccggucccaccagcccagcaccccaaccccugucccccaggcuaugaaccugaugaccaggacucgugcguugauguggaugaaugcgcccaggcccuccaugauugccgaccuucccaggauugucacaacuugccuggcucuuaucaguguacaugucccgacggcuaccgaaaaaucggaccagagugcguggacaucgacgaguguagguauagauauugccagcaccggugugucaaucucccaggaucguuccggugucaaugugaaccaggguuccaguuaggcccuaauaaucggucauguguagaugugaaugaaugcgauaugggagcucccugcgagcaaaggugcuucaacagcuacggaacuuuuuugugcaggugccaucagggauacgaguuacaucgggauggauucaguuguagcgacaucgaugagugcucuuauagcucuuaccuaugucaguaccgguguauaaaugagcccggucguuucuccugccacugcccccagggguaccagcugcuggccacacggcugugucaagauaucgaugaaugugagagcggcgcccaccagugcagcgaggcucagaccuguguuaacuuccaugggggauaccguuguguugauacuaauagguguguugagccguauauucaggugagcgagaaucguugccuguguccugcuuccaauccacugugccgcgaacagccuucaagcaucgugcaccgcuacaugacuaucaccucugaacgaucugugccagccgaugucuuccaaauccaggccaccucuguguaucccggagcguacaacgcauuucaaauacgagcugggaacagucaaggcgacuucuacauaaggcaaaucaacaaugucucggcaaugcuuguccuugcucgaccugugacuggcccgagagaauacgugcucgaucuggaaauggugacaaugaacucucugaugagcuaucgcgcuucaagugugcucaggcugaccguuuucguuggugcauauacguucuag

SEQ ID NO: 248778 - RNA, 609 nt, Artificial Sequence
  Description of Artificial Sequence: Synthetic coding sequence
auguugcccugcgcaagcugccugccggggagcuuacuccucugggcccuacugcuccuucugcuugguucugccuccccgcaggauucugaagagcccgauucuuacaccgaauguaccgauggcuacgaaugggauccagauagccagcacugccgugacgucaaugaaugucucacaaucccagaggccuguaagggagagaugaaguguaucaaccauuacggcggcuaccuguguuugccaagaagugccgcagucaucaacgaccuccacggagagggcccuccuccacccgucccaccugcacaacaucccaaucccuguccucccgguuacgagcccgacgaucaggacucaugcguggacguugacgaaugcgcccaggcacuucacgacugccgccccucccaggauugccacaaucuuccaggaagcuaucaguguacuugcccagacggauaccgaaaaaucggcccagaauguguggauauagaugagugucgcuacagguauugucaacaccggugcgugaaucuuccgggaagcuuucgcugccagugugagcccggauuccagcuagggccaaacaacagaucaugcguguag

SEQ ID NO: 248779 - RNA, 552 nt, Artificial Sequence
  Description of Artificial Sequence: Synthetic coding sequence
augcuucccugugcuagcugcuuaccugggucacuguuacugugggcacucuuacuucuucuucucgguucagcaagcccucaagacagugaagaaccagacagcuauacugaauguaccgacggcuaugagugggauccggauucccagcacugcagagacguuaaugagugucuaaccauuccugaagcgugcaagggcgaaaugaagugcauuaaucauuacgguggauauuuauguuugccaagaucugccgcagucauuaacgaccuacauggagaaggcccgcccccgccuguccccccugcccagcaucccaaccccuguccuccuggcuaugagccugaugaucaggacucgugcguggauguagaugagugcgcacaagccuugcaugacugccgaccuucucaagacugucacaaucucccaggcucguaucagugcaccuguccagauggcuauagaaagaucggcccugaaugcgucgacauugaugaaugucgcuacagauacugucagcaccgcugcgucaaucuuccaggcucuuag

SEQ ID NO: 248780 - RNA, 1332 nt, Artificial Sequence
  Description of Artificial Sequence: Synthetic coding sequence
augcucccaugcgcaucaugccuacccggaagccugcuccucugggcacuccugcuacuucuccuugggucagcuucaccucaagacagugaagagccagauagcuacacagaauguaccgauggcuaugagugggauccugacagucaacauugcagagacgucaaugagugccucacgauucccgaagccugcaagggcgaaaugaaauguauuaaccacuacggaggguaucugugcuugccucgcagcgcagcgguaaucaaugaccugcacggggagggaccuccgccaccggugccaccugcucagcaccccaacccauguccccccggcuacgaaccagaugaccaggauucuuguguggacguggacgagugugcgcaggcgcugcaugacuguagaccuucacaggacugccacaacuugccugguucauaucagugcacuugccccgacggcuaucggaagauuggaccagaaugcguagauaucgaugaaugcagauaccgcuacugucagcaucggugcgucaauuuacccggcucauuucguugccagugugaaccgggauuccaacugggaccuaacaaucgcuccugugucgacgugaacgagugcgacaugggagcaccaugugagcaacggugcuucaacagcuauggaacauuucugugcaggugucaccagggguacgagcuacaucgggacggauucucuugcagcgacauugaugaaugcagcuacaguagcuauuuaugccaauaccggugcauaaacgaaccaggaagauuuucaugccacuguccucagggauaucaacugcucgccaccagacugugucaggauauugaugaaugugaaaguggggcgcaccaauguagcgaggcucagaccugugucaacuuucacggaggguaccguuguguugauacuaaucgcugcguggagcccuauauacaggugagugagaauaggugccuguguccagcuucuaacccacucugccgcgaacaaccuucuucaauuguccaucgguacaugacaauuacuucagagagaucugucccugcugauguauuucagauccaggcuaccaguguuuacccaggugcuuauaacgccuuucaaauccgugcugguaauucccagggugauuuuuacauacgacagaucaauaaugugagcgcuaugcucguucuagcacggccuguuacaggaccacgagaauaugucuuagauuuagagauggugacaaugaacucgcugaugucauaccgagccuccaguguccugcgguugaccguuuuuguaggcgccuauaccuuuuag

SEQ ID NO: 248781 - RNA, 3018 nt, Artificial Sequence
  Description of Artificial Sequence: Synthetic coding sequence
auggcaccagcuagaggccggcugccaccagcacuauggguuguuacagcagccgccgcagcagcuacuuguguuagugccgccagaggggaaguaaaccugcuugauacaucuacuauacauggagacuggggcuggcugaccuaucccgcucaugguugggauagcaucaaugaagucgacgaguccuuccagccuauucauaccuaucaggugugcaacguuaugagcccuaaccagaacaacuggcuacgcacguccuggguuccuagagauggugcucggagaguguaugcagagauaaaauuuacucucagagauuguaauuccaugccugggguccugggaacuugcaaagaaaccuucaacuuguacuaucuggaaagugaccgugauuuaggugccagcacgcaggagucucaguuucuuaaaaucgacacuauugcugcugacgaaaguuucacuggggcggaucuuggggugagacgacugaaacugaauacugaagugcgguccguagguccccucucaaaaaggggcuuuuaccuggccuuucaagauaucggcgccugucuagccauccugucacugaggauuuacuauaagaagugccccgcgauggugcgaaaucuagcagccuuuucagaagcagugacaggagcugauucauccagucuaguggaaguuagaggccaaugcguccgccauagcgaggagcgggauacuccgaagauguacugcucugccgagggagaauggcuuguuccaauuggcaaguguguauguuccgccggcuacgaagagagaagggacgccugugucgcaugcgagcugggcuuuuacaaaucugccccaggggaccagcugugcgcgcgcugcccaccccauucucacucugccgcccccgcagcucaagcuugccauugugaucugucuuauuacagagccgccuuggauccuccaucauccgccugcaccaggcccccuucugcccccguuaaucuuauuagcucagugaauggaacaucagugacccucgaaugggcuccaccccucgacccuggcggcagauccgacauuacuuauaacgccguaugccguagaugucccugggcccuaucucgaugugaagcguguggaucugggacgcgcuucguuccccaacagacuucucugguucaagccagucuguugguggcgaauuuguuagcccacaugaacuacagcuuuuggauagaagccguaaacggagugagcgaucuaucccccgaaccaagaagagccgcuguugugaauaucacaaccaaccaggccgccccuagccaggucguuguaauucggcaagaacgcgcggggcagaccuccgugucccuucucuggcaggaaccagagcagcccaacgguaucauacucgaauacgaaauuaaauacuacgaaaaggauaaggaaaugcaguccuauucuacgcuuaaagccgugaccaccagagccacagucuccggccugaaacccgggacccgcuauguguuccaagugcgugccaggacaagugcgggcugugggagauuuucccaggccauggaggucgaaacaggaaagccccgaccgcgauaugauacacggacuauuguguggaucuguuugacccuaaucaccgguuuggucgugcuccugcuccuccugauuuguaaaaagcgucacugcggauauucuaaggccuuccaagauucagacgaagagaaaaugcauuaccagaauggacaggcaccucccccuguguuccucccauuacaccauccucccggaaagcugccggaaccacaauucuaugccgaaccgcauacguacgaggagccaggacgcgcagggagauccuuuacucgggaaauagaggccagcagaauccacaucgagaagauaauugguaguggugauuccggagagguuuguuacgguaggcugcggguaccaggacaacgggacgucccaguggccauaaaagcccucaaagccggauacaccgaaaggcagagacgagacuuccucagcgaggcaucaaucaugggacaguuugaucaucccaauaucauccguuuggaagguguuguuacuagggggagacuugcaaugauugugacagaguacauggaaaacgggucacuugauaccuuccugcgaacccacgacggacaauuuaccaucaugcaacugguuggaaugcuucggggcguuggcgcaggaaugagauaucuguccgauuugggcuaugugcaucgagaccucgcggcccgaaacgugcuuguugacucaaaucuaguguguaaagugucggauuucggacuuaguagagugcuggaggaugacccggacgcugcauacacuacuacuggggggaagaucccgaucagauggaccgcuccugaggccaucgcuuuucgaacauucucuucagccagcgaugucuggucuuuuggcguagucaugugggaggugcuagcauacggcgaacgccccuacuggaauaugaccaacagggacgugauaagcucuguggaagagggauacagacuccccgcucccaugggaugcccucaugcccuacaucaauugaugcuagauuguuggcacaaagauagagcacagcgacccagauucucucaaauuguuuccguguuggaugccuugauucggucuccugagucucuuagagcaaccgcaacgguaucgagaugcccuccaccagcauuugucagguccugcuucgauuuacgaggcgggucagggggcggcgggggacucacugucggugauugguuagauucgauacgcaugggccgcuacagagaucauuuugcugcagggggauauagcucacuggggaugguacugcggaugaaugcgcaggacgucagagcgcugggaauaacguugaugggacaccagaaaaagauccuuggauccauccagacaaugcgugcacaguugacaucuacucaaggcccacguagacaccuuuag

SEQ ID NO: 248782 - RNA, 1653 nt, Artificial Sequence
  Description of Artificial Sequence: Synthetic coding sequence
auguccacaucaucccuacggagacaaaugaagaauaucgugcacaauuacucugaagcugaaauuaaagugcgugaagcuacuuccaaugacccuuggggccccuccagcagccugaugagugagaucgccgaccugacuuacaaugucguagccuuuagcgagaucauguccaugaucuggaaacgacuuaaugaccacgggaaaaacuggcgccacguguauaaggccaugacccugauggaauaccuuaucaagacuggguccgaacgugugucccagcagugcaaagagaauauguaugcugugcagacacucaaagacuuccaguauguggaccgggauggaaaggaucagggaguuaauguuagagaaaaggccaagcaacucguagcacuucuuagggaugaagauagacuacgggaagaacgcgcgcaugcccucaaaaccaaggaaaaacuagcccagacugcuaccgcguccucagcugcaguagggucaggaccaccaccugaggccgaacaggccuggccccagucaagcggagaggaggagcuucaguugcaacuugcacuggccaugucaaaagaggaggcagaccaggaagaacgaauucggcgaggcgacgauuuaagacuacaaauggcuauagaggaauccaagcgcgaaaccggcggcaaggaggagagcagucuaauggaccuagcggacguauuuacugcgccagcaccggccccaacuaccgacccauggggugggccagccccaauggccgcagccgugccaacugccgccccuacuagugaccccuggggaggcccuccaguuccccccgccgcagaccccuggggugggccugcccccaccccggccaguggcgaccccuggcgacccgcugcucccgccgggccaucagucgacccauggggaggaacgcccgccccagcugcaggugaaggaccuacuccugauccauggggaaguucggacgguggggucccagugaguggcccaucugcuagugacccuuggacucccgcucccgcauucagugacccuuggggaggguccccugcgaagccauccacuaauggcaccacugcaggcggauucgacaccgagccggaugaauuuagugauuuugaccgucugagaacugccuugccuacuucaggaucuucugccggugaauuggagcuccuggcaggcgagguucccgcccgauccccuggcgcuuuugacauguccggcgugcguggcagucuggccgaagccgucggaagcccuccgcccgcagcaacccccacacccaccccaccuacacguaaaaccccggaaucuuuucucggcccaaacgccgcucuaguggaccuggacucacucgucuccagaccaggcccaaccccgccaggggccaaggcauccaaucccuuucuccccggaggcgguccugcaacaggccccagcguuaccaaucccuuccagcccgcgccuccagccacacugacccugaaccagcugcgacugagcccugugccuccaguucccggagcccccccuacauauauuagcccccugggcggaggacccggccuuccaccuaugaugcccccuggccccccugcacccaauaccaauccuuuuuugcuuuag

SEQ ID NO: 248783 - RNA, 1272 nt, Artificial Sequence
  Description of Artificial Sequence: Synthetic coding sequence
augucuagucagguaguuggcauugagccgcuguacauaaaggccgagccagccucuccagacucucccaaaggauccuccgagacggaaaccgaaccaccuguggcacuggccccgggccccgcgccuacccguugccuaccuggacacaaagaagaagaggauggcgagggagccggacccggagagcagggggggggcaaacugguccucucaucacucccaaaacgacucugccucgucuguggcgaugucgcuucaggguaucacuaugguguugccuccugugaggcuuguaaggccuucuucaaacgcaccauucagggaaguaucgaauacucauguccggccuccaacgagugugaaauuaccaagaggaggaggaaggcuugucaggcguguagauucacaaaaugucuucgaguugggaugcucaaagaaggagucaggcuugacagggucagagggggcaggcagaaguauaagaggagaccugagguggauccgcucccauucccagggcccuucccugccggacccuuggccguagccggugguccccgcaaaacagcugcaccagugaaugcuuugguuucccaucuacuaguggucgaaccggaaaaguuauacgcaaugccagauccagccgggccggauggacaucucccugcagucgccacccugugugaccuguuugauagagagauuguagucacaaucuccugggccaagucaaucccaggcuucuccucccugucccugucugaccagaugaguguguugcaguccguguggauggagguccucguucucggggucgcccaaagaucacuaccuuuacaggacgagcuggcuuuugcggaagaucuaguccuugaugaggaaggggccagggccgccggcuugggggaacugggagcagcccugcugcaacucgugagacgacuucaggcucuccgccuggaacgggaagaauauguacuccuuaaagcgcuugcucuggccaacuccgacaguguacacaucgaggacgcagaggcgguggaacaacuuagggaggcuuuacacgaggcccuccucgaauaugaagcaggucgugcugggcccggcgguggcgcagaacggcgucgagccggcagacugcuacucacacucccccugcuccgacagaccgcuggcaagguguuagcucacuuuuauggagugaagcuggaggggaaaguaccaaugcauaaacuguuucucgaaauguuggaggcuaugauggauuag

SEQ ID NO: 248784 - RNA, 1239 nt, Artificial Sequence
  Description of Artificial Sequence: Synthetic coding sequence
augggccuccaucuccggccauaccgaguaggccuacucccugauggauugcuguuucuccugcuccuguugaugcuguuagcugaccccgcacucccugcaggacgccaucccccugucguacuagucccuggugaccuuggcaaccagcuugaggccaaauuggacaagccaaccguggugcacuacuugugcaguaagaaaacugaauccuacuucaccauuuggcugaacuuagaauugcugcuaccuguuauuaucgauugcuggauagauaacauuaggcugguuuacaauaaaacaaguagagcaacacaguuucccgacggaguugacguacgcgugccggguuucggcaaaacauucucucuggaauuccucgaucccuccaagagcaguguugggaguuauuuccauaccaugguugagucacuaguaggguggggguacacucguggcgaggacguucguggggcucccuaugauuggagaagagcaccaaacgagaacgguccguacuuucuugcccugagagaaaugauugaagaaauguaccagcuguauggcggaccggugguccugguugcgcacucaaugggaaacauguacacacuuuacuucuugcagaggcaaccucaggcuuggaaagacaaauacaucagggccuucgucucguuaggggcaccuuggggaggagucgcaaaaacucucagggugcuggcaagcggggauaacaauaggauuccugucauuggaccuuuaaaaauuagagagcaacagcgaucugcagugucuacuucuuggcugcugcccuauaacuacacauggucaccggagaaaguguuuguccagacacccacuauuaacuacaccuugcgcgacuaucgaaaauucuuccaggauauugguuuugaagacggauggcugaugaggcaggacacugaaggacucguggaggccaccaugcccccuggcguucagcugcacugucuuuacggaacaggcgugccaacaccugacucauucuacuaugaaucauucccugaucgcgaccccaaaauuugcuuuggcgauggugauggcacagucaaucugaagucagcuuuacagugucaggcuuggcagucuagacaggaacaucagguacuccuacaagaacucccugguuccgaacauauagagaugcucgcaaacgcaacgacuuuggcauaccucaagagaguuuuacuuggcccguag

SEQ ID NO: 248785 - RNA, 939 nt, Artificial Sequence
  Description of Artificial Sequence: Synthetic coding sequence
auggcaaaaguuuuuucauucauuuuagugaccacugcacugacuaugggaagagagaucagugcacuugaggacugugcacaggagcagaugagacuacgugcucagguccguuuauuggaaacuaggguaaagcaacagcaggugaaaauaaaacagcuacugcaagaaaacgagguacaauuucucgacaaaggcgaugaaaacacuguaaucgaccugggaaguaagcgccaguaugccgauuguagcgagauuuuuaaugacggcuacaagcugagcggguucuauaagauuaaaccuuuacaaucaccugcugaguuuuccguuuacugugauaugucugacggcggcggauggacuguaauacagagaaggucggacggcagcgagaauuucaauaggggcuggaaggauuaugagaauggcuuuggcaauuuugugcagaaacauggugaguauuggcuuggcaauaagaaccuccacuucuuaacuacacaggaggacuauacccugaaaauagaccuggcggacuucgagaaaaacucacguuacgcucaauacaagaauuuuaaggucggggaugagaaaaauuuuuacgaguugaacauaggcgaguauagugguacggcaggcgauucccuagcaggcaacuuccaccccgagguccaguggugggcuucucaucaaagaaugaaguuuucgacaugggaucgugaccacgacaacuaugagggaaacugcgcugaagaagaucaguccggcuggugguucaauagaugucacucugcaaaccuuaacggugucuauuauucagguccauauacggccaaaacugacaacggaaucgugugguacacauggcauggauggugguacucccucaagagcgucguaaugaagauuagaccuaacgacuuuauucccaacgugauauag

SEQ ID NO: 248786 - RNA, 939 nt, Artificial Sequence
  Description of Artificial Sequence: Synthetic coding sequence
auggccaaaguuuucuccuucauuuuagugaccacagcauuaaccauggggcgcgaaaucucagcucucgaagacugugcccaggaacagaugagacuccgggcucaggucagauugcucgaaacacgggugaagcaacaacagguuaaaaucaagcaacuccugcaggagaacgaggugcaauuucuugauaagggcgaugagaauacuguaauugaccuggguagcaaaagacaguaugccgauugcucagaaauuuucaacgacggguauaaacugagcggcuuuuacaaaaucaaaccccuucagaguccggccgaauucuccguguauugugacaugagcgauggaggcggcuggacagugauucagaggaggucugauggcucugaaaacuuuaauagaggauggaaggacuacgagaauggguucggaaauuucguucagaagcacggugaauacuggcucggcaauaaaaaccugcacuuucugacaacacaagaagauuacacccuuaaaaucgauuuggcagacuuugagaagaacagccgauacgcacaauacaagaacuucaagguuggggaugagaaaaacuuuuaugagcugaauauaggagaguacucuggcacugcaggcgauucgcuugccgggaacuuucaccccgagguacaguggugggccucccaucaacgaaugaaauucuccaccugggacagagaucacgacaacuaugagggaaauugcgccgaggaagaucaaucugguuggugguucaauagaugucacagcgccaaucugaacggaguuuauuacagcggacccuauacugccaagaccgacaauggcauugugugguacaccuggcacggcuggugguauucacugaaaucggucguaaugaagauuagacccaacgacuucaucccaaauguaauuuag

SEQ ID NO: 248787 - RNA, 939 nt, Artificial Sequence
  Description of Artificial Sequence: Synthetic coding sequence
auggccaaaguguucucauucauuuuaguaacgacagcccucacuaugggaagggaaauuucagcccucgaagauugcgcacaggagcagaugagguuacgagcacagguacgucuuuuggagacucgcgugaaacagcaacaagugaaaauuaaacaguuacugcaagagaacgagguacaauuucuggauaagggcgaugagaacaccguuaucgaucugggaagcaagaggcaguacgcagauugcagugagaucuucaacgauggguacaaguugaguggauucuauaagaucaagccacugcaaagcccagcagaguucagcgucuacugugacaugucugacggcgggggauggacugugauccagagaagguccgacggcagcgaaaauuucaacaggggcuggaaggauuacgagaacggguuugguaauuucguucaaaaacauggggaguacuggcuggguaauaagaaucuacauuuucugaccacacaagaagauuauacccugaaaaucgaucuggcugauuuugaaaaaaacucucguuacgcacaguauaaaaacuuuaagguuggagacgaaaagaauuucuacgagcucaacauuggugaauauaguggaacugcaggugacagucuggcuggcaacuuucacccagagguucaguggugggcaucucaccagcgcaugaaguucucaaccugggaccgugaccaugacaacuacgaaggaaacugcgccgaggaagaccagaguggcuggugguucaauagaugucauucggccaaucucaacggaguuuacuauagugggcccuauacugccaaaacugacaaugggaucguaugguacacuuggcacggguggugguauucucuuaaaaguguagugaugaaaauccgccccaaugauuucaucccaaacguuaucuag

SEQ ID NO: 248788 - RNA, 939 nt, Artificial Sequence
  Description of Artificial Sequence: Synthetic coding sequence
auggcgaagguuuucucuuuuauuuuagugacuacagccuugacuaugggaagggaaauuucagcauuggaggacugcgcucaagaacagaugcgccugcgagcucaggugagacugcuugaaacgcgcgugaagcagcaacaagucaaaauaaaacaacugcuccaggagaacgagguucaguuucuggacaagggcgacgagaacaccgugauugaccuagggagcaaacgacaguacgcugauugcucggaaauuuuuaacgacggcuacaaacuuagcggauuuuacaagauuaagccccuacaaucuccagcagaguucucuguguacugugauaugagugacgguggugguuggacagucauccagaggcgaucagauggguccgagaacuucaacaggggcuggaaagacuaugaaaacgguuucggaaacuuuguccagaagcauggcgaguauuggcugggcaacaagaaccuccacuuucuaacaacccaagaggacuacacgcugaaaaucgaucuggcagauuucgagaagaauaguagauacgcgcaauauaagaacuuuaaagugggugaugagaaaaacuucuaugaguuaaacauuggcgaauauuccgguacagcaggugauagcuuagcuggcaacuuucacccugaggugcaauggugggccucgcaccaaaggaugaaauuuaguacuugggaccgcgaccacgauaauuaugaggggaacugugcggaagaggaccaaagcggcuggugguuuaaucgcugccauucggcuaaccugaacggaguauacuauuccggccccuauacagcaaaaacugacaacggcauugugugguauacuuggcacgguuggugguauuccuugaaaaguguugucaugaaaaucaggcccaaugacuuuaucccaaauguaauuuag

SEQ ID NO: 248789 - RNA, 939 nt, Artificial Sequence
  Description of Artificial Sequence: Synthetic coding sequence
auggccaaaguuuucucauuuauacuggugaccaccgcccugaccaugggacgcgaaauuucugcacuagaggauugcgcccaagaacagaugaggcuccgggcccaggugcgccuguuagaaacuagaguuaagcaacagcaagugaagauuaaacagcucuugcaggaaaacgaagugcaauuccuagauaagggugaugaaaauacggugaucgaucucgggagcaagagacaguaugccgauuguucugaaauauuuaaugauggcuauaaacugaguggcuucuauaagaucaagccgcuucagucacccgccgaguucagcguuuauugugacauguccgacggggggggguggacagugauucaacggagaucagacgggagcgagaauuucaacagagguuggaaagauuacgaaaauggguuuggaaacuucguucagaagcauggggaauauuggcuggguaacaaaaaucuacauuuccugacgacgcaggaggacuacacccucaagauagauuuagcagacuuugagaagaauuccagauacgcucaauacaaaaacuuuaagguaggagaugagaaaaacuuuuacgaacucaacaucggagaauauaguggaacugcuggagauucccuugccggcaacuuucaccccgaagugcaauggugggccucacaccagcgcaugaaguuuaguaccugggaucgagaccaugacaauuacgaaggcaacugugcggaagaagaccaauccgguuggugguucaaucgaugucauagcgcaaaccugaacggggucuacuauuccggaccuuauaccgcaaaaacugauaauggcaucguaugguauaccuggcacggcuggugguacucucugaagucaguaguuaugaaaauuaggcccaacgacuuuauaccgaauguuauuuag

SEQ ID NO: 248790 - RNA, 939 nt, Artificial Sequence
  Description of Artificial Sequence: Synthetic coding sequence
auggccaagguauucucuuuuauucuuguaacuaccgcccucaccaugggcagggagaucagugccuuagaggauugcgcccaggaacagaugcgguuaagggcccagguccguuuauuagagacacgcgucaagcaacagcaagugaaaauuaaacaguuacuucaggaaaacgaggugcaauuucucgacaaaggggacgagaauacagucauagaucuggggucuaagaggcaguaugcugauugcucagagauauuuaacgacggauacaagcugucuggauucuauaagauaaaaccucuccagagcccugccgaauuuucagucuacugcgauaugucagacggggggggguggaccguuauacagaggcggagugaugguagugagaauuucaauagaggguggaaggacuacgagaauggauucgguaauuucguccagaagcacggggaauacuggcucggaaauaaaaauuugcacuuuuuaacuacucaggaggacuacacgcugaaaaucgaccuugcugauuuugaaaaaaacaguagauacgcccaguacaagaauuuuaagguaggggacgaaaaaaacuucuaugaguugaacaucggcgaguauagcggcacagcuggcgauucucucgcuggcaauuuucacccagaggugcaguggugggcuagucaccagaggaugaaguucuccacuugggaccgcgaccacgauaacuacgaaggcaacugcgcugaagaagaccaaagcggauggugguuuaauagaugucauucugccaauuugaacgggguauacuacucaggucccuauacagccaaaacagacaacgggauuguaugguacacauggcaugguuggugguauagccuaaagucugucguaaugaagauuaggccaaacgacuuuauaccgaauguuauauag

SEQ ID NO: 248791 - RNA, 849 nt, Artificial Sequence
  Description of Artificial Sequence: Synthetic coding sequence
augagauuacgggcucaggugagauuacucgaaacuaggguuaagcaacagcagguuaagaucaaacaacuguuacaagagaacgaggugcaguucuuggauaaaggcgacgaaaacaccguuauugaccuggggucuaagagacaguaugcagauugcuccgaaauuuuuaacgacggauacaagcuuagugguuuuuacaaaauaaaaccucuacagucaccugcagaauuuucgguauacugugacaugucugacggcgggggguggacugugauucagagaaggucugauggaucggagaacuuuaacagaggauggaaagauuaugagaacgguuuugggaauuucgugcagaagcauggcgaguauugguugggcaauaagaaucuccacuuucuaacaacucaagaggauuacacauuaaagaucgaucuggcugacuucgaaaagaacucuagauaugcgcaguacaaaaauuuuaaagugggagacgaaaagaacuucuacgaacucaacauuggugaauauuccgguaccgcuggggauucacucgcagggaacuuucacccggaaguccaauggugggcuagccaccagcggaugaaauucucuacaugggacagggaucacgauaacuaugaagguaacugcgcugaggaagaccagagcgguuggugguucaaucggugucacucugcaaaccugaauggaguuuacuacucuggcccuuauaccgcgaagacugauaauggcauuguuugguauaccuggcauggauggugguacucucugaaaagcgugguaaugaaaauucgcccuaacgauuuuauaccuaacgugauuuag

SEQ ID NO: 248792 - RNA, 939 nt, Artificial Sequence
  Description of Artificial Sequence: Synthetic coding sequence
auggcaaaagucuucucuuuuauacucgugacgacagcucugacuaugggaagagagauuucagcccuugaggauugugcgcaggaacagaugcgacuucgugcucaaguacgccuauuggaaacgcgagucaagcagcaacaagugaagauuaagcagcuacuccaagagaaugagguccaauucuuagacaagggggacgagaacacaguuaucgacuugggaucgaaacggcaguacgccgacugcucagagaucuuuaaugaugguuacaagcugaguggguuuuacaagauaaaaccauugcaaagccccgcagaguuuuccgucuauugugacaugagcgacggcggcggauggacagugauucagcgccgcuccgauggauccgagaacuuuaacagaggauggaaggauuacgagaauggauucggcaacuuugugcaaaaacauggggaauauugguuggguaauaaaaaucuccacuuccucacaacacaggaggauuacacacugaaaauugacuuggcagauuucgaaaagaacucacgguacgcucaguacaaaaacuucaaaguaggggacgaaaagaacuucuacgaauuaaacauuggcgaguacucuggaaccgcuggugauucauuggcuggaaacuuccaucccgagguacaguggugggcaagucaucagcgcaugaaauuuucaacaugggaccgcgaccacgauaauuacgaaggaaacugcgccgaagaagaucaauccggcuggugguucaauagaugccacucugccaaccugaacggggucuauuacucggggccguauacagcaaagacugacaauggcauuguaugguauaccuggcacggcuggugguauucccuaaagagugucgugaugaagauuagaccaaacgauuucaucccaaauguuauuuag

SEQ ID NO: 248793 - RNA, 2052 nt, Artificial Sequence
  Description of Artificial Sequence: Synthetic coding sequence
auggagcgagccgccccuucacgacguguaccccugccuuuguuacuucuaggcggauuggcauuacuugcugcaggaguggacgcagacguucuguuagaagcguguugcgcagauggucacagaauggcuacacaccagaaagacuguuccuugcccuacgcgaccgaaucuaaggaaugucgaaugguucaagaacaaugcugucauucucagcuggaagaacugcacugcgcaacaggcauuucccuggcaaaugaacaggauaggugugcuacaccacacggcgacaacgcgucccucgaggcuacauucgugaaacgaugcugucacugcugucugcuuggcagagccgcccaagcacaaggacaaaguugugaauacucucuaauggugggcuaccaauguggucagguguuccaagcauguugcgugaagucucaggaaacuggggaccuggauguggggggccugcaggaaaccgacaaaaucauugagguggaagaagagcaggaggaucccuaccugaacgaccguugccguggugguggcccuugcaagcaacaaugucgagacacuggcgacgaggucguauguucgugcuucguaggauaucaacugcugagugacggcgucagcugcgaggacgugaaugaguguaucaccggcucucauagcugccgacugggcgaguccugcaucaacacagucggcucuuuucgcugucaacgcgacuccagcuguggaacaggauacgaacuuacugaggacaauagcuguaaagacauagaugaaugugaaucuggcauucacaacuguuuaccugauuucaucugccaaaauacucuugggaguuuccgaugucggcccaagcugcaaugcaaauccggauuuauacaggaugcauuagggaauugcauugacauaaaugagugccuuagcauaucagccccgugccccaucggucauacauguaucaauacggagggaagcuacacaugccagaaaaacgugccuaacuguggucggggauaucacuugaaugaagaagguacacgcugugucgacguggaugaaugcgcccccccagccgaaccuugugggaaaggccauaggugugucaacucuccuggguccuucagaugcgagugcaaaaccggauauuacuucgauggcauuuccagaaugugcguugaugucaacgagugucaaagauacccugggcgccuauguggacacaaaugcgagaacacucucggaagcuaccucuguucuugcuccgugggcuuuagguugucaguggacggucgaucaugugaggauauaaaugaguguucuucuagucccugcucacaggaaugugcuaauguuuauggcagcuaccagugcuacugcagacgaggguaucagcuuucugauguggacggcguuacgugcgaagacauugacgaaugugcucuccccaccgguggacacauauguucauauagauguaucaacauccccggaucauuucaaugcucuuguccaucuuccggcuacagacuggccccaaauggcagaaacugccaggauauagaugagugugugacagguauccauaauugcucuaucaacgagacaugcuucaacauacagggaggcuuuaggugucuggccuuugaaugcccugagaacuaucgacgauccgcugcaacacgaugcgaaaggcugccuugucacgaaaauagagaaugcuccaaacugccgcucagaaucacauacuaccaucucaguuuucccacuaacauacaggcccccgccguuguguuucggaugggcccuagcagugcugugccgggcgauucuaugcaacucgcuaucacugguggaaacgaagagggauucuuuacaacuaggaagguuucaccccacagcggcgugguggcacucacaaagcccgucccagaaccucgcgaucuacuucuuaccgugaaaauggacuugagccgacauggaacagucaguucuuucguggcaaaacuguuuaucuuugucucugccgaacucuag

SEQ ID NO: 248794 - RNA, 2112 nt, Artificial Sequence
  Description of Artificial Sequence: Synthetic coding sequence
auggaacgagcggcaccgucgcggcguguuccccuaccucuauuauugcugggaggacucgccuuacuugccgcgggcguggacgcagacgugcuccuggaggccugcugcgccgacggucauagaauggcuacccaccaaaaggauuguucauuaccuuacgcuaccgaauccaaagagugcaggauggugcaggagcagugcugccacucucaacuggaagaguuacacugugcuacaggaaucaguuuggcaaacgaacaggauaggugcgcaaccccccacggcgacaaugcgagccucgaggcuacguuugugaaaagaugcugccauuguugccugcuugggcgugcagcucaggcacaggggcaaaguugugaguauaguuugauggugggguaccaaugcggccagguuuuccaagcuuguugcgucaaaagucaagagacaggugaucuugauguugguggcuuacaggaaacagacaaaauuaucgagguggaagaggaacaggaggauccauacuuaaaugaccgaugcagggguggggguccauguaagcagcaaugucgagauacgggggaugaggugguguguucauguuuuguuggauaccaacuguugucagacggcguuucaugcgaggacgucaacgaaugcauuaccgguagccauuccuguagacugggagagagcuguaucaauaccguaggaagcuuccgcugucagagggacucuagcugugggaccggauacgaacuaacugaggacaauaguugcaaggauauugacgagugugaauccggcauacacaacugucugccugauuuuauaugucagaauacacuuggcucauuccggugucggcccaagcuacaaugcaaaagcggauucauacaggacgcgcugggcaauugcaucgauauuaacgagugcuugaguaucucugcccccugcccuaucggccacaccugcauuaacaccgaagguucauauacuugccagaagaaugucccuaacugcggccguggcuaccaccugaaugaggaaggaaccagaugcguggacguugaugaaugugccccgccugcggaacccugcggaaagggccaccgcugcgugaauaguccuggguccuuuagaugcgaauguaaaacugguuacuauuucgauggcauuucucggaugugcguggauguuaaugaaugucaaagauaccccgggagacucugcggccauaaaugcgaaaauacacuaggaaguuaucugugcucuugcagcgucgguuuccgauugagcguagacgguagguccugugaggacaucaacgaaugcagcagcuccccuugcucgcaagaaugcgccaacguauacggcaguuaucaaugcuauugucgaaggggguaccaauugucagacguagacggugucaccugcgaggacauugacgagugcgccuuacccaccggaggacauauuuguucuuaccguugcauaaacauccccggauccuuccaauguucauguccuagcaguggauauaggcuggcaccgaacggaaggaauugccaagauaucgaugaaugcgucacaggaauacacaauugcucuauaaaugaaaccugcuuuaacauucaggguggcuuuagaugcuuggccuucgagugcccagagaacuaucgacgauccgccgccacccugcagcaggaaaaaaccgauaccguucguuguauuaaaucuuguagaccuaacgaugugacaugcgucuucgaccccgugcacaccauuucccacacagugauuagccucccaaccuuucgcgaguucaccaggcccgaggagaucauuuuuuuacgagccauuacucccccacaccccgccucucaagccaacauaauuuuugacauuacugagggaaaccugcgagacucguucgacaucaucaaacgguauauggauggaaugacugugggcguuguucgacaagugaggccuaucguuggacccuuucacgcagugcuuaaacucgaaaugaacuauguggucggcggggucgucagucacagaaacguggucaaugugcauauuuucgucagcgaguauugguuuuag

SEQ ID NO: 248795 - RNA, 1701 nt, Artificial Sequence
  Description of Artificial Sequence: Synthetic coding sequence
auggagcgcgccgcaccuucuaggaggguuccccucccccugcugcugcuaggaggccucgcucugcuggcugccggcgucgacgcugaugugcuccucgaagcuugcugcgcagacggccaucgcauggcaacucaucagaaggauugcucucugcccuacgccacagaauccaaagagugucgcaugguucaagaacaguguugucauagccaacuggaagagcugcacugugccaccgguauuucccuagcaaacgagcaagaccguugugcuaccccucauggugauaaugcuucacuugaagcuaccuucgucaaacgcuguugucacuguugucuguuaggacgggcggcucaggcccaggggcaaagcugcgaauacucacugaugguuggcuaucaaugcgggcagguguuucaggcgugcugcgugaagagucaggaaacaggugaucucgaugugggcggguugcaggaaacagauaaaaucauugaagucgaggaagagcaagaagauccauacuugaacgaucgaugucgaggcggaggcccuuguaagcaacaaugucgggacacaggugacgaaguuguuugcucauguuuugucggcuaccaauugcucuccgaugguguuagcugugaggaugugaaugaauguauaacugggucccacucgugucgucugggggaauccuguauuaauaccgucgggucuuuccgaugccagcgagacagcaguugugggaccggauaugaacugacugaagauaacagcugcaaggacaucgacgagugugagucagguauccacaacugucuucccgauuucauuugccagaacacucucggcuccuuuagaugcaggccuaaauugcagugcaagagcggauucauucaggacgcacugggcaauugcauugacauuaaugaaugcuuauccaucuccgcucccuguccuauuggccacacuugcauaaauaccgagggaucuuauacuugccaaaaaaacgugccaaacuguggucgggguuaucauuugaaugaggaaggcacaagaugcgucgacguugacgagugcgcacccccagccgaaccuugcgguaaaggacaucgauguguaaauagucccggauccuuccguugcgaauguaaaacugguuauuauuuugacggaauuucacgcaugugcguggacgugaacgagugccaacgguauccuggacggcuuugcggccacaaaugcgagaauacucugggcucuuaucugugcagcuguagcgugggcuuuagauuaucgguggacgguagaaguugcgaagacauaaacgagugcagcuccaguccuugcagucaggaaugcgccaaugucuacggcucauaucagugcuauugcaggagaggauaccaacuaagcgacgucgacggcguaacaugugaggacauagaugagugcgcccugcccacuggaggucauauuuguagcuaccgauguauuaacaucccuggauccuuucaguguucuugucccucguccggcuacagauuagcacccaauggucgcaacugccaggacaucgaugaaugcguuaccgggauacauaauugcagcauaaacgaaacguguuuuaacauccaaggcggcuuucguugcuuagcauucgagugcccagagaacuaccguagaucggccgcuacuuag

SEQ ID NO: 248796 - RNA, 2112 nt, Artificial Sequence
  Description of Artificial Sequence: Synthetic coding sequence
auggagagagcagcuccgucaagacgcgucccacucccccuguuacuacuaggaggccuugcgcuguuggcagcaggcguugacgccgacguauugcuugaagccugcugcgcugauggccacaggauggcaacgcaccagaaagauuguagucugccguacgccacugagucaaaggaauguaggaugguccaggaacaguguugccacagucaacuagaggaacuucauugcgcuacgggaauuucacucgcuaaugagcaggacaggugcgccacaccucauggcgauaaugccagcuuagaggcgacguucgugaagaggugcugucacuguugccugcucggacgggccgcacaagcucaaggccagucaugcgaguacucuuugauggucggauaccaguguggccagguauuucaagcauguugcgucaagucgcaggaaacaggggauuuggacgucggaggccugcaagaaacagacaaaauaauagaaguggaagaagaacaggaggaccccuauuuaaaugacagaugucgcggcggcggucccuguaaacaacagugcagggacacgggagacgaggugguguguagcuguuucguaggauaccagcuucuguccgauggagugucuugugaggacgucaacgaguguaucacagggagccacagcugccgacugggagaaagcugcauuaauaccguuggaagcuuccgcugucagcgcgacucuuccugugggaccggguaugaacuuacugaagauaauagcugcaaagacaucgaugaaugugagucugggauucacaacugccugccugauuucauuugucagaacacauuaggaagcuuucguugccgaccaaaacugcaguguaagucuggauucauccaagaugcacucggcaauuguauugauauaaaugagugccuguccauuagugcuccauguccaauaggccacaccuguaucaacacugaaggaucauauaccugccagaaaaaugugccuaauuguggaagagguuaucauuugaaugaggaggggacacggugcgucgacguggaugaaugcgccccaccagcggaacccugugggaaaggacaucgcuguguuaauucucccggcucguuuagaugcgaaugcaaaacgggauacuauuucgaugggaucagcagaauguguguggauguaaaugagugucaacguuaccccggucgucugugcggacauaagugcgagaacacccuuggcucauaucuuugcuccuguucgguaggcuuuaggcugagugucgauggaaggucgugugaagacaucaacgaguguuccaguucucccuguucccaagaaugugccaaugucuauggcucauaccaguguuacugccguagaggcuaccaacugucagacguagauggagugaccugcgaggacaucgacgagugugcccuaccuacugggggacacaucugcuccuaucgcugcaucaauauccccgguucguuucaauguucuugucccucaagcggcuauaggcucgcacccaacggccgcaauugccaggacauugaugaaugcguuaccggcauccacaauugcucaauaaaugaaacuuguuucaacauucaaggcggcuuuagaugucuggcauuugaaugucccgagaauuaucgacgguccgcagcaacccagaaaaguaagaaaggacgacaaaacaccccagcaggcagcucuaaggaggauugucguguccucccauggaagcagggcuuagaagauacacaccucgaugcuuaucuucccugcugucgccguuucacaagaccagaagaaaucaucuuccuacgggcuauuacaccuccacaucccgcuagccaagccaauauuauauucgacaucaccgaaggcaaucuucgcgauucauucgacauuaucaagcgguacauggacgguaugacagucggcgugguaaggcagguucgaccgauagugggcccauuccacgcaguucuuaagcuggaaaugaauuacgugguugggggugugguuucucaccgaaauguugucaacguucauaucuuuguuagugaguauugguucuag

SEQ ID NO: 248797 - RNA, 2166 nt, Artificial Sequence
  Description of Artificial Sequence: Synthetic coding sequence
auggaaagggcugcaccuagcagacgaguucccuugccccugcugcugcucgguggacuggcccugcuugccgccggcgucgaugcugaugugcugcucgaggcuugcugugcugauggccacagaauggccacacaccaaaaagacuguucacuaccauacgccaccgagucuaaagagugcagagcagugggacucgcuucauugugucaggauuugaauggcgcaugggcuguguggaaaguuggucgagccucccaggccgagggcaccgcaagcgcgcgcgcccaaagacgagguaugguucaagagcaauguugucauucgcagcuggaggaguugcauugcgcuacuggaaucucccucgccaacgaacaggaucggugugcaacaccacauggggauaaugcaagucucgaagccaccuuugucaagcgauguugucacugcugucugcucggucgagcggcacaggcucaaggucagucaugcgaauauucccucaugguuggauaucagugcgggcagguuuuucaagcauguuguguuaagucccaagagaccggugaccuggacgucgggggucugcaagagacugacaagauuaucgaaguggaggaagagcaggaggauccauaucucaaugacagaugucggggcggugggccauguaagcagcagugucgugauacaggugacgaagucguuugcuccuguuucguugguuaccagcugcugagcgacggagucucuugcgaagacguaaacgagugcauuaccggaucccauaguugccgucucggcgaaaguugcauuaauacagugggcuccuuucggugucagcgggacucuagcugcgggacaggauaugaauuaaccgaggauaacagcuguaaagauaucgacgagugugaguccggaauucacaacuguuugccugauuucaucugucagaauacgcugggcucuuuccgcugucgccccaaacuccaguguaagucaggcuuuauucaggaugcccucggcaacugcauugauauuaacgaauguuuauccauaucagcgccuugucccauuggacacacauguauaaacaccgaagggagcuauaccugucagaagaacgugccuaauugcggucgcggguaccaucucaacgaggaaggaacacggugcguggauguagaugagugugcuccgccggcugaaccguguggcaagggacauagguguguuaacagcccaggaucuuuuagaugcgaaugcaaaaccggcuauuacuuugacggaaucuccagaaugugugucgacgucaacgaaugucaaagguacccagggaggcuguguggacacaaaugcgaaaauacgcucggcuccuaccuguguaguuguagcguuggguuucgacucucaguugacggcagaaguugugaagauauaaaugaaugcaguucaucuccaugcagucaggaaugcgcuaauguauacgggucauaccagugcuauugucgaaggggauaccagcuuagcgacguagauggcgucacuugugaagacauugacgaaugugccuuacccaccggcggccauauuuguucauaucggugcauuaacaucccaggguccuuccaguguuccugucccagcagcgguuacagacucgcucccaacgguagaaacugccaggacaucgaugaauguguaacaggaauucauaacugcagcaucaacgaaaccugcuuuaacauucaaggcggcuuuaggugucuggccuucgagugcccugagaauuaucgucggagcgccgcaacccggugugaacguuugccuugucacgagaaucgcgaaugcagcaaacugccauugcgcaucaccuauuaccaccuaucuuucccaaccaauauucaggccccagcagucguuuuccggaugggcccaucgagugcaguucccggagacucaaugcagcuggcaauuaccggagguaacgaggaaggauuuuuuacuacuagaaaagugagcccucauagcggcguuguugccuugacaaagcccguaccagaaccucgcgaucuccuacucaccgucaagauggaucugucacgacaugguacaguauccucauucgucgcaaagcucuucauuuucgugucugcugaacucuag

SEQ ID NO: 248798 - RNA, 570 nt, Artificial Sequence
  Description of Artificial Sequence: Synthetic coding sequence
augaauaguuacacccgugguucaaggcggccaucagcgaaagccgcaucuccggcugcaucaguuacuucucgagugucuccauccggcccgggcgugcccguagacgcggacgugcuccuggaagccuguugugcugacggucauagaauggccacgcaucaaaaagacuguagccuuccauaugccacagagucaaaagagugcaggaugguccaagagcaguguugucacucacaacuagaagagcugcacugugcuacuggcaucucauuagcaaaugagcaagauagaugcgcaaccccccauggagauaacgccucuuuggaagccaccuucguaaaaagauguugccacugcuguuugcuaggcagggccgcccaagcccagggccaaucaugugaauauaguuugauggucggauaucaauguggacaagucuuccaggcgugcugugugaagucccaggagacaggggaucuggauguugguggacugcaggaaacagauaaaaucauagaaguagaggaggaacaggaagauccauaucugaacgacagaugccgguag

SEQ ID NO: 248799 - RNA, 81 nt, Artificial Sequence; identical to SEQ ID NO: 248193
  Description of Artificial Sequence: Synthetic coding sequence

SEQ ID NO: 248800 - RNA, 1806 nt, Artificial Sequence
  Description of Artificial Sequence: Synthetic coding sequence
auggaacgagccgccccgucccgacgagucccacuccccuugcugcuuuuggggggccucgcguugcuugcagccggcguggacgcagaugugcuccuugaagcuuguugugcugacggucauagaauggcaacucaccagaaggauugcucuuuacccuaugccacugagaguaaagagugcaggaugguccaggaacaaugcugccauucccagcuugaagagcuccauugugcaacuggcaucucacucgccaaugaacaagaucgaugcgccacaccccacggcgacaacgccucccuggaggcaacuuuugugaagagguguugucacuguugcuuacuggguagggccgcgcaggcacaaggccaauccugugaguauucucugaugguggguuaucaauguggacaaguauuucaggccuguugugucaagagccaagaaacuggugaucucgacgugggugggcuccaggagaccgacaagauuauugaaguggaggaagagcaggaagaucccuaucucaaugaucggugcagaggcggcggaccuugcaaacagcagugccgagauacaggugaugaggucguuuguuccugcuucguaggauaccaauuauuguccgacggcguuaguugugaggauguuaaugagugcauuacuggaagucacucuugcagacugggagaaagcuguauuaacacugugggaaguuuuagaugucagagggacagcucuugcggaaccggcuacgaguugacugaggacaauaguuguaaagauaucgacgagugcgagaguggcauucauaacugccuaccugauuucaucugucagaacaccuuggguagcuuucgcugcaggccaaagcuccaaugcaaaucuggauuuauucaggacgcucucggaaacuguaucgauauuaaugagugcuuauccaucucggccccuugcccgaucggccacacguguauuaacacagaagggucuuauaccugccagaaaaauguucccaauugcggacgaggauaucaccugaaugaggaggguaccagaugcguggauguggaugaaugcgcucccccagccgaaccauguggaaaaggccauagaugcgugaacucgccaggaucuuuucgcugugaaugcaagacgggauauuacuucgauggcaucucuagaauguguguggaugugaaugagugucagagauaccccggcaggcuuuguggccacaaaugcgaaaacacccugggcucuuaucuauguucaugcucugugggguuccgccuauccguagacggaagaaguugugaagauauuaacgagugcucaagcucccccuguucccaagaaugcgcaaacguuuacgggaguuaccaaugcuacugcaggcgggguuaucagcugucagauguugacggcguaacaugugaggauauugaugagugugcucuacccacuggcgggcauauuugcagcuacagauguauuaauauacccggguccuuucaauguucuuguccaucuagcggauacagacuggcccccaauggacggaacugccaggacauagacgagugugucacaggcauucauaacuguucuauuaacgaaacguguuuuaauauccagggcggcuuuagaugcuuagccuuugaaugcccugaaaacuacaggaggagcgcagcaacacaaaaaucgaagaaaggacgccaaaacacccccgccggcucaaguaaagaggacugcaggguacucccauggaaacaggguuuagaggauacucaucuggacgcauag

SEQ ID NO: 248801 - RNA, 198 nt, Artificial Sequence; identical to SEQ ID NO: 248195
  Description of Artificial Sequence: Synthetic coding sequence

SEQ ID NO: 248802 - RNA, 546 nt, Artificial Sequence
  Description of Artificial Sequence: Synthetic coding sequence
uguaggaugguucaggaacaguguugucacucacaacucgaagagcuccacugcgccacaggcaucagucucgccaaugagcaagaucgaugugccacuccccacggcgacaacgcaagccuggaggcuaccuuuguuaaaagaugcugccacuguugucugcuggguagagcagcucaggcccagggacagaguugcgaauauucacuuaugguuggauaccaaugugggcaaguuuuucaggcguguugcgugaagagucaagaaaccggcgaccuugacguuggcggucugcaggagacaggcggcggcccauguaaacaacagugucgggacacgggagaugaaguaguguguucuugcuucguuggauaucaacuucucucagauggugucucuugcgaggacgucaaugagugcaucacuggaagccacuccugcagauugggggagucuuguauuaauacagucgggucauucaggugccagagagauucauccugcgguacuggauaugaacugaccgaagacaauagcuguaaauag

SEQ ID NO: 248803 - RNA, 420 nt, Artificial Sequence
  Description of Artificial Sequence: Synthetic coding sequence
auggccacacaccagaaagauugcucucuucccuacgccaccgagaguaaggaaugcagaauggugcaggagcagugcugucauucucagcuggaagaguuacacugcgcuacggggauuucgcucgcuaacgagcaggaccgaugcgcuacaccccacggcgacaaugccaguuuagaggcuaccuucgucaaaaggugcugucauugcugucuccuaggacgugccgcucaagcucagggucagucuugcgaauacagucucauggucggguaucagugcggacagguuuuucaagccuguugugucaagagucaggagaccggggaucuggacguuggcggccugcaagagacagacaaaaucaucgaaguggaagaagagcaagaggacccuuacuugaacgauaggugccgguag

SEQ ID NO: 248804 - RNA, 519 nt, Artificial Sequence
  Description of Artificial Sequence: Synthetic coding sequence
auggaaagggcagcgccuuccaggaggguuccucucccucuucuauuacucggaggacuggcccugcuugcagcuggugucgacgcugaugugcuucuugaagccuguugcgccgauggucaccggauggcaacacaccaaaaggacugcagucugccauacgcgaccgaaucaaaagaauguagaaugguccaggagcaguguugucacagccagcucgaggaacuccauugcgcuaccggcauaucccuggccaacgagcaggacagaugcgccacaccgcacggcgacaaugcuucuuuagaagccacuuucgugaagagaugcugccacuguugccugcuuggcagggcggcucaggcccaggggcaguccugugaauacucuuugauggucgguuaucaguguggccagguuuuccaagcaugcugugucaaaucccaagagacgggugaccuagauguaggcggcuuacaggaaaccggaggaggaccuugcaaacaacagugucgggacuag

SEQ ID NO: 248805 - RNA, 792 nt, Artificial Sequence
  Description of Artificial Sequence: Synthetic coding sequence
augaggccuggagccccuggcccuuuguggccccuuccuuggggagcucucgcuugggcuguuggauucguuucuucuauggguagcggaaaucccgcuccugggggugugugcugguuacagcaggggcaggaggcaacauguucacuuguccugcagaccgauguaacacgggccgagugcugcgcaucaggcaacauugacacugcauggaguaauuuaacucacccagguaauaagauuaaccuacucggcuuucugggacuuguacacugccuuccaugcaaagacucuugcgacggcguugaaugugguccgggaaaggcgugucgaaugcuggguggcaggcccaggugugaaugugcucccgacugcucagggcucccugcaaggcuccagguuuguggauccgauggcgccacauacagagacgagugugaacuucgggcggccagaugucgcggucauccugaucuauccgugauguaccggggaagaugucgaaagaguugugaacacguggugugccccaggccacagucuugugucguggaccagacaggcucugcucacugcgucgugugccgugcugcuccaugccccgucccaaguaguccuggccaggaauugugcggcaacaacaacguuacauauauuucuucgugccacaugcgucaagcaacauguuuccuugguaggucuauugguguacgucaugcuggauccugcgccggcacccccgaagaaccuccaggcggggagucugcagaagaggaagagaacuucguauag

SEQ ID NO: 248806 - RNA, 984 nt, Artificial Sequence
  Description of Artificial Sequence: Synthetic coding sequence
augggucguacaagcaaagauaaacgggauguguauuacaggcuggcuaaagaaaacggcuggcgggcuagaucugccuuuaaguugcuccagcuagauaaagaguuccagcuguuucagggagucacuagggccguagaccuuugcgccgcacccggcucauggucacagguacugucucaaaagaucggagggcagggauccggacacgucguagcaguugaccuacaagcuauggcuccccucccuggcguuguucagauucaaggagauauuacgcaacuuucuaccgccaaagaaauuauccagcacuucaaggggugcccggcugaucuuguugugugugauggggcaccugaugugacgggcuuacaugaugucgacgaguauaugcaggcccagcuucuucuggcagcauugaauauagccacgcacguauuaaagccgggcgguuguuuuguggcaaaaauuuuuagaggacgcgacgugacacuucucuacucccaacugcaagucuucuucagcuccgugcucugcgccaaaccgagaaguucccggaauucuuccaucgaagccuucgccgugugucagggguacgacccuccagaagguuucaucccugaccucagcaagccucugcuggaucauucuuacgacuuuaaccagcucgauggcccaaccagaauuauugugccauucguuaccugcggugaccuguccucauaugacagcgaccgcuccuauccacuugacuuggaaggcggaucugaauacaaauacaccccucccacccagccgcccaucucaccccccuaucaggaagcauguacacuuaaacgcaagggucaauuagcgaaagagauacgaccccaggacugcccuaucagucguguggacaccuucccacagccccuugccgcuccccaaugccauacacuucuugcaccagaaauggaagauaacgaaaugucaugcucucccuag

SEQ ID NO: 248807 - RNA, 1404 nt, Artificial Sequence
  Description of Artificial Sequence: Synthetic coding sequence
augcgaccacaagaacuuccccgguuagccuucccgcugcuuuugcugcuguugcuucugcugccaccccccccuugucccgcccacucagcuacucgcuucgauccaacaugggagucacuggacgcuaggcaacugccagcaugguucgaucaggcaaaguuuggcauauucauccacuggggcguguucucugucccaucauucggaagugaaugguuuuggugguacuggcagaaggaaaagauucccaaauauguugaguuuaugaaagacaauuauccuccaucguuuaaguacgaggauuucgggccauuauuuacugccaaauucuuuaacgcaaaucaaugggcagauauuuuucaggcgagcggagcaaaguacaucguguugaccuccaaacaucaugagggauucacuuugugggguucugaauauaguuggaauuggaacgcaauugacgagggaccuaagagagauauugucaaagagcuggagguggcuauuaggaacagaaccgaccuccgcuuugguuuguacuacucccucuucgaaugguuucacccgcuguuucucgaagacgaaagcucaucuuuccacaaacgccaguuuccuguaagcaagacacuucccgaacucuacgaauuagugaauaauuaucagcccgaaguguuauggagcgauggcgacggcggugccccagaccaguacuggaacucaaccggauuucucgccugguuguauaacgagagcccaguccggggcaccguggugacaaacgaccgcuggggcgccggaucuauuuguaaacacggagguuuuuacacgugcucugacagauauaacccuggacauuugcugccacauaaaugggaaaacuguaugacuaucgauaagcucaguuggggguaucgaagggaagcugguaucuccgauuacuuaacgauugaggaacuggugaaacagcuggucgaaacugugucuugcggugguaaccuucugaugaacaucggaccaacacuggauggaaccauuuccgugguguuugaggagcgacuccgccaaaugggcagcuggcucaaaguuaauggugaagcaauauaugaaacucauaccuggagaucucagaaugauacagucacaccugacgugugguacaccucuaagcccaaagaaaaacuugucuacgcuauuuuucucaaauggccaacaucaggccaguuguuucucggacauccuaaggcgauccucggugcuacugaagucaagcucuugggucauggucagcccuuaaauuggaucucucuugagcaaaaugggauuauggucgaauuaccccagcugacaauucaccaaaugccuugcaagugggguugggcucucgcacuaaccaaugucaucuag

SEQ ID NO: 248808 - RNA, 354 nt, Artificial Sequence
  Description of Artificial Sequence: Synthetic coding sequence
augaaguggauguuuaaagaggaucacucauuggaacacagauguguugaaucugcuaaaauccgugcuaaguaccccgaccgagugccagucaucguggaaaagguguccggaucucagaucguagacauugauaagaggaaauaccugguucccucugacauuacaguggcucaguuuauguggaucauacgaaaaagaauucaacuaccgagcgaaaaggccauuuuucuauuugucgauaaaacagucccccaaucuagccugacaaugggccagcuuuacgaaaaagagaaggacgaagauggcuuccuuuacguugcauacaguggugagaacacauucggauuuuag

SEQ ID NO: 248809 - RNA, 1371 nt, Artificial Sequence
  Description of Artificial Sequence: Synthetic coding sequence
augagaaagucgcccggucucucggauugccugugggccuggauauuacugcucagcacauuaaccggaagaucuuauggacagccuucacugcaggaugaguuaaaagauaacacaacugucuucacuagaauacuggauagacuccuugauggcuaugauaaucggcuuagaccgggccugggggaacggguuacggagguuaagacagacaucuuuguaacaagcuuuggucccguauccgaccacgauauggaguacacuaucgacguguuuuuucgccaauccuggaaagaugaaaggcucaaguuuaaagggcccaugacuguccuaaggcugaacaaccucauggcaucuaagauuuggacccccgacacauuuuuucacaauggcaaaaagagcguagcucacaauaugacaaugcccaacaagcuccugcgaaucaccgaagacggaacucuucucuauacuaugcgccuuaccgugagagcagaaugcccuaugcaccucgaagauuuuccuauggacgcacaugccugcccacucaaauucgguaguuacgcuuacacucgugccgaggucguauaugaauggacucgcgaaccugcuagaucuguggugguggcagaagacggcuccaggcugaaccaauacgaccucuuggggcagacuguggauucuggaauugugcaaucaucuacuggcgaauauguagugaugacaacucacuuucaccugaaaaggaagaucgguuacuucguuauacagacuuaccuaccuugcaucaugaccgucaucuuaucccagguuuccuucuggcugaaucgggaaagugugcccgcgaggacgguguucggcgucacaacagugcugacaaugacuaccuugagcauuucggcuaggaacucucugccaaaaguugcuuacgccaccgccauggacugguucauagccgucuguuaugccuucguguuuuccgcucucaucgaauuugcuaccguuaacuauuuuacgaaaagaggguacgcuugggaugggaagucugucgugcccgagaagccuaaaaaagugaaagauccgcuuauuaagaagaauaacacuuaugcucccaccgcuaccagcuacaccccgaauuuagccagaggagaccccggauuggcuacaauugccaagagcgccacuauugaacccaaggaggucaaacccgaaacgaaaccgcccgaaccuaaaaaaacauuuaauucagugaguaaaaucgaucgucugucccgcauugcuuucccuuugcuguuuggcauauucaaccucguauauugggccacuuaccugaaucgcgagccccagcucaaagcaccuacuccacaucaauag

SEQ ID NO: 248810 - RNA, 345 nt, Artificial Sequence
  Description of Artificial Sequence: Synthetic coding sequence
auggccaacuccggauguaaagaugugaccggcccagaugaagaaagcuuucuguacuuugcuuacggaucaaaccucuugaccgaacgcauccacuugcggaaucccucggcugccuucuuuugcguggcacggcuccaggacuucaaacucgauuucgguaacucccaaggaaaaacaucucagaccuggcaugguggcaucgcuacgaucuuucagagcccuggagaugagguauggggcgucguguggaaaaugaauaagucaaacuugaauucccucgaugaacuuuucgccuggguacaaaagaaaaugguguguagaugguccauaaagagauccuag

SEQ ID NO: 248811 - RNA, 2196 nt, Artificial Sequence
  Description of Artificial Sequence: Synthetic coding sequence
auggucguggaacaccccgaguuucuaaaagccgguaaggagccgggauugcagauuuggcgcguggagaaauucgaucuaguaccuguuccgacaaaucuguacggggauuuuuuuacaggagaugcuuacguaauucugaaaaccgugcaacuacgaaauggcaaucuccaauacgaccuucacuauuggcuggguaacgagugcucgcaggaugagucuggggcagcagcuauauucaccgugcaguuggaugacuaccucaauggaagggcgguacagcacagagagguacaaggauuugaauccgcuacguuccugggcuacuuuaaguccggucucaaauauaagaaggggggggucgcuuccgguuucaaacaugucgugccuaaugagguugucgugcagaggcuguuucaaguaaaaggucggagaguggugcgcgcuacagaggugccgguguccugggaaaguuuuaauaauggcgacuguuucauucuggaccugggaaauaacauccaccaauggugcgguucaaauagcaauagguaugagagauugaaagccacacaggugucuaaaggaauccgggauaaugagagaucggggagagcuagagugcacguauccgaggaggguaccgagcccgaggcgauguuacagguauuagguccuaaacccgcacuaccagcugggacagaagauaccgcgaaagaagaugccgccaaucgaaaacuagcuaagcucuauaaagugucaaacggagcugggacuaugagugugucccuugucgcugaugaaaaucccuucgcucagggugcauuaaagucagaggacugcuuuauucuugaccacgggaaggaugguaaaaucuucgucuggaaagguaaacaagccaauacggaagaaaggaaagccgcccucaagacggcaagcgacuuuaucacaaagauggacuauccaaagcaaacccaagugagcguacugccugagggaggagaaaccccucuguucaaacaauuuuuuaagaauuggcgcgacccugaccagaccgacggucuuggccuaucuuaccugucuucucauaucgcgaauguagagcgcgucccuuuugaugccgcuacucugcacaccucaacugcgauggcagcacagcaugguauggaugaugauggcaccggccaaaaacagaucuggcgcauugagggaaguaacaaggugccgguggauccagccacauauggacaguuuuacgguggugauucuuauauuauucucuacaacuacagacacggcggaaggcaaggucagauaauauauaauuggcagggugcccagucuacucaagacgagguggccgcuucagcuauccucacugcgcagcuagaugaggaacuuggagguaccccggugcagagcagagugguccaaggaaaagagcccgcucacuuaaugagucucuuuggcggcaaaccuaugauuaucuacaaaggggguacgucucgggagggaggacagacagcuccggcuucaacucgguuguuccaggugagggccaauagcgccggggccacaagagcugucgagguguugcccaaggcaggcgcccuaaacuccaacgaugccuucgugcuuaaaacaccaagcgcggcauacuuguggguaggaacuggugcaucagaagccgaaaagaccggggcacaagaacuauuacgcguacugagagcacagcccgugcagguggcugaagggagcgagcccgauggauucugggaagcccuuggcgggaaagccgcauaccgcaccucuccccgacuuaaggauaagaaaauggacgcccauccuccccgauuguuugcaugcaguaacaaaaucgggagauuuguuauagaggagguucccggagagcuuaugcaagaggaucuggcaacggacgacgugaugcuuuuggacaccugggaucaaguuuuuguauggguuggcaaagauucacaagaagaggagaagacugaggcauugacaucugcuaagcgguacauugaaacagaccccgccaauagagauagacgcacaccuauaaccguugugaaacaaggcuuugaacccccuuccuuugucgguugguuccucggaugggaugaugauuacuggucgguugacccucuugaucgcgcaauggccgaacuggcagccuag

SEQ ID NO: 248812 - RNA, 2196 nt, Artificial Sequence
  Description of Artificial Sequence: Synthetic coding sequence
auggugguugaacaucccgaguuccugaaggcuggcaaggagcccggacuccagaucuggcgugucgagaaguuugacuugguaccagugccuaccaacuuguauggcgacuucuucacaggggacgccuacguaauuuugaaaacugugcaacuaagaaacgggaauuugcaguaugacuuacauuauuggcuuggaaaugaguguucgcaagacgagagcggggcagcagcuauuuucaccguacagcuggacgacuaccugaacggaagggcugugcaacauagagagguccaaggcuuugaguccgcaacauuccuggguuauuucaaaucuggccuaaaauacaagaagggcggcgucgcauccggguuuaagcacgucgugcccaaugagguaguugugcagcggcucuuucaagugaaaggaaggcgggugguaagagcuacagagguuccuguguccugggagucuuucaacaacggggauuguuucauucuggaccuagguaacaacauucaccaaugguguggcucaaacagcaacagauacgaacgacugaaggccacacaggugucuaaaggcauccgagauaacgagcguuccgggcgugcacgagugcacguuucagaggagggaacagagccagaagcuauguugcaggugcuuggaccaaagccggcgcugcccgcaggaacagaagauacugccaaggaggacgcagccaauagaaaauuagccaaauuguauaaggugucaaauggcgcaggaacgaugucaguaagucuaguggccgacgagaacccuuucgcccaaggggcucucaagucagaagauuguuuuauucuggaucacggaaaggauggaaaaauauucguauggaaagggaagcaagccaauaccgaagagaggaaggccgcccucaaaacagccagcgacuuuauaacuaaaauggacuauccaaaacagacacaagugucuguauuacccgaagguggagaaacaccacuuuuuaagcaauucuucaagaauuggcgugaucccgaccagacggauggacucggccucucauaccugagcucucacauugcgaaugucgaaagagugccauucgaugcagcuacacuccacacuaguacagcaauggcagcccaacacgggauggaugaugacggcacgggacagaaacagauauggagaaucgagggaucaaacaaggugcccguggaucccgccacuuacggccaauucuauggcggagauaguuacauuauccuuuauaauuauaggcacgggggaaggcagggacagauuaucuauaauuggcaaggagcccaaucaacacaggacgaaguggcagcuucggccauucugaccgcucaguuggacgaagagcucggcggcacuccuguacagucacggguaguucaaggcaaggagccagcccauuugaugucgcuguucggaggcaaaccaaugaucaucuacaaaggggggacaucgcgcgaggguggacagacagcacccgcaucgacuaggcuguuucaagucagagccaauagugcgggagccacaagagccguggaaguccuaccuaaagcaggagcucuuaacucaaaugaugcuuuugugcugaaaacaccuucggcugcauaucucugggucgguacuggcgcuucggaagccgagaagaccggcgcgcaggagcuccuacggguguuaagagcgcaacccguccaaguggccgagggcagcgaaccggaugguuuuugggaggcguugggagguaaggccgcauaccguacgucccccagauugaaggauaaaaagauggacgcacacccgccaagacuuuuugcauguaguaauaaaaucgggcguuuugugaucgaggaggugccaggcgaacuuaugcaggaggauuuagcuacagaugaugucauguugcuggauacaugggaccagguguucguguggguugggaaggacucgcaggaggaagaaaagaccgaagcacucacaucagccaaacgguacaucgagacagacccagcuaauagagaucggaggacucccauaacuguaguaaaacagggauuugaaccuccuucuuuuguuggaugguuucuagggugggacgaugauuauuggagcgucgaucccuuggaccgggccauggcagaacuugcagcuuag

SEQ ID NO: 248813 - RNA, 2349 nt, Artificial Sequence
  Description of Artificial Sequence: Synthetic coding sequence
auggcaccccacagaccagccccagcccugcugugcgcacucagccuggcccugugugccuugucacucccuguuagagcugcaacugcuucuagaggcgccucucaggccggugccccccagggccgcgugccggaggcgagacccaacucaauggucguggaacauccagaauuucucaaggcugggaaagaaccaggguuacagauuuggcggguugaaaaauucgacuugguuccaguuccaacaaaucuguacggagacuucuucacaggagaugcuuaugugauuuugaaaacagugcaguugcgaaacgggaaccugcaauacgaccuccacuauuggcugggaaaugaaugcucgcaggaugaaucuggcgcggccgcgauuuuuacugugcaguuagacgacuacuugaauggacgcgcggugcagcauagagaagugcaaggcuucgaaucggcuacauuucucggauacuucaagucuggccugaaauauaagaaagguggaguggccucaggauuuaaacacguggugccuaacgagguaguugugcagcgccuguuucaagugaaaggaagacguguggucagagcuacugaggugccugugucuugggagagcuucaacaacggagauuguuuuauucuagaccugggaaauaauauccaucaguggugugguagcaacaguaauagguaugaacgucucaaggcaacucaagucuccaaagguaucagggacaacgaacgguccgggcgcgcccggguacacguguccgaagaaggaaccgagccugaggcuaugcuccaagucuuaggacccaagcccgccuugccagccggaacugaggacaccgccaaagaagaugccgccaaucgaaaacuugcgaaacuguauaaggugagcaauggagcagguacuaugucugugagucugguugccgacgagaacccguucgcgcagggcgcccugaagagugaggauuguuucauacuggaccaugggaaggauggaaaaauauuuguuuggaaggggaaacaggccaacaccgaggaaaggaaggcggcgcugaagacggcaagugacuuuaucacuaaaauggauuaccccaaacaaacucaggugaguguacugccugaaggaggagagaccccauuauuuaagcaguuuuucaaaaauuggagggacccugaccagaccgaugggcugggucuauccuauuuaaguucacacaucgcaaacguugagagggugccauucgacgcggccacacuucacacaaguacugccauggcagcucagcacggaauggaugacgacggaaccggucagaagcaaaucuggcgcauagagggaucaaacaaaguacccguagacccagcuacauacggacaguuuuaugguggagacucguacauaauauuauauaauuacagacauggggggcggcaggggcagaucauauacaauuggcagggagcucaaucuacacaagaugaagucgccgcaucggcuauacuuacugcacaacucgaugaggaacuggguggcacgccugugcaaucucgagugguucagggcaaagaaccagcacauuugaugucucuauuuggggggaagccaaugaucaucuacaaaggcggaacaagccgggaggggggccagacugcgccugcuagcaccaggcuguuccagguucgagccaacucugcgggagcgacuagggccguggaagugcuuccaaaagcaggcgcacucaauagcaacgacgcguucguccugaagacaccuuccgcagcauaccuuuggguuggcaccggggcaagcgaagccgagaagaccggagcccaggaacuuuugcgaguguugcgagcccagcccgugcagguagcugaaggcuccgaaccugacgguuucugggaagcgcugggcgguaaggcugcauauagaacuucaccccgguugaaagacaagaagauggacgcacacccccccaggcuauuugcuugcucuaauaaaauuggccgguuugugaucgaggaggucccuggugaacuuaugcaagaagacuuggcuacagaugaugugaugcuacuagacacuugggaccaaguuuucguuuggguaggaaaagauucgcaagaagaggaaaagacagaggcccugaccagugcaaaacgauauaucgagacagaccccgcgaauagagauagacgcacgccgaucaccgugguuaagcagggcuuugaacccccgaguuucgucggaugguuuuuggggugggacgaugacuauuggucuguggaucccuuagauagagcuauggccgagcuggcugcauag

SEQ ID NO: 248814 - RNA, 2196 nt, Artificial Sequence
  Description of Artificial Sequence: Synthetic coding sequence
augguaguugagcacccugaauuuuuaaaagcaggcaaggaaccuggccuacagaucuggcgaguggagaaauuugacuuagucccugugcccaccaaucuuuauggcgacuuuuucacuggagaugcguauguuauccugaaaacggugcaacuucgaaacggaaaucugcaauacgaccugcacuacuggcuaggcaacgaauguagucaagaugagucgggggccgcugcuaucuucaccguucaguuagacgauuacuuaaauggucgggccguccagcaucgggagguccagggauuugaaucagcaacauuucuaggguacuucaaguccggucugaaauacaaaaagggaggaguugcuagcgguuuuaaacacguggugccaaaugaaguggugguacaacgccuguuucaagugaagggccggaggguggugagggcaacagaggucccagugucuugggagagcuuuaacaauggggacugcuucauacuugaccuuggcaauaacauucaccaguggugugguaguaacuccaauagauacgaacgucugaaggcaacacagguaaguaaaggcaucagagauaacgagcguucagggcgggcucgggugcauguuagcgaggaggguaccgaaccagaggcuauguuacagguguuggggcccaagcccgcacucccugcaggcacagaagacacagcaaaggaggaugccgccaauaggaaauuagcuaaacuguacaaggucucaaauggagccgggacaauguccgucucgcuaguagccgaugagaacccauuugcccagggagcuuuaaaaucggaagacugcuuuauccucgaucacgggaaagauggcaagaucuuuguuuggaagggcaaacaggccaacacagaggaacggaaggcagcccuaaaaaccgcaucagauuuuauaaccaaaauggauuacccgaagcagacccaggugucuguguuacccgaggguggcgaaacuccacuguuuaagcaauucuuuaagaauuggcgcgaccccgaucagaccgacggacugggacuuucuuaucucuccucccacauugcaaacguggaacgagucccuuucgacgccgcgacccuucacaccucaaccgcaauggccgcccagcacgguauggacgaugauggaaccggacagaaacagauuuggcgcauagaaggaucuaauaaggugcccguagacccagcaaccuacggucaauuuuauggcggggacuccuacauaauucuguauaacuauaggcacggaggacgucaggggcagaucaucuacaacuggcagggagcucagaguacccaggacgaaguugcagcuucagccauucugacagcacagcuugacgaggaacuggguggcacuccgguacagagcagagugguccagggcaaagaacccgcccacuuaaugucccuguuugguggcaagccgaugauuauuuacaaaggcggaacuagccgugaaggaggacagacagccccagccucuacuaggcuguuucaggugagggcuaacuccgcaggcgcuacuagggcgguggaaguccugcccaaggccggugcccugaauuccaaugaugcuuuuguccugaaaaccccauccgccgcuuaucuaugggucggaacuggugccucugaagcagaaaaaacuggagcccaggaacuucucagagugcuucgcgcacagccuguccaaguggcugagggcagugaaccugacggcuucugggaagcccuggguggaaaagccgcguaucggacuuccccucggcuuaaggacaaaaaaauggaugcacauccuccgagauuauucgcauguucuaauaaaaucggcagauucgugauugaagaagucccgggggaacugaugcaagaggauuuagccacagaugauguuaugcuuuuagacaccugggaucagguauuuguaugggucggaaaggacucacaggaagaagagaaaacugaggcucugacuucugcuaaaagauacauagaaacagauccagcaaacagagaucggcggacccccauuaccguagucaaacaaggauuugaaccuccauccuucguaggcugguuucuggguugggaugaugacuauuggagcguugauccacucgaucgagcaauggcugaacuggcugccuag

SEQ ID NO: 248815 - RNA, 2148 nt, Artificial Sequence
  Description of Artificial Sequence: Synthetic coding sequence
auggugguggagcacccagaauucuugaaggcaggcaaagagcccggacuacagaucuggcgcguugaaaaauuugaugcauacgucauuuugaagacaguucaacugaggaacgguaauuuacaguaugaccuacacuauuggcuggggaaugaguguucacaggacgaauccggagccgcggcaauuuuuacagugcagcuggaugauuauuugaaugggcgcgccgugcagcaccgggagguccaagguuuugaguccgcaaccuuucugggguauuucaaaucaggccugaaguauaaaaaagguggcguggcauccggcuucaaacacguaguaccuaaugaggugguugugcagcgcuuauuucaaguuaaggggcggagggugguccgagccacagaggugccagucaguugggaaagcuucaauaacggcgacuguuucauuuuggaucugggaaauaacauccaccaguggugcggaucaaauaguaauagguacgagagguuaaaggcgacucaggucagcaaggggauucgggacaacgagagaucaggcagggcccgagugcacgugagcgaggagggaacagagccugaggcuaugcugcaaguucuagguccuaagcccgcuuugcccgccggaacagaagacacugccaaagaagacgccgccaaucgcaagcuggccaaauuauauaaggucucaaacggugccggaacgaugagcgugucacugguagcugaugaaaaccccuuugcacaaggugcacuuaaaagugaggacuguuucauuuuggaccacggaaaagacggaaagauauucguguggaaggguaagcaggccaacaccgaggaacggaaggccgcuuuaaagacugcuucugauuuuauuacuaagauggacuaucccaagcaaacucagguuucaguccugccugaaggaggcgagacgccccucuucaagcaguucuuuaagaauuggcgagauccugaccaaaccgacgguuuagggcucaguuaccugucuucacauaucgccaauguugaaagagucccauucgaugcggccacccuccacacuagcacugcuauggcggcucaacacgggauggaugaugauggcacagggcagaagcagauuuggcggauugaggggagcaacaagguaccgguggaccccgcaacauauggacaguucuaugguggcgauaguuauauaauucuuuacaauuaccggcacggaggccggcagggucagauuaucuacaauuggcagggagcucagaguacgcaggaugagguugccgcguccgcaaucuuaacagcucagcuagacgaagaacugggcgggacgccagugcaaucaagggugguccaggggaaagagccagcacaccugaugucccuuuuuggagggaagcccaugauuauuuauaagggugguacgagcagagaaggaggacagaccgcucccgcuagcacaagacuauuccagguaagagcaaauuccgcuggagcaacuagggccguggaagucuugccuaaggccggggcuuugaacaguaacgacgcuuucgugcugaaaacucccagcgccgcuuaucucugggucggcaccggcgccuccgaagcugagaagacuggagcucaagaacuucuacggguguugagagcccagccagugcagguugcagaagguuccgagccggacggauuuugggaagccuugggaggaaaagcggcuuaccgaaccaguccuagacugaaagacaagaagauggaugcccacccaccaaggcuauucgcaugcagcaacaaaauuggacgcuuuguuauugaagagguuccaggcgagcugaugcaagaagaccuggcuacugaugauguaaugcuacuggauacaugggaucagguguucguuuggguaggaaaagacagccaagaggaagaaaaaacagaggcccucacguccgcuaagcgcuauaucgagaccgacccagcuaauagggaccgccgcacucccaucacagucguuaagcagggauuugaacccccuuccuucguagggugguuucugggaugggacgaugauuacuggagugucgacccucuggaccgugcuauggcugagcuggcugcguag

SEQ ID NO: 248816 - RNA, 2229 nt, Artificial Sequence
  Description of Artificial Sequence: Synthetic coding sequence
auggagaaacuguucugcugcuuucccaacucaauggucguggagcacccagaguuccugaaagcugggaaggagccaggacugcaaauauggcguguugagaaauuugauuuaguucccgucccaacgaaucuuuauggcgauuuuuucaccggcgaugcauacgugauuuugaaaacagugcaacugcguaaugguaacuugcaguacgaccugcacuacuggcuaggaaacgaguguagccaagacgaguccggcgccgcagccauuuuuaccguacaauuagacgacuaccucaaugggcgcgcaguccaacacagagaggugcagggguuugagagugcaacguuccuaggauauuucaagaguggacucaaauauaagaaaggaggaguugcuagcgguuuuaagcauguugugcccaacgagguggucgugcagcgguuguuucagguuaaaggccgcaggguggugcgugcaacugaggugccggucagcugggaauccuuuaauaacggugauuguuuuauucuagauuuagggaauaacauccaucagugguguggcaguaacuccaacagauacgagcguuugaaggccacacaggucucgaaggguauuagagauaaugagagauccggccgcgcaagaguacacgugucagaagaaggcacugaacccgaagccaugcugcagguacuggggccuaaaccagcucuccccgcuggcaccgaagacacagccaaggaagacgccgccaacagaaaacuggccaagcuguacaagguaucuaacggcgccgggacuaugucugugucgcuggucgcugaugaaaauccguucgcgcagggugcucugaagucugaggauugcuucauccuggaucauggaaaagaugggaaaaucuuuguuuggaaagggaaacaggcuaacacagaggaaagaaaggcagcacuuaaaaccgcaagcgacuucauuaccaagauggacuacccuaaacaaacacaaguauccguucucccugaggggggcgagacgccuuuauucaaacaguuuuuuaaaaauuggagggacccagaccaaaccgauggacucggccucagcuacuugucuucacauauugcuaauguggaacgggucccguucgaugccgccacgcugcacaccucaaccgccauggccgcccagcacgggauggaugaugaugguacgggucaaaaacaaauuuggagaauugagggcaguaacaaaguacccgucgaccccgcaacauaugggcaguucuacggcggagacagcuacauuaucuuauacaacuaccgacauggcggcagacagggccaaauuauuuacaacuggcagggcgcccagucaacccaggaugaagucgccgccagcgcgaucuugaccgcucagcuugacgaggaauuggggggaacgcccgugcaaagccgcgugguccagggaaaggagcccgcccaccugaugagucuguucggcgguaagccaaugauuaucuauaaagggggcacuucgagggagggggggcaaacagccccagcuucuaccagacuguuccagguuagagcaaauuccgccggggcuacuagggcaguggagguccugccgaaagcuggggcucuaaacucaaacgaugcauuugugcuuaaaacaccaucugcggcauauuuaugggucggcacuggggcuagcgaagccgagaagacgggugcucaggaacucuugagggucuuacgagcccagccuguacaaguugcggagggcagugagcccgaugguuuuugggaggcguuaggcggcaaagcggcuuauaggacuucgccuagacuuaaggacaagaaaauggacgcucaucccccaagacucuucgcaugcuccaacaagaucggacgauuuguaaucgaggaagugccgggagaguuaaugcaagaagacuuagcgacagaugaugugaugcugcuggacaccugggaccaaguuuuuguguggguggguaaggacucucaggaggaagagaagacugaggcccugacaagugcuaagagauacauugaaacagauccugcaaauagagauagacguacaccgauuacaguggugaagcaggguuuugaaccccccucuuuuguuggaugguuccuaggcugggaugaugacuauuggucaguugauccuuuggacagggcuauggccgagcuugcggcauag

SEQ ID NO: 248817 - RNA, 2196 nt, Artificial Sequence
  Description of Artificial Sequence: Synthetic coding sequence
auggugguagaacacccggaauucuugaaagcagguaaggagccugggcugcagaucuggcgcguggagaaauucgaccucguacccgucccaaccaaucucuacggcgacuucuuuaccggggacgcuuacguuauccuaaagacggugcaacucaggaacggcaaccuucaauacgaucuacacuacuggcuggguaaugagugcucgcaggaugagaguggagcagccgcaaucuucaccgugcaguuagacgacuaccuaaacggccgagccgugcagcaucgcgaagugcagggcuuugaaucagccacauuccuuggauacuucaagaguggacuaaaguacaaaaaagguggcguggcauccgguuucaagcauguugugccuaaugagguggucgugcaaagguuguuccaggugaaaggacgaagaguagugcgagcaaccgagguuccuguguccugggaaucauucaacaacggagauuguuucauucucgacuugggaaacaacauacaucaauggugcggcuccaauaguaacagauacgaacgucuuaaagcaacucaggugaguaaaggcauucgcgacaaugagcgaagcggcagggcucgcguccacguuuccgaagaggguaccgaaccagaggcaaugcuccaggugcucgggccaaaacccgcacuucccgccggaacugaagacacugcuaaggaagaugcagccaacagaaaacucgccaaguuguacaagguuuccaauggcgccgggacaauguccgucucuuuaguugccgaugagaacccauucgcacagggugcauugaaaagcgaagauuguuucauuuuagaucacgguaaggacggcaagauauucguguggaaagggaaacaggccaauacugaagagagaaaggccgcccucaagacagcauccgacuuuauuaccaagauggacuacccaaaacaaacacagguuucugugcucccugaaggaggugagacuccccuguucaaacaguucuuuaaaaauuggagggaucccgaccagacugauggccugggccugaguuaucucuccucgcacauugcgaauguggaacgagugccauuugaugcagcuacccuccauaccagcacugcaauggcugcgcagcauggaauggaugacgaugggacuggacagaagcagauuuggaggaucgagggaagcaauaaaguccccguugauccagcaacauauggccaguucuacggcggcgauuccuauauaaucuuauauaacuacagacacggcgggaggcagggccagauaaucuacaacuggcagggagcucaaaguacgcaggaugagguagcggccagcgccauucuuacagcccaguuggacgaggaguuagggggcacaccagugcagucaagagucgugcaggggaaagagcccgcccaccugaugucucucuucgguggcaagccuaugauuauuuauaagggggguacuagcagagaaggcggacagaccgcccccgcaagcacuagacuuuuucaaguaagagccaauucugcgggagccaccagagcuguggagguacucccgaaagcaggugcacugaauagcaacgaugcuuuugugcugaaaacgccuagugccgcauauuuauggguuggaacgggcgcuagcgaagccgagaagacuggagcgcaggaacugcucagaguucugcgggcccaaccagugcagguggccgaaggaagcgaaccggacggcuuuugggaagcgcuugggggcaaagcagcguaccguacuaguccccgccucaaggauaaaaaaauggaugcucauccgccaagacuauucgcuuguaguaacaagaucggaagauucguaaucgaagagguuccaggagaacuaaugcaggaagaccuugccacagaugauguuaugcuguuggacacaugggaucaaguuuuugucuggguggggaaggacucccaggaggaggagaaaaccgaggcacugacuuccgccaaaagauauaucgagaccgacccggcuaauagggaccguaggacgccaaucacuguaguuaagcaaggauucgaaccucccucguuuguuggcugguuucugggcugggaugacgauuacuggucaguagauccccuugacagggcaauggccgaacuugccgcauag

SEQ ID NO: 248818 - RNA, 783 nt, Artificial Sequence
  Description of Artificial Sequence: Synthetic coding sequence
augguuguagaacaccccgaguuucugaaagcggguaaggaaccaggccugcagauauggcggguggagaaauucgaucuugugcccgugccuaccaaucucuauggagacuucuuuacuggcgacgcguaugugauucucaagacaguccaacuccgcaauggaaacuuacaauacgaucuacacuauuggcuuggaaacgaauguucacaggaugagagcggcgcugcugcuaucuucacaguucagcuggacgacuaccuaaaugggagggcaguucaacaccgggaaguacagggcuuugagagcgcuacauuucugggauauuucaaguccggucucaaauauaaaaaaggaggcguggcuagcggauuuaaacacguugugccuaacgaggucguaguccagcggcuauuccagguuaaaggcagaagggugguacgcgcaacagaagugccugugucuugggaaucuuuuaacaauggcgacuguuuuauccucgaucucggcaauaauauucaccaguggugcgguagcaacucuaauagguacgagcgucuuaaggccacgcagguuuccaaaggaauccgggacaaugaacgaaguggaagggcgagagugcacguuagcgaggagggcaccgaaccugaggcuaugcugcaaguucuaggcccuaagccagcgcugcccgcaggaacggaggacacggccaaggaggaugccgcuaaccgaaaacuggccaaauuauacaaggugagcaacggagccggaacaaugucuuag

SEQ ID NO: 248819 - RNA, 2229 nt, Artificial Sequence
  Description of Artificial Sequence: Synthetic coding sequence
auggagaagcuguucuguugcuuuccuaauagcaugguuguggagcauccugaauuucucaaggccgggaaggagccuggacugcagauauggagaguggaaaaauucgaccucgucccaguacccacuaaucuuuauggggacuucuucacaggugaugcauaugucauccucaagacugugcagcugagaaauggcaauuuacaguacgacuuacacuacugguuaggaaaugaguguucccaggaugaaucaggggccgccgcaauuuuuaccguacagcuggacgauuacuugaaugggagagccguccagcaucgcgaaguccaggguuucgaguccgccaccuuucugggcuacuuuaaaucuggucugaaauacaagaaaggcggggucgcaagcggguucaaacacguugucccuaaugaagugguaguccaaagauuauuccaagugaaaggacggagagucgugagggccacagagguucccguguccugggaaaguuucaauaacggagauugcuuuauccuugaccuaggaaauaauauacaccaguggugcggauccaacagcaaucgguacgaaaggcucaaggccacacaaguauccaaaggcauuagggauaacgaaagaaguggacgcgcuagaguccacguguccgaagaagguacggagccagaggccaugcuccagguacuuggaccuaaacccgcacucccugcaggcaccgaagacacugccaaagaggacgcagcaaauagaaagcuugccaagcucuacaaggucucuaauggugcaggaacuaugagcguuagccucgucgccgacgaaaauccuuuugcccagggagcccucaagucagaagacuguuucauccucgaucacggcaaagacggaaagauuuucgucuggaagggaaagcaagccaacaccgaggaacgcaaagccgccuuaaaaaccgcuagcgacuuuaucacuaagauggacuaucccaagcagacccagguuuccguccugcccgagggcggagagacaccccuauuuaagcaguucuuuaaaaacuggcgggacccagaucagacugacgggcucggccucucauauuuaucaucacauaucgcuaacguggaacggguuccuuuugacgcagccacacuccacaccucuaccgcuauggccgcacaacauggaauggaugacgacgguacagggcagaaacagaucuggcguaucgaaggaucgaacaagguucccguggacccugcgacauacggacaauucuauggaggcgauagcuacauuaucuuguauaauuaucggcacggggggagacaaggucagaucaucuauaacuggcagggggcucagagcacacaggaugaagucgccgcuagcgcaauccuuacagcccagcuggacgaagaacuuggcggcacaccggugcaaucuagggugguccaggguaaggaacccgcacaccucaugucucuauuugguggcaaaccaaugauuaucuacaagggugguacaucaagggaaggcggccagaccgccccagcaucuacuagacuguuucaaguacgcgccaacuccgcuggagcaacaagggcggucgaagugcugccuaaagccggggcacuuaacagcaaugacgcguucguucuuaaaacacccuccgcugcauaucuaugggugggcacuggcgcuagugaagccgagaaaaccggagcacaggaacugcucagggugcugcgcgcacagccugugcagguggcagagggguccgagccagacggguuuugggaagcauugggagguaaagccgccuacagaaccagcccuaggcucaaggauaagaaaauggacgcucacccaccgagauuguucgccugcucaaauaaaaucggucgcuuugugauagaagaaguuccaggcgaauugaugcaggaggaccuugcaacugacgauguaaugcugcuggacacaugggaucaaguguucguguggguggggaaagauagccaggaagaggaaaagacagaggcgcugacuuccgccaaaagauauauugaaaccgaucccgcuaaucgcgaccguagaacuccgaucacaguugugaagcagggcuucgaacccccuaguuuuguuggcugguuccuagguugggaugaugacuacuggucaguggaucccuuggauagagcaauggccgaguuagcugccuag

SEQ ID NO: 248820 - RNA, 2196 nt, Artificial Sequence
  Description of Artificial Sequence: Synthetic coding sequence
augguaguggaacauccugaauuuuuaaaagccggaaaagaaccaggccugcagauuuggcgcguggaaaaauuugaccucgugccuguuccaacuaauuuauauggagauuuuuucacgggugacgcuuauguaauccucaagacagugcagcugagaaauggcaaucugcaguaugaccuccauuauuggcucgggaaugaauguucacaggacgagucuggggcggcagcuaucuucacgguccaacuggaugacuaucugaauggcagagcuguacagcaccgcgaagugcagggauucgagagcgcuacuuuccugggguauuucaagagcggguuaaaauacaagaaaggaggaguugcaucaggauuuaaacacgucgugccuaacgaggucgugguucagcguuuguuucaggugaaaggacgcaggguuguuagagccacagaagugccagucucgugggaaucauucaauaacggugacugcuucauccuggaucugggcaauaauauucaccagugguguggaucaaauucaaaccguuacgaacggcuuaaggcgacacaggucucuaaggguauucgcgacaaugaaagguccggacgggcccgcgugcacgugagcgaggagggaacugagccagaagccaugcuucagguguugggaccuaaacccgcccugccggcuggcacugaagacaccgcaaaggaagaugcugcgaacaggaagcucgcaaaacucuacaagguaaguaauggagcgggaaccaugucugugucccugguggcagacgagaaccccuuugcacaaggagcacugaagucagaagacugcuuuauccuggaucacgguaaagauggaaaaaucuucguauggaaagguaaacaggcgaauacugaagagcggaaggcugcccugaagacagccagugacuuuaucacgaaaauggauuauccuaagcaaacccaggugagugugcuccccgagggcggcgagaccccucucuuuaaacaguucuucaagaauuggcgugauccggaccagacagauggacuuggccugucauaucugagcucccacauugccaacguagagagagugccauuugaugcagccacauuacauaccaguaccgcuauggcagcacaacacggaauggacgacgauggaacggggcagaaacaaauauggcgcauugagggcuccaacaagguccccguagacccagccaccuacggccaguuuuacggaggugauuccuacaucauacuauacaacuaucgacacggcggaaggcagggccagaucauauacaauuggcagggugcacagaguacccaggacgaggucgcggcaucugcgauucugacagcgcagcuugaugaagaacugggaggcacccccguacaaagccgcgugguccaaggcaaagaaccagcacaucugaugucacuuuuuggaggcaaacccaugauuaucuacaaaggaggaacuucaagagaagguggccagaccgcuccagcaucaaccagacuguuucaggugcgggccaacagcgcuggcgccacaagagccguggaggugcugcccaaagcgggcgccuugaacucuaaugaugcguucguccugaaaacccccucagcagccuacuuguggguggggaccggagcauccgaagcagaaaagacuggggcacaagagcuccuucgcguguugagagcccaaccaguucaaguugccgaagggagcgagccugacggcuuuugggaggcauuaggcggaaaagcugcuuauaggacgucccccagacugaaggauaagaagauggaugcucacccccccaggcuuuucgcuugcucaaauaagauuggaagguuugucauagaagagguaccuggcgaacuuaugcaggaagauuuagcuacagacgauguuaugcugcucgauacgugggaccaaguguucgugugggucggcaaggacagccaggaagaagagaaaaccgaagcguuaaccucugcaaaaagauacauagaaacugaucccgcaaauagggauagacggacccccauuacaguggugaaacagggauuugaacccccaucuuuuguuggcugguuccucggcugggaugaugauuauuggagcguggacccccuggacagagcuauggcagagcuggcugcuuag

SEQ ID NO: 248821 - RNA, 2118 nt, Artificial Sequence
  Description of Artificial Sequence: Synthetic coding sequence
auggucgucgaacauccugaauuccucaaagcagggaaggaaccuggccuucagauauggaggguagaaaaguuugacuuagugcccguacccacuaaucuguacggcgacuuuuuuaccggcgacgcauaugugauccugaagaccguccaauuaagaaauggcaaccugcaauacgaccuucacuacuggcuagggaacgagugcucacaggaugaauccggugcugcugcaauuuuuacugugcaguuggacgauuaccugaaauacaaaaaaggaggaguagcaucaggcuucaagcaugugguuccuaaugaagucgucgugcagagacuguuucaaguuaaagggaggaggguuguccgggccacagaggugcccguuucgugggagagcuucaauaauggcgacuguuuuauucuagacuuagguaacaauauccaccagugguguggcaguaauucuaauagauacgaaagguuaaaggcaacacagguguccaaagggauucgcgacaaugaacgaucaggacgcgccagaguccauguaagugaagaggguacagaaccggaggcuaugcugcaggugcuuggccccaagccugccuugcccgccggcacagaggacaccgcuaaggaggacgcagcgaauagaaaauuagccaaacuuuacaaagugucuaacggcgcggggacuaugucagugagccugguggcagacgaaaacccauucgcacaaggugcguugaaaagcgaggacuguuucauccuagaccacggcaaggacgguaagauauucguauggaaaggaaaacaggcaaauacugaggaaaggaaagccgcccucaagacugcgagugacuucauuaccaaaauggacuacccaaagcagacccaagucucaguauuacccgaaggaggagagacacccuuauucaagcaguuuuucaagaacuggagagauccugaccagacugacggacucggccugagcuauuugaguucucacaucgccaauguggagagagugcccuucgacgcugcaacgcuccauacuuccacagcuauggccgcccaacacggcauggaugaugacggcaccgggcagaaacaaauuuggcggauagaagguucaaacaagguuccuguugaucccgcuacauacgggcaauuuuaugguggcgacucguacauuauccucuacaacuacagacacggcggcagacaggggcagaucauuuacaacuggcagggagcgcagagcacccaagacgaaguagccgcgucugcgauauugaccgcucaacucgaugaagaacuuggagguacuccuguccaaucacgggucguccaggguaaagagccagcccaucucaugucucuuuuugggggcaaaccuaugaucauuuauaaaggcggcaccagccgggaaggaggccagaccgcccccgccaguaccagacucuuccaggugagggcuaacagugccggugcuacacgagcaguagaaguccucccaaaagccggggcacuuaacucuaaugaugccuuuguucucaagacgccuagugccgccuaccuaugggucgguaccggugcuagcgaggccgaaaagaccggagcccaagaauugcugaggguuuuaagagcacagccuguccaaguggccgagggaagcgaaccugauggguuuugggaagcccuagggggcaaggccgcguauagaacaagcccccgccucaaagauaaaaaaauggacgcccacccuccccgacuguucgcuugcucuaauaagauuggaagauucgugauugaggaggucccuggggaacuuaugcaagaggaccuggcaacagaugaugugaugcugcuggauacaugggaccaaguguucgugugggugggaaaagauagccaagaagaggagaagacagaggcacucacuucggccaagagauacauagagacagaucccgcaaaucgggaccgcagaacucccaucaccguggucaaacagggauuugagccaccgagcuuuguagguugguuuuugggaugggacgacgacuacugguccguggacccuuuagacagagcaauggccgaacuugcagccuag

SEQ ID NO: 248822 - RNA, 2220 nt, Artificial Sequence
  Description of Artificial Sequence: Synthetic coding sequence
augccccuguguaccccaaauucaauggugguggagcaccccgaauuucuuaaggcagggaaggaaccgggccuccagauuuggagaguggaaaaauuugaccucguucccgugcccacaaacuuguacggcgauuuuuuuaccggugaugcauacgugaucuugaaaaccguccaacuacgaaacggaaaucugcaauaugauuugcauuauugguuaggcaacgagugcagccaagaugaguccggggccgccgcaauauucacagugcaacuagacgacuaucugaauggaagagcuguccagcaccgggagguucaaggauucgaguccgcuacauuccugggguacuucaagagugguuuaaaauauaagaaaggcggagucgccucaggguucaaacauguggucccuaacgaggucgucgugcaaagacuuuuucagguuaaaggaagacgaguggucagagccacagaggugcccgugagcugggaauccuucaacaauggcgauugcuucauccucgaucugggaaacaauauccaucaguggugcggaucuaauucuaaucgguaugagagguuaaaggcuacacagguguccaagggaauaagggacaacgagaggagcggaagggccagggugcacgugucagaagaaggaacagagccagaggccaugcugcagguccuugguccgaaaccugcucugcccgcgggaacagaagacacggcaaaggaggacgcagccaacagaaaguuagccaaauuauauaaaguauccaacggagccgguaccaugucagucucucuaguggcagacgagaauccauucgcccagggggcacucaaaagcgaagacugcuuuauacucgaccacggaaaggacggaaagaucuucguguggaagggcaaacaagcaaauacggaagagcggaaagcagcgcuaaaaacagcgucugauuuuauuacgaagauggauuacccgaagcagacacaggugagcguuuuacccgagggcggcgaaacucccuuguuuaaacaguuuuucaagaauuggagagaccccgaccagacagacggccuuggcuuaucuuaucucaguucccacauugcaaacguggaacgcgucccuuuugaugcagccacccugcauacaaguaccgcaauggcagcgcagcaugggauggacgaugacgggacaggacagaaacagauauggagaauugagggcucaaauaaaguaccaguggacccagccaccuacggacaguucuauggcggugauuccuauaucauucuauacaauuacagacauggcggccgccaaggacagauuauauacaauuggcaaggagcucaaucgacucaggacgaaguggcggcaucagcuauauuaacugcucagcuugacgaggagcuggggggaacaccugugcagucccgcguggugcaggguaaggagccugcucaucugaugagucuauuuggagggaagccuaugaucauuuauaagggcgguacaagccgagaaggcggccagacugccccagccuccacgagacuauuucaggugagggcaaauucagcuggcgccacaagagcugucgaaguccugccaaaagccggagcgcucaauuccaacgaugcauucguccugaagaccccuagugccgccuauuuauggguggguaccggagcuagcgaagcugagaagaccggagcacaggaacugcuuaggguacugcgggcccagcccgugcaagucgccgaggggagcgagccagacggauuuugggaagccuugggagggaaggcagcguaccggacaucucccagauuaaaagacaagaagauggaugcacaucccccaagguuguuugcauguucuaacaagauuggccguuuuguuauugaggaaguaccuggcgagcucaugcaggaggaccuagcuacugaugaugucaugcuccucgauacaugggaccagguuuucgucuggguuggcaaagauucacaggaggaggagaagacugaggcuuugaccucugccaaaagauacauagaaacagaccccgcaaaucgugacagaaggacaccuauaacagucguuaagcagggauucgagccaccaagcuucgugggaugguucuuagguugggaugacgauuauugguccguugacccacuggaucgugcaauggcagaacuggcugcauag

SEQ ID NO: 248823 - RNA, 351 nt, Artificial Sequence
  Description of Artificial Sequence: Synthetic coding sequence
augcccucaccggguacaguguguucucuucuccuuuuagggaugcuuugguuagaucuggcaauggccggcucuucuuuucuuuccccugagcaccaacggguccagcgaaaggaaucaaagaaaccgccggcgaaauugcagccacgggcacuggccgguuggcuacgacccgaggaugggggacaggcagaaggagccgaagaugaacuugaagugcgcuucaaugcacccuuugacgucggaaucaagcucucuggaguucaguaucagcagcacagccaggcuuuaggcaaguuucuacaagacauacucugggaggaggcuaaggaggcaccagcugauaaauag

SEQ ID NO: 248824 - RNA, 354 nt, Artificial Sequence
  Description of Artificial Sequence: Synthetic coding sequence
augcccagcccugguaccgucuguucacuucuacuucuggguaugcuuuggcuugaccuugcuauggcgggcucuucuuuucugucucccgagcaccagagagugcagcagaggaaggaaucuaaaaagccacccgcgaaacuucagccuagggcgcuggcaggcugguuacgacccgaggacggaggccaagcugaaggcgcggaggaugaacuagaagugcgauucaaugcaccauuugacguuggcauuaaacuguccggggugcaguaucagcaacauucacaagcucugggaaaguuccugcaagacauccuuugggaagaagcuaaggaagcccccgccgacaaauag

SEQ ID NO: 248825 - RNA, 276 nt, Artificial Sequence; identical to SEQ ID NO: 248219
  Description of Artificial Sequence: Synthetic coding sequence

SEQ ID NO: 248826 - RNA, 102 nt, Artificial Sequence; identical to SEQ ID NO: 248220
  Description of Artificial Sequence: Synthetic coding sequence

SEQ ID NO: 248827 - RNA, 354 nt, Artificial Sequence
  Description of Artificial Sequence: Synthetic coding sequence
augcccaguccagggacaguuuguagucuccuucugcucgguauguugugguuggacuuggccauggccgguaguucuuuccuuaguccugagcaucaacgcguucaacaacggaaagaaucuaaaaagccgccagcgaaauuacagccucgcgcacucgcaggguggcugagaccagaggauggaggccaggcugaaggggccgaggacgaacuggaagugagguuuaaugcgcccuucgaugugggcauuaaauuaucggguguucaauaccagcagcacucucaggcucuagggaaguuccuccaagacauucucugggaagaggcaaaagaggcaccagcagacaaauag

SEQ ID NO: 248828 - RNA, 351 nt, Artificial Sequence
  Description of Artificial Sequence: Synthetic coding sequence
augcccucuccuggcacgguuuguagcuuguuauuacuaggcaugcucuggcuggaucuugccauggcaggcuccucuuuccuauccccagagcaccagcgcgugcagagaaaagagagcaaaaagccacccgcuaagcugcagccaagggcacuggccggauggcugagacccgaggacggugggcaggccgagggcgcagaggaugaacuggagguucgcuuuaacgcucccuucgacguuggcaucaaacuaagcggaguacaguaccagcagcacucccaagcuuuaggaaaguuucuccaggacauccuuugggaagaagcaaaagaggcucccgcugacaaguag

SEQ ID NO: 248829 - RNA, 318 nt, Artificial Sequence
  Description of Artificial Sequence: Synthetic coding sequence
auguucacuugcugguggucuuaucugagaucaacacucgcagcagucccgggcgaggccagccgggugcagcaacgcaaagagucuaagaaacccccagccaaacuccaaccccgcgcacuugccggauggcuccgucccgaggauggcgggcaggccgagggggcagaggaugaguuagagguaagauucaacgcccccuuugacguagguaucaaacugucaggaguccaauaucaacagcacucacaggcuuuagggaaguuucuacaggacauccuuugggaggaggccaaagaggccccugcugacaaauag

SEQ ID NO: 248830 - RNA, 201 nt, Artificial Sequence; identical to SEQ ID NO: 248224
  Description of Artificial Sequence: Synthetic coding sequence

SEQ ID NO: 248831 - RNA, 315 nt, Artificial Sequence
  Description of Artificial Sequence: Synthetic coding sequence
auguuuaccugcugguggucuuaccugagaagcacacuagcggcuguaccaggcgaggcaucgagggugcagcggaaagagucuaaaaaaccucccgcaaaauugcagccccgcgcuuuagcagguuggcucagacccgaagacggcgggcaggcugagggggccgaggacgagcuagaaguuagauucaaugccccauucgacgucgggaucaagcuuucgggcgugcaauaccagcaacacucacaggcacugggaaaauuccugcaggacauuuuaugggaagaagcaaaggaagcgccagcagauaaguag

SEQ ID NO: 248832 - RNA, 351 nt, Artificial Sequence
  Description of Artificial Sequence: Synthetic coding sequence
augccuuccccagguacugugugcucacuacuuuuacucgguauguuguggcucgaccuggcaauggccggaucgucguuucugucucccgaacaccagcgaguucagcgaaaagaguccaagaagccuccugcuaaacugcagccuagggccuuagcaggaugguugagacccgaagacggaggacaagccgaaggagcugaagaugagcucgaggucagguuuaaugcacccuuugacgucgggauaaaguugucaggcgugcaguaccagcagcauagucaggcacucgggaaauuccuucaagacauucuaugggaagaggccaaggaagccccagcggauaaguag

SEQ ID NO: 248833 - RNA, 354 nt, Artificial Sequence
  Description of Artificial Sequence: Synthetic coding sequence
augccauccccuggcaccgucugcucccugcuguuacuaggcauguugugguuagaccuggcaauggcuggcucgucguuucugucaccggagcaucagagaguccagcagcggaaagaauccaagaaaccacccgcaaaacugcagcccagggcccuggcgggguggcugcggcccgaagauggaggacaagccgagggcgcugaagacgaacuggaggugcgauuuaaugccccuuuugacgugggaaucaaacuuuccgguguucaguaucagcagcacagucaagcacugggcaaauuuuugcaagacauuuuaugggaagaagccaaggaagccccagccgauaaguag

SEQ ID NO: 248834 - RNA, 354 nt, Artificial Sequence
  Description of Artificial Sequence: Synthetic coding sequence
augccuagccccggaacugucuguucgcugcuucuccuuggaaugcugugguuagaucucgcuauggccggaagcagcuuucucuccccugaacaucagaggguucaacagaggaaggagucaaaaaagccucccgcaaaauugcagccacgugcccucgcgggguggcuucgcccagaagauggcggccaggcugagggagccgaggaugagcuagaggugagauucaacgccccauucgaugugggcaucaaacugagcggagugcaauaucagcagcacagccaagcucucgguaaguucuuacaagacauacuuugggaggaagcaaaggaagccccugcagauaaguag

SEQ ID NO: 248835 - RNA, 1350 nt, Artificial Sequence
  Description of Artificial Sequence: Synthetic coding sequence
auguauucuuucaauacucuucgucuguauuuaugggaaacaaucgucuuuuucuccuuggcagcuuccaaagaggccgaagcagccagaucugcccccaagccuaugucuccuucugacuuucucgacaaacuuaugggaagaacuuccggguacgacgcacggauucggccaaacuuuaaaggcccucccguuaaugugagcuguaacaucuuuauaaauaguuucgguucuauugcagagaccaccauggacuaucgagugaauauauuucugagacagcaguggaacgacccuagauuagccuauaacgaauacccugaugacagccuggaucucgaccccagcaugcuugacucaauuuggaagcccgaccucuucuuugccaaugaaaaaggcgcacacuuucaugagauuacuaccgauaacaaacucuugcgaauuagucggaacggaaaugugcuuuacucaauuaggaucacuuuaacacucgccugccccauggaucucaagaauuuuccuauggacguccagaccugcauuaugcagcuggaaucuuuuggauacacaaugaacgaucuuauauucgaauggcaagagcaaggggcagugcagguggcagauggacugacucucccccaauucauccuuaaggaagagaaagaccugcguuacuguacaaagcacuacaacacagggaaguucacaugcauugaagccagauuucaccucgaacggcagaugggauacuaccucauccagauguauaucccuucguuauugauugugauacuuagcuggauuucuuuuuggaucaacauggaugcagcucccgcacgcgugggccuugggauaacgacaguacuuacaaugaccacacaaucaucuggcucucgggcuagucugcccaagguguccuaugucaaggcaauagacauuuggauggcggugugccugcuuuuuguguucucagcacuccuggaguacgcagccgucaauuuuguaucucgucaacauaaggaguuacugcgcuuccgaagaaaaagacggcaucacaaggaagaugaggcuggcgaaggacgguuuaacuuuucagcguaugggauggggcccgcaugucugcaagcuaaggauggcauuagcgugaaaggggcuaauaacucaaauacaaccaauccccccccagcucccucaaagagccccgaggagaugcggaaguuauuuauacaaagggcuaaaaagauagauaagauuucaagaaucggauuucccauggcuuuccugaucuuuaauauguucuauuggauuauauauaaaaucgucagacgggaggacguacauaaucaauag

SEQ ID NO: 248836 - RNA, 1374 nt, Artificial Sequence
  Description of Artificial Sequence: Synthetic coding sequence
auguacagcuucaacacucuucgcuuauaucuaugggagacuauagucuuuuuuucucuggcugcaagcaaggaggccgaggccgcaagaucggcaccuaaaccaaugucacccucugacuuccuagacaaacuuauggggcgcacaucuggcuacgaugcccgaauuagacccaacuucaagggaccuccugugaacguaagcugcaacaucuuuauuaacuccuuugguaguauugcagagaccacuauggacuaucgugucaacauuuuucuuagacagcaguggaaugauccucgccuugcuuacaacgaauaucccgaugauucacuugaccuagacccauccauguuagauuccauuuggaagccggaccucuucuucgcuaaugagaaaggcgcacauuuucaugaaauuacuacugauaauaagcuuuugagaauuucgcgaaaugggaacguacuguauucuaucagaauuaccuuaacccucgcauguccaauggaucucaagaacuucccgauggacguucaaaccuguaucaugcagcuagaaucauucggcuauacuaugaaugaucucauuuucgaauggcaggagcaaggcgcagugcagguggccgacggacuuacauugccccaguuuauucugaaggaggagaaggauuugcguuacuguaccaaacauuauaacaccgggaaauucacauguauagaagccagauuccaucuagagcggcaaaugggcuauuauuugauccagauguauauaccgucauuauugauugucauucucagcuggauuucuuucuggaucaacauggacgcagcgccugcccgggugggucucgguauuacaacaguucugacaaugaccacucagaguagcgguuccagggccagccugccuaaagucucauauguuaaggcgauagacaucuggauggcagucuguuuacuguucguguucagcgcauuauuggaauacgcggcagucaauuucgugagcagacaacacaaagaacuacuacgcuuucggcgcaaacgcagacaucacaagaguccaaugcucaacuuauuccaagaagaugaggccggagagggacgguuuaauuuuucugccuacggaaugggccccgcuugccuucaagcaaaggacggcauuaguguuaaaggugcuaacaacagcaauacaacuaacccccccccugcuccuucaaagagccccgaggagaugcgcaaacucuuuauucagcgugccaaaaaaaucgacaagaucucuagaauuggcuuuccaauggcuuuucuaauauuuaacauguuuuauuggaucauuuacaaaaucguacgacgcgaagauguacacaaccaauag

SEQ ID NO: 248837 - RNA, 1101 nt, Artificial Sequence
  Description of Artificial Sequence: Synthetic coding sequence
auggacuaucgcgucaauaucuuucuucggcagcaguggaaugauccucgauuggccuacaaugaauaucccgacgacucucuugacuuagaucccucuauguuagauagcaucuggaaaccggaccuuuuuuucgcaaacgaaaagggcgcacauuuucaugagauuacuaccgacaauaaauuacugcgaauuagucgcaaugguaauguccuuuacuccauccgaauaacucugacacucgcuugccccauggacuuaaagaacuucccuauggacgugcagaccuguauaaugcagcuggagucuuuuggauauacuaugaaugaucugaucuucgaauggcaagaacagggcgcagugcaaguugcugacgggcugacauugccucaguucauccucaaagaagagaaagaucuacgguacuguaccaagcauuauaacacagggaaauuuacaugcauagaggcccgguuucaccucgaacggcagaugggcuacuaccucauccagauguacaucccuagccucuugauugucauccuuaguuggauuucuuuuuggaucaacauggacgccgccccagcucgcgugggucugggcauuaccaccguacugacgaugacuacacagagcagcggaucaagagccagccugcccaaggucucguaugugaaagccaucgauauuuggauggcaguuugucucuuguuuguuuucuccgcucuacuagaauacgcugccgugaauuucgugucaaggcaacacaaagagcugcucagguucaggcgcaaacggaggcaucacaaagaagaugaagccggugaaggacgcuucaacuucucagcuuacggaaugggcccugcgugcuuacaggcuaaggacgguauuucagugaaaggcgccaacaacucaaacacuaccaacccuccacccgcuccguccaagucaccugaagagaugagaaaacucuuuauccagagggcaaaaaaaaucgacaaaaucucuagaauaggguucccuauggcauuucugaucuucaacauguucuacuggaucauuuacaaaauagucagaagagaagacguacacaaccaauag

SEQ ID NO: 248838 - RNA, 1365 nt, Artificial Sequence
  Description of Artificial Sequence: Synthetic coding sequence
auguccgcugguggacccugucccgcagcagcuggcggaggacccggaggagcauccugcagugucggagccccgggcggcgucuccauguuccgguggcuggaaguucucgagaaagaauucgacaaggccuuugucgacguagaucugcuucugggugaaauagaccccgaccaggccgauaucacauaugagggacggcaaaagaugaccagucugagcagcuguuucgcacagcugugucacaaagcucaguccguaucucaaauuaaucacaaauuggaggcucagcucguggaccuuaagucagaacuuaccgagacacaggcagagaagguuguucuggaaaaggaaguacacgaccagcugcuccagcugcacaguauccagcuucaguuacacgccaaaacggggcaguccgcagauucaggaacuauuaaggcaaaacucgaacgugagcuggaagccaacaagaaggaaaagaugaaggaggcgcaauuggaagccgaaguuaaguuguugcgcaaagagaacgaagcacuuagaagacauaucgccguacuccaagccgagguauacggcgcacggcuggccgccaaguaucuagauaaagaauuggcagggaggguacagcagauucaacugcuugggagagauaugaaaggcccugcucacgauaagcuguggaaccaauuggaggcugagauccaccuucacagacauaaaacaguaauccgggccugucguggaaggaacgaccucaaacgaccaaugcaagcuccuccaggccacgaucaggacaguuugaagaaaucccaggggguaggaccaauccgaaaagugcugcuuuuaaaggaagaucaugaaggccugggcauuaguauuacggggggcaaggagcacggaguucccauccugauaucugagauacaccccggccaacccgccgauagaugcgguggcuugcaugugggggaugcuauacucgcugugaauggcgucaaccugagagauacgaaacacaaagaagcugugacaauacugagccagcagaggggugaaaucgaguuugaggucgucuauguggcccccgagguggacagcgaugacgagaauguggaauaugaggaugaaagugggcauagguaucguuuguaucucgacgaauuggagggcggcggcaauccaggcgccucuuguaaagauaccagcggugaaauuaaagugcugcaaggauuuaauaagaaggccgugacugauacucacgaaaacggcgaccuggguacagcaagcgaaacucccuuggaugauggugcuuccaaacuggaugaccuccauacacuauaucacaagaaaaguuacuag

SEQ ID NO: 248839 - RNA, 918 nt, Artificial Sequence
  Description of Artificial Sequence: Synthetic coding sequence
auggcugcaggccucgcccgccuguuauugcuacuuggucuuucagcugggggcccggcaccggcaggcgcagcuaaaaugaaagugguggaagagcccaacgcguuugguguaaacaacccguuucucccccaggccagccggcugcaggcaaaacgugaucccagccccgucucaggcccuguacaucuuuucagacugucgggaaaguguuuuagccucgucgaaucaacauacaaguacgaguuuugucccuuccacaaugucacccagcaugagcagacauuucgguggaaugcuuacuccggaauauuaggaauuuggcaugaaugggagauagcgaacaacaccuuuaccggaauguggaugcgagacggagaugcaugcaggagcagaagccggcaaagcaaaguggagcucgcuuguggaaagucuaaucguuuagcucaugugagugagcccucgacaugcguauacgcuuuaacguucgaaacaccgcucgugugccacccucacgcucuguugguguaucccacucuaccagaggcucuucagcgacaaugggaccagguggaacaagaucuagccgaugagcuuaucaccccacagggucacgagaaguuacucagaacuuuguuugaggacgcuggauacuuaaagaccccugaagaaaacgagcccacacaguuggagggaggaccggauucccuugguuuugaaacucuggaaaacugucgcaaggcccacaaagagcucaguaaagaaauuaaaagacugaaaggacuguuaacucagcacggcauucccuauacacguccgaccgagaccaguaaccuagagcauuugggccaugagacuccucgcgcaaaaucuccugaacagcuccgcggugauccaggucugagggggagucuguag

SEQ ID NO: 248840 - RNA, 2196 nt, Artificial Sequence
  Description of Artificial Sequence: Synthetic coding sequence
augaguugguuugucgaucuggcuggcaaagccgaggaucuacucaauagggucgaccagggagcagccacagcccugagccggaaggacaacgcuagcaacaucuauagcaagaauaccgacuauacagaacuacaccagcaaaauacagacuuaaucuaccagacugggcccaaauccaccuacauuucuuccgcagcggacaacaucaggaaccaaaaggcgacaauauuggcuggcacagcaaacgugaaggucgguucacggacaccaguagaagcaucacacccugucgaaaacgcuagcgugccccgaccuucuucgcauuuuguccggcgcaaaaaauccgaacccgacgacgaguugcucuuugacuuucucaacuccucgcagaaggaaccaacaggucgggucgaaauacggaaagagaaggguaagacaccagucuuucaaagcucccagacaucuuccguguccucaguuaauccuuccgucacaacaauaaagaccauugaagaaaauucauucggcucccagacacacgaggcugccuccaacuccgauucgucccacgaaggucaagaagaguccagcaaggagaacguguccuccaaugccgcaugccccgaccauaccccaaccccuaaugacgacggaaaaucccacgaacucagcaaucuucgguuggagaaucaacuguugagaaacgagguucaguccuugaaccaggagauggcaagucuacugcagagauccaaagagacccaagaggagcucaacaaggcaagagcaaggguggagaaguggaaugccgaccauaguaaaagugacagaaugacucgaggccuuagggcacagguggacgaucuaacagaagccguagcagccaaggauucccagcuggcggugcucaaagugagguuacaggaagcagaccagcuauuguccacacgaaccgaagcacuggaagcucugcaaucagaaaaaucccgaauuaugcaagaccaauccgaagguaacucucugcagaaccaagcccuucaaacuuuccaggaacggcugcacgaggcagaugcaacuuugaaaagggaacaagagaguuauaaacagaugcaguccgaguuugcagcacgccugaacaagguugagauggagagacaaaaccuggccgaggcaaucaccuuggcugaaagaaaauauuccgacgagaaaaagcgaguggacgaauugcagcagcaaguaaagcuuuacaagcugaaccuggaaagcucuaaacaagaacuaauagauuacaaacaaaaggcaacccgcauucuucagaguaaagaaaaacugauuaacucucuuaaagagggcagugguuucgagggucuggacuccucuaccgccucauccauggaacucgaggaauuaagacaugagaaggaaaugcagagagaggaaauacagaagcugaugggacaaauucaccagcugaggucugaguuacaggacauggaagcgcaacaagugaaugaagcugaaucagccagagaacaacuccaagaccugcacgaucagaucgccggacaaaaggccuccaagcaagaacucgagaccgaauuggaaagacuaaagcaggaauuccacuauaucgaagaggaucuauaccgaaccaaaaauacgcuacagucaagaaucaaagaucgggacgaagaaauacagaaacuuaggaaccagcugacgaauaagacccuuagcaacucaucucaaagcgaguuagaaaaccguuuacaccagcugacagagacucugauccagaagcagacuaugcucgagucuuugucuacugagaagaacucacucguuuuccagcuggagcguuuggaacagcaaaugaacagugcauccggaagcagcagcaacggauccaguaucaacaugucagggaucgacaauggggagggcaccagacuucgcaacguuccggugcuauucaacgacacugaaacuaaccucgcggguauguacggcaaggugcgaaaggcagcaagcagcaucgaucaauuuagcauccgacugggaauuuuccuucgccgauaccccaucgcucgcgucuuuguuaucaucuacauggcccuacuccaccuguggguuaugauuguucucuugacuuacacgcccgaaaugcaucacgaucagccuuacgguaaauag

SEQ ID NO: 248841 - RNA, 1782 nt, Artificial Sequence
  Description of Artificial Sequence: Synthetic coding sequence
auguggacucuggugucauggguugcccuuacagccggucuggucgccggaaccagaugcccugacggucaguucugccccgucgcuuguugcuuggauccuggaggggcuuccuacagcuguugucgcccacuucuagauaaauggcccaccaccuuaucucgucaucucggggggcccugucaaguugaugcucacuguagugcgggucacuccugcaucuuuacugucucgggcaccucaucauguuguccguuuccugaggcuguggcuugcggcgacggucaucacuguugcccuagaggcuuucauugcagcgcugauggccggagcuguuuccaaagguccgguaauaacucugucggagcaauucaaugcccagauucccaguucgaguguccagacuuuucaaccugcuguguaaugguugacggcagcuggggaugcugcccgaugccucaagccagcugcugcgaggauagggugcauuguuguccacauggagccuuuugugaccuugugcauacgagguguauuaccccuacaggcacucacccucucgcuaaaaaacuaccagcccagcggacuaacagagccguggcucugucaagcucagucaugugccccgaugccagaaguaggugccccgauggaaguacgugcugcgagcugccauccggaaaauauggauguugcccaaugcccaacgccacauguugcucugaucaccuucauugcugcccucaggacacggugugcgaccugauccaguccaagugcuugucaaaagagaacgccacaacagauuugcuaacgaaguuacccgcccacaccgucggagacguuaaaugcgauauggaagugaguuguccagauggauacacuuguugcagacuccagucgggcgccuggggaugcugcccuuucacccaagcaguguguugugaagaccauauucacuguugcccugccggauuuaccugcgauacacaaaaagguacgugugagcaaggcccacaccaaguacccuggauggagaaggccccugcacaccugagccugccagacccacaagcucucaaaagggacgucccaugugauaacgugucaagcuguccuaguucugacaccugcugccagcugaccagcggugaaugggguuguuguccuaucccggaagccguaugcugcagugaccaccagcacuguuguccacagggcuacacuugcguagcugaaggacagugucagagaggaagcgaaaucguagccggacuggagaaaaugccagcaagacgggcaagcuuaucccauccuagagauaucgguugcgaucaacacacaucaugccccgugggacagaccugcugcccuucacuuggcggaaguugggccugcugccagcuuccgcacgccguaugcugcgaagaccgccaacacugcuguccggccggcuacacuuguaacgugaaggcgagauccugugaaaaagaagugguaucagcccagcccgccacuuuuuuggcuaggucaccacaugugggaguaaaagacguggagugcggagagggccauuucugccaugauaaccaaacaugcugccgcgauaauagacagggaugggcaugcugcccauacagacaggggguguguugcgcagacagaagacauuguugcccugccggcuuucgaugcgcagccaggggcacaaaaugccugcgaagagaagcuccccggugggaugcaccuuugcgggacccagcucuacgccagcucuuauag

SEQ ID NO: 248842 - RNA, 1080 nt, Artificial Sequence
  Description of Artificial Sequence: Synthetic coding sequence
augacgcucgaaucuaugauggccuguugccugucagacgaagugaaggaguccaaacgaauuaaugccgagauugagaagcagcuaaggcgcgacaagagagacgcacgcagagaacucaaacuuuuauugcugggaacgggggaaucaggcaaguccaccuucaucaaacagaugcguauuauccacggcgccgguuacagcgaggaagacaagagaggauucaccaaguuaguauaucagaauaucuucacugcaaugcaggcgaugauccgagcaauggaaacucugaagaucuuguauaaguacgaacaaaacaaagccaaugcauuacucauccgggaaguagauguugaaaaaguuacaaccuucgagcaccaguacgucagcgccaucaagacacuaugggaggacccugggauacaggaguguuacgacagacgcagggaauaucaacugucugauagugccaaguauuaucuuaccgacgucgacagaaucgccacauugggauaucugccaacucaacaggacgugcucagaguacgggugcccaccaccgggauaauugaguauccauucgaccuggagaauaucauuuuuagaaugguggacguagguggccagaggucugaacggcgcaaguggauucacuguuuugaaaaugucaccucuaucauguuccuuguugcuuuguccgaguacgaccaaguucugguagaaucagacaacgaaaauagaauggaagaaucuaaggccuuguuuaggaccaucauaaccuacccuugguuccagaauuccuccgugauucucuuccugaauaaaaaggaucucuuagaggacaagauuuuauauucucauuuaguugacuacuucccugaauucgacgggccccagagagaugcacaggccgccagggaauuuauccugaaaauguucgucgauuugaauccugacuccgacaagaucauuuauucccacuuuacuugcgcuaccgauacagagaacauuagguuuguuuucgccgccgucaaagauacgauacuucaacugaaccucaaggaauauaaccuuguauag

SEQ ID NO: 248843 - RNA, 606 nt, Artificial Sequence
  Description of Artificial Sequence: Synthetic coding sequence
auggggaaugucauggaaggcaaaagcgucgaagaguugaguaguacagaaugucaucagugguacaagaaauuuaugaccgaguguccuagcggacaguugacccuguacgaguuucgucaauuuuuuggacugaaaaacuuaucacccucagccucacaguacguggaacagauguucgaaacauucgacuucaacaaagacggguauauugauuucauggaguacguggccgcccugucacugguauugaaaggaaagguggagcagaaauugaggugguacuuuaagcuuuaugauguggacgggaacggauguauugaccgcgaugaacuuuuaacuauaauacaagcuauccgagccauuaacccauguucugacacaaccaugacagccgaagaguucacugacacaguuuuuucuaaaauugacgugaacggagacggcgagcugucucucgaggaguucauugaagggguacagaaggaccagaugcuccuagacacuuugaccagaucucuugaccugacccggauugugcguagauuacagaauggggagcaagacgaagaaggggccgacgaggccgcagaggcugcaggcuag

SEQ ID NO: 248844 - RNA, 1482 nt, Artificial Sequence
  Description of Artificial Sequence: Synthetic coding sequence
augagcaaggguccugcagucggcauagaccugggaacaacuuauuccuguguggguguguuccagcacggaaaagucgagauuauagcaaaugaccaaggaaaccgaacuacccccucauacguagcguuuacugauacugaacgacucaucggagaugccgcaaagaaucaaguagcuaugaaccccacuaauacuguguucgaugcgaaaaggcuuaucggcaggagguucgacgacgccgugguucagucugacaugaagcacuggccguucauggucgucaaugacgcuggacggcccaaagugcagguggaguacaagggcgaaacuaaaagcuucuauccugaggagguuuccagcaugguauuaacaaagaugaaagagauagccgaagcuuaucuggguaagacagucaccaacgccguggucacaguccccgcauauuuuaacgauagucagcgucaggccaccaaagaugcagggacaaucgccggacugaauguucuccggauuaucaacgaacccacagcagcugccauagcauacggacuggauaagaaggugggggcagagcguaacguguugaucuucgaccugggcggcggcacauucgaugugagcauucuaacgauugaggauggcaucuucgagguuaaaucuacugccggugacacacaucuuggcggagaagacuucgauaaccgaauggugaaucacuucaucgccgaguucaaacgcaagcacaagaaagauaucucagagaacaagcgggcagugagaagacugaggacagcgugugaaagagccaaaagaacccugagcaguagcacacaggcuuccauagaaaucgacaguuuguacgagggaauugacuucuacaccagcauuacacgggcccgguucgaagagcugaaugccgacuuguuccggggcacccucgauccagucgaaaaggcauuacgcgacgcaaaauuggauaagucgcaaauccacgacauuguuuuagucggcgggagcacacguauuccaaagauucaaaaguugcuucaagauuucuucaacggaaaggaauuaaauaagagcaucaacccagacgaggccguugcauauggcgcagcagugcaggccgccauucugaguggagacaaguccgagaacguccaagaccugcuacuccuugaugucaccccccuuagucuugguauugaaacagcuggggguguuaugaccgugcugauuaagagaaacacuaccaucccgaccaagcagacucagacuuucaccacauacagcgacaaucaaccaggaguacugauccaaguauacgaaggggaacgcgcuaugacaaaagauaacaaucugcuugguaaguuugaacucacaggaaugcccggagguaugccuggcggauuucccggcgggggugcgccaccuucuggaggagccucuagcgguccaacgauugaggaaguagacuag

SEQ ID NO: 248845 - RNA, 1884 nt, Artificial Sequence
  Description of Artificial Sequence: Synthetic coding sequence
augucgaagggcccagcagugggaauagaucuuggaacgacguacucgugcgugggcguauuucagcauggaaaaguggagauuauugcaaaugaucaggggaauagaaccacuccuucauacguagcuuucaccgauacagagcgccugaucggagaugcagcaaagaaccaaguugcuaugaacccaacuaacacaguguuugaugcuaaaagacuuaucgggagaagguucgacgacgcaguggugcagucugauaugaaacauuggcccuucaugguggucaacgaugcaggaagaccuaaggugcaaguggaauauaagggcgagaccaagucuuuuuacccugaggaaguaaguagcaugguuuugacaaagaugaaggaaauagcagaggcuuaccuggggaaagcaaccaaagacgcuggaaccauagccggacugaauguguugaggaucauaaaugagccaacggcagccgccauugcuuauggguuggacaaaaagguuggugccgagcggaauguucuuaucuuugaucuuggcggggguaccuuugaugugucaauccugaccauugaagaugggauauuugagguuaaguccacagcuggagacacucauuuggggggcgaagauuucgauaacaggauggugaaccauuuuaucgccgaguucaaacgcaaacauaaaaaggacaucuccgagaacaaaagagcugucagacgccuacgaaccgcaugcgagcgggcuaaaaggacacuaaguucuucuacccaagcaucaauagagauagauagucuguacgagggaaucgauuuuuacacaagcaucacccgggcuagauucgaagaacugaaugcugaccuuuucagaggcacucuggacccaguggaaaaagcucucagagacgcaaaacucgauaagucacagauccaugacaucgugcugguugggggcucuacaaggaucccuaagauucaaaaacuacuccaagacuucuuuaacggaaaagaacucaauaaauccaucaacccugacgaagccguggcauauggcgcagcggugcaagccgccauccugaguggcgauaagucagagaaugugcaggaccuguugcugcuggaugugacaccucuaucucuggggaucgaaacagcgggcggagugaugacaguuuuaauuaaacgcaauacaacgaucccaacaaagcagacccaaacauucaccacuuacuccgauaaucagccaggcguucucauacagguguacgagggagaacgcgccaugacaaaagacaauaaucuccuugguaaauucgaacuuacuggaaucccuccggccccucgcggagugccucagauugaggugaccuuugacauugaugccaacggaauauuaaaugucuccgccguagacaaaagcacuggcaaggaaaacaaaauuaccaucacaaaugacaaagggcgcuuguccaaagaagauauagagagaaugguucaagaagcagaaaaguacaaagccgaagacgaaaaacagcgggauaaggucagcagcaaaaacagucuggagagcuacgcauucaauaugaaagccaccgucgaggacgagaagcuucaggguaaaauuaaugaugaagacaaacagaaaauccuggacaaaugcaacgagauuauaaacuggcuggauaagaaccagaccgcugaaaaagaagaguuugagcaucagcaaaaggaacucgagaaaguguguaacccaaucauuacaaaguuguaccaaagcgcaggagggaugccgggugggaugccuggaggauuuccuggagguggggcgccccccagcggcggagcaucaagugggccgacuauugaagaaguggauuag

SEQ ID NO: 248846 - RNA, 1941 nt, Artificial Sequence
  Description of Artificial Sequence: Synthetic coding sequence
augaguaagggaccagccguaggcauugaccuggguaccacuuauucaugcguugguguguuccagcaugggaagguggaaauaauugcuaacgaccaagguaaucggaccaccccaucauacguagcuuuuacagauacagagagguugaucggugaugcagccaaaaaucaagucgcaaugaauccuacuaauaccguuuucgaugcuaagaggcucauuggucggcgauucgacgacgcugucgugcagagugauaugaagcacuggccguuuaugguggugaacgacgcgggacguccuaaggugcagguggaauauaagggagagacuaaaagcuuuuaucccgaagagguuaguucuaugguucuuaccaaaaugaaagaaauugcagaggccuaucuggguaaaacagucacaaaugcaguagugaccguaccagccuauuucaaugacagccaaagacaggccacaaaagaugcaggcacuauugcagggcugaacgugcuuagaaucauuaacgagcccacagcagcagcuaucgcuuauggauuggacaagaaggugggagcugagcgcaacgugcugauuuucgaucuggguggggguacauucgacguguccauccuuaccauagaagauggcauauucgaggugaagucuacggcaggcgacacacacuugggcggcgaggauuucgacaauagaauggucaaucauuuuauagccgaguuuaaaagaaagcacaagaaggauaucagcgagaacaaaagagcagugagaagacuuagaaccgcuugcgaacgggcaaagcgaacuuuaucuagcagcacccaggccagcauugaaauagauucccucuaugagggcauugauuuuuauacaucgaucaccagagcaagauucgaagaauugaacgcagaucuguuucgcgggacucuggacccggucgagaaagcacuucgagaugcaaaguuggacaagucacagauccacgauauuguacuggucgggggaaguacccgcauaccgaaaauccagaaguugcuucaggauuuuuuuaaugguaaagaacugaauaaaucuaucaaucccgaugaggcugucgccuauggagccgcaguccaagcugccauacuguccggcgauaagagugagaauguacaagaucuccugcuacucgacgucaccccacuaucauuagggaucgaaaccgcaggaggcgugaugaccgugcugauaaaacguaacacuacaaucccuaccaagcaaacccaaacauuuacuacuuacucagacaaucagccaggcgucuugauucaggucuaugagggcgaacgcgcuaugaccaaggacaauaacuuacugggcaaauuugaguugacaggcaucccacccgcgccacggggaguuccacagauagaggugacauucgauaucgaugccaauggaauucucaaugucucugcugucgacaaaucaaccggcaaggaaaacaagauuacuaucacuaacgauaaggggaggcuuucaaaggaagauauagaacgcaugguucaagaggcagagaaguauaaggccgaggacgaaaaacagagagacaaggucagcagcaaaaacagucuggaaaguuacgcauuuaacaugaaggccacagucgaggacgagaagcugcaggggaaaauaaaugaugaagacaaacagaaaauucuggacaagugcaacgaaauaauuaacuggcuagacaagaaccagaccgccgagaaggaggaauucgaacaucagcagaaggaacuggaaaaggugugcaaucccauaauuacuaaacuauaccaaucggcaggaggaaugccaggugguaugcccggaggauucccagggggaggugcccccccuucagguggcgcgucaaguggucccacaauagaggagguagauuag

SEQ ID NO: 248847 - RNA, 1503 nt, Artificial Sequence
  Description of Artificial Sequence: Synthetic coding sequence
augagcaaggggccugccgugggaaucgaccuugggacgaccuauucuuguguuggaguguuucaacauggaaaaguggagauuaucgcuaacgaucagggcaauagaaccacacccucuuacguagccuuuacagauacagaacgccuaauuggugacgccgcgaagaaccaggucgcuaugaauccaaccaacacaguuuuugacgccaagcggcugauuggcagacgauuugacgaugcuguaguccaaagcgacaugaagcacuggccuuucauggugguuaacgacgcaggacggcccaagcauaagaaggacaucagugaaaauaaacgcgcagucagaagguuaagaaccgcuugugagagagccaaacguacccugucuaguuccacgcaggcaucuauugaaaucgauucacucuaugaggggaucgauuucuauacauccauuacacgggcaagauuugaagagcugaaugcugauuuguucagagguacgcuagaccccguggagaaggcgcuccgagacgcuaaacuugacaagucacaaauccacgacauaguuuugguuggaggcaguacaagaauccccaagauucaaaaauugcuccaggauuuuuuuaaugggaaggaacugaauaaguccauuaacccagacgaagccguggccuauggagcugcaguccaggcagccauccucagcggcgauaaaucagagaauguccaagaucuccuucugcucgaugucacaccucugagccuaggcaucgagacagccggcggcgugaugaccguuuuaaucaagcgaaacacuaccauucccaccaagcaaacccaaaccuuuacaacuuauagcgauaaccagccugggguccucauccaagucuacgagggcgagcgagcuaugacuaaggacaauaaucuucuggguaaauucgagcuuacuggcauccccccagcacccagaggugugccgcagaucgaggugacuuucgauauugaugcuaacggaauucugaacgucucagcaguugacaagaguacuggaaaagagaacaagaucacgauaacaaacgauaaaggacgacuaagcaaagaagacauugaacguaugguccaagaagcagagaaguacaaggccgaggacgaaaagcaacgcgacaagguguccagcaaaaacucccuagagucuuacgcuuucaauaugaaggccaccguggaggaugagaagcugcaagggaaaauuaacgaugaagauaagcaaaaaauucuggacaagugcaaugaaauaauuaacuggcuggauaagaaucagacagccgagaaagaagaguuugaacaccaacaaaaggaguuagaaaagguuugcaauccaauuaucaccaagcuguaccagucugccggagggaugccagggggaaugccagguggguucccagguggaggcgcucccccuagcggaggugcgaguuccgggccaaccaucgaggaagucgacuag

SEQ ID NO: 248848 - RNA, 1233 nt, Artificial Sequence
  Description of Artificial Sequence: Synthetic coding sequence
auggucaaccauuuuauagccgaauucaaacgaaaacacaaaaaagacaucagcgaaaacaaacgggccgugagacgcuuaaggacugcaugugaacgggcuaaacgcacacugaguaguaguacccaggccucaaucgaaauugauucacuguaugaaggaaucgauuucuauacaucuauuacacgagcuagguucgaagaguugaaugccgaucuuuucagagguacuuuggaucccguggagaaagcccugagggacgccaagcucgacaaaagccaaauacacgauauagugcuggugggcgggagcacacgaauccccaagauccagaaauugcuacaggacuucuuuaacggaaaggaacugaauaaaagcauuaauccagacgaagccgucgcuuacggugccgcagugcaagcagccauccucucgggagacaaaucugaaaacguccaggaucugcuccucuuagacguuacuccucuaucuuuagguauugagaccgcaggcggaguuaugaccgucuuaaucaaacggaauaccacaaucccuaccaaacagacucagacuuuuaccacuuacucugacaaccagccaggaguguuaauucaggucuaugagggugaaagagccaugacuaaagauaacaaucuauuaggcaaauucgagcuaacagguaucccaccagccccacgcggcgucccucagaucgaggugacuuucgauaucgaugcaaacggaauucugaacguguccgcgguugauaagucaacaggcaaagagaauaagauuacgauuacaaaugauaaggggcguuugucaaaggaagacauugaacgaaugguacaggaagcagagaaguauaaagcugaagaugagaagcagcgagauaaaguguccucaaaaaauucuuuggaauccuacgcuuucaacaugaaagccacaguggaagaugagaaacuacaaggaaagaucaacgaugaagacaagcagaagauuuuggauaaaugcaaugagaucaucaacugguuagacaaaaaccagacugccgagaaagaagaguuugaacaucagcagaaagagcucgagaaggucugcaaccccaucaucaccaaacuguaccagucugccgguggaaugccaggugggaugccaggagguuuccccggaggaggugccccaccuucaggaggcgcuucaucaggccccacuaucgaagaaguagacuag

SEQ ID NO: 248849 - RNA, 1941 nt, Artificial Sequence
  Description of Artificial Sequence: Synthetic coding sequence
augucuaagggaccugccgucggcaucgaccugggaacuaccuacucaugcgucggaguguuucagcaugggaaagucgagauuauagcaaacgaccaaggcaaucguaccacacccagcuauguggcauuuacggauacugaacgccucaucggcgacgccgcaaagaaucagguugcgaugaauccuacaaacacaguguuugacgcaaaaaggcuaaucgggaggagauucgacgaugcaguugugcaaagugauaugaagcacuggcccuuuauggugguuaacgaugcgggacgccccaagguucagguugaauauaagggagaaacuaagucuuucuaccccgaggaaguuagcucaaugguccuaacuaaaaugaaagaaaucgcagaggcauaucugggcaagacaguaaccaacgccguaguaaccguccccgcuuauuuuaacgauucacagagacaagccaccaaggaugcuggaaccauugccggacugaacguucugcgcauaauuaacgagcccacagcagccgcaauugcauauggauuggauaagaagguaggggcagagcguaacgugcugaucuucgaucugggcggaggaaccuucgacguuuccauccugaccauagaagacggcaucuuugaggucaaguccaccgcuggggauacccaccugggaggagaagauuuugacaaucgaauggugaaccauuucauugccgaauucaaacgcaaacauaagaaggacauaucagaaaacaaaagagcugugcguagacuuaggaccgcaugcgagagggccaaaagaacgcugucaaguucuacccaagcuucaauagagauugacucgcuauaugaaggaaucgacuucuacacaucuauaacacgugccagguuugaagaauuaaaugcggauuuguuuagaggcacucuggaccccguugagaaggcucugcgcgacgcaaaauuagauaaaucacagauccaugacauugugcugguaggcggcuccacacguauccccaagauucaaaaacugcuucaggauuuuuucaacggcaaagaacugaauaaaucgauuaacccggaugaggcaguggcauacggugcagcagugcaagcugcgaucuuguccggagacaagagcgagaaugugcaagaccuccuacuucucgacgugaccccucuuucucuaggcauagaaaccgcuggaggcguaaugaccgucuugauuaagcggaacaccacuauccccacaaaacagacucagaccuuuacuaccuauuccgacaaucagccuggaguacugauucagguguacgagggugagcgcgcaaugaccaaagacaacaacuugcuugggaaauuugaauugaccggaaucccgccagcuccaagaggggucccccagaucgaagugacguuugacauagaugcaaauggcauauugaaugugucggcuguggauaaaucaacuggaaaggaaaacaagauuaccaucacuaaugacaaggggagauuaucuaaagaagacauagagagaauggugcaagaggcggaaaaguacaaggcugaagacgagaaacaaagggacaaagucucaaguaagaacucucuggaaucuuaugcauucaacaugaaagcuacagucgaagacgagaagcugcagggaaaaauaaaugaugaggacaagcagaaaauccucgacaaauguaaugaaaucauuaacugguuggauaagaaucagacagcugaaaaggaggaauuugaacaucaacagaaagagcuggagaaaguguguaacccaauuaucacuaaguuauaccaaucugcgggugguaugccaggcgggaugccagggggcuucccaggcggcggcgcuccccccucaggcggcgcauccucuggacccacuauugaagaagucgacuag

SEQ ID NO: 248850 - RNA, 483 nt, Artificial Sequence
  Description of Artificial Sequence: Synthetic coding sequence
auggaaauaccuguacccguccagccgucuugguuacguagagcaagugccccucugcccggcuugagcgccccuggccgacuguucgaucagcgguuuggcgagggccugcucgaggcugagcucgccgcgcucugcccuaccacccuugcuccauauuauuugcgcgccccuucuguggccuuaccugucgcccaagucccaaccgaucccggacacuuuucaguccuucucgaugucaagcacuucucacccgaggagauugccgugaaggucgugggagaacacguugaaguccaugcgagacaugaagaaagaccugaugagcauggcuucguggccagggaguuucaccggagauaccgacugccccccggaguagacccagcugcagugacauccgcucucaguccugaaggcguucuaucuauccaagccgcgcccgcaagcgcccaggcccccccuccagccgcggcuaaguag

SEQ ID NO: 248851 - RNA, 570 nt, Artificial Sequence
  Description of Artificial Sequence: Synthetic coding sequence
auguuagguaugaucaagaauucacucuuuggaucaguggagaccuggccuuggcagguguugagcaaaggagauaaggaggagguugccuaugaggaaagagcgugugagggagguaaauuugcaaccguugaagugaccgacaaaccuguggacgaagcucucagagaggccaugcccaaaguggcuaaguacgcuggggguacuaaugauaaggguaucggaauggggaugaccgugccuaucagcuucgcuguguucccaaaugaggaugggucucuccagaagaagcuuaaggugugguuccgaauucccaaucaauuccaguccgaucccccagcaccaucugauaagagcguaaagauagaggaacgcgaagggauuacaguuuacucaaugcaguuugguggauacgcaaaagaagccgacuauguugcacaggcuacacggcuccgugcugcucuggaggggacagcuacguacaggggggacaucuauuuuugcacagguuacgacccacccaugaagccauacgggcgcagaaacgagauuuggcugcucaaaaccuag

SEQ ID NO: 248852 - RNA, 477 nt, Artificial Sequence
  Description of Artificial Sequence: Synthetic coding sequence
augggaaagggcgauccgaaaaaaccucgcggaaagaugucaagcuacgcguucuuugugcagaccuguagggaagagcauaaaaaaaaacaccccgacgccagugugaacuucagcgaauucagcaaaaagugcucugaacguuggaaaacuaugagugcuaaagaaaaggggaaguuugaagacauggcaaaggccgacaaagcaagauaugaaagagagaugaagaccuacauuccacccaagggagagacaaaaaaaaaauucaaggaccccaaugcuccuaagagaccgccaagugcauucuuccuauucugcucggaauaucgacccaaaaucaaaggagaacacccugguuuaagcaucggggauguggcgaagaagcuaggugagauguggaacaauacagcugcagaugacaaacagcccuacgaaaagaaggccgcuaaacucaaagagaaauacgaaaaguucuag

SEQ ID NO: 248853 - RNA, 648 nt, Artificial Sequence
  Description of Artificial Sequence: Synthetic coding sequence
augggaaaaggcgacccuaagaaaccucgcggcaaaauguccucauacgccuuuuucguucagaccuguagagaagaacacaaaaaaaagcaccccgaugcuuccgugaacuuuuccgaauucaguaaaaaauguucagaacgcuggaagaccaugagcgccaaggagaagggaaaauucgaagacauggcgaaggcugacaaagcccgguaugaacgcgaaaugaagacguauauuccgccuaagggcgagaccaagaaaaaguuuaaagaccccaaugcaccaaaaagaccuccaagugcauuuuuccuguuuugcuccgaauaucgaccgaagauuaagggugaacaucccgguuuauccaucggcgauguggcgaaaaaacugggagaaauguggaauaauaccgccgccgaugacaaacagcccuaugaaaagaaagcagcaaagcugaaagagaaauaugaaaaagacaucgcagcuuaucgugccaagggaaagccggacgcagcuaagaagggggugguuaaagcugagaaaaguaagaaaaaaaaggaggaagaagaagaugaggaagacgaagaggacgaggaggaggaggaggaugaagaagaugaagacgaagaggaggacgacgaugaugaauag

SEQ ID NO: 248854 - RNA, 648 nt, Artificial Sequence
  Description of Artificial Sequence: Synthetic coding sequence
auggguaagggugaucccaaaaagccccgcgggaaaaugaguagcuacgcuuuuuuugugcagacuuguagagaggaacauaaaaaaaaacacccugacgccucaguaaauuuuagugaguuuucuaaaaagugcagcgaacgauggaagacgaugagcgccaaggaaaagggaaaguuugaggacauggccaaggcugacaaggcuagguacgagcgggaaaugaagaccuauauuccaccaaaaggcgagacuaagaagaaauucaaggauccaaacgcccccaaaagaccucccucagcuuuuuuccuguucuguagcgaguacagacccaagauaaagggagagcaucccggauugagcauaggugacguggcaaaaaaacugggggagauguggaacaacacugcggcggacgauaagcaacccuaugaaaaaaaggcugccaagcuaaaagagaaguaugaaaaggacauugcugcuuacagggccaagggcaaaccagacgcggcuaaaaaaggaguggucaaggccgaaaagucaaaaaagaagaaagaagaagaagaagacgaggaagacgaggaagaugaagaggaagaagaggaugaggaggacgaagaugaggaagaagaugaugacgacgaguag

SEQ ID NO: 248855 - RNA, 294 nt, Artificial Sequence; identical to SEQ ID NO: 248249
  Description of Artificial Sequence: Synthetic coding sequence

SEQ ID NO: 248856 - RNA, 477 nt, Artificial Sequence
  Description of Artificial Sequence: Synthetic coding sequence
auggguaaaggcgauccuaaaaaaccacgcggaaagaugaguagcuaugccuucuuugugcagacaugccgggaggaacauaaaaagaagcauccagacgcaagcgugaauuuuucagaguucuccaagaaaugcuccgagcgcuggaagacuaugucagcuaaggagaaaggaaaguuugaagauauggcaaaggccgauaaggcgagauaugaacgugagaugaagacauacaucccaccuaagggcgaaacaaaaaagaaauucaaggaccccaaugcuccaaagagacccccgagcgcauuuuuucuuuucuguuccgaauauagaccaaaaaucaagggagaacauccaggguuaucuaucggggacgucgcgaagaagcugggggaaauguggaacaacaccgccgcggacgauaaacaacccuaugagaagaaagccgccaaguugaaagaaaaguacgaaaaauuuuag

SEQ ID NO: 248857 - RNA, 648 nt, Artificial Sequence
  Description of Artificial Sequence: Synthetic coding sequence
augggaaagggugauccaaaaaaaccucgggggaagauguccagcuacgcguuuuuuguacagaccugcagggaggagcacaagaagaaacauccagacgccucagugaauuucagcgaguuuagcaaaaaauguagcgaacguuggaagacgauguccgccaaggagaaggguaaguuugaagauauggcaaaggcugacaaagcgagauaugagcgggaaaugaagacuuacaucccacccaagggcgaaaccaagaaaaaauuuaaggauccuaacgcuccaaaaagaccuccuuccgcuuuuuuucuguuuugcuccgaauauagacccaaaauaaaaggugaacacccaggccugucuauuggggacgucgcuaaaaaauugggcgagauguggaauaacaccgcugccgaugauaaacagccuuacgagaaaaaagcugcaaaauugaaagagaaguaugaaaaagacaucgcugcguaccgcgcaaaagggaagcccgacgcggccaagaagggagugguaaaggcugagaaauccaaaaagaaaaaggaggaggaggaagaugaggaagacgaggaggaugaggaggaggaagaggacgaggaagacgaagaugaggaggaagaugaugaugaugaguag

SEQ ID NO: 248858 - RNA, 648 nt, Artificial Sequence
  Description of Artificial Sequence: Synthetic coding sequence
augggaaaaggagaccccaagaaaccaagaggcaagaugagcuccuaugcauuuuucguacagacuugcagagaagaacauaaaaaaaaacaccccgacgcuuccgugaauuucucugaauuuagcaagaaauguagugaaagauggaaaaccaugucugccaaagaaaagggaaaguucgaggacauggcuaaggcagacaaggcccgauaugagagggaaaugaaaaccuauauuccaccaaaaggagaaaccaaaaagaaguucaaagacccaaacgccccaaagagaccucccagugccuuuuucuuauuuugcucugaauacagaccgaagauuaagggugaacauccaggacugaguauuggggauguagccaaaaaguuaggugagauguggaauaacaccgcugcggaugauaagcaaccuuacgagaaaaaagccgccaaguugaaagagaaguacgagaaggauaucgcugcuuauagggcuaagggcaaaccggaugcggcaaagaaagggguugugaaggccgagaaauccaagaaaaagaaggaagaggaggaggacgaagaagacgaggaggaugaggaagaagaagaggacgaagaagaugaagacgaagaggaggaugacgaugaugaauag

SEQ ID NO: 248859 - RNA, 489 nt, Artificial Sequence
  Description of Artificial Sequence: Synthetic coding sequence
auggggaaaggagauccaaagaagccgcgcggaaagaugagcucguacgccuuuuucguccagaccuguagagaagaacauaaaaaaaagcaucccgacgcuuccgugaauuucucugaguucucuaaaaaguguucggagcgguggaagaccaugucagcuaaggagaagggcaaguucgaggauauggcuaaggcggacaaagcaagguacgagagggaaaugaagaccuauauucccccaaaaggagaaaccaagaagaaguuuaaagacccuaaugcaccuaaacguccacccagcgcguuuuuuuuauucugcucagaguaccggccgaaaauuaagggcgaacauccgggcuugagcaucggcgaugucgcuaagaaauugggagaaauguggaacaacacugccgcugacgacaaacaaccuuaugaaaagauucuccuccacaucgaacuuaaagagucccuuaugcaacagaaaagauag

SEQ ID NO: 248860 - RNA, 942 nt, Artificial Sequence
  Description of Artificial Sequence: Synthetic coding sequence
auggacuucgaugaacgcgguccauguuccagcaacauguaccucccaaguuguacuuacuaugugucaggcccggacuuuucuaguuugcccuccuuccugccccagacacccagcagcagaccuaugaccuauagcuacucaucaaaccucccccaagugcaacccguacgcgaggugaccuucagagaauaugccaucgaaccugccacuaaauggcacccucgcggaaaucuggcacacugcuauucagccgaagaacuaguucacagggauugucugcaagcaccaucugcugccggugucccuggcgacguacuugccaaaaguagugcaaacguauaccaucauccuacucccgcugugucauccaacuuuuauucaacagucggccguaacggcguuuuaccucaggccuucgaccaguucuuugaaacugccuauggcacucccgagaaccuagcaagcagcgauuauccaggggacaagagugccgagaaaggcccccccgcggcuaccgcgacuuccgccgccgccgcugcagcagcuacuggagccccagcgaccuccuccucugacucagguggaggcggcggguguagagagacagccgccgcagccgaagagaaagagcgucgaagaaggccagaaucuucauccuccccugaauccagcaguggccauacugaagacaaagcaggaggcucaucugggcagagaacuaggaagaagagauguccguauaccaaauaccagauccgcgagcucgaacgagaguuuuucuucucugucuauaucaacaaagagaaacgccugcaacuuucgcgaaugcugaaccugacugaucgccaggugaagaucugguuucaaaacagacguaugaaggagaaaaaaauuaauagagaccggcugcaauacuacuccgcuaauccccuauuauag

SEQ ID NO: 248861 - RNA, 729 nt, Artificial Sequence
  Description of Artificial Sequence: Synthetic coding sequence
augagcucauacuuugugaauccucuguucucuaaauauaaggcuggcgaaagucuggaacccgcauauuacgacugccgcuuuccgcaaagcgucgggcggagccacgcccuagucuauggcccagguggaucagcccccggcuuucagcacgccucucaucacguacaagauuucuuccaucacgggacaagugggaucaguaacaguggguaccagcagaauccguguucacucagcugucacggcgacgcaucgaaguuuuacggauaugaagcccugccacgacaaucccucuacggggcacaacaagaggcaagugucguucaguacccugauugcaagucaucagcaaacaccaacaguucagaaggccaggggcaucucaaucagaacucuucccccucccugauguuucccuggaugcgcccccaugcccccggacgcagaucgggcaggcagaccuauucucgcuaucagacucucgaacuggagaaggaauuucucuucaacccauaccucacacggaaacgcagaauagaagucucccacgcccucgggcugacagaacgccaagugaaaauuugguuccagaaucggcgcaugaaauggaaaaaagaaaauaauaaggacaaacugcccggggcgagagaugaagagaagguggaggaggaaggaaaugaggaggaagagaaggaggaagaggaaaaggaggagaacaaggauuag

SEQ ID NO: 248862 - RNA, 7341 nt, Artificial Sequence
  Description of Artificial Sequence: Synthetic coding sequence
auggauaccggcgauacagcccugggccagaaagcaacuagccgguccggggagacagauaaagcuagcggacgauggagacaggaacagucugcugugauuaaaaugaguaccuucggcagucaugagggccagaggcaaccacaaauugaaccagagcagauuggaaauaccgccuccgcccaauuguucggaucaggcaaguuggcuagucccagugaaguaguccagcagguggcagaaaagcaguauccgccucaccgacccucccccuauucaugccaacauucccugagcuuuccucaacauagucuaccccagggcguuaugcacucuacgaaaccucaccagucgcuagaggggcccccauggcuguuccccgguccacuccccagcgucgcuucagaggaucuguuccccuucccuauucacggccauagugggggauacccuagaaaaaaaauauccucccucaaucccgcuuauucccaguauagccagaagucgauugaacaggcagaggaagcgcauaagaaagaacacaaaccuaaaaaaccaggaaaauacauuuguccauacuguucaagagccugcgccaagccaucagugcugaagaaacacauccguagccacaccggagagcgcccuuacccauguauucccugcggcuuuucguucaagaccaaauccaaucuguacaaacaccguaaaagccacgcacacgccauuaaggcaggccuugugccuuucacagaaucagccgugucaaagcucgaucuagaggccggauuuauagauguggaggcagaaauccauagugauggcgagcaauccacugacaccgaugaggaauccagucucuucgccgaagccuccgacaagauguccccuggucccccuaucccucuggauaucgccucacggggagguuaccaugggucuuuagaggaaaguuugggggggcccaugaaggucccgauacucaucauccccaaaaguggaaucccccugccuaacgagagcagccaguacauagguccagauaugcugccaaaucccucucucaacacuaaggcagacgauucucauaccgugaaacaaaaguuggcauuacgccucagcgaaaagaagggucaggacagcgaacccagucucaaucuguuaaguccacauaguaaggggagcacugauuccggcuacuucucuagauccgaguccgcggaacagcagaucaguccucccaacacaaacgcaaaguccuacgaagagauuauauucggaaaguacugucgacucucuccucggaacgcccugagcgugacuacgaccucccaagagcgggccgccaugggccggaaaggaauaauggaaccccuaccucaugugaacaccagacucgauguaaaaauguucgaagauccugucagccagcucauaccuagcaaaggcgaugucgaccccucucagacuuccaugcucaaaucuacuaaguucaauuccgaaucaagacaaccacaaauaauucccucaucgaucaggaaugaaggcaaauuauaucccgcuaacuuucaggguuccaauccugucuuauuggaggcucccguggacaguuccccacuuauaagaucgaacaguguaccaaccuccagcgcuaccaaucugacuauaccaccgucacugcgcggcucucacucguucgaugagagaaugacaggcucagacgacguauuuuacccuggcacuguugggauuccgccucaacggaugcuccgcagacaagccgccuucgagcugccuucuguucaggagggacacguagagguggagcaucauggccgaauguugaaagguaucagcuccaguucacugaaggagaaaaaacuaucuccaggcgacagaguaggauacgauuacgauguguguaggaagcccuauaaaaaaugggaggacuccgaaaccccuaaacagaacuaucgggacauuaguugucugagcucacuuaagcacggaggagaguacuuuauggaccccgucguuccgcugcagggaguccccucaauguucgguacaacaugugaaaacagaaagagaagaaaggagaagucagucggugacgaagaggacacgccaaugauauguucaucgaucguaucgacaccagugggaauaauggcaucagauuacgauccgaagcuacagaugcaagagggaguccgcucuggauuugcuauggccggacacgaaaaucucucacacgggcauacagaacgcuuugaccccugccggccccaauuacagccuggaucccccucuuuggucagugaggaaucuccaagcgcaaucgauucagauaagaugagcgaucugggcgggcguaaacccccugguaaugugauuagcguaauucaacacacaaauucucugucccguccuaacaguuucgaaagguccgaaucagcagagcuuguagcauguacccaggacaaagcgcccucaccgucagaaacuugugacuccgaaaucagcgaagcaccagugagccccgaaugggcccccccaggggauggagccgagaguggugggaaaccauccccaucgcaacagguacagcagcaaucguaccacacccagccacgacuuguaagacaacacaacauucaggugccggaaauucgggugaccgaggagcccgauaaaccagagaaagaaaaggaagcccaaucaaaggaaccagagaagcccgucgaggaauuccaguggccucaaagguccgagacucucucacaacuucccgccgaaaagcucccuccaaaaaagaaaagacuaaggcucgcugacauggaacacucuuccggcgaaagcaguuuugaaagcacaggcaccgggcugucuagaucuccaucccaagaaaguaaccuuagccacaguuccuccuuuuccaugucuuucgaaagagaggagacuagcaaacuguccgcccugccaaaacaggacgaauuuggcaaacacuccgaguucuuaacagugccagcaggauccuacucccugagugugccaggucaccaucaucagaaagaaaugcggcggugcagcagcgaacagaugccgugcccgcauccagccgagguucccgaggugcguucuaaaucuuuugacuacggaaaucucagucacgcacccguauccggagcagccgcguccacuguuagccccagcagggaacggaagaagugcuuucuaguacgccaggcauccuucuccggcucccccgagaucucccagggcgaagugggaauggaucagagcgugaagcaggagcaacuggagcaccugcaugcagggcucagauccggcuggcaucacgggccccccgcagugcuuccaccccugcagcaagaggaucccggcaaacagguagccgguccauguccaccccugaguagcgguccacuucaucucgcccagccacagaucaugcacauggacucacaggagagcuuacggaauccacuuauccaaccaacaagcuauaugacuucuaaacacuuaccagaacaaccacaucuuuucccacaucaagaaaccauccccuuuagccccauucagaacgcucucuuucaauuccaauaucccaccgucugcaugguccaccugccugcccagcagccccccugguggcaagcucacuucccucauccuuucgcccagcauccacaaaagucauaugguaagcccucuuuucagacagaaauucauucuuccuacccccucgaacacguggcugaacacaccggcaaaaaaccugccgaguaugcacauaccaaggaacagaccuauccuugcuacucaggcgcauccggacugcacccuaagaaccuacugccaaaauucccuagugaccagagcaguaaaagcaccgaaaccccaagcgaacagguccuacaggaggauuucgcgucagcgaacgccggcucccugcaaagcuugccugguacuguagugcccguacggauacaaacgcacgugccaagcuacggcucaguuauguacaccucaaucucacagauucugggacagaacucccccgcgaucguaauuuguaaaguagacgagaauaugacccaacgaaccuuagugaccaaugcagccaugcaaggaauaggcuuuaauauagcacagguccugggccagcaugcugguuuggagaaguauccuaucuggaaggccccccagacguugccauuaggccucgaguccuccaucccacugugccucccuagcacaucagacucagucgccacuuugggagguuccaagcgaauguuaucaccugcaaguucccucgagcuguuuauggaaacgaagcaacagaagcgugucaaggaagagaagauguacggacagauugucgaggaacugucggccguggaauuaacuaauagcgauauaaagaaggaccugucccgaccccaaaagccccaauuaguaaggcagggcugcgcuagugaaccuaaagauggccugcaguccgguuccaguucauucuccagucugaguccuaguucuagccaagauuacccuuccgugagcccaagcucccgcgaacccuuuuuaccuagcaaggaaaugcugagugguucuagggcaccccuacccggucaaaagucaaguggaccaucugaguccaaggagaguagugacgaguuagacauagaugagaccgcuagugauaugaguaugagcccucagagcuccucccugccggccggagacggacaguuggaggaggaaggcaaagggcacaaacggccuguaggaaugcugguaagaauggcaagugcgccgagcggcaauguggccgauagcacccuucuccuaacagauauggccgauuuccagcagauucuucaguucccuagcuuaagaaccacuacuacuguuagcuggugcuuccucaauuacacaaaaccaaacuacguccaacaagcaacuuuuaaguccaguguuuacgcguccuggugcaucucuagcuguaauccaaaccccagcggccugaauacuaagaccacucuggcccuccuucggaguaagcagaagauaacagccgagaucuauaccuuggccgcuaugcacaggcccgggaccggaaagcugacgagcuccucagcauggaagcaauucacacagaugaagccagaugccucauuuuuguuuggcaguaaguuggaaaggaagcuggugggaaacauacugaaagaaagagggaagggagauauccauggcgauaaggacauaggcucuaagcagaccgagccuauacgcauaaaaauuuuugaaggcgguuacaaaucaaacgaggacuauguuuauguaagaggaagaggaagggggaaauacauaugugaagagugcggcauucgaugcaaaaagccuucuauguuaaaaaagcauauucgcacccauacagaugugcguccuuacguuugcaagcuuugcaacuucgcauucaaaacaaagggaaaucugacaaaacacaugaaguccaaagcccacaugaagaagugccuggagcuagguguaaguaugacuagcguggacgauacagagaccgaagaagcugaaaaccuugaggaccuccacaaagccgccgaaaaacacucuaugaguucaaucucuaccgaucaucaguuuuccgacgcagaagagagcgacggagaggauggggacgauaacgaugaugacgacgaggacgaggaugauuuugaugaccagggagaucuaacgccaaagacacgaucacgcaguacaagcccgcagccuccuagauuuaguucucugccuguaaacgugggggccgucccacacggcguacccucagacucuucacuggggcacucaagccugaucucuuauuuggugacccugccuagcauaagagugacucaacucaugacucccagugacucaugcgaagacacccagaugacagaauaucagagacuguuucagucaaaauccacagacuccgagcccgauaaggacaggcuagauauacccagcugcauggacgaagaguguaugcuuccauccgagccuucaaguucacccagagacuuuagucccucuucgcaucacucgagcccgggguacgauucaucaccgugccgagacaauucuccuaagcgauauuugauacccaaaggugaucugagcccaagaagacaccucucccccagaagagaucuuaguccaaugaggcaccuuaguccucgaaaagaagccgcccugagacgggagaugucacaacgagauguaaguccucggaggcaccuuuccccccgacggccugugucccccggcaaagacauuacugcucgacgggaucugucuccccggagagagagaagauacaugaccacuauccgagcaccaagcccaagacgcgcucuguaccacaaccccccacucagcaugggacaauaccugcaggccgaaccuaucguguugggacccccaaacuuacggcgcgggcuaccacaagucccguacuucuccuuauacggcgaucaggagggcgcauaugagcacccagggucuagcuuguucccggaggggccuaaugacuacguguuuagccacuugccuuuacacucucagcaacagguacgugcaccuauaccaauggugccugugggcggaauucaaaugguccauuccaugccacccgcucucucaaguuuacacccuagcccaacacuuccccugcccauggagggguuugaagaaaaaaaaggggccucuggggaguccuuuagcaaagacccauacguccugaguaaacagcacgaaaagagaggaccucacgcucuacaaucauccgggccuccaaguacuccuuccaguccuagacuucucaugaagcaaucaacaagcgaggauagcuuaaacgcaacagaacgggaacaggaggaaaauauucagacuuguaccaaagccaucgccucuuugcgcauagcaaccgaggaggcugcucuauugggaccugaucaaccagccagaguccaggagccccaccagaauccucucggaagcgcacauguguccauccgccacuuuagccgcccagagccuggccagccuuguaccagugccacccacccagaucugcacgacggugaaaaggacaauuucggcaccucucagacaccucucgcacauucaacuuuuuauucuaaguccuguguggacgauaaacagcuggacuuccacucuucuaaggaacugagcagcagcaccgaagaaucuaaagaucccuccucagaaaaaagccaauugcacuag

SEQ ID NO: 248863 - RNA, 786 nt, Artificial Sequence
  Description of Artificial Sequence: Synthetic coding sequence
auggccgcagcaugccggaguguaaaaggucugguggcagucaucacaggcggugcuagcgggcugggacuugccaccgcugaacgacuaguuggacaaggggccucagcggucuuguuagaucugcccaauagcgggggugaagcccaggcaaaaaaauuaggaaauaauuguguguuugccccugcggaugugacuucugagaaggacgugcaaaccgcucucgcccuggccaaggggaaauuugguagagucgacguugccgucaauugcgcagggaucgccgucgccucgaagaccuacaaucugaagaagggucaaacucauacacuggaggauuuccaacgugugcuggauguuaaccuaaugggcacauucaacgucauccgauuaguagcgggcgaaaugggccagaacgaaccagaccaggggggccagcggggcgugauuauaaauacagcaucuguugcugcuuucgaaggacaggugggucaggcggcauacagugcaaguaaaggagguauuguggguaugacgcucccuaucgccagggaccucgcuccuauugggauucguguuaugaccaucgcuccuggcuuguuugguaccccacuucucacgucacugccagaaaaagucugcaacuuccuugcgucucaaguacccuuuccuagucguuuaggcgauccugccgaguaugcucaccucguacaggcaauaaucgagaauccuuuucugaauggggaagugauuagacuggacggagcaaucagaaugcagcccuag

SEQ ID NO: 248864 - RNA, 792 nt, Artificial Sequence
  Description of Artificial Sequence: Synthetic coding sequence
augaaaggaggguucaccggaggagaugaauaccagaaacacuuucugccaagggauuauuuagcuacguacuacucuuucgauggcaguccaagcccagaagcugagaugcugaaauucaaucuagaauguuugcacaagaccuucggcccuggaggccugcagggggauacccuaauagauaucgggucuggccccacgaucuaucagguucuggccgcuugcgauaguuuccaagacaucacucuuagcgacuucaccgaccggaacagagaagaacuggaaaaguggcugaaaaaggaaccuggcgcauacgacuggacacccgccgugaaguuugcuugcgaacucgagggaaauucgggccgaugggaggaaaaagaagagaaguugcgugccgccgugaagagaguucuuaagugugacguucaucugggaaauccucucgcacccgccguccucccacuagcagauugcguucuuacccuacuugccauggagugcgcaugcugcucccuugacgcuuaucgggccgcucuuuguaaucuugcuuccuuguuaaagccuggcggacaucugguaacaaccgugacccugcgucucccuuccuacaugguuggcaaacgggaauucucaugcguggcauuggagaaggaagagguagaacaggcagugcucgacgcaggcuuugacauagaacagcugcugcacuccccccagaguuacuccgugacaaaugcugcaaauaaugggguaugcuuuaucguugcaagaaagaagcccggaccauag

SEQ ID NO: 248865 - RNA, 1386 nt, Artificial Sequence
  Description of Artificial Sequence: Synthetic coding sequence
auguggcaacugacuagucuccuacucuuuguggcgacuuggggcauuucuggcaccccugcccccuuagauucuguuuucagcuccucagagcgggcccaccagguucucagaauccgaaaacgcgcaaacaguuuucucgaggaauugcgacauucaucauuggaacgggagugcaucgaggaaaucugcgauuuugaggaagccaaggaaauuuuccagaacgucgacgauacauuagcauucuggucuaaacacguggacggcgaccagugccuaguccuuccucucgagcaccccugugcuucccuguguuguggccauggaacauguaucgacgggauugguucuuuuucaugcgauuguagaucuggaugggaagggcguuuuugccagagagaaguuuccuucuugaauuguucucuugauaacggugguugcacccacuauuguuuggaggaggucggauggagaagaugcaguugcgccccuggguacaagcugggagacgaccuauuacagugucacccugcggucaaguuucccugcggucggccauggaagaggauggaaaagaaacgcagccaucucaaacgugacacagaggaccaagaagaucagguugacccuaggcuaauugacgguaaaaugacgcgccggggagauuccccauggcaaguggugcuccuggacucgaagaaaaaguuggccugcggagcugugcuuauccacccuucauggguccugacagccgcccauugcauggacgagagcaaaaaacuacuggugaggcuuggagaauacgauuugaggagaugggagaagugggaauuggaucuggacaucaaggaggucuucgugcauccuaacuacagcaagagcacuacggauaacgauauagcauuacugcaccuggcccagccugccacucuaucucaaacuaucgugccaauuugucucccugacucaggguuagcagagagggaacugaaucaagcuggacaggagacauuagugacuggcuggggcuaccacaguucaagagaaaaggaagcaaagaggaaccggaccuucguccuaaauuuuaucaaaauucccguggucccccacaacgagugcuccgaagucaugucgaacaugguuagcgaaaauaugcugugcgcaggaauucugggagaccggcaggaugccugugagggggacucaggcggaccuauggucgcuucuuuccacgggaccugguuucuggucggucugguaucuuggggggagggaugcggucuguuacacaauuauggaguguacacuaaaguuagucgguauuuagauuggauacaugggcauaucagagacaaagaggccccucagaaaagcugggccccuuag

SEQ ID NO: 248866 - RNA, 2934 nt, Artificial Sequence
  Description of Artificial Sequence: Synthetic coding sequence
augacggcucgagaacacuccccucggcauggcgccagagcccgcgcuaugcagcgugcuuccaccaucgauguagcugcugacauguuaggccucucauuagcaggaaauauccaggaucccgacgaaccuauucuggaauuuucucuagcaugcuccgaauugcauacaccaagccucgaccggaagccaaacuccuuuguggccguuucaguuacuaccccaccccaggccuuuuggacuaaacaugcacagacggaaaucaucgaaggaacuaauaacccaaucuuucuauccaguaucgcauucuuucaagauucucucauuaaccagaugacucaaguuaagcucaguguguacgacgugaaagauaggucacaagguacuauguaucuacuagguagugguacauucaucguaaaggaccuccugcaggaccggcaucauagacuacaccucacccuccggagcgcggaauccgaucgaguugggaacaucacagucaucggcuggcagauggaggaaaaaucugaucagcgcccaccagugacccguucaguggauacugucaauggacgaauggucuugccaguagaugaguccuugaccgaagcacuuggcauucggagcaaauaugcaucucuuagaaaggauacauugcucaaguccguguuuggaggagccauaugccggauguaccgcuuuccuacuacugacggaaaucauuugagaauucucgagcaaauggcagaaagcgugcucucguugcaugugccccgacaguuugugaaacuccugcuugaggaggaugccgcacggguaugcgaauuggaggaacuuggcgagcuaucccccuguugggaaagccugagaagacaaauugugacucaguaccagacuaucauccuuacguaucaggagaauuugacagaucuacaucaguaccggggaccauccuucaaggccucuucgcuuaaggcggauaaaaaacuagaguucgugcccacuaauuugcacauccagaggaugcgcgugcaagaugacggaggaucagaucagaauuacgacaucgucacaaucggugccccagcugcucauugccagggauucaagucgggcggccugagaaagaagcugcacaaguucgaagagaccaaaaaacacuucgaagaaugcuguacgucuuccggaugccagagcaucauuuacaucccgcaagaugucgucagagcgaaggagauaauugcccagauuaauaccuuaaagacacaggugucauauuaugcugaacgccucucgcgugcugcuaaagaccgcuccgcuacaggucucgaacggacccuugcaauccucgccgacaaaacaagacagcuggugaccguaugugacuguaagcugcucgccaacuccauucacggcuugaacgcugcuagacccgauuauaucgcauccaaagcaagcccaaccucuaccgaagaggagcaggugaugcuccguaacgaucaagacacccucauggcccgcuggacaggccguaacagucgcaguucucuacaaguugacuggcacgaagaggaaugggagaagguuugguuaaacguggacaaauccuuggaauguaucauccagagaguggacaaauuacuacaaaaggagagauugcacggggaagggugcgaggauguguucccaugugccgguaguuguacuucuaaaaagggcaauccugauagccaugcauauuggaucagaccugaagacccguucugcgacgucccaucaucucccugccccucaacaaugccuaguacugcgugucacccccaccugacgacucauugcagcccuccuccugaagaaagcucuccuggcgaauggucagaggcacucuauccccucuuaaccacauugaccgacugcguagccaugaugagugacaaggcaaaaaaggcaaugguauuucugcugaugcaggauagugcacccacgauagccacauaccucucgcugcaguauagaagagacguggucuuuugucagacacucacagcccucauaugcggguucaucaucaaauuaagaaauugccuccacgaugauggcuucuugaggcaacuguauacuauuggucugcuggcucaguucgaaucccugcuuucuacguacggugaggagcuugcaauguuggaggauaugucucucgggaucauggauuuacgcaauguuacguucaagguuacacaggccaccucguccgccuccgcugauaugcugcccgugaucacuggaaacagagauggauuuaacguccgcgugccccuacccgggccacuguuugacgcgcuaccaagagagauacaguccgggaugcuccugcguguccagcccguacuuuuuaacgugggcaucaacgaacagcagacuuuagccgaacgauucggcgacacaucccugcaggaggugauuaacgucgagucccugguacgcuuaaacucuuacuuugagcaguucaaagaaguccuaccagaagauugucucccucggucaagaucacagacaugucucccugaacuacuacgguuucugggucagaauguccacgcucgcaagaacaaaaacgucgauauccucuggcaggcagccgaaauuugccgacggcuaaacggugugagauucacuucaugcaagucagcuaaggauaggacagcaaugucggugacccuugagcaaugccuaauucugcaacacgaacacgguauggcgccacaaguguucacccaggcccucgagugcaugaggagugaaggaugcagaagagagaauacgaugaaaaauguggguagcagaaaguacgccuucaauucgcugcagcugaaagcuuucccuaagcacuauaggccacccgaagggaccuaugguaaagucgaaacuuag

SEQ ID NO: 248867 - RNA, 3201 nt, Artificial Sequence
  Description of Artificial Sequence: Synthetic coding sequence
augggacccggaccuucuagagcuccccgggccccucgucucaugcugugcgcguuggcgcugauggucgcugccggaggaugcguggucuccgcuuuuaaccuggauacucguuuccuuguugucaaagaagcaggaaaccccggaucauuguucggguacuccguugcacuucaccggcaaacagaacgacagcaaagauauuugcugcuggcuggggcaccacgugagcuggcgguccccgaugguuauacaaauaggacuggagcugucuaccuaugccccuugacagcccacaaagaugacugcgagcgaaugaacauuacagugaaaaacgaucccggacaccacauuauugaagauauguggcugggcgugacaguggcaucgcaagggccggcugggcgagugcuggugugcgcacacagauauacacaaguucucuggucgggaucugaggaccagcggaggauggugggaaaauguuauguucgcggcaaugaucucgaacuugacaguuccgacgauuggcaaacuuaucacaacgaaauguguaauuccaauaccgauuacuuagagacagggaugugccaacuggggaccucuggcggguucacacagaacacgguuuauuuuggugcuccgggagcauauaacuggaaggggaacuccuauaugauucagcgcaaggagugggaccugucugaauauucuuauaaggauccagaggaccaaggaaaucuauacaucggauauacaaugcaaguggggagcuucauccuucacccaaagaacaucacgauagucacaggcgcuccaagacacagacacaugggugcaguuuuccucuugucccaggaggccgggggcgaucuccgacgacgacaggugcuggaagguagucaaguaggugcuuauuuuggauccgcaaucgcucuagcagauuugaauaaugacggguggcaggaccuguuggugggugccccauauuacuucgaacgcaaagaggagguuggcggcgcuauuuauguauuuaugaaccaggcagggacaagcuuccccgcucaucccagucuacuucugcacgggcccucugguucugcguuuggacucagcgucgccaguauuggugauauuaaucaggacggauuucaggauauugccguaggcgcaccuuucgagggauuggggaagguuuacaucuaucauucuucuucuaagggacuuuuacgccagccccaacaagucauccauggugaaaagcuggggcuccccggucuggcuacuuucggauauucacugagugggcaaauggacgucgacgaaaauuucuauccugaucuguugguugguagccugucugaccauaucguucuguuaagggccagaccuguaauuaauaucgugcauaaaacucugguaccaagaccggcaguguuagaccccgccuugugcacggcgacuuccugcgugcagguagaacuguguuucgccuacaaccagucugcuggaaacccgaauuauaggaggaacauaacucucgcuuauacguuggaagcagaucgugaccgccguccgccccggcuacgauucgcuggcuccgagucugcuguuuuccacggcuucuuuucaaugccagaaaugagaugccagaagcucgaacuccugcugauggacaaccugcgggacaagcugcggccaauuauuaucuccaugaacuacagucuaccauuacgaaugccugacagaccuagacugggccugcguagucucgacgcguaccccauauugaaccaagcccaggcccuggaaaaccacacagaaguacaguuccagaaagaguguggccccgacaacaaaugugaaucaaacuugcaaaugagagccgccuuuguaucagagcagcagcaaaagcucaguaggcugcaguacuccagagauguaagaaaguuacuucuauccaucaauguaacaaauacccgaaccagcgagaggucuggcgaggacgcccaugaggcccugcucacccugguaguuccccccgcguugcuuuuaaguagcgucagaccuccuggugcaugccaagccaaugagaccaucuuuugcgagcucggaaauccauuuaaaaggaaucagcgaauggaacuguugauugcguucgaagugaucggaguuacccugcacacuagagaucuccaaguucagcugcaacuauccacgaguucucaccaggacaaccuguggccuaugauccucacacuucucguggauuacacccugcagacuucccuaaguaugguuaaucaccggcuccaguccuuuuucggaggaacaguuaugggugaaucuggaaugaaaacugucgaagacgugggaucaccuuuaaaguacgaauuucaggugggaccgaugggcgaagggcucgugggauugggcacuuuaguucucggacuugaauggccuuaugaagugucgaauggaaaauggcuucuauaucccaccgaaaucacaguacacggaaauggguccuggccaugcaggccucccggagaucugauuaacccccugaaucucacauuaagcgauccuggcgacagaccuagcucaccacagcggagacggaggcagcucgauccgggcggcggucagggaccuccuccagucacgcuggcagccgcgaaaaaagccaaauccgaaaccguuuugacaugugcuacuggaagggcucacugcguuuggcuugaaugcccaaucccugaugccccuguugugacaaacguuacagugaaagcuaggguguggaauuccacuuuuauugaggauuaucgagauuucgaccgcgugcgaguuaacggaugggcuacccucuuccuccgaacaagcaucccaacgauuaauauggagaacaagacaacaugguuuagcguugauauugauucugagcugguggaggaauugccggcugagauugaacugugguuaguacuuguggccgucggagccgggcuuuuacuauugggacuuauuauucuccuuuuguggaaaugcgauuucuuuaaacgaacucgguauuaccagauuaugccuaaauaucacgccgucagaauacgcgaagaggaaagauacccgccaccugguuccaccuuacccaccaagaagcacugggugacguccuggcagacuagagaucaguauuauuag

SEQ ID NO: 248868 - RNA, 1644 nt, Artificial Sequence
  Description of Artificial Sequence: Synthetic coding sequence
auggcuacaauggugccaucgguguuguggccgcgcgccuguuggacauuguuggugugcuguuuacuuaccccugguguacagggccaagaguuccuacugagaguugagccucaaaaucccgucuugucugccggugggucacuguuuguuaacugcucaacugacugucccucaagcgaaaaaauugcucuagaaacaagcuuaucuaaagaauuaguagccucuggcaugggaugggcugccuucaaucuguccaauguaaccgguaauagccggauccuuugcaguguuuauugcaauggcagccaaaucacuggaucaucaaacaucaccguauaccgccugcccgaacgcguugaacuggcgccucucccuccuuggcagccugugggacaaaacuuuacucugcgcugucaaguggaggauggaucuccccguacgucguuaaccguugugcugcugcgaugggaggaggaacucagccggcaacccgccguggaagagcccgccgagguaaccgccaccguauuagccucaagggaugaucacggagcgccuuucucauguaggaccgagcuggacaugcaaccacaagggcuaggccuguuuguuaauaccuccgccccccgacaacuucgaacauuuguguuaccagugacaccacccagguugguggccccacgguucuuagaaguggaaaccucauggcccguugauugcacacuugauggucuguuccccgcgagcgaggcucagguguaucuugcucuuggcgaccagaugcuuaacgcaacugucaugaaccacggagauacccuuacagccacggcuacugcaacagcccgcgcugaccaggaaggcgcucgcgaaauuguauguaauguaacacucggaggugagaggagagaggcccgcgaaaaccuaacugucuuuucauuucugggaccaaucguaaacuuaucugaaccaaccgcacacgagggcuccacagugacaguaucuuguauggccggggcuagaguacaagugaccuuggauggcgugccugccgccgcgccugggcagccagcacaauugcagcugaacgcuaccgaaucugaugauggccgguccuucuucugcuccgccacccuugaaguugacggggaguuuuuacaucgcaacucuucuguccaauugagaguccuguauggucccaaaauugauagagccacuugcccccaacaccugaaauggaaagacaaaacccgacacgugcuucagugucaggccagggguaaucccuauccugagcuucgaugccucaaggaagguagcuccagagagguaccuguaggaaucccguuuuuuguuaacgugacccacaauggaacauaucaaugucaagcgucaucuucucgcggcaaguacacccucgucguagugauggauauugaagcgggcagcagccauuucgucccugucuuugucgcagugcuguuaacacucgggguugugacgauuguacucgcacucauguacguuuuccgugaacaccaacgauccgguagcuaccacguuagggaagaaaguaccuauuuaccccucaccaguaugcaaccaacagaggcuaugggggaagagccaucgagagcagaauag

SEQ ID NO: 248869 - RNA, 1356 nt, Artificial Sequence
  Description of Artificial Sequence: Synthetic coding sequence
augccaaaaaauaagaagcguaauaccccucaucgaggcagcucugcaggaggaggaggauccggagcagcagccgcuaccgccgcgaccgccggaggucaacauagaaauguucaacccuucucugaugaagacgccucuauugagacuaugucucauuguaguggcuacagcgacccauccagcuuugccgaggacggucccgaagugcuggacgaagagggcacacaggaagaccuggaauacaagcuuaagggacucaucgaucuuacccuugacaaauccgcuaagacccgacaagcugcccuggaaggaauaaagaaugcccucgcgagcaagauguuguacgaauucauccuggagaggagaaugacccugacggauuccaucgaacgaugccugaaaaagggaaagagugaugagcaaagagcugccgcugcccucgccaguguccugugcauccaguugggaccuggaauagaauccgaggaaauacuuaaaacccugggaccuaucuuaaagaaaauuaucugugacgguucugcuagcaugcaggcacgacaaacaugcgcuacguguuuuggaguaugcuguuucauugcaaccgaugauaucacugagcuuuauucuacucuggaaugccuggaaaacauuuucaccaaguccuaucugaaagagaaagacacaaccgugauuuguagcacccccaacacagugcuccauaucucuucccuacuggccuggacacugcucuuaacgauuuguccuaucaaugaaguaaaaaaaaagcuagagaugcauuuccacaagcuaccuagucugcuguccugcgaugacgugaacaugagaaucgccgccggugagagccucgcacugcuguuugagcuggcaagagguaucgaaucugacuuuuucuaugaggacauggaaucucugacacagauguugcgagccuuggcaaccgacggaaacaagcaccgagcuaaaguggauaaacggaagcagaggagcguguuucgagacgugcuucgcgcaguggaagaaagggauuuccccacagaaacaauuaaauucggaccagaaaggauguacauugauugcugggucaaaaaacacacauacgauacauucaaagaagugcugggcuccggaaugcaguaucaccuucagucuaacgaguuucuuagaaauguuuucgagcuuggcccccccgugaugcuagaugccgcgacucugaagacgaugaagaucagcagauuugaaagacacuuguacaacucagcagcuuucaaagcaagaacuaaagcacguuccaagugccgggacaaaagagcagauguaggcgaauucuucuag

SEQ ID NO: 248870 - RNA, 1713 nt, Artificial Sequence
  Description of Artificial Sequence: Synthetic coding sequence
augacgcuucugugguguguggucagccuguacuucuaugguauccugcagucugaugcaucagaacgcugugacgacuggggacuggauaccaugcgccagauacagguauuugaagaugaacccgcuaggaucaaaugcccauuauucgaacacuuucuuaaauuuaauuauagcacugcucacucagccggacucacucucauuugguacuggacccgacaggaucgcgaccucgaagaaccaauaaauuuuagauugccugagaacagaauaucuaaagagaaggauguauuaugguuucgcccuacucucuuaaaugauaccggaaauuacacuuguaugcugagaaacaccaccuacugcagcaaaguugccuucccgcuugaggugguccagaaggauaguuguuucaauagcccgaugaaacuucccguacacaaauuguacauagaguacggaauacaacgcauuacuugcccaaauguggauggcuacuucccuuccucugucaagcccacuaucacaugguacaugggauguuauaaaauccagaacuucaauaacgugaucccugaggguaugaaucugagcuucuugaucgcacuuaucagcaacaacggcaauuauacaugugucgucaccuaucccgaaaacggccgaaccuuccaucugaccagaacauuaaccgugaaagucgugggcagcccuaagaacgccgugccuccuguaauucauagcccuaacgaccacguaguauacgagaaagaaccaggcgaggaauugcucauucccuguacaguguacuucuccuuccugauggauuccaggaacgaaguuugguggacuauugacggcaaaaagccugaugacaucaccauugacgucacaaucaacgagagcauuagccacucccguacagaggacgaaaccagaacgcaaauacugagcauuaaaaaggucacuagugaagaucuuaaaagaagcuauguaugucacgccagguccgcuaaaggcgaaguggcaaaggcggccaaagucaaacagaaagucccugcgccucgcuacaccguugaguuagcauguggguucggugccaccguucugcugguagugauucuaaucgucguguaccacguguacuggcuagagaugguccuuuucuacagagcgcacuucgggacugaugagaccauacuugacgggaaagaguacgacaucuacgucagcuaugcucgaaaugccgaagaggaagaguuuguuuugcugacucuccgaggagugcuggaaaacgaguuuggguacaaauuaugcauuuucgauagagacuccuuaccuggcggaauugugaccgacgaaacuuuguccuuuauccagaagucuagacggcugcugguugugcuuagcccuaacuauguacugcagggaacccaggccuuauuagaacugaaagccgguuuggagaacauggcaagcagagggaauauuaaugucauauugguccaguauaaggcagucaaggaaacgaagguuaaagaguuaaagcgagcaaagacggugcuuacggugaucaaguggaagggugagaagucgaaauauccccaagguagguucuggaaacagcuacagguugccaugcccgugaaaaaaaguccacgaaggucuuccucagaugagcagggucuauccuacuccagccucaagaauguguag

SEQ ID NO: 248871 - RNA, 987 nt, Artificial Sequence
  Description of Artificial Sequence: Synthetic coding sequence
augggcuucuggauccucgccauccugacuauccucauguacucaacagccgcaaaauuuaguaagcaaagcuggggauuggagaaugaggcauugauuguacgcugcccacgacaaggaaaacccucuuacacgguggacugguacuauucacagacaaauaaaucuaucccuacucaagagcgcaacaggguguuugccaguggccaguuauugaaguuucugcccgcggccguggccgauucugguaucuacacaugcaucgugagauccccaacauucaaccgcaccggauacgcuaaugugacaaucuauaagaaacaaagugauugcaacguucccgauuaucugauguauagcacugucucagguuccgagaaaaacuccaaaauauacuguccgaccauugaucucuacaacuggaccgccccacuggaaugguucaaaaacugucaggcucugcaaggcucacguuaucgagcucauaaguccuuucugguaaucgacaacguuaugacagaagacgccggugauuacacgugcaaguuuauccacaaugagaauggugcuaacuacuccguaaccgcuacaagauccuucacaguaaaagacgaacagggauucucacuguuuccugucauuggcgcacccgcgcaaaaugagaucaaagaaguagaaaucggaaagaacgcaaaucucaccuguagcgcaugcuucgguaaaggcacccaguuccuugcagccguucuguggcaguuaaacggcacuaagauaacagacuucggagaaccuagaauacaacaggaagaggggcaaaaccaaagcuuuagcaacgggcucgcgugucucgacauggugcugcgcauugcagacgugaaagaggaagauuuacugcuacaguaugacugccucgcucuaaacuugcacggauugagaaggcacacugugcgcuuaucaaggaagaaucccagcaaagaaugcuuuuag

SEQ ID NO: 248872 - RNA, 780 nt, Artificial Sequence
  Description of Artificial Sequence: Synthetic coding sequence
augggcuuuuggauuuuggccauacucacaauucuuauguauagcacggccgccaaguucucuaagcaaagcuggggauuggaaaacgaagcucucauuguccgaugcccacgucagggcaagcccucuuacacaguggacugguauuauucucagacaaauaaguccaucccuacgcaagagcgaaauagagucuuugccuccggucaacuucuaaaauuccugccagcugccgucgccgauagcggaauauacacauguauugucaggagcccuacauuuaaccguacuggguaugccaacgucacaauuuacaaaaaacaguccgauugcaaugucccagauuaccuuauguacucuacuguuucggggagugaaaaaaacucuaaaauuuacuguccaaccauagaucuguacaauuggacggcgccucuagaaugguucaaaaacugccaagcauuacagggaucccguuacagagcucacaaguccuuuuugguaauugauaauguuaugacugaggacgcaggcgauuacacaugcaaguucauacacaacgagaauggagcgaacuacuccgugaccgcuacccgaaguuucacugucaagguauggugccagagcuuuugcaaacuaaaaaaaucccuuauuuuuuccaauacacacuggauccagucccuuaugagaggauucguuaugguguacuacggugugcacaaauguuguagaguaguguuuaacuuaugucuccaguauuuccagcaucaucaauggccuuag

SEQ ID NO: 248873 - RNA, 636 nt, Artificial Sequence
  Description of Artificial Sequence: Synthetic coding sequence
auguacucuacugugagcggaucugaaaaaaauuccaaaaucuauugcccgacuauugaucuguauaauuggaccgcuccacuggaaugguuuaaaaacugucaggcacugcaaggcucacgcuauagggcucacaaaagcuuucugguaauagauaauguaaugacagaggaugcgggggauuauacaugcaaguucauacacaacgaaaacggugcaaauuacuccgucaccgccacacgaaguuucaccguaaaggacgagcaaggcuuuagcuuauucccugugauuggagcaccugcacaaaaugaaauuaaggaaguagaaauugguaaaaaugcaaaucugaccugcuccgcuugcuucggcaaaggaacccaguuucuggcggcagugcucuggcaacucaacggaacaaaaauaaccgacuuuggcgaaccccgcauucaacaagaggaagggcagaaccagucuuucucuaauggguuagccugucuggauauggugcuuagaauugcagacgugaaagaagaagaucugcuccuccaguaugauugcuuagcgcucaaucuucacggacucagaagacacaccgugagacugucaagaaaaaacccuagcaaagaauguuuuuag

SEQ ID NO: 248874 - RNA, 945 nt, Artificial Sequence
  Description of Artificial Sequence: Synthetic coding sequence
augggguuuuggauccuugccaucuugacaauucuuauguauagcaccgcugcuaaauucagcaaacagucaugggguuuagagaaugaagcacuaauuguuagaugcccucggcagggcaaaccuucguauacuguggauugguauuacucccagaccaauaaauccaucccuacucaagagagaaacagaguguucgccucuggucagcuccuuaaauuccucccagcugcaguggccgauucugggauauauacauguauuguucguucaccaacuuucaaucgaacaggauacgcuaaugugaccaucuauaaaaaacagucugacugcaacgucccagauuaucugauguauucuacuguuucaggaagcgaaaaaaauucuaagauuuacugcccaacgauugaucuuuauaacuggacggcaccgcuggagugguucaagaauugccaggcccugcaagguagccgauacagagcccacaaauccuuucuugugaucgacaaugugaugaccgaagacgcuggggacuauacgugcaaauucauucauaaugaaaacggggcgaauuacagcguuacugcuacccgaucuuuuacaguuaaggacgaacagggauucagccucuuuccugugaucggcgcaccugcccagaacgaaaucaaggaaguugaaauuggcacgcaguuucuagccgcuguucuuuggcaauugaacggcacaaagauaacagacuucggugaaccucggauacaacaggaagaaggacaaaaccaaucuuucucuaauggccuggcuuguuuagacauggugcugcgcaucgccgacguuaaagaagaggaucuacuccuucaauaugauugccuggcacucaaucuucacgggcuucggcggcauaccgucagacugucacguaaaaauccaagcaaagaguguuuuuag

SEQ ID NO: 248875 - RNA, 117 nt, Artificial Sequence; identical to SEQ ID NO: 248269
  Description of Artificial Sequence: Synthetic coding sequence

SEQ ID NO: 248876 - RNA, 300 nt, Artificial Sequence; identical to SEQ ID NO: 248270
  Description of Artificial Sequence: Synthetic coding sequence

SEQ ID NO: 248877 - RNA, 1671 nt, Artificial Sequence
  Description of Artificial Sequence: Synthetic coding sequence
augggcuuuuggauccucgccauccugaccauccucauguacucaacugccgcaaaguucucaaaacaguccuggggacuggaaaacgaagcccuuaucgucaggugcccacgacaggguaagccgucauauacaguggauugguacuauucccagacaaacaaaaguauucccacccaagagagaaacaggguguuugccuccggucaacucuugaaauuccuaccugcugccguagcugauuccggcaucuacacgugcaucguacgcagcccgaccuuuaaucgaaccggcuaugccaacgugacaauuuacaaaaaacagagugacugcaauguacccgacuaucugauguauucaacugucucugggucugaaaaaaacucaaagaucuauugcccgacgaucgauuuguauaacuggacggcaccgcuggaaugguucaagaacugucaagcccugcaagggagccgguauagggcucacaaauccuuucuuguaaucgauaauguaaugaccgaggaugcuggcgauuauacuuguaaauuuauucauaaugagaacggugcgaauuacucagugacagcaaccagauccuuuacgguuaaggaugagcagggcuuuucuuuauuuccagugauaggcgcccccgcacagaaugagaucaaggaaguggaaauaggcaagaacgcgaacuugaccugcagcgcauguuuugguaaaggaacucaguuucuggcggcagugcuuuggcaguugaaugguacgaagauuacagacuucggcgagccuaggauccaacaggaggaaggacagaaccagucauucucaaauggucucgcuugucuggacaugguuuugcgaauugccgacguuaaagaggaagauuuacuauugcaauacgauugccuugcauuaaaccuccacggcuuaagaagacacaccgugcggcugagccgcaagaauccuaucgaccaucacucuauuuauuguaucaucgccgucugcucuguguucuuaaugcugaucaacguucuaguaaucauacugaagauguuuuggauugaggcuaccuuguuguggagggacauugccaaaccuuacaaaacaagaaaugauggaaagcucuacgaugcauauguggucuacccccgcaauuacaaaucaagcaccgacggcgccucaaggguugagcacuuugugcaccagauauugccugacgugcucgagaacaaaugcgguuauacuuugugcaucuauggcagagauaugcucccaggggaagaugucgucaccgcgguggagaccaacauucgaaaaucccggagacacauauucauacuuacuccacaaauaacacacaauaaggaauucgcuuacgagcaggagguggcauugcacugugcucugauccaaaaugacgcuaaagugauucucaucgagauggaagcucugucugaauuagauaugcuccaggcugaagccuuacaggacucucugcaacaucugaugaaaguucagggcacaauuaaauggcgagaggaucacauagcuaacaagcgaagccuuaacucaaaguucuggaaacaugucagauaccagaugccuguccccuccaagauuccgcgcaaggccucaagucuaaccccacucgcugcucaaaaacaguag

SEQ ID NO: 248878 - RNA, 741 nt, Artificial Sequence
  Description of Artificial Sequence: Synthetic coding sequence
augcuguggcggcaguuaaucuauuggcaguuacuggcacuguucuuucugccuuucugucugugccaggacgaauacauggaguccccccaaaccggagggcuacccccugauuguucgaagugcugccacggugacuacucauucagaggcuaccagggaccuccuggcccaccaggaccuccagguaucccugggaaucauggaaacaaugguaacaauggcgcuacuggucacgagggugcaaagggugaaaaaggcgauaaaggugaucucggaccccgcggagagagagggcaacauggccccaaaggcgagaagggauauccaggaaucccuccggaacugcagauugcuuucauggccucacuggccacacacuuuucuaaccaaaacaguggcauuauuuucuccaguguggaaacaaacaucggcaauuuuuuugaugucaugacagggcgguucggcgcucccguguccggcguguauuuuuucaccuuuucuaugaugaagcacgaggauguugaggagguauacguguauuugaugcauaaugguaacacaguauucaguauguacucuuacgaaaugaagggaaaguccgauaccucaucaaaucaugcuguccuaaaacuggccaaaggcgacgagguuuggcucaggaugggaaacggugcccugcacggcgaucaccagcguuucucaacauucgcaggcuuccuuuuguucgaaacaaaauag

SEQ ID NO: 248879 - RNA, 666 nt, Artificial Sequence
  Description of Artificial Sequence: Synthetic coding sequence
auggcagccgcuagaccauccuuaggucgagugcucccuggcucauccguccuuuuuuugugugacaugcaggagaaauuccgccauaauauagccuacuuuccacagauuguguccguggcagcucgcaugcucaaggucgcucgacugcuagaaguccccgugaugcugacugagcaguauccccaaggucuugggcccacggugccagagcugggaaccgaaggcuuacgcccucuggcuaaaacgugcuucuccauggugccggcacuucagcaagaacuggacagcagaccucaguugaggucgguccugcucuguggaauugaagcccaagccugcauuuuagacccccguucuuacccugggcucgcccucacuaguuuauauccccagaauaccacccucgauuuacuggaucgcggcuugcaggugcaugucguaguggaugcguguagcucucggagccagguggaccggcucguugccuuagcgcggaugagacagagcggagcuuuucucaguacaucagaaggucugauacuacaacuugucggugaugcugugcauccgcaguuuaaagaaauccagaagcuuaucaaagaacccgcgccugauucuggacucuuaggauuguuccaaggucaaaacucccuccuccacuag

SEQ ID NO: 248880 - RNA, 834 nt, Artificial Sequence
  Description of Artificial Sequence: Synthetic coding sequence
auguggcccuuggcacugguuauugcuucacugacgcuggcccucaguggaggcgugucccaggaaucaagcaaaguccugaauacuaauggcacgaguggcuuucuuccaggcggcuauacguguuuuccccauucccagccuuggcaagccgcccuguugguucaaggccggcugcugugcgguggcguucugguucauccuaaguggguuuugacugcugcccauugucuuaaagagggauuaaagguauacuugggaaaacaugcuuugggcagaguugaggcuggcgagcaggucagagaaguugugcacuccaucccacaccccgaauaccguaggaguccaacgcaccugaaucaugaucaugauaucaugcugcucgagcuucaaucaccaguacaguugaccggcuacauucagacucucccccucucccacaauaaccgccugacucccggaaccacuugccggguuuccgguugggguacgacaacaucgccacaggucaauuauccaaaaacccugcagugcgccaauauucagcuccguuccgacgaagaaugcagacaggucuaccccgguaaaaucacggauaacauguuaugcgcuggaacuaaggaggggggcaaggacucuugcgagggagacucugggggcccacugguguguaaucggacucuuuacgguauuguuucuuggggcgauuucccuuguggccaaccugaccggccaggugucuauacaagaguuucccgauaugugcuuuggauuagagagacuaucagaaaauacgagacucagcagcagaaauggcugaagggcccacaguag

SEQ ID NO: 248881 - RNA, 804 nt, Artificial Sequence
  Description of Artificial Sequence: Synthetic coding sequence
augagccugcgugugcucggcaguggaaccuggccaucggcaccuaagauguuucugcuguugacugcccugcaaguacuggcuauugcuaugacacagucccaggaggacgagaacaagauuauagggggacacacuuguacacgcucaucccagccguggcaagccgcccuccuugcuggccccagaagacgguuucuguguggaggggcuuuauuaucgggucaauggguuaucaccgcugcccacuguggccgaccuauccuacagguugcccucggcaagcacaaccugagaagaugggaagcaacacaacagguucugcgcgugguccgacaagugacccacccaaauuacaauucccgcacccaugacaacgaccucaugcucuuacaguugcaacagccugcccgcaucggccgagcaguccgccccauugaggucacccaggcuugugcuucccccggaacauccugucgggucagcggaugggguacaaucucuucaccaauugcccgguacccagccucccuacaaugcguuaacauaaacaucagcccagaugaaguuugccaaaaagccuauccacgcaccauaaccccgggaauggucugcgccggcgugccacagggaggaaaggauagcugccagggugacucuggaggaccucuggucuguagaggccagcugcaggguuugguaaguugggggauggaaagaugcgcccuaccgggguauccgggaguguauacuaaucuauguaaguacagguccuggaucgaggagacaaugcgagacaaauag

SEQ ID NO: 248882 - RNA, 804 nt, Artificial Sequence
  Description of Artificial Sequence: Synthetic coding sequence
augucccugcguguguuagguuccgguacauggccgucagcucccaagauguuccucuuacuuacagcccugcagguucucgccauugccaugacacagucccaggaagaugagaacaagauuaucggagggcacaccugcacccgcuccucacaaccauggcaggcugccuuacuggccggaccucgccgaagguuucugugcgggggugcucuucuauccggucaauggguuaucacagcagcacauugcggccggccaauucuucaagucgcacuggggaaacacaaucugcgcaggugggaagcuacccaacaagugcucagaguggugcgucagguuacacacccaaauuauaauucaaggacacacgacaacgaucuaauguugcugcaacuacagcagcccgcgaggauaggaagagcggugcggcccauagaagugacucaggcaugcgcaucacccggaaccucgugcagggugagcggguggggaaccaucucuaguccgauagcccgauauccagcgaguuuacagugcgucaacaucaauauuucaccugaugaaguuugccagaaagcauacccccgaaccauuacccccgggauggucugugccggaguaccucaaggcggcaaagacucgugccagggggauucuggaggcccccuuguguguagaggccaacugcagggauuagugagcuggggcauggaaagaugcgcacugcccggcuacccaggaguguacaccaacuuguguaaauaccgcagcuggaucgaagaaaccaugcgcgacaaguag

SEQ ID NO: 248883 - RNA, 804 nt, Artificial Sequence
  Description of Artificial Sequence: Synthetic coding sequence
augucgcugagaguucuaggauccgguacguggccauccgccccuaagauguuccuccuguugacugccuuacagguacucgccaucgccaugacacagagccaggaagaugagaauaagauuauuggugggcauaccugcacuagaaguagccagcccuggcaagccgcccugcucgccggcccaagacgacgcuucuuguguggaggggcccugcuuuccgggcagugggucauuaccgccgcucauugcggccgcccgauacuacagguggcucuggguaagcacaaucugcgcaggugggaggcuacacagcaaguuuugcggguugugaggcaagucacucauccaaacuacaacagucggacucacgauaaugaccuuauguugcugcagcugcaacagccagcccgcaucggucgggcgguaagacccauugaaguaacacaagcuugugcaagccccgguaccaguugccgcgucucugguugggggaccaucucaucaccuaucgccagguauccugccagucuccaguguguaaauauaaauaucucaccagacgaagucugucagaaggcuuauccuagaacgauuacuccgggaaugguuugcgccggcgugccacaaggggggaaagauaguugucagggcgauuccggcgguccacuuguguguagaggccaguuacaaggacuaguauccugggguauggaaagaugcgcucugccugguuacccugguguauauacuaaccucugcaaauaccggaguuggauagaggagacaaugcgggacaaauag

SEQ ID NO: 248884 - RNA, 1068 nt, Artificial Sequence
  Description of Artificial Sequence: Synthetic coding sequence
augagucugcgacugcaaucuucuagcgcgucuuacgguggcggcuucggcggggguagcugucagcuagguggagguagaggugugagcacuugcucuaccagguuugugagcggcggaucagcaggcggguauggagguggggugucaugcggauuuggcgguggagcaggcucaggguuugggggaggacuggggggagguuucggaggaggcuuugccggaggcuuuguggacuuuggagcgugugacgguggcuugcugacagggaaugaaaaaaucacaaugcaaaauuuaaaugaucgccuggcaucauaccuggagaaaguccgggcccuugaggaagccaacgccgauuuggaagucaagauacgugacuggcacuugaaacagucccccgccuccccagagcgagacuauucaccuuacuauaaaacgauugaggaguugagagauaaaauacugacagccaccauagagaauaaucgcgugauccuggagaucgauaacgcuaggcuggcugcugacgacuuuagacugaaauacgaaaaugagcuugcacugagacaaagcguugaggccgacauaaacggacugcguagaguccuggaugaguugacccugagcaaaaccgaucuugaaaugcagauugaaucuuugaaugaggagcucgcguauaugaaaaagaaucaugaagaagagaugaaggaauuuagcaaucagguggugggacaagugaacguugaaauggaugccaccccgggaaucgacuugacucgcgugcucgcagagaugcgagagcaguaugaagcaauggcagaacgcaauaggagggacgcggaggaaugguuccauaccaagagcgccgaacugaacaaggagguuagcaccaauaccgcaaugauacaaacgaguaagaccgagaucaccgaacuaagacgaacacuucaagggcuugaaaucgaacugcagucucagcugucuaugaaagcaggauuagaaaacaccgcggcugacccaggcacccaccagcagcaccggggcccggcugaaagagcuccucaguag

SEQ ID NO: 248885 - RNA, 1275 nt, Artificial Sequence
  Description of Artificial Sequence: Synthetic coding sequence
auggauuuuagccgcaggagcuuccauaggagccugucauccagccuacaggcacccgugguaaguacagugggaaugcagcgucuagguacaaccccaucaguguauggcggagcagguggaagggggauccgcaucucaaauucacggcauacagucaauuacggcagugaccugacgggcggaggggaucuauuugucggaaaugagaaaauggcuaugcaaaacuugaacgaccggcuggcaucuuaccuugaaaaaguccgaacucuggagcaguccaauuccaagcuggaggugcagauuaaacagugguacgaaacaaacgcuccacgugccggaagagacuacuccgcuuacuaucgccagauugaagagcugaggucgcagauuaaagacgcccaguugcaaaaugcucgcugugugcuccaaauagacaaugccaagcucgcugccgaggacuucaggcuuaaauaugagacugagcgcgggaucagguuaacugucgaggccgaucugcagggacugaauaagguguucgacgaccuuacuuugcacaagacugauuuggaaauucagaucgaagaguuaaacaaagaucuugcuuuacuaaagaaagaacaccaggaggagguggacggccugcacaaacaccuggggaauaccgucaauguagaaguggacgcagcuccuggacugaaucugggggugauuaugaacgaaaugagacaaaaguacgaaguaauggcacaaaagaaucugcaagaagcaaaggaacaauuugaaagacaaacagcgguacuccaacagcaggugacugugaacaccgaggaguugaaaggcacggaagugcaacugacugaacugaggaggacgucccagucuuuggagauugaacuccagagccauuuaucuaugaaggagagcuuagaacacaccuuggaagaaaccaaagcucgauacucgucacaguuagccaaccuacagucuuuauuaucaucucucgaggcucagcucaugcagauuaggucuaacauggagcgacagaauaaugaauaucacauccugcucgauauuaagacucgcuuggagcaagagauugccaccuaucggcgccugcucgagggagaagaugucaaaaccacugaauaucaacucuccacucuugaggaacgggacauuaagaaaacaagaaaaaucaagacgguggugcaagaggugguggacggaaagguugugaguagugaagugaaagaaguugaagagaauauuuag

SEQ ID NO: 248886 - RNA, 1215 nt, Artificial Sequence
  Description of Artificial Sequence: Synthetic coding sequence
augaguuacucaugcggacugcccucuuuguccugucgaacaagcuguucauccaggccaugcgugcccccaucuugccacggcugcacuuuaccaggugcguguaauaucccagcaaaugucucuaauugcaauugguucugcgaaggaucauucaauggcucugagaaggaaacuaugcaguuccucaaugacagguuggccuccuaucuugaaaaggucagacagcuggaacgcgacaaugccgagcuggaaaauuuaauccgagagaggucucaacaacaggagccauugguuugugccagcuaccagucuuacuucaagacaaucgaagaauuacaacagaagauccugugcagcaaauccgaaaaugcuaggcugguggugcagauugauaacgccaagcucgccagugacgauuuccggacuaaguaugaaacagaacucucguuaagacagcugguugaguccgauauaaauggccugagaagaauacuggaugaacuaacccugugcagaagugaccuggaagcacagguggagucccucaaggaagaacuccugugucugaagcagaaucaugagcaggaagugaauacacugcggugccaguugggggauagacugaauguagaaguggacgccgcuccaaccguggaucugaaucaaguguuaaaugagacaagaagccaauacgaggcacuggucgaaaccaaucggagggaaguggaacagugguuugcgacacagacggaggaguugaauaagcagguaguuagcuccucagagcagcuccagagcuaucaggcugagaucauagaacugcggaggaccgugaaugcccuggaaaucgaacuacaagcgcaacacaaccugagagauucccuggagaauacccuaaccgagagcgaggcgagauacuccucccaauugucacaggugcagagacugauaaccaacgucgagucccaguuggcggaaauuaggucugauuuagagagacagaaucaggaauaccaggugcuauuggaugugcgagcccgacuggaaugcgaaaucaacacauacaggagucugcucgaaagcgaggauuguaagcugcccucaaaccccugcgccacuacuaaugcaugugauaagaguacuggaccuuguauauccaacccuugcggucuaagagcgagaugcgggccauguaauaccuuugguuacuag

SEQ ID NO: 248887 - RNA, 738 nt, Artificial Sequence
  Description of Artificial Sequence: Synthetic coding sequence
auggcaguuauuaucggcgucgcaguaggugccggagucgcauuucucgugcugauggcuacuaucgucgcguucuguugugcaaggucucagcggaaccucaagggcguggugucugcuaagaacgacauaagaguugaaaucgugcauaaggaaccugcaucuggucgugaaggcgaggaacacagcaccaucaagcaacucaugauggauaggggagaguuucagcaggauucaguacugaagcagcuggagguguugaaagaggaggaaaaggaauuucagaacuugaaggauccaaccaauggcuacuauucuguaaauacauucaaagaacaucauaguacaccuacuauuuccuuaucaucuugucaacccgacuugagaccugcagguaagcagcgggugccaacuggcaugucuuuuaccaacaucuacaguacacuguccggacaagguagacuuuaugauuacggccagagauuuguucuggggaugggauccucuuccaucgaacuaugcgaacgcgaauuucaacgagggucucugagcgauagcaguagcuuucuagacacacagugcgauuccucggugaguuccucaggaaaacaagacggauacgugcaauuugauaaagcaagcaaggccagugcgucgagcagucaccacucacaauccagcagccagaauagcgaccccuccaggccccuccagagacgaaugcagacccauguuuag

SEQ ID NO: 248888 - RNA, 2337 nt, Artificial Sequence
  Description of Artificial Sequence: Synthetic coding sequence
augaagccguuucagcuugaucuacuuuucguuuguuucuuucuguucucccaggagcuagggcuccagaaaagaggguguugccuaguccuuggauacauggcuaaagauaaauuucgcagaaugaacgaaggacagguguauuccuucucccaacaaccacaggaccaggucguggugucuggacagccugugacucugcugugcgccauucccgaauacgauggauuugugcucuggauuaaagauggucuggccuuaggcgucggucgggaucuaagcagcuacccacaguaucucguggucgggaaucacuuaucgggugaacaccacuuaaagauccugagagcagaguuacaagacgacgccguguacgaaugccaagcuauucaggcagccauucguuccagaccugcacgccugaccgugcugguaccuccugaugacccugugauacucggcggaccuguuauuuccuugcgcgccggggauccacugaaucuaacaugccacgcugacaaugcgaagcccgcugcgagcaucaucugguuaagaaaaggcgagguaaucaacggagccacauacagcaaaacuuuacuacgugauggaaagcgugaaaguauugucaguacucuauucauuagcccaggagacguggaaaacggccaaaguaucgucuguagagccacaaauaaagcuaucccaggagguaaggaaacuagcgucacgaucgacauccagcauccgccacuggugaaccugucaguugagccucagcccguucuugaggauaacguaguaacauuccauugcuccgcuaaagccaauccggcaguuacacaguaccguugggcaaaaaggggucaaaucaucaaggaggcuucgggcgagguguaucgcacaaccguugacuacacuuauuucucggaacccguaagcugugaagucaccaacgcccugggaaguaccaaccuuucuagaaccguugacguauauuucggaccgagaaugaccaccgaaccacagucccuucugguggaccucgguagcgacgcuauuuuuucuugcgcuuggacgggcaauccaucucugaccauuguguggaugaaacgagguucgggugucgugcugaguaacgaaaagacacuuacacuaaaaagcguuaggcaggaagaugcugguaaguacguuugcagagcugucgucccucgagugggcgccggagaacgggaaguuacccugacgguuaacggaccccccaucauauccagcacacaaacucagcaugcccuucauggagaaaaaggacagaucaagugcuucauucgcuccacuccaccuccugaucgcaucgccuggucauggaaagagaacguccucgaaucuggaacguccgggcgcuacacaguugagacgaucucuacagaagaaggaguuauaucuacccucaccaucaguaacauugugcgagcagauuuucagaccauuuauaacuguacggccuggaauucuuuugguuccgacacugagauaauucgguugaaagagcagggcagcgagaugaaguccggggcagggcuugaagccgaaucagucccuauggcaguuauaauaggaguggcgguuggagccggcguggccuuccuggugcuaauggcgacuauuguugcauuuugcugcgcaagaucccagagaaaccuuaaaggcguggucuccgcuaagaacgauauaagggucgagauuguccacaaagaacccgcgagcggccgcgaaggggaggagcauagcacaauuaagcagcuaaugauggauagaggcgaguuccagcaagauuccguucucaaacaguuggaagucuugaaggaggaggagaaagaauuucaaaaccuaaaggaucccaccaacggauacuacagcgugaacaccuuuaaagagcaccacuccacccccacaaucaguuuaagcaguugucagccggaccuuaggccugcugguaaacagcgagucccaacaggaaugucauucacuaauaucuacuccacauugagcggucagggcagauuguacgacuacggacagcgcuuugugcuuggcaugggguccuccucaaucgaacugugugagcgcgaauuucaaaggggcucacuuuccgacucuucaucauuucucgacacgcagugugacucaagcguuucuucguccggcaaacaggauggguacguucaauucgacaaagcuaguaaagcaagugccaguucuagccaccacagccagucauccucacaaaauucugauccuucucgcccauuacagcggagaaugcaaacucacguguag

SEQ ID NO: 248889 - RNA, 1803 nt, Artificial Sequence
  Description of Artificial Sequence: Synthetic coding sequence
augaagcccuuucaacuggaucuuuuguucgucugcuucuuucuguucagccaagagcuggguuugcaaaagcggggcuguugucuggugcugggauauauggccaaggauaaauuucgaagaaugaaugaaggacaagucuacuccuucucccaacagccccaggaucaaguggugguauccggccagcccguaacgcuauuaugugcaauuccugaguacgauggauuuguccucuggaucaaggauggucucgcuuuggguguggguagagaccugaguaguuauccccaauacuugguggucggaaaucaccugucuggagaacaucaccuaaagauucugcgggcugaacuccaggacgacgcagucuaugagugucaagccauccaggccgcuauucguagccgaccagcacgcuuaacuguguuagugcccccugaugaccccguaauucugggaggaccggucauuuccuuacgugcuggggacccuuugaaucucacaugucaugcugauaacgcaaaaccugccgcuuccauuaucuggcugaggaagggagaaguuaucaauggagcaacauauagcaagacgcuccugagagaugguaaaagggagagcaucguaaguacauuguuuaucucuccaggggacguggaaaauggccaaagcaucguaugucgugccacuaauaaagcaauacccggcgguaaagagacaucaguaacaaucgauauccagcacccaccucucgucaaccucucaguggaaccucagccuguccuggaggauaacguugugacauuucacuguucagcaaaggccaauccugccgugacucaauacagaugggcgaagagggggcaaauuauuaaagaggcgucuggggagguguauagaacaacugucgacuacacuuauuucucugagccugugucaugugaagugaccaacgcccucggaaguacaaaucuuuccaggacugucgauguauacuuuggaccuaggaugaccacugaaccacagucgcugcuggucgacuugggaagcgaugcuaucuuuucaugugccuggaccggaaauccuagccugaccauuguuuggaugaaaagggguagcggagucguguugaguaacgagaaaacucugacacugaaaucuguaagacaggaagacgccggaaaguaugugugccgggcuguuguuccccgcguuggagcaggugagcgcgagguuacccucacagugaacggaccgccuaucaucuccucuacucagacacagcaugcacuucauggugagaaagggcaaauaaagugcuucauucggucaacacccccacccgaccguaucgcuuggagcuggaaggagaaugugcucgagagugggacuucagggagguacacaguggagaccauuucuaccgaagagggaguuauaagcacacugacaauuucuaacauaguaagggcagauuuucaaacuaucuacaauuguacagcauggaauucauuuggcucugauaccgagaucaucagacugaaagagcagggaucagaaaugaaaagcggcgcaggccuugaggcagaguccgugcccauggcggugaucauugggguggccguaggagcugggguugccuuucucguucugauggcgacaauaguagcuuuuuguugugcucgaucucaacgaagcacagguggcagaagcgggauuaguggacgaggaacagagaaaaaagcccgccugcgauugccucgaagggcaucuaaacaggagugcaacgagcaggggaguuag

SEQ ID NO: 248890 - RNA, 2301 nt, Artificial Sequence
  Description of Artificial Sequence: Synthetic coding sequence
augaaaccuuuucagcuggaccuacucuucguuuguuucuuccucuucucgcaggaacuaggacuccagaagcgggguuguugucucgugcugggguacauggccaaggauaaguuccggagaaugaaugaaggucagguuuacucuuuuucccaacaaccucaggaucagguugugguuuccggacagcccgugacccugcuuugcgccauacccgaauaugacggcuucguauuauggauaaaagauggacuggcucucggcguggggagagacuuaaguucauauccacaguaccucgugguuggaaaccauuugagcggagagcaccauuugaagauuuuacgcgccgagcugcaagacgacgcuguguacgaaugucaggcgauacaggccgcuauucggucuagacccgcccgacugacaguucugguccccccugacgaucccgugauacugggcggcccugucauuuccuugcgagcaggagauccgcuaaaucucacgugccacgccgacaacgcaaagccugccgccucaauuauuugguuaaggaaaggcgaagugauuaauggagcaacauauucaaagaccuugcugcgcgaugguaagcgcgagagcauaguaucaacccuauucaucucacccggagacgucgagaauggacagagcaucguguguagggcaacaaauaaagccaucccgggcggaaaagagacaucuguuacaaucgacauucagcaccccccgcuugugaaccucucugucgagccccagcccgugcuagaagacaaugucgugacuuuccacuguucugcuaaagcgaaccccgcagugacucaguaucgaugggccaaacgcggucaaaucauuaaggaagcaagcggcgaaguguaccgcacaaccgucgacuacacauauuucucggaacccgugaguugcgaaguuaccaacgcuuuaggaucaacaaaccucucucggacaguggauguguacuuugggccaaggaugacaacugagccacagucccugcuuguagaccugggaucagaugcuauauucaguugugcguggacgggaaauccuucuuugacuaucguguggaugaagagagggucuggcgucgugcugucaaacgagaaaacacuaacgcuuaagucuguuagacaagaggacgccggcaaauacgugugcagagcaguaguuccuagagucggugcaggcgagcgcgaggucacacuaaccguuaacggacccccuaucaucucauccacccagacacagcaugcgcugcacggggaaaaaggucaaauuaaaugcuuuauuagaucgacaccaccacccgacagaaucgcuuggagcuggaaagagaaugucuuggagagcgggacuagcgggagauacacuguggagacaaucucaaccgaggaaggcgugauaucaacacugacuauuucaaauauugugagggccgacuuccaaacuauauauaacugcaccgcuuggaacaguuucgguucggacacugaaauaauucgguugaaagaacaagaaaguguaccaauggcagugauuaucgguguugcagugggagcuggcguggccuucuuagugcugauggcaaccauugucgcuuuuugcugugcgcgcucgcaacgaaacuugaaggguguugucucagcgaaaaacgauauacgagucgaaauagugcacaaggagccagccagugggagggaaggagaagagcauaguacgauuaaacagcugaugauggaucgcggggaguuucagcaggauuccgugcuuaagcaacuggaaguguuaaaagaagaggagaaagaguuccagaauuugaaagacccgacuaacggcuauuauucuguaaacaccuucaaggaacaccauucgacaccuacgaucucucugaguagcugucagccagaucugaggccggcuggaaagcagcgagugccaacgggaauguccuucaccaauaucuacaguacacuguccgggcaagguagacucuaugacuaugggcaaagauucgugcuuggcaugggcaguucaucuauugaguuaugcgaacgcgaguuccagaggggcucccugagcgauuccucaagcuuuuuagauacacagugcgauucauccgucucuaguucuggaaagcaggacggauauguucaauuugauaaagccaguaaggcaucagcaaguaguagucaccauucccaaagcagcucucagaauucagauccaucccgacccuuacaacgacgcaugcagacucacgucuag

SEQ ID NO: 248891 - RNA, 1998 nt, Artificial Sequence
  Description of Artificial Sequence: Synthetic coding sequence
auggccgcuggaggaucuacacagcaacgacgacgugagauggccgccgccagugcagcugcaauauccggcgccgggcgcugucgacuuuccaagauaggagccacucggaggccuccacccgccagggucagaguggccgugagacucaggcccuucgucgacggaacggcaggugcuagcgacccaccuugcguccgggguauggacucuuguaguuuggaaauugcgaauuggaggaaccaucaagagacacucaaauaccaguuugacgcuuucuacggcgaacgaagcacgcagcaagauaucuaugccggcucgguccagccuauucuacgucaccuucuugaaggacagaaugccuccgugcucgcauacgggccaacgggcgccgggaaaacacacacaaugcuggggagucccgaacagccaggcgucauaccccgcgcccuaauggaucuucuccagcuuacacgagaggaaggcgccgaaggaagaccuugggccuugagugucaccaugucauacuuggagauuuaccaagagaaggugcucgauuuguuagacccugccucuggagaucuggugauuagagaggauugucgggggaacauuuuaaucccuggacuaucccagaaaccuaucucaaguuucgcugauuucgagagacacuuucugccugcgucuaggaaucgcaccgugggcgcuacacggcucaaucaacggaguucuagaagucacgccgugcugcuugugaaaguugaucagagagaacgccuugcgcccuucagacaacgcgagggaaagcucuauuugauugaccuagcuggaagcgaagacaaucggaggaccggaaauaagggccugagacuuaaagaaagcggagccaucaauacaagucuguuugugcuugguaaaguugucgaugcgcugaaucaaggacuucccagggugccauaccgcgauucaaaacuaacacggcugcuacaggauagccucggcggaagugcccacucuaucuuaauagcgaauaucgcuccagagcggagauucuaccucgauaccgugucagcacucaauuucgcagcccgcuccaaagagguaaucaaucguccuuucaccaaugagucguuacagccacacgcccuggguccuguuaagcugucccagaaagaacuccucggccccccugaagcgaagcgcgcacggggcccagaagaggaagagaucgguuccccagagccuauggccgcaccugcaagugcuucacaaaaauuguccccucuucagaaauuaaguucuauggauccugcaaugcuggaacgauugcugagccuggaccgacugcucgcuucccaaggcagccagggcgcccccuuacucuccacccccaagcgcgagagaauggugcugaugaagacaguugaggagaaagaccuugaaauugaaaggcugaaaacaaagcagaaggagcucgaagcuaagaugcuggcccagaaggcugaggagaaggaaaaucauugccccacgauguugaggccgcuaucucaccgaacagugacaggugcuaagccucugaaaaaagccguggucaugcccuuacaguugauccaggaacaagccgccagucccaacgccgaaauccacauccucaagaacaaaggacgcaaacgcaaacuggagucacuggacgcucuagaacccgaagagaaggcugaggauuguugggaguuacagaucucgccugaguugcuggcucacgggaggcagaagaucuuagacuuacuuaacgaaggcagcgcccgcgaucugcgcuccuugcagcgaaucggaccaaaaaaagcccagcucaucguggguuggagagagcuucaugggcccuucucccagguugaggacuuagaaagaguggaaggaauuacaggaaaacagauggaguccuuucugaaagcuaacauucuuggacuagcagcuggacagagauguggggcguccuag

SEQ ID NO: 248892 - RNA, 1065 nt, Artificial Sequence
  Description of Artificial Sequence: Synthetic coding sequence
augcaaggucuauuauucucuacccuacugcuggcaggauuagcacaguuuuguugccgugugcaggggacaggaccucucgacaccacaccagaaggacguccaggagaggugagcgaugcgccccagagaaaacaauucugccacuggccauguaaauguccgcagcagaaaccacggugcccuccaggugucagucugguuagagauggguguggaugcuguaaaaucugugccaagcagccaggcgagauuugcaacgaagccgauuuaugcgauccacacaaagggcuguauugugacuauucuguugauagaccaagauacgagaccggggugugcgcuuauuuggucgccguuggaugcgaguuuaaccagguucacuaucacaauggccaggucuuccagcccaacccucuguuuagcugccugugcgucaguggugcaauuggauguacuccucucuuuauucccaaacuugcaggcucacauugcagcggggcuaaaggcggaaaaaaaagcgaucagagcaauugcucuuuggaaccgcuccugcagcagcucucuaccuccuauaaaacgaugcccgcauacagaaaucuacccuugaucuggaagaagaagugccuggugcaggccacgaaguggaccccguguagccggaccuguggcaugggaauuuccaaucgugugaccaacgaaaauucuaacugcgagaugagaaaagaaaaacgccuuuguuauauccagcccugugacagcaacaucuuaaaaacaaucaaaauaccaaaaggcaaaaccugucagcccaccuuucagcucagcaaggccgaaaaguuuguguucagcggauguuccuccacccaauccuauaagcccaccuucugcgguaucugccucgacaaacguugcugcauccccaacaagagcaagaugaucacaauucaauucgacugcccgaacgagggcucauuuaaauggaaaaugcuguggauaaccucgugugugugucagagaaauugucgcgaaccuggggacaucuuuuccgaacucaagauccuuuag

SEQ ID NO: 248893 - RNA, 267 nt, Artificial Sequence; identical to SEQ ID NO: 248287
  Description of Artificial Sequence: Synthetic coding sequence

SEQ ID NO: 248894 - RNA, 363 nt, Artificial Sequence
  Description of Artificial Sequence: Synthetic coding sequence
auggcucuaucgucagcuuggagauccguccuuccccuauggcucuugugguccgcagcauguucacgcgccgcuucaggcgacgacaacgccuuuccuuuugacauugagggaucgagugccguuggccggcaggaccccccugagacaucugaaccacguguagcccuggguagauuaccccccgccgccgaaguccagugccccugccacugccaccccgcuggggcaccagcacccccucgggcagucccccacucuucuuucuccuuaucaccaccccuuuccagcccgcaauguuuagaaucuuucacaugggccagaucaguucggaaacuggaaauaaagagcuuuccauuguag

SEQ ID NO: 248895 - RNA, 549 nt, Artificial Sequence
  Description of Artificial Sequence: Synthetic coding sequence
auggccuuguccuccgccuggagauccgugcucccucucuggcuccuuuggagugcugcuugcagccgcgcugcgucuggagacgauaacgcuuuucccuucgacauagagggaucuucugcugucgggcgacaagauccucccgaaacauccgagccucgcgucgcacugggucgucuuccuccugccgccgagaaauguaacgccggcuucuuucacaccuuguccggggagugugugccaugugacugcaacgggaauagcaaugaaugccuagauggcucaggguauuguguucauugucagcguaauaccaccggggagcauugcgaaaagugcuuggauggcuauaucggagacucuauuagaggagcuccccaguucugucaaccuuguccaugcccucuuccacaucuggccaauuucgcggaaucgugcuaccgaaagaauggagcugugagguguaucuguaaugagaacuaugcuggaccuaacugcgagagacccaguccacagucuacacgaggauucccacugaaugauucauag

SEQ ID NO: 248896 - RNA, 537 nt, Artificial Sequence
  Description of Artificial Sequence: Synthetic coding sequence
ugaauuuucgaggacugugacgaaguaacgggccaaugccguaacugccuacggaacacuacuggauuuaaaugcgaaaggugugcuccugguuauuauggcgaugcgaggaucgcuaagaacugcgcggucugcaauugugguggagggccuugcgauagcguuacuggcgaguguuuggaagaaggcuucgaaccuccgaccggcauggauugcccuaccauuuccugcgacaaaugugugugggaccuuaccgaugcacugagacuggcggcacuaucuauugaagaggggaaaucaggaguucucucgguguccuccggggccgcggcgcacaggcaugugaacgagaucaacgccacuaucuaucuccuuaagaccaaacucagcgaaagagagaaccaguacgcacuuagaaaaauucagauuaacaaugccgaaaacacaaugaaaucccugcugagugacguagaagaacucguugaaaaacauuggaacaagccuagacgcagauuagaacugcaagaagguguuuag

SEQ ID NO: 248897 - RNA, 5451 nt, Artificial Sequence
  Description of Artificial Sequence: Synthetic coding sequence
auggccuuguccagcgccuggcggucugugcuaccacuguggcugcugugguccgcagcuugcucucgcgcugcguccggggacgacaacgcuuuucccuuugacauugagggcucuuccgccgugggacgacaagauccucccgagacgucagaaccuagaguggcgcugggacgcuuaccaccugcugcagaaaaaugcaaugccgguuucuuucauacgcugucaggagaguguguccccugugacuguaauggaaauuccaacgaaugucucgacgguuccgguuacugcguucacugccaaagaaauaccaccggcgaacauugcgagaaaugccuggauggauacauuggcgacuccauccgcggcgccccccaauucugccagccgugcccaugcccacucccucacuuggccaacuucgcagaaagcuguuaucgcaagaauggagcuguuagauguauuugcaaugaaaauuacgcugggcccaacugugagcgaugcgccccaggauauuacggaaauccccuccugauuggaaguacuugcaaaaagugugacugcuccggcaacucugacccgaaucugauauuugaggauugugacgaaguaacuggccagugccguaacugucucagaaauacaacaggguucaagugugagagaugcgccccagguuauuacggagaugcaagaauagccaagaauugugcuguuugcaacugugggggugggcccugcgauucugugacuggcgagugucuggaggaaggguuugaaccgccgaccggcugcgauaagugugugugggaucuuaccgaugcccugcggcuugcugccuuguccauugaagaagggaagaguggcguguuaagugugaguucuggggccgcggcacaccgccacgugaacgaaauaaacgcuacaaucuacuugcucaaaaccaaacugucugaaagagagaaccaguaugcccuccggaaaauccagauuaacaaugcggaaaauacaaugaagucuuugcuuagugauguugaggaacucguugagaaagagaaccaggcaucaaggaaaggucaacucgugcagaaggagaguauggauacaauaaaucaugcaucccagcucguugaacaggcacaugacaugagagacaaaauucaggagaucaauaauaagauguuauauuacggagaggagcaugaauugucacccaaagagauaucagaaaaacucgugcuggcucagaaaaugcuggaggagauucggucaagacagccuuucuuuacccagcgggagcuuguagaugaggaggccgaugaagccuaugaacuguugucccaagcggaauccuggcagaggcugcacaaugagacucgcacacuuuuccccgugguacuggagcagcuggacgacuauaacgcaaaacuuagugaucugcaggaggcccuagaccaggcuuuaaauuacgugcgggacgccgaagauaugaauagggcuacugcggccaggcagcgggaccaugagaagcagcaagaaagaguucgugagcagauggaagucgucaacaugucguuauccacaagcgcugacagcuugacaacgccuagacugacccucagcgagcucgaugacauuauuaagaaugccuccggaaucuaugcagaaaucgacggggcgaaaucagaguugcaagucaaacucagcaauuuaagcaaccuuucucacgauuuaguccaggaagccauugaccacgcgcaggaccuccaacaggaagcuaaugagcugucaagaaagcuucauucaucugauaugaauggccucguacaaaaggcccuggaugcaaguaacguauacgaaaauauugugaacuauguuuccgaggccaaugaaacagccgaauucgcccugaacacgacugacagaauauaugaugccgucagcggaauagauacacagauaaucuaucacaaagacgagagcgagaaccuccugaaccaagcuagggaauuacaggcaaaagcagaguccuccuccgaugaggcuguggcggacacuagucggcggguuggaggagccuuggccagaaagucagcccuuaaaacacgguuaucugacgcuguuaaacaguuacaagcagcggaaagaggugacgcacaacagcgacucggacaaucaaggcuuauuacagaagaggcgaacagaaccacuauggaagugcagcaagcaacagcaccgauggcuaacaaucucacaaacuggucacagaaccugcaacauuuugauucauccgcuuacaauacugccgugaacuccgcucgcgacgccgugagaaaucuaacggaagucgugccgcagcugcuggaccagcuucgaacuguugagcagaaacggccugcaagcaaugugagugccagcauucaacggauccgagaacugaucgcacagacaagaaguguggcauccaaaauucaagucaguaugauguuugauggacagagcgcaguugaagugcauucaagaacgaguauggaugacuugaaagccuuuacaucucucucgcuguacaugaaaccaccugugaaacguccagagcuuaccgagacugccgaccaguuuauccuguacuuggggucaaaaaacgcuaaaaaagaguauaugggucucgcgauaaagaacgacaaccuaguguacgucuauaacuuaggaaccaaggacgucgaaaucccucuagacaguaagcccguguccaguuggccugcuuacuucucgaucgugaaaaucgagcgcgugggaaagcacggaaaaguguucuuaacagugccgucucuaagcuccaccgccgaagaaaaauucaucaagaaaggcgaauuuagcggagacgauagucuguuggaucuggaccccgaggacaccgucuucuacguggguggcgucccaucuaauuuuaaauugccaacaucauugaaccugccaggauucguaggaugucucgaguuagcaacccugaacaacgacgugauaucacucuacaauuucaaacacaucuacaauauggaucccucuaccuccguuccaugcgcccgagauaaauuagccuuuacacagucgcgggcagcuuccuauuuuuuugacggaucaggguaugccgugguuagagauauuacgcggcgcgguaaguucggccaggugaccagguuugauauugaaguaagaaccccugcagacaacggccugauccuccugaugguuaauggaaguauguucuucagacuugagaugagaaacggguaccugcauguguucuaugacuuuggauucucuggaggaccagugcaccuggaggacacucugaagaaagcucaaauaaacgacgcuaaauaucaugaaauauccaucaucuaucauaacgacaagaaaaugauucugguggucgauagaagacacgugaaauccauggauaaugaaaaaaugaaaauccccuucaccgacauuuacaucggcggagcuccucccgagauccugcagucacgugcauugcgggcucacuugccacuugacauuaauuuucgggguuguaugaaaggcuuccaauuccagaaaaaagauuuuaauuuacuggaacaaacugagacgcuuggaguggguuacggaugccccgaagacagccucaucucccggagggcuuauuuuaauggacaaagcuucaucgcuucuauucagaagauuucauucuuugacggcuucgaggggggcuucaacuuuagaacucugcagccaaaugggcuauuauuuuacuacgcuaguggcagcgacguuuucucaaucagccucgauaacgggaccguaaucauggacguuaaggguauaaaagugcagagcguggacaaacaguauaacgacggccucagccauuucgugaucucaucggugagccccacaagauaugaacugaucguugacaaaucaagagucggauccaagaacccaaccaagggcaaaauagaacaaacacaagcuucagagaaaaaguuuuauuuugguggcaguccuaucucggcccaauacgcuaacuucacaggauguaucaguaacgcuuauuuuacccggguagacagagauguagagguugaagauuuccaacgauacaccgagaagguacauacaagucuguacgagugcccgauagaauccagcccuuuauuccuccugcacaaaaagggcaagaacuugaguaagccgaaggcaucacaaaacaagaaaggaggaaaaaguaaagaugcccccagcugggaccccguugcccugaagcugccugaacgaaauaccccccggaacucacauugccaccucaguaacucccccagagccauugaacaugccuaccaauauggagguaccgcuaacaguagacaggaauuugagcauuugaaaggagauuuuggugcuaagucucaguucucuauuagacuucgaaccagaagcucucacgguaugauuuucuacguuagugaucaggaggagaaugacuucaugaccuuguuccuggcucacggucgcuuagucuacauguuuaaugugggucacaagaaauuaaagauuaggucacaggagaaguacaacgacggauuauggcacgacguuaucuucauuagagagagaucaucaggcagacuuguuauugacgguuugagaguacucgaggaaagccuaccgccaaccgaggcaaccuggaagauuaaagggccuaucuauuuagguggaguggcuccaggaaaagcugugaaaaacguucagaucaauuccauuuacagcuuuucagggugucugagcaaccuucagcuuaacggcgcaucuaucacaagugcaucucaaacauuuucugugacccccuguuuugaaggcccuauggaaacuggcaccuauuuuucaaccgagggugguuacgugguccuggaugagucauucaacaucggcuugaaguucgaaauagccuuugaaguaagacccagaucuagcagcggaaccuuagugcacggacauagcgugaacggugaguaucucaauguucacaugaagaacggacaggugaucgugaagguuaauaacggaauucgagacuuuucuaccuccguuaccccuaaacaaagcuuaugugacgggcgcuggcacaggauuaccgugauuagagacucaaacguagugcagcucgauguggacagugagguuaaccaugucguugggccccuuaaccccaagccaaucgaucaccgugaacccguuuucguggggggggucccugagucccugcugaccccaagauuagcuccuuccaagcccuucaccgguuguaucagacacuucgugaucgacgggcauccaguuucuuucuccaaagcugcuuuaguauccggugccgucucuauuaauuccugccccgcugcuuag

SEQ ID NO: 248898 - RNA, 5451 nt, Artificial Sequence
  Description of Artificial Sequence: Synthetic coding sequence
auggcccugaguucagcuuggcggucuguguuaccccugugguuguuguggagcgccgccuguucccgcgcugcuucgggugacgauaaugcuuuuccuuuugauauugagggcucuuccgccgugggucgccaagauccucccgagaccucugagccucgcguugcccuggggcgccuucccccggcugcagagaaguguaacgcagguuuuuuccacaccuuaagcggugaaugcgugccaugugauuguaauggaaauucaaacgaaugucuggaugggaguggauacuguguucacugucaacguaauacgaccggcgagcauugcgaaaagugccucgauggguacaucggagauucuauccgaggcgcaccucaauuuugccaaccuugucccugcccauuaccucaccuggcuaacuuugccgaaucauguuauagaaagaauggggccgugcgcuguauauguaacgagaauuacgccggcccaaauugcgagagaugcgcgcccgguuacuauggcaacccccugcugauuggaucaacguguaaaaaaugcgacugcucuggaaauuccgaccccaacuuaaucuucgaagacugugacgaggugaccgggcaaugccgaaauugcuugaggaauacuacuggcuucaaaugugagcgaugugcccccggauacuauggcgaugcuaggauagcuaaaaauugcgcuguauguaacugcggaggcgggccaugcgacuccgucacaggcgagugucuggaggaaggauuugaacccccaaccggcugcgacaaaugcgugugggaccugacugaugcccugaggcuggcugcguugucuauugaggaagguaagucuggcgugcugaguguuuccaguggugccgcugcacaccggcacgugaacgagaucaaugccacgaucuaccuccugaaaacuaagcuuucugagcgagagaaccaauacgcccuccggaagauucaaaucaauaacgccgagaauacaaugaagagccuccugagcgaugucgaagaguuaguagaaaaagaaaaccaagcaagucggaaaggccagcucgugcagaaagaaagcauggacacuaucaaucaugccucucaacugguugagcaggcccacgacaugagagacaaaauccaagagauaaauaauaaaaugcucuacuauggggaagagcaugagcucagcccuaaggagauaagcgaaaagcugguccuggcucagaaaauguuggaggaaauuagauccagacagccauucuuuacacagcgagaacuuguggacgaagaagccgaugaggcguaugaacuauugucacaagccgaauccuggcagagauugcacaaugagacccggacucuuuucccagucgugcucgaacaacuugacgacuacaaugccaagcuaucagaucugcaggaagcucuugaccaggcgcugaauuacguucgugacgcugaagauaugaacagagccacggcugcgcgccaaagagaccaugagaagcagcaggagcgaguaagggaacaaauggaagucgugaauaugagccucucaacauccgcugauucucucaccacaccacgauugacgcuuagugaacuggaugacauaauuaagaaugccuccggaaucuacgcagaaauugauggcgcaaaaagugaacugcagguaaaacugucuaaccuuucaaaccucagccaugacuuaguucaggaggcuauugaucaugcccaggaucugcaacaagaagcaaacgaacuuucacgcaagcugcauucauccgauaugaauggccucgugcagaaagcacucgacgcgucaaacguguaugaaaacauugugaauuaugugucugaagcuaaugagaccgcugaauucgccuugaacacuacugauaggaucuaugaugcaguuuccggaaucgauacccagaucaucuaccacaaggacgaaucagagaaccuacugaaccaggcucgggaacuccaagcaaaagcugaauccucuagugacgaagcagucgcugacaccucacggcgggugggaggcgcacucgcgaggaagucugcccuaaaaacuaggcuuucggacgccgucaaacaauugcaagcagccgagagaggugacgcgcagcagagacucggccagucaaggcugauuacugaagaggcuaauagaacuacaauggaggugcaacaggccaccgccccaauggccaacaaucuaacaaacuggagccagaaccugcaacauuuugacucuagcgcguacaauacagccgugaacucagccagggacgccgugcgaaaucugaccgaagugguuccccagcuccucgaccaacugcgcacaguggaacaaaaacggccagccucuaaugucucugcaucaauacaaaggauucgggaacugauagcacagacaagauccgucgccucaaaaauccaaguuagcaugauguuugacgggcaauccgccgucgaagugcauucgcgaaccucuauggaugaccugaaagcauuuacaucacugagucuguauaugaagccccccguuaagcgacccgagcucaccgagacagcugaccaauucauccuuuaucugggguccaagaacgcuaaaaaggaauacauggggcuggcaauaaaaaacgacaaucuuguguacgucuauaacuuagggacuaaagacguggagaucccucuagacaguaaacccgugucgucuuggccugcauauuucucaauugucaaaaucgaaagaguuggcaaacacgggaaaguuuuuuugaccguucccucauuaagcagcacugccgaggagaaauuuauuaaaaagggcgaauuuucuggugacgauucccuacuggaucuugacccugaagacacaguauuuuacguugguggcguuccuucuaacuucaaacugcccaccucucugaaccugccuggauuuguuggcugucucgaacuggcaacccugaauaacgauguaauaucacuauacaacuucaagcauauuuauaauauggacccaagcaccagugucccaugcgcccgagauaagcuggccuuuacccagucuagagcagccagcuacuuuuuugacggcucaggcuacgcuguaguaagagacauaacccgcagaggaaaguucggacaaguuacgagauucgauaucgagguaagaacuccugcagacaauggguuaauccuccugaugguuaacggaucuauguucuucagacuggagaugaggaacggauaucugcauguauucuacgacuucggcuucagcgggggaccgguccaccucgaagacacacuuaaaaaggcacaaauaaacgaugcgaaguaccacgaaauaagcaucauuuaucacaacgacaagaagaugauccuggugguggaucgacggcacgucaagaguauggacaaugaaaagaugaaaaucccuuucacggauaucuacaucggcggcgcaccccccgaaauccuccaaucgcgagcacuuagagcacaucuuccacuggauaucaacuuuagaggauguaugaagggguuccaauuccagaaaaaagacuuuaaccugcuugaacaaacugaaacccucgguguugguuacggaugucccgaagauuccuuaauuucccguagagcauacuucaacggccaaaguuucauugcauccauccagaaaaucagcuucuuugacggguucgaagggggguuuaacuuuagaacacugcagccuaauggacuacucuuuuacuacgcgagcggcucggauguguuuagcauaucacucgacaacgggacugucaucauggacguuaagggcauaaaggugcaguccguugauaaacaguacaaugauggccugucacacuuuguaaucucuucagucucucccacucgguacgagcuaaucguugauaaauccaggguuggaagcaagaaccccacaaaaggcaaaauugagcagacucaagccuccgaaaaaaaauuuuacuuuggcgggucuccaaucuccgcacaguacgcaaacuuuacagggugcauaucgaaugcauacuuuacgagagucgacagggaugucgaggucgaagauuuccagagauacacagaaaagguccacacuucauuguaugagugcccuauagaaucuucuccccuuuuucugcugcacaaaaaaggcaaaaaccucagcaagccuaaagcaagccaaaacaagaaaggcgggaagagcaaagacgccccgagcugggauccuguggcucugaagcugcccgagagaaauacacccaggaauagucauugucaccuauccaacucgcccagggcuauugagcacgccuaucaauacggaggaacggcaaacucucgucaagaauuugagcaucucaaaggagauuuuggagccaaaagccaguuuagcauaaggcuacgaacacgcucaucacauggaaugauuuucuacgucucagaucaagaagagaaugacuuuaugacuuuguuccuggcucacggaagauugguguauauguucaacgugggucacaagaagcuaaagauucggucacaagaaaaauacaaugauggucuauggcaugauguuaucuucauacgugaacggucaaguggacgccucguuauugauggccugagaguacuugaggaguccuuaccuccuaccgaagcuacauggaagaucaaaggcccuaucuaucugggcggggucgcucccggaaaagccgugaaaaacgugcagaucaauucuaucuauucuuuuucaggaugccuuaguaaccugcaguuaaauggagccucuauaacuagcgcaagccagacuuuuucagucacuccaugcuucgaggggccuauggaaaccggcacguacuuuuccacagagggcggcuacguaguguuggaugaguccuucaauaucggccucaaguuugaaauugcauucgaaguccgacccaggucaucuucaggaacucuagugcauggccauucugucaauggcgaauaucucaacguccacaugaagaacggccagguaauagugaaaguuaauaacgguauuagggauuucagcacuuccguaacaccuaagcagucccugugcgacggaagauggcaccgaaucaccgugauucgugacaguaauguuguccagcucgacguagacagcgaggugaaccauguaguagguccauuaaacccuaaacccaucgaucaucgcgagccagucuuugucggcggugugccugaaucccugcucacaccccgccuugcucccuccaaaccuuuuaccggcuguauucgccacuuugugaucgacggucacccugucuccuucucuaaagcagcccuuguuagcggagccgugucuaucaauucauguccagcagccuag

SEQ ID NO: 248899 - RNA, 390 nt, Artificial Sequence
  Description of Artificial Sequence: Synthetic coding sequence
auggccuuaaguagugccuggcggucggucuuaccacucuggcuuuuguggagugcugcguguucacgggcugccuccggcgacgauaacgcuuuucccuuugauaucgaaggcucaucugcagucgggcgacaggaucccccagaaacaagugaaccuagaguggccuuggggcggcuaccccccgcagcagaaaaauguaacgccggauucuuccauacacucucaggggaaugcgucccgugugacugcaauggcaauaguaaugaaugccuugacgguaguggcuauuguguaacuaccgauggcgaagaccccggguucucagccucagcguugucauucauucuuuccucucaaggcgcucgcgaagccagggcuccaaccuag

SEQ ID NO: 248900 - RNA, 363 nt, Artificial Sequence
  Description of Artificial Sequence: Synthetic coding sequence
auggccuuaucuagugcuuggcguucgguucugccccuguggcuacugugguccgcagcauguucucgggccgcaucaggugaugacaaugccuuuccauuugacaucgaggguuccuccgcuguuggcaggcaagauccuccugaaacuucagaaccacggguggccuugggcaggcucccaccagccgcagagguacagugucccugccauugccaccccgccggagcucccgcucccccccgugccgugccccauucuaguuuuucucuaaguccaccccucagcucaccacaguguuuggaaucauucaccugggcucgcuccguacgaaaacuugaaauuaaguccuucccacucuag

SEQ ID NO: 248901 - RNA, 1125 nt, Artificial Sequence
  Description of Artificial Sequence: Synthetic coding sequence
auggcucugagcucugccuggcgaucuguacuuccccuguggcuucucuggucugcugccuguucacgcgcugcaagcggcgaugauaacgccuuucccuuugauauugaaggaaguucugccguugguagacaggacccgcccgaaaccagugaaccucgcguggcgcugggccgacucccaccugcagcugagaaauguaaugcuggauuuuuccacacccuuagcggugaaugugucccgugcgacuguaaugguaacagcaaugaguguuuagacgguucuggcuauugcgugcauugccaaaggaauacgacuggcgaacauugcgaaaaaugucuggacggauauauaggagauagcauucgcggcgccccccaguucugccagccuugcccaugcccuuuaccccaccuugcuaacuuugcugaguccugcuaccggaaaaauggagcugugagaugcauuuguaaugagaauuacgcgggccccaacugcgagcggugcgcaccagguuauuaugguaaucccuuacucauugggucuacaugcaagaaaugcgacugcucggggaacucugaccccaacuuaaucuucgaggacugcgaugaaguuaccggucagugucgaaauugccuccgaaacacuacaggcuucaaaugugagcgaugcgccccuggauacuauggagaugcacgaauugcgaagaacugcgccguaugcaacuguggcggcgggcccugcgauagugucacaggcgagugucuugaagagggguuugaaccuccuaccggaauggauugucccacaaucucuugcgacaaaugcgucugggaccugaccgacgccuugcgacuggccgcuuuaucaauugaagagggaaagagcgguguacugagcgugucauccggagcugcugcucaccgccacguuaacgaaauaaaugccacuaucuaccuucuuaagacuaaacuaucagaacgagagaaccaauacgcucugagaaagauccagauaaacaaugccgagaacaccaugaaaaguuugcugagugaugucgaggaacuugucgagaaacacuggaacaaaccuagacggagacuggagcuccaggagggugucuag

SEQ ID NO: 248902 - RNA, 363 nt, Artificial Sequence
  Description of Artificial Sequence: Synthetic coding sequence
auggcuuugagcucagcuuggcggucaguacugcccuuauggcuacuuugguccgccgcuugcucacgggccgccucaggagacgacaaugccuuuccuuuugauauagaggguuccucagccguaggcaggcaagauccaccugaaaccuccgaaccccgcguggcucugggaagacugccgcccgcugcugaaguucaguguccuugccacugccauccugcuggcgccccugcccccccacgcgcugugccacauucaucuuucuccuuaaguccaccgcucuccagcccccagugucuggaauccuucacgugggcccgauccgucagaaaacucgagauuaagucauucccccuguag

SEQ ID NO: 248903 - RNA, 324 nt, Artificial Sequence
  Description of Artificial Sequence: Synthetic coding sequence
auggcccuguccagcgcauggcggucuguguugccgcucuggcuucucuggagcgccgcguguucucgcgccgcuagcggugaugacaaugccuuucccuucgauaucgagggaagcucagcaguggggcgccaagacccccccgagacuucagaaccccgugucgcccucggacgauugccuccagcagcugagaagugcaaugccggcuuuuuccauacccuguccggugaguguguuccuugugauuguaacggaaacagcaaugaaugccucgacggcucuggcuacugugugcacugucagcgaaauacaaccggauag

SEQ ID NO: 248904 - RNA, 996 nt, Artificial Sequence
  Description of Artificial Sequence: Synthetic coding sequence
auggcacuguccuccgcguggcgcuccguccucccauuauggcuacugugguccgcagcguguagcagagcagcaaguggugaugacaaugcuuuuccauucgauaucgaggggucaucugcagugggucgacaggauccuccagaaaccucugaaccucggguagcccuuggccgccugccccccgcugcugagaaguguaacgccggcuucuuccacacccugagcggugagugcguuccuugugauuguaaugguaacuccaacgaaugcuuggaugggagcggguacugcgugcacugucaacgaaacacgacaggcgaacacugcgaaaagugccuugauggauacauuggagacucaauccggggcgcgccacaguucugucagcccugucccuguccgcugccucaucuggcuaacuucgcugagucaugcuaucggaaaaauggcgccguacgaugcauuugcaacgaaaacuacgcuggaccuaauugugagagaugugcgccuggcuacuauggaaaucccuugcucauuggcucaaccuguaagaaaugugauugcucugguaacucugaccccaaccucaucuuugaggacugugacgaagugacaggacaauguagaaacugccuccgcaacacaacuggguucaaaugugagcggugugcuccuggcuauuacggcgacgcaagaaucgcaaaaaacugugcaguauguaauuguggaggagggcccugcgauagcgugaccggcgaauguuuggaagagggguuugaaccuccuaccgguauggacugcccuaccauaucaugugauaagugcgugugggaccuuaccgaugcccugagacuggcagcacuauccaucgaggaagguaaaagcggcgugcucucaguauccuccggugccgcggcccacagacacgucaacgaaauuaacgcaaccaucuaucucuugaagaccaaacucagcgagcgugagaaucaauag

SEQ ID NO: 248905 - RNA, 246 nt, Artificial Sequence; identical to SEQ ID NO: 248299
  Description of Artificial Sequence: Synthetic coding sequence

SEQ ID NO: 248906 - RNA, 5451 nt, Artificial Sequence
  Description of Artificial Sequence: Synthetic coding sequence
auggcccugaguucagcuuggcgaaguguucucccacuguggcuuuuauggucugcggcaugcucccgcgcugccucaggagacgauaaugcauuuccuuuugauaucgagggcucaucugccgugggccggcaggacccccccgaaacuuccgagccucgcguggcacuuggucgccuucccccugccgcugaaaaguguaaugcuggauucuuccauacucugucuggugaaugugugccuugcgacuguaauggaaauucuaacgaaugucucgaugggucagguuauuguguacacugccaacgaaacacuacgggagagcacugcgaaaagugccuggacggauauaucggugauucuaucaggggagccccucaauuuugccagccgugcccauguccacugccacauuuagcuaauuucgccgaaucauguuauagaaaaaacggagccguccgcugcauuuguaaugagaacuaugccggcccuaacugugaacgaugugccccugguuacuauggaaacccccuguuaauugguucuacuugcaagaaaugugauugcagugggaacuccgaucccaaucucauuuucgaagacugugacgaaguaacagggcaauguagaaauugucugagaaauaccacuggguuuaaaugugaaagaugcgccccgggauacuauggagaugcgagaaucgcgaagaauugugcagucuguaauugugguggugguccaugugacucagucacuggugaaugucucgaagaggguuuugaacccccuaccggaugcgauaaaugcgucugggauuugacugacgcucugcgacuggccgcucugagcauugaggagggcaaaagcggaguacuuucugugagcaguggggcggcugcgcauagacacguaaacgagaucaacgcgaccauauaucuccugaagaccaagcuuuccgagcgugagaaccaguaugcuuuaaggaaaauacagauaaauaaugccgaaaacacaaugaagucccugcucuccgacguggaagaacuugucgagaaagaaaaccaagcuagcagaaagggccaacuuguccagaaagagucuauggacacaauuaaccacgcgucccaauuaguugaacaggcucaugauaugcgagauaagauacaggaaauuaauaacaagaugcuguacuacggcgaagaacacgaacuaagcccgaaggaaaucucggagaaacuuguacuugcccagaagauguuggaagagauucggagcaggcaaccauuuuuuacacaaagagaacucgucgacgaggaggcagacgaagcuuaugagcugcuuucccaggcugagagcuggcagcgccugcacaaugagacuagaacucuguucccuguggugcucgaacagcuggacgauuauaacgcaaaacucucagaucuccaggaggcgcuggaucaggcucugaacuaugugagggaugcugaggauaugaaucgcgccaccgccgcacgccaaagagaccacgagaaacaacaggaacggguaagagagcagauggagguggugaacaugucacugagcacuucagccgacagcuugacaacccccaggcucacacugagugaauuggacgauauaauuaaaaacgcuagcgguauauaugcugaaauugauggagcaaagucugaacuucaaguaaagcuguccaaucuuuccaauuuaagccacgaccuugugcaagaagccauugaucacgcucaggaucugcagcaggaagccaacgagcugagccguaagcugcacucaucagauaugaacggacugguucagaaagcccuugaugccucaaauguguacgagaacauaguuaacuacgucucugaggcaaacgagacagcugaguuugcucucaauaccaccgaccggauauacgaugcugugagcggaaucgacacacagaucaucuaucacaaggaugaaucggaaaacuuacucaaucaggcaagagaacuacaagccaaagccgaaagcuccucugacgaagcaguggccgauacuucgagacgggugggcggcgcccucgcacggaaaucagcgcuaaaaacgcgacugucagacgccgucaagcaacugcaggcugcugagcgaggagaugcucaacaacgccuaggacaaagcagauugaucacagaagaagcuaacagaacaacaauggaagugcaacaggcuacagcaccaauggcaaacaaucugaccaacuggagccagaaccugcaacauuucgauucauccgccuauaacacggcagucaacagcgcacgggaugccguucgaaaucugaccgaaguggucccucaauuauuagaucaguuaaggaccguggaacagaaaaggcccgcaagcaacgucuccgcauccauccagagaauaagagaacuaaucgcgcaaacacggucuguugcaagcaaaauccaggugucaaugauguuugacggccaauccgcugucgaagugcacagucgaaccagcauggacgauuugaaagcuuucacaucgcugaguuuguacaugaaaccuccuguaaaacguccugagcucacagaaacagccgaccaauuuauccuguaccucggcucgaagaaugcuaagaaggaauacauggggcucgccaucaagaacgauaaucucgucuacguguacaaucugggcaccaaagacguagaaaucccccuggacucaaaaccuguaagcagcuggcccgcuuacuucagcauugugaagaucgaacgcguaggaaaacacggaaaaguguucuugacugucccuucacuuucuuccacugccgaagaaaaauuuaucaagaaaggugaauucucaggagaugacucguuacucgaccuugaccccgaagacacugucuuuuauguuggcggcgugcccagcaauuuuaaacuccccacaagcuuaaaucugccuggauucgucgggugucuggagcucgccacacuaaacaacgacgugaucucccucuacaacuuuaagcacaucuacaacauggaccccuccaccucagugccaugugcgcgggauaaauuggccuucacacagaguagggcggccucuuacuucuucgacggaucuggcuaugcuguuguccgagacauaacacgcagagguaaguuuggacagguuacuagauucgacauugagguuagaacuccugcagacaacggcuugauccuucuuaugguaaauggcaguauguucuucagacuggaaaugcggaacggauaccuccauguguuuuaugauuuuggguucaguggaggccccguucacuuggaagauacacuuaaaaaagcacaaauaaacgacgcuaaauaccaugaaaucucuaucauauaccauaacgauaagaagaugaucuuggucguggaucgcagacacguuaaaucgauggacaacgaaaagaugaagaucccauuuaccgacaucuacauuggcggagccccgccugaaauccugcagucccgggcccuucgcgcgcauuuaccccuugacauuaauuuuagaggcuguaugaaaggauuccaguuccagaaaaaggacuucaaccugcucgaacaaacagaaacacuggggguggguuaugggugccccgaagauucucugauuagccgccgggcguacuucaacggccagucuuucauugccagcauccagaaaauuagcuucuuugauggcuucgagggcggguucaacuuccggacacuucaaccuaaugguuugcuguuuuacuacgccucuggauccgacguauucucuaucucacuggauaauggaacuguuauuauggacgucaaaggcauuaagguacagucaguagacaaacaguacaacgacggucugagccacuucgugauuuccuccgugagcccaacuagauacgaauugaucguagacaagagccgcguugguucgaagaauccuacuaaagguaagauagaacaaacacaggccuccgagaaaaaguucuacuucggcggaucaccaaucucugcucaguacgccaacuuuaccgggugcaucucgaaugccuacuuuaccagaguggaucgcgaugucgaaguugaggauuuucaaagguauaccgaaaagguacacacaucucuguacgaauguccgaucgaaaguagcccucuguuucuguugcauaagaagggaaagaaccucucaaaaccuaaagcuucgcaaaacaagaagggaggaaagagcaaggacgcccccucaugggacccaguggcccugaaauuacccgaacggaauacacccaggaacucgcauugccacuugucuaacuccccccgcgccaucgaacacgcuuaccaguaugggggcacagccaauucuagacaagaguucgagcauuuaaagggagacuuuggagcgaaaagccaauuuucuauuagacuaagaacaaggagcucccacggcaugaucuuuuacgucuccgaucaggaggagaacgacuuuaugacguuauuucucgcucauggacgccucguguacauguucaauguugggcauaagaaguuaaagaucagaagccaggagaaauacaacgaugggcuguggcacgacgugaucuuuaucagagagaggagcuccgguaggcuggucaucgacggacugcgugucuuagaagagucuuuaccucccacagaggccacauggaaaauaaaaggcccaaucuaucuggguggcguggcccccggcaaagcaguaaaaaauguucagauuaacagcauuuacuccuucuccggauguuugucgaaccuccagcucaauggagcgaguaucaccuccgccagucagaccuuuucagugacuccuugcuucgaaggcccgauggagaccggcaccuauuuuucaacagaaggcgguuacguggucuuggaugaaagcuucaacauaggccucaaguucgaaauugcauucgagguaagaccuagaaguagcucggggacacucgugcacggccacagugugaauggagaguacuuaaaugugcauaugaagaacggucaagucauugugaaagugaacaauggcauuagagauuucucuaccagcgugaccccaaaacaguccuuaugcgacgggcgauggcaccgaauaacagucauccgggacucaaacguaguccagcuggauguagacucugaagugaaccacgucguuggcccacugaauccuaaaccaaucgaccaccgugaaccugucuuugucggaggcgugccugaaucucuguuaacaccacgucuggcaccuucgaaacccuucacagguuguauuaggcauuucguuauugauggacacccugucucuuuuagcaaagcugccuuggucucuggcgcuguuuccaucaauucuugucccgccgcuuag

SEQ ID NO: 248907 - RNA, 975 nt, Artificial Sequence
  Description of Artificial Sequence: Synthetic coding sequence
auggcgcugaguucagcuuggcgauccgugcugccguuauggcuacuguggucagcagcaugcagucgugcagcgaguggggacgacaacgcauuuccauucgacauagagggaucaagugcaguaggcagacaggauccccccgagaccuccgaaccacggguugcucuuggacgccuucccccugcugcugagaagugcaaugccgguuuuuuucauacacugagcggagaguguguaccuugcgacuguaauggaaacagcaaugaaugccuugauggaaguggcuauuguguacacugccaacggaauacuaccggagaacauugcgagaaauguuuggauggauauaucggcgauaguauucgcggcgccccacaguucugccagccgugccccugcccucugccgcauuuggcuaacuucgccgagucauguuacaggaaaaacggagccguacgcugcauaugcaaugaaaauuacgcuggccccaauugcgaacguugcgcuccaggcuauuauggcaauccucucuugaucggcucuacguguaagaagugcgacuguucagguaacuccgauccuaacuugaucuuugaagauugugaugaggugacaggccaaugccguaacugucuaagaaacaccacaggcuuuaagugcgaaagaugcgccccgggcuauuauggagaugcucguauugcuaagaacugugccgucugcaacuguggagggggaccaugugauuccgugacaggcgagugucuugaggaaggguuugagccaccuacuggaugcgacaagugcgugugggaccugaccgaugcucuccggcuggccgcucucucaauugaagaaggcaaaucagggguucuaucagugagcuccggcgcggcugcccaccgacacgucaaugaaauuaacgccacaauuuaucuucucaaaaaaacuaaacagaaaaacaacaagaaguag

SEQ ID NO: 248908 - RNA, 276 nt, Artificial Sequence; identical to SEQ ID NO: 248302
  Description of Artificial Sequence: Synthetic coding sequence

SEQ ID NO: 248909 - RNA, 2553 nt, Artificial Sequence
  Description of Artificial Sequence: Synthetic coding sequence
augggacugcuacaacugcuagccuuuucuuuccuggcccuaugucgggcccgugucagagcgcaggaaccggaauuuuccuaugggugcgccgaagggagcuguuacccagcaaccggagauuuacugaucggccgggcacagaaacucagcgucacuagcaccugcggucuccauaagccugagccauacuguauaguaucucaucugcaagaagacaagaagugcuucaucugcaauucccaggaucccuaucacgagacacucaauccugacagccaucucaucgaaaacguuguuacgacauucgcuccaaaccgacugaaaaucugguggcagucugaaaauggcguugagaacgugaccauccaacuggaucuggaagcugaauuccauuucacacaccuuaucaugacguuuaaaacauuccggccagccgcuaugcugauagaacgguccucagauuucggcaagacauggggggucuauagguacuuugcuuacgauugcgaggcauccuuucccggaauauccacuggcccaaugaagaaggucgacgauauuauuugcgacucaagauacagugauauugaacccaguaccgaaggcgagguuauuuuccgugcauuggauccagcguuuaagauagaggacccguacucaccuagaauccaaaaucuguuaaaaauuaccaauuugcguaucaaauucguuaagcugcacacuuugggagauaaucuccucgauaguaggauggagaucagagaaaaauauuauuaugcgguauacgauauggucguccgaggaaauuguuucugcuauggucacgcuuccgaaugcgcuccagucgacggcuuuaacgaggagguugaagguaugguccauggacacuguauguguaggcacaauacaaaaggucugaacugcgagcucuguauggacuucuaccacgauuuaccuuggagaccugcugaaggcagaaauaguaacgcauguaagaagugcaacuguaaugaacauucaaucucuugucacuuugauauggccgucuauuuagcuaccgggaaugugucaggcggcgugugcgacgauugucagcacaauaccaugggccggaauugcgagcagugcaagcccuucuacuaucagcacccagagagggauauccgcgauccuaacuucugcgagcgaugcaccugcgaccccgccggaagccagaacgagggcaucugcgauuccuauacugauuucucaacuggacugauagccgggcaauguagauguaaacugaauguugagggcgaacauugcgauguguguaaagaagguuucuaugaucuaucaagugaggacccauucggguguaagucuugcgccugcaacccucuggguaccauuccugggggcaaccccugugacucugaaaccggccacuguuauugcaaacgacuaguaaccggccagcauugcgaccagugucugccagaacacuggggccuguccaaugauuuagacggaugucggccuugcgauugcgaucugggcggcgcacucaauaacaguuguuucgccgaaucuggccaguguucuugcagaccucacaugaucggcagacaguguaaugagguugaaccaggcuauuacuucgccacucuggaccacuaccuauacgaggccgaagaagcaaaucugggaccgggggucucaauuguggagcgacaguacauucaggaccggaucccaucguggacgggcgcaggguuugugagagucccagagggggcuuaucuagaguucuucauagauaacauacccuacaguauggaauacgacauucugauucgauacgagccucagcugccugaccacugggagaaagcaguuauaaccguucaaaggcccgguagaauucccacuaguuccaggugcgguaacacaauuccagaugaugacaaucaggugguuucacuuagccccgguucucguuaugugguccuaccacgccccguaugcuucgagaagggcacuaacuauacggugcguuuagagcucccucaauacacuagcagcgacucugauguggaaucccccuacacccugaucgauucccugguucucaugccguauugcaaaagccuggauauuuuuaccguaggaggcuccggugacggugucgucacgaacagugcgugggagaccuuccagagauauagaugucucgagaacucuagaucaguaguaaagacccccaugaccgaugucugccgaaacauuauauucagcaucagugcacuucugcaccagaccggacuagcuugugaaugcgauccccaaggaucacucagcagugucugugacccuaauggcggccaaugccagugucggcccaacgucguaggucgaacuugcaaccguugugcgccgggaacauuuggauuuggaccuuccgguuguaaaaggagauuccugaaauccaucgucaugcacucuuucagacugacacaaccauuguggcaaggauccauugcugcugaacccaugcugccuucauag

SEQ ID NO: 248910 - RNA, 3912 nt, Artificial Sequence
  Description of Artificial Sequence: Synthetic coding sequence
augcccgguccacgcggggccgccgggggauuagccccugagaugagaggugccggugcggccgggcuucucgcacugcugcuacuacugcuacugcugcuucuuggacugggcgggaggguggaggguggaccagccggcgaaagaggugcaggaggugguggggcucuggcaagggaacgguuuaaggucguguucgcuccagugauaugcaaacgaacuugucucaagggacaaugccgcgacucaugccaacaaggcaguaacaugacucuuauuggggaaaauggacacucuaccgacaccuugacagguuccggcuuucgcgucgugguguguccccugccuuguaugaacggcggacagugcuccucacgcaaccaauguuugugcccuccagauuuuacagggagauucugucaggugccugcagguggggcuggugguggaaccggcgggagugggcccgguuuaagccgcacuggggcuuuaucuacaggagcguugccaccccuggcgccugagggagacucuguggccucuaagcaugccaucuacgcuguucaaguuauugccgacccccccggcccaggugaagguccacccgcccagcacgcugcuuuccuuguuccccuuggacccggacagauuuccgcagaagugcaagcaccuccuccaguggugaaugugcgagugcaccauccaccugaggcuucugugcaaguucaccggauugaauccucgaaugcugaaucugcagcuccuagccaacaccuucugccucacccuaaaccuagccauccccggcccccaacucagaaaccucugggcagauguuuccaagauacacuaccgaaacaaccuugcggcaguaacccauugccaggucucacgaaacaggaggauuguugugguuccaucggaacggcguggggccagagcaaaugccacaaauguccucaauuacaguacacuggaguccagaagcccgggccugugcgaggcgaggugggagcugacugcccccaaggauauaagaggcuuaauaguacucacugucaagacauuaaugaaugcgccaugcccggggugugccgucauggagauugucucaacaacccaggcaguuacaggugcguaugcccaccagggcacucucuaggaccuucacgcacacagugcauugcagacaaaccagaagagaaaucucugugcuuccgccuagugucgccggaacaucaaugccaacaucccuugaccacacgauuaacucgucagcuguguuguuguucaguugggaaggccuggggcgcccgcugucagcgauguccuaccgauggcacagccgccuucaaagaaauuugccccgcaggcaaaggguaucauauccucacgucgcaccaaacauugacaauccagggagaguccgacuuuagcuuguuucugcaucccgacggaccaccaaaaccacagcagcuccccgaauccccuagucaagcgcccccaccagaggacaccgaggaagagcgcggugugacuaccgacuccccaguaucugaggaaagguccgugcaacagucccacccgacggcaaccacaacaccagcaagaccauacccagaacugauaucuagaccuucaccgccaacaaugcgcugguuccuacccgaucuacccccuucgagaucugcagucgaaauagcaccaacucaaguaacagagaccgacgaaugcaggcuaaaucagaauaucuguggacauggcgaaugugugccaggcccacccgauuacucuugccacugcaaucccgguuauaggucccacccccaacaccgcuauugcgucgacgugaaugaaugcgaagccgaaccuugcgggccagguagaggaauuugcaugaacacaggaggcucguacaacugccacuguaauagaggcuaccggcuucaugugggcgcaggcggaagauccugugucgaucuuaaugagugcgcuaagccccaccuguguggugauggaggauucugcaucaauuuccccggucauuacaaguguaauugcuacccuggauacaggcucaaagcaucucgcccccccgucugugaagacauagaugagugucgcgaucccuccucaugcccagacgguaaaugugagaacaagccaggauccuuuaaauguaucgcaugucagcccgguuaccgcucucaaggcggaggugccugccgagacgugaacgaaugugcugaagggucacccugcucaccuggauggugugaaaaccuaccugguucguucaggugcaccugcgcucaaggcuaugccccagcuccugacgggaggucuugcuuggacgucgaugagugcgaggcaggagacgucugugacaauggaauuuguagcaacacaccagguuccuuucaaugccagugccuguccggauaucaucuuucacgugacagaucacacugcgaagacauagacgaaugugacuuuccggcagccuguaucgguggcgacuguauaaacaccaauggauccuauagaugucuguguccgcagggccacagguuggugggcggccgcaaaugucaggacaucgaugaguguucccaagacccaucccuuugccuuccucacggagccuguaagaaucugcagggaucauaugucugcguuugcgaugagggauuuacucccacccaggaucaacacggaugcgaagaaguagaacagccucaucacaagaaggaaugcuaucucaacuuugacgacaccguuuuuugugacaguguccucgccacaaaugugacgcagcaggaauguugcugcucgcuuggagccggcuggggugaucauugcgagauuuauccaugccccguuuauucaucagccgaguuucacagccucuguccggacggcaagggcuacacccaggauaauaauaucguuaauuacggaauuccagcgcauagagauauugacgagugcauguuauucggauccgaaaucugcaaagagggaaagugugugaacacucagccuggauaugaaugcuacugcaaacaaggcuucuauuacgauggaaaccuacucgaaugcguagacguggacgagugccuggaugaaucaaacugucgaaauggcgucugcgaaaacaccagaggcggcuacagaugcgcuugcaccccucccgcugaauacuccccagcacaaagacaaugucugagccccgaagaaauggaugucgacgagugucaagacccagccgcaugcagaccaggacgguguguuaaccugccugguucuuaccgcugcgagugcagacccccuugggugcccggccccuccggccgcgauugccaguugccugaaagcccugccgagcgggcaccagaacggcgggauguguguuggucccaaagaggagaagacgguaugugcgcuggcccccuggcuggccccgcgcuaacauuugacgauugcuguugcaggcaaggcagaggcuggggugcucagugccggccaugcccaccgagaggugccgggagucacuguccaacaagccagagcgaaucaaacucauuuugggauacaucgccucuccugcucggcaagccuccaagagaugaagauucuagugaagaagacucugacgaauguagguguguuucuggcagaugcgucccaaggccaggaggggcggugugugaauguccuggaggguuccaguuggacgccucacgagcuaggugcguggacaucgacgagugccgagaauugaaccagaggggauuacugugcaaauccgaacguugugugaauaccucagggucuuuccgcuguguguguaaagcuggcuucgcacgcucccguccccacggugcgugcgugccgcagaggcguagauag

SEQ ID NO: 248911 - RNA, 792 nt, Artificial Sequence
  Description of Artificial Sequence: Synthetic coding sequence
augcuguucggaagugaaauuugcaaggaaggaaagugugugaauacccaacccggcuacgagugcuauuguaaacaaggguucuauuaugacggcaaucuccucgaguguguggauguggacgaaugucuagaugagaguaacugccggaauggggugugcgagaauaccagggguggcuauagaugcgcuuguacuccacccgccgaauacucaccugcccaacgccagugucucucccccgaggaaauggauguggacgaaugccaagacccugcugcuugccggccaggccgaugcgucaaucugccuggcucauaucgcugugaaugccggccgcccugggucccuggaccaucaggccgugauugccaacugccggaaucccccgccgagagagccccugagcgaagggacgucuguuggucccaacggggcgaagacgggaugugcgccgguccucuggcagggccugcccucacuuuugacgacugcugcuguagacaaggccgugguuggggcgcccaauguagaccguguccaccacgaggggcaggaagccauuguccaacaagucaaagugaaucuaauucuuucugggacacaucaccucucuugcuuggcaaaccccccagggacgaggacagcucugaggaggauagcgacgagugcagauguguuucugcugcugcaugccgcggacgagcugccccuugcgcaucaguuccugccgccuccucuucgacuccccccgcaccagccgcguggauuucuacaagcgccgaaucuuag

SEQ ID NO: 248912 - RNA, 3771 nt, Artificial Sequence
  Description of Artificial Sequence: Synthetic coding sequence
augccuggcccgcggggagcugccggaggacuggcuccagagaugcgcggcgccggcgccgccggccugcuugccuugcugcugcugcugcuucugcuucuccuaggccucggcgguagagucgaaggcgggcccgcuggugagagaggcgcgggcggagggggagcacucgcucgggagagguuuaaggucguauucgcgcccgucauaugcaagcgcaccugccugaagggacaguguagagauaguugccaacaaggaucaaacaugacguugauaggagaaaauggacacaguacagacacccugacggggaguggcuuuagaguagucguuugcccccuucccugcaugaacggaggccagugcaguucuagaaaccagugucugugucccccagauuucacuggaagauucugucagguuccagccggcggugccggaggcgggaccggcggcucuggcccgggccuguccaggaccggugcuuuaucuacuggagcucucccuccucucgccccugaaggugacuccguugcguccaagcacgcuauuuacgcuguccaggucauugccgaccccccaggaccaggggaaggccccccggcccagcacgcggcuuuucugguaccacugggccccggccagaucuccgcagagguccaagcucccccccccguuguaaacguccguguacaucauccccccgaggcaagcguucagguccaucgcauugaauccagcaacgccgagucagcagcccccucucagcaccuucugccccaccccaagcccucucauccccgucccccuacacaaaaaccccuuggccgcugcuuccaagauaccuuaccaaagcagccguguggauccaacccucugcccggccuaacgaagcaagaagacuguugugguaguauagguacagcuuggggccaaagcaaaugccacaagugcccacagcugcaguacaccggcguccagaagccaggcccaguucgaggagaaguuggagcagauugcccccaaggauauaaaagacucaacucgacacauugccaagauaucaaugagugcgcuaugccugguguguguaggcauggcgacugucugaacaaucccgguucauauaggugugugugcccaccaggccacagcuugggcccguccagaacacaaugcaucgcggauaagccagaggaaaagucacuuugcuuccguuugguuuccccugagcaccagugccaacacccgcugacaacccgccuaacacgccaauuauguugcugcuccguggggaaggcguggggcgcaaggugccaaagaugucccacagaugguacggccgcuuucaaagaaaucugcccagcgggaaagggguaucacauccugacuucccaccagaccuugacgauccagggagaaucugauuuuagcuuauuccugcauccugacggccccccuaaaccgcaacagcugccagaaucaccgucucaagcucccccaccugaagacacugaggaagaacggggcgugacaaccgacucuccagugucagaggagcgaaguguccagcagucgcacccuacagccacuacuacuccagcacguccauacccugaacuuauaagcagaccuuccccaccgaccaugcggugguuucucccugaucuaccuccuagccgcagcgcgguagaaauugccccaacucaagucaccgagacugaugagugccgacuuaaucaaaacauuuguggucacggcgaauguguacccggucccccugacuacuccugccauugcaacccuggauaccgaagccauccucaacaccgguacuguguagaugugaacgagugcgaggcagaaccuugcggaccuggcagagguauaugcaugaauacuggaggauccuauaacugucauugcaaccgaggauaccgacugcacgugggugcuggaggucggagcugcguggaucuaaaugagugcgcaaaaccgcaccuguguggagacgggggguucugcauaaauuucccuggccauuacaagugcaauugcuauccuggauaucgucuaaaggcaucacgacccccagucugcgaggauauugaugagugcagagaucccucgaguugcccagaugguaagugugagaauaagcccggcuccuuuaaauguauugcgugccagccaggcuauagaucccagggcggcggagccugcagagacguaaacgagugcgcagaagguagcccuugcagcccuggauggugcgaaaaccuuccuggaucauuccgcuguacgugcgcccagggauacgcaccugcuccagacgggaggaguuguuuagacguggacgaaugcgaggcuggcgacgugugugacaauggcauauguaguaacacccccggcuccuuccagugccaauguuuaucugguuaucaucucucccgagacagaucucauugugaggauaucgacgagugugauuucccugcugccuguauaggcggagacugcaucaauacaaacggcuccuaucgcugccuauguccccagggccaccgccuagugggggggagaaagugucaagauauugaugaauguagccaggacccuucccuuugucuaccacacggcgcuugcaaaaauuugcagggaucuuauguuugcgugugugaugagggauucacucccacccaggaucaacauggcugugaggaaguggaacagccucaccauaagaaagaaugcuaucucaauuucgaugacacuguuuuuugcgauagcgugcuugcuaccaauguuacucagcaagaguguugcugcagccuaggagcuggcuggggagaccacugcgaaaucuaccccugcccuguguacucuucugccgaauuccauucucucugcccagauggaaaaggauauacucaggauaacaacaucguuaauuauggaaucccggcccaucgcgauauagaugaaugcaugcuguuuggauccgagaucuguaaggagggaaaaugcgugaacacucagcccggauacgaguguuauuguaaacagggauucuacuacgauggcaaucugcuagaauguguugacguggaugaaugucuggaugagucaaauuguaggaauggcguuugugagaauacuagaggcggauauaggugugcuuguacccccccagccgaauauucgcccgcgcagcggcagugucugagcccugaagaaauggaaagagcgcccgagcgacgugacguguguuggucccagagaggugaggacggaaugugugccggccccuuggcuggaccugcguuaacguucgaugauugcuguugccgccagggccguggguggggcgcccagugcagaccauguccaccacgcggcgccgggucacacuguccuacaagccaguccgagucuaacagcuucugggauacuuccccucugcuauuaggaaagccucccagagaugaggacagcagugaggaggauucagaugagugcagaugcguguccggccgcugugugccuagacccggcggagccgugugcgagugcccagggggauuucaauuagaugccucucgggcacguugcguggacauagacgaaugcagagagcucaaccagcggggacuauuauguaaauccgagagaugcguaaacacuagcgguagcuucagaugcguauguaaggcaggguuugcaaggaguagaccacauggcgccugcgucccccagcggcgaagguag

SEQ ID NO: 248913 - RNA, 921 nt, Artificial Sequence
  Description of Artificial Sequence: Synthetic coding sequence
augcucuuugguucggaaaucuguaaggaaggaaagugcguaaacacccagccaggguaugaaugcuacuguaagcaaggguucuacuaugauggaaaucuuuuagagugugucgauguagacgaaugcuuagacgagucgaauuguaggaauggugucugugagaacacccgugguggcuauagaugcgcuuguacccccccagccgaauacucccccgcccagcgacagugucugucaccugaagagauggacguggaugaaugccaggaccccgcugccugucgacccggucguugcgucaaucugcccggaucuuauagaugcgagugccggccaccuuggguccccggcccuucuggacgugauugucagcugccugagucccccgcagagcgugcuccugaaaggcgcgacguuugcuggucccagcgaggcgaggacggaaugugugcgggcccucuggccggcccugcauugacauuugaugacuguugcugucgccaaggaagagguuggggcgcucagugcaggcccugccccccuagaggcgccggaagucauugccccaccagucagucagagucaaacucauuuugggacaccucaccuuuacuguugggcaagcccccuagagaugaggacagcagcgaagaagacagugacgaaugcagaugugucucuggaagaugugugccuaggccugguggcgccguuugugaauguccaggagguuuucagcuggacgccucgagagcucguuguguggauaucgacgagugcagggaguuaaaucagagagggcuauuaugcaaaagugaaaggugcgugaauaccuccggaucuuucagguguguauguaaagccggguuugcucgaucccggccccauggcgccugcguaccucaacgucgccgcuag

SEQ ID NO: 248914 - RNA, 3414 nt, Artificial Sequence
  Description of Artificial Sequence: Synthetic coding sequence
augacguugauuggagaaaacggucauuccacggauacccucaccgguucagguuuuagagucguaguaugcccauugccuuguaugaaugggggccaauguagcucucggaaccaaugucuaugucccccggauuuuacaggucgcuucugucagguucccgcagguggagccgggggcggcacagggggaucuggucccggacuguccagaacgggugcccucuccaccggugcccuccccccacuggccccagaaggggacagcgucgccucuaaacaugcaaucuaugcagugcagguaaucgcugacccuccagguccuggagaaggaccaccagcacaacacgcugcuuuccuugugccucuugggcccggccagaucuccgcugaagugcaggccccgccgccugugguuaauguuaggguucaccauccacccgaggccucuguccagguacaccgcaucgagucaucuaacgcagagucagcugccccuagucagcacuuacugccucaucccaagccuagccaucccagaccaccaacgcaaaagccuuuagggcgauguuuccaagacacacuuccuaaacaacccuguggcucuaacccauuaccaggccuaaccaaacaggaagauuguuguggcuccaucggaacugccuggggucaguccaagugucacaaaugcccucagcuacaguauaccggaguccagaaaccagguccugugcgcggugaagugggcgcagacugcccucaaggcuacaaacgucugaauucuacccacugucaggacauuaaugaaugugccaugccuggaguaugucgucauggcgacuguuuaaacaaccccggcucauaucguuguguauguccgccgggucacucccucgggccguccaggacucaguguauagccgacaaaccagaagagaaaagccucugcuuccgacucgugagcccugaacaccagugccaacauccccugaccacaagacuaaccagacaacuauguugcugcagcgucggcaaggcauggggagcucgaugccagcggugcccaacugauggaacugccgccuucaaagagauuugcccugcaggaaagggauaucacauccucacuagccaccaaacuuugacuauucaaggugagagugauuuuucauuguuuuugcacccggacggucccccuaagccacagcaguuaccggaguccccgucucaagcaccuccccccgaagacacagaagaagagcgagggguuacuacagacucccccgucagcgaagaacgaucagugcagcaaagucaccccacagccaccacaacuccugcacgccccuauccugaacugauuagccgaccaucccccccgacgaugagaugguuucugccagaucuuccuccuagucgcagugccguugagaucgcaccaacucagguuacagaaaccgaugaaugcagacucaaccagaauaucugcggccauggcgagugugugccuggccccccugacuacagcugucacugcaaccccggauacagaagccacccccagcaccgauacugcguugaugugaaugagugugaggccgaaccuugugggccaggucgaggaaucugcaugaacacaggaggguccuauaacugucacugcaaccggggguauagauugcacgugggugccggagggagaaguuguguagacuuaaacgaaugcgccaaaccccaccuuuguggagacggcggauucuguauuaauuuuccgggucacuacaaauguaauugcuacccuggcuauagacugaaggcuagcagaccaccagucugugaggauaucgaugagugcagagacccaaguaguugccccgauggaaagugugaaaacaaaccaggcucuuuuaagugcauugcaugccaaccaggcuacagaucccagggcggcggcgcuugucgugacgucaaugaaugugcugaaggcucucccuguucccccggcuggugugaaaaucuucccggcaguuuuagaugcaccugugcucaaggguaugcucccgcucccgauggacguucaugucuggacguggacgagugugaggcgggcgauguuugugauaauggaaucuguaguaauaccccuggauccuuucagugucagugccucagcggauaccaucugucaagagauaggagccacugugaagacauugaugagugugacuucccagccgccuguaucgguggcgauugcaucaauaccaacgguucuuaccggugucucuguccccagggccacagacuugugggcggccgaaaaugucaagauaucgacgaguguagccaagaccccucucucugucucccgcacggcgcauguaaaaaucugcaaggauccuacgugugugugugugacgaaggauuuacacccacccaggaucaacauggcugcgaggagguggaacagccccaccauaagaaggaauguuaccucaacuuugaugacaccguguucugcgacuccguuuuggcaaccaaugugacacaacaagaaugcugcuguucucugggcgccggcuggggugaccauugcgaaauuuauccaugcccaguguauucuuccgccgaauuucacucccucugcccugacgggaaaggcuauacgcaggauaacaacaucguuaauuacggaaucccggcccacagagacaucgaugagugcaugcuguucggaucugaaauuugcaaagaagggaagugugugaauacgcagccuggcuaugagugcuauuguaaacaaggcuuuuacuacgauggaaacuugcuagaguguguugaugucgacgagugcuuggacgagucaaacugccguaacggcgugugcgaaaacacuagaggaggcuacagaugugccuguacccccccagcugaauauaguccggcccagaggcaaugccugucaccugaagagauggacguggacgagugucaggauccagcugcuugucgucccgggagaugugugaaucugcccgggucuuaucgcugcgaaugcaggcccccuuggguucccggcccuucuggucgcgacugccaacugccugaaucuccagcagaacgagcccccgaaagacgugauguguguuggagccagaggggugaggacggcaugugcgccggcccccuugcuggaccagcacucaccuuugacgauugcuguuguagacagggccguggauggggcgcacaauguagaccaugucccccuagaggcgcugggucucacuguccuacaagccagucugaaaguaauaguuucugggacaccagccccuuacuauuaggaaagccgccacgagaugaggauucuagcgaagaggacucugaugaauguaggugcguuucuggcuag

SEQ ID NO: 248915 - RNA, 2202 nt, Artificial Sequence
  Description of Artificial Sequence: Synthetic coding sequence
augccugccgaaacugaugagugccgguugaaccagaacauuugcggccacggagaguguguaccuggcccgccagacuacagcugucacuguaauccaggauacaggucucacccacagcaucgcuauugcguggaugucaaugagugugaagcagaaccuugcggucccggacgcgguauauguaugaacaccggcgggagcuauaacugccacuguaauagaggguacagauuacacguuggagcgggcgggagaucaugcguggaccuaaacgagugugcuaagccucaccucugcggcgauggaggcuuuugcauuaauuuucccggacacuacaaguguaauugcuacccagguuacagacucaaggcguccagacccccagugugugaagauaucgaugaguguagagauccgucuuccugcccggaugggaagugcgaaaauaagccagguaguuuuaaguguaucgcuugccaaccuggauauagaucucagggcgguggugcguguagagacgucaacgaaugcgcggaagggucuccuugcucaccagguuggugugagaaccugccuggaagcuuccgcuguacgugcgcccagggguaugcucccgcaccugauggaagaucaugccucgauguugaugagugcgaggccggagaugugugugacaacggaauuugcagcaacacaccagggucguuucagugccagugucucucuggguaucaucuaaguagagauaggucucacugcgaagauaucgacgagugcgauuucccugccgcuuguaucggcggagacuguaucaauacaaacgggagcuauaggugccucugcccccagggacacaggcuagucggcggccguaaaugucaagacaucgaugaguguucccaggaucccucgcuuugucuuccgcacggugcuugcaagaaccuacagggaucauacgucugcguuugcgacgaaggcuuuacucccacacaagaccagcacgguugugaggagguggaacagccacaccacaagaaagagugcuaccucaauuuugacgauaccguauuuugugacagugugcucgcaacaaauguuacacaacaggaauguuguugcucucuuggcgccggauggggagaucacugugaaauuuaccccugccccgucuauucauccgcugaauuucauucauuaugucccgacgguaaaggcuacacucaggauaacaauaucgugaauuauggaauuccggcccaccgcgauauagaugaguguaugcuguuugguuccgagaucuguaaggagggcaaaugcguuaacacccagccaggauacgaauguuauugcaaacaggguuuuuacuaugauggcaaccuacuagaguguguggauguugaugaaugucuggacgaguccaauugcaggaacggagucugugagaacacaagaggggguuaccgaugcgcuugcacucccccugcugaauauuccccugcucagagacaaugccucaguccagaggaaauggaugucgacgagugccaggaccccgcugcaugcaggccugggagaugugugaaucucccugggucauaucgcugugaaugcagaccaccguggguccccggaccaucaggucgagauugucagcuacccgaaucuccugcugaaagagccccagaacgaagggaugucugcuggucgcagaggggugaagaugguaugugcgcagggccuuuagccggacccgcacugacuuucgacgauuguugcugccggcaagguagggguuggggagcccagugccgacccugcccgccucgcggugccggcagccacugcccaacaucacaguccgagucuaacucuuucugggacacuuccccccugcuuuuaggaaaacccccccgcgaugaagauucuuccgaagaggacucagaugaguguagaugcguuagcggacgaugcgugccaagacccggcggagcuguuugcgaaugucccgggggauuccaacuggacgcguccagggcgaggugcguggauaucgaugaaugccgagagcugaaccagcggggacuuuuauguaagucggaaaggugugugaauaccucugguucauuccgcugcgugugcaaagccggauucgcccgcaguagaccccacggagccugcguaccacagagaaggcgauag

SEQ ID NO: 248916 - RNA, 2649 nt, Artificial Sequence
  Description of Artificial Sequence: Synthetic coding sequence
augacccucauaggagagaauggacacucuacugacacucugacagggagcggcuuccggguugccgacaagccggaggaaaaaucacucuguuucagacucgugucccccgagcaccaaugccagcacccacuaacuaccagauugaccagacaguuguguugcugcucaguuggcaaagcauggggcgcaagaugccaaagguguccuacugauggaaccgcugcuuuuaaagagauauguccugcaggaaaaggcuaccacauccucaccucccaccaaacgcucacuauucagggggagucagauuuuucuuuguuucuccacccugauggcccuccaaaaccccagcagcugccugagucuccgucucaagcucccccucccgaagacacagaggaggaaagaggagugacuacugauucacccguauccgaagaacgcagcguucagcagucucaucccaccgccacaacuacucccgcacgcccauacccagagcucaucuccaggcccucccccccuacuaugaggugguuuuuaccagaccugccacccucaagaagcgcaguugaaauugcaccuacgcagguaacagagacggacgagugucgacuuaaucagaacaucugcggccauggagaguguguucccggacccccagauuacagcugucauuguaacccagguuaucguucacacccucagcaucgauauuguguagacgugaaugaaugugaagcagaaccuuguggccccggaagaggaaucuguaugaacaccggaggcuccuauaauugucauuguaaccgcggcuacagguuacacguaggugccggcggacgcuccuguguagaccuuaaugagugugccaagccucaccuguguggcgacggaggguucuguaucaauuuccccggccauuacaaguguaacugcuaccccggguauagauugaaggccucacguccacccgucugcgaagauauagaugagugucgcgacccauccagcugccccgauggcaagugugagaauaaacccggcuccuuuaaaugcaucgcgugccaacccggguaucgcucccaaggggggggggcaugucgcgacgugaacgaaugcgcagaaggaucuccauguagccccggcuggugugaaaaccuuccagguuccuuucguuguaccugugcacaaggauaugccccagccccagacgggagaucaugcuuggauguggacgaaugugaggcaggcgacguaugugauaacgggauuuguucaaauacuccagggagcuuucaaugucagugccuuucuggguaccacuugucccgcgaucggagccacugugaagauaucgacgaaugcgacuuucccgcagcaugcaucggaggagauuguauuaacacuaacgggaguuacagauguuuaugcccucagggacacagacuggugggugggcguaaaugccaggacaucgaugaguguagccaggauccaucucucuguuuaccucacggggcaugcaagaaucuucaaggaucuuauguuuguguuugcgaugaggguuucacaccaacacaggaccaacacgggugcgaggagguugaacagccacaccauaaaaaagaaugcuaucugaacuucgacgacacuguauucugugacucugugcucgccacuaacguuacucagcaagaauguuguuguucccucggagccggauggggcgaccacugugaaaucuacccguguccgguauacucuucugccgaguuccauuccuugugucccgauggcaagggcuacacccaggauaacaauaucguaaacuacggcaucccagcccacagggauaucgacgaaugcaugcucuucggaucugagauaugcaaagagggaaagugcgugaauacccagccuggcuacgaauguuauugcaaacagggguuuuacuaugaugggaacuugcucgaauguguagacguggaugaaugucuggaugaaaguaacuguagaaacggagugugcgagaauacacggggaggcuacaggugugcuugcaccccgccagccgaauauaguccagcacagaggcaaugccugagcccugaggagauggaacgagcaccugagagacgugaugugugcuggucacagagaggagaggauggcaugugcgccgggccccucgcuggcccggcccugacauuugacgacugcugcugccgacaggguaggggauggggugcucagugccgcccuugcccaccccggggugcgggcucucauuguccuaccucccagagugaaaguaacucuuucugggacacgucgccacuacuguuggggaagccaccgcgugacgaggauagcucagaagaagacagcgacgagugcagaugcguguccggcagaugcguccccagaccgggcggugcgguaugcgaaugcccaggaggauuccaguuagacgcuucacgagcccguuguguggauaucgaugagugcagggagcugaaccagagaggauugcuguguaaaucggagagguguguaaauacuucuggaagcuucagaugcguguguaaagcuggauuugcacgaucucggccacacggugcuuguguaccacaaagaagacguuag

SEQ ID NO: 248917 - RNA, 2127 nt, Artificial Sequence
  Description of Artificial Sequence: Synthetic coding sequence
augcgggaacgaauaugggccccaccccuguugcuuuugcuuccucuucuucugccaccuccuuuauggggaggccccccugauucaccgaggagagaacucgaacuggaaccagguccucugcaaccuuuugaucuucuguaugcaucaggcgcugcugcuuacuacucaggcgacuacgagagagcugugcgcgacuuagaggcagcccuccguagccaucgccgacuucgcgagauccgaacccggugcgcaagacauugugccgcaagacacccccucccucccccacccccuggagaagguccaggugccgaacugccacucuucaggucgcucuuaggacgagccagaugcuaccggagcugcgagacucagcgauugggagggccagccagcaggcaccgcgugucagaagacgugcgaagugauuuucagcguagagugccauauaacuaucugcaaagagcauacauuaagcugaaccaacuagagaaggccguggaagcagcucacacauucuuugucgcuaacccagaacauauggagaugcaacagaacaucgagaacuaucgcgcaacugcaggcguugaggccuuacaguuaguugaccgagaggcuaaaccucauauggaaucauauaacgccggugugaagcacuaugaagcagacgacuucgagauggcaaucaggcacuuugagcaagcacugagagaguacuucguggaagacacagaauguagaacccugugugagggaccucaacgauucgaagaguaugaauaccugggguacaaagcagggcucuaugaagccauugcugaucauuacaugcagguccuugugugucagcaugaaugugugcgugagcuagcuacgagaccaggaaggcuuagcccaauagaaaacuuccugccguugcacuacgauuaucuucaguuugccuacuauagagugggugaguauguaaaggcucuugaaugcgcuaaagccuaccuccuuugccacccagaugacgaagaugugcuugauaaugucgauuacuacgagucccugcuggacgauagcauugacccagccagcaucgaagcaagagaggaccuuacgauguucgucaaacgccauaaacucgagagcgaacucauuaagucugcagcugagggcuuaggcuuuucuuauaccgaaccaaacuacuggauuagguacgguggccgacaagacgagaaccggguuccuagcggggugaacguggaaggugcugaagugcacggguuuucaaugggcaaaaagcugaguccuaaaauagaccgagaccuaagagaggggggcccacugcuauaugaaaauauuacguucgucuauaacucugagcaacucaacggcacucaacggguucuacuagacaaugugcuauccgaggaacaauguagagaacuucacucuguggccucugguauuaugcuugugggcgauggguaucggggaaaaacgucuccucacacaccaaaugaaaaauucgaaggugccacuguacugaaagcucugaaaucuggcuacgagggcaggguuccccucaaguccgccagauuauuuuacgauaucucugagaaagcccgcagaaucguugaaagcuauuucauguuaaacuccacccuguacuucuccuauacgcacauggucugucguaccgcacugagcggucagcaggaccggcgcaacgaucucagccacccuauucacgccgauaacuguuuacucgaccccgaggccaacgagugcuggaaagaacccccagcauauacauuccgagauuauagugcuuugcuauacaugaacgaugacuuugaggguggcgaguuuauauucacagagauggacgcaaagaccgugacagcgaguauuaaacccaaauguggccggaugaucucauucaguucaggcggggagaacccccacggcgucaaagccgugacaaagggaaaaagaugugcagucgcccugugguuuacacuggacccucucuaucgggaacuggaaagaauucaggcagaugaagucauugccaucuuagaccaggagcaacaaggcaagcaugagcugaacauaaacccuaaagaugagcuguag

SEQ ID NO: 248918 - RNA, 1584 nt, Artificial Sequence
  Description of Artificial Sequence: Synthetic coding sequence
auggagaugcagcagaacauagagaacuaucgcgcuaccgcgggcguugaggcccugcagcuuguugaucgagaagccaagccacauauggaaagcuauaacgcaggaguuaaacacuacgaagcagaugauuuugaaauggcgauuagacacuuugagcaggcacugagagaguauuuuguagaggauacugaaugcaggacauugugcgagggcccacagcguuucgaggaauacgaguaccuggguuacaaggcggggcuguacgaggccauugcugaucauuacaugcagguguuagugugccaacaugaaugcguucgagaacucgccacuaggcccggacguuuaaguccuauugagaacuuuuugccgcugcacuaugacuacuugcaauucgccuauuaucggguuggugaauacgugaaggcgcuggaaugugcaaaggccuaccugcugugccaccccgacgacgaggacguuuuggauaacguugauuauuacgaaucccuucuagacgacucaauugaucccgcuaguaucgaggcccgcgaagaccugacaauguucgucaagaggcauaaguuggaaucagagcucaucaaguccgccgcggaaggcuuagguuucucauauacugaacccaauuacuggauuagauacggugggagacaagaugagaacagaguccccagcggagucaacguggagggcgccgaagugcacggauuuaguaugggaaagaagcugucaccaaaaaucgaucgagaucugagggaaggagggccucuucuguaugagaacaucaccuucguguauaacagcgaacaacuaaauggaacacagcgcguacugcuggacaacgucuugagcgaggaacagugcagagaacuacacuccguggcaagcgggauuaugcugguuggggacggcuacagagggaaaacaaguccgcacacuccaaaugagaaguuugaaggagccacuguucucaaagcgcugaaaucuggcuacgagggacguguaccccugaaauccgcacgccuuuuuuacgauauuagcgaaaaggcacgcagaauuguugagaguuacuuuaugcugaacagcacauuauacuuuagcuacacgcacaugguaugucgcaccgcguuaucuggacaacaagaccgacgaaacgaucucucccacccgauucaugccgauaacugcuuguuagaucccgaagccaacgaauguuggaaggagcccccagcauauaccuuuagagacuauagcgcccugcuguauaugaacgacgauuuugagggaggggaauucauauuuacugaaauggacgcuaagaccgugaccgcuaguauuaagccgaaguguggacggaugauaagcuucucuagugggggagagaauccucacgggguaaaggccgugacaaaaggcaaacgaugcgcaguggcccugugguucacucuggauccauuauaucgagagcuggagcggauacaggccgaugaagucauugcgauuuuagaccaagagcagcaagguaagcacgaacuaaacaucaacccuaaagacgaacucuag

SEQ ID NO: 248919 - RNA, 4614 nt, Artificial Sequence
  Description of Artificial Sequence: Synthetic coding sequence
augaccaccaagagaaagauaauugguagacuggugccuugcagaugcuucagaggcgaagaagagaucauuucaguucuggacuauucucauuguucacugcaacaaguacccaaggagguguucaauuuugagcggacacucgaggagcucuaucuugacgcuaaccagaucgaagaguugccaaaacaguuauucaauugccaggcgcuccgcaaguuauccaucccugauaacgaucuuagcaaccugccuacuacuauugccucacuuguuaaccugaaagagcucgacauaagcaaaaaugggguucaagaguucccugaaaacaucaaaugcugcaaaugcuugaccauuauugaagccuccgugaauccaaucucaaaacugccagauggcuuuacccaguuacucaaucugacccagcuguaccucaacgacgcuuuccucgaauuccuucccgccaauuucggcagguuggugaagcugagaaucuuggaguugagggagaaucaucuaaagacauugccuaagaguaugcauaagcuugcccaacuggaacgacucgaccuaggaaacaaugaauuuggagaguuaccggagguccucgaccagauccaaaaccuucgggaacuguggauggacaauaacgccuugcaggucuugccaggaucgaucggcaaacugaaaaugcucguauauuuggauaugucaaagaauagaaucgagacaguugauauggacaucagcggcugugaggcucuugaagaucugcugcucucaucgaacaugcuccagcagcuaccagacagcaucggccuccugaaaaagcuuacuaccuugaaaguugacgauaaccagcucacgauguugcccaauaccauugguaaucuuucacugcuagaagaauuugauugcaguugcaacgaguuggaaucccucccaucaacuaucggcuaccugcacucccuacguacccuggcaguugaugagaacuuuuugccagagcucccccgcgagaucggcucuuguaagaauguuacagugaugagucucagaucuaauaaguuagaguuucucccagaagagaucggucagaugcagaaauugcggguucuuaaucuauccgauaacagacuuaaaaauuugcccuuuucauuuacaaagcucaaagagcuugccgcuuuauggcuguccgacaaccagucuaaagcucugauuccccugcagacugaagcucaccccgagacuaaacaaagagugcugacaaauuauauguuuccgcaacaaccuagaggcgaugaggauuuucagagcgauucggacucauuuaauccaacacuuugggaggaacaaaggcagcagaggaugacagucgcuuuugaguuugaagacaagaaagaagacgaugaaaacgcagguaaagucaaggaccugaguugucaagcacccugggagcguggccaacggggaaucacccugcaaccugcaagacugucaggagauuguugcacuccuugggccagaugcgaucagcagauacaggauaugccggucccccaaaaugauccucaguuggcaugggguuguauuuccggauugcagcaagagagauccaugugcacuccacugcccgucgccgcucagagcaccacccugcccucccucaguggccggcaaguugaaauaaaccuuaaacgauauccuacuccauacccagaggaucugaagaacaugguaaaaagcguacagaaucuugugggcaagccuucccauggugugagagucgagaauucuaacccgacugcaaauaccgaacaaacugugaaggaaaaauacgaacacaaguggccaguugcuccaaaagagauuacuguggaggacucuuuuguacauccugcuaacgagaugcgaaucggugaguugcaucccuccuuagcggagaccccucuuuacccucccaaacucguccugcucggcaaagacaaaaaggaauccacugaugagucggaaguggacaagacacacugccugaauaacagcgucagcucuggaacauacagcgacuauuccccaucccaggccucuucaggaagcucuaauacccgagucaagguuggaucacugcagacuacugcaaaggaugccgugcacaacucauuguggggcaacaggaucgcuccaagcuucccacagccucuggacuccaagccacuucuuagccaacgugaagccgucccaccagguaacaucccucaacgcccugaccguuugcccaugagcgacaccuuuacugacaacuggacagaugggagucacuacgauaacacaggguucguggccgaggagacaaccgccgaaaaugcgaacagcaaccccuuacucucuuccaaaagucgcaguacaagcucgcauggacgcagaccccuaauucggcaagaucguaucguaggcguaccuuuagaacucgagcaaagcacccacagacacacgcccgaaaccgaaguccccccuucuaauccuuggcagaacuggacgcggacucccaguccauucgaggacagaacggccuuccccagcaagcuagagacaacaccaacaacuuccccucugcccgagcgaaaagaacauauuaaggagagcacggaaaucccaucgccuuucaguccaggcgucccuugggaauaucacgauucaaaccccaaccgcagccuuucaaauguguucucgcagauacauugcagaccugagucuucaaagggugucaucucaaucucgaaaucaacagaacgguuaucuccuuuaaugaaggacaucaaaucaaauaaguucaaaaagucccaguccaucgacgaaaucgacaucggcacuuacaagguuuacaacauuccccuagagaacuacgcaucaggaucugaccacuuagguagucacgagcguccugacaagaugcuggguccugaacacgggaugucaagcaugucaagaagccagucagugcccauguuggacgacgagaugcuuacauacggaagcaguaaaggcccccaacagcagaaagccuccaugacuaagaagguuuaucaguuugaccagucauuuaacccucagggauccguugaaguuaaagcagagaaaagaauucccccgcccuuccaacauaaccccgaauauguccagcaggccuccaagaauaucgcaaaggauuugauuuccccuagagcauacagaggcuaucccccaauggagcagauguuuuccuucucccagcccagugucaaugaggaugccguaguuaaugcucaguuugccucacagggagcucgugccggcuuucugcgucgcgcagacagucuggucuccgcaaccgagauggcaauguucagaagagucaaugagccccaugaauugccuccaaccgaccgauauggcaggcccccguaucgaggcggauuggaccgccaaaguagugugaccguuaccgaaucacaguuucugaaacggaauggccgauacgaggaugaacaccccuccuaccaggaagugaaagcucaggcaggcuccuuccccgugaagaaccucacccagagacggcccuuaucagccagaucuuacucaaccgaaagcuacggagcaagccagacacggccagugucagcuagacccacaauggccgccuuacucgagaagaucccaucugacuacaacuuagguaacuauggcgauaagccuuccgacaacucugaccugaaaacacgccccacaccugugaaaggagaagagagcugcggcaagaugcccgccgauuggcgucagcagcuccuuaggcacaucgaagcucgaagacuugaucgcaaugcagccuauaagcacaacaccgugaaucucggaaugcucccuuauggaggcaucuccgcgaugcacgcuggccgcagcaugacucucaaucuucagacuaagagcaaauuugaucaccaggagcuuccucugcagaaaaccccaagccagcaaucaaacauucuggauaacggccaagaagaugugucccccagcggucaauggaacccuuacccacugggaagaagagaugugcccccugauacaaucacuaagaaagcuggaagucacauacagacccugaugggaagucagucuuuacaacaucgcagcagagagcagcaaccuuacgaagggaauauaaacaagguuacaauccaacaguuccaaucuccuuuaccuauacagaucccauccucucaggcuacgcgcggcccccagcccggacggugucuaauccagacaaaaggacagagguccauggacggcuacccggaacaauucugcgugcgcauugaaaaaaacccaggccucgguuucucuauuucaggcggcaucucuggacagggcaacccuuuuaaaccuuccgacaaaggaauuuuuguaacgagagugcagccagacgggccugccucaaaccucuugcagccuggcgacaagauucuccaggccaaugggcauucauucgugcacauggaacaugaaaaagcuguacuucuauugaaaucauuccaaaauacuguagaccucgucauucagagggaacucaccgucuag

SEQ ID NO: 248920 - RNA, 1320 nt, Artificial Sequence
  Description of Artificial Sequence: Synthetic coding sequence
augacuccuauucugacagugcugauaugucucggacuaucacuugacccccgaacccacguccaagcaggccccuugccaaagccaacauugugggcagaaccuggaucagugauaacucaaggaucuccggugacauugagaugccaagggucccuagagacacaagaauaucaccuguaucgggagaaaaaaaccgcgcuuuggauuacccgaaucccucaagagcuggucaaaaaggggcaguuuccgauucugagcaucacaugggaacaugccgggagauacuguugcauuuacggcucucacacagcugggcucagugaaagcucugacccacuggaacucguagugacaggcgcauauucaaagcccacccugucagcccucccuuccccaguagugaccuccggcggcaacgugaccauccagugugacucucaaguggccuuugacggguuuauucucuguaaagaaggugaggaugagcacccccagugccuuaauagccacucccacgcuagaggcagcuccagggcgaucuuuucuguagggcccgugucaccaaguagaagguggucauaucggugcuauggcuacgacagccgcgcaccuuacguuuggucccuccccagcgaucugcuaggacucuuggugccgggcguuuccaagaagccaucccuaucagugcaacccggaccuguggucgccccuggagaaaagcuuacguuucagugcgggagugacgccggauacgauagauucguccuuuauaaagaguggggaagggacuuucugcagcgaccugggcgucagccacaggcuggccugucacaggcaaacuuuacauuaggucccgucagucgauccuauggugggcaguauacaugcucuggugcuuauaaccugagcucagaauggucagcccccucugaccccuuggauauuuugauaaccggacagauccgcgcgcgccccuuucuuuccguaagaccgggcccaacaguagccaguggcgaaaaugugaccuugcugugucagagucagggcgggaugcacaccuucuuguuaacaaaggagggagcggccgauagcccccuccgucuuaaaucaaagcgacaaucucacaaguaccaggcagaauuucccaugucaccuguuacaagcgcucaugcugggaccuaccgcuguuaugggucucucagcucgaauccuuacuuguuaacccacccaucugacccacuggaacucguaguguccggcgccgcugaaacucuaagucccccccagaacaaaucagauagcaaagcuggagaauag

SEQ ID NO: 248921 - RNA, 1371 nt, Artificial Sequence
  Description of Artificial Sequence: Synthetic coding sequence
augcaccgaggauuaauccacccucaaucaagcgcagucggcggagaugcgaugacacccauucucacaguccuuauuugucugggccugucacuggacccccgcacacaugugcaagccgggccucugccgaaaccuacucugugggccgagccaggaucugucaucacacagggcucccccgugacccuaaggugccaaggcucccuggagacgcaggaauaucaccuuuauagagagaagaagaccgcuuuguggaucacgcgaaucccccaggaacuugucaagaaaggccaguucccgauuuuguccaucacuugggaacacgccggccgcuacuguugcaucuauggaucacacaccgcaggccucuccgaaucuuccgacccccuugaacuuguggucacuggggcauacucaaaaccaacccuguccgcuuuaccgucacccgugguaacaucaggaggcaacgucaccauccaaugcgacucacagguggcuuucgacggcuucaucuugugcaaagaaggggaagacgaacacccucaaugucugaauucacacucacacgcacgcgguagcagccgagccauuuuuagcgugggccccgugucaccuagccgccgauggaguuaucgcugcuauggcuacgauucccgggcaccauaugucugguccuugccuuccgaucuacuuggucuccugguccccggugucaguaaaaagccgaguuuaucuguccagccagguccagucguggcaccgggugagaaauugaccuuccagugcgguuccgaugcgggcuaugacagauuuguguuauauaaagaauggggaagggauuuccugcaaagaccaggcagacagccacaggccgggcuuucucaggccaauuucacucuuggaccagugucaaggagcuacggggggcaauauacauguagcggagcuuacaaucucagcagcgaauggagugcucccucugacccucuugauauacugaucacggggcagauccgggcuagacccuuccucagcgugcggccaggucccacaguggcuagcggcgagaaugugacccuucugugucaaagucagggcggcaugcauaccuuucuccucacaaaggaaggagccgcugacucaccucuuaggcucaagucaaaaagacagucacacaaguaccaggcagaauuucccaugagcccugugaccucugcacacgcuggaacauaccgcugcuauggcucacugaguuccaaccccuaccuccucacucaccccuccgacccuuuagagcucgucgucaguggcgcugccgagacccuuucccccccccaaaacaaaucagauagcaaggcaggugaauag

SEQ ID NO: 248922 - RNA, 1098 nt, Artificial Sequence
  Description of Artificial Sequence: Synthetic coding sequence
auggcuaaggucgccaaggaucugaaucccggaguuaaaaaaaugagucuagggcaguugcagagugcuagaggcguugcguguuugggaugcaagggaaccugcaguggauuugaaccucacaguuggcgcaaaauuuguaaaaguuguaaguguagccaagaagaccacugucucacgucugaccuugaggacgaccguaagauugguaggcuguugauggauucuaaguauaguacccuuaccgcacgugugaaggggggagacggaaucagaauauauaagcgcaauagaaugaucaugacgaauccgaucgcuaccggcaaggacccaacauuugacacuaucacauacgagugggcuccucccggcgugacucagaagcucggguuacaguauauggaacuuauuccaaaagaaaagcaaccggugacuggaacugagggagccuucuacaggaggagacaacugaugcaucagcugccuauuuacgaccaagacccaagccgaugcagaggccugcuggagaaugaacugaagcuuauggaagaauucgugaaacaguauaaauccgaggccuuaggaguuggagagguggcccuccccggucagggaggucugccaaaggaggagggaaaacaacaggagaagcccgaaggagccgagaccaccgccgcuaccaccaacggcaguuuauccgauccuagcaaggaaguugaauauguuugcgaacuguguaaaggcgcugcaccaccugacucaccugugguuuacuccgaucgugcggguuauaacaagcaguggcaccccacuuguuucgucugcgcaaagugcucugagccgcugguggaucugauuuacuucuggaaggauggugcuccuugguguggucgucacuauugcgagagcuugagaccuagaugcuccggaugugaugaaaucauuuuugcagaagacuaucagcgcguggaagaucucgcuuggcaucggaaacauuuuguuugcgaaggaugcgagcagcuacuuaguggcagagcauacaucgugaccaaagggcaguuacugugcccuacuuguucuaagaguaaaagaaguuag

SEQ ID NO: 248923 - RNA, 1602 nt, Artificial Sequence
  Description of Artificial Sequence: Synthetic coding sequence
auggcuuugaggaauguaccuuuucgcagcgagguccuggggugggaucccgauucacuagccgauuauuucaagaagcuuaauuauaaagauugcgagaaggcagugaagaaguaucauaucgacggagcacgguuucucaaucuaacagaaaaugauauccagaaguucccaaagcuuagagucccaaucuuauccaagcucucccaagagaucaacaagaacgaagaacgucgcagcauauucacccguaaaccucagguucccagauuccccgaggaaaccgagucacaugaggaggacaacggcgguuggagcaguuuugaggaagaugauuacgaaagcccuaacgaugaccaggauggggaggacgauggcgacuacgaaucccccaaugaggaagaagaagccccaguugaagacgaugccgacuacgaacccccgccuucuaacgacgaggaagcucugcagaauagcauacucccagcaaagccauucccgaacuccaauucaauguauauagauagaccuccaucuggcaagacaccucagcagccccccguccccccccaacgccccauggcugcacuaccaccaccaccugcaggcagaaaucauucaccuuugccccccccacagaccaaucaugaggaaccuaguaggucacgcaaucacaaaaccgccaagcugccggccccuuccauugaccguucaaccaaaccuccuuuagaccgcucccucgcuccauuugaucgugagccuuuuacacucggcaagaagccaccauuuagcgacaaacccucaauaccagccggacgcagucuuggagagcaccuccccaaaauccagaagcccccccugccccccaccaccgagagacaugagcgauccaguccccucccaggaaaaaaaccgcccguuccaaaacacggaugggguccagacagacgcgagaacgacgaagacgaugugcaucagagaccacugccccagcccgcccuccugcccaugucuucuaauacuuuuccuuccaggucaacuaaacccucacccaugaauccacugcccuccucucauaugccuggggcuuuuucagaauccaacucuagcuuuccucagagcgccagucucccaccauauuuuucucagggucccucuaauagacccccaauucgcgcggaaggccgcaacuucccucucccgcugccgaauaaaccuagacccccuaguccugccgaggaggagaauucgcugaacgaagaaugguacgugucuuacaucacccgacccgaagcugaggcugcccugcggaagaucaaucaggaugggacauuucuaguuagggacagcagcaagaagacaaccaccaacccuuauguacugaugguauuguacaaagauaaaguuuacaauauucagauuagauaucaaaaagagucacaaguuuaucugcucggaaccggguugcgcggaaaagaagauuuccuaucuguguccgacauaauugacuauuuccguaaaaugccgcuucugcucauugacgggaaaaauagaggcucccgcuaccaaugcacccuuacucaugcugcuggcuacccauag

SEQ ID NO: 248924 - RNA, 1356 nt, Artificial Sequence
  Description of Artificial Sequence: Synthetic coding sequence
auggaacaaugggaucacuuccauaaccagcaggaggauaccgauucauguucagagucagugaaguucgacgccagauccaugaccgcauugcuaccacccaaucccaaaaauucgcccagccuccaggagaaacuaaaaucuuuuaaggcugcucuuaucgcccuuuacuuauugguuuucgccguucuaauuccucugaucgggaucguggccgcacaacuucuuaaaugggagacaaagaacuguucuguuucgagcacgaacgccaacgauauuacgcagucacuuaccggaaaggggaaugacuccgaggaggaaaugcgguuucaagagguguucauggaacacaugucgaauauggaaaaacggauucagcacauccuugauauggaagccaaccugauggauacagagcacuuccagaauuuuucuaugacgacagaccaacgauuuaaugacauuuuacuacaauuaucaacucuguuuucaucuguucaaggccauggcaacgcgaucgaugagauauccaaguccuugauuucgcucaacacgacucuuuuagaucuucaacuuaauaucgagaaccuuaacggcaagauucaagagaauacauuuaagcagcaggaagagaucucaaagcuggaggaacggguguacaaugugucugcagaaauuauggccaugaaggaagaacaagugcaucuggaacaggaaaucaagggggaagugaaaguucugaauaauaucacuaaugaucugaggcucaaagauugggaacauagccagacacugcgaaacaucacauugauucagggcccccccggaccccccggcgagaaaggugauagaggcccaacgggagaaucaggccccagaggauuucccggcccaauugggcccccuggucuuaaaggugauagaggcgccauuggauuucccggcuccagagggcuucccggguacgcuggcagaccaggcaauaguggucccaaaggacagaaaggagagaaaggaucgggaaauacacugaccccuuuuacuaagguacgucugguggggggaucuggaccgcaugaaggccgaguugaaauuuuacauaguggccaauggggcacuaucugcgacgaucgcugggaggucagagugggccaggucguuuguaggucucugggguauccaggaguucaggccguacauaaggccgcccauuuuggacagggaaccggaccuauauggcugaacgaaguguuuugcuucgggagagaaucuucuauugaggaauguaaaaucagacaaugggguacucgggcaugcagucauucagaagaugccggaguuacguguacucucuag

SEQ ID NO: 248925 - RNA, 1167 nt, Artificial Sequence
  Description of Artificial Sequence: Synthetic coding sequence
auggagcaaugggaucauuuucauaaccagcaagaagacaccgacagcuguuccgagagugucaaauuugaugcucgaucuaugaccgcgcuacucccccccaauccuaagaauucacccucccuccaggagaagcucaagucauuuaaggccgcucugaucgccuuguaccuccucguuuuugccgugcuaaucccccugaucgguauagucgccgcacaacuucucaagugggaaaccaagaacugcucuguaagcagcacaaacgcuaaugacaucacacaguccuugacgggcaaaggcaacgauucugaggaagagaugcgguuucaagagguauucauggagcacaugucuaacauggaaaaaagaauccagcacauacuagauauggaagcaaaucugauggacaccgaacacuuccaaaauuuuucgaugaccacugaucagagguucaacgacauucucuuacagcuauccacccucuucagcucuguccagggacauggcaacgcuaucgacgaaaucucaaaaagccugauuucccuaaauacuacguuacuggaucuccaauugaauauugaaaaucucaaugguaaaauucaggagaauacauucaaacaacaggaggaaauuaguaaacuagaagagagggucuauaacgugucagcagagaucauggcuaugaaagaagagcaaguucaccuagagcaggagauuaaaggggaaguaaaggucuuaaauaacaucacuaacgaccuccgcuuaaaagauugggaacauucgcagacucugagaaacauuacccugauucagggcccacccgggccuccaggcgagaaaggggacagggggcccacaggcgaaucuggaccccgcggauucccuggacccaucggcccgcccggccugaaaggcgauagaggggcaauuggauuccccggauccagaggauugcccggauaugcuggucgcccagggaacagugggccuaaaggccagaagggagagaaggggaguggcaacacacugucuacggggccaaucuggcugaaugaaguguuuuguuuuggaagagagaguagcauugaggaauguaaaauccggcaguggggcaccagagccuguagccauagcgaagaugcuggcgucaccuguacauuauag

SEQ ID NO: 248926 - RNA, 1167 nt, Artificial Sequence
  Description of Artificial Sequence: Synthetic coding sequence
auggagcagugggaucauuuccauaaucagcaagaagauaccgacucauguagugaaagugugaaguucgacgccaggagcaugaccgcccuucugccaccuaacccaaaaaacucaccuagucuacaagagaagcugaaaucauuuaaggccgcguugaucgccuuguacuuauugguguucgcugugcugauuccccuaauuggcauugucgccgcucagcugcugaaaugggaaacaaaaaacuguaguguuucaucaacuaaugcuaacgacauaacccaaaguuugaccggaaagggcaaugacucagaagaggagaugagauuccaagaggucuuuauggagcacaugagcaacauggagaaacgcauacagcacauccuggacauggaagccaaucucauggauaccgaacacuuccagaacuuuucgaugaccaccgaucagcgguuuaaugauauccuauuacaacuaucuacucucuuuuccucaguucaaggucacggaaacgcaauagacgaaauuuccaaaagccuuauuucacuuaauaccacacucuuagaucugcagcuuaauaucgagaaucugaauggcaaaauacaggagaacacauuuaaacaacaggaggagauaucuaagcucgaggaaaggguguacaacgugagcgcagagaucauggcaaugaaggaagaacagguccaucuggagcaggaaauuaagggagaagugaaaguccuaaacaauauuacaaaugaucugagacuuaaggacugggaacauagccaaacccugagaaauauuacccugauccaggguccacccggccccccaggugagaaaggcgaucgcgggccuacuggggaauccggaccuaggggguuuccagggcccaucggcccuccaggguugaaaggggaucggggcgcaauugguuuucccggcucucgcggucuccccggauaugcugggcggccuggaaauuccgguccaaagggccagaagggcgagaaaggaaguggaaauaccuugagcacugguccgauuugguugaacgaagucuuuuguuucggacgcgagaguucuaucgaagaaugcaagauaagacaguggggaacacgagcauguucacacucagaagaugcuggggugaccuguacuuuguag

SEQ ID NO: 248927 - RNA, 1077 nt, Artificial Sequence
  Description of Artificial Sequence: Synthetic coding sequence
auggagcagugggaccauuuccacaaccaacaagaagacacugacuccuguuccgaguccgugaaguucgacgcacgcucaaugaccgccuugcuaccgcccaacccaaaaaauagcccuucgcuccaggagaagcugaaaucuuucaaagcugcucugaucgcucuguaccugcuaguuuuugccguucugaucccucugauuggcaucguugcugcacagcuccuaaagugggaaaccaaaaacuguuccgugagcucaacuaacgccaaugauaucacccaaagccucacuggaaaaggaaaugauucugaggaggaaaugcgcuuucaagaggucuuuauggaacauaugucuaauauggagaaacgcauucagcauaucuuggacauggaagcgaaccugauggauacagagcacuuucaaaacuuuucgaugacaaccgaccagagauuuaacgacauccuguugcagcugucuacacuauucaguucuguccagggccacggcaaugccauugacgaaaucuccaagagccugauuagucuuaacacuacccugcuugaucugcaauugaacauugaaaaucugaacggcaagauucaagagaauacguucaagcagcaggaagagauuagcaaauuagaggagcgcguguacaaugugagcgccgaaauuauggcaaugaaggaagagcaagugcaucuugaacaggaaaucaaaggagaagugaagguccugaacaacaucacgaaugaucugcgccugaaagauugggagcacucacaaacacuacguaauaucacccuuauacaaggcccucccggccccccgggggagaagggcgacagaggcccuacuggcgagucaggcccacgcggguuuccaggcccgauugggccaccaggcuuaaaaggcgaucgaggugcgauuggcuuccccggcagcagaggacugccgggauacgcaggcagaccuggaaacuccggcccgaagggacagaagggugaaaaaggauccggaaacacucugcgaccugugcaauuaacagaccacaucagagccggccccucuuag

SEQ ID NO: 248928 - RNA, 1410 nt, Artificial Sequence
  Description of Artificial Sequence: Synthetic coding sequence
augugcuaucuuuccgcaaucauuucgauaucccugcugaauaagaaaccguccauggaacaaugggaccacuuccauaaucaacaggaagacacugauaguuguuccgagucagucaaguuugaugcaagaucuaugaccgcccuacugccaccuaauccaaagaauucaccgucccugcaggagaaacugaaauccuuuaaggccgcucugaucgcuuuauaccugcugguguucgccgucuuaauaccacucaucggaauugucgcugcgcagcuccugaagugggagaccaagaacugcucagugucauccacaaacgcuaaugauaucacccaaucacugaccggcaaagggaacgauucagaggaggagaugcgcuuucaagagguguucauggaacauaugaguaauauggaaaagagaauacagcauauacuggacauggaagcaaaccugauggauaccgaacacuuucagaauuuuucaaugacaacugaucaacgguucaaugacauccugcugcagcugucaacacucuuuucgucuguacagggucacggaaacgccaucgacgagauuucuaagaguuuaaucucccugaacacgacauuacucgaccugcaacucaauaucgagaauuuaaauggaaagauacaggaaaacacuuuuaaacaacaggaggagauuuccaaacucgaagaaagaguuuacaacguuagugcugagaucauggcaaugaaagaagagcaaguucacuuggaacaagagaucaaaggagaagugaaaguguuaaacaauauaacuaacgaccugcggcuuaaagauugggaacauagucagacucugagaaauauaacgcucauucaggguccccccggcccaccgggcgagaaaggggacagaggcccuacgggagaauccggcccccgaggauuccccgguccuaucggcccuccaggcuuaaagggggauagaggcgcaauugguuucccugggucacgcgguuugccaggguaugccggaagaccagguaauagcggucccaaagggcagaagggagagaaggggucugguaauacucucacuccuuuuacaaaagugcgccuggugggagguaguggaccucacgagggucgcguggaaauucugcacaguggucaguggggaacaauuugugacgaccgaugggagguuagggugggccaagugguuugccggucucucgguuaccccggaguucaggcuguucauaaggcugcucacuucggucaggguacaggacccauuuggcugaaugaaguguucuguuucggaagagagucaaguaucgaagaaugcaaaauaagacaguggggcacaagagcuuguucccacuccgaagacgcuggagucacauguacucuauag

SEQ ID NO: 248929 - RNA, 195 nt, Artificial Sequence; identical to SEQ ID NO: 248323
  Description of Artificial Sequence: Synthetic coding sequence

SEQ ID NO: 248930 - RNA, 399 nt, Artificial Sequence
  Description of Artificial Sequence: Synthetic coding sequence
auggcgaugaaggaggaacaagugcauuuggaacaagaaauuaaaggggaaguuaaaguuuuaaauaauaucaccaaugaucuacgcuugaaggauugggagcacagucagacucugcguaacauuacucucauucagggccccccaggaccgccaggggagaagggcgauagaggucccaccggcgagucugguccccgcgguuuccccggcccaauuggacccccaggguugaaaggagaccguggagccaucggguuuccuggaagcagaggauugccuggauaugcuggcagaccaggcaauucaggacccaaggggcagaagggggaaaaaggaucuggaaacacccuccgcccagugcaacugaccgaucacauccgagcaggacccaguuag

SEQ ID NO: 248931 - RNA, 1143 nt, Artificial Sequence
  Description of Artificial Sequence: Synthetic coding sequence
augagauggcugcuacucuauuaugcacuuuguuucucccuaucuaaggcuuccgcccauacagucgagcucaacaacauguucggacaaauucaaucccccgguuacccugauuccuaccccagugacagcgaggugacuuggaauauaacggugccugacggcuuccggaucaaauuguacuuuaugcacuuuaaccuggaaagcaguuaccucugugaguacgauuacguuaaagucgaaacugaagaccaaguccuugcuacuuucugcgggcgagaaacaacugacacagagcagaccccugggcaggaagucgucuugaguccagguucauucaugucuaucaccuuuaggucagacuuuuccaacgaggagcgguucacaggauuugaugcucacuacauggccguggauguggaugagugcaaagaaagagaagacgaggagcugucuugcgaucacuauugccacaauuauauuggcggauacuacugcucaugcagauuuggguacaucuuacacaccgauaaucggacuuguagaguggaguguucugauaauuuauuuacgcagagaacuggcgucauuaccucaccugacuuuccuaauccuuauccuaaaagcucugaguguuuauauacgauugaguuggaagagggcuuuauggugaaccuacaauuugaggacauuuuugauauugaagaccaccccgaagugccaugcccuuacgauuacauuaagauuaaagugggacccaaagucuuaggcccauucugcggggaaaaagccccagagccuauuuccacccagucacacagcguccucauucuuuuccacuccgacaauucuggcgagaacaggggcuggcggcugucuuaccgugcagccggcaaugagugucccgaauugcaacccccugugcacggaaagauugagcccucacaggcaaaguacuuuuucaaagaccagguccuggugagcugcgauacuggcuauaaaguccugaaagacaacguugaaauggauacauuccagauagaaugccucaaggacgguacauggagcaauaagaucccuacauguaagaagaaugaaaucgaucuggaaagugaacucaaaucugagcaaguuacagaguag

SEQ ID NO: 248932 - RNA, 2187 nt, Artificial Sequence
  Description of Artificial Sequence: Synthetic coding sequence
augagaugguugcuucuguacuacgcacucuguuuuucccuaucuaaggcuucggcacacacuguagaauuaaacaauauguuuggacagauacaguccccagguuauccugacagcuaccccagugauagcgaggugacuuggaauauuacagucccugacgguuuucguauuaaguuauacuucaugcacuucaaucuugaaucaucauaucucugugaguacgauuauguaaagguggagaccgaggaucaaguucuggcaacauuuugcgggcgugaaaccacagauacugagcagacaccuggccaggaagugguucugucaccuggcucuuuuauguccaucacuuuucgcagugauuuuagcaacgaagaaagauuuaccggauucgacgcucauuacauggccguggacguagaugaguguaaagaacgugaagaugaggagcugucgugcgaucauuacugucacaauuacauaggaggguacuauugcagcugucgguuuggcuacauucugcacacagauaacaggaccuguaggguggagugcucagauaaccuuuucacucagcgcacuggagucauuacauccccagacuucccuaaucccuacccuaaaucuagcgagugccuguacaccauugaacuagaagaaggauucauggugaaucugcaauuugaggacauauucgacauugaggaucacccugaggugccaugccccuacgacuauauuaaaaucaagguuggaccuaaaguguuaggacccuuuugcggagagaaggccccagaaccuauuucuacucagucccacagugucuuaauccuguuucacagcgauaacucuggcgagaacaggggcuggagacuuaguuacagggcagccggaaacgaaugcccagagcugcagccuccagugcacggaaagaucgagccaagccaggccaaauauuuuuucaaagaccaggucuuaguaucgugugauaccggauacaaagugcugaaagauaaugucgaaauggacacuuuucaaauagaaugcuugaaggacggcacauggaguaacaaaauaccaacuugcaaaaucguggacugcagggcaccgggcgaacuggaacacggccucauuacuuuuucgacccgcaacaaucuuacuacuuauaaguccgaaaucaaguauuccugucaagagccguauuauaaaaugcugaauaacaacacaggcauauacacuuguuccgcccagggcguguggaugaauaagguccucggacgaucacucccuacauguuugcccgaauguggacagcccucucgcagccugccaaguuuggugaaaagaauuaucggcggccgaaaugcagagccuggacuguucccauggcaggcguuaaucgugguggaagacaccucgcgaguucccaacgacaaaugguucggaagcggugcucuguugucugcuucuuggauucuuaccgcugcucauguccugcgaucucagcgcagagacaccacugugauuccugugucuaaggagcacguuacaguguauuuaggccuccacgacgucagggauaagucuggagcaguuaacucaagugcagcgcgaguaguccuccaccccgacuuuaauauacagaacuacaaccacgacauugccuuagugcagcugcaggaaccugugccccuggguccccaugugaugccaguguguuugccccgucuagagccugaagggcccgcaccacauauguugggcuuaguugcaggauggggaaucagcaacccaaacgucacugucgacgaaauuauuucuucugggacgagaacuuugagcgauguauuacaguaugucaaacuuccuguagugccacacgccgaaugcaaaacuuccuacgaauccaggucuggaaacuacucagugacugagaauauguuuugugccggcuauuaugaggggggcaaggacacaugccugggugauagcgguggagcguucguaauuuuugacgaucuaucccagcgauggguuguacagggccucguauccuggggagggccagaagaaugcggcaguaaacagguguaugggguguacacgaaggugaguaacuauguggauugggugugggagcaaaugggucuuccucagagugucguugaaccgcaggucgagagguag

SEQ ID NO: 248933 - RNA, 2100 nt, Artificial Sequence
  Description of Artificial Sequence: Synthetic coding sequence
augcgcuggcuccuucuguacuacgcuuuauguuucucacugagcaaagccucagcucacacgguagaguuaaauaacauguuuggacaaauucaaucucccggauacccugacuccuauccuucugauagcgaggugacuuggaauauuaccguaccagauggcuuucgaaucaaacuguacuucaugcauuuuaaccuggagucgaguuaccucugcgaauacgacuaugugaaggucgagaccgaagaucaaguacuggccaccuuuugcggccgcgagacuacugauacugagcagacgccuggccaggaagucguccugucuccaggaagcuucauguccaucacguuucggucggauuuuucgaacgaagaacgauucacugguuucgacgcccauuacauggcuguagacguugacgagugcaaagaacgagaagaugaggaacugucuugcgaucacuauugucacaacuauaucggaggcuauuacugcagcuguagauucggguacauucugcauaccgauaauagaaccugucgugucgaaugcucugacaaccuauucacucaacgcacagguguuaucaccucaccugauuucccuaaucccuacccgaaaucaucagaauguuuauauaccauugaacuggaggagggcuuuaugguuaaccugcaguuugaagacaucuuugauauugaagaccacccagaagucccaugcccauacgacuauaucaaaauuaagguggggcccaaagugcucggaccguucuguggcgagaaggcccccgagccaauaagcacccaaucacauagcguacuuauucuuuuucacucagacaacuccggagagaaccgcgguuggaggcuguccuacagagcagcaggcaacgaaugccccgaacugcaacccccuguacauggcaagauugagccgucacaagcaaaauauuuuuucaaggaccaggugcugguuuccugcgauacuggguauaagguucucaaagacaacguggaaauggauacguuccagaucgaauguuugaaggauggaacauggucaaacaaaauucccaccuguaagaucguggacugucgcgcuccgggagaacucgaacacggucuaauuaccuucucuacccgaaacaaccugacgacauacaagucagaaauuaaauauucaugccaggaacccuacuacaaaaugcucaauaauaacacgggaaucuacacaugcagugcccagggcguauggaugaauaaaguucuggggcgaucuuuaccaacgugccucccagucuguggccuaccuaaguuuucacguaaacugauggcucgcaucuuuaacggacgaccugcacagaaagggacaacuccauggaucgcuauguuaucccacuuaaauggacaaccuuuuugcggggggucacuccucggcuccucguggaucguaacugcggcucauugccuucaccaaucucuggauccagaagaucccacacuaagggauagugauuugcuuaguccaagugacuuuaaaaucauccuggguaaacacuggagauugagaucagacgaaaaugagcagcaccugggagugaagcacacuacucuccacccccaguaugaccccaauacauuugagaacgacguggcccugguugagcugcuugaaucgcccguccugaaugcuuuugugaugccaaucugucuccccgagggaccacagcaagaaggagcuaugguaauuguguccggcuggggaaagcaauuucugcaacgcuuuccagaaacccucauggaaauugaaauuccuauagucgaccacagcacuugucagaaagccuaugccccccucaaaaaaaagguaacgagggacaugauuugcgcaggugaaaaggaaggcggaaaagacgcgugcgccggagacucuggagguccuaugguaaccuugaacagagaaaggggccagugguaccugguggggacagugucuuggggagacgacugcggaaagaaagauagauacgggguguacagcuacauucaccacaacaaagauuggauacaacguguuacaggggugcgaaacuag

SEQ ID NO: 248934 - RNA, 1848 nt, Artificial Sequence
  Description of Artificial Sequence: Synthetic coding sequence
auguccaucaccuucagauccgacuucuccaaugaggaacgcuucaccggauucgacgcucauuacauggccguagacguggacgaauguaaagagagagaagacgaggaacugucaugcgaccacuauugucacaacuauauuggcggcuauuauugcaguugucgguucggcuacauauugcacacugauaaucgcacgugcagaguugaguguucugauaaucuguucacacagaggaccggcgucauuacaucaccugacuuucccaacccuuaucccaaauccagcgaaugccuguauacuaucgaguuagaagaagguuucauggugaaucuccaguuugaggacaucuucgacaucgaagaucauccugaaguuccuugcccuuacgacuacaucaaaaucaaaguuggaccgaaaguccucgggcccuuuugcggagaaaaagcgcccgagccuauuuccacgcaaucucacucuguuuuaauauuguuucauuccgacaacucaggagaaaauagaggauggagacuuagcuauagagcggcuggcaacgagugcccggaacugcagccaccaguccacggcaagauugaaccuucacaagcgaaguauuucuuuaaagaccaaguccugguaagcugugauaccgguuauaaaguucucaaagacaauguggagauggauacauuccagaucgagugccugaaggauggaacuugguccaacaaaauuccaacguguaagauuguugauugucgagccccaggcgaacuggaacacggccuaauuacauuuucuacucggaacaaucugacgacauauaaaagcgagaucaaauauagcugccaggaacccuauuacaaaauguuaaacaauaauaccggaaucuacacuugcucagcccaagguguguggaugaacaaaguucucgggcgaagucucccaaccugccucccagagugcggacaaccuucccgaagccugccuucuuuggucaaacggaucauuggcggaaggaaugcagagccuggacuguucccuuggcaagcccucauaguuguagaggauacuucgagaguccccaacgacaaaugguucgguuccggggcuuuacucagcgccuccuggauauugacagcagcgcacgucuuacggagccagcgccgcgauacuacagugauuccgguaaguaaggagcacgugacaguuuaucucggcuugcaugauguuagggacaagucuggagccgucaacaguagugcagcucgcgucguacuucauccugauuuuaacauucaaaauuauaaccacgauaucgcucuuguacaacuucaggaaccugugccuuuaggcccucacgugaugccagugugucucccgcgacuggaaccggagggccccgccccucacaugcucggacuaguugcgggcuggggcauaaguaaucccaaugugacuguugaugaaaucauaaguuccggaacaagaaccuugagugacguguugcaguaugucaaacugccuguggugccucaugcugaauguaagacaagcuacgaaucucgaucuggaaacuauagugugacagaaaacauguucugugcaggcuacuaugaaggcgguaaggacacuugcuuaggcgauagcggaggggccuuugugauauuugaugaccuuagucaaagaugggugguucaaggccuggugagcuggggagggcccgaagaauguggaucaaagcaaguguauggaguauauacaaaagucucgaacuauguggacugggugugggaacaaaugggccucccucagucuguuguagagccucaaguagagcguuag

SEQ ID NO: 248935 - RNA, 249 nt, Artificial Sequence; identical to SEQ ID NO: 248329
  Description of Artificial Sequence: Synthetic coding sequence

SEQ ID NO: 248936 - RNA, 1443 nt, Artificial Sequence
  Description of Artificial Sequence: Synthetic coding sequence
augagcauaaccuucagaucagacuuuucgaacgaggaacgauucacuggauucgacgcucauuacauggccguagacguagaugaauguaaagaaagagaggacgaagagcugucuugugaccacuacugccacaauuacaucggcgguuacuacugcagcuguagauuuggauauauucuccacacugacaaccgaacauguagagucgagugcuccgauaaucuuuucacccagcgcaccggaguuauuaccucuccugacuuuccaaaucccuaucccaaaucuuccgagugccuuuauacgaucgaacuggaggaaggguucauggucaacuuacaguuugaagacaucuucgacauagaagaccaccccgaagucccuuguccuuacgacuacauaaaaaucaaggucggccccaaaguguugggucccuucuguggagaaaaagcucccgagccaauuagcacacagucucacagcgugcuuauccucuuucauucagacaacagcggcgaaaacagagguuggcgguuaucuuacagagcagccggaaacgagugucccgagcuccagcccccagugcaugguaaaauugaaccaucucaggcaaaguacuucuucaaggaccagguuuuagucagcugcgacacaggguauaagguguuaaaagauaauguggaaauggacaccuuucagauagagugucugaaggaugggaccuggaguaauaaaauucccaccugcaagauuguggacuguagggccccuggagagcuggaacacggauuaauaaccuucucuacucgcaacaauuuaacuaccuauaaaagugaaauuaaauauucaugucaagagcccuauuacaagauguugaauaacaauaccggcauuuacaccugcagcgcccaaggaguguggaugaacaaggucuuaggacgcucacucccgaccugccugccugagugcggucagccuuccagauccuugccuucccucgucaagaggaucaucggugggcgcaacgcugaaccuggcuuguuccccuggcaggcacucaucguagucgaagauaccucucggguccccaaugauaaaugguuuggaucaggggccuuacuguccgcauccuggaucuugacagcugcccacguacucagaagccagagaagagacaccaccguuauucccguuucuaaggagcacgucaccguuuaccucggccuccaugauguacgagauaaaaguggcgcagucaacucuucagccgccagggugguuuugcaccccgacuuuaauauccagaauuacaaucacgauauagcucugguucagcugcaggaaccuguacccuuggguccucacgucaugcccguaugcuugccucgacuagagccccccggaggaagguugggucaucuccagucucagugugauucuuag

SEQ ID NO: 248937 - RNA, 834 nt, Artificial Sequence
  Description of Artificial Sequence: Synthetic coding sequence
auguuccccuucuacucauguuggaggaccggacuccuacuucuccuccucgcuguugccgucagggagucauggcagacggaagagaaaacgugcgaccuaguuggggagaaaggaaaggagagcgagaaggaacuggcacucgucaagaggcuuaaaccucuauuuaauaaaucguucgagagcacagucgggcagggaagugacacguauauuuacauuuuuaggguaugucgagaggcuggaaaucacacaagcggugccggcuuaguacagaucaauaaaagcaacgggaaagaaacagugguuggccgacugaaugagacacacaucuuuaacgggaguaacuggauaauguugauuuauaagggaggcgacgaauacgauaaccauuguggcaaggaacagagaagagcuguugugaugaucucauguaauagacauacacucgcugacaacuucaauccuguguccgaagagagggggaagguccaagauuguuuuuaccuuuucgaaauggacucuucacuggcaugcagcccagagaucagccaucucagugucggcagcauauuacucgugaccuucgcaucguuagucgcuguguacguugugggaggcuucuuauaucaacgguuggugguuggugccaaaggaauggagcaguucccccaccuggccuucuggcaagaucuggggaaucugguggcugauggaugugauuuugucuguagaaguaagccaagaaacgugccugcugcuuauagagguguaggcgacgaccaacugggcgaggaaucugaagagcgggacgaccaccuacugccaauguag

SEQ ID NO: 248938 - RNA, 3942 nt, Artificial Sequence
  Description of Artificial Sequence: Synthetic coding sequence
augucaggauggagauaucugauuugcgugucuuuucugcugacaauucugcuggaauugacuuaucagggccccccaguaccagccucguccuccaccaaacugcugaugacuagcuauaguaugcggagcacaguuguuucacgcuacgcccacacuuugguuaccagcguguuguucaauccccacgccgaagcccaugaagcuauauucgaucuugacuuaccacaucuggcauuuauuagcaauuucacaaugacuauaaauaacaagguauauaucgccgaaguuaaggaaaaacaccaagcaaagaagauuuaugaggaagcacaccagcagggaaagacagcagcccauguaggcauccgcgauagggaauccgagaaguuccggauuagcacaucauuagccgcagggacagaaguuacauuuucauuagcauacgaagaacugcuacaacgacaucaaggacaguaucagcuggucgugucacugagaccgggccaacuggucaaacgccucagcauugaaguaacggugagcgaacguacggguauuaguuacgugcauauccccccacugcgcacuggacggcuccggacuaaugcacaugcgucugagguugauuccccgccaucaacccgcauagagagaggagaaacuugcguccggaucaccuauugcccuacccuucaagaccaaaguucgaucaguggcucugguauaauggcugauuuucuuguacaauacgacguagugauggaagauauaaucggcgacguucagauuuacgaugauuauuuuauccauuauuucgccccaagaggucugcccccuauggagaagaacgucguauucguaauugacguuucuuccaguauguucggaaccaagauggaacagaccaagaccgcaaugaacgucauacuaagcgaucuacaggccaaugauuauuuuaacaucauuucauucuccgauaccgucaauguuuggaaggcagggggcucuauacaggccacaauucagaauguccacagcgccaaggacuaccugcauuguauggaggcagacggauggaccgauguaaauuccgccuuguuagccgcagcuagcgugcuuaaucacuccaaucaggagccagggagaggucccucuguuggaagaaucccucuuauuauauuuuugacugacggcgaaccuacagcuggcgugacaacaccaucugugauacuauccaacguaaggcaggcacuugggcaccgcgugucacucuuuucuuuggcauuuggagacgacgcggacuuuacccugcuuagacggcucucuuuagaaaaccgcgggaucgcgcggagaaucuacgaagacaccgacgccgcguuacagcugaaaggauuauacgaagaaaucucuaugccgcuccuggcugacguaaggcugaacuaucucggggggcuugugggagcuaguccgugggccguguuccccaacuauuucggcgguagcgagcuuguaguagccggccaaguucaaccugggaaacaggaacuggggauacacuuagcagcaaggggacccaaagaucaacuccugguggcccaccacucugaaggugcaacaaacaauucacagaaggccuucggguguccuggagaaccagcaccaaaugucgcucacuuuauccgaagacucugggcauacguaacgauaggcgaguugcuugaugcccauuuccaggcucgugacaccacuacucgccacuugcuugcugccaagguucugaauuugagucuggaguacaacuuugugaccccccuuaccagccucgucaugguccagccuaaacaagcaagugaagaaacaagacggcagacauccacaagcgcagguccugacacaaucaugcccucaaguucuagucgucacggccucggagucucuaccgcucagcccgcguuggugccaaaagucauuagccccaagucccguccaguuaaacccaaauucuaccugucgaguacaaccacugcuuccaccaagaaaaugcugucauccaaagaauuggagccucugggcgaguccccucauaccuugucuaugcccaccuacccgaaagcaaaaauuccugcgcagcaagacucaggaacguuagcucagccaacccuaagaacaaaaccgaccauucuggugccuaguaacucagggaccuuacuuccucugaaacccggcucccucucccaucagaaccccgacauucugcccacaaacagcagaacucaggugccuccagugaagccuggaauaccagccuccccuaaagccgacacagucaagugcgugacaccccugcauagcaagccuggcgcuccuucccauccacaacucggagcacuuacaucgcaagcaccaaaaggccugccacaaucacgaccaggcguuucuaccuuacagguccccaaguauccccuccacacuagaccacgagugcccgccccaaagacacgaaacaacaugccccaccugggcccgggaauacuccucucaaagacccccaagaucuuacuaaguuugaagccaagcgcaccuccucaccagaucucuaccucgauaucccucagcaaacccgagacacccaauccucacaugccgcagacuccucugcccccccgucccgacagaccacggcccccgcuuccugaaucacugagcacauuuccuaauacaauaagcucuucaacagggccuuccucaaccacuacuacaucuguucugggugaaccacuaccaaugccuuuuacccccacacugccuccuggucgguucuggcaccaguacgaccugcuccccgguccucagcgcacucgccagguacuuggcccaaguagacccggggucccaacaaugucccucuugaauagcucaagaccaacaccagagggcucucccccuaaccugccuauucuacuucccucuucuauuuugcccgaagcgaucucccuccugcugcucccagaggaacuugagcuguuauccgaauccaugguggaauccaaauuugucgaaucccuaaacccgccugccuuuuauacauuccugacccccgaugaggacgggucuccaaauugggauggaaauagcgaagagaucuuagggggggcagguggcucaauggaaucccaagguucaucugucgggcuggccaaggguacuuuaccuuccaucuucacauucucaucaucaguugacggcgacccgcauuucgucauccagaucccccacagugaagagaagaucuguuuuacucucaacggucaucccggcgaucuucugcagcuaaucgaggacccuaaagccggccuacaugugagcggaaaacucuugggggccccacccagaccaggccauaaggaccagaccagaacguauuuccagauuaucacagucacaaccgauaaaccccgcgccuauaccauaacaauaagucgcaguucaaucagccuccggggcgagggaacucugcgguuguccugggaccagccagcccuacucaaaagaccacagcuagagcuuuauguugccgcugcugcccggcucacccuaaggcuaggccccuaucucgaauucuugguccugagacaucgcuauagacaucccucuacccuccagcucccucaucugggguuuuauguugccaacgggagcggccuuagcccauccgcccgcggucucauuggacaguuccagcacgccgacaucagacucguuacuggcccuauggguccuugccugagaagacaccacggaccugauguaccagugauacuuggcaagcgccugcuaaaagauucccccagacugcugccuaggugggcuaguuguuggcucgucaagcggucccaugucgaauugcuuuuaggucacccuuaucuaucauauguacuguag

SEQ ID NO: 248939 - RNA, 804 nt, Artificial Sequence
  Description of Artificial Sequence: Synthetic coding sequence
augaugagcucuaagcccaccagccacgcugaggucaacgagacaaucccuaacccauaucccccaagcuccuuuauggccccaggauuucagcaaccccugggaucuaucaacuuagaaaaccaggcucaaggugcacagcgcgcacagcccuaugguauaacuucccccgggauauucgcaucaagucaacccggacaggggaauauccaaaugaucaaucccuccguaggaaccgccgucaugaacuuuaaggaagaagcaaaagcucugggaguaauccagauuauggucggucugaugcacauaggcuuuggcauuguuuuaugucuuauuuccuuuuccuuuagagaggugcucggcuucgcuagcacggccgucauugguggcuaucccuuuuggggcggguugucuuuuauuauaucaggcagucuguccgucagugccaguaaagaacuuaguagguguuuggugaaagguagucuuggaaugaauauugugagcuccauacucgcuuuuauaggcguaauacugcuccuggucgauaugugcauuaacggcguugcgggacaagacuacugggcuguucugaguggcaagggaauuucugcuacuuuaaugauuuuuucccuccucgaauucuucgucgccugugccaccgcccacuucgcuaaucaggcgaacacgaccaccaauaugucaguuuuggucauaccuaauauguacgagucaaauccagucacaccagcuuccaguagugcgccgccacgauguaacaauuauucugccaaugcccccaaauag

SEQ ID NO: 248940 - RNA, 876 nt, Artificial Sequence
  Description of Artificial Sequence: Synthetic coding sequence
auggaacgcaaaagaugggaaugucccgcacugccccagggaugggaaagggaagagguaccucgccguaguggacugucggcgggccaccgugaugucuucuacuauucgccgagcggcaaaaaauuuagguccaagccucaacuugcacgauaccuaggagguagcauggaucugagcaccuucgacuuuaggaccgggaaaauguuaauguccaaaaugaauaaguccagacagcgcguucgauaugauagcucuaaucaaguuaagggaaagccugaucuuaacacugcccugccuguucggcagacugcaagcauuuucaaacagccagucacgaaaauuaccaaucacccaucuaauaaagucaaaagugacccccaaaaagcaguggaccagccacgccaauuauuuugggaaaagaaguuguccggauuaaacgcauuugacauugcagaagagcuggugaagacaauggaucugccaaaggggcuccagggcgucggaccgggguguaccgaugagacuuuguuauccgcgaucgcuuccgcacuucauacaucuacaaugccaauuacaggccagcucuccgccgcaguggaaaaaaacccuggaguguggcugaauaccacccagccccuguguaaagccuuuauggugaccgacgaagacaucagaaaacaggaagaacuggugcagcagguucgaaagagacuagaagaggcccuuauggcugauaugcucgcacauguggaagagcuggccagagacggagaggccccucuugauaaagcuugugcagaggaugaugacgaagaggaugaggaagaagaagaggaagagccugacccagauccugagauggagcacguguag

SEQ ID NO: 248941 - RNA, 522 nt, Artificial Sequence
  Description of Artificial Sequence: Synthetic coding sequence
augucucuuuugggcccuaagguucugcuguuucuggccgcauucaucauaaccucugauuggaucccucucggagugaauagccagcggggcgacgaugugacccaagccacaccugaaaccuucacugaagaccccaaccuuguuaaugauccagccacagaugaaaccgugcucgcuguacucgcagacaucgcaccuagcacugaugacuuggcuucccucagcgaaaaaaacaccacugccgaguguugggacgagaaauuuacaugcacuagguuguacucgguccaccguccagucaaacaauguauccaccagcucuguuuuaccucuuugcggcggauguauauaguuaauaaagaaauaugcucaagacuggucuguaaggaacacgaggccaugaaggaugaauugugucgucagauggcaggacuaccuccccguagauuacgacguuccaacuacuuuaggcucccaccgugcgagaacgucgacuugcagcggccuaauggccuguag

SEQ ID NO: 248942 - RNA, 492 nt, Artificial Sequence
  Description of Artificial Sequence: Synthetic coding sequence
augucucuccugggcccuaagguucuccuguuccucgcagcuuucaucauaacuucugauuggauuccacugggaguuaauucgcaaagaggcgaugacgugacacaggccacccccgaaaccuuuaccgaggauccaaaucuagucaacgacccugcuacagacgaaacggugcucgccguguuggccgacauugcucccuccacugacgacuuggaguguugggaugaaaaguucacaugcacgcgacucuauucagugcauagaccggucaaacagugcauccaccagcugugcuuuacaucacugaggaggauguauauaguaaauaaagagaucuguuccagacugguaugcaaagagcacgaagcuaugaaggacgaacucugucggcagauggcuggccucccuccucgccgacucagaagaucaaauuauuuuagacucccccccugugagaacguggaccugcagcgacccaacggccucuag

SEQ ID NO: 248943 - RNA, 447 nt, Artificial Sequence
  Description of Artificial Sequence: Synthetic coding sequence
augucguugcuugggccuaaagugcuucuuuuucuggcugccuucauaauuacaucugacuggaucccccugggcgugaacucgcagcgcggagaugaugugacacaagcuacucccgaaaccuucacggaagauccuaaccuggugaaugauccagccacagacgagaccgaauguugggaugaaaaauucaccuguacuagacucuacuccgugcaucgccccgucaaacagugcauucaccaacuuuguuuuacuucccuacggcgcauguacaucgucaauaaagagauuuguucgcggcugguaugcaaggaacaugaagcuaugaaggaugagcucugccgacaaauggccggccuccccccaagacgacuaaggcggucaaacuauuuccgauugccucccugcgaaaaugucgaucuccaacgaccaaauggcuuguag

SEQ ID NO: 248944 - RNA, 492 nt, Artificial Sequence
  Description of Artificial Sequence: Synthetic coding sequence
augucuuugcuaggaccuaaaguucuguuguuccuggccgccuuuauuauuacaucugauuggaucccccuuggagugaauucccaacgcggugaugacguaacccaggccacccccgaaaccuucacugaggacccaaaucuugugaacgacccggccacugaugagacgguuuuagccgugcuggcugacaucgcccccaguacggaugaucuggaauguugggacgaaaaguucacauguacacgccuuuauucagugcaccguccaguuaaacagugcauacaucaacuuugcuucacuucccucagaaggauguacauugugaacaaagagauauguucaaggcugguguguaaagagcaugaagccaugaaggacgagcuguguagacagauggcaggucuccccccccgacgguugcgccguuccaauuacuuuagacucccaccuugugagaacguggacuugcaaaggccaaacggguuguag

SEQ ID NO: 248945 - RNA, 276 nt, Artificial Sequence; identical to SEQ ID NO: 248339
  Description of Artificial Sequence: Synthetic coding sequence

SEQ ID NO: 248946 - RNA, 468 nt, Artificial Sequence
  Description of Artificial Sequence: Synthetic coding sequence
augguugacuuaacccagguaauggaugaugaaguauuuauggccuuugcuagcuaugcaaccauuauccugagcaagaugaugcuaauguccacagcuacagccuucuacagacuuaccaggaaaguauuugccaaccccgaggauuguguggccuucgguaaaggagagaacgcgaagaaauaucugcggacugacgaucguguggaacgcguacggagagcacaucuuaaugauuuagagaacaucauccccuuucucgggauaggccuucuguauucacugagcgguccagaucccucaaccgcaauccuucauuuccgauuauucguaggcgcacggaucuaccacacaaucgcauaccuaacuccacuuccacagccuaauagagcucugucuuuuuuuguuggauacgguguaacgcuguccauggccuaucguuuacugaaguccaaacucuaccuguag

SEQ ID NO: 248947 - RNA, 4395 nt, Artificial Sequence
  Description of Artificial Sequence: Synthetic coding sequence
auguucuccuuuguugauuuaagacuacuacugcugcuagcugccaccgccuugcugacacacggacaggaagaaggacagguggaaggacaggacgaagauauucccccaauuacuuguguccaaaaugggcugagauaucacgaucgagauguguggaagccugagccuugccggauuugugucugcgacaauggcaaaguucucugcgaugaugugauuugcgacgaaaccaagaauuguccaggcgccgaggugcccgagggagaaugcugccccguaugcccagacggcucugagucuccuacagaucaggaaacaaccggcgucgaagguccaaaaggcgacacuggaccuagggguccuagaggaccugcggggccucccggaagagaugggauccccggacaaccugguuuaccgggccccccaggcccacccggaccgccaggacccccuggccugggcgguaauuuugcaccucaguuguccuacggguaugaugaaaagaguaccgguggaaucucagugccuggcccuaugggaccguccggaccccguggucuaccgggcccaccaggugcaccggguccgcagggguuucaggggccacccggcgaaccgggggaaccgggugcuagcgggccuaugggaccaagaggccccccugguccccccggaaagaauggugaugauggggaagcaggcaaaccuggacgaccuggggagcgcggucccccagggccacagggugcgcggggccugccugggacugcgggacuaccuggcaugaaaggccaccgaggcuucucggguuuagacggagcgaaaggcgacgcaggaccugcuggaccuaaaggagaaccuggaucgccuggggagaauggggccccaggccaaauggggccuaggggcuuaccuggggagagaggucgacccggugcaccugggcccgccggagcgcgagggaaugacggugcuacaggcgcagcagggccacccggacccacugguccugcaggacccccuggguucccuggugccgucggugcuaaaggggaagcuggaccucaaggcccacggggaucugaaggaccucagggugugaggggugagcccggcccuccuggaccggccggagcagccgggccagcaggaaauccaggugcagaugggcaaccaggggccaaaggagcuaacggcgcaccuggcaucgccggugcgccaggcuucccaggugcacgcggacccuccggaccucagggaccuggcgggcccccggggcccaaagggaacucaggugaaccaggcgccccgggaucaaagggagauacaggcgcaaaaggcgagccgggaccaguuggaguucaaggcccacccggaccugccggagaggaaggcaagagaggggccagaggcgaaccaggaccaacaggguuaccaggcccccccggagagcgcgggggaccugggagucgcggcuuuccuggagcugacggaguggcagggcccaaaggaccggcaggcgaaagggggucccccggaccagccgggcccaaaggcaguccuggcgaagcugguagaccaggcgaggccggccugccuggcgcuaaggggcuuacugguuccccagguuccccuggucccgacgguaagacuggaccccccggcccggccggacaagauggacggccaggcccaccuggcccaccuggugccaggggacaggccggcguaaugggcuuucccggaccaaaaggagcagcuggagagccugggaaagcgggugagaggggaguuccuggaccccccggcgcuguggggccggcaggcaaagacggagaggcuggggcacaggguccacccggaccggcuggcccggccggcgaacguggggagcagggaccagccgguucuccaggauuccaaggucuacccggaccagcgggacccccuggagaagcagguaaaccaggugagcagggaguccccggugaccuuggcgccccggggcccaguggagcgagaggggagaggggauuucccggggaacggggcguacaaggcccacccggcccagccggcccuagaggggcuaauggugcuccagggaacgauggcgcuaaaggagacgcgggcgcucccggcgcuccagguucucaaggcgcucccgguuuacaaggaaugcccggcgaacguggcgccgccggccuccccggaccaaagggagacagaggcgaugcagguccaaaaggagcagacggcuccccugguaaggauggugugagaggcuugaccggaccuauagggccucccgggccggccggggcccccggagacaaaggcgagagcggaccuucagggcccgcagggcccacaggcgccagaggagccccaggggaccguggggagcccggaccacccggccccgcaggauuugcuggccccccaggugcugaugggcagcccggggccaagggagaaccaggggacgccggagcuaagggagaugccgguccuccaggcccugcuggcccugccggacccccaggacccaucggaaacgucggcgcccccggugcaaaaggcgcgagaggcucagcaggcccacccggugcaacuggauuccccggagcagcaggccguguagguccgccggggcccucaggaaaugccgguccccccgggccucccgggccugcuggcaaagaggguggaaagggcccaagaggugagacuggucccgccgggagacccggagaaguugggccccccggaccacccggcccugcuggcgagaaaggcagccccggugccgauggccccgccggcgcacccgggacuccuggaccucagggaauagcagggcagcggggaguggugggccuuccaggccaaagaggagaaagagguuuccccggccugccggguccaaguggagagcccggcaaacaagggccuaguggggcaucgggugagagggggccaccugguccgauggggcccccuggacuggcagggcccccgggagaaucaggucgggagggagccccuggagcugaaggcagccccggccgcgauggcaguccaggagccaaaggugauagaggugagaccggcccugcuggcccucccggagcaccaggcgcacccggagcuccggggccuguggguccugcugggaagagcggagaucggggcgagacaggcccagcugggccaacuggacccgucgggccaguaggugcucgaggcccugcaggcccccaggggccaagaggugacaaaggggagacaggggagcagggagauagagguaucaagggccaccgcggcuuuucuggacuccagggaccaccugggccccccggcucacccggggaacaaggaccuucuggcgcguccgggcccgccggaccacggggcccacccggcagugcaggagcccccgggaaagacggccuuaacggauugccuggccccauuggcccccccggacccagaggcagaacaggugaugcgggucccguuggccccccuggcccaccuggacccccaggaccaccaggcccucccucugcuggcuuugacuuuuccuuucuuccucagccaccccaggaaaaagcccaugacggcggccgcuacuaccgcgcugaugacgccaaugugguacgagauagagaucuggaaguugauacaacauuaaaauccuugucacagcaaauugaaaauauucguucuccagaaggaaguaggaaaaaccccgcucgcacuugcagagacuugaagaugugucacucugauuggaagaguggagaauacuggaucgauccaaaucagggcuguaaccuagaugccaucaagguuuucugcaauauggaaacuggggagacuuguguguauccaacccagccuagcguggcucagaagaacugguauaucucaaagaaucccaaggacaagagacaugugugguuuggcgaaaguaugacagauggcuuucaauucgaguacggggggcaagggucagacccagcagauguggcuauacaguugacauuccuaagacucauguccacagaggcaucacagaacauuaccuaccacugcaaaaauucagucgccuauauggaucagcagacagggaaucugaagaaagcuuuacuuuuacaagguucaaacgagauugagauuagggccgagggaaauagcagauucaccuauagcgugacaguugauggauguacaagucacaccggcgcgugggggaagaccguaauagaguacaagaccacaaaaacuucucggcuaccaaucauagacgucgcuccucuggaugucggcgcacccgaucaggaguuuggauuugacguggggccugugugcuuccuguag

SEQ ID NO: 248948 - RNA, 606 nt, Artificial Sequence
  Description of Artificial Sequence: Synthetic coding sequence
auggcagcaagaacagcuuuuggcgcaguaugucgcagacuuuggcaaggccucggaaacuucucugucaauaccucuaagggaaauaccgccaaaaacgguggccugcuucugucaacaaacaugaagugggugcaguuuaguaaccuucacguggauguuccaaaggacuuaacuaagcccguagugacuauaagcgacgaaccagacaucuuauauaagcggcucuccguccucguuaaaggucacgauaaagcgguuuuagauaguuacgaguauuucgccgugcuggcggcgaaagaacucgggauuucuauaaaagugcaugagccacccagaaaaauagaacgauucacccuuuugcagagcguucacaucuauaagaaacauaggguccaguaugaaaugcgaacacuguaccgcugucuggaguuggagcauuuaaccggaucuacagcugacguuuaccucgaauacauccagcgaaauuuacccgaaggcguugccauggaggucaccaagacccagcuggagcagcuucccgaacacaucaaggaaccuauuugggaaacucugagcgaagagaaggaggaguccaaaucauag

SEQ ID NO: 248949 - RNA, 972 nt, Artificial Sequence
  Description of Artificial Sequence: Synthetic coding sequence
auggcugccgccgcacugcccgcauggcuuucccugcaaucacgagccagaacgcugagggcuuucuccaccgcuguguacucugccacccccgugccgacccccucacuuccagaacgcacuccugguaacgagagaccccccaggcgcaaagcuuuacccccuaggaccgaaaagauggcagucgaccaagacuggccuucgguguauccaguagcagccccuuucaagccauccgcugugccuuuaccagucagaaugggguacccagugaaaaaaggagucccaauggcaaaggagggcaaccucgagcugcugaaaaucccuaacuuucuccaucucacccccgucgccauaaagaagcacugcgaagcacuaaaagauuuuugcacugaguggccugccgcgcucgacuccgacgaaaaaugugaaaagcacuucccuaucgaaaucgacucaacugacuauguaucuucuggccccuccguucgaaacccccgugcccgagucguuguacuacgcgucaaauuaaguagccugaaucuggaugaccacgccaagaaaaagcucaucaagcucguaggagaacgcuacugcaagaccaccgauguguuaacgauaaaaacagacaggugcccccugaggcggcagaauuaugauuacgcuguguaucuauugacaguacuguaccaugaaaguuggaauaccgaagaaugggaaaaaucuaagacagaggcagauauggaggaguacauaugggaaaacucaaguuccgagagaaauauccuggagacccugcugcagaugaaggcugcugagaaaaacauggagauaaacaaggaggagcugcuggguacgaaagaaauugaggaauacaagaaaagugucgugagucugaagaaugaagaagaaaaugaaaauucuaucagccaguacaaagaaucagucaaaagacucuugaauguuaccuag

SEQ ID NO: 248950 - RNA, 1797 nt, Artificial Sequence
  Description of Artificial Sequence: Synthetic coding sequence
augcucccugauuuccccuccccuaguaccugggccccuggacuucuacugccauccggaccagccuugcucagcccgucaguucugcaagacucucuuagcuuaggucgaagugaacagccucauccaauauguuccuuucaagaugauuuccaagaguuugagaugaucgaugauaaugaagaggaggaugaugaggaugaggaagaggaggaagaagaggaagaaggagauggagaagggcaagaagguggugaucccggaagugaggcacccgcuccgggcccccugauuccuagcccaagcguagaagagccacacaagcaccgcccgaccacucugcgccuuaccacccuuggugcucaggacagccaagauccugaggcugcggccgggcccggaggagucgagcuuguugacauggagacccugaacccaaccagagauacuaucaccccccuuugggcagcaccagggcgagcagcuagacccggacgugcgugcucugccgcauguuccgaggaggaggacgaggaggacgaugaagaagaagaagacgccgaagauuccgccggaucaccugggggcagaggcaccggcccuagcgcaccgcgcgacgcaucucuuguuuaugacgcagucaaguauacuuugguagucgacgagcacacacaguuggaguuggucucucugagaagaugugcaggccugggacaugacuccgaagaagauaguggcggggaagccucugaagaggaggcuggggcagcucuucugggcgguggacagguuucaggcgauacguccccagacuccccagaucugacauuuucuaaaaaguucuuaaaugucuucguaaacagcacgucucggucuucuucuacugaaagcuuuggccuguucucuugccuaguaaauggagaggagagggagcagacucauagagccguauucagauucauucccaggcaucccgacgagcucgaauuggacguugacgacccuguguuagucgaggcugaggaggaugacuuuugguuucgaggauuuaauaugagaacgggcgagaggggaguguuccccgcauucuaugcgcacgccguaccagggccugccaaggacuuacuggguaguaaacggagcccuugcuggguagaacguuuugaugugcaguuccucggguccguugaagucccgugccaucaggguaauggaaucuuaugugcagccaugcagaagauagccaccgccaggaagcugaccguucaucuacguccccccgccucaugugacuuagagauaagcuuaagagguguuaaacugucuuuaagcggcggcggcccagaguuccaaagguguucccauuucuuccagaugaaaaacauauccuucuguggaugccauccgaggaauuccugcgaagcaccucaaggcgcagccuuucaaugggagcggggcguugauagaaaacggguccuucagacucgcgguaacguacagccacaccucggcgcuggacagggcgcugcacucaaccgcgccaccgaaggauccuccaccggauccgagaaaggcgaauggacaccgcucgugaucauggagcucacccaaucagugaauaguuguuacuuuggguuuaucaccaaacauccucuuuugucaagauuugccugucacguuuucgugucucaggaaaguaugagaccugucgcacagucagucggucgagcauuccucgaguauuaccaagaacaccuugcauaugccugucccacggaggauaucuaucuugaauag

SEQ ID NO: 248951 - RNA, 3357 nt, Artificial Sequence
  Description of Artificial Sequence: Synthetic coding sequence
auggaacccuccagagcauugcuggguuguuuggcuuccgcagcagcggccgcacccccgggcgaggacggggcuggggccggcgccgaggaggaggaggaagaggaagaggaagcagcugcagcugucggaccaggugaguuagguugugaugccccccugcccuauuggaccgccguuuuugaauaugaggccgcaggugaagacgagcucacauuacgccugggggacgugguagaagugcugagcaaggacucacagguaucaggcgacgaaggcugguggacaggccaguugaaucagagagucggaaucuucccuaguaauuaugucacuccuaggagugcauucaguagcagaugccagccuggcggugaggacccuagcuguuacccccccauccagcuccuagaaauugacuuugccgagcuuacccucgaggaaaucauaggaauuggcggcuuuggaaaagucuauagagccuuuuggauuggugaugaaguggcagugaaggcugcucggcacgaucccgaugaagacauaagccagaccauugaaaacgucaggcaggaagcuaagcuauuugcuauguuaaaacacccuaacauuaucgcccuccggggggugugccucaaggagccaaaucuaugccucgucauggaauucgcacggggagggccucucaaccgggugcugagcgggaaacggauaccccccgauauccuuguuaacugggccguccaaaucgcaagagguaugaacuauuugcacgacgaagccaucguaccgaucauccaucgagacuugaaaucaucgaauauccuaauauuacagaaaguagaaaauggcgaccucagcaacaagauucucaagaucacagauuuuggucucgccagagaguggcaucgcacaaccaagaugucugcugccgggacuuacgcauggauggcaccagaagugauuagggcguccauguucucgaaagguuccgacguuuggagcuauggcguccuguugugggagcuccugaccggugaagucccuuuuagaggaauagacggccuugcaguggccuacgguguugccaugaacaaauuagcacugccuaucccauccaccugcccagaaccauucgcuaagcucauggaagauugcuggaacccugacccacauucuaggccuuccuuuacaaacauucuggaccaguuaacgacuaucgaggaauccgguuuuuucgagaugccgaaagacucauuccauugccugcaggauaacuggaagcacgaaauccaggagauguucgaccagcuucgagcaaaagagaaagaguugcgaacaugggaagaagaauugacccgggcggcccugcagcagaagaaccaggaagaacuuuuaagacgcagggagcaggaacuggcugaacgcgaaauugauauacuggagagggaacugaauauuauaauccaccagcugugccaggaaaaaccgagagugaagaagcguaagggaaaguuucgaaagucucgcuugaaacugaaggaugguaaucguauaucucucccuuccgauuuucagcauaaauuuaccguccaggccagcccgacgauggauaaaagaaaaagccucaucaacagucgaucaaguccaccagcaagcccaaccauuauacccaggcugcgggccauccaacucacaccaggagaaucaagcaaaacguggggaagaaguuccguugugccaaaggaagagggcgaggaggaggagaaacgugccccuaagaaaaaaggcagaacaugggguccuggaaccuuaggacagaaggaacuggcuaguggcgacgaaggauccccucaaagacgagagaaggccaauggucuaucuacaccaucggaauccccucacuuccacuuaggacucaagaguuugguugacggauacaagcaguggaguagcagcgccccaaaccugguuaaggguccaagaucuaguccagcccugcccggcuuuaccucauugauggagauggcucugcuggccgccuccugggucguucccauagauaucgaagaagacgaagauuccgaaggcccaggcagcggggaaucucgacuucagcauagccccucccaguccuaccugugcaucccauucccucgcggcgaagacggcgacgguccuucaucagacgggauacaugaggagccuaccccagucaauagcgcuaccuccaccccccagcuuacgcccaccaauucccuuaagcgggguggugcucaucaccgaagaugcgagguugcccuccuuggaugcggcgcagugcuggcugcuaccggucuuggcuucgaccucuuagaagcggguaaaugccagcugcugccccuggaagaaccggaaccccccgccagagaggaaaagaagcgucgagagggucuguuccagagaaguucacgcccccgcagaucuacaaguccucccuccagaaagcuguuuaagaaagaagaacccaugcugcuccuuggagauccuagcgcaucacugacucugcucucccucuccucgauuagugaguguaauucuacccgcucucuguugagaucugacuccgaugagauuguagucuacgaaaugccugugagcccggucgaagcacccccucuuaguccauguacacacaauccccuugugaacgugaggguggagcgauuuaaacgggauccaaaucagucacuuacccccacgcacgugacacugacuacccccucccaacccagcucucaccgucgcaccccaucagacggggcacugaagcccgaaacucuacuggcaagccgcucacccaguucaaauggccugucuccaaguccaggcgccggcaugcucaagacacccucccccucucgggauccaggcgaauucccuaggcuaccggauccuaacguagucuucccacccaccccccguagauggaacacucagcaggacucaacccucgaacgucccaagacccuggaauuucugccaagaccucgucccuccgcuaaucgacaacgucuggauccauggugguucguuagccccagucaugcucgcagcaccagcccugcuaauagcucuucuaccgaaacccccuccaaucucgacucuuguuucgcaucuagcuccucaaccguugaagaacguccaggccuacccgcacugcugcccuuccaagccgguccccuacccccuacugagcgaacucugcuggaccuggacgcugagggccaaucucaggauucaaccgucccguugugccgugcagaacucaacacacaccguccugcccccuaugaaauccaacaagaauucuggucuuag

SEQ ID NO: 248952 - RNA, 2541 nt, Artificial Sequence
  Description of Artificial Sequence: Synthetic coding sequence
auggaggcuccgcuccguccggcagcggauauacuacgccgcaacccacagcaggacuacgaacuuguucagagagucggcagcggcacuuacggcgaugucuauaaagcucgaaacguucauacuggggaguuggcagcugucaaaaucauuaagcuugaaccuggugaugacuucagucugauucagcaagaaaucuucaugguuaaagaauguaaacacuguaauauaguagcuuauuuuggcucuuaucugucacgugagaaauuauggauuuguauggaguauugcgggggcggaagccugcaggacaucuaucacguuacgggaccgcuuucugaacuccagaucgccuacgugugccgagaaacucugcaaggacucgccuacuugcacacaaaaggaaaaaugcaucgagacauuaaaggcgccaauauccuccucacagaucacggcgaugugaagcuggccgauuuuggcguagccgcaaaaauuaccgccacuauagcuaagagaaaauccuucaucgguacucccuauuggauggcucccgaaguggcagccgucgaaaaaaacggagguuacaaucaacucugcgacauaugggcaguugggaucaccgccauugaacugggcgaacuccagccuccuauguucgaccuacaccccaugcgagcccuguuccuuauguccaaaucaaauuuccagccuccaaaguuaaaagacaagaccaaguggagcagcacauuccacaacuuugucaaaaucgcccuuacaaaaaaccccaaaaagagaccaacagccgagcgcuugcugacucacacuuuuguggcccagccgggccugucccgugcuuuagccguggaacugcuagauaaaguaaacaacccagacaaucacgcucauuauacugaagccgacgacgacgacuucgaaccucaugcaaucauccgacacaccauaagaaguacuaaccgcaacgcacgagccgagcgcaccgccucugaaaucaacuucgacaaacuccaauuugagccaccucugcgaaaagagacggaggcacgagaugaaaugggacuuaguucagaccccaacuucaugcuucaguggaaucccuuuguggacggggcgaauacuggcaaaucaaccucgaagagagcaaucccgccaccuuuaccacccaagccgagaaucucuucguaccccgaagauaauuuuccagaugaagagaaggccuccaccaucaaacauuguccugauuccgagucuagagcuccacagauccugagaagacaaucaaguccuuccugcgggccggucgcagagaccucaagcauaggaaacggagauggaauuucaaaacugaugucagaaaacaccgaaggaucagcgcaagccccucaacucccucgaaagaaggauaaaagggacuucccuaaacccgcuauuaacggccugccaccuacucccaaaguguugaugggagcguguuucagcaaagucuuugacggcugcccccuuaagaucaacugcgccacaagcuggauacacccugacaccaaagaucaauacaucaucuucggaaccgaagacggaaucuacacucugaaccugaacgaacugcacgaggccaccauggaacaacucuucccucggaagugcacauggcuguacgugauuaauaacacacugaugucacugucugugggaaaaacuuuucagcuguacucacauaaucucaucgcccuguuugaacacgcaaagaaaccuggacuggcugcccauauucagacucaucgguucccagaucggauuuugccccguaaguucgcccucacuacaaagauuccagauaccaaaggcugccacaaaugcuguaucguucgcaacccauacacuggucauaaauaccucugcggggcccugcaaagcggaauuguguugcugcagugguacgaacccaugcaaaaguuuaugcucauuaagcacuuugacuuuccacuuccuagcccccuuaauguuuucgaaauguuaguaauuccugaacaggaauauccgaugguauguguggccaucagcaaaggaaccgaaucuaaccaaguugugcaguucgaaaccauuaaccugaauucugcaucauccugguuuacagaaauaggggcaggcucccagcagcuagauucuauucacgugacacaguuagaaagggacacagucuuagugugcuuggacaaguucgucaaaaucgugaaccuacaagggaaacugaaaaguucgaagaagcuagcauccgagcucagcuuugacuuuaggaucgagucugugguuugucugcaggauagugucuuggcauuuuggaagcacggcaugcaaggaaaaucguucaagagugaugagguaacacaagagaucuccgacgaaacuagaguguuccgccugcuggguucugacagaguggucgugcuugagucuagaccaaccgaaaauccgaccgcccauucaaaccuauacauacuugcuggccaugaaaauucuuauuag

SEQ ID NO: 248953 - RNA, 345 nt, Artificial Sequence
  Description of Artificial Sequence: Synthetic coding sequence
auggucucgaggaaggccguggccgcgcuucugguuguacacgucgcagccaugcuggcaucacagaccgaagcauuuguaccaauauuuacauauggggaacugcagcggaugcaagagaaggagagaaacaagggacagaagaagucucuaucagucuggcagcgaucaggcgaagaaggccccgucgacccugcagaaccaaucagagaagaagagaaugagaugaucaaacugacggcuccucuugaaauaggcaugcgcaugaacagccggcaacucgaaaaauaccccgccaccuuggaaggccuauuauccgaaauguuaccucagcacgcaaaguag

SEQ ID NO: 248954 - RNA, 348 nt, Artificial Sequence
  Description of Artificial Sequence: Synthetic coding sequence
augguaagccgcaaagcaguggccgcguuacugguggugcauguggcugccaugcucgcuagccagacugaggcauuugugccaaucuuuaccuauggcgaauugcagaggaugcaggaaaaagaacgaaacaaagggcagaaaaagagcuuauccguguggcaaagaucgggagaagaaggcccuguggauccagcggaaccuauccgggaagaagagaaugaaaugaucaaacuuacagcuccuuuggaaauuggcaugaggaugaacagcagacagcuugaaaaauauccugccacucuugaaggccuccuaagugagaugcucccacaacacgcagcgaaguag

SEQ ID NO: 248955 - RNA, 327 nt, Artificial Sequence
  Description of Artificial Sequence: Synthetic coding sequence
auggucucaaggaaggcaguggccgcacuguuagucgugcauguugccgccaugcuggccucccagacggaggccuucgugccaaucuucacuuauggagaauuacagagaaugcaggagaaggagcggaauaaagggcagaagaaaaguuuaucuguguggcagagaaguggggaagaaggaccgguagacccugcagaacccauacgcgaagaagagaaugaaaugaucaagcugacagcuccuuuggaaaucggaaugcggaugaacucccggcagcuugaaaaauaccccgccacacuugaaggauuauuaacagccaaguag

SEQ ID NO: 248956 - RNA, 17121 nt, Artificial Sequence
  Description of Artificial Sequence: Synthetic coding sequence
augggggccccaucagccugccgcacacucguacuugcauuagcagccaugcucguagucccucaagccgagacucagggccccguggaacccagcugggaaaacgcaggucacacaauggacgggggcgcccccaccagcucaccuacuaggcggguuucauuuguucccccagucaccguguuccccagccuguccccacugaacccugcucauaacggccggguuugcucuacuuggggcgauuuccauuacaagacauuugauggcgauguguucagauuccccgggcuguguaauuauguguuuucagagcauugccgcgccgcguaugaagauuucaauguccagcugagaagaggauuagugggaagucgccccguaguaacuaggguagucauuaaggcccagggucuggugcucgaagcaagcaauggaucaguucuuaucaauggccagcgcgaagagcugccauauagucgcacgggcuuacucguugaacagagcggagacuacaucaaaguuucaauacgacuugugcuaaccuuccuguggaauggugaggacagugcacuguuggagcuggacccuaaauaugcaaaccaaaccugcggccucuguggcgacuuuaacggccuuccugcguucaacgaauuuuaugcccauaacgcccgacugaccccccugcaguucggcaaccugcagaaacucgacgguccuacugagcaaugcccugacccgcugccgcuaccugccgguaacuguacagacgaagagggaaucugucaccgcacacuguuaggacccgccuucgcagagugucacgcacuggucgacucuacagcuuaccuagcugcgugcgcccaggaccucugucggugccccacuuguccaugcgccacuuuuguugaauacucaaggcaaugcgcacaugcaggcggccagcccaggaacuggagaugcccugaacugugcccgcgaacauguccccugaauaugcaacaccaagagugugguucgccauguacugauaccuguuccaacccucaacgugcccaacugugcgaagaucacugugucgauggaugcuuuugcccccccggcucaaccgugcuggacgacaucacccacagcggcugccugccccugggccagugcccaugcacucacggagggagaaccuauagucccggaacaucauuuaacacuacgugcaguagcuguacauguagcgguggacuguggcagugccaggaccuuccuugcccaggaaccugcuccgugcaggguggagcgcacaucagcaccuacgacgaaaaacuguaugaucugcauggcgauuguuccuauguucuuucuaaaaaaugcgcugacucuuccuuuacggugcucgccgagcuucgcaaauguggucucacugacaacgaaaauuguuugaaagcugucacucuaucccucgacggaggcgacaccgcaauucgcguccaggcugacgguggcguuuuucugaauucaauuuacacccaacugccguugucugccgcgaacaucacucucuuuacacccucuaguuucuucauuguggugcagacaggccucggauuacagcugcugguucagcuagugccacucaugcaaguuuuugugagacuggacccugcccaucagggacaaaugugcggguuaugcggaaauuucaaucagaaucaggccgaugacuuuacagcacuguccgggguugucgaggccaccggagcugcuuucgccaacaccuggaaggcccaggccgcaugcgcaaaugccagaaacagcuucgaggaucccugcaguuugucugucgaaaacgaaaacuacgcuaggcauuggugcagucgucugacagauccaaauucagcauucucucggugccacaguauuauaaacccaaaaccuuuucauuccaacugcauguucgauacuuguaauugcgaaagguccgaagauugucucugugcggcccugagcucuuauguccacgcuugcgcagcaaaaggcguacagcuaucugauuggcgcgaugguguuugcacaaaguauaugcagaacugccccaagucccagcguuaugcguauguuguggacgcaugccagcccacauguagaggacucuccgaagccgacgugacuuguucugugucuuucguucccgucgacggcuguaccuguccggccggaacauuucucaaugaugccggggccugcguuccugcacaagagugcccgugcuaugcucaugggacagugcucgcuccaggcgagguuguacaugaugaaggggcgguguguucaugcaccggaggcaagcuuucuugucugggagcgucccuacaaaaaucuacuggcugugcugcuccuauggucuaccuagauugcuccaauuccucagcaggcaccccuggugcugaaugccuucgcucuugucacacuuuagauguuggcugcuuuucgacacacugcguuucaggcugcgugugcccuccugggcuggugucagacggauccggggguuguauagcggaggaggacugccccugugugcacaaugaggccacauacaagccaggugaaacgauccgaguagacuguaauacauguaccugucggaauaggaggugggaguguagccacagacucugccucggcacaugugucgcauacggugacggucauuucauaaccuuugacggagaucgguauaguuucgaggguucuugugaauacauauuagcucaggacuacugcggagacaacaccacucacgggacuuuccggauugugacggagaauaucccaugcgguacuacagguacaacuugcucuaaggcuaucaaacucuucguugaaagcuaugaacucauccuccaagaagguacauuuaaagccguagcccgaggaccuggcggcgauccucccuacaagauuagauacaugggcaucuuucuugugauugagacccacggaauggcaguguccugggauagaaagacuuccguuuuuauuagacugcaccaagauuacaagggcagagucuguggacugugcggcaacuucgaugacaaugcaauuaaugacuucgccacucggucuaggucugucgugggcgacgcacucgaguucggaaacuccuggaaacucaguccgaguugccccgaugcacuagcucccaaagaccccuguaccgccaacccuuucagaaagucuugggcccaaaaacaguguucuauccugcacggccccacauuugcugccugccgcucacagguggacaguaccaaauacuacgaagcuugugugaaugaugccugcgccugcgauucaggcggagacugcgaauguuuuugcacugccguggcugccuaugcccaggcaugucacgaugccggacucugugugaguuggagaaccccugacacaugcccucuguucugugacuucuacaauccucacgguggcugcgaauggcacuaccaacccugcggagcacccugucucaagacaugcagaaaccccucaggucacugccucguggaccugccgggccuggaagguuguuauccuaaaugcccaccuagccagcccuuuuucaacgaggaucaaaugaaguguguggcgcaguguggcuguuacgacaaagacgggaauuauuaugaugugggagcuagggucccaacagcugaaaauugucagagcugcaacugcacccccuccggcauccagugugcacauucccucgaggccugcacauguaccuacgaagacagaacauacucauaccaagaugugauauauaauacaacagaugggcucggagcgugccugauugcgauaugcggcucaaauggaacuauuauucgcaaagccgucgccugccccgguacgccugccacaaccccuuucaccuuuaccacagcuugggugccgcacuccacuaccucgccagcccuuccuguauccacuguuugcgugcgcgagguuugccgauggucuucuugguauaauggacaccgaccagagccuggacuuggagggggcgacuuugagacuuuugaaaaucugagacagcggggcuaucaggugugccccguacuagccgauauagaaugccgggcugcccaguugccggauaugccgcuggaagaacuaggccagcaaguagacugugaccgaaugagaggccugaugugcgccaauucccaacaguccccaccucugugucacgauuacgaacuccgugugcuguguugugaauaugugccuugcggcccgagcccggcgccuggcaccaguccgcagccuucucucuccgcgucuaccgaacccgccguuccuaccccgacccagacuaccgccacagaaaaaacaacacuauggguuacaccaucgauucguuccacagccgcccuuacaucucagaccggcaguagcuccggcccaguuaccgucacaccuucugccccggggaccaccacaugucaaccucggugucaguggacugaaugguuugacgaggauuaccccaagagugaacagcugggcggagauguugaaucauaugauaaaauaagagcugcaggcggccaucugugucagcaaccuaaggacauugagugccaagcagaaucauuccccaauuggacccuugcccaggucggacagaaaguucauugcgauguucauuucggacuaguuugcagaaacugggagcaggaggggguguucaaaauguguuauaacuaccggauccgggugcugugcuguucugacgaccauugcaggggacgggcaacuacuccgccuccaacuaccgaauuagaaaccgccacuaccacgaccacccaggcauuauucuccaccccccaaccuaccuccucuccgggucugacacgagcgccccccgcuucaacuaccgccguuccuacccugucggaagggcugaccagcccucgcuacaccucuacacuugguacggcuaccaccggaggcccuacaacuccagccggcucuacugagcccaccguaccuggcguugcaacuucaacucuucccacucgaucagcacuucccggcaccacgggcucucuaggaacauggcgcccuucacaaccuccaacacuagccccgacuacgauggccacaagccgcgcccgccccacaggcaccgccucuaccgcaucaaaggaaccuuugacgacuagccuggcuccuacucugacaucugaacuuucuaccucucaagcagaaacaagcacuccgcgcaccgagacuacaaugagcccccucacuaauaccacaaccucucaggguacuacgagaugucaaccaaaaugugaauggacugagugguucgauguggacuuuccuacaagcggcguagcuggaggcgacauggagacuuuugagaacaucagagcugcgggaggcaaaaugugcugggccccuaagucgaucgaaugccgcgcagagaauuaccccgaagucucaaucgaucaggugggucaaguucugaccuguucacuggaaaccggccugaccugcaaaaaugaagaccagaccggacguuucaauauguguuuuaacuauaacgucagaguucuguguugcgaugauuacucucacuguccaagcaccccugccacuucaagcacagcaacaccuuccuccacaccaggcaccacuuggauucucacuaagccaacaaccacggcgaccaccacagcauccaccgggaguacagccacccccacaucaacucuccgcacugcuccaccaccgaaaguguugacuacuacagccaccacuccuacaguuacaucuucgaaggccacccccucuucaagcccaggaacagcaacugcccuaccagcccuuaggucaacugcuacaaccccuaccgcaacauccgucacccccaucccauccucuaguuuaggaacgaccuggacgagacuaucucaaacuaccacgccaaccgccacuaugucaaccgcuacaccaagcucaaccccugaaacggcucauacaagcacuguucugaccgccacagcuaccaccacuggggccaccggaucugucgcaacgccaaguaguaccccaggaacagcccauacuaccaaaguuccaacaacgacaaccacagguuuuacagcaaccccuaguucuuccccugggaccgcacucacaccccccguauggauuucaaccaccaccacaccuaccacacgaggaagcacagucacuccuucaucuauccccggcacaacucacacggccacagugcugacaacaacaacaacaaccguggccaccgguagcauggcaacuccuuccaguucuacacagacgucaggcacgcccccuucacuuacaaccaccgccaccaccaucacugccacagguucuacaaccaaucccucuucuacccccggaaccaccccaauucccccaguauuaacaacaacugcaacgacucccgccgcgacuaguaauacugugacaccuagcuccgcucuuggaaccacacacacuccccccgucccaaauacuauggccaccacccacggacgcucccugccccccagcucaccucauacaguucgcacagcauggaccucugcuacaucuggcauucugggaacuacccacaucaccgagccgucuacuguuacuucccacacauuagcagccacaaccgggaccacccagcauagcacccccgcauugagcagcccacauccaucgucacgaacaacugaauccccaccaucacccgguacaaccaccccuggccauaccacugccaccagccgaacgaccgccacugccacgccuuccaagacccgaacuaguaccuugcugccuagcucccccacauccgcccccauuacuacagucgucacuauggggugugaaccacagugugcauggucugaauggcuugauuacucauacccaaugccuggaccaucaggcggcgauuuugauacauacucuaauauaagagcugccggcggcgccgugugcgagcaaccacuaggccuggaauguagagcucaagcucagcccggcgugccccuccgggagcuagggcaagugguggaaugcucccuagauuucgggcuggucuguaggaauagagaacagguugguaaauuuaaaaugugcuuuaacuacgaaauaagagucuuuugcugcaauuacggccauugcccaaguacccccgccaccagcagcacugccaugccuuccucgacaccugggaccaccuggaucuugaccgaacugacuacuaccgcaaccacuaccgagucaaccgguucaacagccaccccauccucuacaccugccaccgccgggacuccucacguuuccacaaccgccacgacgcccacgguaaccucuagcaaagccacaccauuuuccucuccgggcacagcaacugcacucccagcucuccgaucaacugccaccacaccaaccgccaccaguuuuacagcaauccccaguuccucccucggcacuaccuggacccgccuuagucaaacuaccacuccuaccgccaccaugucaaccgccacuccuaguucaacccccgaaaccgugcacacuucuaccguucuuacaacaacugcaacuacuaccggugccacgggcucaguagcgacuccuuccaguaccccaggcaccgcccacaccaccaagguccuuacuacaacaacaacaggguuuaccgccacacccuccaguaguccgggaacagcacggacacuuccuguguggauuucaacaaccaccacuccuacaacacgagguucaaccgugacacccucaucaauuccaggaaccacccauacuccuacaguacuaacgaccacuaccaccacuguugcuaccgggagcauggcgacuccuucuuccucaacccagacaucugguacccccccaucucugaccacuaccgccacaacaauuacagccacaggaucaacuacaaacccguccuccacuccugggaccacaccaauccccccuguccuaacuaccacagccacaacuccggcagcuacuagcucgacugugacccccuccucagcccugggcacaacucacacaccaccaguccccaauacuacugcuacaacccacggucgcuccuugagucccagcuccccacacacaguucgcaccgccuggacaucagccacuucugguacacuugguacuacccacaucacagagccgagcaccggcacuagccacaccccugccgccacuacaggaaccacgcaacauaguacuccagccuugucuuccccgcauccuaguucaagaacaacugaaucgccaccguccccuggcaccaccaccccagggcacacucgcgcuaccaguaggacaacugccacagcuacaccaucaaagacacgcacuucgacacucuugcccagcucucccacaucagcacccaucaccacagugguuacaauggggugugaaccgcagugugcauggucagaaugguuggacuacuccuacccuaugccaggaccgaguggcggggauuuugacacauauagcaacauacgcgcggcaggaggcgcugucugcgaacagccauugggacuagaaugccgagcacaggcccagccuggcguuccauugagagaacuaggccaagucguggaaugcucacuugauuuuggucucguaugcaggaacagggaacaaguugggaaauuuaagaugugcuuuaacuacgagauacggguguucugcuguaauuauggucacugcccuucaacacccgcaacuucuagcacugccacucccaguucuacccccggcaccaccuggauacugacugagcagaccacagccgcuaccacuaccgcaacuacaggcucuaccgcuauccccuccuccacccccggaacggcgcccccgccuaaaguguugaccaguaccgccaccacaccaaccgcaaccucaagcaaagccaccagcuccucaucuccccgaaccgccaccacccugccuguccuuaccucuacagcaacuaagagcacugccacguccuuuacuccgauuccgaguuucacacuggggacuacugggacgcuuccagagcagaccaccacacccauggccacaaugagcacaauccaucccucuucuacacccgaaaccacccacaccagcacaguucucacuaccaaagccacgaccacccgcgcuacuucuuccaugucuacacccucgucuacacccggcaccacuuggauccucacagaauuaacuaccgcugcuaccacaacagccgcgaccggacccaccgccaccccaucuagcacacccggcacuacauggauuuugaccgaacccucaacaaccgcuacagucacagucccaacugggucuaccgccacagcuagcucaaccagggccaccgccggcacuuugaaaguauugaccuccaccgccacaacgccuacaguaauuucuucucgggcgacuccgaguucaucacccgguacagccaccgcacuuccagcgcugcgaucaaccgcuacuaccccaacagcaacaagcgugaccgcuauuccuucuucaucacugggcacagcauggacucgacugucucaaaccacgaccccuacugcgaccaugagcaccgcaacacccuccuccacacccgaaaccgugcacaccagcaccguguuaacaaccaccacaacuacaacucgagccaccggcucaguugcgacuccauccucgacaccaggcacugcgcauacaacgaaaguaccaacuacaacaaccacgggcuuuaccgcuacccccucuuccucccccggcacagcuuugacccccccuguuuggauauccaccaccaccacgcccacuacaagagguuccaccgugacgcccuccaguauucccggaacgacucacaccgccaccgugcugaccaccacaacuacaaccgucgccacagggaguauggccacuccuaguaguuccacccagacaucaggcaccccuccuagcuugacaacaacagccacuacuauaaccgcgacagguuccacuaccaacccaagcucgaccccaggaacgacuccuauccccccaguuuugaccaccacagccaccacccccgccgccaccuccuccacagugacaccuucuucugcacucgggacuacacauaccccuccugugccaaauaccaccgccacaacccauggacgcagucugccacccucaagcccacacaccgucaggaccgccuggacuagugccaccucagggauccuuggaacgacucacaucacggagcccucaacaguuacuucucauaccccggcggccacgacaucuacaacucagcacucuaccccugcccucuccuccccucauccuucuucucggaccacagaaagucccccaagcccuggaacgacgacaccugggcacacccgcgggacuaguagaaccacagcuacagcuacccccucaaagacacggacaucgacucuccugccaaguaguccaaccagcgcccccauaaccacagucguaaccaccggaugcgagccucagugugccuggucugaauggcucgauuacagcuaucccaugcccggaccuucaggcggcgauuucgacacauauucaaauauccgugcugccgguggagccguaugcgagcaaccacuaggguuagaguguagagcucaggcccagcccgguguuccacugcgggaauugggccagguaguugagugcucauuggacuucgggcucguuugcagaaacagagaacaggucggcaaauuuaaaauguguuucaacuacgaaauccgcguguucuguuguaacuauggccauugccccagcacuccugcaacuucaucaaccgcuacuccuucuuccacaccuggaaccacuuggauacugacaaaacucacuacaaccgcgacaaccacagaauccacaggcucgacagccacgccuucaaguacaccaggagcaacagccgggacaccucaugugaguacuaccgcuacuacuccgaccgugacauccucaaaagccaccccauucuccucucccggaacugccaccgccuuacccgcccugagaagcacugcaaccacuccaaccgcaacuuccuucaccgccaucccauccucuucacucggaacgacuuggacacgccuaucucagacuacaaccccaacagcuacuaugagcacugccacuccauccagcaccccagaaaccgcccacacauccacaguacugaccacaaccgccacuaccacuagagccacaggaaguguggcuacgccauccucgacuccugggaccgcccacacaacuaaaguaccuacaacaacaaccaccggguuuaccgucacccccagcucaagcccaggcacagccagaaccccgccuguauggauaucaacaaccaccaccccaaccacaaguggcuccacuguuaccccuucgagugugccuggcacuacacacacgccuacagugcugaccacaacuacaaccacugucgccacgggcucuauggccacccccucaucaucgacccagacaucuggcacgccuccuucucugaucacaaccgcaacuacaaucacugccacaggcucuaccaccaaucccucguccaccccuggcacuacacccauuccacccgugcugacuacaacugccaccacuccugcugcgacaucuucaacagugacccccucaucugcccuugguacuacucacaccccaccagucccaaauaccacugcaacgacccacggccgcuccuuaucuccuaguucgccacacacggugcgcacugccuggaccucugcaacaucgggcacgcuggguaccacccauaucacugaaccuucuacaggaacaagucauaccccagcugcuacuacuggcacuacccagcacucgacaccagcucugagcucuccgcaccccaguucccgcaccaccgaaaguccacccagcccagggacaacaacucccggacacacgaccgcuacuagccguaccacagcaacagccacaccaagcaagacaagaacaaguacccuacugcccuccucccccaccucagccccuauaacaacuguuguaacuacaggaugcgagccccagugugccuggagugaauggcuggauuacuccuaccccaugccaggcccaucuggaggugauuucgauaccuauaguaacauuagggcagccgggggagcgguuugcgaacagccauugggucuagaauguagagcacaggcccaacccggcguuccuuuaggcgagcucggacaggucguggagugcucuuuggacuucggucuugugugccgaaaccgcgagcagguaggaaaguuuaaaauguguuuuaacuaugaaaucagggucuuuuguugcaacuacggccacugcccgucuaccccagcuacaucaagcacagcaaugcccaguagcacgcccgggacuacuuggaucuugacagagcucacaacaaccgccaccacaacagccucuacaggaagcaccgccacaccaaguucgacucccggcacagcucccccaccuaaaguucucacuuccccggcaaccacgccaacagcaacauccagcaaggccacauccuccucaucaccgcgaacagccacuacacugccaguacuaacguccacagcuacuaaguccaccgcuaccucugugacaccaauaccauccucuacauuaggcacuaccggaacccugccagagcagacaacgacuccuguugcuacaaugagcaccauucacccauccucaacccccgaaacaacacacaccucuacaguccuaacaaccaaagccaccaccacacgggcaacuucauccacuucgacucccuccuccacccccgggacuaccuggauucucacggaacucaccacagccgcaacuaccacagcagcaaccgguccuaccgcuaccccaucuuccacccccgguacuacuuggauccugacugaacugacuacuacugcaacaaccacagcaagcaccgguuccacggcaaccccuagcagcacucccggcacaacuuggauccuaaccgagcccaguacuacugcaacuguuacagucccaaccggaucaacagcaacugcauccucaacccaggccacagccgguaccccacacguuuccacuacggcuaccacucccacaguuacuagcucaaaagccacgcccucuaguucacccggcacagcuacugcucuuccagcccugagaucuacagcaaccaccccaacagccaccuccuuuacggcgaucccaucuagcucucuugggaccacguggacuagacucagccaaacaacaaccccaacugccaccauguccacugccacgcccucaaguacgcccgaaaccguacauacuucaacuguuuuaacugccacugcuacuacuacaggggccacuggcaguguugccacacccucauccacuccugguacagcgcauacgaccaagguuccuacuacaacuaccacugguuuuacagcgacgccuuccucauccccugguacagccuuaaccccgcccgucuggaucagcacaaccacaacgccuaccaccacgacccccacgacauccgggucaaccgugaccccgagcucaaucccaggaacuacacacacagcacgcguucuuacaacaacaacaaccaccguagcuaccgguuccauggcuacccccucaaguaguacccagacaucagguacucccccaucccucaccacaacagcaaccacaauuacagccaccggcagcaccacuaacccaagcucaacgcccggaacaacaccaauuacaccuguccugaccucuaccgccacgaccccugcggccacauccaguaaagccaccagcucuucauccccacgcaccgcaacuacguuaccagucuuaaccuccacugccacaaagucuacagcaacgaguuucacacccauaccaucgagcacccuuuggacgacuuggacagugccugcccaaacaaccaccccuaugucaacaaugagcacaauccacacaaguagcacacccgaaaccacccauaccagcacaguuuuaaccacaaccgccaccaugacucgggccacuaauuccaccgcaacuccuuccuccacgcucggaacuacacgcauacucacagagcugacuacaaccgcgaccaccacagcagcaacuggaagcaccgccacccugaguuccaccccugggacgaccuggauucuuaccgagccuaguaccauagcuacugucauggugccaaccggcaguacugcgaccgcauccucaacucuaggcacggcccauaccccuaaagucgugacaacaauggcuacuaugccuacugccaccgccucaacuguucccucauccucuacuguuggcacuacucgcacacccgccgugcuuccaagcucucucccuaccuuuaguguguccacaguauccuccucaguccucacaacacuccguccuacuggcuuuccuaguucucacuuuuccaccccaugcuucugccgagcuuucggccaauucuucuccccuggugaagugauuuacaauaagacugaccgagccggaugucauuuuuacgcgguauguaaucagcauugcgacaucgauagauuccagggcgcauguccuaccucccccccucccguuagcagcgcaccacucucuuccccuucccccgcacccgggugcgauaaugcaaucccccuccggcaaguaaaugagaccuggacacucgaaaacugcacaguggcucggugcgugggcgacaaccgaguggugcuccuggaucccaaaccuguggcuaauguaacuugcgucaauaagcaucuccccaucaaagucagcgacccaucccaaccuugcgacuuccauuaugaaugcgaauguauuugcucaauguggggagguucacacuauagcacuuuugaugguacgaguuauaccuuuaggggcaauuguaccuauguccugaugcgcgaaauccaugcccgauucggaaaccucagccuuuaccuugauaaucacuacugcaccgcaagcgccaccgccgccgcagcccggugcccccgagccuugucuauccacuacaaaucuauggacauuguguugaccgugacuaugguccauggaaaggaggagggauuaaucuuguucgaucagauuccaguuagcaguggguuuagcaagaacgguguuuuggugagcguucugggcaccaccaccaugcguguagauaucccugcccucggcguauccgucacuuucaauggucaggucuuucaagcuagacugccuuauucacuuuuccacaauaacaccgagggucaaugcggcacguguacuaacaaccagagggaugacugccuucagagagacgguaccacugcagcaucauguaaggacauggcaaagaccuggcuugucccagauaguaggaaggacggaugcugggccccaacaggaacccccccgaccgcuuccccugcagcuccagugucaaguacccccacaccaacuccauguccuccucagccccugugcgauuuaaugcuuucccagguguucgcggagugccacaaccuagucccuccuggcccauuuuucaacgcuuguauauccgaccacugccgcgguagacuggaggugccaugucagucguuagaagcguaugccgaacuuugccgagcucgaggcgugugcuccgauuggaggggagcaaccggaggcuuaugcgaccuuacauguccaccaacgaaaguguacaagcccugcggacccauucagccugccacauguaauucuagaaaucagucaccacagcucgagggcauggccgagggguguuucuguccugaagaccaaauauuauuuaacgcacacaugggaaucugcgugcaagcuugccccugugucggucccgacgguuucccaaaguuucccggagaaaggugggugucaaauugccaaucaugcgugugcgacgagggauccguguccguucagugcaaaccucugcccugcgacgcucaaggacagccuccucccuguaaccggcccggauuugucacaguuacuagaccccgagccgaaaauccuuguuguccagaaaccguauguguaugcaauaccacgaccuguccccagagucugcccgucugccccccaggccaggagucuaucuguacucaggaagaaggggacuguugcccaaccuuccgaugucgaccccaacucuguuccuauaacggaacguucuauggcguuggcgccacuuuuccaggcgcauuacccugccacauguguacaugccucaguggagauacacaagauccuacagugcaaugccaggaagacgccuguaacaacaccacaugcccucaaggauucgaguauaaaagagucgcaggacaauguugcggcgaguguguccagaccgcgugucucacccccgauggccagccuguccagcucaaugaaacauggguuaauucgcauguggacaacuguaccgucuaccuuugugaggcggaaggaggaguccaccugcuaacaccccagccagccuccugccccgacguaucuagcuguaggggcagucugcguaagaccgguuguugcuacucgugcgaggaggacucgugccagguccggaucaacacaacuauacuauggcaucaaggaugcgagacagaagugaauauuacauuuugcgaagggaguugucccggggcuuccaaauacagcgccgaggcccaggccaugcagcaccagugcacaugcugccaggaacgacgaguucaugaggaaacaguuccccugcauugcccuaacggaucugccauccuccacacuuacacccacgucgacgaguguggcuguacuccauuuugcgugccggcaccuauggcucccccgcacacccgaggauucccagcccaggaagccacagccguuuag

SEQ ID NO: 248957 - RNA, 16587 nt, Artificial Sequence
  Description of Artificial Sequence: Synthetic coding sequence
gcucccaggaugggcgcacccagugcuugccggacauuggugcuugcuuuggccgcuaugcugguagugccacaagccggaaagaguccaccuuugcgaccacugagcagaaauuccggcgccggcuuagacgguggcgcgcccaccagcuccccaacuagacgagugucauuugugcccccugugacaguuuucccuuccuugagccgcaaacaaaugcugccccuaccagccggcaagggcguguuugcaucuccaaaagguggcgggccagaccucggcgugcagcuaccccccgcccuuaaucccgcucacaaugggcgugucugcucaacauggggggacuuucauuacaaaacuuuugacggggacguguuuagauuucccggacuuuguaacuauguuuucucagaacacugucgcgccgcguacgaggauuucaauguucagcucaggcggggccugguuggaagucguccggugguuacucgcgucgucauaaaggcucaaggacucguuuuggaagcuucuaauggcagcguccugaucaacggucagagagaggaacugcccuauucacgcacuggacugcugguagaacagucaggagauuacauuaaggucagcauaagacuggugcucacuuuucuauggaacggcgaagacagcgcgcugcuagagcucgacccuaaauacgcaaaccaaacauguggccuuuguggcgauuucaacggcuugccagcauuuaacgaauuuuaugcccacaacgcucguuugaccccccuccaguuuggaaaccuccagaagcucgacggcccuaccgaacagugucccgauccacucccauugccagccggcaacuguacagacgaggaagggaucugccaccguacccuguugggaccugcauucgccgaaugccacgcccugguggacagcacagcuuaccuugccgcuugugcccaggaucugugcaggugcccuacaugcccgugcgcaaccuucgucgaauauagcagacaaugcgcucaugccggggggcaaccucgcaauuggagauguccugaacuuuguccacgaaccuguccccuuaauaugcagcaucaagagugcgguucaccauguacagacaccuguaguaacccacaaagggcccaauugugugaagaccauugcgucgauggcugcuuuugcccacccggccgcucauguacagugcucgaugacauuacacacuccggcugucuuccucuuggucaauguccuuguacacaugguggaagaacuuacuccccugguacuagcuuuaacaccaccugcuccucuuguacuugcagcggggguuuguggcagugccaagauuugccuugucccggaaccugcuccguacaggguggggcucauauaucaacauacgacgagaaguuauacgaccuccacggggacugcucguacgugcugucuaaaaaaugcgcagauucaaguuuuaccguacuggcagagcuccgcaaguguggacugacggauaaugagaacugucugaaggccguaacucugucacuugacgguggggauaccgcuauccgcguccaggcagauggaggcguauuccucaacagcauuuacacccagcuucccuuguccgccgcaaauaucacccuguucaccccuuccuccuucuucauugugguccagacaggacugggauuacagcuguuaguccaacucguaccauugaugcagguguucguuaggcuugaccccgcacaccaggggcagauguguggcuugugcgguaauuuuaaucaaaaccaagccgacgauuuuacugcucuauccggagucguugaagcaaccggugccgccuuugcaaauaccuggaaagcccaagccgccugugccaacgcccgaaauagcuuugaagacccgugcagccugagcgucgagaacgaaaacuaugccagacacuggugcucuagacugaccgacccaaacuccgcauucagcagaugccauaguauaauaaacccaaagccauuccauuccaacugcauguucgauacaugcaauugugaacgaagugaagacugccugugugcugcccugaguuccuacguucaugcaugugccgccaagggcgugcaacugucugauuggcgagauggugucugcaccaaguacaugcagaacugccccaagucccagcgauacgcguaugugguggacgccugucaaccaacuuguagaggucuuucagaggccgacguuaccugcucagucuccuuuguaccuguugacggcuguaccuguccagcugguaccuuccucaaugacgccggugcauguguuccugcacaagaaugccccuguuaugcccacgguaccguccuugccccgggggaaguuguccaugaugagggugcgguguguagcuguacuggaggaaaacuuucaugucucggagccucccugcagaagucuacagguugcgccgccccgauggucuaucuggacuguuccaacucgucugcaggaacccccggcgccgagugccuacgaaguugucauacccucgacgucgguugcuuuucgacgcauugugucucuggcuguguguguccaccugggcuggucucugacgguagcggcgguuguauugccgaggaggacuguccuugcgugcauaaugaagcgaccuauaaaccaggcgagacaauuagaguggauuguaauacuugcacaugucguaaucgaaggugggagugcagccacagacucugccucggaaccuguguggcuuauggagauggacauuuuauaaccuucgauggggaucguuacagcuucgaaggcucaugcgaguauauucuagcgcaggauuauugcggcgauaauacaacccacggaaccuuucggauugucacugagaacauuccaugcgggacgaccggaacgaccuguaguaaagcgauuaaacuguucguggaaguaaggacugcccccgcggucaguacaccagaucccgcagcaaaugaaccugccccuagagaagcuagugucggauuuagacagagauugccuccccuucaaucuuaugagcugauucugcaagagggaacuuucaaagccguggcucggggacccggcggcgaccccccuuauaaaauucgcuacaugggcauauuuuuggugaucgagacacacggaauggcugugagcugggaucgaaaaaccuccguuuuuauccgcuuacaccaggauuauaaaggaagagugugcggauugugugggaacuucgaugauaacgccaucaacgauuucgcaaccaggucuagguccgucguaggcgacgcccucgaguucgggaacaguuggaaacugagcccuucauguccugacgccuuagcucccaaagacccuuguaccgccaauccauuucguaaaagcugggcucagaaacaguguucgauccuccauggccccacauuugcugcaugccggucucaaguugauucuacaaaguauuaugaggcuugcgucaaugacgccugugccugcgauuccgggggagacugcgaguguuucuguacugccguugccgcuuacgcucaggcgugccacgacgcugggcuguguguuucuuggcgcacccccgacacaugcccccuguucugcgacuuuuauaacccccauggaggcugcgaauggcacuaccagccaugcggggcgccuugccuaaagacauguagaaaccccucuggccauuguuuaguggaccugccuggauuagaaggcugcuaccccaaauguccaccgucucaacccuuuuuuaacgaggaccagaugaagugcguggcucaaugcggcugcuacgacaaagaugguaacuacuacgacguuggcgcuagaguuccuacagccgaaaacugccaguccuguaacuguaccccaucggguauccaaugcgcucacucacuggaagccuguaccugcacuuaugaagaccguaccuacuccuaccaagacgugauuuauaacacuacugauggacucggcgcauguuuaauagcaauuuguggcucaaacggcacgauuauucguaaagcuguggcaugcccgggcaccccagcuacuacuccuuucacuuucacgaccgcuugggucccucacucaaccaccagcccugcccuacccgucagcacaguaugugugagggaaguauguagauggucauccugguauaaugggcacagaccggagcccggacuaggcgggggagauuuugaaaccuuugaaaaccuuaggcaacgaggauaucaaguaugccccgugcucgccgacaucgaguguagagcugcucaguugcccgauaugccccuggaggaguuaggucagcagguugauugugaucggaugaggggccucaugugcgcaaauucgcaacagucaccaccucuuugucaugauuacgagcugcggguguuauguugugaguacgugccuuguggccccuccccagcccccggcacgucaccacaaccgucucugucagccagcacugaaccagcuguacccacccccacccagacuaccgcuacugagaagacaacccuguggguaaccccauccauuaggaguacagcugccuuaacaucccagacaggcucaaguuccgguccaguuacugugacuccuucagccccagguaccacuaccugucaaccaagaugccaguggaccgaaugguuugaugaagauuacccaaagucagaacagcucgguggcgaugucgaguccuaugacaagaucagagcagcaggcggucaccugugccaacaaccaaaagacaucgagugucaggcagaaagcuuucccaacuggacgcucgcgcaggucggucagaaaguccacugugaugugcauuucggucuggugugccgcaauugggaacaagaaggugucuuuaagaugugcuacaacuauagaauccgcguguuaugcuguagcgaugaucacugccgcggccgagcuaccacuccuccuccgaccacggaguuggaaacagcuaccacuaccaccacccaagcccucuucaguacaccccaaccaaccagcagccccggucucacccgugccccucccgccucgaccaccgcaguaccaacccuuucugaaggauugaccaguccccgauacacuagcacgcucgggacagccacuaccggagguccaacaacuccagccggcaguacagagccuacaguccccggcguggccacuucuacccugccaacccgaagugcccugcccggcacuaccggauccuugggcacuuggcgaccaucccagccccccacucuggcuccaacuaccauggcaacuagucgggcucguccuacaggaacggcuucuaccgccuccaaggagccacugacaacuagcuuggcaccuacauugaccucagaauuaaguaccucgcaagccgagacaaguaccccuagaacugagacuaccaugagccccuugaccaacacaacaaccucucaaggcacaacuagaugucagccaaagugcgaguggacagaaugguucgacguggacuuccccaccucuggcguagccggcggggauauggagacauuugaaaauauaagagcggccggcgggaagauguguugggccccuaagagcaucgaauguagggcagaaaacuauccagaagucagcauugaccaaguuggucaaguucucacuugcucucuugagaccggccugaccugcaaaaaugaagaccagacaggaagauucaauaugugcuuuaauuauaauguucgcgugcuuugcugcgaugacuacagccacugccccucuacaccagccacauccucuaccgccacccccucuucaaccccaggaacuacauggaucuuaaccaagccuacaacaacggcgacaacuacugcaucgacuggaagcaccgcuaccccgacuucgacccugcgcaccgccccuccacccaagguccuuaccacaacugcuaccacgccuacuguuacuaguaguaaagcuacacccucaucaucccccggaacugcuaccgccuugccugcucuccgguccaccgcuacaaccccaacugcuaccaguguuacaccaaucccuuccagcagccucgggaccaccuggacacgccucucucaaaccacaacgccaacagcuaccauguccaccgccacaccuaguuccacuccagagacugcccacaccuccacaguccuuaccgccacagccacaaccaccggcgcuacaggcucuguggccaccccuucauccacccccggcaccgcucacaccacuaaagugccuacaaccacuaccaccgguuucacugcaacccccagcuccucaccagggaccgccuugacacccccuguguggauuucuacaacaaccacccccaccacccgcggcagcacaguaacuccuucauccauacccgggacaacgcacacugcaaccguguuaacuacuaccacuaccaccgucgcaacaggaaguauggcuacuccuuccagcagcacacagacuuccggaacaacccacacccccccugucccuaauacaauggccaccacucauggacgaagccugccccccucaucuccucauaccgucaggacugcauggacaucagcaaccucuggaauccucggaacuacccacauaacagagccaucaacuguuacgagccacacccuggccgccaccaccgguaccacgcaacauuccaccccagcgcugucgucaccccacccuucuucacgcacgaccgaaucuccacccagcccugggaccacuacccccggacauacaaccgcuacgagucgcacuacagcaaccgcaaccccuucaaagacucggaccucgacccuucugcccucuagccccaccuccgccccaauaacgacaguugucacuaugggcugcgagccucagugugcuuggucggaauggcuugauuacucuuacccgaugccagggccuucaggaggcgacuuugacacauacaguaacauaagagcugccggaggagccgugugcgaacagccccugggacuggaaugucgugcucaagcccaaccaggcguaccccugcgcgaacucggacaagugguggaguguagccuggauuucggacuuguuugucguaaccgagagcagguagguaaauucaagaugugcuuuaauuacgaaauucggguuuucuguugcaauuauggacauuguccuucgaccccugcuaccucuucaaccgccaugcccucgucuacaccgggaacaaccuggauucugacugaacugacaaccaccgccacaacuaccgaaaguacaggcaguaccgcgacuccaucaucuacccccgggaccacauggauccugacggaaccaucuaccaccgcuaccguuacagugccgacgggcuccacugcuaccgcuucuaguacucaggcuacagccggcacuccccacgucagcaccaccgcaacaacacccacuguaacuucgucuaaagccacuccuuuuuccucaccaggcaccgcaaccgcccucccugcccucaggucaacagcaacuacgcccaccgcaaccagcuucaccgcaauuccuagcuccagcuuagguacuacauggaccaggcugagucaaacuacaacuccuacugccacuaugucaaccgccacccccaguagcacaccagagacaguucacaccucaaccguccuaacuacuacagcgaccacuaccggggcaaccggaagcgucgcuaccccuaguuccacccccggcacugcucauaccacuaaaguucucacuaccaccaccaccggauucacugccaccccgucuaguuccccuggaacggcccggacucuuccaguuuggauuaguaccacuacaacuccaacuacacgcggaucaacgguaaccccuucuagcaucccuggcaccacucacacuccaacaguuuugaccacaacuaccacuacugucgcuacugguucaauggccacacccaguuccucuacccagacaucaggcacaacccacacaccuccugugccuaacaccacagcaacuacucacggcagaucccugagcccgucaaguccacauacaguucguacagcauggacaucagcgacaagcggcacccuuggcacuacucacauuaccgaaccuucuacaggcacuucacauacaccugcugccacaacaggaaccacacagcacucaacacccgcacucagcucuccucacccuuccucccguaccacggagucuccacccucuccaggcacuacaacccccgggcacacccgagccaccagccgaacaaccgcaacugccaccccgucuaaaacucgaaccaguacgcuccugccguccuccccgacuucugccccuauuacuacugucguaacaauggguugugagccccagugugccuggagugaaugguuggauuauaguuauccuaugccagggccuaguggcggcgacuucgauacauacucuaacauccgugcagcagggggugcggugugcgaacaaccucugggccuggaaugccgagcccaggcacagcccggugugccucuaagagaacucggccagguaguagaauguagccuggacuucggacucgugugucgcaaccgagagcaggucggaaaguuuaagauguguuuuaauuacgagauucgcguauucugcugcaacuauggacacugucccucuacaccugccaccucuagcacagccacuccuagcagcaccccuggaacaaccuggauucucacagagcagaccacugcagcaacuacuaccgccacaacaggcagcacggcaauuccuucaagcaccccuggcacugcaccgcccccuaaaguccuuacgagcacagcuaccacgccaacagcaacgagcagcaaggccaccucgucauccagcccaagaacagcuacaacacucccgguacuaaccucuacagcaaccaaguccaccgccacuuccuucacccccauccccagcuucacccuaggaacuacaggaacccuccccgagcagacaacaacacccauggccacuauguccacuauccaucccagcucuacacccgagacgacucacacuucgacgguccucacaacuaaagcuacuacgacuagagccacuagcagcaugagcacucccaguucaacuccuggcacaacauggauuuugaccgaacugacuacggccgcuacaacuacugcagccaccggaccaaccgcuacaccaagcaguacacccggcaccaccuggauacuuacugagccauccaccaccgccacagucacugucccuaccggaucuacugccacagcaucuuccaccagagcuaccgcagguacccucaaaguucuaacaagcaccgcgacgacucccacugucaucuccucacgugcuacucccucauccucccccggcaccgcaaccgcuuugccggcuuugcgcagcacugccacaacaccaacugcuacuagcguuacugcuauuccuaguucaucccucggaaccgcauggacccgccucucacagaccacaaccccaaccgcaaccauguccacugccaccccuuccuccacucccgaaaccgugcauaccucuaccgugcucaccacuacuacgaccacaacccgcgcaaccggcuccgucgccacccccucuagcacaccugguaccgcccauacaacaaaaguaccaaccaccaccaccaccggcuuuacggcuacaccuagcucuuccccugggacagcucuuacgcccccgguuuggauuucuacuaccacgaccccaaccacccggggcucaacuguaacaccuagcucuauuccuggaacaacucauacagcgacugugcuaacuacuacuaccacuacaguggccacagggucaauggccacuccuagcuccagcacacaaaccucaggaacuacacauaccccccccgugccaaacacaacagcuacaacccacggacgaucacugccgccauccucuccucacacagugcgcacggccuggacuagugcuaccuccggcauucucggcaccacacacaucaccgaacccaguacuguaaccucccauacacccgccgcuacaacuuccaccacccagcacuccacaccagcccugucuuccccacaucccaguucaagaacuaccgaauccccccccaguccuggcacuacgacccccggucacacacgcggcaccucucguaccaccgcuacagccaccccuucgaaaacucguaccuccacccuacugcccucauccccaaccucagcacccaucacaaccgugguaacuacaggcugcgagccacagugugccuggucggagugguuggacuauagcuauccuaugcccggucccucaggcggagauuuugacaccuauucuaauauccgggccgccggaggggcaguaugcgaacagccucugggcuuagaauguagagcacaggcgcaaccaggagucccccugagggagcucggacaggucguugaaugcucgcucgacuuuggauuagugugccggaaucgugaacaggucgggaaguucaaaauguguuuuaacuacgagauuagaguauuuuguuguaauuacggucauugccccagcacgcccgcuacauccaguacugccacccccucauccaccccaggcacuacauggaucuugacuaaacuuaccacuacugcuacaaccacagaaucuacagggucuacugccacaccuaguucuacaccagguacaaccuggauccugacagagccuucgacaacugcaaccgugacagugccuaccggaucuacagccaccgcuuccuccacucaagccaccgcaggcacaccccacgugucgacaacugcaaccacccccacagucacaucaucaaaggcuacuccauucucuagucccggcacagcaaccgcucuccccgcguuacgauccacagcaaccacgcccacugccaccaguuuuacugcuauccccuccuccucucugggcacaacauggaccagacucagccaaacgacuacccccacugccaccauguccaccgcuacacccuccucuacacccgaaaccgcucacacuuccacaguuuugacgacaaccgcuacaaccacucgcgcaacuggguccguugcaaccccgucauccacacccggcaccgcccacacuaccaaaguuccuacgacaacuacuacaggauucacaguuacgcccagcaguagcccuggaacugcucggacuccgccgguguggaucucaacaacaacaacacccaccaccucaggauccaccguuacccccagcucagugcccggaacgacacacacuccuaccguucuuacaaccaccacuacaacuguagcgacaggcaguauggcgacaccuuccucuagcacacagaccucugguacuacccacacgccuccagugcccaauaccaccgcaaccacucauggccguucccucuccccuucuuccccgcacacaguuagaaccgccuggaccuccgccacuuccggaacccugggaacuacacacauuacagaaccuuccaccggcaccagucauacacccgccgcuacuacaggaacaacccagcauaguacaccugcauuaucaagcccccauccauccaguagaacaaccgaaucccccccaucaccaggaacuacaaccccgggucacaccacggcaaccagucgaacaaccgcuaccgcuacgccuuccaagacaaggacuucaacacugcugccaucaucccccacauccgcucccauuaccaccguugucaccacaggaugcgagccucagugugcgugguccgaaugguuagauuauaguuaucccaugccugguccuuccggcggagauuucgauacauauaguaacauccgggccgcuggaggugccgucugcgaacagccucuaggccucgaaugccgugcucaagcccaacccggcgugccuuuaggagaauuaggacaggucguagaaugcucucucgauuuuggcuugguuugcaggaaccgagagcagguaggcaaguuuaaaauguguuuuaauuacgagauucgcguguuuuguuguaauuauggacauugucccuccacaccagcuacauccagcaccgcaaugccguccagcacaccagggacuaccuggauccucacagaguuaacuacaaccgcaacaacuacagcuucuacaggaaguacugccacaccuaguucaacccccggcacagcaccuccaccaaaaguacugaccucaccugcaaccacaccuaccgccacaucuucaaaggcaaccagcagcucguccccccgcacggccacuacccugcccguucuuacaucaaccgccacuaagucuaccgcuacuucugucacccccaucccguccuccacacuggggacaaccgggacacuuccggaacagacuaccaccccuguugccaccaugucuacaauucauccuuccaguaccccugagacuacucauacuuccacuguccuuacuaccaaagcuaccaccacccgggccacgagcagcaccucaacccccucauccacacccggaaccaccuggauucugacugaacugaccacagccgccacaaccacugcggcuacuggacccacggcgacucccucaucaacuccuggaacgaccuggauccugacagaacucacuacuaccgcaaccacaacagccucuaccggaucuaccgccaccccgagcuccacuccuggcacaacauggauacuaacagagcccuccacgacagccacggugaccguccccacagguuccaccgccaccgccagcuccacccaggcuacagccggcacuccccacguuuccacgacugccacaacuccaaccguuacauccucuaaagcuacaccuagcagcucaccuggaaccgccaccgcccugcccgccuugcgcaguacagcaaccacccccaccgccacaucuuuuaccgcgauuccuaguucuucucugggcaccacauggacccgucugucccagaccacaacaccaaccgcgacaaugagcaccgcaacuccaucauccacucccgagaccguccacaccuccaccguacuuacagcaaccgccaccaccacaggugcuaccgguagcguugcuacacccucuucgacucccgguacugcucauacuacuaaaguuccgacuacgaccacgaccggcuucacugccacuccgagcuccucaccaggcaccgcccucacacccccgacuacaacaccaaugucuacuaugucaacaauccauaccaguagcacgccugaaacaacgcacaccucuaccguuuugacuacuacggcgacaaugacuagggccacaaacuccacagcaaccccgagcagcacacuaggcacuacacgaauuuugacugaacuuaccacgaccgccacuacuacagcagcgaccggaucaacggccacccucuccucuacaccagggaccacauggauacucacagaaccuucuacaaucgcaaccguaaugguccccacuggcucaaccgccacagcaucaucuaccuuggguacugcacacaccccuaaggucguuacuacgauggccacgaugccaacugccaccgcuucgacaguaccauccucaucuacaguugguaccacgcggacccccgccgucuugccaucgucccugccaacauucucagucucuaccguguccuccaguguccucaccacucuccgcccuacaggauucccuaguucacacuucucaacaccauguuucugucgcgccuuuggccaguucuuuagucccggagaagugauauauaacaaaacugacagagcugggugucacuucuaugcuguguguaaccaacauugugauauagauagguuccaaggcgccuguccaacaagccccccuccggugucuuccgccccauugucuucgccuagcccagcaccgggcugugacaacgcuaucccauugcggcaagugaacgaaacuuggacucuggagaacugcaccguggcucggugugucggugacaacagagugguccuucucgauccaaaacccguagcuaauguaacaugugugaacaagcaucugccuauuaagguaucagauccuucacaaccuugugacuuucauuaugagugcgagugcgaaugugucggcggacguggaauuacaccaggcgcaggaauauguucgauguggggugguucccacuacucaacauuugacggaaccagcuacacauuuagggggaacuguaccuacguacucaugcgggaaauccacgcacgauucggcaaccucuccuuauaucuggauaaccacuauugcacugcaagcgcgacugcagcggccgccagaugcccaagggcacugucuauccacuauaagaguauggacaucgugcuuacugucacuauggugcacggaaaagaagaagguuuaauccuauucgaucagauuccagucucaagcggcuucucaaagaacggcguucugguuucugugcuggggacuacgacaaugaggguugacaucccggcccuugggguuucugugacauucaacggccaaguguuucaggcuagacugcccuauucucucuuucacaauaauacugaggggcaguguggcacuuguaccaauaaccaacgcgacgauuguuuacagcgagauggcacaaccgcugcgucuuguaaagauauggccaaaacaugguuaguaccagauucaaggaaagauggauguugggcccccacuggcacccccccuacagccucaccugccgccccuguuuccuccacccccaccccuacucccugccccccucaaccauuaugcgacuugauguugagccagguuuuugcggagugccauaaucuuguccccccugggccuuuuuuuaacgccugcaucagcgaucauugucgcgggcgacuggaagucccaugccagaguuuagaagccuaugcagagcugugucgagcgaggggcgugugcucugauuggaggggugccaccggcggccucugcgacuugacgugcccaccaaccaaagucuauaaacccuguggacccauucagcccgcaacauguaauagccgcaaccaaucuccccaacuggaagguauggcggaaggcuguuucugcccagaagaccaaauacuguuuaaugcccauauggggauuuguguucaggcaugcccaugcgucgggccugaugguuuuccaaaauuccccggugaaagguggguaucuaauugucaaucuuguguaugugaugaggggagcguuaguguacaauguaaacccuugcccugcgaugcucaaggccagcccccaccuugcaacagacccggauuugugacagugaccagaccaagagccgagaaccccuguugcccagagacaguuugcgucuguaauacuacuacgugcccccaaucguuacccgucugcccgcccggucaagaauccaucuguacucaggaggaaggugacuguugcccaaccuuucgcugccgaccccagcuauguucauacaauggaacuuucuauggcgugggcgcuacauuuccaggagcacugcccugccacauguguaccuguuuaucaggagacacccaggauccaaccguacaaugucaagaggaugcauguaacaauacaacuugcccgcaaggcuucgaauacaaacggguugccggucaguguugcggggaaugugugcagacagcuugcuuaaccccagauggacagcccgugcaacugaaugaaaccugggugaacagccacguugacaauuguacagucuaucuaugcgaggcagagggaggcguucaucuccucaccccacaaccugccucaugcccagacgucagcaguuguagagggucccuuaggaaaaccggguguugcuacucaugcgaagaagauagcugccaagugagaauuaacacuacgauccuuuggcaccagggcugcgaaacagaggugaauaucacguuuugcgagggcucuugucccggugcaucuaaguacuccgcugaagcacaggccaugcagcaccaguguacaugcugucaggaacgaagaguucaugaggagaccgugccccuucacugucccaauggaucugcuauucuccacacauauacacacgcuguccagguacucugcggucuuuuggcguggggccugcaagcuggagggcacauucggggcgcaguacaggacccucagcagcccuuaaaggaccaggaagcuucagguaaggcgaggcaggguggaggauaucgccaaaccguggccuggggugauaaaucaaacgcacgugccuggcuccagaaaccugugguuuggguccaguccggugcauuuccaacucccggcccugcgucagccuuauguccuugguag

SEQ ID NO: 248958 - RNA, 17298 nt, Artificial Sequence
  Description of Artificial Sequence: Synthetic coding sequence
augggagcccccucugcgugucguacacugguacucgcucuugcggccaugcuggucgucccacaggccgagacucaggguccuguggagccaaguugggagaaugcaggucacacuauggauggcggcgcccccaccuccucuccaacccgucgcgucagcuucgucccucccguuaccguuuuuccuagucucucccccuugaauccagcccacaacggcagaguuuguaguacuuggggagacuuucauuacaagaccuuugauggagacguguuccgcuuucccggccuauguaauuacguuuucuccgagcauugucgggccgcauacgaggacuuuaauguccagcugagacggggacuggucggcucgaggcccguagugacucgcguggucauaaaagcacagggccucguucuugaagcauccaacggauccguguuaauaaauggccagagggaagaacugccguauucucggacugggcugcugguggaacagagcggugauuauauuaagguuaguauucgucugguucuaacauuuuuauggaauggcgaggauucagcauuauuagaacuagaccccaaauacgcuaaccaaacauguggucugugcggagauuuuaacggauuaccagccuucaaugaauucuaugcacacaacgcuagauuaaccccccugcaguuuggaaauuuacagaaacucgauggucccaccgaacagugcccagacccgcugccccugccagccggaaauuguacugacgaggaaggcaucugucacaggacccugcuggggccagcauuugcagaaugccacgccuuagucgacucuaccgccuauuuggccgcuugcgcccaggaucuaugucggugccccacaugccccugcgccaccuuugucgaauauagcagacagugcgcucacgccggcggccaacccaggaauuggcgcugcccagaacuuugcccacgcacgugcccacugaacaugcaacaucaggaauguggaucaccaugcaccgacaccuguucuaacccucagcgagcgcagcucugugaagaccauugcgucgacggauguuuuugccccccaggaaggucuugcaccguacuggaugauauuacacauagcggcugccucccacuggggcaguguccaugcacgcauggcgggcggaccuauagcccuggcacaucuuuuaacaccacauguucuucuugcacuuguuccgggggucuguggcagugucaagaucucccuugucccggcacuugcucuguccaggggggcgcucacaucaguacguaugaugaaaaacucuacgaucugcacggcgauuguuccuacguucuuuccaagaaaugcgcagacagcagcuucacuguucuagccgaguuacguaaguguggacugaccgauaacgagaauugucucaaggcaguuacacugagccucgacggaggggauacugccauccgaguccaggcggacggagguguauuccucaauagcaucuacacucagcucccuuuguccgcggcuaauauuacgcucuuuaccccuaguucguucuuuauagugguacaaacuggucugggauugcaguuacucguccagcucgugcccuuaaugcagguguuugugcgauuagauccagcgcaucagggccagauguguggccucugugguaacuuuaaucaaaaccaggcugacgauuuuaccgcucuuagcggaguaguagaggcaacaggagccgccuucgcuaacacuuggaaagcacaagcugcuugugccaacgccagaaauaguuuugaggaucccuguagccugucuguggagaacgagaacuacgcuagacauuggugcucccgacuaaccgaccccaacucugcuuucucccgcugucacucaauuaucaauccuaaaccuuuucauaguaacuguauguucgacaccugcaauugcgagaggagcgaggacugucuaugcgcagcuuugagcuccuacguccacgcaugcgcugccaaaggaguccagcuuucugauuggcgcgacggcguguguacaaaguauaugcagaacugcccuaagucccaacguuaugcguauguggucgacgccugucagcccaccugccgcgggcucucagaggcagacguaaccugcucaguaaguuucgugccaguggaugggugcacaugccccgcaggcaccuuccugaaugacgccggugcaugugucccagcucaggaaugcccuugcuaugcccaugguacagugcuugcccccggugaagugguccacgaugaaggugccguuuguuccuguacaggagggaagcucucauguuuaggggccaguuugcaaaaaaguaccggcugugccgcaccuaugguguaucuggacugcucaaacucaucugcugguacaccgggagcagagugccuccgcagcugucauacccuagaugugggaugcuuuucuacccacugcgucuccggcugugucuguccgccaggccuuguuucugacggcucugggggcuguauugcugaagaagacuguccuugcguccauaacgaagcuaccuauaagcccggcgagaccauucgcguggacugcaauacauguacuuguagaaaucgucgaugggaaugcucccaccgcuugugccuggggacaugcgucgccuauggcgacgggcacuucauuacauuugauggcgauagguacuccuucgagggcucuugcgaauacauucucgcccaggacuauuguggugauaauaccacucacggcacuuuccgcaucgugaccgaaaacaucccaugcggcacaacaggaaccacuugcucgaaggcuauuaagcuguucguagaaucguacgagcuuauacuacaggaaggcacauuuaaagcagucgcucgaggacccgguggcgauccucccuauaagaucagguauaugggaaucuuccuugugauagaaacccacggcauggcugucaguugggauagaaagacuucuguuuucauucggcuccaccaggauuacaaggguagaguuugcggguugugcgggaauuucgaugauaacgcuauuaacgauuucgccacacgaagucgauccgugguuggcgacgcccucgaauucggcaacaguuggaaacuuaguccuucuugcccagacgcucucgcucccaaagauccuugcaccgcuaacccauucagaaagucaugggcucagaagcaaugcagcauucuacacgggccuacguuugcagccuguagaucccaaguagauuccacgaaauacuaugaagcaugugugaacgaugccugugccugcgacagugguggagauugcgagugcuucuguacagccgucgcugcauacgcucaagcaugucaugaugcugggcucugugugucauggcggacaccugauaccuguccucuguucugugacuucuacaacccacacggcggaugcgaauggcacuaucaaccauguggcgcucccugcuugaaaacuugccggaaucccagcgggcacuguuuggucgaccuucccgggcucgaagggugcuauccaaaauguccacccucccaacccuucuucaaugaagaccagaugaaaugugucgcacaguguggcugcuacgacaaggacggaaacuacuacgacgucggggccagaguaccuaccgcugaaaauugccagucaugcaacugcacuccuaguggaauccagugcgcucauucuuuggaggccuguacauguaccuacgaagauagaaccuacagcuaccaagacguuauuuacaacacgacugauggcuuaggagccugcuugauugccauauguggguccaacggaacaauuaucaggaaggccguggcaugcccugguacgccugcuacuacaccauuuaccuuuacuacagcauggguuccacauucaaccacguccccggcuuuaccagugaguaccgucugcgugcgcgaggugugccguuggagcucaugguauaaugggcauagaccugaaccuggauuggggggaggagacuucgaaacauucgaaaaccuuaggcaaagaggauaccaagucuguccgguuuuagccgauaucgaaugccgcgccgcacaguugcccgauaugccucuggaggaauugggucagcaaguggauugcgaccgcaugcgcggcuuaaugugcgccaauagccaacaguccccaccauugugucacgauuaugaacuccgcguccucugcugcgaauacguaccaugcggacccucucccgcucccgggaccucuccccagccuucccucagcgccuccacagaacccgccgugccuacgccuacucaaacaacagccacugagaagaccacauuaugggucacccccuccauccgcucuacagccgcccugaccagccaaacaggcucuagcuccggaccuguaacgguuacacccagcgccccugggacaacuaccugccagccccgcugccaguggaccgagugguucgaugaggacuacccaaagucugaacaacucggcggagauguggagucguacgauaagauucgagccgcagguggccaucuuugccaacagccuaaagacaucgagugucaagccgagaguuuucccaacuggacguuagcacaagugggucagaaagugcauugcgauguucacuucggucuuguaugucgcaacugggaacaggaggguguguucaagauguguuauaacuacagaauucgagugcuuuguugcagcgacgaucauugucggggccgugcaacuaccccuccccccacgaccgagcuugagacagcaacaacuaccaccacccaggccuuguuuuccaccccccaacccaccucuaguccugggcugacaagagccccccccgccagcacuaccgcaguacccacccucucagaggggcugacuuccccuagauauaccuccacccuaggcacagcaacaaccggaggacccaccacaccugccgguaguacagaaccaacugugccaggggucgccaccuccacucugcccacacguagcgcucucccagguacgacgggcagccuugggaccuggagacccucacaaccuccuacucuugcgccuaccacaauggcuaccagucgcgcaaggcccacaggaacagcaaguacugcaucgaaggagccucugacuacgucccuggcaccaacuuugacuucagaauuauccacuagccaagccgagacauccacuccucguacagagacaaccaugucccccuugaccaauaccacuacaucccagggcacuacuagaugucagccgaaaugcgaauggacggagugguucgacguagauuucccaacaucugguguggccgggggggacauggaaaccuucgagaauauccgagccgcgggcgguaaaauguguugggcucccaaaagcaucgagugccgagccgaaaacuaucccgaagugucaaucgaucaaguggggcaaguucuuacaugcucuuuagagacugggcuaaccugcaagaaugaggaucagacaggucgguucaauaugugcuuuaauuauaacguaagaguacuauguugugaugacuauucacacugcccuaguacaccugcaacuucaagcaccgcaaccccgaguagcaccccaggcaccacuuggauacugacuaagcccacgaccaccgccacuaccacagccucuaccggcucuacagccaccccgacuucuacacuccggaccgccccaccuccuaaaguacugacgacaaccgccaccaccccuacagucacaaguuccaaagccacgcccuccucgagcccgggaacagcuacggcccugcccgcccuccgaucuacugccacaacucccaccgcgaccucaguuacgccaauccccucuucauccuuaggcaccacauggacuagguugagucagacaacuacuccuaccgccacgaugucuacagcuacaccaucaucaacaccagagacagcccauacuucuacaguucugaccgcgaccgccacgacuaccggcgcaaccggcucaguugcaacacccucauccaccccugggacagcucauacaacuaaggucccaacgacuaccacuacaggcuuuacggcuacuccauccuccucacccggcaccgcuuuaaccccucccguguggaucaguacuacuaccacacccaccacucguggauccacugugacuccuuccuccaucccuggaacuacccacacugcuacaguucugaccacgacgacgacuaccguggccaccggcagcauggccacuccaucuagcucgacgcagacuucuggcacgcccccaucccugaccacgaccgcaaccacaauuacagcaaccggaucaacuacuaauccuuccuccacucccgggacgacacccaucccuccaguuuuaacuacaacagccaccacacccgcagcaacuaguaacaccguaaccccuuccucugcucuaggcacuacccauacaccccccguucccaacaccauggcuacuacccacgggcgcucucucccuccaucuagcccacacacugucaggaccgcauggaccucugccacuuccggaauccuggguacuacacauauuacagaaccaagcaccgugacuucucauacccuggccgccaccacuggaacuacucagcacucaacacccgcucugucuucgccacauccaucaucuaggaccacugaaagccccccaaguccgggaaccacuacuccuggccauaccaccgcuacuucacgaacaaccgcaaccgcuacaccauccaagacacggaccucaacccuauugccgucuucccccaccuccgccccuaucacaacgguagugacuaugggaugcgaaccccaaugugcuuggagcgagugguuagacuacaguuauccaaugcccggucccuccggaggagauuucgauacuuauagcaauauucgcgcagcgggaggugcagugugcgaacagccauugggucuggaauguagagcucaggcacagcccgggguaccccuccgggaacuugggcaggugguugaguguucguuagacuucggacugguauguagaaacagggagcaagucggcaaguuuaagaugugcuucaauuaugaaauucgaguguucugcugcaacuauggucacuguccaucuacuccggcaacuuccucuacagccaugccauccucuacuccuggcacuacuuggauauuaaccgagcugacaacgacagccacgacuacugaaucuacugguuccacugcgacacccucuucuacuccugggacaacuuggauacuuacugaaccauccaccaccgcaaccguaacaguccccaccggauccaccgccacagcuagcaguacacaggcaaccgcugguaccccacacgugaguacuaccgccacaacccccacugugacaaguucaaaggccacuccguuuuccagucccggaacugccacugcuuuacccgcgcuacgcucaacagcaacuacaccuacagccaccaguuucacugcuauucccuccucuucuuugggcacaacuuggacccgucuuucucaaaccacuacccccaccgcaaccauguccacugcuaccccauccucuacuccugaaaccgugcacacuucaacuguauugacgaccacggcuacgaccacuggagcuaccggcuccgucgcgaccccauccucaacuccuggaacugcccacacgaccaaagugcucacuaccaccaccaccgguuuuaccgccacuccauccucuucuccagguacagcccggacgcucccuguguggaucucuacgacuaccaccccuacaacccgcggaucaaccguuaccccaaguucuauuccaggcaccacgcacacucccacugucuugacuacaacgaccaccaccguagcaaccgguucuauggccacacccuccucuucuacacaaaccagcgggacgccccccucccucaccaccacagcuaccacuaucaccgcuacuggcucaacaacgaauccuucaucuacccccgguacaacucccauuccuccuguuuuaacuaccaccgccacgacaccugcagcuaccagcagcacugugacaccuucuagcgcuuugggaacuacacacaccccuccaguuccgaacaccacggccacuacacacggucgaagucuguccccuucauccccucacacuguucgcacugccuggacaucugcaacaucuggaacccugggcacgacacauaucacagagccuucuacuggaaccucccacacgccugccgccacuacgggcacgacacaacacuccacaccugcucuaaguuccccccauccuagcucccguaccacugagagucccccuagccccgguacgacaacccccggacacacccgugcaaccagcaggaccaccgccaccgccacuccaagcaaaacucgaacaucaaccuuacuuccuuccaguccaacaucagcuccaauaaccaccguggucacaaugggcugcgaaccucagugugcuugguccgaauggcucgacuacucuuaccccaugccuggcccuuccgguggcgacuuugauacuuauucaaacaucagggccgccggaggcgcagugugugaacaaccccucggccucgaaugucgggcccaggcucaacccggaguccccuuacgcgaacugggccaggucguagaaugcagccuagauuuuggacuggugugcagaaaccgggagcagguggguaaauuuaaaauguguuuuaacuaugaaauuagaguguuuuguuguaauuauggacacugcccaagcacgccggccaccucuucuacugcaacuccaucuagcacgccuggaaccacuuggauucucacugagcaaacuacagcggcaacgacaacggccaccaccggaucuaccgcuauccccaguagcacuccuggcaccgcacccccccccaagguucuuacaucuaccgcaaccacacccacugccacuagcucuaaagcaacaaguucaucuucuccucguacagcaacaacccugcccguccuaaccaguacugccacgaagucuacggcuacauccuucacuccaaucccauccuuuacauuaggcacuacaggcacccuacccgaacagacuaccacccccauggcuacaaugucuacuauccaccccucaaguacccccgaaaccacacacacuuccaccgugcugacaacaaaggcuaccacuacacgggccaccucuaguaugucaaccccaagcucuaccccuggcacaacauggaucuuaacagagcuaacgaccgccgccacaacuacugccgccaccgggccaacagcuacuccuucaucaaccccugggacaacuuggauauuaacugagccuucuacuacggccacagucacuguaccuacuggaucuaccgcgaccgcaucuucuacccgugccacagccgggacguuaaaagugcucaccucaaccgccacaacccccaccgugauuagcucucgugccacacccucauccuccccagguaccgcaacagcacuuccagcuuugagaucaacagcuacaaccccaaccgccaccuccgugacagccauucccuccuccucuuuagguacugccuggacuagauugagucagaccaccacuccuacggcuacaaugucgacagcuacucccucuagcaccccagaaaccguccauacuucgacaguccucaccacuaccacgacuaccacgcgggcuaccggaagcguagccaccccauccucaaccccugguaccgcacacacaacaaaaguucccacaacaacgaccaccggguucaccgccaccccaucuucuagccccggaacggcccuaaccccaccaguauggauuucaaccaccaccaccccuaccacacgcgggucaacugugacgccaagcucuauuccuggcacuacucacacagcuacagugcucaccacgacuacaacaacaguugcuacaggcucaauggccaccccaucuucgaguacucaaacuucugggacucccccaagucuaaccacaacugcgacaacaaucacagcuaccggauccaccacaaacccgaguagcacaccagguacuacucccaucccacccguucugacuacuacagcaaccacuccagccgcgaccucaagcaccgucacaccauccagcgcacucggaaccacucacacacccccaguuccuaacaccacagcaacuacacacggaagaucucugcccccuucaucaccccacacaguucgaacagcuuggaccuccgccacuagcggcauccuagguacaacacauauuaccgaaccuaguacugucaccucccacacucccgcagccacgacgagcacuacucagcauagcacgcccgcacuuucuuccccucauccauccucccggaccacagaaagcccaccuucaccaggaacaaccacaccagggcacacccgcggaaccucaagaacgaccgcaacugccacuccaagcaagacacgaacgagcacccugcuuccuuccucccccacguccgcuccuaucacuacugucgucacuaccggcugugaaccccagugcgccuggagugaauggcucgacuauagcuacccuaugccaggcccuaguggcggcgacuuugacacuuacaguaacauuagagcugcgggaggggcugugugcgagcaaccuuuaggcuuggagugucgggcccaggcccagcccggcgucccucugcgcgaacuuggccaggugguggaguguagccuggacuucggacuugucugccggaauagagagcaagucggcaaauucaagauguguuucaauuacgaaaucagagucuucugcuguaacuauggacacugucccucaacacccgcaacaucgucaacugcuacgccuuccucuacacccggaacuacauggauccuaacaaaacugacgacaaccgcaacuacaacagagucuacagguagcaccgccacaccaucauccacaccugguacgaccuggauccuuacugagccuucaaccacagccaccguaacagucccaaccggcuccaccgcuacugcuaguucaacucaagcaacagcagguacuccccaugugagcaccacugccacuacuccuaccguuacaagcagcaaagccacgccauucucuuccccuggaacagccacagcacuacccgcccuuaggucaacagcuaccacgccaaccgccaccucauucaccgcuauccccucuuccucccugggaaccaccuggacacgacugucucagaccaccacaccuacagcuacuauguccacagccacuccgagcagcacccccgaaacagcucauaccaguaccgugcugaccacaaccgccaccacuacucgcgccaccggguccguggcgaccccuucaucgacaccuggcacagcccauaccacuaaagucccgaccacgaccaccacaggauucacaguuacucccucaucuagcccuggcacagcgcgcacuccgccaguuuggauuuccaccacgacuacucccaccacuucagguagcaccgucacuccgucuucugugccugggacgacccacaccccaacaguccuuaccaccacaacaacuaccguggcuacaggaagcauggcgacaccuagcuccuccacccagacauccggcaccccaccuucccuaauuaccaccgcaacgacuauuaccgcaacuggcucaacgaccaaccccuccucuacuccaggcacaacuccaauucccccgguccugacaacuacggcuaccaccccugccgccacauccucaacagucacaccauccucugcacucggaacaacacacacgccacccguuccuaauaccaccgcuaccacacacggccgaagcuugucccccucuagcccacauacuguuaggacagccuggacuucagcgacuucugggacccuaggaaccacucauaucacagaaccaucuaccggaaccucacacacuccagccgcuacgacuggaaccacucagcacuccacaccagcccuguccuccccccacccuucaagucggacaacagagucaccgcccagcccaggaaccacaacccccggccacaccacugccacuucuaggacaaccgccaccgcgacuccuucaaaaacucguacaagcaccuugcuccccucuagcccuacauccgcuccuauuacuacuguagugaccaccgggugcgaaccccaaugcgcguggagcgaauggcuagacuauucuuacccuaugccaggaccuaguggaggugauuucgauacauacaguaauauacgugcagcaggaggcgccgucugugagcaaccucucgggcuugaauguagagcccaggcccagccaggggugccauuaggcgagcuggggcaagugguggaaugcagccuugacuuuggacuaguguguaggaauagagagcaagucggcaaauuuaaaaugugcuucaauuaugagauucgaguguuuuguugcaacuauggccauugcccuucuacccccgcgacgucaucaaccgccaugccaucuagcacccccggaacaaccuggauucugacagaacugaccacgacagccacaacuacugcguccacugguucuaccgcaacuccgucuaguacgccuggaacggcacccccuccuaaagugcucacuagcccagccaccacaccaacagcaaccucuagcaaggcaaccagcucaagcucaccgcgaaccgccacuacccucccuguacugacauccaccgcgacgaaaagcacugcaacauccgucacuccuauuccauccagcacuuuggguacaacaggaacucugccagaacagaccaccacaccuguggccacaauguccacaauucacccuucuagcacuccugaaacgacucacaccucaaccgugcugacuacuaaagcuacuacgacuagagccaccuccucaacuagcacgcccuccuccaccccuggaacuaccuggauucucaccgaacuuacuacagccgcgaccaccacggcugccaccggcccuacagcgacccccaguagcaccccuggaacaaccuggauucucaccgaacugacaaccaccgccaccacgaccgcuagcaccggguccaccgccacaccgucaucaacucccggcacuaccuggauucuaacagagccauccaccaccgccacgguuacugugcccacaggguccacagcaacugcgagcaguacccaggccaccgcaggcaccccacaugucucaacgaccgccacuacacccaccgucaccagcucgaaagcaaccccaucuaguuccccagggaccgccaccgccuuaccagcacugagaucaaccgccacuacccccacagccacauccuucacagcaaucccuagcuccucccugggcaccacuuggacccguuuaagccagacuacaaccccgacagcgacuaugaguaccgccaccccuuccucaacccccgagacuguucauaccuccaccgugcuaaccgccacugccaccaccacgggcgcuacuggcuccguggcaacaccaagcucuacacccggcacagcgcauacaaccaaagugccuaccaccaccacgacaggauuuacagccacaccaucgucuucuccuggaacggccuuaacacccccaguuuggauaucuacaacuacaacacccacaaccacaacucccacgacuuccggcuccacagugacaccuagcucuauccccgguacuacucacacggcccgaguccugacaacuacaaccacgacuguggcuaccggcucgauggccacucccuccagcuccacacagacuucuggaaccccaccaucuuuaaccaccaccgccaccacaauuaccgcaacuggaucaacuaccaacccuaguuccacucccgguacaaccccaaucacaccaguucugacaucaacugcaacaacuccugccgccaccucuagcaaagccacaagcaguagcuccccucgcacagccaccacccuaccgguccugacaucgacagcaacuaagucuacggccaccuccuucacaccuauccccucuucaacccuuuggacaacuuggaccguuccugcccaaaccacaacaccaaugaguacaauguccacaauucauacuaguaguacaccggaaacuacccacacauccaccguccucacaacgacugcaacuaugacacgcgcuacuaauagcacugccacucccuccucaacauuagggacaacucguauuuugacugagcucaccaccaccgcaacgacaacagcugcaacaggauccacggccacauuauccucuacacccgggacuaccuggauccucacggagcccucuaccauugcaacugucaugguuccuacugguucaaccgccacagccuccucaaccuugggcacugcccacacccccaaaguagugacuacuauggccacgaugccaacagcaaccgcuucaaccguaccauccucaagcacuguagguacuacgcguaccccugcugugcugccuuccucgcucccuacuuuuuccgucucaaccguaucuagcaguguccugacuacccuccgcccaaccggauuuccuucuucacacuuuagcacccccuguuucuguagggcuuuuggucaguucuucucuccaggcgaagucauauacaauaagaccgaucgcgccggcugccauuuuuacgcugucuguaaccaacacugcgacaucgacagauuccagggggcuugccccacuaguccaccccccgucuccagcgcaccucuuagcucccccaguccugcucccgguugcgacaacgcuauccccuugcggcaggugaacgagaccuggacuuuagaaaauuguaccgucgcccguugcgugggugauaauagagucguuuuguuagacccuaaaccagucgccaaugugacaugcgugaauaagcaccugcccauuaaagucuccgaccccagccaaccaugcgauuuucacuaugaaugcgagugcaucugcucuauguggggagggucccacuauuccaccuuugauggcaccuccuacacuuuccgcggcaauugcacuuacguguuaaugcgggagauccacgcccguuuuggcaaccugagucuguaccuggauaaccacuauuguaccgcguccgccacugcugccgccgcaagauguccccgcgcccuaucuauucauuauaagagcauggauaucgugcuuacugugaccaugguucaugggaaggaggaaggccuaauccuuuuugaucagauuccugucuccagcggcuucuccaagaacggaguucucgugucuguauuagggaccacaaccaugcgcguugauauccccgcuuugggaguuucugucacauucaacggccagguuuuccaagcaagacugcccuacuccuuguuucacaacaauaccgaaggacagugcgguacaugcacaaauaaccaacgcgacgauugccugcagcgggacgguaccacagcugcuucgugcaaggauauggcaaaaacauggcuaguccccgauucccggaaagauggaugcugggcaccuaccgguacaccaccaacagcaagcccagccgcucccguauccuccacacccacuccaacccccugcccaccccagccccucugcgaccugaugcuuucccaggucuuugcugaaugccacaaucucguucccccaggacccuucuuuaacgcaugcauauccgaucacugccgcggacggcuggagguaccaugccaaucauuagaggcuuacgcagaguuaugcagagccagggguguguguucugauuggcgcggcgcuacagguggacuuugugaucugacgugcccccccacuaaaguguauaagcccugcggacccauacagcccgcuacuugcaauucuaggaaucagagcccgcagcuggagggcauggcugaaggcugcuucuguccagaggaucagauucuguuuaacgcccacauggggaucugcgugcaagccugccccuguguaggucccgacggcuuuccaaaguuuccgggugagagaugggugucaaauugccaaagcugugugugugacgaagguuccguguccguucaauguaagccucucccaugcgacgcucagggacagcccccgcccuguaaucgacccggcuuuguaacagugacccgacccagagcugagaaccccuguugucccgagaccgugugcguguguaauacuacaaccugcccucagagucugccugugugcccaccaggacaggaaagcauuuguacacaagaagagggcgauugcugcccuaccuucagaugcagaccccagcuauguucuuacaacgggaccuucuauggagugggagcuacuuucccuggggcacucccaugucacaugugcacaugccugagcggugacacccaggaccccaccguccaaugccaggaagacgcaugcaacaauacaacuuguccacaaggguucgaauacaaaaggguugcaggacaguguuguggcgagugcgugcagaccgcuugucugacaccagauggacagccuguccaacugaaugagacuugggugaauucucacguugauaacuguacuguuuaccuaugcgaggcggaaggagguguccauuuacuaaccccccagccagccucaugccccgaugugucuucuugccgcgggucacugagaaagaccgguugcugcuauuccugugaggaggauuccugucaggugcgaauaaacaccaccauucuauggcaccaggggugugaaacggaggucaacauuacuuuuugugaagggucuuguccuggagcuuccaaguacagugcugaggcucaagcaaugcagcaucagugcacaugcugccaagaaaggaggguccacgaggagacugucccccuucauuguccuaauggguccgcuauuuuacauacauacacccacguugacgagugcgguuguacccccuuuuguguccccgcuccgauggcucccccacauacccgcggauuuccugcacaggaagcaacagcagucuag

SEQ ID NO: 248959 - RNA, 17289 nt, Artificial Sequence
  Description of Artificial Sequence: Synthetic coding sequence
augggugccccaucagccuguaggacccuugucuuagccuuagcagcuaugcucgucguuccgcaagcggagacucagggaccaguggaaccaaguugggagaaugcuggccacacuauggacgguggugcaccuaccucguccccuacccgccgcgugucuuuugugccucccgugaccguuuucccauccuuaagcccccucaauccagcacacaauggcaggguguguuccacuuggggagacuuccauuauaagacuuuugauggcgauguguucagauuccccggccuguguaacuauguguucagcgagcauugucgcgcagccuaugaggacuucaacgugcaauuaaggagggggcuuguuggcagucguccuguggucacaagaguagucauaaaggcccaaggcuuaguucucgaggccagcaacgggucagugcuuauuaauggacagagagaagaacuccccuauucaagaaccggguuauuaguagagcagagcggugacuacaucaaaguaucaauccgucuaguucucaccuuccucuggaauggcgaagacucugcucuucuggaacuggauccuaaauacgcaaaucaaacauguggacuuugcggagauuuuaacggcuuaccugcauuuaaugaauuuuacgcacauaaugccagauugaccccacugcaguucggaaacuugcagaaauuagauggccccaccgagcaauguccagacccuuuaccuuuaccagccggcaacugcacugacgaggaaggcaucugccaccgcacgcuacuugguccggcuuucgcggaaugccaugcuuugguggacagcacugcuuaucuggcugcaugugcccaagaccugugucguugcccaacauguccuugcgccacguucgucgaauauagcagacaaugugcgcacgcagguggacagccuaggaacuggagaugccccgaguuaugcccaagaaccuguccuuugaacaugcagcaucaagaguguggcucuccuuguacugacacgugcuccaauccgcagcgggcacagcuaugugaggaucacugcguggaugguuguuucugcccacccggaacaguccuugacgacauuacucauuccgguugucucccccucggccaauguccaugcacacauggcggaagaaccuacaguccugggacuucuuucaacaccacaugcucuucguguacuugcucaggugguuuauggcagugccaagaucucccaugcccuggcacauguagcgugcaaggaggggcucauauaaguaccuaugacgaaaaacuguaugacuugcacggcgauugcucauacgugcuguccaaaaagugugccgauaguucuuucacuguacuagcagagcugagaaaauguggucugacugacaaugaaaacugccugaaagcggugacucugucgcuugaugggggugauacagccauacggguccaagcugacggcggaguguuucugaauucaaucuauacucaguuaccuuuaagugccgcuaauaucacacuauuuacaccuuccucuuucuuuauagucguccaaacaggacugggucugcaauugcucguccagcucguccccuugaugcaagucuuuguuagacuggaccccgcucaccagggacaaaugugcggguugugugggaauuucaaucagaaccaggcugacgauuucacagcacugucaggaguuguggaggcuacaggugcugcuuucgcuaacacauggaaggcucaagcugccugcgccaacgcccggaauaguuucgaggacccgugcucuuuaucugucgagaaugagaauuacgcucgacauugguguucgcgcuugaccgaccccaacagugcuuucucaaggugccacucaauuaucaacccaaaaccuuuucauuccaauuguauguucgauaccuguaauugugagcggagcgaggauugucugugcgcagcauugagcaguuacgugcacgccugcgcugccaaaggaguucagcugagugacuggagagauggcguuuguacuaaauauaugcagaauugucccaaaucacagagauaugccuacgucguggaugcuugucagccuacguguagaggccucucugaggccgacgucaccuguucuguaucauuugugccaguagauggcuguacaugucccgcuggaaccuucuuaaacgaugccggagccugcguccccgcccaagaaugccccuguuacgcgcacggaaccgugcuggcuccuggagagguagugcacgacgaaggagccguaugcuccuguacagguggcaaguugucuugucugggagccucguugcaaaagucaacuggaugugccgcacccaugguguacuuggauugcagcaacucaucugcuggcacucccggcgcagagugccuuagauccugccacacccuggaugugggguguuuuucuacccauugcguuucggguugugugugucccccgggcuugguuuccgacgggagcggagggugcaucgcugaagaggacugccccuguguacacaacgaagcuaccuauaaaccuggagagacuaucagaguugauuguaauaccuguacaugucguaaucgccgcugggagugcagucaucgucucugccugggcacauguguugcauacggggaugggcacuucauaacauucgacggagaucgguacagcuucgaaggaucuugcgaguauaucuuggcucaggauuauuguggcgacaacacgacgcauggcacguuuaggauagugacggagaauauuccgugugggacaaccgggacaaccuguagcaaggccaucaaacuuuuuguggaauccuacgaauugauccuccaggaaggcaccuucaaagccguagcgcggggacccggcggggauccuccuuacaagauuagauacaugggaaucuuccuagugauugagacucaugguauggcuguuucuugggauagaaaaacauccguguuuauccgauugcaccaagauuacaaaggcagaguaugugggcuguguggcaauuucgaugacaaugcgauaaaugauuuugcaacccguagcaggucuguaguaggcgaugcucuugaguuugggaacuccuggaagcuuaguccuaguugcccagaugcccuggcuccaaaggaccccuguaccgcaaaucccuuucguaaaucaugggcucagaagcaguguucuaucuugcacgggccaacguucgccgccugucgaagucagguugacagcacuaaauauuaugaggcuuguguaaaugacgcaugcgccugcgacucuggaggagauugugaaugcuuuugcacagccgucgccgccuaugcccaagccugucaugaugccggacuuugugugagcuggagaaccccugacacaugcccauuguuuugugauuucuauaauccgcacggagggugugaauggcauuaccagcccugcggcgcgcccugccugaagacaugccggaaccccucgggucacugccugguggaucugcccggccucgaaggauguuaccccaaauguccaccuucccagcccuuuuucaacgaagaccagaugaaauguguagcucagugcggcuguuacgauaaagacggaaauuacuacgaugugggggcccggguucccaccgcugagaacugucagaguugcaauuguaccccaagcggcauccagugcgcccauucccucgaggcauguaccuguacguacgaggaccggacuuauucuuaccaggacgugauuuauaauacuacugauggccucggcgcuugucugauagcuaucuguggcucuaaugguacuauuauucggaaggcaguugccugcccgggaacacccgcaacuacaccauuuaccuucaccacagccugggucccacacaguaccacaagcccagcccugccuguguccacagucugcguaagggaaguuugucguuggaguucuugguacaacggucauagaccagaaccuggcuuggguggcggcgauuucgaaacuuucgagaaucucagacaaagaggauaucagguuugccccguauuagccgacaucgaaugccgcgcggcucaacucccagacaugccucucgaggaguuaggccaacaaguagauugugaccggaugagaggacucaugugcgcgaacagucaacagucaccaccucucugucacgauuaugagcuucggguccucuguugcgaauaugugcccugcggccccaguccagcucccggcaccucuccgcagccuucacuaucagcuagcacggaaccugccguccccacuccuacccagacgaccgccacggaaaaaacaacacuaugggucacacccucuauacgaucaacagcggcccuuacuagccagacagguaguagcuccgguccggucaccguaacccccuccgccccaggaaccaccacuugccagccuaggugccaguggacagagugguucgaugaggauuacccaaaaucagaacagcucgggggcgacguugaaagcuaugacaagauccgcgccgcugggggccaucuuugccagcagccuaaggacaucgaaugucaagcagaaagcuucccuaauuggacucuugcacaggugggccagaaagugcauugugauguccacuuuggccucguauguaggaauugggagcaagaaggagucuucaagauguguuauaacuacagaauccgaguauuauguugcagcgaugaucauugccgagguagagccaccacccccccccccacuacugagcuugaaaccgccaccacaacuacaacgcaggcacuguucuccacuccacaacccaccuccucgcccggccucacccgcgccccacccgcaagcacuaccgcagucccaacacugucugagggccuuacaucaccuagauauaccucaacccuugguaccgcuacaacuggcggcccuacaacacccgcagguaguacugaaccaaccguacccgguguugcuacaagcacgcugccgacucgcuccgcccugccaggcacaaccgggucgcucggcacguggcguccuucucagccccccacucuugcaccuacuacuauggccacgucaagagcaaggcccacagguacagcuucaaccgcuaguaaagagccucugaccaccagcuuagcaccaacuuuaacauccgagcucucaacuucccaagcugaaaccucuacaccuagaacagagacuacaaugucaccucuuaccaacacaaccacaucacaaggaaccacuagaugccagcccaaaugcgaguggacagaaugguucgaugucgacuuccccaccucaggugucgccgguggcgacauggagacauucgagaacauuagagcugccggcggcaagaugugcugggccccaaagucuaucgaauguagagccgaaaauuaccccgaggugucuauagaucaagugggacagguacucacgugcucccuggagacuggccugacgugcaagaaugaagaucagacugggagguuuaauaugugcuuuaacuauaauguccgcguccugugcugugaugauuacucacauugcccuucaaccccugcaaccagcucuaccgcaaccccaaguucaaccccuggcacuacauggauuuuaacuaaaccaacaacgaccgccaccaccacugcaagcacaggcuccaccgccaccccuacaucaaccuugagaacagcgccgccgccaaaagugcuuacaacuaccgccaccacacccacagucacaucuagcaaagcuacccccagcuccagcccugguaccgcgacagcucuuccugcacuucggucaacagcuaccaccccaaccgcgacaaguguuacaccuauccccucaucaucgcuuggaacuacuuggacacgccugucacaaacaacaacuccuacggccacuauguccaccgccacccccucaucaacuccagagaccgcccacacauccaccgugcuaacugcgaccgccacaaccaccggcgccacaggaucaguggcgacuccuuccagcacaccaggaacggcucacacaaccaaaguucccaccacaaccacgaccggauucacagcaaccccuagcucaucccccggaaccgcacuaacaccuccuguuuggaucagcacaacuacaaccccaacaaccagaggaucaacagucacccccagcucuauuccgggaacuacccacaccgccaccguauuaacaaccacuacgacaaccguggcuacaggcucuauggcuaccccaagcuccaguacccagaccucaggaacuccuccaagccucacuacuaccgccacuaccauuacugccacuggcuccaccaccaacccuucuagcacgcccggcaccacaccuauuccuccuguccuuaccacaacagcaacaacaccggccgccaccuccaauacugucacuccuucuucagcuuuaggaacuacccacacuccccccguccccaauacaauggcgacuacucacggacguagccugccucccuccagcccucacaccguuagaaccgcauggacaagcgcaacauccggcauccuuggcacgacacacauuacugagccauccaccgugacgucccauacccucgccgcuacuacaggaacuacacagcauuccacgccagcccuuagcagcccacacccaucaucaagaacaacagagucaccucccaguccugggaccacaacaccaggccauacaacagccaccucaaggacuacagcuaccgccacuccguccaaaacccgaacuaguaccuugcuuccgagcaguccaaccucugcaccgauaacaaccgugguaaccaugggcugugaaccccagugugcguggucagagugguuagacuauaguuaccccaugcccggccccuccggcggcgacuuugacaccuacuccaauaucagagcugcgggcggggcaguuugcgagcagccccucggacuggaaugcagagcucaagcccaacccggugugccacugcgcgagcucggacaagucguugagugcucccucgacuuugguuuagugugccgaaaucgcgaacaggugggaaaguucaaaauguguuuuaauuaugaaauuaggguauuuugcugcaauuauggucacugccccucuaccccugccacuucuuccacugccaugccauccucuacacccgguacuacguggauucucaccgaacugacaacuaccgcuacaacaaccgaguccaccgguucaaccgcuacacccaguaguaccccuggcacgaccuggauccuuacagagccaucaacuaccgccacugugacaguuccuacgggaaguaccgccacugcuucuuccacucaggccacugccggcacuccucacgucucaaccacugcuaccacgccuacgguuaccucaucuaaagccaccccguuuucgagucccggcaccgccacagcucuuccagcccuccgaagcacggcuaccacaccuacagcaaccucauucacagcgauuccuucaagcucacucgggacaacauggacccgccugagucagacuacaacaccaaccgcaacuaugucuaccgccaccccuagcucaaccccagagaccguccauaccucaaccguucuuacaacgaccgcgaccacuaccggagcaacuggaucaguagccaccccauccucaacacccggaacagcccauacuaccaaagugcuaacaaccacaacuaccggcuuuacagcaaccccaucuuccucaccagguaccgcucgcacacugccuguauggauuuccaccacuaccaccccgaccacgcgcgguucaacggugacuccuuccagcauuccaggaacgacacacacaccaacagucuugacaacgacaacuacuaccguggccacuggcucaauggccaccccuucuucaucaacgcaaacaucugguaccccacccagccugacaacaacugcuacuacaaucaccgcuacaggaucgacgacaaacccaaguucuacccccggaacaaccccaauuccuccuguuuugaccacgacugccaccacgccagccgccacaucgaguaccguaaccccuuccagcgcacugggcaccacacacacuccccccgucccuaacacaaccgccacuacccacggucgaucucuuucuccuagcucuccacauaccguaaggacugcuuggaccagcgcgacaucuggaacccucggaacgacccauauaaccgagcccucaaccggaacuucacacacucccgcagcuacuacgggcacuacccagcauucuacacccgcgcuuucuuccccucacccuuccagcaggaccaccgagucaccccccuccccugggaccacaacacccggccauacccgcgcaaccucacgcacaaccgccacggcuacaccuuccaagacacguacaucaaccuuguugccaucuucaccuacuucugcacccaucacaaccgucgugaccaugggaugcgaaccucagugugcauggucugagugguuagacuauaguuaucccaugccuggacccagcggcggagacuuugacacuuacagcaacauacgugccgcaggaggagccgugugugagcagccacucggucuugagugucgugcacaagcacagccagggguuccuuuacgugaguuggggcaggucguagaaugcucucuggauuuuggacucgucugucgcaaccgcgaacaagugggaaaguuuaagauguguuuuaauuaugagaucagaguguuuugcugcaacuacggccacuguccuagcaccccagccacauccagcacagccacgccaaguucuaccccaggcacuaccuggauucugaccgaacaaacaacagcagcaacaaccaccgcgacaaccggaucuacagcuaucccgucuucuacaccaggcacggccccaccaccuaaggugcugacaucuaccgcaacuacuccaaccgccaccucuucuaaagcuacaagcucuucuucuccccgcaccgcuacuacccuuccuguccugacauccacagcaaccaaaagcacagcuacuucauuuacgcccauccccucauuuacucucggaacuacaggcacccucccggagcagaccaccaccccaauggcaacaauguccaccauucacccuuccucaaccccggaaacgacccacaccuccacuguucuuacaacaaaagcuacaaccacacgugcgaccucuagcaugucaacaccuuccucuacuccuggcacuaccuggauccuaaccgaacugaccaccgccgcuaccacgaccgcugcaacaggccccaccgcgacuccgucuaguacuccugggaccacuuggauccugaccgaaccgaguacaacagcgacagucaccguacccacaggcucuacggccaccgccagcucgacucgcgccacagcaggaacucucaaagugcucaccuccacugcgaccacaccaaccgugauaagcuccagagcgaccccauccagcagcccgggcacagcgacugcccugccagcauugcguucaacagccacgaccccuacugcaacgucagucacagccauaccuucgagcagccucgggaccgcuuggacccgacucucccaaaccacaacccccacagccacaaugucuacugccaccccuuccaguacaccagagacaguucauacauccaccguucuaacuacaacaacaacuacuacucgggcgacaggcagcguugccacccccuccaguacaccugggacugcucauacuacuaaggugcccacaacgaccacaacaggcuuuaccgcaacaccuucuuccaguccaggcacagcucuaacaccuccuguguggauuagcacuacaaccacaccuaccacccgggguuccacugugacgccuagcucuauuccagguaccacccacaccgccaccgugcugacgacuacuacaacgaccguugcgacugggucaauggcuaccccaagcucuuccacccaaacaucuggcacuccucccucacugacuacgaccgccacaacaauuaccgcuaccggauccacaacuaacccuuccucuacacccggaacaacaccaauuccucccguucugacaacaaccgcuaccacucccgcugcaacgagcuccacugucacaccaucuucugcacugggaacaacucauaccccucccguuccaaauacuacagcuacuacccacggucggucccucccccccucaagcccccauacuguuagaacugcuuggacuuccgcaacaucagggauucucggcacaacccacaucacagagccaucuacugugaccagccacaccccugcagcuacgacuuccaccacucagcacagcaccccagcccuguccagcccccaucccucaagucguaccacagagaguccucccucaccagggaccacaacgcccggucacacacgaggcacuucccgaacaacugcgacugccacaccuucaaaaacgagaacgucaacuuuacucccgucuucuccuaccucugcgcccauuacuaccgucguuacuacaggcugugaaccucagugcgccuggucugaauggcuagauuacaguuaccccaugccaggaccaagugggggcgauuuugauaccuacagcaacauacgagcagccggcggagccguuugcgagcaaccucugggcuuggaaugucgggcucaagcucaaccuggggucccacuuagggaacuggggcaggucgucgaguguucucuugacuuugggcuaguaugccgcaaucgagagcaaguggggaaguucaaaaugugcuuuaauuaugaaauacgcguuuucuguugcaauuacggacacugucccucaacuccugcuacuucgucaacggcuacaccauccucuacucccgggacaaccuggaucuuaacuaaacugacuacaacagcgacuacuacagaaucuacaggcuccacggcuacaccuuccucuacaccagggacuacauggaucuugacagagccauccacuacagccacuguuacaguucccacaggcaguacugcgaccgccucuuccacacaagccacagcaggaacgccucauguuagcaccaccgccaccacccccacaguuaccucaagcaaagcuacuccauuuuccucuccaggaacagcaacugcuuuacccgcucuuaggucgaccgccaccaccccaacugccacaaguuuuacugcuauccccucaaguucccuuggcaccacauggaccaggcucucacagacuacuacgccuaccgccaccaugucaacagccaccccaucaucaacgcccgaaaccgcucacacaucuaccgucuuaaccacaaccgcaacuacuacaagagcuacaggcuccgucgcaaccccaucaaguaccccaggaaccgcgcauaccacaaagguccccacuaccaccaccacaggguucaccguaacaccaucuuccagcccuggaacugcacggaccccuccaguguggauaucuacgacaaccaccccaacaacgaguggcucuacagugacaccgaguucagucccuggaacuacucauacccccaccguucucacaacuacgaccacaacuguugcuaccggcucaauggccacuccauccuccagcacucagaccagcgggacaccacccucacugauuacuaccgcgacuacuaucacggcuacuggaucuaccacaaaccccucuuccacccccggaaccacccccauccccccuguccuuacaaccacugcuacaacucccgcugcaacuucuagcacagucacccccagcagugcccuugguacuacccacacaccccccgucccaaauaccaccgcgaccacacacggcaggucacuguccccaaguuccccacauacagucagaacagccuggacauccgcuacaucugguaccuugggaaccacacauauaacugagccuuccacugggaccagucauaccccagccgccacaaccggcacuacacagcauucaacgcccgcacucucauccccccauccaucuagccgcaccacagagucaccacccagcccuggcacaaccacuccuggccacaccacagcuacaagccgcacuacagcuaccgccacuccaucaaagacuagaaccaguacacugcugcccucaucgccaacauccgccccaauuacuaccguagugacaacuggcugcgagccccagugcgcaugguccgaaugguuggacuauaguuacccuaugccugggccuagcggcggugauuuugauaccuacucgaacauuagggcugccgguggcgcggugugcgaacagccuuuaggacucgaguguagggcucaggcgcagccgggcgucccucuuggagaacucggccaaguugucgaauguucccuugacuucggacuugucugcagaaacagagagcagguugggaaauucaaaauguguuucaauuacgaaauaagaguuuucuguuguaacuacggccacugcccuucaacacccgccacauccaguacugccaugccuucuucuacgcccggcaccacauggauacugacugagcucaccacaaccgcaaccaccacagcaucuacuggaucuacugcaacccccuccuccacaccuggcacagccccucccccuaaagugcugaccuccccugccaccaccccgacugcuaccuccuccaaagcaacuuccaguaguuccccaagaacugcaaccaccuuaccagugcugacaucgacagccaccaaaaguacagccacaucugugacuccaauccccuccuccacucuuggcacaaccgggacacucccugaacaaaccacaacuccuguagcaaccaugucuacgauacauccguccuccacaccagagaccacacacaccagcacuguccucaccacuaaggcuacaacaacccgugcgacguccucuaccaguacgccuucuucuaccccuggcaccacuuggauucugacagagcucacaaccgccgcaacgacgacagccgccacagggccaaccgccacacccagcagcacucccggcacgacauggauacuaacagaguuaacuacuacggccacaacgaccgcauccacaggcucaaccgcgaccccaucaucuacaccugggacuacuuggauucucaccgaacccucaacaacagcuaccguuacaguaccaaccggaagcacagccaccgccuccucaacacaagcaacagcaggaacaccacacgugaguaccacggcuacaacuccuaccgucacaucguccaaggcuacaccaucauccucaccagggaccgcaaccgcccugccagcucugcgcucaacagccaccaccccaacagcgaccagcuucacagcuauaccuucuagcucucucggaaccacauggacaaggcucucucaaacaaccacucccaccgcuacuaugucaacggccaccccaucaucuacacccgaaacuguccacaccucaaccguccugaccgcaacagcuaccacaacaggggcaaccggaagcguugccaccccaaguucuacgcccggcacagcacacacgacuaaggugccuacgacuacuacuacugguuuuacugcuacacccucaucgaguccuggcacagcgcuaacacccccaguauggauuucgacuaccaccacgcccacuacuacaacacccacuaccagcggaucgacaguaaccccgucaaguauuccaggaacaacucacaccgcucgcguccugacuaccacuacaacgacagucgcaaccggaucuauggcuaccccgucuagcaguacccagacauccgggaccccaccuucucuuaccaccaccgccacuaccauuacugcaacuggauccaccacuaacccaucauccaccccaggcaccaccccuauaacccccguccugaccuccacagccaccacacccgcagccaccaguucaaaggccaccagcucauccagcccccgaacagccacgacuuugccaguucugacuaguaccgcgaccaagucuacagcaacaagcuucaccccaaucccuagcagcacacuuuggacgaccuggacuguucccgcacaaacuacuacccccaugagcacaaugucuaccauccacacaucaagcacuccugaaacaacccauacuucaacuguccugaccacuacagcaacuaugacaagagccaccaauagcaccgccaccccguccaguacucucggcacaacaagaauccuuacagaacugacuacgacagcuaccaccacugcagcgacgggcucaaccgccacacucuccucuacccccgguacuacuuggauccugacugagcccucaacgaucgcaaccgugauggugccaacaggcuccacggcuaccgcauccagcacccucgggacagcucauacgcccaaagucgugaccacaauggcaaccaugccaaccgcaaccgcuuccacagugccuagcucauccacugucggaacuacuaggaccccagcaguuuuaccaucuucccuuccuacauuuuccgucuccacuguuucauccucuguguugacuacacuccguccuaccggauuucccuccucacauuucucaaccccaugcuucugccgcgccuucggacaguuuuuuucuccaggcgaggucauuuauaacaaaaccgaccgggccgggugccacuucuaugcagucuguaaccagcacugcgacaucgaucgauuccagggagcaugcccaaccucuccaccuccugucagcuccgccccuuuaagcaguccuagcccagcccccggcugcgacaaugcaaucccccuuagacaggugaacgaaaccuggacacuugaaaacuguacaguggcccgcugcgucggugacaacagaguaguccuguuggacccaaagccagucgcuaacgucaccugugucaacaaacaccugccaauuaaagucagugauccaucucaaccuugugacuuucacuaugaaugcgaguguauauguucaauguggggcggaucucauuacuccaccuuugacgggaccuccuacaccuucaggggaaauuguacuuauguguugaugagagagauacacgcacguuuuggcaaccuguccuuguauuuagauaaccauuacugcacagccuccgcaaccgcagcugccgcccgaugcccgagagcacuguccauucauuacaagucuauggacaucguacuuaccguuaccauggugcauggcaaggaggaggggcuaaucuuguucgaucaaaucccaguguccucaggauuuuccaagaacggcguccuggugucaguguugggcacuacuacaaugagagucgauaucccugcacucggcguuucggugaccuuuaauggucaaguguuucaggcgaggcuccccuacucauuauuccauaacaacacagagggccagugcgguaccuguaccaacaaucagcgagaugauugucuucagagagacggaacaaccgcagcaaguuguaaagauauggccaagaccuggcuugugccagacagcagaaaggacggcuguugggccccaacuggcacucccccuacugccuccccggccgccccggugagcucuacccccaccccuaccccaugucccccccagccguugugugaccuaaugcugucucagguuuuugcugaaugucacaaccuuguuccacccggcccuuucuuuaaugccuguaucuccgaccauugccgaggucggcucgaagucccuugccagucccucgaagcuuaugcugagcugugccgggcuaggggcguguguagcgacuggcgaggagcuaccggcggacuuugcgacuugaccugccccccuacaaagguauacaagccauguggccccauccaacccgccacuugcaacucgcggaaucaguccccacaacuugagggcauggccgaaggcuguuuuuguccugaggaccagaucuuguucaaugcgcauaugggaauuugcgugcaggcaugucccuguguugguccugauggauuuccuaaauuuccaggugaacgcugggucucuaauugucaauccuguguuugugacgagggcagugucuccguccaguguaaaccacuacccugugaugcgcaaggccagcccccucccuguaaccguccuggauuugugacagugacuaggcccagagcugaaaacccuugcugccccgagacgguuugcguguguaauaccacaaccugcccccagucccucccaguaugucccccuggccaggagucuauuuguacccaggaagaaggugauugcugcccaacauuuagaugcagaccucaacucuguagcuacaacgguacuuuuuacggagugggggcaacuuucccaggugccuuaccuugccauauguguaccugucucagcggagauacucaagaccccacuguccagugccaggaggaugccuguaauaauacuaccuguccccagggguucgaguacaagcgcguugccggccaguguuguggugaaugcguccaaacagcaugucugacuccggacgggcagccaguucaacuuaaugaaacgugggucaacucacauguugacaauugcaccguguaccuuugugaagcugaggggggcguacacuugcuaacuccacaaccugcuuccuguccugacgugagcagcugcagagggucuuugagaaaaacuggaugcugcuacuccugcgaagaagauucuugccagguacguaucaacaccaccauccuauggcaccagggaugugagaccgaaguuaauauuacauuuugugagggaaguugcccaggcgcaucgaaauauuccgcugaggcucaggcuaugcagcaucagugcaccuguugccaggaacgcagagugcacgaagaaacagugccacuacauugccccaaugguuccgccauucuucacacauacacccaugucgaugagugcgguuguacaccuuuuuguguccccgccccuauggcccccccucacacacgcggcuucccagcucaggaggcuaccgccguuuag

SEQ ID NO: 248960 - RNA, 1611 nt, Artificial Sequence
  Description of Artificial Sequence: Synthetic coding sequence
guuuuuugcugcaacuacggccacugcccaccaagacccccugccuuacggcccugcccucccccccuucgggggcgcccaggaucaaccgagcuuacaacuacugcgacuacuacugcauccacuggaagcaccgccacacccucuucuacuccugguacagcgccuccccccaaaguccugacuucccccgcuaccaccccgaccgccaccucuucuaaagccacaucuuccucaagucccagaaccgccaccacccugcccguauugacuucgacugcgacgaagagcaccgccacuagugugacccccaucccuaguucuacacuggggaccaccggaacccucccugaacagaccacuaccccugucgccaccaugucaaccauccauccaagcuccacuccagagacgacucauaccucaaccguccucaccacgaaagcuacuaccacacgcgccacauccucaacgagcacaccuucuucgacucccggcacuacauggauccucacugaacugacuacggccgccacaacgacagccgcaacaggcccuacagccacccccuccucaacaccuggaacuacauggauucucacagaauugacaacuaccgcuacuacgacugcauccacaggcagcaccgcgacgccuagcaguacuccugguacaacauggauacuuacagaaccuaguacaacagcaacgguaacugucccaaccggcagcaccgcaacugccaguuccacacaggcuaccgcaggcacgccucacgucucuacuaccgccacuaccccgacagugaccagcaguaaagccacaccguccuccucuccaggaaccgccacagcauugcccgcacucagaagcaccgccaccacccacucauaccagcuuuacucccacccacuauuacugccuacuaccuggacucgccucucucagaccacgacuccuaccgccaccaugucaacugcaacgccaucuuccacucccgagacagugcacaccaguaccguccucacugcuaccgccacaaccaccggacccgcgcuuuggcccccuccaccuccuccacaggaacagcucaccuugccaaaaugccggcucccccaaccuagacacucucaucccuuacugcagccccgcgaugguacacacgcuucguccguugaccaacacaaccaccauacccauaaccaccauacccacaaucagugguuacacggcgauccguugcugcacccaggcgaccauccccacagacagagcgccgaccaucaccaccacaacuguaccgguucaauggccaccccguccuccucaacucagacaucuggaaccccuccuagcuugacuacuacugcaacgaccauuacagcuacaggcucuacuacaaaucccuccucuacuccaggcacaaccccuauuacccccguucuuacauccaccgcuacaacgccugcugccacuucuuccaaagcuaccuccucauccucaccuaggacugccacgacucucccaguauugacuucgaccgcgacuaagagcacagccacauccuuuacuccuauuccuuccccuugcggacccagaggcccaucauag

SEQ ID NO: 248961 - RNA, 561 nt, Artificial Sequence
  Description of Artificial Sequence: Synthetic coding sequence
aguucuacccccggcacuaccuggauuuugaccgaaccuaguaccacagcuacugucacagugccaaccggaucaacagcuacugcaagcucuacccaggcuacagcaggcacuccacacgucucaaccacagccacaacaccuacaguaacuucuucaaaagccacccccuucucuucuccagggacagccacagcacugccagcccugagaagcacugcaacuacaccaacagcaaccucuuuuaccgccaucccuaguagcugggcucccccaggcccugcauaccacaggccgccccaucccaggccaccuuguccucagccccaccccccuccacugcagcgccuaaguacaccaccccaaugucugcccccaagaccuccacggggccaccgccugugcggacauccacuguugcauccucggaacucaucccacuaccagucagcagacuaccauaaucacuucacagcgaccccaucuuccaguccuggcacagcacguacccucccugucuggaucagcaccaccacaacccccacaacccgcgguuccuag

SEQ ID NO: 248962 - RNA, 960 nt, Artificial Sequence
  Description of Artificial Sequence: Synthetic coding sequence
accaaggccaccacaacaagagcaacaagcucuaugucuacgcccaguucuacaccuggaacuacauggauccugacagaauugacgacagccgccacgacaaccgccgcaacaccucacggccaucccguccugcaucccagagaccaucucgacccccauagagcccaacauuacacagugaccguccccacaggaucaaccgccaccgcuucgagcacacgcgcuacagcaggaacccucaaagucuugacuagccaucacacacacagccaccaacuucagucccacuccuugcugcagagccgggauuguaacagacccucaucgaccgagaagcauucucaucacacucauuccuaccaacgauacagccacccccuuuuccuuccaaccgccuggacuaggcuuagccagacaacuacccccacagcaaccaugucaaccgccaccccuuccagcacacccgagaccguacacacgucaaccgucuuaacuacaaccacuaccaccacucgugccacucucuggccuccucccccaccaccacaagaacagcugacgcuccccaagugccggcugccgcaaccccgucauucucacccucuccuccagccuagagacggaacccacgcaucuuccguagaccagcauaaucaccauacucacaaucagcggcuccacggagacccccuacuccaccccacaacacacacagcuacgguacugacuacuacuacuaccaccccccucgugcuuuggcagcauccuccccucgcccauagaccuguugugcccccuucacugacaacgaccgccaccaccauuaccgccaccggaucuaccacaaaccccuccaguacaccugguacuacuccgauaccacccguccugacaacaacugcccauacuugcucucaucaacagcacagcgacucucuucuaugcccucgugacuag

SEQ ID NO: 248963 - RNA, 2007 nt, Artificial Sequence
  Description of Artificial Sequence: Synthetic coding sequence
augagggaaauucacgcccgcuucggcaaucucucccucuaucucgacaaccauuauuguaccgcuucugcuaccgccgccgcagccagauguccuagagcucuuucuauucauuauaaaaguauggauauuguguugacagugacgauggugcaugggaaggaggaggggcugauucuguucgaucaaaucccaguuucuagcggauucuccaagaaugguguguuggucaguguucuaggcacaacaacuaugcgaguagauauccccgcccugggugucucugugacuuuuaacggacaaguguuucaagcccgauugccauacucgcuguuccacaacaacacggaaggccaaugcgguacuugcacuaacaaucagagggacgacuguuuacaaagagaugggaccaccgcugccucguguaaagauauggcuaagacuuggcuggugccggauucacggaaagacgggugcugggccccgaccggaacaccaccuacugccucccccgccgcuccugucagcaguacuccuacuccaaccccaugcccaccucaacccuugugugaccucaugcugagucagguguucgccgaaugccacaaucuugucccacccggacccuucuucaacgcuuguaucuccgaccauugccgaggacgccuugagguccccugucaaucccuggaagcguacgcugagcucuguagagcucggggaguguguuccgacuggagaggcgcuacaggcggccuaugugaccucaccugcccaccaacaaaaguauacaagccauguggaccaauucagccugcaacuugcaauucaaggaaucagucgccccagcuggaggguauggcugagggaugcuuuuguccagaagaucaaauucuguucaaugcacacaugggcaucugugugcaggccuguccuugugugggcccugauggcuucccaaaguuuccaggagaacgcuggguauccaauugucaaucaugcgugugugaugaaggaucaguguccgugcaguguaagccccuaccaugcgaugcccaaggccagccuccccccuguaacagacccggauucgugaccguuacccgccccagagcagaaaauccuugcugcccagagaccgugugcguuugcaacacuacuacauguccucagucucugcccgugugccccccgggucaggaaagcauuugcacacaggaagagggggauugcuguccuacuuuccggugucgcccgcagcucugcaguuauaacggaacauuuuauggaguuggcgcaacauucccuggugcacuccccugccacaugugcaccugccugucuggcgauacccaagaucccacuguccagugccaagaggacgcuugcaauaacacaacuuguccccagggauucgaauauaaacggguggccggacagugcugcggagaauguguccagacugccugccugaccccugauggccaaccuguucaacuuaacgagacuuggguuaauagccauguggacaacuguacuguauacuugugugaagcagagggaggcgugcaccuucugaccccucaacccgccucuuguccugauguuucuucauguagagguucacuucgcaagacuggguguugcuauagcugcgaggaagauagcugucagguccggaucaacaccaccauuuuauggcaucagggaugugaaaccgaggucaauaucacguuuugcgaaggcucuuguccuggagccuccaaauauagcgccgaggcccaagcaaugcagcaucagugcaccuguugccaagagagaagaguccacgaggagaccgucccacuucauugccccaaugguucagccauccuccauacuuauacacauguugacgaaugugggugcaccccuuuuuguguuccugccccuaugucuccccccgccugcguguggcaccccgcccuacgcgccccagcagcucaccucggacucgccccccccuag

SEQ ID NO: 248964 - RNA, 441 nt, Artificial Sequence
  Description of Artificial Sequence: Synthetic coding sequence
augacuaugcgcucacugcuacgcacccccuuucuguguggucuacuuugggcuuuuugugcuccaggagcccgugcugaggagcccgccgcauccuuuucccagccaggaucuaugggcuuagacaagaacacagugcaugaucaggaacacauuauggagcacuuagagggggucauuaacaaaccugaagccgaaaugucaccucaagaauuacagcuccauuauuucaagaugcacgacuacgaugggaauaaucugcuggacggauuagaguugaguacugcaaucacccacguucauaaagaggagggaucggaacaggcgccuuuaaugagugaagacgaacugauuaauauuauugacggaguccucagagaugaugauaagaauaacgacggguacauagauuacgcugaguucgcgaaaagcuuacaguag

SEQ ID NO: 248965 - RNA, 441 nt, Artificial Sequence
  Description of Artificial Sequence: Synthetic coding sequence
augaccaugcgaucucuccuccgaacacccuuccuaugcgggcuuuugugggccuucugcgcgccaggugcacgugcagaagagccagcggccucguuuagucaaccuggaucaaugggccuggacaaaaauacugugcacgaucaggaacacauaauggaacaccucgagggcgucaucaacaagccugaagccgagaugucaccacaagaacuucagcugcacuacuucaaaaugcacgacuacgacggcaacaaccuguuagacggucuggaacugucaacagccaucacacacguucacaaagaggaaggaagugaacaagccccacuuaugucagaagacgagcuuaucaauaucauugacggcgugcugagggacgaugacaagaacaacgauggauacauagauuacgcagaguuugcaaaaagcuugcaguag

SEQ ID NO: 248966 - RNA, 285 nt, Artificial Sequence; identical to SEQ ID NO: 248360
  Description of Artificial Sequence: Synthetic coding sequence

SEQ ID NO: 248967 - RNA, 441 nt, Artificial Sequence
  Description of Artificial Sequence: Synthetic coding sequence
augacuaugaggaguuuacugcguacuccauuucuaugcggacuucuaugggcuuucugcgcgcccggugcucgagccgaagagcccgcggcauccuucagccaaccugggagcauggggcuugauaaaaauacaguucaugaccaggaacacauuauggaacaucuagagggcgugauuaauaaaccugaagccgaaaugagcccccaggaauuacagcuacacuauuucaagaugcaugauuacgacggcaauaaccucuuggauggacuggagcuauccacggcaaucacacacguccauaaagaagagggaagcgagcaggcaccacucaugagcgaggacgagcugaucaacaucauagacggaguacuuagggaugacgacaaaaauaaugacggcuauaucgacuacgcggaauucgccaaaucguuacaguag

SEQ ID NO: 248968 - RNA, 441 nt, Artificial Sequence
  Description of Artificial Sequence: Synthetic coding sequence
augacgaugagaaguuugcuuagaacacccuucuuauguggacugcuuugggcuuucugcgcccccggcgcucgcgcugaagaaccugcagcuaguuucucccaacccggcucaaugggccuugacaaaaacacugugcacgaucaggagcauauuauggaacaucuggagggcguaaucaacaaaccugaagcggagaugucaccacaagaacuucaguuacauuacuuuaagaugcacgauuaugacgguaacaaccuguuggaugggcucgaacucucaacagccaucacacacgugcacaaagaggagggauccgaacaagccccacugaugucugaggaugaguugauuaacauuauugacggcguauuaagggacgacgacaaaaacaacgacggguacauagacuaugcagaauuugccaaaagucuacaguag

SEQ ID NO: 248969 - RNA, 285 nt, Artificial Sequence; identical to SEQ ID NO: 248363
  Description of Artificial Sequence: Synthetic coding sequence

SEQ ID NO: 248970 - RNA, 285 nt, Artificial Sequence; identical to SEQ ID NO: 248364
  Description of Artificial Sequence: Synthetic coding sequence

SEQ ID NO: 248971 - RNA, 441 nt, Artificial Sequence
  Description of Artificial Sequence: Synthetic coding sequence
augacgaugaggucucugcuucgcacacccuuccuuuguggcuuacucugggccuucugugcaccaggagcacgcgcugaggagccugcugccagcuuuucacaacccgggaguauggggcucgauaaaaacacaguccacgaccaagaacacauuauggagcaccuugagggcguaaucaacaaaccugaggcugaaaugaguccucaagaacugcagcuucauuauuuuaagaugcaugacuaugacggcaauaaccuucucgauggccucgaacugucuacugcaaucacccacguucacaaagaagaagguucugaacaggcaccauuaauguccgaggaugagcuaauaaauauuaucgacggcguucugagggaugacgacaagaauaacgacggguacaucgauuacgcugaguuugcaaaauccuuacaauag

SEQ ID NO: 248972 - RNA, 441 nt, Artificial Sequence
  Description of Artificial Sequence: Synthetic coding sequence
augacaaugagauccuugcuaaggacacccuuccucugcgguuugcuuugggccuuuugugcuccaggcgcccgggccgaagaaccugccgcaaguuucucucagcccggcucuaugggacuagacaaaaauacuguucaugaucaggaacacaucauggaacauuuggagggcgugauaaauaaaccggaagcugaaauguccccccaggagcuccaguuacacuacuuuaagaugcacgauuacgauggaaauaaucugcuugaugggcucgaauuauccacagcaaucacccacgugcacaaggaagagggaucagaacaggcaccucuuaugagcgaagacgagcuaaucaacauuauugauggaguguuacgagacgaugauaaaaauaacgacggcuacauagauuacgcggaguuugccaaaucacuccaguag

SEQ ID NO: 248973 - RNA, 186 nt, Artificial Sequence; identical to SEQ ID NO: 248367
  Description of Artificial Sequence: Synthetic coding sequence

SEQ ID NO: 248974 - RNA, 384 nt, Artificial Sequence
  Description of Artificial Sequence: Synthetic coding sequence
augcuaucugugugcucuugcaggacauccuccggaaugagaucccaguggccuagcgcacgacagcggagcucuagucuuaguacuuuuaggcacauaauggaacaccucgagggagugauuaacaaaccugaagcugagauguccccccaggagcugcagcuacauuacuucaaaaugcaugacuaugacggcaacaaccucuuggacggccuugaacugaguaccgccauuacccacgugcauaaggaagaaggaagcgaacaagccccccugaugagcgaagacgaauugaucaacaucaucgauggaguguugagggaugaugauaaaaacaacgaugguuauauagauuaugccgaauuugccaaaucccugcaguag

SEQ ID NO: 248975 - RNA, 1515 nt, Artificial Sequence
  Description of Artificial Sequence: Synthetic coding sequence
augcgguucuucugcgcacgcuguuguuccuuuggccccgagaugcccgcuguacaacuccuucuccucgcuugucucguaugggauguuggagccaggacggcacaauugagaaaagccaacgaccagagugggcgaugucaauauaccuucaguguggcaagcccaaaugaguccucuugcccugagcagucacaggccaugagcgugauccacaaccugcagcgagauucgucuacacagcgucucgaccuggaagccacaaaggcccgccugucuucucuugaaucucugcuccaucagcuaacacuggaucaggcugcuagaccccaggaaacucaggaggggcuacagagagagcuuggcacguugcgcagagaaagggaccagcuagagacccagaccagagagcuggaaaccgcauacuccaauuugcugcgugauaagagugugcuggaggaggaaaagaaacgauuaaggcaagaaaacgaaaacuuagcccgucggcucgagagcagcagccaagaaguugcaagacuuagaagaggucaaugcccacagacacgcgauacugccagagcagugccaccaggcagucgcgaagugagcacauggaaccuugacacacuagcguuucaggaacucaaaagcgagcugaccgaagucccggcaucuagaauccugaaggagucaccaagcggcuaccucaggaguggugagggggauaccggaugcggagaacuggucugggugggagaaccacuaacacugaggaccgcagagacuaucacuggcaaguacggaguguggaugagggacccaaagccgaccuaccccuacacacaggaaacuacauggcgaaucgacacagugggaaccgauguacggcagguauuugaauaugaucucaucucacaguuuaugcaggguuauccuucuaaaguccacauuuugccucggccuuuggaaaguacuggcgccgugguauacuccggaagucuuuauuuucagggggcagaauccagaacagucauucguuacgagcugaacacugagacaguuaaggcggagaaggagauuccaggcgcagguuaucacggacaauuuccuuacaguugggguggcuacacugauauugacuuagcggucgacgaagcgggucuuugggugauuuauagcaccgaugaagcaaagggugcuauaguuuuaucaaaacuuaaucccgagaaucuggaacuggaacaaacgugggaaacaaacaucagaaagcagucuguggccaaugcauucauaaucugcggaaccuuguacacaguuagcuccuacaccagcgcagaugcaacugugaauuucgcauacgacacuggcaccggaauuucuaagacgcugaccauccccuuuaaaaauagauacaaguacucuucaaugaucgacuauaauccauuagagaagaagcuuuucgccugggauaaucucaacaugguuacuuacgauaucaagcuuucuaagauguag

SEQ ID NO: 248976 - RNA, 1107 nt, Artificial Sequence
  Description of Artificial Sequence: Synthetic coding sequence
auggggcggaaaaaaauucaaauuucacgaauccuggaucaacgcaaccgccagguaaccuuuacuaaaagaaaauuuggacugaugaaaaaagccuaugaacucagcgucuugugugauugugaaaucgcccugaucauuuuuaacagcgccaaucgccuauuccaauacgcgagcaccgauauggaccgcgugcugcuuaaauacaccgaauacuccgaaccccaugagaguagaaccaauaccgauauucuugaaacucugaaacgaagaggcaucggguuagacggccccgagcuggaaccugaugagggacccgaagagcccggcgaaaaauucaggcgccuagccggggaagggggugauccagcguuacccagaccuagacuguaccccgcagccccugccaugccaucgccggacguaguguacggcgcucuuccaccaccuggcugcgacccuucuggacuuggggaggcacuaccagcucaaucucggccuagcccguuuagacccgcagccccuaaagccggccccccuggccuaguacacccccuguucagcccaagccaucugacgaguaagacaccaccaccccucuaucuuccaacagaaggcaggagauccgaucuuccuggcgguuuggcugguccuaggggcggacugaacacaagucgaucacuguacaguggacuccaaaauccgugcuccacugccacgcccggcccaccuuugggcucauuucccuucuuaccaggcggcccucccgaguauggauugggcgacccuccaccaccacccggucuguugcaaccuccuacccuugcucccuggcaaccaagcagaggagaugguccaccagccgugaguucucaacccagugggggacgaucgcugggcgaagagggccccccgaccagaggggcaucccccccgacuccaccaguuuccauuaaaagcgaaagacugucaccagcccccggagggccaggugacuucccaaaaacuuucccuuauccuuuguugcucgcacgcaguuuagcugagccccugcgcccaggucccgcucugagacggcuacccuuagcagauggcuggccaagauag

SEQ ID NO: 248977 - RNA, 3477 nt, Artificial Sequence
  Description of Artificial Sequence: Synthetic coding sequence
auggcagccgucaggggagcgccucuccucaguugcuuauuggcauugcucgcccuguguccgggagggaggccucagaccgugcugacagaugaugagaucgaggaguuuuuggagggcuuucuuucagagcuugagcccgaaccaagagaggaugauguggaagcccccccgccccccgaacccacgccccgagucaggaaggcccaggccggugggaaaccaggcaagcgaccagggacagcagcagaaguccccccugaaaagacuaaagauaaggguaaaaaaggaaagaaagacaaaggacccaaggugccuaaagaaagccuggaagguucuccacggccacccaaaaaggggaaagagaaaccgccuaaagccacaaagaaaccaaaggaaaagccaccaaaggccaccaagaaacccaaagaaaagccacccaaagccacuaagaaaccaaaagaaaagccuccgaaagcuaccaagaagcccccauccgguaagcggcccccgauacuggcccccagcgaaacccucgaauggccacucccaccucccccgagccccggcccagaggaguuaccucaagaaggaggggccccucuaaguaauaacuggcagaaccccggggaggaaacacacgucgaagcgagggagcaccagccugaaccagaagaagagaccgagcagccuacacuugacuacaacgaccagaucgagcgcgaagauuacgaggacuuugaauacauccggagacaaaagcaaccuagaccgcccccgagccggagacgcagacccgagcgaguauggccagagccaccugaggagaaggcucccgccccugcacccgaagaacgcauugagccgcccgugaaaccucugcugccaccauugccucccgacuacggagauggcuacgucauaccuaacuaugaugauauggauuacuacuuuggaccccccccaccccagaaaccagaugcugagcgacaaacugaugaggagaaggaagaacuaaagaaacccaaaaaggaagauaguagcccaaaggaagagacugauaaaugggcuguggaaaaggggaaggaccacaaggagccacggaaaggugaggaacucgaggaggaauggacacccacagagaaggucaaauguccgccuaucgguauggaaagucauagaauugaagauaaucaaauuagggcuuccuccaugcucagacauggacuuggcgcucaacgcggacgacuaaauaugcagacaggggcuacagaggacgauuauuacgauggcgcuuggugugcagaagacgaugcacggacucaguggauugaggucgacacaagaaggacuacaagauucacaggagugauuacucaggguagggacucuucuauucacgaugauuuuguuaccacauuuuuugucggauucagcaaugauucucagaccugggugauguauacaaacggcuaugaagagaugacguuucacgggaacguggacaaagauacaccugugcuaagcgaauugcccgagcccgucguggcaagauuuauuagaaucuacccacugaccuggaaugguaguuuauguaugcgucucgaaguccuaggauguuccgucgccccuguauauucauauuaugcccagaacgaggugguagccacugaugaucuugauuuccggcaccacagcuacaaggauaugcggcaguuaaugaaggucguaaacgaagaauguccuacaaucacucgcaccuacucucugggaaaaaguucacggggacucaaaaucuaugcuauggagauuagugauaacccaggagaacaugaguuaggugagccugaguucagguacacugcaggaauucacggaaaugaagugcugggacgcgaacuguugcugcugcuuaugcaauaccugugcagagaauaccgagacgguaauccaaggguccggucgcugguacaggauaccagaauccaccuuguuccuaguuugaacccugauggcuaugaaguugcugcccaaaugggcucagaauuuggaaauugggcccugggccuuuggacugaggagggauucgacaucuuugaagauuuccccgacuugaauuccgugcuguggggagccgaggagagaaagugggugccauauagggugccaaauaauaaucugcccauuccugagagauaucuuucuccugacgccaccgugucaacagagguacgagcuauuauugcauggauggaaaaaaaccccuuuguccuuggagcgaaucugaaugguggcgaacgacuugucaguuaucccuaugauauggcccgcaccccgacacaggaacaguugcucgcagcagccauggcggccgcucggggcgaagaugaggacgaggugagcgaggcccaggaaacacccgaucacgcgauauuuagauggcuggcgauuagcuucgcguccgcacaccugacccugacagagcccuaccgcggcgggugccaagcucaagauuauacugguggaauggggauugugaauggcgccaaguggaauccccgcacgggaacaauuaacgauuuuucauaccuucauaccaacugccucgaacugagcuucuaucuugguugugauaaguuuccgcacgaaucugaacugcccagggaaugggaaaacaauaaagaggcccuacugaccuucauggagcagguacacagagguauuaaaggcguuguuacugaugagcaggggauccccauugcaaaugccacuauuagcguauccggcauuaaccacggcgucaaaacugcuuccgggggugacuacuggagaauacucaauccuggggaauaccgagugacugcgcacgccgaaggcuacaccccuagugccaaaacuugcaacguugauuacgauaucggggcuacacagugcaauuucauuuuggcgagauccaacuggaagagaauccgcgagaucauggcuaugaauggcaaucgaccuaucccucacaucgacccaagcaggccuaugaccccucagcaaagaagguuacaacagaggcgcuuacagcauagauugcgucuucgggcucagaugcgcuuaaggcgauuaaacgccacuacuacauugggcccccauacuguccccccuacucuaccgccggcccccgccaccacccuuucaacuaccaucgagccuuggggccucaucccacccacaaccgccggaugggaggagucugaaacagaaacauacacagaaguagugaccgaguuuggcacugagguugaaccagaguuuggaacaaaggucgagccagaauuugaaacccagcuggaacccgaauucgaaacccagcuagagccagaauuugaggaagaagaagaggaggagaaggaggaggagauugcuaccggacaagccuuuccguuuacaaccguagagaccuacacaguuaauuuuggcgauuuuuag

SEQ ID NO: 248978 - RNA, 471 nt, Artificial Sequence
  Description of Artificial Sequence: Synthetic coding sequence
auggcuucccgaguguugagugcuuacgucagccgccugcccgccgccuuugcuccauugccaagaguaaggaugcuggcuguagcccgaccauuaaguaccgcuuugugcucagcaggaacucagacacgccuugggacucuccagcccgccuugguguuggcccaaguaccaggcagggucacacaacuaugucgacaguauuccgauaugcccccacugacacucgagggaauccaggaccgggugcuguauguccuuaaauuauacgauaaaaucgauccagagaagcuuuccgugaacagucacuucaugaaggaccugggacuagacucauuggaccaaguagaaauaauuauggcaauggaagacgaauucggguucgagauuccugacaucgacgccgagaaacugauguguccucaagagauuguggauuacauagcugacaaaaaggacguuuacgaguag

SEQ ID NO: 248979 - RNA, 1707 nt, Artificial Sequence
  Description of Artificial Sequence: Synthetic coding sequence
augaugggauguuggaucuuaaaugaaggacuguccaccauccucgucuuguccuggcuagguauuaacuucuaucuuuucauugacacuuuuuacugguacgaagaggaagaauccuuucacuacacccgcguuaucuugggcaguacauuggcuugggcucgagccucagcacuuugucucaauuuuaauugcaugcugauccuuaucccugugagucgcaaccuuauuuccuucaucagaggcacguccauuuguugccgugggccuuggagacgccagcuugauaagaaccugagauuccauaaacugguggccuauggcaucgcaguuaacgcaaccauucacauugucgcccacuuuuucaauuuagaacgcuaccauuggucccaaagcgaggaggcacaaggucuucuugccgcacugucaaaguuggguaauacaccaaacgaauccuaucucaauccugugaggacauuucccaccaauacuacuaccgaacugcugcggacaauugccggagugacuggccuagugaucucuuuagcccucgugcucauuaugacgucgucgacggaauucauccgacaagcuucguacgaacucuucugguacacccaucaugucuucauuguuuuuuucuuaagucuggcuauacacgggacaggaaggauuguccgggggcaaacucaggauucucucagccuccauaacauuacauuuuguagagauagguacgcugaauggcaaaccgucgcccaaugucccguuccccaauucagcgggaaagaaccuuccgccuggaaauggauuuuggggccuguaguauuguaugcaugcgagagaauuauccgcuuuuggagauuucaacaggagguggucauaacaaaggucguaagucacccguccggaguccuugagcuacauaugaagaaaagggguuuuaaaauggcaccuggucaguauauauuagugcagugcccugcuauaucuagucucgaauggcauccuuuuacccugacuucugcuccucaggaagauuuuuuuucaguccauauaagagcugccggcgauuggaccgcugcccuccuggaggccuuuggcgcggaaggacaggcacuccaagaaccuuggagccucccucgccuggccguugacggcccauuuggaaccgcgcucaccgauguuuuucauuaccccguuugcguguguguggccgcuggaaucggagucacccccuucgcagccuugcucaaaaguaucugguacaagugcucggaggcccagaccccccucaaacuaucaaaagucuacuuuuauuggaucugccgcgacgccagagcguucgaaugguucgcagaccugcuacugagccucgagacuaggaugagcgaacaagguaagacccauuuucucucuuaccacaucuuucugacaggaugggacgaaaaccaagcacuccauauugcucugcauugggacgaaaauacugaugucauuaccggacugaagcaaaagacauucuauggccggccgaacuggaauaacgaguuuaagcagauugcauauaaccacccaucaucauccauuggcguauucuuuugcggaccaaaagcccugucgcguaccuugcagaagaugugccaccuuuacuccuccgccgaucccaggggaguucauuuuuacuacaauaaagaaucuuuuuag

SEQ ID NO: 248980 - RNA, 2520 nt, Artificial Sequence
  Description of Artificial Sequence: Synthetic coding sequence
augaguauucggcggcugcucauucugauccugaaaauuggacgacgguggaccgagcuuaucaggacaauggaaucuagagugcuacugcgaacuuuuugucucauauucgguuuaggugcaguuuggggucuaggcguggaucccuccuuacagauagacguccucacugaacuagagcugggagaaaguaccaccggcguacgacaggugccagggcugcacaacggcacaaaagccuuccuguuccaggacaccccccgaagcaucaaggccucuacagcuacggccgaacaguuuuuccagaaguuaagaaauaagcacgaauucacuauuuuggucacacuuaagcaaacacaccucaacucgggagucauccuuucaauucaucaccuggaccauagguaccuggaguuagaauccucuggucaccgcaacgaggugcggcugcacuauagaagcggcagucaccgcccccacaccgaaguuuuuccauacauacuggcagacgauaaauggcauaaacuaucccucgcuaucuccgcaucccaccugauucuucauauagacugcaauaagaucuacgagcgcgucguggagaagcccucuaccgaucucccacucggaacuacauuuugguuaggacagagaaacaacgcccauggcuauuuuaagggaauuaugcaggauguacaacuuuuagucaugccccaaggguucauugcucaaugccccgaucucaaccgaaccuguccgacaugcaaugacuuccaugggcucgugcagaaaauuauggaacugcaggauauacuggccaaaaccuccgcaaaacuaagccgggcugaacagaggaugaauagauuagaucaguguuauugcgaacguacaugcacuaugaaggggacaaccuaucgagaauucgagagcuggauagacgguuguaaaaacugcacuugucucaauggaaccauccaaugugaaaccuugaucugcccuaacccugauugcccucucaaaagcgcguuggccuauguggauggaaaauguugcaaagagugcaagagcaucugccaauuucaaggaagaacuuacuucgaaggugaacggaauacugucuacucaaguucuggugucuguguauuguacgaguguaaggaucagaccaugaagcucgucgagaguucuggcugcccggcccuagauuguccugaaagccaccagauuacgcugucccauuccugcuguaaagucuguaaaggauaugacuucugcuccgaacgccacaauuguauggaaaacucaauuugccggaacuuaaaugaccgugcuguauguuccugcagggacggcuuccgcgcucugagagaagacaaugccuauugugaagauaucgacgaaugugcggagggaagacauuauugucgggagaacacuauguguguaaauacccccggcagcuuuauguguaucuguaaaaccggcuauauaagaaucgaugacuauagcugcacugagcacgacgagugcaucacaaaucaacacaauugcgaugagaaugccuuauguuucaacaccgucggaggucacaauugcguguguaaaccuggauacacaggaaaugguacuacuugcaaggcauuuuguaaagaugguugccgcaacggaggggcuuguauagcagccaacguaugcgccuguccccaagguuuuaccgguccaucaugugagacugauaucgaugaguguuccgacggcuucguucagugcgauagccgcgcaaauuguaucaaucuuccagggugguaccacugugagugucgggacggcuaccacgauaacggaauguuuagcccaaguggggagaguugcgaggauauugaugagugcgggacuggccgccauucaugcgccaacgauaccaucugcuuuaaucuggaugggggcuacgauugcagguguccacacggcaagaacugcacaggagacugcauucacgacgguaaagugaagcauaauggccaaauuugggucuuggagaaugaucgaugcucaguuuguuccugccaaaauggauucgucauguguagacguaugguuugcgauugugaaaauccaacgguggaucuguuuugcugccccgaaugugaucccagacuguccucucaaugcuugcaccagaauggggagaccuuguauaacagcggugacacauggguccagaauugccaacagugcagaugccuucagggggaaguagauuguuggccuuuacccugccccgaugucgaaugcgaauucucgauucugccagagaaugaauguugcccacgauguguuacagauccgugucaggcugacacgauccgcaacgauaucacuaaaacauguuuagaugagaugaauguuguccgguuuacgggaaguaguuggauuaagcaugguacggaauguacacuuugccaguguaaaaacggacauauuugcugcagugucgauccacagugucuucaggagcuguag

SEQ ID NO: 248981 - RNA, 2448 nt, Artificial Sequence
  Description of Artificial Sequence: Synthetic coding sequence
auggaaaccggccucggugcccccuuguucaaagcuuggcuacugauuaguguuuggggccucggcguggacccgucucuccagauugacguacugacagaacucgaacugggugaaucgacuacaggagucagacagguuccuggauugcauaaugggaccaaggccuuucucuuucaggauacaccacgcucuaucaaagcuuccacggcaaccgcggaacaauuuuuucaaaaauuaagaaacaagcaugaauuuacuauuuuggucacccugaagcagacccacuugaacucugggguaauacuuucaauacaucaccuugaccaccgcuaccuggagcucgaaucuuccggacacagaaacgaggucagacuccacuacagaucugguucccaccggccccacacagaagucuuccccuauauacuggcugaugacaaguggcauaaguugagucuagccaucucggccucacacuugaucuugcauaucgacugcaacaaaauauacgagagaguugucgagaagccauccaccgaucuuccauugggcacaacauucugguugggucagcgcaacaaugcacacggauacuucaagggaauaaugcaggauguccagcugcugguuaugccucaggguuuuauugcgcaguguccagaucucaacaggacaugcccaacgugcaacgauuuucauggauugguccaaaaaauaauggaacuccaggacauccuggcaaaaacgagcgcuaaacugucaagagcagaacaaaggaugaaccgguuagaccaguguuacugcgaaaggacuugcacaaugaagggaaccacauauagagaauuugaaucuuggaucgauggaugcaaaaacugcacaugccugaacggcacuauccagugcgagacucuaauuugcccaaaucccgacugcccauuaaaauccgcccucgcuuaugucgauggcaaauguugcaaggaauguaagaguaucugucaguuccaaggacggacguacuucgaaggggaaagaaacaccguuuacaguucuuccggggucuguguccuguacgaguguaaagaccaaaccaugaaauuaguugaauccagugguugccccgcuuuggacugcccggagucucaccagaucacucuaagccauucguguuguaagguauguaagggguaugauuuuugcuccgaacgccacaauuguauggagaacagcauuuguaggaaccuuaaugauagagcgguauguucaugucgggacgguuuccgggcacucagagaggacaaugcauacugugaggacaucgaugaaugcgcugaaggacggcacuacugcagggaaaauacaaugugcgugaauaccccaggaucguuuaugugcauuuguaagacuggcuacauuaggaucgacgacuauaguuguacugagcaugaugaaugcauaaccaaucaacacaacugcgaugaaaaugcucuuugcuuuaauacaguuggugggcacaauuguguguguaagccggguuacaccggcaauggaacuacauguaaagcauuuuguaaagacggaugccgaaauggcggggccugcauagcugcuaaugugugcgcuugcccacagggcuucaccggcccaaguugcgaaaccgauaucgaugaguguucagacggguucgugcaaugugauucucgggccaauuguaucaaucugccaggaugguaucacugugaguguagggauggcuaccacgauaacggaauguucaguccuucaggagagucuugugaggauauagacgagugcggaacuggccgucauagcugugcuaaugauacaaucugcuuuaauuuagacggcggauaugauugucgcugcccccauggaaagaauuguacuggcgacuguauccacgauggcaaagugaaacacaacggacagauaugggucuuagagaacgaccgcugcucaguguguuccugucagaacggauucguaaugugccgcagaauggugugugacugugaaaacccaaccguggaccuguuuugcugucccgagugcgaucccagacuguccucccaaugccugcaccaaaacggcgagacacuguacaacucuggagauacauggguucaaaauugccagcagugcagaugcuuacagggugaaguggauugcuggccccugccuugccccgauguggaaugugaauuuucaauucugccugaaaaugagugcuguccccguuguguuacagauccgugucaagcugacaccaucaggaacgacaucaccaaaacaugucucgacgaaaugaacguggucagguuuaccgguaguucguggauaaaacacggaacagaaugcacccucugucaguguaaaaauggccacauauguugcuccguagacccccaaugccuccaagaacuguag

SEQ ID NO: 248982 - RNA, 2451 nt, Artificial Sequence
  Description of Artificial Sequence: Synthetic coding sequence
auggaaucuaggguccuacuucgcaccuuuugcuuaauuuucggccugggagccguguggggacugggaguggauccaucacuacaaaucgacguguugacugaacuugaacucggugaauccaccacuggcguuaggcaggucccuggacugcauaacgguaccaaagccuuccuuuuucaggauacaccgcgcucaaucaaagcuucgaccgccacagcagagcaguuuuuccagaagcuccggaauaagcacgaauucacuauuuuagucacccuuaagcagacccaccucaacucagggguuauacugucaauucaucacuuggaucacagauaucuggaacucgagucaagcggacaccggaacgaggucaggcugcacuaucgaagcggaagccaccguccccauacagaagucuucccuuauauacuggcagaugacaaauggcauaaacuuagucuugcaauuucagcuucccaccucauccuucauaucgacugcaauaagaucuacgagagagucguggagaaacccucgacggacuugccccucggcacaaccuucuggcugggacagcgcaacaacgcacacggauacuucaaggggaucaugcaggauguccagcugcuggucaugccucagggcuucauugcgcagugcccggaucucaaucguacuugucccaccugcaacgacuuucauggacugguccagaagaucauggagcugcaagacauacucgccaaaacgucagccaaacuguccagagccgaacagagaaugaauagacuagaccaauguuacugugagcgaaccugcacaaugaaagguacaacguaucgagaauucgaaucuuggauagauggaugcaaaaacugcacaugccugaacggaaccauucaaugugaaacuuugaucugcccaaacccugauugcccucuaaaguccgcccuugcauacguugacgggaagugcuguaaggaaugcaaaaguauuugccaauuucaaggccgaacauacuucgagggcgagcgaaacacuguauacucaucaagcgggguguguguccuauacgaauguaaggaucagacgaugaaacucguggaaagcucugggugcccggcacuugauuguccagaaagucaccaaaucacacugucccauucuuguugcaaaguuuguaagggauaugacuuuuguucagaacgccauaauugcauggagaauucgauauguaggaaucuuaaugaucgagcgguuuguucaugucgggacggguuuagagcccuuagagaggauaacgcguacugugaggauauugaugagugcgcugaaggccggcacuauugcagagaaaacacaaugugcgucaacacccccggaagcuucaugugcauuugcaaaacaggguauauuaggaucgaugacuacaguuguacugagcacgacgaaugcaucacaaaccagcacaacugugacgaaaaugcccuaugcuuuaauaccguuggaggccauaacugcgugugcaaaccagguuacacagguaacggcaccaccugcaaagcuuuuugcaaagaugguuguaggaacggaggcgcauguauagccgcuaacgucugcgccugcccacagggcuucacugggccaagcugcgaaaccgauaucgacgagugcucagacggauuuguccagugugauaguagggcuaauugcauuaaucucccuggaugguaccacugcgaaugucgagauggcuaccaugacaauggcauguucucuccuucaggugaguccugcgaagacauagacgagugcgggacuggacggcauagcugcgcuaaugacacaaucugcuucaaucuggacggagguuacgacugucgguguccgcacggaaagaacugcacaggugauuguauucaugacgggaagguuaaacauaauggacaaaucuggguacuggagaaugaccgaugcagcguguguagcugucaaaacgguuucgugauguguaggagaaugguuugugauugugagaacccaacgguugacuuauuuugcugucccgagugugacccucgccuuucaucacaauguuugcaccagaauggagagacucuguacaauaguggagacaccuggguucagaauugucaacaaugcaggugcuuacagggagaaguggauugcuggccucugcccugccccgaugucgagugcgaguucagcaucuugccagagaacgaguguugcccccgguguguaacagacccgugccaagcagacaccauucgcaacgauauuacgaaaacaugucuggaugagaugaacgucguucgcuuuaccggaagcagcuggaucaagcauggaacugaguguacauugugucaguguaagaacggucacauaugcugcucagucgacccucaguguuugcaggaauuauag

SEQ ID NO: 248983 - RNA, 2601 nt, Artificial Sequence
  Description of Artificial Sequence: Synthetic coding sequence
augggguucccuccgcuuuugaaaggccaggcauccgcuaccaggucaagucuugccuccuguaguuggguagucuuuuuccugucuugucuuaguagacaugcgccugaaauugaaggugggcggcgauggacagagcugauucggacuauggagucucgcguauugcugaggaccuuuugucuaauuuucggacugggugcuguguggggguugggaguggacccuucacugcagauugacgugcucaccgaguuagaguuaggagagagcacuacaggaguccgccaggucccaggccuccacaauggcacaaaagcauuccuauuucaggauaccccacgcagcaucaaggcuucuaccgccaccgcugagcaguucuuucagaaauuacgcaauaaacacgaauucacaauccucgugacccugaagcaaacacaccuaaacuccggcguuauucugucuauccaccaucucgaccaccgcuauuuagaguuggagucuuccggacaccggaaugaggugcgcuugcauuauagaagcggcucucauagaccccauacugagguauuuccauauauccuugcagacgauaaguggcacaagcuuucacuugcuaucucagcuucgcaucuuauucugcauaucgacuguaacaagauauaugagcgggucguggaaaagccuucaacagaucucccacucggaacuacauuuuggcuuggacagcguaauaaugcucacggcuauuuuaaagggauuaugcaggauguucagcucuuaguaaugccucagggguuuauugcacagugucccgaucuuaaccgaacuugucccacaugcaacgauuuucacggacugguccagaagauuauggagcugcaggauauccuggcgaaaaccagugcuaagcucagcagagcggaacagaggaugaauagauuggaucaaugcuauugugaacggacuugcaccaugaaggguaccacauaucgcgaauuugaaucuuggaucgauggauguaaaaauugcacauguuuaaacgggacuauccagugcgagacacuaauuugcccuaauccugacugcccucugaagucugcccucgcuuauguggaugggaaauguugcaaagaauguaaauccauaugucaauuccagggucgaacguauuuugagggagagaggaauacugucuacucuagcucuggaguaugcgugcuguacgaauguaaggaccagacaaugaaacuuguagaaucuucaggcugcccagcacuggacugcccugaaucccaccagaucacucucucgcacagcuguuguaaaguguguaaaggcuacgacuucuguuccgaacgacauaauuguauggagaacuccauuugcaggaaucuuaaugacagagccguguguaguugucgcgacggcuuuagagcacuucgagaggacaaugcauauugcgaagacauagacgagugugccgagggcaggcacuacugucgggaaaacaccaugugcguaaauacgccuggaagcuuuauguguauauguaagaccgguuacauuagaaucgacgauuauuccugcacggagcacgaugaauguaucaccaaucaacauaacugugacgaaaacgcacucuguuucaauacggugggaggccacaacugcgucugcaagccuggauacacugguaacggaacgacaugcaaagccuuuuguaaagacggaugucggaacgggggcgccuguauugccgccaaugugugcgcuuguccacagggcuucacuggcccuagcugugaaacugauauugaugaguguagcgaugguuucguacagugugacucaagggccaauugcaucaauuuaccggguugguaucauugugaguguagagacggauaccacgacaacgguauguuuagcccuuccggggaaaguugcgaagacauugaugaguguggcacaggcagacacagcugugccaacgacacuaucuguuucaaccuggacggagguuacgacuguagauguccccauggcaagaauugcacgggagauugcauucaugacggaaagguaaaacauaacggucagauuuggguguuggaaaacgacagauguuccguguguagcugccagaacggcuucgugaugugccggagaauggugugugacugcgagaaucccaccguagaccuguuuugcugcccugaaugcgauccuagacuguccagucaaugucuucaccaaaacggcgagacccucuauaacucgggcgacaccuggguucagaacugucaacaaugucgcugccuucagggggaaguagacugcuggcccuuacccugucccgacguggagugugaguuuaguauccucccugaaaacgaauguuguccuagauguguaaccgauccgugccaggcagauaccauucguaaugauauuaccaaaacuugcuuggaugagaugaacguggugagauuuacuggauccaguuggauaaaacacggaacagaauguacacugugucaauguaaaaauggacauaucugcuguucagucgacccccagugucuccaagaacuguag

SEQ ID NO: 248984 - RNA, 2451 nt, Artificial Sequence
  Description of Artificial Sequence: Synthetic coding sequence
auggaaucccggguacuccugcgcacuuucugccuaauuuuuggacugggugcaguguggggccugggaguagauccaagccugcaaaucgaugucuuaaccgaguuagaacuuggagaaagcacuaccggaguuaggcaaguaccuggucuccauaacgggaccaaagcauuucucuuucaagacacuccccgaucaaucaaggccaguacagccacagcugaacaauucuuccagaaacucagaaacaagcacgaauuuacuauccugguaacgcugaagcagacgcaccugaacucagguguaauacuauccauucaccaccuggaucaucgauaucuggaacuggagaguaguggacaucguaacgaggugcgguugcacuaccgaagcggaucucacagaccucacacugaaguauuucccuauaucuuggcugacgauaaauggcacaagcugagccuagcaauuucugcaucccacuugauuuuacauauugacugcaacaaaaucuacgaaagagugguugagaagcccuccaccgauuugccucuggguacaacauucugguuggggcaacgcaauaaugcccauggauacuuuaaaggcaucaugcaagacguacagcuccuuguuaugccccaggguuuuauagcacaguguccggaucugaaccgcaccuguccaacuugcaacgacuuccacggccugguucagaagauuauggaauuacaagauauucuggccaaaacgucagcuaagcuuagcagagccgagcaaagaaugaauagauuagaccaauguuauugcgaaagaaccugcacaaugaaggggaccacuuaucgugaguucgaaucauggauugaugguugcaagaauugcaccugucuuaauggaacuauccagugcgaaacccuuaucugccccaacccagacugcccauuaaaaucugcgcuggccuacgucgauggaaaguguuguaaagaaugcaaaagcauaugccaguuccagggccgcacauacuuugaaggcgaacgcaauacaguguacuccucuaguggcguuugugugcuguacgaauguaaggaucagaccaugaagcuugucgaaucuuccggcuguccugcgcuggauugccccgaaucucaucagaucaccuuaagccauaguuguugcaaaguuugcaagggcuacgacuuuuguagugaacggcacaauuguauggaaaauagcaucugccggaaccucaacgauagagccgugugcaguuguagagaugguuucagagcauuaagggaggacaaugcuuacugugaggacauagaugaaugugcagaaggacgucacuacuguagagagaacaccaugugcgugaacacuccaggaucuuuuauguguauauguaagaccggauacauucgaaucgacgacuacucauguaccgagcacgacgaauguaucaccaaucaacauaauugcgaugagaacgcucuuugcuucaauacuguuggagggcauaauugugucugcaaacccgguuacacuggaaacggaaccaccugcaaagcauucuguaaggauggcugccguaacgggggugccugcaucgccgccaacgucugugcaugcccacaaggauuuaccggaccuuccugcgagaccgauaucgaugagugcuccgauggauuugugcaaugcgauucuagggcaaacugcauuaaucugcccggaugguaccauugugaguguagagauggauaccacgacaaugggauguucagccccagcggugaaaguugugaggauauugacgagugcggaacaggaagacacagcugcgcaaacgauacgauuugcuuuaauuuggaugguggguaugacugucgguguccucacggcaaaaauugcaccggcgauugcauccaugacggaaagguuaagcacaauggccagauuugggucuuggagaacgacagauguucaguuugcagcugucagaacggauucgugauguguagacgaauggugugcgacugugaaaacccgacuguugacuuguucuguugccccgagugcgauccacgacugaguucccagugucugcaccagaacggggagaccuuauauaauucuggcgauaccugggugcagaauugucagcaaugccgaugucuucagggugaagucgacugcuggccacuuccuuguccagauguggagugcgaauuuucaauacugcccgagaacgaauguuguccucgcugcgugacagaccccugccaggcugacaccauccgcaacgauauuaccaaaacgugccuggaugaaaugaaugucgugcgguucaccgggagcucauggauuaagcauggcacugaauguacacuaugucaauguaaaaauggccauauuuguugcucagucgauccucaaugccuccaagaacuuuag

SEQ ID NO: 248985 - RNA, 1734 nt, Artificial Sequence
  Description of Artificial Sequence: Synthetic coding sequence
auggaaaccggacugggcgccccccuguucaaagcaugguuacucaucucuguauggggacucggaguugacccuuccuugcagaucgacgugcucacugagcuggaacuuggagaguccacaaccgggguaagacaaguuccuggucugcacaauggcacgaaggccuuucucuuccaagauaccccccgaucaaucaaagcaucaacggcuaccgccgagcaauuuuuucagaaacugcgcaacaagcacgaauuuacuauacugguaaccuugaaacaaacacaccugaauagcgguguuauuuuauccauccaccaucuggaccacagauaccucgaacuggaguccucuggacaucggaacgaagugcgccugcauuauagaagcggcucucaccgaccucacaccgaaguauuuccauauaucuuagcugacgacaaauggcauaaacugagccuggccaucucugcaucccauuugauuuugcauaucgauuguaauaaaaucuacgagcgaguggucgaaaaacccuccaccgaccuaccccuuggcacaacguucuggcuuggccagcggaacaaugcucacggauacuucaagggaauuaugcaagacguucagcugcuggugaugccgcagggauuuauugcucagugccccgaccugaaucggacgugccccacuuguaaugacuuucauggccugguccaaaaaaucauggagcugcaggacauacuggcuaagaccucugccaaacugucucgugccgaacaacggaugaaccgccuugaucagugcuauugugagcggacauguaccaugaagggcacuacauacagagaauucgagagcuggauugauggcuguaaaaauuguaccuguuuaaauggaacuauccaaugugaaaccuugauauguccuaacccugauuguccgcucaaauccgcucuggcguacgucgaugggaagugcuguaaggaauguaagucaaucugccaguuccagggaagaaccuauuucgaaggcgagaggaacacuguauacucauccucgggcgugugcgugcucuaugaaugcaaagaucaaacuaugaaacugguugaaaguagcgggugcccagcccuggacuguccugagagccaccaaaucacucugucccauucguguuguaagguguguaaaggauaugauuucuguuccgagagacauaauuguauggagaacuccauaugcaggaaccugaacgacagagccgucugcuccugcagagauggguuuagggcuuugagagaagauaacgcuuacugcgaagauaucgaugaaugcgcagagggacgccacuacuguagagaaaacacaaugugcguaaacaccccaggcaguuucauguguaucugcaaaacuggcuauauucggaucgaugacuauucuuguaccgaacaugaugaaugcaucacuaaucaacacaacugcgaugagaacgcgcugugcuuuaacacagucgguggccauaauugcguuuguaaaccaggguauacugggaauggcacaacauguaaggcauucuguaaggacggaugccgaaaugguggugcuuguauugcggccaaugugugcgcaugcccucaaggauucacaggacccaguugcgaaacugacaucgacgaauguucagacggauucgugcagugugauagucgcgcaaacuguauuugccuugugccacucuag

SEQ ID NO: 248986 - RNA, 333 nt, Artificial Sequence
  Description of Artificial Sequence: Synthetic coding sequence
auggagaccggauuaggcgcuccguuguuuaaagcuuggcuacucauaucaguguggggcuugggagucgauccgucgcugcaaaucgaugugcugacagagcuagagcugggcgagaguacuaccggcguucgucaaguuccaggacuccauaacggcacaaaagcguuccuguuucaagauaccccucgcucuaucaaagcaucuacugccacugcugaacaguucuuccagaagcucagaaauaaacacgaguuuacaauccuugucacccugaaacaaacacaucuuaacagcggaguaauccuguccauucaccaccuugaccauuag

SEQ ID NO: 248987 - RNA, 2448 nt, Artificial Sequence
  Description of Artificial Sequence: Synthetic coding sequence
auggaaacuggucucggugcuccccuguuuaaagccugguuguugaucuccguauggggccucggcguugauccaucuuuacagauugacguacucaccgagcuggaacugggugaauccacaacaggggugcgucaggugccuggucuucauaaugggacuaaggcuuuucuguuccaggauaccccaaggucuaucaaagcuagcacggcaacugcugaacaguucuuucaaaaacugcgaaacaaacaugaauuuacuauccuagucacucucaagcaaacacaccucaacucuggggucauccugaguauucaucaccuugaucaccgcuaccuggaacuggaauccucuggccaccggaacgaggugcgauugcacuaccggagcggaucgcacagaccacauacugaaguguuucccuacauccuggcggacgauaaauggcacaagcuuucucuggcuaucagcgcuucccacuuaauccugcacaucgauuguaacaaaauuuacgagagaguuguugaaaagccuuccacagaccuaccacuggguacaaccuucuggcuuggucaacgcaacaaugcccacggauauuucaaaggcaucaugcaagauguccagcuucucgucaugccgcagggcuucauugcucaauguccagaccuaaacagaacauguccuacuuguaacgauuuucauggguugguccagaagaucauggagcugcaagacaucuuagccaagacaagcgcuaaacucucccgugccgagcagaggaugaacagauuggaccaauguuauugcgaacgaacuuguaccaugaaagguaccacauaucgggaauuugagucuuggaucgauggcuguaaaaacuguacaugcuugaaugggacaauccagugcgagacccugauaugcccaaacccagacugcccucucaagagcgcucuugcauacguggacgguaaguguugcaaggaauguaagucuaucugucaguuccaggguaggacguacuucgaaggggagagaaauaccguuuauaguuccuccggagugugcguccuguaugaguguaaagaccaaacuaugaagcuagucgagucuuccggauguccagcuuuggacugcccugagucacaucaaauaacucuuucucauucuuguuguaaaguuuguaaaggcuaugauuucugcuccgagaggcacaacugcauggagaauucuauuugcagaaaccuuaacgauagggccguuugcucauguagagauggauucagggccuuaagagaggauaacgccuacugugaagauauugacgaaugcgcugaaggcaggcacuauugcagagagaacacaaugugcgugaauacucccggaucuuuuaugugcaucugcaaaacuggauauauaagaaucgacgauuacucgugcaccgaacacgacgagugcauuaccaaccaacacaacugcgacgagaacgcgcuuuguuuuaacaccgucggcggccauaauuguguuuguaaaccaggcuacaccgggaauggaaccaccugcaaagcauuuuguaaggacggaugccggaacgggggugccugcauagcugcuaauguaugcgccuguccucagggguucacggggccuaguugcgagacggauaucgacgaauguucagauggauuuguccaaugugauagccgagcuaauuguauuaacuugcccgggugguaccacugcgaauguagggacgguuaccacgauaacgggauguucagccccuccggcgaauccugcgaagauaucgacgagugcggaaccggccggcauucaugugccaaugauacaaucugcuuuaaucuggacggaggcuacgacuguagguguccacacggaaagaauugcacaggcgacuguauacaugauggaaaagugaagcacaauggacagauuuggguacuggaaaacgaccgcuguucugugugcuccugucagaauggguuugugauguguagaagaauggucugcgacugcgagaaucccacagucgaucuguucugcuguccagagugugacccuagacucucuucucaaugccugcaccaaaacggagaaacacuauacaacagcggggacacuuggguucaaaauugucaacagugccguugcuuacagggugagguugacugcuggccuuugccauguccugacguggagugcgaguucuccauccugccagagaaugaauguuguccuagaugcgugacugacccuugccaggccgacacaauccgaaacgauauaaccaaaacgugccuggacgaaaugaacgugguucgguuuacaggcucaaguuggauuaaacacggaacggaauguacuuuaugccaaugcaaaaauggucauauauguuguuccguagauccacaaugccuucaagaacucuag

SEQ ID NO: 248988 - RNA, 69 nt, Artificial Sequence; identical to SEQ ID NO: 248382
  Description of Artificial Sequence: Synthetic coding sequence

SEQ ID NO: 248989 - RNA, 966 nt, Artificial Sequence
  Description of Artificial Sequence: Synthetic coding sequence
auggaaucucgcguacugcuacggacuuuuuguuugauuuucggucugggcgcuguaugggggcuuggcguggauccuucauuacaaaucgaugugcuaacggagcuggaguugggcgaaucuacaacuggaguuaggcaaguuccuggucugcacaauggaacgaaggccuuucucuuccaagacacaccacggagcauuaaagcauccaccgcaacugccgagcaguucuuucaaaagcugcgaaacaagcacgaauucacuauucuugucacccugaagcagacacaccucaauucagggguuauucucuccauucaccaucuggaccauagauaccuggaacucgagagcagcgggcauagaaacgaaguccgcuuacauuauagaucagggagccaccgaccccacacagagguauucccauacauccuggcugacgauaaauggcauaaguugucccuggcuauaucagcaagucaucuuauccuucauaucgauugcaauaagaucuacgaacgcgugguagaaaagcccaguacagaucuuccccugggaaccacuuucugguuaggccaaagaaacaacgcacacggauauuuuaaaggaaucaugcaggauguucagcugcuggugaugccacaagguuucaucgcccagugucccgaccuuaaucggacuuguccuacauguaaugauuuucauggucugguucaaaaaauuauggaguugcaagauauccucgcuaaaaccuccgccaaacucucuagagcugagcaacgaaugaaucgacuggaucaaugcuacugugaacggacgugcaccaugaaaggaacaacuuaucgggaguuugagucguggaucgauggcuguaagaauuguaccugccugaacggaacaauucagugugaaacccuuaucugcccuaaccccgacuguccucucaaaucugcucucgccuacuag

SEQ ID NO: 248990 - RNA, 246 nt, Artificial Sequence; identical to SEQ ID NO: 248384
  Description of Artificial Sequence: Synthetic coding sequence

SEQ ID NO: 248991 - RNA, 513 nt, Artificial Sequence
  Description of Artificial Sequence: Synthetic coding sequence
augauggcagggaugaaaauucaacuggugugcaugcuauuacuggcuuucucaucuuggagucucuguagcgauucagaagaggaaaugaaggcguuagaggccgauuuccugaccaacaugcauacaucuaagauuuccaaagcccauguccccagcuggaagaugacccuccuuaacgucugcucucuggucaauaaucucaauucaccagcugaagaaacuggcgagguccaugaagaggaacuggucgcaagacgaaaauugcccaccgccuuggacggauucagccucgaggcuaugcucacaauuuaucaacugcauaagaucugucacucacgagcauuccaacauugggagcugauucaggaagacauuuuagacaccggcaaugacaagaacgggaaggaggagguaauuaagagaaaaauuccauacauacuaaagagacaguuauaugaaaacaaaccaaggaggccauacauuuuaaagagagacuccuauuauuauuag

SEQ ID NO: 248992 - RNA, 348 nt, Artificial Sequence
  Description of Artificial Sequence: Synthetic coding sequence
augacgcuguuaaaugugugcucucuggugaacaaucugaauagcccggcugaagaaacaggugaaguacacgaggaggagcugguggcacggcgaaagcuuccaacugcucucgauggcuuuucccucgaggcuaugcugacuaucuaucaacuacauaaaauaugccacucaagagcguuccagcacugggaacugauucaagaggauauccuggauacuggcaacgauaagaauggaaaggaagaggugauuaaacggaaaauacccuacaucuuaaaaagacaacuguacgagaacaagcccagacgccccuauauacugaaaagagacucauacuacuacuag

SEQ ID NO: 248993 - RNA, 288 nt, Artificial Sequence; identical to SEQ ID NO: 248387
  Description of Artificial Sequence: Synthetic coding sequence

SEQ ID NO: 248994 - RNA, 774 nt, Artificial Sequence
  Description of Artificial Sequence: Synthetic coding sequence
auguccauucucuuuuaugucaucuuucuggccuacuuacgcggcauccaagggaacaauauggaccagagaucauugccagaggacucucucaauucacuuauaauuaaguugauccaggccgacauucugaaaaacaaacugagcaaacagaugguagaugugaaggaaaauuaucagaguacacuccccaaggccgaggcacccagggagccugaaagggguggcccugcuaaaagcgccuuccaaccugugaucgccauggacaccgaacuucugcgccaacagagacgauacaauucaccaaggguccuccugucagauaguacaccauuagaaccgcccccccuauauuugauggaagacuacgucgggucuccaguuguagcuaauaggacguccagacggaagagauaugcagagcacaagagccaucggggugaguacuccgugugugauucugaauccuuguggguuacagacaaaaguucagccauugacauuaggggacaccaggugaccgugcucggagaaauuaaaaccggcaacaguccagugaagcaguauuuuuaugaaacacgcuguaaagaagcuaggcccguuaagaauggcuguaggggaaucgaugauaaacacuggaacucucaauguaagacaucacagacauacguaagagccuuaaccagcgaaaauaacaaacuuguaggcuggcgguggaucagaauagacaccuccugcgugugugcacuuuccaggaagaucgggaggacuuag

SEQ ID NO: 248995 - RNA, 813 nt, Artificial Sequence
  Description of Artificial Sequence: Synthetic coding sequence
auggucacuuuugccacuauacugcaggucaauaaaguuaugagcauccuguuuuauguaauauuccuagccuaucuccgggggauucaagguaacaacauggaccagcgcagccugcccgaagauagccugaauagccugauaauuaagcuaauccaggcagauauccugaagaauaagcucuccaaacagauggucgaugucaaagagaacuaccagaguacccugccaaaggccgaagccccaagagaacccgaacgcggcggacccgcaaagucugcuuuccaaccuguaauugccauggauacagagcuccuuaggcagcagagaagauacaacucuccaaggguucuacucuccgacucuaccccacuugagccaccgccacuguaucuuauggaagauuauguggguucucccguuguggcuaaccgaacaucaaggcgaaagagauaugcagagcacaaaagucaccguggagaauacagcgugugcgacuccgaaucucucugggugacugacaaaucuucugcuaucgacauuagaggccaccagguaaccgucuugggcgagauaaagacggguaauucuccagugaagcaguauuuuuaugagaccagaugcaaagaggcacgcccugucaagaauggaugccgaggaaucgacgauaaacauuggaauucccaaugcaaaacgagccaaaccuacgucagagcauuaacgucugagaacaacaaacucgucggauggcgcuggauuagaauugacaccucuugcgugugcgcgcugucccguaaaaucggaaggacuuag

SEQ ID NO: 248996 - RNA, 2754 nt, Artificial Sequence
  Description of Artificial Sequence: Synthetic coding sequence
auggcuuucauacgaaaaaagcagcaagagcagcaguugcaacuguacucuaaggaacguuuuucacuacugcuguugaaccuagaggaauacuacuucgagcagcacagggcaaaccacauccugcacaaaggaucacaccaugagaggaaaauccguggaucacucaagaucuguagcaagucagugauuuuugaacccgauagcauuucucaaccuaucauuaaaaucccauuacgcgacugcauuaagaucgguaaacacggugagaauggcgcaaacagacacuucaccaaggcaaagucgggggggauuagcuuaauuuuuucacaaguauauuucauuaaagaacauaacgucguggcuccauacaagauugaacgagggaagauggaauauguguucgaguuggacgugccugggaagguugaagacgugguggaaacccuacuucagcugcaucgcgcgucuugcuuagauaaacucggggaccagacagcuaugauuacagccauuuuacagucuagacuugcuagaacuuccuucgauaaaaauagauuccagaacauuucagaaaaacugcacauggaaugcaaagcggaaauggugacaccucucgucacaaaccccggacauguaugcauaacagauacaaaucucuauuuccagccucuuaauggguacccuaaaccaguaguccagaucacgcugcaggacguacguagaaucuacaagaggaggcauggccugaugccccuuggccuggaaguguuuuguaccgaagacgaccuguguagcgacauauaccucaaauucuaugaaccacaggacagagacgaccuguacuuuuauauagcuacuuaucuggagcaucacguugcagaacauaccgcagagagcuacaugcuccaauggcaacgagggcaucuuucuaauuaucaguacuuguugcaucucaacaaucucgcagaccgguccuguaacgaucucucacaguaucccguguuuccuuggaucauccaugacuacucuucauccgaguuagacuugagcaauccuggcaccuuccgggaccuuucuaagccggucggugcucucaauaaggaacgacucgaacgcuuguugacccgcuaccaggaaaugccagagccaaaauuuauguacggaucacauuacaguagcccaggguacgugcuguuuuaccucgugcgcaucgcaccugaguacaugcucugucuucagaacgggagguucgauaacgcagaccgcauguucaacagcauugccgagacuuggaagaauugccuugauggcgcaaccgacuucaaagaacugauaccugaauucuauggugacgauguaucuuuucugguuaacuccuuaaaacucgaucugggaaaacggcaggguggccagaugguugaugacguugagcuccccccaugggcuuccucgccagaagacuuucugcaaaaaaguaaggaugcauuggaaucaaacuauguauccgagcaccugcaugaguggauugaccuaaucuucggauauaagcagaagggaucagaugccgucggcgcucacaaugucuuccauccucucaccuaugaaggcggcguagaucugaacucaauucaggauccugacgagaaaguggcaaugcucacccaaauauuagaauuuggacagacaccuaagcagcucuuugugacaccacacccccgucguaucacuccaaaguuuaagucuuuaucucagacuaguucauauaacgcaaguauggccgacagccccggagaagagucauucgaggaucuaacugaagaaucuaaaacacuggcauggaauaauauaacuaaacugcagcuccacgagcauuauaagauacacaaagaagcugugacagguaucacgguauccaggaaugggucaaguguguuuaccaccucccaggacuccaccuuaaaaauguuuucuaaagaaagcaagaugcugcaacgcucuaucucuuuuucuaacauggcacuuaguucaugccucuugcucccaggagaugcaacugucauuaccucuucaugggauaacaacgucuauuucuauucuaucgccuuuggaagacgacaggacaccuugaugggacacgaugacgccgucucuaagauauguuggcaugauaaucgccuguacagcgccaguugggacuccacugugaagguguggucuggagugccugccgagaugccaggcacaaagcggcaucacuucgaucugcucgcugagcuggaacaugaugugucuguugacacuauuucgcucaacgcugcuucaacacuuuugguuuccggcaccaaggaagggacagucaacauuugggauuugacaacugcuacacugaugcaucaaauuccuugccacucaggcauugugugcgacacagccuuuuccccugacucacgccacgugcuuucuaccggcacugacggcugucuaaaugugauugacgugcagacugguaugcugauuaguaguaugacaagugaugagccacagagaugcuucgugugggacggcaauagcguccugucugggucucagagcggggaacugcuggucugggaucuucucggagccaagauaagugaaagaauccaaggccauaccggggcaguuaccuguauuuggaugaaugaacaguguucuuccauuauuacgggaggagaagaucggcaaauuaucuuuuggaaauugcaguacuag

SEQ ID NO: 248997 - RNA, 1188 nt, Artificial Sequence
  Description of Artificial Sequence: Synthetic coding sequence
auggugucagccgcaggccugucaggugaugggaagaugcgaggcguccuguuagucuuacuuggauugcuguauucguccacaagcuguggcgugcaaaaggcaaguguuuucuauggucccgauccuaaggaaggucucguuucuagcauggaguuccccuggguugugucauuacaggauagucaguauacacaucuggcguucggaugcauucugucugaguucuggguacugagcaucgcaucagccauacagaaccgcaaagacauuguagucauuguggggauuaguaacauggauccaucgaaaaucgcacauaccgaauauccugugaacaccaucauaauccacgaagacuucgauaauaauagcauguccaacaauauugcacuucucaaaaccgauaccgccaugcacuucggcaaccucguucagucuaucuguuuucugggacgcaugcuccacacaccaccuguccuccagaacugcugggucagcggcuggaauccaacaucugcaaccggaaaccacaugacuauguccgugcucagaaaaauuuucgugaaagaucucgacauguguccacuauacaaacuccaaaaaacagaaugcggcucucacaccaaagaagaaacaaaaaccgcuugucugggcgacccggggagcccaaugaugugccagcugcaacaauuugaccuguggguuuugagaggagugcucaacuuuggaggcgagaccugcccaggccuguuuuuauauacaaaaguggaagacuauaguaaguggauaacuucuaaagccgagcgcgccggaccuccacuguccucacugcaccacugggaaaagcuaauaucuuuuucucaccauggccccaacgcaacuaugacacagaaaacuuacucggacagcgaauugggacacgugggcucuuaccugcaggggcagagacgcacaaucacacauagccggcuuggaaauagcaguagggacagucuugacgucagggagaaggacgugaaagagucuggaaggagucccgaagccuccguucaaccucucuauuacgauuacuacggcggugaggugggagaaggacgcaucuucgcagggcagaacagauuauaucaaccggaggaaaucauccucgugagcuucgugcuuguguuuuuuuguucuucuauuuag

SEQ ID NO: 248998 - RNA, 2085 nt, Artificial Sequence
  Description of Artificial Sequence: Synthetic coding sequence
augaaacaucugaagcggugguggucagccggugggggacuguuacaccugacccuucucuugagccuggcugggcugcgaguugacuuggauuuguaucuacugcucccuccccccacacuauuacaggaugagcugcuuuuucucgguggacccgcuagcuccgcauacgcccugucacccuuuuccgccucuggcggcuggggccgagcaggacaccuccaccccaagggcagagaacuggaccccgcggccccacccgaaggucaguuauuaagagaagucagagcccugggagucccauuugucccuagaacaucgguggaugcgugguugguacacagcguggcugccggaucugcugacgaggcgcauggucugcucggagcugcagccgccagcucaacaggaggcgccggggcuagcgucgacggcgggucucaagcaguccagggaggcggcggagacccaagagccgcaaggucuggaccacucgacgcaggugaagaagagaaagcaccugccgagccaaccgcccagguuccggacgccggaggaugugcaucggaagagaacggaguacugcgcgagaaacacgaggccguggaucauaguucucaacacgaagagaaugaagaaaggguaagugcucagaaggaaaauaguuuacagcagaacgaugacgacgagaauaaaaucgcagagaagccugacugggaagccgagaagacaacugaaagccgcaacgagcgccaucucaacggcaccgauaccucuuuuagccuugaagaucucuuucagcuccuuagcagccaacccgagaacucacuggaagguauaagccucggagauaucccccugcccggcuccaucucagaugguaugaacaguagugcccacuaccacgugaacuucucccaagccauuucacaagacgucaaccuacacgaagcuaucuugcugugcccgaauaacacuuucagacgggacccaacagccagaacgucccagucacaagaacccuuccugcagcuuaacucucauacgaccaacccagagcagacccugccaggcacuaaccuaaccggauuccugaguccugucgauaaucacaugagaaaccugaccucacaagaucugcuuuacgaucuggauauuaacaucuucgaugagauuaaucugauguccuuggccacagaagacaauuucgaucccauugaugucucccaacuguuugacgagccugacucugacuccggauuaagccuggacagcucacacaacaacacauccguaaucaagucuaauuccagccacucugugugcgaugagggcgcuaucggauauugcaccgaccaugaaucauccagccaccacgauuuagagggggcaguugggggguacuacccagagccuagcaaacuuugucaccuagaucagagcgacuccgauuuccacggcgaucugacauuccaacauguuuuucacaaucauacuuaucaucuccagccaacugcaccugaaagcacuucugaacccuuccccuggcccggcaaaucacagaagaucagaaguagguaucuggaagacacagaucgcaaucuuagcagagaugaacagcgagcuaaagcccuacacauuccguuuucuguagacgaaaucgugggaaugcccgucgacuccuucaacuccauguugucucgguacuaccugaccgaccugcaagugagcuugauccgcgacaucagacgacgcggaaaaaauaaaguagcugcucaaaauugcagaaagagaaagcuggacaucauucugaauuuggaggacgacgugugcaaucuucaggccaagaaagagacucucaaacgugagcaagcccaguguaauaaagccaucaauauaaugaaacaaaagcuucacgaccucuaucacgauauuuuuucacgcuuaagggacgaccagggacgacccgugaaccccaaccacuacgcauugcagugcacccaugacggauccauucuuauaguuccaaaggaacuuguagccuccggacauaagaaggagacucagaaagggaaacggaaguag

SEQ ID NO: 248999 - RNA, 1404 nt, Artificial Sequence
  Description of Artificial Sequence: Synthetic coding sequence
augccuggacgcuggagguggcagcgggacaugcacccugcccguaaguuacugucucuccuguuucuaaucuuaaugggcaccgaacucacccagguauuacccaccaacccugaggagucuuggcaagucuauaguagcgcucaagauucggaagggcgaugcauuuguaccgucguugcaccucagcaaaccaugugcucucgggaugcuagaacgaaacagcugcggcagcuccucgaaaaaguacagaacaugucacaauccaucgagguucuggauaggcgcacacagagggacuuacaguacgucgagaagauggagaaucagaugaagggccuggaaaguaaguuuaaacaagucgaggaaucucauaagcaacaccuugcacgccaguuuaaggcuauaaaagcuaagauggacgagcugagaccacugaucccuguguuggaggaguacaaagcugacgccaagcucgugcugcaguuuaaagaggaagugcagaaccugaccagcguccuuaacgaguugcaggaagaaaucggcgcuuacgacuacgaugagcuucagucgaggguguccaaucuagaagagagacuucgcgccugcaugcagaagcuggccugugggaaguugaccggaauaucugacccaguuaccguaaagacaucagggucucgguucggaaguuggaugacugacccccuagcacccgagggcgacaaccgcguaugguauauggauggauaucacaacaaucgguuugugcgagaauauaagagcauggucgacuuuaugaacacagauaacuuuacaagucacagacugccucauccauggagcgggaccggucaggugguuuacaacggcuccauuuauuuuaacaaguuccaaucccauauaaucauccgcuucgaucuaaaaaccgaaaccauccugaaaacucgaucccuggacuacgcaggcuauaauaauauguaccauuaugccuggggaggacacagugacauagaucucaugguugaugaaucuggacucugggccguguacgcaaccaaucagaaugccgggaacauagucgucucucgacuggaucccguguccuuacaaacccuucaaacguggaacacauccuacccaaaacgaucagcaggugaagccuucauuauaugugggacacucuacgugacaaacggcuacagugggggaacuaaaguucacuacgcauaccagacaaacgccaguacauacgaauacauugacaucccauuccagaauaaguacucccacauuagcaugcuugacuauaacccaaaggaccgcgcacuguacgcuuggaacaacggccaucagauccuguauaaugucacucuguuccacgucauuagauccgacgaacucuag

SEQ ID NO: 249000 - RNA, 408 nt, Artificial Sequence
  Description of Artificial Sequence: Synthetic coding sequence
augccaggcagauggagguggcagagagauaugcauccugcuaggaaguuacuuagccuauuguuucugauccugaugggaacugaacuuacccagguacugcccaccaaucccgaagaaucauggcaggucuacagcagcgcucaagauagcgaaggcagguguaucuguacagucguagcaccucaacaaaccauguguucucgagacgccaggacaaagcaauugcgacagcuguuagagaagguacagaacaugagccagucaaucgaaguacucgaccggcgaacccagcgggaucuacaguauguggagaagauggagaaccagaugaagggguuagagaguaaauucaagcaggucgaagagagucacaagcaacaccuggcgagacaguuuaaaggguag

SEQ ID NO: 249001 - RNA, 1458 nt, Artificial Sequence
  Description of Artificial Sequence: Synthetic coding sequence
auguccgugccuuugcugaagaucggcgugguccuaagcaccauggccaugauaacaaacuggaugucacagacacugcccucgcuggugggacugaacaccacuaaacugagcgcggcgggaggaggaaccuuggaucgaagcacagggguuuugcccacuaaccccgaagaaagcuggcaggucuauuccagcgcacaagauucugaaggaagauguauaugcacaguggucgcgccucagcaaacuauguguucacgggaugcuaggacaaagcaacugcgacagcuucucgaaaagguacagaacaugucucagaguauagaaguucuggaucguaggacgcaaagggaccuccaauacgucgagaagauggagaaccagaugaaaggacuggaaucuaaguucaagcagguggaagaaucucacaagcagcaccuagcuagacaguuuaaagcuauuaaagcuaagauggacgaguugcggccguugauuccagugcucgaagaguauaaagcugaugccaaacucguacuccaauuuaaagaagaaguucagaaccucaccuccguucuuaaugaacuucaggaagaaaucggcgcuuaugauuaugacgagcugcaaucccggguguccaaccucgaagaacgacugagggcuugcaugcaaaagcucgccugcggaaaauugacugguauaagcgaccccguuaccgugaagaccucaggaucccgauucgguaguuggaugaccgaccccuuagcaccggagggcgacaacagaguuugguacauggacggcuaccacaacaacagauucgugcgagaguacaaaagcaugguugacuuuaugaacaccgauaauuucacuagccauagguuaccccacccuuggagugguacgggccaagugguguacaauggcucaaucuacuucaacaaauuucagucucacauaaucauccgcuucgaccugaagacagaaaccaucuugaagacccgcagccuugacuaugccggcuacaacaauauguaucacuaugcauggggaggacacuccgacaucgaucugaugguggacgaaucugggcucugggcaguuuacgcaaccaaccaaaacgcugguaacauaguggucucaaggcuagacccagucucccugcagacacugcagacauggaauacaucauauccuaagagaagcgccggagaagcauucaucauuuguggaacucuguauguuacuaacgguuacucaggugggacuaagguacacuaugcauaucagacuaaugccucaacauaugaguauauugacauucccuuucagaauaaauacucacauauuucaaugcucgauuauaaccccaaagacagggcacuguaugccuggaauaauggccaccaaauuuuauacaauguuacacucuuucauguuauuaggucugacgaacuguag

SEQ ID NO: 249002 - RNA, 1377 nt, Artificial Sequence
  Description of Artificial Sequence: Synthetic coding sequence
augggggaggcacccggacgggaagguagaggaccaugcccccaacuggagagcccacgcagaaggcgcgugcugcccacaaacccugaggaaaguuggcaaguauauuccagugcacaggauucggagggccggugcauuuguacuguaguagccccacaacagaccauguguuccagagaugcccggacuaaacaacuuaggcaguuauuagagaaagugcagaauaugucucagucaauagagguacuggauagaagaacccaacgcgaccuacaauacguugaaaagauggagaaccagaugaaaggucuggaguccaaguuuaagcagguagaggaaucccauaaacagcauuuagccagacaguucaaggccaucaaagcaaaaauggacgaauugagaccccuuaucccagugcuggaagaguacaaagccgaugcaaaacucgugcugcaguuuaaggaagaaguccaaaaucuaacuucaguccuaaacgaacuccaggaagaaauuggugcuuacgauuaugaugaguugcagucacgcgucaguaaucuggaagaacgccugcgcgcuuguaugcagaaacucgcuugcggaaagcuaacaggcaucuccgauccagucacaguuaaaaccaguggaucgcguuuuggcagcuggaugacagacccacuggcuccugaaggcgauaauagagugugguauauggacggcuaccauaauaaucgcuucguacgggaauacaaauccauggucgauuucaugaauacagacaauuuuacaucgcaccgccugccacacccuuggagcgguacggggcaagucguauauaaugguuccaucuacuucaauaaguuucagucccauauaauaauucgauucgaccugaagacggaaacuauccugaaaacccggagccuugauuacgccggcuacaacaauauguaccacuacgccuggggcgggcacagcgauaucgaucucaugguggacgagucuggccuaugggcaguauacgccacuaaccaaaacgccggaaauauaguugugagcagacucgacccuguaucacugcagacauugcagaccuggaacacgaguuacccuaaaagguccgccggcgaggccuucauaauuugcggcacucuauaugucacuaaugguuacuccgguggcacaaaaguacacuacgcuuaccaaacaaaugcuaguaccuacgaauauaucgauauaccauuucagaacaaguacagucacauaaguaugcuggacuacaaccccaaggaucgagcccucuaugcauggaacaacggccaucagauucucuacaacguaacucuuuuucaugucauccgcuccgaugaguuauag

SEQ ID NO: 249003 - RNA, 462 nt, Artificial Sequence
  Description of Artificial Sequence: Synthetic coding sequence
auguccgucccccuauuaaagaucggagucguucugucgacaauggcuaugauuacuaacuggaugagucagacgcuaccgucacuagugggccugaauacuaccaagcuuuccgccgcaggcggggguacacuggauagaucaacaggcguccuccccaccaaccccgaagagucuuggcaagucuacuccucagcacaagauagcgaaggccgcuguauaugcacagugguggcaccccagcagacaaugugcucaagagacgcgaggacuaagcagcuaagacaacugcuugagaaggugcagaauaugagccaaaguauugagguguuagacagaagaacccagcgugaccuacaguacguugagaagauggagaaucagaugaagggccuggaauccaaguucaagcaaguugaagagucucauaagcagcauuuagcaagacaguucaagggauag

SEQ ID NO: 249004 - RNA, 696 nt, Artificial Sequence
  Description of Artificial Sequence: Synthetic coding sequence
auggcaucuauggcugcuauuggauccugcucaaaagaguaucguguacugcucggucagcuccagaaacagacggaucugaugcaagacacauccagacugcuugauccguacauuagaauccagggcuuagacgucccaaaacugcgggagcacuguagggagagacccggggcauuccccucugaggagaccuuacgaggcuugggacggaggggcuuuuuacagacuuugaaugcgacgcucggcuguguccuccacagacuggcggacuuggagcagagauuaccuaaggcgcaggaucucgagcgcaguggucuuaauauagaggaucuggaaaaacugcaaauggcaaggccaaauauacucggucugcggaacaauaucuauuguauggcccaacugcuggauaacuccgauacagcagaaccaacuaaagcaggcagaggcgcaagccaaccccccacaccaacaccagcaagcgacgcuuuucaacguaagcucgaagguugucgcuuccuacacggguaucaccgauucaugcacagcguuggaaggguauucuccaaauggggcgaaucuccuaacagaagccgucggcauagcccccaccaagcacucagaaaaggcguccgcagaacccgccccaguagaaaaggaaagaggcugaugacacggggucaguugccucgcuag

SEQ ID NO: 249005 - RNA, 849 nt, Artificial Sequence
  Description of Artificial Sequence: Synthetic coding sequence
auggcccucguucucauccugcagcuuuugacccuuuggcccuuaugccacacggacaucacccccaguguacccccagcuucauaucacccaaaacccuggcuuggcgcucagcccgcaacaguggucacaccuggugugaacgugacauugaggugucgcgcaccucagccugccuggcgguuuggcuuguuuaaacccggagaaaucgccccccuacucuuccgggacgucucuucugagcuugccgaauuuuuucuggaagaggugacccccgcacagggcggaauauaccgguguugcuaucgacgaccagacugggguccuggaguuuggucgcagccgagcgacguccuggaacugcucgucaccgaggaacugccaaggccaagccucguugcucugcccggcccaguugugggcccuggagcaaacguaucucugcgcugcgcuggacgccugcggaacaugaguuuuguacuauauagagaagggguugcugcaccauuacaguaccggcauagcgcccagcccugggcagacuucacauuacugggcgcucgggcucccggaacuuauucguguuauuaucacacaccuucugcuccauacguucuaagccagcgcuccgagguacucgugauuuccugggaaggugaaggcccugaagcaaggcccgccucuagugcuccgggaaugcaggcuccuggcccgccuccuucugauccaggggcccaggccccaucuuuaucuagcuucagaccccgcggacugguacuacagccacucuugccccagacacaagacucaugggaccccgcccccccuccauccgauccuggcgucuag

SEQ ID NO: 249006 - RNA, 759 nt, Artificial Sequence
  Description of Artificial Sequence: Synthetic coding sequence
auggcgcugguccucauucuccaacugcugacccucuucccaccugccaguuaucauccaaagccuuggcucggugcccagcccgcaacaguugugaccccaggaguuaacguuacgcuuaggugcagagccccacagccggcauggagguucggucucuuuaagccgggugaaauugccccacuacucuuuagggacguuucaagcgagcucgcagaauucuuccucgaagaggugacaccugcacaaggagguauuuauagauguuguuaccggcgcccugacuggggacccgggguguggagccagcccagugaugugcucgaacugcucgugaccgaagaacugcccagaccuucuuugguugcucuccccggaccaguaguuggaccaggcgcuaauguaagucuccguugcgccggacggcucagaaauaugucauucguauuauauagagaaggaguugccgcaccauugcaguacagacacagcgcucagccuugggccgauuuuacgcuucuuggcgcgagggcaccaggcacguacagcugcuacuaucacaccccuagugcaccuuacguacucucacagcguucagaaguccuggugaucucaugggaagacucuggaaguucagauuauaccaggggaaaucucgucagacugggccuagcuggacucgugcucauuagucucggugcccucgucacuuucgauuggcguagccagaaucgcgccccagcaggcauaaggccuuag

SEQ ID NO: 249007 - RNA, 804 nt, Artificial Sequence
  Description of Artificial Sequence: Synthetic coding sequence
auggcauuggugcuaauacuccaguuguugacucuguggccguugugccacacugauauuacuccuagcguggccauaaucgucccaccugccucguaucauccaaaaccauggcuuggcgcccagccagcuacuguagucaccccaggcguuaacgugacguuacgcuguagagcuccacaaccagcauggagauucgggcucuuuaaacccggagagauugcgcccuuguuauuuagagacguguccucagagcuagcugaguuuuuccuggaggaagugacuccugcgcagggggguaucuacagguguuguuacagacgaccagauuggggaccagggguuuggucgcaaccgagcgacgugcuggaauugcuugucacugaagagcuucccaggccaucuuugguagcuuuaccaggaccuguugugggucccggggcuaacgugucacucagaugugccggacgccuccggaauaugucuuuuguacuguaucgggaagguguggcagcuccucuccaguauaggcacagcgcacaacccugggcggacuucaccuuacucggcgcccgugcaccaggcaccuacucuuguuacuaccacaccccguccgcuccuuacgugcucagucaaagaucugaagugcuugugauuucuugggaggacucuggauccucugauuauaccaggggcaaucucgugcgcuuagguuuagccgguuugguacucaucucccuuggggcccuagugacauuugacuggagaucccagaaucgcgcgccugccggcauucgcccuuag

SEQ ID NO: 249008 - RNA, 792 nt, Artificial Sequence
  Description of Artificial Sequence: Synthetic coding sequence
auggcccucgugcucauccuccaacuucuuacauuguggccccugugucauaccgauauuaccccuucuguuccaccagcuuccuaccacccuaaaccuuggcuuggcgcacagccggcuacugucgugaccccuggggugaacgugacauugcgcuguagagcuccccaaccagcuuggagauuuggucuguuuaagccaggagaaauugccccccuguuguuucgggacgugucgagcgaauuggcagaguucuuuuuggaagaagugacaccggcccagggagggauuuauaggugcuguuaccgacgaccugauugggguccuggagucuggucccagccuuccgacgugcucgagcugcuggucacagaagaacugccccgucccucacucguggcucuuccugggccagucguuggaccuggagcaaauguaucucuccgcugcgcagggagacuacgcaauaugagcuucguccuguauagagagggcgucgccgcuccccugcaauacaggcauucagcccagccuugggccgauuuuacacuccucggcgcucgcgccccugggacuuacucuugcuacuaccauacccccagcgccccuuacgugcucucccaaagaucagaagugcuuguaauuuccugggaagauaguggcagcagugauuacacacgcggaaacuuggugcggcugggccucgcuggucuugugcuaauuagccucggagcacuagugaccuucgacuggagaagccaaaacagggccccagccggaaucagacccuag

SEQ ID NO: 249009 - RNA, 1716 nt, Artificial Sequence
  Description of Artificial Sequence: Synthetic coding sequence
augaccauccuucccaaaaaaaaaccaccuccacccgaugccgacccagccaaugagccccccccaccugggcccaugccaccagcccccagacgcggaggcggcguaggagucggagggggcggcacaggaguugggggaggcgaccgcgaucgggauagugguguugucggagcgcgaccccgagccucuccucccccucaaggcccucuuccagguccuccaggggcccugcauaggugggcccucgccguacccccuggcgcagucgccggccccaggccacagcaagcgucccccccaccaugcggaggaccggggggcccaggcggcgguccaggagacgcuuuaggagcggcugcagccggcgugggggcugcugggguggucgugggcguugggggagccguaggagucggcggaugcuguucaggucccggucacagcaaaagaagacgccaggcgccuggagucggagccgugggggguggcuccccagagcgugaggaggucggugcuggauacaacucggaagacgaguaugaggcugccgccgccaggaucgaggcuauggacccugcuacagucgaacaacaagaacauugguucgaaaaggcacucagggauaagaagggauucauaauaaaacagaugaaggaggauggagcgugccuauuuagagccguagcugaccaaguguacggugaucaggauaugcaugaagucguacguaagcacuguauggacuaucugaugaagaaugcagacuacuucucuaacuauguaaccgaagauuuuaccaccuacauuaaucgaaagagaaagaauaacugucacgggaaccauauugaaaugcaggccauggcagagauguacaaucggccgguggagguuuaucaguacaguacuggcacuagcgccguagagccaauuaacaccuuucacggaauccaccagaacgaagacgagccgauucgugugagcuaccacagaaacauccauuauaauaguguagucaauccuaacaaagcuacuauuggagucgggcugggcuugccuucuuuuaaaccuggauucgccgagcagucucugaugaaaaaugcgauuaagacuagugaggaaucuuggaucgagcagcagaugcuggaagauaaaaagagagccaccgauugggaagcaacgaaugaagcgauugaagaacaggucgcacgcgaguccuaucugcagugguugcgagaccaggagaagcaggcaagacaggugcgcgggccaagucagccgagaaaggccucugcgacaugcuccucagcuacggccgcagcauccucaggucucgaagaguggacuagccgaucaccuagacagcguuccagcgccucuagccccgagcauccagaacuucacgcugaguugggaaugaagcccccaucacccggaaccguccuugcccucgcaaaaccuccaucucccugugccccuggcaccuccagucaguuuucggccggcgcugacagagccacaaguccauuggugucucucuacccugccuuagagugcagagcccuaauccagcagaugucacccagcgccuucggccugaacgacugggacgaugacgaaauucuugcaagcgugcuagcagugagucagcaagaauaccuggacucgaugaagaaaaauaaggugcaccgugaccccccgcccgauaaaucuuag

SEQ ID NO: 249010 - RNA, 2529 nt, Artificial Sequence
  Description of Artificial Sequence: Synthetic coding sequence
auggauuuucaggagagagauccacccuuccuacccgaaagcgcucagagcaguaagccaucaagugcccaacaggcaagugaacucugggaagugguggaagaaccaagagugcgacuaggcacagagggagugaugcccgagagacaggaaggacaccuguugaaaaagaggaaauggccccucaaaggauggcauaagagguauuuugugcuggaagacgggauccugcauuacgcaacgacuaggcaggauaucacaaaaggcaagcuccacggcucuaucgacguuaggcuaaguguaaugucaaucaacaaaaaggcacagcgaauugaucuggauacagaggacaauauauaucacuuaaagauuaaaagccaagaccuuuuccaauccuggguggcccagcucagagcccacagacuggcacauagacuggacaugccccggggaucucuaccauccaccgcccauagaaaaguccccggcgcucagcuccccaccgccgcaacagcuucugcccucccuggccucgggccgagagagaaaguaucuucauggcugcgggauagcgaugggcuugacaggugcucucacgaacucagcgagugucaaggcaaauuacaggagcuccaccgccuguugcagaguuuagaaucucuccaccgcauucccagcgccccagugauaccaacccaccaggccucugugacuacugagcggcccaagaaagggaagaggaccucucgaaugugguguacacagagcuucgcaaaagaugauacaauuggaagaguaggcagacugcacgggagcguuccuaaccugucucgcuacuuggaaucuagggacaguuccggaacgagggguuuaccuccaaccgauuacgcccaucuccagcgcagcuucugggcccuggcccaaaaagugcacaguucauugucuuccguucuugcugcucugacaauggagagagaccagcuacgcgacaugcaucagggcagugaauuaucaaggauggguguuucagaggccucuacaggccagcgacgccuacacucacucucuacaucuagugacacgaccgccgacucuuucuccucacuuaauccugaagagcaggaggcucuguauaugaaaggaagagaacuuacuccucaauugagccagaccaguauacuaucauuagcagacagccauacggaauucuuugacgcaugugaaguucuccucagugcaaguaguagcgaaaacgagggcucggaggaggaggaaagcuguacaagugagauaacaacuucccuuagcgaagagaugcuugaccugagaggagccgagagaugccaaaagggagggugugucccaggccggccaaugggcccccccagacguagaugccucccagcggcuagcgggccuggugccgaugugucccucuggaauauucuucgcaacaauaucgguaaagaccuuagcaaaguguccaugccaguucagcuuaacgaacccuugaacaccuuacaaaggcugugcgaggaauuagaauauucguccuuacuugaucaggcaagucguaucgccgacccaugugaacggaugguuuauaucgccgccuucgccgucagugcauacucuuccaccuaccaccgcgccggaugcaagcccuucaauccaguguugggcgaaacuuacgagugcgagcgaccagaccgugguuuuagauucaucucagagcaggugucacaccauccacccaucucugccugccaugcagagucagaaaauuucgccuuuuggcaggauaugaaguggaaaaauaaguucugggggaagucacuugaaauugugccagugggaaccgucaacgucagucugccucgcuuuggagaccauuucgaguggaacaaggugacaaguugcauccacaaugugcugaguggccagagauggauagagcacuauggcgagguauuaaucaggaauacacaagauagcaguugucauuguaagauuaccuuuugcaaagccaaauauuggucuagcaacguccacgaaguucagggagccguucugaguagaagcggccggguucugcauagauuguuuggaaaauggcaugaaggauuguaucggggcccaacuccuggaggccagugcauuuggaagccuaacuccaugcccccugaucacgagcgcaauuucggauuuacgcaguucgcccuggaauugaacgagcugacagcggaauuaaaaagaagccucccuucuacugacacucgccugagaccugaccagcgguaccuagaggaagguaacauucaagcagccgaagcacaaaagcgcagaaucgagcagcugcagagagaucgccggaaggugauggaagaaaauaauaucguucaucaagcgagauucuucaggaggcagacagauucuagugguaaagaaugguggguuacgaacaauacguauuggcgccucagagcggagcccggauacgggaauauggacggagcugugcugugguag

SEQ ID NO: 249011 - RNA, 816 nt, Artificial Sequence
  Description of Artificial Sequence: Synthetic coding sequence
auggccucaccgggcugccuaugguuacucgccguggcacugcuuccuuggacuugugcaucacgggcuuugcaacaucuagauccacccgccccucugccucuugugauauggcauggaaugggcagcagauauguggcccaaacuggucuugaacuucuggccagcucuaaccccccugcaucuucuuaucagagcgccggcaugaucggggacucuugcuguaauccacuuaguaugggugcaaucaaaaaaauggucgagaaaaagaucccugggaucuacguacugucucucgagauaggaaaaaccuugauggaggauguugaaaauagcuuuuuccucaaugugaacagccagguuacaaccguaugucaggccuuagcaaaagauccgaaacuccagcagggguacaacgcaaugggauucagccagggggggcaguuuuugcgugcuguugcccaacgaugcccuucucccccuaugauuaaucuaaucuccgucggcggucaacaucaaggcgucuucggccuccccagaugcccaggcgaaaguucccauauaugcgauuucauccguaagacacuuaacgcaggagcauauaguaaggugguacaggaacguuuaguacaggcugaguauuggcaugaccccauuaaggaagacgucuacaggaaccauagcauuuucuuagccgauauuaaucaggagaggggcauuaacgagucauauaaaaaaaaccucauggccuuaaaaaaauucguaaugguuaaauuccuuaacgauaguauuguugauccaguagauagugaauag

SEQ ID NO: 249012 - RNA, 921 nt, Artificial Sequence
  Description of Artificial Sequence: Synthetic coding sequence
auggccagcccgggguguuuguggcuucuggcgguugcccuucugccuuggaccugugcaucaagagcucuucagcaccuggaccccccugccccccuaccucuugucauauggcauggaaugggagauucaugcuguaauccccuguccaugggcgccaucaagaaaauggucgagaaaaagauccccggaauuuacguccuaucccuggagauuggaaagacccuuauggaggauguugaaaauuccuucuuccugaacgugaauagccaggugacuaccgugugucaggcuuuagcgaaggauccuaaacugcagcagggcuauaaugcgauggguuuuagccagggaggccaauuucugagagcaguggcccagcguuguccgagcccccccaugaucaaccuuauuaguguggguggucagcaccaagguguauuuggccugccuagaugcccaggcgaauccucucauaucugugauuuuauucggaaaacuuuaaacgccggagccuacagcaaaguugugcaagaacgccuugugcaggccgaauauuggcaugauccaauuaaggaggacguguacagaaaccauucuauauuccuugcagacaucaaccaggagagaggcaucaaugaaagcuacaagaaaaaccuaauggcucugaaaaaauucgugaugguaaaauuucuuaacgauagcauaguggacccuguggauagcgagugguuuggauucuacagaucaggccaggcuaaagaaacgauuccuuuacaagagaccagucucuauacccaagaccgccugggacugaaagaaauggacaacgccggccagcuuguguuucuggccacugaaggggaucaucuacagcugagugaagaaugguuuuaugcccauaucaucccauuucuagguuag

SEQ ID NO: 249013 - RNA, 612 nt, Artificial Sequence
  Description of Artificial Sequence: Synthetic coding sequence
auggcaucuccuggcugucuuuggcuccuugccgucgcccugcuucccuggaccugcgcaucgcgggcgcuccagcaccuagauccacccgcaccccuaccccugguuaucuggcaugguaugggcgucuuugggcugccucguugcccuggcgagagcucccacauuugcgauuuuauccggaaaacccugaacgccggggcuuauucuaaaguuguucaagagaggcucguacaggccgaguauuggcacgauccgaucaaagaagacguguaccgaaaccacuccaucuuccucgccgacauuaaccaggagcgagguaucaaugaaucuuauaaaaagaaucugauggcucucaaaaaguuugucaugguuaaauuccuaaacgauucuaucguagaucccguggauagcgaaugguuuggcuuuuacaggagcggacaagcaaaggagacaauuccacugcaagaaacuaguuuguacacccaggaucgccucggacugaaggaaauggacaaugccggccagcucguguuucuggcaaccgaaggagaccaucugcaguugagcgaagagugguuuuaugcccacauuaucccuuuccugggauag

SEQ ID NO: 249014 - RNA, 921 nt, Artificial Sequence
  Description of Artificial Sequence: Synthetic coding sequence
auggccucccccgggugccucuggcugcuugcuguugcguugcucccguggacgugcgccucucgcgcucugcagcaccuagacccuccugcaccgcuaccucucgugaucuggcauggaaugggggacuccuguuguaauccucugagcaugggcgcuauuaaaaagaugguugaaaaaaagauaccuggcaucuacgugcugucacuagagauuggaaagacacugauggaggacguggaaaauuccuucuuccugaauguaaauucccaagugaccacuguaugucaagcucucgcaaaagaccccaaacuccagcagggauacaacgcgauggguuucagucaaggugggcaguuccuuagggccguggcacagagauguccuucuccaccuaugaucaaucugauuucuguaggcggccagcaucaggggguguucggacucccgagauguccaggagaguccucucacauuugugauuuuauaaggaaaacucuuaacgccggugcauauuccaaagucguacaggagcgccucgugcaggcagaauacuggcacgacccaaucaaagaggaugucuaucggaaucacucaauauuucuggcugauauaaaccaggagaggggaaucaaugaauccuacaagaaaaaucucauggcucugaaaaaauuugugaugguuaaguuucuaaacgauucuaucgucgaucccguggacagugaaugguuugguuuuuacagguccggacaagccaaggaaacaauuccgcuucaggagacgucucuauacacgcaggaccgcuugggacuaaaggagauggauaaugccggccaauuagucuuucuggccaccgaaggagaucaucuacaauuauccgaagagugguuuuaugcucacaucaucccuuuucucggcuag

SEQ ID NO: 249015 - RNA, 2310 nt, Artificial Sequence
  Description of Artificial Sequence: Synthetic coding sequence
augggcuguaauaugugugucguccagaagccugaggaacaauacaagguaaugcugcaagucaauggaaaagaacugucuaaauugucccaggaacagacacuucaggccuuaagaucuucaaaggaaccccucgugauccagguccugcgcaggucuccuaggcuuaggggugauaguucaugccacgaucugcaacugguggauagcggcacucagaccgauaucacauuugagcacauaauggcacuaggcaagcugcgcccccccaccccuccaaugguuauccuggaaccccccccuauaagccacgaguauuacgacccugcugaauucauggaagggggaccacaagaggccgaccgacuggacgagcucgaguacgaagaagucgaacuguauaagagcucccaucgcgacaaacuggggcucaugguuugcuaccgaacagaugacgaggaggaucuggggauuuacgugggugagguuaauccaaacucaauugcugcuaaagacgggaggauaagagaaggugaccggaucauacagauuaauggaguagacguacaaaacagagaagaggcuguugcaauauugucacaagaggaaaacacuaacaucucccuguuggucgcccgccccgaaucccagcuggcaaagagguggaaggacucugauagagacgauuuucuugacgauuuuggcagcgagaacgaaggggaauuacgggccagaaaacugaaauccccaccagcccagcaacccggcaaugaagaggagaagggcgcccccgacgcgggaccuggucugucaaacucccaagaacucgacagcggugugggaagaacugaugaaagcacacguaacgaagaaucgagugaacacgacuugcucggugaugagcccccuaguuccacaaauaccccagggucacuccggaaauucggccuccaaggagacgcacugcagaguagggacuuucauuucaguauggauucacuccuggcagagggagcagggcucggggggggggaugucccaggccuuaccgaugaggaauaugagcgguaucgggaguugcuggagauuaaaugucaccuggaaaacgguaaccagcuagggcuucuuuuuccacgcgccuccgggggaaacagcgcgcuugacguaaauagaaaugaaucucugggccacgaaauggccaugcucgaagaggagcugagacaccuggaguuuaaaugcagaaauauacugagagcacagaagaugcaacaacugagagaacgcugcaugaaggcuugguuacuggaggaggagagccucuacgaucuugccgcauccgaaccaaaaaagcacgaguuaagcgauaucagugaacugcccgaaaaauccgauaaagauucgacuagcgcguauaacacgggagaaucuugccgcucuaccccucuccuuguagagccucugcccgagucgccacuucgccgcgccauggcuggcaacucgaaccuaaaucgcacccccccugggcccgcaguagccacuccagcaaaagccgcaccaccacccgggagccccgcaaaguuuagaagccuuaguagggacccagaggcaggcagacggcaacaugccgaggaaagagggcgccgcaacccuaaaacaggcuugacccuagagcggguaggcccagagagcucacccuauuuaagucgaagacaucgcggacagggccaagagggagagcacuaccacuccugcguucagcuugccccgacccgaggccuggaagaacucggccacggcccccuuagccuggcuggagggccacgcguugggggaguggcagccgcggcgacagaagcaccccguauggaauggaagguuaaaguacgaagcgacggcacaagauacguggccaagagacccguucgggacaggcugcuaaaggcucgcgcgcuuaaaauucgagaggaaagaagcgguaugaccacagaugacgacgcaguguccgagaugaagaugggacgguacugguccaaagaggaacgcaagcagcaucugauaagagcacgagaacagcgaaagaggagagaguuuaugaugcagaguagacuggaauguuugagagagcagcagaacggagauucuaaaccagaacugaauauaaucgcuuugagucaucggaagaccaugaaaaaaaggaacaaaaagaucuuggauaauuggauaaccauucaggagaugcuggcucacggggcaagaucugcagacgggaagagaguguacaauccucuacugagcgucaccacuguguag

SEQ ID NO: 249016 - RNA, 477 nt, Artificial Sequence
  Description of Artificial Sequence: Synthetic coding sequence
augcucgaggccauggccgagcccaguccugaagacccuccuccuacccuuaagccugaaacacaacccccagaaaaacguagacgaacuauagaggauuuuaauaaguuuuguucuuuuguucucgccuacgcuggauauauacccccaucaaaagaagaaucugauuggcccgccuccggaucuucuaguccauuaaggggcgaauccgccgccgacucagacggaugggauuccgcaccuagugaucuacgcacuauacaaacauuugucaaaaaagcgaaauccuccaaaagaagggcagcucaagccggaccuacucagcccggaccaccuagaaguacuuuuucacgguugcaggcuccagacucggccacacugcuagaaaaaaugaagcugaaggacucccuguuugaucucgacgggccaaagguugcgagcccgcucagccccccaugcgccgccaacaccccuuag

SEQ ID NO: 249017 - RNA, 1665 nt, Artificial Sequence
  Description of Artificial Sequence: Synthetic coding sequence
augaggcgcccucuuucaaagugcggcauggagccuggaggaggagacgcaucccuuacgcuacacggucuccaaaacagaucgcacggcaaaauuaaacuucgcaaaagaaagucaacuuuauauuuuaacacacaagaaaaauccgcgcgccguagaggcgacuuauugggcgaaaacaucuaucugcuucuguucaccaucgcgcuucggauucuaaacuguuuucuaguccagaccuccuucgugccugacgaguacuggcagucucucgaggucucccaccauaugguauuuaauuauggcuaucuaacaugggaguggacggaacgacucagguccuacaccuacccccuuaucuucgccuccauuuauaaaauccugcauuuacuugggaaagauagcguucaguuacucauuuggaucccacgacuggcccaagcacugcucagugccgucgcggaugugcgacucuacucacucaugaagcaacuggagaaccaagaaguggcucgaugggucuuuuucugucagcuuuguuccugguuuacaugguacugcuguacgcggacgcuuacaaacaccauggaaaccguccucaccauuaucgcacuuuucuauuacccacucgagggcucaaaaucgaugaauuccguaaaguacuccucccucguggcacucgccuucauuaucagaccuacagcugugauucucuggacuccuuugcuguuccgucacuucugccaggaaccaagaaaacuugaccuaauauugcaucacuuucuuccagugggcuucgucacacuuucucuaucguuaaugaucgacaggaucuuuuucgggcaguggacauuggugcaguucaacuuccuuaaauucaacguccuccagaauuggggaacauuuuaugggucccaccccuggcacugguacuucucucaaggauucccaguaauucugggcacacaccuacccuuuuucauccauggcugcuaucuggcucccaagagauaccgaauucuucucguaaccguucuguggacccugcugguguacucgaugcugagccacaaggaauucagauuuaucuacccuguacuuccguuuugcaugguuuucuguggcuauucacucacucaucuuaaaaccuggaaaaaacccgcacuguccuucuuauuccuuucuaaccuuuuccuggcccuuuauacggggcucgugcaccagagagggacacucgacguaaugucacacauacagaagguguguuauaauaauccuaacaaaucaucugccucaauauuuauuaugaugccaugccacucgacuccauauuacucccauguccacugcccguugccaaugcguuuuuuacagugcccccccgaccucaccgguaaaucccauuaucuugaugaggccgacgucuucuauuuaaauccacugaacugguuacaucgagaauuccaugaugacgcuucucugcccacacaucugaucaccuucagcauuuuagaagaggaaauaagcgccuuuuuaaucagcaguaauuauaaacggaccgcaguuuucuuucacacccacuuaccugaaggccgcauuggaagccauaucuacgucuaugagcgcaaacugaaaggaaaauuuaauaugaaaaugaaauucuag

SEQ ID NO: 249018 - RNA, 1482 nt, Artificial Sequence
  Description of Artificial Sequence: Synthetic coding sequence
auguggccacaggaucccucucgaaaagagguccuccguuuugccgucagcuguagaaucuuaacccuuaugcuccaagcccuauuuaacgcaaucauuccagaucaccacgccgaagccuuuucucccccucggcuggcacccuccggcuucgucgaccaacuuguggaagggcuguuaggggggcuaagccacugggacgccgaacauuuccuguuuauagcagagcacgguuaccuuuacgagcacaauuucgccuucuucccuggguucccauuggcccuauugguggguacagagcuucuacgaccuuugcgaggacuuuugucucuuagguccugccugcuuaucuccguggcuucccugaauuuccuauuuuuuauguuggccgcugucgcauugcaugacuugggaugccuggugcuucauuguccucaccaaucauucuaugcagcccuucuauucugucuaaguccugcuaacgucuuccuagccgcgggauauagugaggcucuuuucgcccuccugacguuuuccgcuaugggccaauuagagagaggccguguguggacuaguguguuguuguuugcauucgcuacuggggugaggucaaauggauuagucucagucggcuuucugaugcauucccaaugucaagguuuuuucagcucccucaccaugcuuaacccccugagacaguuguucaaacugauggcuagucucuuucucucuguuuuuacccucggccuuccauuugcccucuuucaauacuaugccuauacccaguucugucuucccggcucagccagaccaauaccagagcccuuggugcaacuugccgucgacaaaggcuacagaauugcugagggaaaugaaccccccuggugcuucugggacgugccuuugaucuauuccuauauccaagauguauauuggaaugucggguuccuuaaguauuaugagcucaaacagguccccaauuuccugcuagccgcaccugucgcuauucucguugcuugggcaacauggacuuacguuacaacccacccguggcugugccuuacacugggccuccagcgauccaagaauaacaagacacuugagaaaccagaucuggguuuucucagcccucagguuuucguguauguggugcaugcagcugugcuucuucuguucgguggccuguguaugcaugugcaagucuugacucgcuuucucggaucaucuacucccauuauguacugguuucccgcccaccuacuccaggaccaagaaccuuuguugagaucgcuaaagacuguaccuuggaaaccauuggcugaagacagcccaccaggucaaaagguuccaaggaacccaaucaugggauugcucuaccacuggaaaaccuguagccccgugacgcgcuauauucucggcuacuuccuaaccuacuggcugcucggccuccugcuccauuguaacuuccuucccuggaccuag

SEQ ID NO: 249019 - RNA, 2529 nt, Artificial Sequence
  Description of Artificial Sequence: Synthetic coding sequence
auguccagaccucugucugaucaggagaagagaaagcagaucucuguucgaggacucgcuggcguggagaacgugaccgagcugaagaaaaauuuuaaucgacacuuacacuuuacccuuguuaaagaccgcaacgucgccacuccccgcgacuauuauuucgcccuggcacacaccguaagagaccaucugguuggcagauggauaagaacccagcagcauuacuacgagaaagaccccaaaaggaucuauuaccugucacucgaauuuuauauggggagaaccuugcagaacacuauggugaaucucgcucucgagaacgccugugacgaagcaacauaucaguuaggccuggacauggaggaguuagaagaaauagaggaagacgcgggacuugggaauggcggacucggcagguuggcggcgugcuuucuugauucaauggccacacucggacuagcugcauacggauacgggaucagguaugaguucgguauuuuuaaucagaaaauuagcgggggcuggcagauggaagaagccgaugauuggcucagguacggaaauccaugggagaaagcuaggccugaguuuacacuaccagugcacuuuuacggucauguagagcauaccucacaaggggccaaguggguagauacacaagucguguuggcuaugccauaugauacaccagugccagguuaucgaaacaaugucgucaauacuaugagacuuuggagcgccaaagccccaaaugacuucaauuugaaagauuuuaaugugggcggcuacauccaggcagugcuggacaggaaccucgccgagaauaucagccggguacuuuauccuaaugacaacuuuuucgagggaaaggagcugagguuaaagcaggaguauuucguggucgccgcaaccuugcaggacauuauucgcagauuuaagagcucaaaauuuggcugcagagaccccgugaggacaaauuuugaugccuuuccagacaagguagcaauacaauuaaacgauacacauccauccuuagcaauucccgaacuaaugcgcaucuuaguugaccuggaacgaauggacugggauaaagcuugggacguuacaguaaggacaugugcauacaccaaucacacagugcucccugaggcacucgaaagauggcccgugcaccugcuagagacuuuguugcccaggcauuugcagauuaucuacgaaaucaaccagcguuuccugaauagaguugcagcugcuuuccccggugauguggaucgacuucguaggaugucccucguugaggaaggagccguuaaacggauaaauauggcacaccuuuguauagcuggaagucacgcagugaacggcgucgcacggauccacuccgagauucucaagaagaccaucuucaaagauuucuaugagcuggagccucacaaauuccagaauaagacaaauggcaucacaccacgaagauggcugguacuaugcaaucccgggcuugcggagguaaucgcagagcgcaucggagaagauuuuauaagcgacuuggaccagcuucggaaacugcugaguuucguggacgacgaagccuucauuagggacguggcuaaggucaagcaggaaaacaaacuaaaauuugcagcauacuuagagagagaauauaaggugcacauaaauccuaacucguuguucgacauacaagugaagcgaauucaugaguauaaaaggcagcuguuaaauugccugcacgucauuacuuuguauaacagaauaaaacgggagccuaacaaauuuuuuguaccuaggacagugaugauaggugggaaggcugcccccggcuaucacauggccaaaaugauuaucagacugguaacagcaaucggagacguaguaaaucacgauccagcuguuggcgauagacuccgcgucaucuuccuugaaaauuacaggguauccuuggcagagaaaguuauccccgcagcagacuuauccgaacagaucuccaccgcgggaaccgaagcaucugggacggggaauaugaaauuuaugcugaauggagcacugacaaucggcaccauggacggagcuaacguggagauggcagaggaggcaggagaggaaaauuuuuuuaucuucgggaugagaguagaggauguggacaaguuggaucagcguggcuacaacgcacaggaguauuacgaucguauacccgaauugcgccagguuauagaacaauuaucgagcgguuuuuucucaccuaaacaacccgaucuauucaaggauaucgugaauaugcuuaugcaucaugacagauuuaagguguuugcugacuacgaagauuauauuaaaugccaggagaaggucucagcauuguauaagaacccuagggaguggacgaggauggucauccggaauaucgcaaccuccgguaaguuuaguucugaucgcaccauagcccaauaugcuagggaaauuuggggaguggaacccucuagacaacggcugccugcaccugacgaggcaauuuag

SEQ ID NO: 249020 - RNA, 2646 nt, Artificial Sequence
  Description of Artificial Sequence: Synthetic coding sequence
auggcagcgcccggagccccagcagaauauggauacauaagaaccguccugggacagcagauuuugggccagcucgauuccagcucucucgcacugccuagugaggccaagcugaaguuagcggguagcucaggccgcggaggccaaaccgugaagagcuugagaauucaagaacaggugcagcaaacauuggccagaaagggaagaucauccgucggaaaugggaaucuccaucgaacuagcucugugccugaauacguguacaaccugcaucugguggaaaaugauuuugugggaggucgcagcccuguccccaagacuuacgacaugcuuaaagccggcacuacugcaacauacgaaggaagauggggccgaggaacugcccaauauaguucccagaaauccguagaggagcgcucccuccgccacccccuuagacgacucgagauaucgcccgacuccaguccagagagggcucacuacacccacagugacuaccaguacucccagcgcagucaggcaggacacacacuccaucaucaggaaucacgcagggccgcauuguuaguaccuccuagauaugccagauccgagauugugggugucucacgggccggcacaacaagucgccagcgucacuuugauaccuaccacaggcaguaccaacauggcuccguguccgauacggucuucgauuccauccccgccaacccagcucuacucacuuacccaagaccaggcaccuccagauccaugggcaacuuacuugaaaaagaaaacuaccuaacugccggacugacuguugggcagguccggccgcucguuccucugcagccagugacacagaaucgagcaucucgcucaucauggcaucaguccucuuuccauagcacacgcaccuugcgcgaagccgguccuagugucgcuguggauuccucgggaaggagggcccaucuuaccgucgggcaggcagcagccgguggcuccgguaaccuacugacugaacgcucaaccuucacugacucgcagcucgggaacgcagauauggagaugacacuggaaagagccgucagcaugcuggaagcagaccacaugcugcccagccggauuucugcugcugccacuuuuauacaacaugaaugcuuucagaaaucagaggcucguaagagaguaaaccaacuuaggggcauauuaaaguuauugcaacugcuuaagguacagaaugaggaugugcagcgcgccguuugcggcgcccucaggaauuuaguauuugaggacaacgacaacaaguuagagguggccgaguugaauggagugccuagauuacuacagguucugaagcagacccgcgacuuagagacaaaaaagcagaucacugaccauaccguaaaccugaggucccguaauggcuggcccggugcaguggcucaugcguguaacccuuccacacuggggggacaggguggcagaauaacccgaucuggaguacgcgaccagccugaucagcauggucugcuguggaaccugucuaguaacgauaaacugaagaaccuuaugauaaccgaggcuuuacugacucucaccgagaacauaauuaucccuuucucuggauggccagagggcgacuacccaaaggccaacggacugcuggauuuugauauuuuuuacaacgugaccggaugucuacgaaacaugaguagcgcaggcgccgacggacgcaaagccaugagaagaugcgacggccuaauugacucucucguacauuauguccgcggcacgaucgccgauuaccagccugacgacaaggcuaccgaaaauugcgucuguaucuuacauaaccugagcuaucaacuagaggccgaacucccugaaaaauauucccagaacaucuauauccaaaaucgcaauauacaaaccgacaacaacaagucuaucggcugcuucggcucuagaucuagaaaggugaaggaacaguaccaggacguaccuaugcccgaggagaagagcaauccaaagggggucgaauggcucuggcacagcaucguaauccgcauguaucugagucugauugccaagaguguuagaaacuacacccaggaggcuucacugggagcccugcaaaaccugacagccgguucuggaccaaugcccacuucagucgcgcaaaccgucgugcagaaggaaucugguuuacagcacacucggaagaugcuacaugugggugacccuaguguuaaaaaaaccgccaucagccuauuacgcaaucuuagcagaaaucugucccuucagaaugagaucgcaaaagaaacacugccagauuuagugagcaucauaccagacaccgucccaagcacugauuuacugauugaaacuaccgcauccgccugcuacacucuaaacaauaucauccagaacuccuaccaaaaugcacgcgaucuacugaacaccggggggauacaaaaaauuauggccauaagugcaggagaugcauacgccuccaauaaggccuccaaggccgccagcguccuacucuacaguuugugggcucauacagaacuucaccaugcuuacaaaaaagcacaguucaagaagacagacuuuguuaauagccggaccgcuaaagccuaccauagccuuaaagacuag

SEQ ID NO: 249021 - RNA, 291 nt, Artificial Sequence; identical to SEQ ID NO: 248415
  Description of Artificial Sequence: Synthetic coding sequence

SEQ ID NO: 249022 - RNA, 291 nt, Artificial Sequence; identical to SEQ ID NO: 248416
  Description of Artificial Sequence: Synthetic coding sequence

SEQ ID NO: 249023 - RNA, 291 nt, Artificial Sequence; identical to SEQ ID NO: 248417
  Description of Artificial Sequence: Synthetic coding sequence

SEQ ID NO: 249024 - RNA, 405 nt, Artificial Sequence
  Description of Artificial Sequence: Synthetic coding sequence
augaagagccugacuuggauccucggauuaugggcuuuagcggccugcuuuacgccgggugaaucucagcguggcccucggggucccuaccccccugguccucuggcaccucccccaccuccuuguuuucccuuuggaacgggcuucguccccccgccacacccgccuccuuacggccccggcagauuuccuccuccccugagcccuccauauggaccuggccggauacccccgucccccccaccccccuacggaccgggcaggauucaaucacauucucucccaccuccauacgggcccgguuacccucagcccccaucccagccccgcccuuacccaccaggcccaccuuucuucccuguaaauucuccgacagacccugccuugccaaccccugcgcccuag

SEQ ID NO: 249025 - RNA, 3075 nt, Artificial Sequence
  Description of Artificial Sequence: Synthetic coding sequence
auggcacagggggccaugcguuucuguucagaaggggacugcgcaaucagccccccuagguguccuagaagauggcuccccgagggcccaguaccucagucccccccagcuuccauguacggaucuaccgguagcuugcugagaagagucgcagguccuggcccuagggggcgagaacucggccgcguuaccgccccauguacucccuuaaggggaccuccuuccccgagaguggcaccaucaccaugggcucccucaagcccaaccggacaaccaccccccggagcgcaaagcagugugguuauuuuuagauuuguugagaaggccucaguaaggccuuuaaauggacugccggcacccgguggccugucucgcagcugggaucucgguggugucuccccuccuagaccgacaccugcucucggaccgggcucuaaucgcaaguuacgccuggaagcuucaacaagugacccacugccagcaagaggaggguccgcccugcccggaagcagaaaucugguacaugguccacccgccccuccacagguuggagcagauggucuauacagcuccuuaccaaacggacucggagggccccccgaaagacuggccacuuuguuuggaggccccgcugauaccggcuuucuaaaucagggagauaccuggucaucuccucgugaggugucaucccacgcacaacggauugcuagggcaaagugggaguuuuuuuacggaucccuagauccucccuccagcggcgccaaacccccagaacaagcuccuccaagccccccaggugugggcucccgccagggcucugggguugcagugggccgggcugcuaaauacucugagaccgaucuugacaccgugccacugagauguuacagggagacugacaucgacgaggugcuggcugagagagaggaggcagauucugcgaucgagagucagcccucauccgaaggcccucccggcacagccuauccaccggcucccaggcccgggccuuuaccaggaccccaucccucccucggaagcgguaacgaagaugaagaugaugaugaagccggcggcgaggaagacgucgacgaugaaguuuucgaggcuagugaaggugccagacccggcucuaggaugccacugaagucuccagucccuuuccugccuggaacaaguccaagugccgacggacccgauagcuucucaugcguguucgaggccauccuggaaucucaucgugccaagggcacaucauacaccucucuagcgucccuugaggccuuggccagucccggaccgacccagagccccuucuuuacauuugaguuaccgccgcagccccccgccccuagaccagauccccccgcucccgcaccccucgcaccuuuggaaccugacucugggaccucaucugccgccgauggcccguggacacagagaggggaagaagaagaagccgaagcccgcgcuaagcucgcuccugggcgagaaccaccuagcccuugucauuccgaggacucccuggggcugggagccgcaccuuugggaucugaaccgccccuuucacagcucgugucugacagcgauuccgagcuugauucuaccgaaagacuggcccuuggcagcacagauacccucucaaacggucagaaggcagaucuggaagccgcccagagacuggcuaagcgauuauaucgacuugacggauucaggaaagccgacguugcucgucaccugggaaaaaauaacgauuuuucuaagcugguggcuggagaguaccucaaauucuuuguguucacuggcaugacccucgaucaggcacucagagucuucuuaaaagagcuggcacugaugggcgaaacacaggagcgagaacgagugcuggcccacuuuucacaacguuauuuucaguguaaucccgaggcucugaguagcgaagauggagcucauacacucacuugcgcucugaugcuccuuaacaccgaccuccauggacacaauauugguaaaagaaugacuuguggcgauuuuauagguaauuuagagggccucaaugaugggggcgacuucccgagggaauuacuuaaggcguuauauucgagcaucaagaacgagaagcugcagugggcuaucgaugaagaagaacuucggcgaucuuuaagugagcuggccgauccuaacccuaagguuauaaaaaggauuagugggggaagugguucuggauccuccccauucuuagacuuaacuccugaaccgggggcagccguuuacaaacauggugcacucguuagaaaggugcacgcagauccugauugcagaaaaacuccucgaggcaagagaggguggaagucauuccauggcauccucaaggguaugauuuuguaccugcagaaagaggaauacaaaccagguaaagcccucagcgagaccgaacugaaaaaugcaaucaguauucaccaugcccucgccaccagagcgucugauuacagcaagcgcccacacgucuuuuaccucagaaccgcagacuggagaguauuccuuuuucaagcuccgaguuuagagcagaugcaguccuggauaacaagaauuaaugucguagcagccauguucagcgcuccaccguuccccgccgccgugucuucacagaaaaaauuuucucgaccucuuuuaccuagugccgcgacucgacugagucaagaagagcaagugaggacccacgaggcgaaguuaaaagcuauggcauccgaauugagggagcacagagcugcgcaacuggguaagaaagguaggggaaaggaagccgaggaacagagacagaaggaagcuuacuuagaauucgaaaaaucccgguacuccacauacgcagcucugcugagggugaaguugaaagcugggagcgaggaguuggacgcuguggaagccgcucuggcucaggccggaucuacugaagauggucugccuccaucucauuccucuccaagucugcagccuaagccgagcagucagccaagggcacagagacauagcagcgagccgagaccaggagcugggagugggagaagaaagccguag

SEQ ID NO: 249026 - RNA, 2373 nt, Artificial Sequence
  Description of Artificial Sequence: Synthetic coding sequence
augaaagcauuugguccgccucaugaaggcccccuccaaggauuagucgccucuagaauagaaaccuacggcggccgucaccgggcgagcgcucagucuacagcaggacgacuauacccccgcggauauccuguguuagaucccagccgaagaagacuucagcaauacguuccauucgccagagggucaggccaggcuaggggccucucuccgaugcggcugagagauccagaacccgagaaaaggcacgggggacacgugggugccggacugcugcacucuccuaaacuuaaggagcugacaaaagcacacgaacuggagguuagauugcauaccuuuuccauguucggaaugccucgccugccaccagaagaccggcgucauugggaaauaggagaaggaggggauaguggauuaacaaucgaaaaguccuggagagagcuuguuccuggccacaaagagaugucacaggagcucugucaccaacaggaagccuuaugggaacucuugacaacagaguugauauaugugcgcaagcuuaagauaaugacugacuugcuagcagcgggucuguuaaaucuacagagagugggccuucugauggagguuagcgcugagacucuguuuggcaacgugcccagcuugaucaggacccaucgaagcuuuugggaugaaguauugggccccaccuuggaggaaaccagagccuccggucagccccuggacccuaucgguuugcaaucaggauuuuuaacuuucggccagcgguuccauccuuacguucaguauugucugagggugaagcaaacaauggcuuacgcacgagaacagcaggaaaccaauccucuuuuccacgcauucguucaguggugcgagaagcauaagagaucuggaagacagaugcuuugugaucugcuuauaaaaccccaccaaaggauuacaaaauauccacuccuucuccacgcuguucugaaaagaagcccagaggcccgggcccaggaagcucucaacgcuaugaucgaagccguagaguccuuuuugagacacaucaauggccagguacgccaaggagaagaacaggaaagucuggccgcagcagcucagagaaucggacccuaugaagugcuggagccccccucagacgaagucgaaaaaaaucuccggccauuuucuacacuggaccuaacauccccuaugcugggcguggccucagagcauacccgacaacugcugcuggaggggccaguaagagugaaagagggccgagagggcaaacucgacgucuaccuuuuucuguuuucagauguuuugcuggugacuaagccacagcggaaagccgacaaggccaaaguaauaagaccccccuugaugcuagaaaagcugguuugucaaccguugcgugaccccaauuccuucuuacugauucacuuaacugaauuucagugugugucaucugcguuauugguacacugccccagcccuaccgauagagcucagugguuagaaaagacucaacaagcucaagcugcccuccaaaaacucaaggccgaggaauauguccagcagaaacgugagcuccucacgcuguaucgugaucaggauagagagucuccaucuacccggccuucaacgccaagucuggaaggcucccaaaguagugcugaaggacgaaccccugaauuuucuaccaucaucccacaccuagucguuaccgaagauacugacgaagaugccccccuugucccagaugacacaucagacucuggauaugggaccuugauuccuggcacuccuacagggaguagaucaccacucucccggcucaggcagagagcgcuucgccgggacccucgguugacuuucuccacacucgagcugagagauauuccgcugaggccucauccgcccgauccucaggcuccccaaagacgaucagcgccugaauuacccgagggaaucuuaaaagguggaucucucccucaggaggauccccccacauggagugaagaggaagauggcgcuucagaacggggaaauguaguaguagagacccugcaccgagcgagacucagaggccaauugccaaguaguccaacccacgccgacucugccggcgaguccccaugggaaucaaguggcgaggaggaagaagagggccccuuauuccugaaagcagggcacaccucacugaggccaaugcgcgccgaggacaugcugagggagauucgggaggagcuggcuucccagagaauugaaggagcagaagaaccacgcgacaguaggcccaggaagcugacucgcgcacaacuucaaaggaugcgaggaccacacaucauccagcucgauaccccgcugagcgcaagugaaguguag

SEQ ID NO: 249027 - RNA, 819 nt, Artificial Sequence
  Description of Artificial Sequence: Synthetic coding sequence
augguucuauugacggcugugcuucuguugcucgccgcguacgccgggcccgcacaaucgcuaggaucuuuugugcacugugagccuugcgaugaaaaagcccuuaguauguguccuccuucuccuuuaggcugcgaguuagugaaagagcccggcugcgguugcuguaugacuugugcccuggcagagggacaaaguuguggcgucuacacagaacguugugcucaaggacuucgcugccugccucggcaggaugaagaaaaaccccuccacgcgcuguuacauggacgcggugugugccucaacgaaaaaucauaccgggagcaggucaaaauagagcgggacagcagagagcaugaagagccgacgacuuccgaaauggccgaagaaacauauagcccuaagauuuucagaccaaagcacaccagaaucagcgaacuaaaggccgaagccguaaagaaggaucggaggaaaaagcuaacacagucaaaauuugugggaggcgccgaaaauacagcccacccaagaaucaucuccgccccggaaaugcgucaagaaucugagcaaggcccuugcaggagacacauggaagccagccuucaggaacuuaaggccaguccucgcauggucccaagagccguuuaccuacccaauugugacagaaagggauuuuacaaaagaaaacaguguaaacccucucgaggaagaaagagagggaucugcuggugcguggacaaguauggcaugaagcugcccgggauggaguauguggauggggauuuccaaugucauaccuucgacaguucaaauguggaauag

SEQ ID NO: 249028 - RNA, 2031 nt, Artificial Sequence
  Description of Artificial Sequence: Synthetic coding sequence
auggcagcagccucauccccuccuagagcugagcggaagcgaugggguuggggaagauuaccaggugcucggcgaggaucugcagggcuugcaaagaaguguccuuuuagucuggagcuagccgaggggggaccagccggaggggcccucuacgcaccaauugccccaggagcaccuggccccgcuccgccagcuuccccugccgccccugccgcuccuccuguggcuuccgaccucggcccgcggccuccagugucacucgacccgcgugugucuauuuauucaacccgacgcccuguucuugcucgcacacacguccaaggacgcgucuacaauuuccuggagcguccaacaggcuggaaauguuuugucuaucacuuugcuguguuccugauuguucucguaugccuuaucuuuuccguuuuaucgacaauagaacaguacgcggcccuugcuacaggaacccuauucuggauggaaauuguccucgugguguuuuuuggcacagaguaugucgugcgguuauggagugcugggugucgcucuaaguaugugggccuguggggacggcuucguuuugcgagaaagccaauuucaaucauugaccugauaguggucguggcuaguauggucgugcucugcguugggucaaagggacagguguuugcaacuucagcgaucagagguauucgauuuuugcaaauacuccgcaugcugcacguggauagacagggagguacauggcgucuacuggguucagucguauucauccaccgacaggaauuaauaacuaccuuauauauuggcuuucucggacugaucuuuucaagcuacuucgucuaccucgccgaaaaggacgcugugaaugaaucuggaaggguugaguucggcucuuacgccgaugcucuguggugggggguggucaccgugacaacaauuggcuauggggauaagguaccucagacguggguugguaagaccauugcaucaugcuucucuguauucgcuauuaguuucuucgcucugccugcaggcauucuugggagcggcuuugcacugaaaguacagcaaaaacaacgccagaaacacuuuaauaggcaaaucccagcugcugccucucugauccagacugcuuggagaugcuacgcugcugaaaacccggauaguucaacuuggaaaaucuacaucaggaaagcgccaagaucucauacccuucugucuccuagucccaaacccaaaaaaucagugguuguuaaaaaaaagaaauuuaagcuggauaaagacaauggugucacacccggcgaaaagaugcugacagugccccauaucaccugugacccuccugaagaacgccgauuagaccauuucucaguagauggauaugacucuagcguccgaaaaucuccuacauuacuggaggugaguaugccucacuucaugcggaccaacaguuuugccgaggaccuggaucucgaaggcgagacacuguuaaccccaaucacucauaucucucagcuccgcgagcaccaccgggcuaccauuaaaguaauacggaggaugcaguauuuuguggcaaagaagaaauuucagcaagcacgcaagcccuacgacguaagagacguuaucgaacaguacucccaaggacaccucaauuugauggugcgcaucaaagaacuccaacgucgacuugaucagucuauaggaaagccuagccuguuuaucuccguuagcgagaagaguaaggacagagguucuaacacuauuggagcuagauuaaacagagucgaagauaaggugacccagcuugaucaacgcuuggcacugauuacagacaugcugcaccagcucuugaguuugcauggugguucgacgccuggcucuggugggcccccccgugagggaggcgcacacaucacucagccuuguggaucuggagguagcguagauccagaacuguuccucccgagcaacacacuuccaacuuaugaacagcugaccgugccacgccgcggccccgacgaagguucauag

SEQ ID NO: 249029 - RNA, 1104 nt, Artificial Sequence
  Description of Artificial Sequence: Synthetic coding sequence
auguacccagaaaguaccaccggaagccccgcuagacuuucgcuacgccagaccggcucaccuggcaugauauacuccacgcgcuacggaucccccaaaaggcaauugcaauucuacaggaaucuggguaaguccggacugcgggucucuugucucggguugggcacaugggugacauucggcggccagauaacugacgagauggcagagcagcuaaugacucuugcguaugauaaugggaucaaccuguuugacaccgcugaaguauacgcugcagguaaagcggaaguuguccucggaaacauuauuaaaaagaaggguuggaggaggucuagcuuggucaucacuacgaagauuuuuuggggcgggaaagcagaaacagagcgggggcucagucgcaaacacauuauugaaggacugaaagcuucacuagagagacuccaacucgaauacguggauguaguguucgcuaauagaccugauccuaauacaccaauggaggagacggugcgggcaaugacacaugucaucaaucagggaauggccauguauuggggaacgucuagguggaguagcauggagaucauggaggcuuauuccguggccaggcaguuuaaucugacaccacccauuugcgaacaggcagaauaccacauguuucagagagaaaaagucgaagugcagcugcccgaauuauuccauaaaaucggcguaggagcaaugaccuggucaccuuuggccugcggcauuguuucuggcaaguacgacaguggaauaccucccuacucgcgcgccuccuuaaagggauaucagugguugaaggauaaaauucuaagcgaagaaggaaggcgccagcaagcuaaauuaaaagaacuacaggcaauugcagagagacugggauguacacugccacaguuggccaucgcuugguguuuaagaaacgagggggugaguagcguucuucuaggcgccucaaacgcagaucagcuuauggaaaacaucggggcuauccagguucugccuaaacugaguuccagcaucauccaugagauagauagcaucuugggaaauaaacccuacucuaaaaaagauuaucgauccuag

SEQ ID NO: 249030 - RNA, 1209 nt, Artificial Sequence
  Description of Artificial Sequence: Synthetic coding sequence
augggcccgcugcccgccccuaguuguacacaacggauuacauggaagggccucuuacucaccgcuucccuguugaacuuuuggaaucccccuaccaccgccgaggucacaauagaagcccagccuccuaaaguuagcgaagguaaagacguucuacugcuaguucacaaucuuccacagaaccuuccaggcuacuuuugguacaaaggggaaaugacugacuuauaccacuacaucaucuccuauauuguggacggcaagaucauuaucuacgggccugcuuacucuggaagggaaacaguauauaguaacgcaagucuccugauucaaaauguuacuagaaaagacgccggaaccuacacucugcacauuaucaagcggggcgacgagacccgggaagagauucggcauuuuacguucacgcuauaccucgaaacccccaagccauauauauccucuagcaauuuaaauccgcgggaagccauggaggccgugcgacucauuugcgaccccgaaacacuagaugcaucuuaccugugguggaugaacgggcaauccuuaccagucacacaucgucugcagcugaguaaaacaaacaggacccuguaccuguuuggcgucacaaaguauauugcagguccauacgagugugagaucaggaauccaguguccgccagcaggagugauccaguaaccuuaaaccuccuccacggucccgaucugcccagaauuuauccuaguuucacauacuaccguagcggagagaaucuugaucuuucuugcuuuaccgaaaguaaucccccugccgaguauuuuuggacuauuaacggcaaguuccagcaaucuggccagaaacuguucaucccccaaauuacuagaaaccauuccgggcuguacgcuuguuccguucauaauucugcuacaggcaaagaaauaucaaagucuaugacggugaaagucagugguaaauggaucccugcgucacuagccgugggauuuuacguugaauccauuugguugagugaaaaaucccaagaaaauauuuuuauuccgucucuuugcccgaugggcacauccaaaucccagauacucuuacugaaucccccaaaucucucauuacagacauuguucucccucuucuuuugcuuccuuauggcugaucuggugucagggcuuaaaaagguggggagagggcucuaucagcccuag

SEQ ID NO: 249031 - RNA, 1281 nt, Artificial Sequence
  Description of Artificial Sequence: Synthetic coding sequence
augggccccuugccugcgccaucuuguacucaacggaucacguggaaaggccuguuacuuacugcaagccugcucaauuucuggaaccccccuacuaccgcggaagugacuaucgaagcucagccaccaaaggucucugagggaaaggauguccuguuguugguacacaaucuuccacagaauuuacccggguacuucugguacaaaggcgaaaugacagacuuauaccacuacauaauuucguacauaguugacgggaaaauuauuaucuacgggccagccuauucuggaagagaaacaguauacucaaacgccucuuuauuaauacaaaaugucacucgcaaggacgccggcacguauacucugcauaucauuaaacggggcgacgaaaccagagaagagauucgccacuucaccuuuacacuguaccuggaaacuccuaagcccuauauuaguucaucuaauuuaaauccuagagaagccauggaagcaguuagacucaucugugaccccgaaaccuuagaugcaagcuaucuuugguggaugaacgggcagucacugcccgucacacacaggcuacagcuguccaaaacaaaccgcacccuauaucucuucggggugaccaaauauauugcaggacccuacgaaugugaaaucaggaaccccgucagugcuucccgguccgauccugucacccuuaaccugcucccaaagcuccccauacccuauauuaccauuaauaaucuuaacccccgugagaacaaggacguccuagcauucacuugcgagcccaagucugaaaacuauaccuacauuugguggcucaacggucaaucucugcccgucucuccaggcgucaaacguccgaucgaaaauagaauccuuaucuuacccagcgucacacguaacgaaaccgggccuuaccaaugcgagauuagggacagguacggcggccugagaagcaauccagucauuuuaaaugugcuauacgguccugaccuaccucgcauauacccuaguuuuaccuacuauagaaguggcgagaaccuggacuuaucauguuucacagaauccaauccgcccgcugaguacuuuuggacaaucaacgguaaauuccaacaauccggucagaaacuuuuuaucccccagaucacccguaaucauagcggacuguaugccugcagcgugcauaauucagccacggguaaagaaauuagcaagucuaugacagugaaaguaucaggaccuugccauggcgaucucacggaaucccaguccuag

SEQ ID NO: 249032 - RNA, 723 nt, Artificial Sequence
  Description of Artificial Sequence: Synthetic coding sequence
augggaccucugccugcccccucuuguacccagcgaaucacauggaaaggccugcuguuaaccgccagccugcucaacuucuggaauccccccacaacagcggagguuacuaucgaagcacaaccgccaaaggugucggaagggaaggacguucuuuugcuaguacacaaucugccccagaaucucccaggauauuuuugguauaaaggcgaaaugaccgaucucuaccauuauauuauaucuuauaucguagauggaaagauuauuauauacgggccugccuauucagggcgcgaaacuguguauuccaaugccagucuccugauucagaacgugacuagaaaagacgccgguaccuacacauuacauaucauuaagagaggggaugagacaagagaagagauaagacauuuuacuuucacgcuguacuacggucccgaccucccgagaauuuacccuagcuucacuuacuaucggaguggcgaaaaccuagaccugagcugcuucaccgagagcaauccuccugccgaauacuucuggaccaucaaugggaaguuccaacagucuggacaaaaauuauuuauuccccagaucacuagaaaccauucuggacuauaugccugcagcguccacaauucagcaaccggcaaagaaauauccaagagcaugacaguuaaggugucuggaccaugccacggagauuuaacagaaucucagucuuag

SEQ ID NO: 249033 - RNA, 1164 nt, Artificial Sequence
  Description of Artificial Sequence: Synthetic coding sequence
augggaccacugccagcucccaguugcacucagcguaucacauggaaaggacugcuacugacagccagccugcugaacuucugguauaagggcgaaaugacagaccuguaucacuacaucaucucauauauaguggacggaaagauuauaauauacgggccagcauauuccggacgugaaacagucuauucuaacgccagucuguugauccaaaauguuacaaggaaggacgccggcaccuauacucugcauaucauaaaacgaggcgaugaaacaagagaagagaucaggcacuucacauuuacuuuauaccucgagacaccaaagccguauaucucaucuuccaaccucaaccccagggaggcuauggaagccgugcgccuuauuugcgaucccgaaacccuagaugcgucuuacuugugguggaugaacggucaaagccuuccagugacacaccgccugcaacuuucuaagacuaaccgaacacuuuaucuuuuuggcgucacaaaguauauagcugguccuuacgaaugcgaaaucagaaauccagucagugcuucuagaagugacccugugacucuaaaccuccuuccaaagcugcccauccccuauauaaccauuaauaauuugaacccacgcgaaaacaaggacguuuuagccuucacaugugagcccaagagcgaaaauuacacuuauauuugguggcugaauggacaaucccugcccgucuccccuggaguuaagcgaccuauugaaaaccgcauccugauccuuccgucugugacccguaaugaaacaggcccguaucaaugcgaaauucgagaucguuaugggggucuccgcaguaauccugugauacucaacguacuguacggcccagauuugccgcguauauacccuucuuucaccuacuacagauccggcgagaaucucgauuuauccugcuuuacagaauccaaccccccugccgaguacuuuuggacuauaaacggcaaguuucagcagucuggacagaagcuguuuaucccgcaaaucacacguaaucacagcggccucuaugccuguuccguccacaacuccgcuacagguaaagaaauuucuaagagcaugaccguuaaaguuucuggccccugccauggcgaucuuaccgagagucaauccuag

SEQ ID NO: 249034 - RNA, 1002 nt, Artificial Sequence
  Description of Artificial Sequence: Synthetic coding sequence
augggcccacugccugcuccuaguuguacucagcgcaucacauggaaagggcuucucuuaacugcaucacuccugaacuucuggaaucccccaaccacagcagaggugaccaucgaagcacagcccccuaaaguuucagaaggcaaagauguuuuauugcuggugcauaaccuaccccagaacuuaccgggguauuuuugguauaaaggagaaaugacugaucuuuaccacuacauuauuuccuauauugucgacggcaaaauuauuauuuauggaccugccuauuccgggagggaaacgguguacaguaaugcuagccuucugauccagaaugugacccgaaaagaugcugggaccuacaccuugcauauuauuaaaagaggagaugaaacccgagaagagauccgucacuuuaccuucacuuuguauagcaaacucccuaucccuuauaucacaaucaacaaccuaaauccucgcgaaaauaaggauguguuagccuucaccugugaacccaaguccgagaacuacacuuauaucugguggcugaacggccagucccuaccuguuagcccaggagugaagagacccauugagaaucggauucucauauuacccuccguuacaaggaacgaaacuggccccuaccaaugcgagauucgagaucgguauggcggacugcgcagcaacccagucauccugaauguccuguacgggccugacuuaccgcgcaucuacccgucauuuaccuacuauagauccggcgaaaaucuagaucugaguuguuucaccgaguccaacccaccugcugaauauuucuggacaaucaacgggaaauuucaacaauccggucagaagcuuuuuauaccacagauuacucgaaaucauaguggccuuuacgccuguaguguccacaauucagcaacagggaaggagaucaguaagagcaugacaguaaaagugaguggcccgugucauggagacuugaccgagagucagaguuag

SEQ ID NO: 249035 - RNA, 1485 nt, Artificial Sequence
  Description of Artificial Sequence: Synthetic coding sequence
auggcacgcgcugccccacugcuggccgcucucacggcacugcucgccgcugcugcagcaggaggugacgccccccccggcaagaucgcggugguuggugccggaaucggggguucagcuguggcgcacuuucuucaacagcauuucgguccuagagugcagauugacgucuacgaaaaaggcacagucggagguaggcucgcaacaauuagcgugaacaaacagcacuaugaauccggcgcagcaagcuuccacagccuaucuuugcacaugcaggauuucgugaaauugcucggauuaagacaucgucgcgaggucguugggagaucagcaauuuucggaggugagcacuuuaugcucgaggagacagauugguaccuguugaaccucuucaggcuuugguggcacuacggcaucucauuccuuagacuucagauguggguggaagagguuauggaaaaguucaugcggauuuacaaauaucaagcccauggcuaugccuucucugguguagaagaguuacuguacucacugggugaaagcacauucgugaacaugacacaacauagcgucgccgagaguuuacugcaggugggggucacccaaagauucaucgacgacguggucucagccguacucagagcaucauauggucaaagcgccgccaugccagcauuugcaggggcuaugagccuugccggcgcccagggcagcuuauggucuguugaaggaggcaacaaacugguaugcucuggacugcuaaaacucaccaaagcuaaugucauacacgcgacaguaaccagugucacgcuucacucaacagaaggcaaagcacuuuaccaggucgccuacgaaaaugagguuggaaauuccucugacuuuuacgauauaguggugaucgccaccccauugcauuuagauaacucauccucuaaucucacauucgcaggauuucauccuccaaucgacgauguucaaggcagcuuucaaccaaccguggugucucugguucacggcuacuugaacaguagcuauuucggcuuuccagauccaaaacuguuuccauuugcuaacauucuuaccacugauuuucccucauuuuucugcacuuuggauaauauuugcccugucaauaucagcgcuuccuuccgccgcaaacagccccaagaggcagccguguggcgcguucagucccccaagccgcuguucagaacucagcuuaagacacuauuccgcaguuacuauuccguccagaccgcagaguggcaagcccauccgcuguaugggagucguccuacgcugccuagauucgccuugcaugaucaacuguucuacuuaaaugcucuggaaugggcugcaagcuccguggaagugauggcuguggccgccaaaaacgucgcccugcucgcuuauaauagaugguaccaggaccuagacaaaaucgaucaaaaagaccugaugcacaagguuaagaccgaacuguag

SEQ ID NO: 249036 - RNA, 2277 nt, Artificial Sequence
  Description of Artificial Sequence: Synthetic coding sequence
augggaggcuguacgguuaaaccccaacugcugcuauuagccuuaguccuucaucccuggaacccaugucugggcgcagacuccgagaagcccucuucuauuccaaccgacaaacugcucgucauuacaguugccacuaaagagagcgauggguuucacagguucaugcagagcgccaaguauuucaacuacacggugaagguguugggucaaggggaagaauggagagggggagacggaauaaacagcauaggcggugggcagaaggucagacuaaugaaagaagucauggagcacuacgccgaucaagacgauuuaguagugauguucacagaaugcuucgacgugauauucgccggaggcccagaggaggugcuaaaaaaguuccagaaagcaaaccauaaggucgucuucgcugcugacgguauuuuguggcccgauaagcgguuggcugauaaauauccugugguccauauugguaagcgguacuuaaacuccgguggcuuuaucggcuacgcuccauacgugaaccgaauuguacagcaguggaaucugcaggacaacgacgaugaucagcuguucuauaccaaagucuacauugacccucugaagagagaagcuauaaauaucacacuggaccacaaaugcaagauuuuucagacccuuaacggggccguugaugaaguaguguugaaguuugaaaacgggaaagcucgcgccaaaaacacuuuuuaugaaacacugccuguggcgaucaauggaaauggacccacuaagauccucuugaacuacuucggaaauuacgugccuaacagcuggacacaggacaaugguugcaccuuaugcgaguuugauacugucgaccugagcgcgguggacguucaucccaaugugaguauugguguuuucauagaacagccuacgccauuccuuccacgguuucuagacauccugcugacucuggauuaccccaaggaagcucuuaaauuguucauccauaauaaggagguauaucaugagaaagacaucaagguuuucuucgacaaggcaaagcaugaaaucaagacaauuaagauagugggaccugaagaaaaucucucccaagcagaagcgcgcaauaugggaauggacuucugcaggcaggacgaaaaaugcgacuauuauuucuccguggaugcugacgugguuuugacaaauccgagaaccuugaagauacucauugagcagaaccggaaaaucauagccccuuugguaacgagacauggcaaauuguggagcaauuuuuggggggcccucagucccgaugguuauuaugcucguagcgaggacuacguggauauuguccaagggaacagaguaggcguguggaacguaccuuacauggcuaauguguacuuaaucaaaggaaaaacauuaagauccgaaaugaacgaaagaaauuauuuugugcgagacaagcuggaccccgauauggcacugugcaggaaugcgagagagaugacacugcagagagagaaagauuccccaacaccggagacauuccagaugcucagccccccgaaaggaguauuuauguacauaucuaaccggcacgaauuuggaagauugcucagcaccgccaacuacaauacaucccacuacaauaacgaucuguggcagauuuucgagaacccuguagacuggaaagagaaguauauaaacagagacuauucuaagauauuuaccgaaaacaucguggaacaaccuugccccgacguguuuugguuccccauuuucagcgagaaggccugcgaugagcugguggaagaaauggagcacuacggcaaauggagcggcgggaaacaccaugacaguaggauuaguggagguuacgagaauguuccaacugacgauauacauaugaaacaagucgaccucgaaaacguuuggcugcauuuuauucgggaguucaucgccccugucacccuuaagguuuucgcaggcuauuauacaaaaggguuugcucugcuaaacuuugucgucaaguacucaccagagagacaacgaagcuugaggccacaucacgacgcgagcacauucacuaucaacaucgcccugaauaacgucggcgaggauuuucagggaggagggugcaaguuucuaagguacaacugcucuauugaauccccccgcaaagguuggucauuuaugcaccccggcagacuuacucacuuacacgaagggcugcccgucaagaauggaacuagguacauugcagugaguuuuaucgauccguag

SEQ ID NO: 249037 - RNA, 2214 nt, Artificial Sequence
  Description of Artificial Sequence: Synthetic coding sequence
augggaggcugcaccgucaaaccacaacugcugcuacuggcccuggucuugcaccccuggaacccuugccugggcgcggauagcgagaaacccuccagcauuccaaccgauaaacugcuggugauuacaguugcuacaaaagagucugacggcuuccacagguuuaugcagagugccaaauauuuuaauuacacugugaagguccuuggucaaggggaagaguggcgggggggcgaugguaucaauaguauugggggcggacaaaagguaagacugaugaaagaggugauggaacacuaugcagaccaagacgaccucguugugauguucaccgaaugcuuugauguuaucuuugccgguggccccgaggagguccuuaagaaauuucaaaaagccaaucauaaagugguauuugccgcggauggaauccuguggccugauaagcggcuugccgauaaguauccuguuguccacaucgguaaacgcuaccugaacagcggcggcuucaucggauacgcccccuacgugaaucguaucgugcaacaguggaauuuacaagacaacgacgaugaucaacuguuuuauaccaaaguguacaucgacccgcuaaagcgggaagccauuaacaucacccucgaucauaaauguaaaauuuuccagacccugaacggagccguggaugaaguagugcuuaaauucgagaacggcaaagcacgugcgaaaaacacauuuuacgaaacccucccagucgcgauuaauggaaauggccccacaaagauucugcuaaauuauuuuggcaauuacgucccaaauaguuggacccaagacaacggauguacccugugugaauucgauacuguugaccugucugcuguugacguccaucccaaugucucuaucggaguguucauugaacagccuacccccuuccuuccccguuuccucgauauucuccucacccucgauuaccccaaagaggcucucaagcuguucauucauaacaaggagguguaccacgaaaaagacauaaagguguucuucgauaaagcgaaacaugagauaaagaccaucaagaucgugggccccgaagaaaaucucucccaggcugaggccaggaacaugggaauggacuuuugccggcaggaugaaaaaugcgacuauuacuuuucugucgacgccgauguuguuuuaacaaacccuagaacacuaaaaauccugauugaacagaacaggaaaauaaucgccccacuggucacacgacacggcaagcugugguccaauuuuuggggggcccucucacccgauggauauuaugcacggucugaggauuacgucgacauuguucaagguaacagaguuggggucuggaauguaccuuacauggcaaauguguaucuaauaaaagguaaaacacuucguagcgagaugaaugaacgaaacuauuuuguccgggauaaacuggauccugauauggcccuuugucgcaaugcacgggagaugggagucuucauguacauuucuaaucgccacgaauuuggucgccuccuguccaccgcuaacuauaacaccucccauuauaacaacgaucuguggcaaauuuuugagaacccagucgacuggaaggagaaguauauuaaccgagacuauagcaagaucuucacagagaauauuguugaacagcccuguccagacguguuuugguucccgauuuuuucagaaaaagccugcgaugaacuugucgaagaaauggagcauuauggcaaaugguccggcgguaagcaccacgauagccggaucuccggaggguaugagaaugugccaacugaugacauccacaugaagcagguggauuuagaaaacgucuggcuccauuucauccgugaguucaucgcacccguuacauuaaagguuuucgccgguuacuacacuaagggcuuugcucuguuaaauuucgucgugaaguacaguccugaacgccaaagaagucuccgaccacaccacgacgccuccaccuuuacaauuaacauugccuugaauaaugugggggaggauuuucaaggaggagguugcaaguucuugagauacaauugcuccauagaaagcccuagaaaaggauggucauucaugcauccaggccgacucacccaucuccaugagggccucccugucaaaaauggaacccguuauauugccguguccuuuaucgaccccuag

SEQ ID NO: 249038 - RNA, 1257 nt, Artificial Sequence
  Description of Artificial Sequence: Synthetic coding sequence
augcucgaaaaccacauccuccacaagcgcauuuacauucucacauucuucucccagcagauauuuauccucugucacgcacacuuuauuuucuucuuuacuguuagagacuuuugucgccaggacgagaagugcgauuauuacuuuucgguggaugcagauguuguccugaccaacccuagaacccuaaaaauuuugauugaacagaaccgcaaaauuaucgccccacucguuacuagacauggcaaacuguggagcaauuuuuggggagcauuaagcccugacggauacuaugccagaagcgaggauuacgucgacauaguucagggaaacagagucggcguguggaacguaccguacauggccaauguauacuugauuaaaggaaagacccuuagaagcgaaaugaaugagaggaacuacuucguaagagacaaguuagauccagauauggcccuuuguagaaaugccagagaaaugacgcuacaaagagagaaggauuccccaaccccagagacauuccagaugcuguccccacccaagggaguauuuauguauaucaguaaccgucacgaguucggacgguuacuuagcacagccaauuacaauacaagucauuacaacaacgaucuguggcaaaucuuugaaaacccuguggacuggaaggaaaaguauauuaaccgagauuacuccaagauauucaccgaaaacauuguugagcagccuugccccgacgucuucugguucccaauauucuccgaaaaggcuugcgaugagcugguggaagagauggaacauuacggcaaguggucuggcggaaagcaucaugauagcagaauuagcgggggauaugaaaacguuccuacugacgacauucacaugaaacaagucgacuuggaaaacgucugguuacacuucauccgcgaauuuaucgcuccagugacacugaaagucuuugcuggcuauuauacaaaaggcuuugcucuucucaauuucgucgucaaguauuccccagagaggcaaaggagucuuaggccacaucaugaugcguccacuuuuacuaucaauaucgcccugaacaacgugggugaagauuuccaaggcggaggauguaaauuuuuaagguacaacugcuccauugagagcccacggaagggcugguccuuuaugcacccuggcagacugacucaucuucacgaaggccuaccuguaaagaauggaacccgauauaucgcugugagcuucauugacccauag

SEQ ID NO: 249039 - RNA, 2112 nt, Artificial Sequence
  Description of Artificial Sequence: Synthetic coding sequence
augcaaucagcuaaguacuucaacuauacagucaaggugcugggucagggagaagaguggcgagguggcgaugguaucaacuccauugggggugggcaaaaggugcgauuaaugaaagagguuauggagcacuaugcugaucaggaugauuugguagucauguuuacagaauguuucgaugugauuuuugccgguggccccgaagaaguuuugaaaaaauuucagaaggcuaaccacaaggucgucuuugcugcagacggaauccuguggcccgauaagagauuagccgacaaauauccaguggugcacaucggaaagcgauaccugaacuccggcggcuucauaggauacgcccccuacgugaacagaaucguacaacaguggaaccugcaggauaaugacgacgaucaacucuucuauaccaaaguguauaucgacccauuaaagagagaagcuaucaacauaacacuugaccacaagugcaaaauuuuucagacacugaacggcgcgguagaugaggugguuuugaaguucgagaacgggaaagcacgagcuaagaacacauuuuacgagacccugccuguagcuaucaacgggaauggacccaccaagauucuucugaacuacuuuggcaacuacguuccuaacucuuggacccaggacaauggcuguacuuuaugugaguuugauacuguggaucuuagcgcuguagaugugcacccuaacgucucaaucgguguguuuauugaacagccaaccccuuuucugcccagauuccucgauauuuugcucacccuugacuauccuaaggaagcccucaagcuguuuauucauaacaaagaagucuaucacgagaaggauauaaagguauucuuugauaaagcaaagcacgagauuaaaaccauuaagauagucggaccagaagaaaaucucucacaggcugaggcgcguaauauggguauggacuuuugccggcaggacgaaaaaugcgauuacuauuuuucagucgacgcugauguuguccucacaaauccccggacccuaaagauccucauugaacagaacaggaagauaauugcuccccuggugaccagacacggaaaacucuggaguaauuuuuggggggcacuuagccccgacggauauuaugcaaggagugaagauuauguggacaucgugcaaggaaaccgaguggguguguggaaugucccuuauauggccaacguuuaccucaucaaagguaagaccuugcgcucagagaugaaugagcgaaacuacuucguacgggauaaacuggauccggauauggcccuguguagaaacgccagggaaaugacacugcagcgcgaaaaagauaguccaacaccagaaaccuuccagaugcugagcccuccaaaagguguguuuauguauauuuccaacaggcaugaauucggucgccuccuaucaacagcgaauuacaauaccagccacuacaacaacgaccuauggcagaucuuugagaauccggucgauuggaaggagaaguauaucaaucgagacuauagcaagauuuuuacggaaaauauugucgagcagcccugcccagacguguuuugguuuccaaucuuuucagaaaaggcaugugacgaguuaguggaggaaauggaacauuauggcaaauggucaggcgggaagcaucaugacucaagaauuucuggagguuacgagaacguaccaacugacgacauucacaugaaacaaguggaucuagaaaaugugugguuacauuuuauuagggaauuuauagcuccuguuacccugaagguguucgccgguuauuacacuaaaggauuugcucugcuaaauuucgugguuaaguacucucccgaaaggcagcgaucccuccgaccucaccacgaugccaguacauuuacaauaaacauugcucuuaauaauguuggggaggauuuccaagguggcggcuguaaguuuuugcguuauaacugcuccaucgagucaccucgcaaaggcuggaguuucaugcaccccgguagacugacccacuugcacgaaggauugcccguuaaaaacggcacucgauauaucgccguguccuuuaucgacccuuag

SEQ ID NO: 249040 - RNA, 1608 nt, Artificial Sequence
  Description of Artificial Sequence: Synthetic coding sequence
augaaacugugggugagugcacugcugauggcaugguucggcguccuuucaugcgugcaggcugaguuuuuuacaaguauagggcauaugaccgacuugauuuaugcugagaaagagcucguucagagucuuaaggaguacauccuggucgaggaagcuaaacucucuaagaucaagucaugggcaaacaaaauggaggcucucaccucuaaauccgcagcugaugcagagggcuaccuggcgcaccccguuaacgcuuacaaauuggucaagagauuaaacaccgauuggcccgcuuuggaggaccucgugcuccaagacucugcagccggauucaucgcaaaucuguccgugcagaggcaguuuuuucccacugacgaagaugaaaucggcgcagccaaagcccuuaugagacugcaagauaccuacagauuggaccccggaacuauaucacggggcgaacugcccggcacaaaguaucaggcuaugcucuccguagacgacugcuuugguauggguagaucagcauauaacgaaggagauuacuaccauaccguucuauggauggaacaaguacucaagcaacuagacgccggugaggaagccacaaccacaaagucccaaguguuagacuaucucuccuacgccgucuuccaguuaggagaccugcaccgagccuuggagcugacucgucgccugcuaagccuggauccaucacacgagcgcgcuggcggaaaccugagguacuucgagcaacugcuugaagaagagagagaaaaaacacuuaccaaccagacugaagccgaacucgcuacaccagagggaaucuaugaacggccuguggauuauuuacccgaacgugauguguaugaaucccugugcagaggugaaggugucaagcuaaccccccguagacagaaacgccucuucugucgguaccaucacggaaaccgcgcuccacagcugcugauugcuccuuuuaaggaggaagacgagugggauuccccucauauugucagguacuaugaugucaugucagaugaagagaucgagcgcauuaaggagaucgccaagcccaagcuggcccgagcaacaguuagggacccuaaaaccggaguacugacaguagcaucauacagggugaguaaaucaagcuggcuggaagaagacgaugauccgguugucgcccgcguaaaucgccggaugcagcauauaaccggccugacagugaagacagccgaacuucuccagguagcaaauuacggcguuggcgggcaauaugaaccucauuucgacuuuucuagaaaugaugaaagggauacauucaagcaucuuggaaccgggaauagggucgccacauuucuuaauuauaugagugaugucgaagcugguggcgccaccguguuucccgaccugggcgcggcuauauggcccaaaaaaggcacagcaguauucugguauaauuuauuacggaguggcgagggagauuacaggacacgccaugccgccuguccagugcuggugggcuguaaguggguuaguaauaagugguuccaugaacgcggacaggaguuucuucgaccuugcggaucaacugaaguggauuag

SEQ ID NO: 249041 - RNA, 1635 nt, Artificial Sequence
  Description of Artificial Sequence: Synthetic coding sequence
augggcccuggugcaagacuggccgcauugcuggcugugcuggcccuggggacuggugaucccgaaagagccgcagcacggggagauacguuuucagcccuaaccucaguggccagagcacucgcgccagaaagaagacuucuuggccuguugagacgguaucugcgcggcgaagaagcucgccuccgcgaucugacaagauucuaugauaaaguccucucccuucacgaggauagcacaacgccuguugccaacccauuacucgccuucacacugaucaagcggcugcagagcgauuggaggaacguugugcauagccucgaagcuagcgaaaacauaagagcccugaaggacggauacgaaaaggucgaacaggauuugccagcauuugaagaccuggagggugccgcucgcgcccugaugcggcugcaggaugucuauauguugaaugugaaaggacuagcacguggaguguuucaaaggguuacagggucugccauuacugaccuguauaguccuaagagacuguucagccugacuggggaugacuguuuucaggucggcaagguagccuaugacaugggggauuauuaucacgcuauuccauggcuagaggaggcuguuagccuguuucgaggaucuuauggcgaauggaaaacugaggaugaagcaucccucgaggaugcgcuugaucaccuggcauuugcuuacuucagagcuggcaacguuucaugugcgcucagccucucucgugaauuccuucuuuauuccccagacaacaaacgcauggcaagaaacguucugaaauacgagcgucuccuugcugaaucgcccaaccaugucguugcagaggcggucauacaaaggcccaauaucccgcaccuucaaacccgagacaccuaugaaggguugugucaaacccuaggcagccaaccuacccuguaucagauacccucccuguacuguucguacgaaacaaacucuaacgcauaccuguuguugcagcccauaagaaaagaagugauccaccuagagccuuacauagccuuauaccacgauuucgucucagauuccgaagcccagaagauaagagagcuggcggagccauggcuucagcggucugucgucgcuagcggggaaaaacaacuccagguggaguauagaauuucuaagucagccugguugaaagacacuguugauccgaagcuggugaccuugaaucaucggaucgcugcacugaccggauuggacgugcgaccaccauacgcugaauaucuccaagucgugaauuacggcaucggcggacacuacgaaccccacuuugaucacgcuacauccccaagcagcccuuuauauagaaugaaaagcggaaaccgcguggccacuuucaugaucuaccucagcucaguggaggcaggaggcgcgacggcguuuaucuaugcaaaccuaagcgugccaguuguccgaaacgccgcccuguuuugguggaacuuacauagaucuggagaaggugauucugauacccuacaugcuggauguccaguucucgucggcgacaaauggguagcaaacaaguggauacacgaauacggccaagaauuccggcgccccuguaguagcucuccugaggacuag

SEQ ID NO: 249042 - RNA, 1815 nt, Artificial Sequence
  Description of Artificial Sequence: Synthetic coding sequence
augggcccaggcgcccgccuugcugcacugcuggccgugcuagcacuugguacgggggauccugaaagagcugccgccagaggagacaccuuuuccgcacugacuuccguugcucgagcccuugcgcccgaaaggcgcuugcuaggccuucugcgcagguaucugagaggagaagaagccagauuacgugaucugacucgguucuacgacaaaguucucagccugcacgaagacucuaccacuccagucgccaacccuuuacuggcuuuuacgcugaucaaacggcuucaguccgacuggagaaacguggugcauagcuuggaggcauccgaaaacaucagagcauugaaagacggguacgaaaaaguggagcaagauuuaccggcuuucgaggacuuagagggagccgcacgggcacuuaugagacuucaagacguguacaugcuuaaugugaaagggcuggcccggggaguguuccaaagagugacaggcagugccaucacugaccucuacagcccaaaacgacuguuuucuuuaaccggugaugacuguuuccaagucggaaagguggcauacgacaugggcgacuauuaucacgccaucccauggcuggaggaggccgugucacuguuucgagggagcuauggagaauggaaaacagaagacgaagcguccuuggaagacgcucuugaccaccuugccuucgccuacuuucgcgccggaaauguuagcugcgcucugagccugucuagagaguuucucuuguacucacccgauaacaagcgaauggcccggaacguccugaaauaugaacgacuccuugcugagagccccaaccacgugguagccgaggcggucauccagaggccgaauauuccccacuuacagacacgagacacuuacgaaggccuaugucagacgcugggaagccaaccaacgcuguaucagaucccauccuuguauugcuccuacgaaaccaauuccaacgccuaccuacuuuugcagccaauuagaaaggaagugauucauuuagaaccauacauagcccucuaucaugacuuugugucugauagcgaagcacaaaagauuagggaacucgcagagccguggcugcagcgcucugucguugcguccggugaaaagcaauuacaaguggaauacaggauuaguaagucagccuggcucaaagacacuguugaccccaagcuggucacgcuuaaucaucgaaucgccgcccucaccgggcuagaugugcgcccucccuaugccgaguaucugcagguggucaauuacggcaucggaggacacuacgaaccccacuuugaccaugccaccucaccuucaaguccacuguauagaaugaaaagcgguaauagaguagcgacauucaugaucuaccuguccagcgucgaagccgggggagcuacugcuuucaucuacgcaaaccuguccgugccaguugugcggcauuguuuuggaggcacauguacugggguugugaagggcaccguuacucacuuuaugcuagccguucugucuuggugggaaauauccggguggccaacaucaggauauaugucaauggaccggaauuccgcugaucccgcugcaccagcccucaagacugaacuuuuggcagagcguucaugguggucuccgguagcguuccagcgcucccaggaaccuaaagcuggaguuggugaagagaaagcugaacaacccccuggcaggaggccuugucagcugugucuaugccuagccaaccaaagacaggggcgaggcuguuaucaaggaacacuuaggauguacauauag

SEQ ID NO: 249043 - RNA, 417 nt, Artificial Sequence
  Description of Artificial Sequence: Synthetic coding sequence
aauauaagccugugucccgaaauuugcuuucagaaaauugagucacaaguuuacuucguuagaguggauaguggaauucagccaggcucugauaucucgauuuacuacgaccccaugauaagcaaacuaauaacuuacgggucugaccgcacugaggcucuuaaaaggauggccgacgcgcucgauaauuacguaauaaggggggucacccauaauauagcacugcuuagagaagugauuauuaauucuagauucgugaagggcgauauaucuacuaaauuuuuaucagacgucuaucccgacggguuuaaaggacacaugcucacuaagucagaaaaaaaucagcuccuagcuaucgccucuucccuguuuguugcauuccaauugagagcccagcauuuccaggagaacagcuag

SEQ ID NO: 249044 - RNA, 363 nt, Artificial Sequence
  Description of Artificial Sequence: Synthetic coding sequence
auguccauccaauuucuugggacuguguacaaggucaauauucucacuagacuugcagccgaauugaacaaauuuaugcuugagaaaguuacggaggacacaucuagcgugcugcgaaguccaaugccuggaguggugguggccguuucuguuaagccuggcgaugcagcgacaaguagccugagcguugagauuugccuguuuuggaccuuccagguugcggagggccaggagauuugugugauugaagcaaugaaaaugcagaauagcaugacugcuggcaagacuggaaccgucaaaucagugcacugucaggcuggggacacagucggggaaggcgauuuguuaguagaacucgaguag

SEQ ID NO: 249045 - RNA, 2046 nt, Artificial Sequence
  Description of Artificial Sequence: Synthetic coding sequence
auggcaggcuucuggguugguacagcaccccuaguggccgcagguagacgcgggagguggccuccucagcaacucaugcuaucugcagcucuccggacacugaagcauguacuguacuacagccgacagugccugaugguuucucggaaccucggcagugugggguacgauccaaaugagaagaccuuugauaagauccugguggccaaucgaggugagauugccuguagagugauuagaacaugcaagaagaugggaauuaaaacgguggcuauucacagcgacguugacgcuucuagcgugcacguaaagauggcggacgaagccgugugcgugggaccugccccuacaucgaaaucuuauuuaaauauggaugcaaucauggaagcuaucaagaagacgcgcgcucaggccguucaucccggauacgguuuccucuccgagaacaaagaauuugcccgaugccuggccgccgaagauguuguauuuauuggccccgauacacaugccauacaggccaugggugauaagaucgagucgaagcugcuggccaaaaaggccgagguaaacaccauuccagguuuugauggagucguuaaagacgccgaggaggcagugagaauugcucgggagauuggcuacccugucaugauuaaggccagcgccggcgggggggggaagggcaugcguauagcuugggaugacgaggaaacacgugacggguuuaggcugaguucacaggaagccgcauccucuuucggggacgaccggcugcugauugagaaauuuauagacaaccccagacacaucgagauucagguacucggggauaaacauggcaaugcguugugguuaaaugagagggaauguaguauacagaggaggaaccagaagguaguggaggaggcuccuagcauauuccuugaugccgaaacccgcagagcgaugggcgaacaggcaguggcccucgcacgcgcugucaaguauucaucugcugguaccgucgaguuccuuguagacagcaaaaaaaacuuuuauuuccuagagaugaacacaaggcugcaaguggaacauccagucaccgaaugcauuaccgggcucgaccugguacaagagaugauccgugucgcgaaaggauauccccugaggcauaagcaagcugacaucagaauuaauggcugggccguggagugccgagucuaugcugaggauccuuauaagaguuucggacuuccuuccauuggacgacugucccaguaccaggagccacuucauuugccugguguccgggucgacucggggauucagcccggcuccgacaucucaauuuacuaugacccuaugauaucaaaacuaaucacuuaugggagcgauaggaccgaagcccugaaaagaauggcugacgcauuagauaauuaugugauucggggcgugacacauaacauugcacugcugagagaggucauuauaaauagucguuucgucaagggcgacaucuccaccaaauucuugagcgauguguacccagacggauucaaagggcacaugcuuacaaaaucagagaagaaucagcuccuugccauugcuagcagccucuucguggcuuuucagcuuagagcucagcacuuucaagaaaauuccagaaugccuguuauaaagccggauaucgccaauugggaacugagugucaaguuacaugacaaggugcauaccguaguagccucaaacaacggaaguguguucagcguggaaguggauggcagcaaauugaaugucacuucaacauggaauuuagccuccccucuucuguccgugagcguugauggcacacagcgaacgguucaauguuuaucgcgagaagccgguggcaauaugagcauccaauucuuggggaccgugguggcggaggggcaggaaaucugugugaucgaggcuaugaagaugcagaacucuaugacagccgggaaaacaggaacuguaaagucgguccacugccaggcuggugauaccguaggagagggcgacuugcuaguggagcuggaauag

SEQ ID NO: 249046 - RNA, 2187 nt, Artificial Sequence
  Description of Artificial Sequence: Synthetic coding sequence
auggcaggauucuggguggggaccgccccacugguggcggccggucgacgggguagauggccaccccagcaacucaugcuaagugcagcuuuacggacauugaagcacgugcucuacuauucaaggcagugccugaugguaucacgaaaccucggcaguguaggauaugaucccaacgaaaaaacauuugauaaaaucuugguggcaaacagaggagagaucgccugcagggucauccgaacuuguaagaagaugggcaucaaaacugucgccauacacucugauguugaugccagcagcguucacguuaaaauggccgacgaagcagugugcgugggacccgcuccaaccuccaagaguuaccugaauauggacgcuaucauggaggccauaaaaaaaacaagagcucaggccguacaccccggauaugguuuucucagcgagaauaaggaguuugcgaggugccuggccgccgaagaugucguguuuauugguccagauacucaugccauccaggccaugggagauaaaauugagucuaaguuauuagcuaaaaaagccgagguuaacaccaucccgggcuucgacgggguaguaaaagacgccgaagaagcugugagaauagcaagggagauuggcuauccugugaugaucaaagccucagcuggaggcggcggcaaggguaugcgaauugcaugggacgacgaagaaacaagggacggguucagacuaaguagucaggaggcagccucauccuuuggcgaugaccgucugcuuauugagaaguucaucgauaauccccgacauaucgaaauacagguacugggcgacaaacauggaaaugccuuauggcuuaacgaacgcgaguguagcauacagcguaggaaucagaaaguuguggaagaggccccaucaaucuuucucgaugcugagacucgccgagcuaugggggagcaggccguggcccuugcccgagcagucaaguauucgagugccggaaccguggaguuccucguggauucaaaaaaaaacuucuacuuucuggaaaugaauacacgccugcaagucgagcaccccgucaccgaguguauuacuggguuggaucugguucaggaaaugauuagaguggcaaaaggguacccccucagacacaaacaggcugacaucaggauuaacggaugggcaguugaauguaggguauacgccgaagauccauacaagaguuucgggcugccaucuauaggacgucuuucucaauaccaagagccccugcaccugccuggcguacgggucgacaguggaauccagccuggcuccgacaucuccauuuacuaugauccaaugauuagcaaauugaucacuuacgggucggacaggaccgaagcauuaaagagaauggccgaugcccuugauaacuacgucaucagaggcgugacacacaacauugcuuugcuuagagaggugauaaucaauagucguuuugugaagggggacaucuccaccaaauuucuuagugauguguauccggacggauucaagggccauaugcugaccaagagcgagaaaaaucaacuccuugcaaucgcuucaucccuguuuguggcuuuucagcuccgcgcucagcauuuccaggaaaacaguagaaugccaguuaucaagcccgacaucgcaaacugggaauugucugucaaacugcaugauaaggugcacaccgugguugcuucuaauaaugguucuguauucuccguggagguugacgggucuaaacucaaugucacaucuacauggaaccuagcuuccccuuuacugagcgugucuguggacggaacacagaggacugugcaaugccuuagcagagaggcagggggaaacaugaguauccaguuucugggcacuguguacaaagucaacauucuuacacgucuggccgcugagcugaauaaguuuauguuagagaaagucaccgaggauacgucaucuguccugagguccccaaugccuggcguggucguugccguaaguguuaagcccggagaugcaguggcagaagggcaggagauuugugugauagaagccaugaagaugcagaauaguaugacagcgggaaagacgggaacagugaaaucugugcauugccaggcaggcgauacaguuggugaaggggaucucuugguagagcuugaguag

SEQ ID NO: 249047 - RNA, 2109 nt, Artificial Sequence
  Description of Artificial Sequence: Synthetic coding sequence
auggcuggguucuggguggguacagcuccucucguggcggcugggcggagaggcagauggccgccacagcaguugauguuauccgccgccuugcgcacucucaaaacauuugauaaaauacugguugcgaaccggggcgaaauugcaugcaggguaaucaggacuuguaaaaagaugggcaucaagaccguagcuauucauuccgaugucgacgcuucuuccgugcacgugaaaauggcugacgaggcagucuguguggggccugcaccaacgucuaaaaguuaccugaacauggaugcuauaauggaagcuauaaaaaagacaagagcucaggcaguccauccaggauacgguuuucugagcgagaacaaggaauucgcccggugccucgccgcggaggauguuguauuuauuggcccugauacccacgccauccaggcaaugggagauaaaaucgagucaaaauugcuggcaaaaaaagccgaggucaacacgauaccuggcuucgacggaguugugaaggacgcagaagaggccgugagaauagcccgagagauagguuacccuguaaugaucaaagccucggccggggggggggguaaaggaaugcgaauugcaugggaugaugaagagacaagggacggguucagacugaguucacaggaagccgcgagcagcuuuggagaugaccgucugcuuauagaaaaauuuauugacaaccccaggcauaucgagauacaagugcugggggauaaacauggcaacgcucucuggcuuaaugagcgggaguguaguauacagagacgcaaucagaaggucguggaagaagccccuuccauuuucuuggaugcagaaacaagaagggcaaugggcgagcaggcagucgcgcuggccagggccguaaaauauuccucugcgggcacgguugaauuccucguggacagcaagaagaacuuuuacuuucuggaaaugaauacacggcuacagguugaacauccagugacagagugcaucacuggccuggaccucgugcaagagaugauaaggguagcaaagggauauccacugagacacaaacaggcugacauuagaauaaauggaugggcaguggaaugccgcguguaugccgaggacccauacaagucauuuggacuuccuucuaucgguagauuaucccaguaucaagagccccuccaucugcccggcguuaggguagacuccgguauccaaccugguuccgauauaagcauauacuaugaucccaugauaagcaaacuaauaacguacgggagugaucguacagaggcccugaaacgcauggcugacgcccuugauaauuacgugauccguggugucacucacaauauugcccugcuccgugaagugauuaucaauucuagauuuguaaaaggggacaucucuaccaaguucuuaucugacguauacccagacggguucaagggacacaugcucaccaagagcgaaaaaaaccaacucuuagcaauugccucaagccuuuuugucgcauuccaacugcgugcccagcacuuucaggaaaacaguagaaugccuguuauuaaaccagacauagccaauugggagcugagcguuaaacugcacgauaaaguacacacugugguugccucuaacaauggcucgguuuuuagcguugagguagauggaagcaaauugaacgugacuaguacauggaauuuagcgucaccuuuacuuuccgugagcgucgacgguacgcaacggaccguacagugucuaucucgagaggcaggcgguaauaugucaauucaguuuuuaggaaccguuuacaaagucaauauucucacaaggcuugcugcagagcucaacaaguucaugcuggagaaaguuacagaagacacaagcuccguacugagaagucccaugcccggggugguggucgccgucucagugaaaccaggggacgccguugcagaaggacaagagauuugugugaucgaggcuaugaaaaugcagaacagcaugacugccgguaaaacaggcaccgugaagagcguacacugccaggcuggggacacagugggggaaggcgaccugcugguggagcuggaauag

SEQ ID NO: 249048 - RNA, 255 nt, Artificial Sequence; identical to SEQ ID NO: 248442
  Description of Artificial Sequence: Synthetic coding sequence

SEQ ID NO: 249049 - RNA, 336 nt, Artificial Sequence
  Description of Artificial Sequence: Synthetic coding sequence
uauaaaguuaauauucuuacacgacuggccgcugagcucaauaaguuuaugcuagaaaaagugacagaagauacgucaagcguccucagauccccuaugccugguguagucguugcgguuagcguaaaacccggagacgcagcaacuuccucccuaucugucgagaucugucuguuuuggacuuuucaaguagcggaaggacaggaaauuugcgugaucgaggcgaugaagaugcagaauagcaugacagcgggcaagacgggaaccgugaaaucagugcauugccaggcaggggacaccgugggagagggcgaucuguugguggaguuggaauag

SEQ ID NO: 249050 - RNA, 405 nt, Artificial Sequence
  Description of Artificial Sequence: Synthetic coding sequence
uagaugccagugauaaagccagacauugcuaacugggaauuaucgguuaaauuacacgacaagguccacacagugguggcaucuaauaauggaucugucuucuccgucgaaguggauggcuccaaacuuaaugugacaaguacuuggaaccucgccucaccucuacucagugugucaguggauggaacucagagaacaguccagugccugucuagggaggccggagggaauaugaguauucaguuccucggcacaguggucgccgaaggucaagaaauuugcguaauugaagcaaugaagaugcaaaacuccaugaccgcaggcaagaccggaacaguuaaaagugugcauugccaggccggagacacagucggggaaggagauuuacucguagagcuugaauag

SEQ ID NO: 249051 - RNA, 309 nt, Artificial Sequence
  Description of Artificial Sequence: Synthetic coding sequence
ucagauguuuaucccgacgguuucaaaggccacaugcugaccaaaagcgaaaaaaaccaguugcuggcaaucgcaucuucacuguucguugccuuccagcuuagagcacagcauuuucaggagaauucgcggaugccaguuauaaagccagauauagcgaauugggaacugucuguuaagcugcaugacaaaguacacacugugguggcguccaacaacgguuccguuuuuucaguggagguggauggauccaaacugaacgucacuucaacauggaacuuauuugcucucauuguuugucagcgauag

SEQ ID NO: 249052 - RNA, 483 nt, Artificial Sequence
  Description of Artificial Sequence: Synthetic coding sequence
auggcaacccaucacacccuuuggaugggcuuagcuuugcugggagugcuuggggauuugcaggcagcccccgaagcccaggugagcgugcagccuaacuuucaacaggacaaguuccucggucgaugguucuccgcuggacuggccuccaacagcagcuggcucagagaaaagaaggccgcccuuucgauguguaaaucuguagucgcccccgccacugacggugguuuaaaccugacgaguaccuuccugaggaagaaucagugcgagacuaggacuaugcucuugcaacccgcugggagccucggcucauauucauaccguuccccaagagaguggggacugcaccgaccaccaggcccuucccuaggagcaaccuuggccgguacaaccuuaggucaaccccccgcugcagaaauccauggaguuggaggcgacgguugcccaacauccgucagaggaaagggccaggcaugggcauag

SEQ ID NO: 249053 - RNA, 573 nt, Artificial Sequence
  Description of Artificial Sequence: Synthetic coding sequence
auggccacacaucacacucuuuggaugggauuggcuuuacucgggguccucggggaccuucaggcagccccugaagcgcagguuagcguucaaccaaauuuucagcaggauaaguuucuaggacggugguucagcgcaggccuugcauccaauaguucauggcugagagaaaagaaagcagcccuuucuauguguaagaguguugucgccccggcuacagauggcggacugaaucugacuaguaccuuccugaggaaaaaucagugugagacucggacaaugcuacuucagccagcaggcucacugggcucauacucauacagaucgccacacuggggcucuaccuauagcgugagcguugucgaaaccgauuacgaccaguacgcccuccuuuauucccaaggcagcaaaggcccuggcgaagacuuccggauggcaacucucuacucucggacacaaacaccgcgagcagaguuaaaagaaaaguuuacagcguuuuguaaagcacagggauuuaccgaggacaccauuguguuucugccucagacagacaaaugcaugaccgagcaguag

SEQ ID NO: 249054 - RNA, 189 nt, Artificial Sequence; identical to SEQ ID NO: 248448
  Description of Artificial Sequence: Synthetic coding sequence

SEQ ID NO: 249055 - RNA, 642 nt, Artificial Sequence
  Description of Artificial Sequence: Synthetic coding sequence
uagcugaggggaggugggcaguuucuaggaaggggcgugcgcgguguggccgcgagagggauuggacggggagggggcgcgggguuagaaacaggcggaguggauggccggggcgcaccugcagggcgcaggagaugggugcgcagaguucuggcagaugcgggcggcggacgaaguccacaauuuuugggaagaugguuuagcgcuggccuggccucgaauagcagcuggcugcgggagaagaaggcggcucuguccauguguaaauccgugguggcgccagcuacagacggcggguugaaucugaccagcacauuccugcgaaagaaucagugcgagacccgcaccaugcuacuacagcccgccggcaguuugggcucuuacagcuacagguccccgcauuggggcuccacauauuccguuuccgucgucgaaacugacuacgaucaauaugcccuccuguacucccaaggauccaagggaccaggcgaagacuuucgcauggccacauuauauucccggacucagacuccaagagcagaguuaaaagagaaauucaccgcauuuuguaaagcgcaaggcuucacagaggacaccaucgucuuccuuccccagaccgauaaguguaugaccgaacaauag

SEQ ID NO: 249056 - RNA, 588 nt, Artificial Sequence
  Description of Artificial Sequence: Synthetic coding sequence
auggcaacucaccauacccuguggauggguuuagcucuccugggaguauugggugaccuacaggcagcaccagaagcccaaguuagcguacagccgaacuuccagcaggauaaauuucucgggcggugguucagcgccggacuggccaguaacuccucguggcuucgggaaaaaaaggcagcacucaguauguguaaguccgucguagcgcccgccaccgauggaggccugaauuugacgucuaccuuccugcgaaaaaaccaaugcgagaccagaacaauguuacugcagccugcaggaagucuugguagcuauucauauaggagcccaagagaguggggauugcaccgaccuccaggcccuuccuugggugcaacucuggccggcacaacguuggggcaaccaccagccgcagaaauucauggcgugggcgacuggggcagcacuuacagugucuccguggucgaaacugacuacgaccaauaugcuuuauuauauagccaaggauccaaaggacccggggaggauuuuaggauggcaacucuguauuccagaacccaaacuccacgcgcugaguugaaagaguag

SEQ ID NO: 249057 - RNA, 573 nt, Artificial Sequence
  Description of Artificial Sequence: Synthetic coding sequence
auggccacucaccauacccucuggaugggccuagcccuucucggaguucugggcgaccugcaagccgcacccgaggcgcaggugucaguucagccaaacuuccagcaagauaaauuucugggaagaugguucuccgccgggcucgccucuaacucuucauggcucagggagaagaaggccgcucucaguaugugcaagucugucguagcaccagccaccgauggcggccuaaaccugacuucuacauuccuacgcaagaaucagugcgaaacaagaacaaugcuccuccaaccugcaggaucacugggcuccuauuccuaucgcucgccacauuggggaagcacuuacucgguaucugucguugagaccgacuacgaccaauaugcccuccuguauucgcagggcaguaaagguccuggcgaagacuuucgcauggccacccuguacucacguacccagaccccucgagcagaauuaaaggagaaguucacugcauuuugcaaggcacaaggguucaccgaggauacgaucguuuuccugccucagacugauaaauguaugacagaacaauag

SEQ ID NO: 249058 - RNA, 489 nt, Artificial Sequence
  Description of Artificial Sequence: Synthetic coding sequence
augaagggcuucaccgccacacuauuccuguggacccugauauucccaucuugcucuggcggaggcggcggcaaagcuuggccaacacauguuguuugcucagauuccggauuggaggugcucuaccaaaguugcgauccgcuccaagacuucggauuuuccguugaaaaguguuccaaacaguugaaaucuaauaucaacaucagauuugggauuauucucagagaggauauuaaggaacuuuuuuuggauuuggcuuugaugucacagggcucauccguacuuaacuucucuuacccgauaugcgaggcugcucuacccaaauucucauuuugcggacgacgaaaaggcgaacagauuuauuaugcagguccuguuaacaaccccgaauucacaaucccgcaaggagaguaccaagucuuacuugaacuauacacugagaagaggaguacaguugcaugcgcaaacgcaaccauuauguguucuuag

SEQ ID NO: 249059 - RNA, 945 nt, Artificial Sequence
  Description of Artificial Sequence: Synthetic coding sequence
augggcgcaaggggugcacuccucuuggcccugcuccuggcucgcgcgggacugaggaaacccgagucacaagaggcugccccucuaaguggcccuugcggcagaagagugauaacuucccguauugugggcggagaggacgcggaacugggcagauggccuuggcagggaagucugagacuaugggauucacacgucugcggcgugucccucuuaagucaucgaugggcucuuacggcugcacauugcuuugaaaccuacagcgaucuuucagauccaucgggcuggaugguacaguucggacaacugacaagcaugcccagcuuuuggucucuccaggcuuacuauacgcguuauuucgugaguaacaucuaccucaguccgcgcuaucucggcaauaguccguaugacauagcacuggucaagcuuucugccccagugaccuauaccaaacauauucaaccaaucugccuccaagcuucuaccuuugaguucgagaacagaacagacugcugggugacaggauggggcuauauuaaggaagacgaagcucugcccagcccacacacccuucaagaaguucaaguggccauaaucaacaacucaauguguaaucacuuguuccugaaauacuccuuuagaaaagauauuuuuggcgauaugguuugugcuggaaaugcucagggaggaaaagaugccuguuucggugacagcggggggccguuggcaugcaacaagaacggguugugguaccaaauuggcguggucuccugggggguuggcugcgguagaccuaacaggccuggcguauauaccaauauuucacaccauuuugaguggauccagaaguugauggcacaaagcgguaugagucagccagauccaucauggccucuccucuuuuucccccuguugugggcucuuccucuuuuaggucccgucuag

SEQ ID NO: 249060 - RNA, 954 nt, Artificial Sequence
  Description of Artificial Sequence: Synthetic coding sequence
auggugguuucaggggcuccacccgccuugggcggaggaugucugggaacuuuuacaucacugcugcuccuugcaucaacagcuauccuuaaugcggcuaggauaccggugccgccugcaugugggaaaccucaacaguuaaauagagucgucgggggcgaagacaguaccgauucugaauggccauggauugugaguauccaaaaaaaugggacccaccacugcgccggcucccuacuuacuagccgaugggucauuacugccgcccacugcuuuaaggacaauuugaauaaaccguaccuguuuucugucuugcuuggugccuggcagcuggguaaucccgggucccgcucgcagaaaguuggcgucgcauggguugaaccucacccagucuacucauggaaggaaggugcgugcgcugacauugcauugguuagguuagagcgcucuauucaauucucugaaaggguccugcccauauguuugccugacgcuucuauucaccuccccccaaauacacacuguuggaucuccggaugggggucuauccaggacggagugccucugccccacccccagacauuacaaaagcugaaaguuccaaucauugauagcgaaguguguucccauuuguacuggcggggagcgggucagggucccaucaccgaggauaugcugugcgccggauaccuggaaggggaaagagacgccugucugggagauaguggaggaccacugaugugccaggucgacggagcuuggcuccuggccgguaucauaaguuggggagaagguugugccgaaagaaaccguccaggcguguacaucucucugagcgcucauagaagcuggguggaaaagaucguccagggggugcaguuacgaggaagggcacagggcggaggugcucuucgcgcaccgagccaggggaguggagcugcugcuagaaguuag

SEQ ID NO: 249061 - RNA, 1257 nt, Artificial Sequence
  Description of Artificial Sequence: Synthetic coding sequence
auggaagagaucggaauucuggucgagaaagcacaagacgaaauccccgcucuuucugugucucggccccaaacaggcuugucuuuuuuaggccccgaaccugaagaucucgaagaucuguacucccguuacaaaaaacuccagcaggagcuggaauuucuagaaguccaagaggaauauaucaaagaugaacagaaaaaccugaaaaaagaguucuugcacgcccaggaggaggugaagcgcauucagucuauuccccuugucaucggacaguuucucgaagcaguugaccaaaauacggcaauaguuggauccaccaccgggaguaauuauuacguucgaauacucagcacuaucgauagggagcuccugaaaccuaacgcuucugucgcccugcauaaacauuccaaugcucugguggacgugcugcccccugaagcugauucuagcauuaugaugcuuaccucugaccaaaaaccugacguaauguacgccgauauuggcggcauggauauccagaagcaggaaguccgagaagcuguggaacuaccccucacacacuuugaacucuauaaacagaucggcauugaccccccacgcggcguacucauguacggaccaccaggcugcggaaaaacaauguuagcaaaggcaguugcucaucacaccaccgccgcauucauuaggguugucggcucagaguucgugcagaaguacuuaggagagggcccccgcauggugcgugacguauucagacuugccaaggagaaugcaccagcaaucauuuuuaucgacgaaauagacgccaucgcuacuaaacgauucgacgcucaaacuggcgcagaccgugagguacaaaggauucugcucgaacuguuaaaccagauggacggcuucgaccagaacgugaauguuaaggucaucauggccacaaaccgagcugauacucuugauccggcccuccuuagaccuggacgccucgauagaaagaucgaauuuccacuccccgauagaagacagaaacgacuuaucuucagcacuauuaccaguaaaaugaacuuauccgaagagguugaccuugaagacuauguggcccgaccugacaagauauccggcgcagauaucaacuccauuugucaagaaagcggcaugcuggccgugagagagaaccgguacauugugcuugccaaagauuuugaaaaggccuauaaaacaguuauuaagaaggacgagcaagaacacgaauuuuacaaguag

SEQ ID NO: 249062 - RNA, 786 nt, Artificial Sequence
  Description of Artificial Sequence: Synthetic coding sequence
augagccgaagauaugauucccggacgaccauuuucucccccgaagggcgucucuaccagguugaauaugcaauggaggcaaucggacaugcagggacuugccugggaaucuuggcuaaugauggugugcugcuggcagcagagaggcgaaauauacauaagcuacuugacgaaguuuucuuuuccgagaagauauauaaguuaaacgaggacauggcauguucagucgcagggaucacuagugacgcaaauguucugacgaacgaguugcgacugaucgcccagagauacuugcuacaauaucaagaaccuauccccugcgagcaacucgugaccgcccugugugacauaaagcaggccuauacucaguuuggugggaagaggccuuuuggaguguccuuacuguacaucggaugggauaaacacuauggguuucagcuguaucaguccgacccaucuggcaauuauggaggauggaaagcaacuugcaucggcaacaauagugcagccgcagugagcaugcuaaagcaagacuacaaagaaggcgaaaugacacuuaaaagugcacuugcccuggcuaucaaagugcucaauaaaacuauggauguaucuaaacuuagcgcugagaagguagagaucgcaacccugacccgggaaaacgguaagacagugauccgcguucuaaagcaaaaagagguggaacaguugaucaagaaacacgaagaagaagaggcuaaagcagaaagagagaaaaaagaaaaggagcaaaaggagaaggauaaauag

SEQ ID NO: 249063 - RNA, 4551 nt, Artificial Sequence
  Description of Artificial Sequence: Synthetic coding sequence
auggauaaucaacaggauaaagcuauaguugccuccgccaacggagagaauacacugaucaacggaguaaaggagaacgacagugaggaccaggaugucgcaaugaaauccuucgccgcauuagaggcagcggcccccauucaaccuacgcccguggcccaaaaggagacucucauguacccccgcggacucuuaccucugcccucuaaaaagcccuguaugcaaagccccccauccccucugggacugauugaggccccggaacaugcugccaauagugcuucgguaaaugccaucucacugacgagcggcaucgcgaaaggcuugaacaccuggagccucccaaaugaaugugaaaaggcacccuuugccauaauggaacccgccgguaugagcgcccucaacggcgacugucucaugcaaccuucucguaccugccugggcuguuuuauggaaaguaaagaugcugucgauccagagcccggcauuucccucaaaguaggugaucuuaaccgggauuaugaaaccugugccguuuccgacaucggcauccaauguauuaaugcaggggagaacaugaaguacggugagcaacuucugagcgaccaguuguugggguucccucuucauaaauccagggccggggaccgccgagaaaccgaaaagcccgauauugaucucgaggauccugcccagaagucuuacuacgaagccuuacugcuugauaaguguaauaccgaagaagccuugcuggccaacaguaaucaggacuggggauacuucgagaccuucauaucugagucaaaaauagaacuguuagaucucuguagcaaaaaugagcuuucagucaauuuauucagcgaggaggacguggauaauuauauguuugaugacgacgaaucuacacugggcucggacgucuguagcuuaaagauccgguaugaaucguuccaggacaacgugagagacaagaccacucuguuaaugcaggaagaugcucaauucaacuucuuuccuaguguauucaccacauguccaaaacgagagaguaagucaggagcucuuaaacagaguagcgauuucagccaauucaaaguaccggacguuaguauaaucuggggugaagaagauaaaaaucucgacaagaagaaagggaaggaggagggacaagaagauaaggggguggaaaagaaagaugggaaagauaauggcgagaaacccgcucugaauaaaccaugcagcggcacagagguugagcaguugaaaaaccccaaacagggacauuuggccaauagucuggaaacaucuggaucguucucagacgacaguucuuucauugaaauuuccuacgacgccaugggagagaucaaagauuguucucgauauauggccagggauaccaauagcgggucaaguucaucacaacagaacuaugggcugagggcaaagagaaagguaagauacagcgaagacuaucuauacgauguagacagccuggaaggggagaaagugaacgagcggaaagaauggcuccccgugggaaguaaagaagaagacgaugaugaguggugcccaaagaagagaaggaaagugacgcgcaaggagccccccgugauuauuaaauauauuaucaucaauagauuuaagggcgaaaagaacaugcuagugaagcucggcaaaguggacgcgagugaaacgacagugaaucuuuccgaaaaccaacucaacaaguacgccaaacuggcuccuuuaaaggguuucuggcagaagaagaagaagcagaggaacacaaauacugauagcaucaaaacuccauucucacagaagcagucauuugaaccggguucauuugaagugaguuuucugccaccugcgaggaagaggaaaucaaagcucgguaaccgacacagaauccagagaauaccaucuaucgagaucucugcaucauccaaacaaaucucucucugcaacgaucaacgucacgcuagcaaccauaaagaggauggcggucugaaagggacacucaaguccgcaccccugggggcaccuucaugcgcaaacgguucgcacuugaacgauauaacaggaccggauucuguuaaggugaaagcucaggauacagaguucaaaggccccgagaggaaagugcugaauaagauuaaguuuaagagugaggcgagacucaagucaaagaaggucaaggcugccggacaagaaagcaaaccgaucgugcagauguccccccuuuuagagaaccaaaguaguaaagcaaaccuuaagaaugaagugauacccggcacuagcaacucuucaagacugagcgaauuccacgaagccaaggcugccaaaagcucuacauuccucccaacuacauguagcuccgagaugccccuguccagugccaacgugacuaccaacauaccagugauuccuggcggcuaucuccagacccuucucgaugcuagcgauuuaagcaacaauacuuccauauccuacuuuucacaucauaguccagaacagaacgagggaucccugacccagacagaaaaaucauucgugccauugcagccuacucaggauuguguacugaccucuagcucugacucugagcuacagcaaagcucucauaacuuuaaaauggaaucuucuaauuauaggaauguguggccuaacaaggcuacgaguggaacccaagaauuuauggcugaagugucuagagagaucgcgccuacucagucaucagaauuuggggcuucccaggugguuagcauggaaaauaacuugaccccaacgacguacaauccuauuugccugaacucuggugguuccaacugcaauaagguccuauacgauaguaugcaagacacgcaacuaccauccgaugauuccuaccagcugugucauuucaauaauggagaaaucugcuuccccuuccagcagggccccguaaacauggaugacggacgucuuuuuagcuuugacagcauggccccccucagcgucuccucuucgaacuacugcucucucucacugaagucuugugaaaaggauggugaugacgacauaaccgaugacuuccucgcccacuguuccccgaagcugguaauucaacagucuauagacgagauugcaccgcucaaggaguccacugaucuguuggacauuaguaacuucaccccugacaaauucaggcacucuucccucuccgaaaugucuccccccgauacaccaucucuaaguccucaaauuaccaggugugagucuaugaaaaccuugggaacccuuaagggauuccaggagggcguacccggcccccucgauuccguggagaaaauuaaaugggacuguagcacucugucccgacaaguucaaauggaagacggguucacuuugaauaaccaucaauuucaguuccacauguuuaacgacgaagauucaguuucccuguugcagaaaaauccauguuugaguaccuucaacgacccaucuggacaaauaaguacaaauaacaaagugucuaagagccgcaaaaaaagcucuccuucaaaaagcggagcgaugaaccagucuuccucacagaaaaauaccagaaagaagagucugaagggaaauaacaagggaaucgaaaagccgccaggaaagaauucucgacaggucccaaaaaguacaaagaaagguaaguauauggcugcaauuaauggcgagaaaaugcaaaucgggauaggaagaggugguagucagacgaauacaauuagcuccacugguaaaacucucgcagaaugcauucaacacgguggaccaauggcaaguaugaaaaugcccagucagaagggccucucaggcgauugggcuuuaggaaaagagucuagucccggcuggucggacaugaguaugggcacuaacacaaauucccucuuagaugaugaccagcgcgaguuccaagagcccuccuauauacugaguaauaucgccucgggcauggccgauguccaaagauuuaugauggcaaguauugaaccuuugugggaaccuauggagcaucauggagauccuaauauuuucuacagcccagaauccaauagcuugaaacugaaaacauuaaagauccuggccggaaccccacaggaaagcaagaaaaagaucaacagcggaucacaaggggccaccaaaaaucaucggucaauuaaggguguauccaagagcaauggaaaaacagccaucggcgauccgggacgagcuaacaugccgggguacaacgaagacucgcggucuaccuucuuugacaaaaaauacucuaauaugucgacgcuugguaacaacggacccacccacaaaaagcucuaccgacauaaguccucuucuaaggcccuccgugaugaaaaauguaaaggcaaacauauggagcgcgaacagguacauaaagaugagagugggacagcuucauuugaaaaguugcgagauuccgacuacaaccuucugaaagcugaaacuacuuuuuggguacuacccguguucgaagaagaaaccagaauuuuucaaaaagauauauag

SEQ ID NO: 249064 - RNA, 1494 nt, Artificial Sequence
  Description of Artificial Sequence: Synthetic coding sequence
auggagacuaaacucccacccgcauccacccccacuucuccgagcucccccgggcucagcccuguaccgccaccagauaaaguugauggguuuuccagaagaucucugcgacgggcacggccccgaagaucgcacucuucaucccaauuccgguaucaaucaaaccaacaagaacuuacucccuuaccucuccuuaaagacguuccagccucggagcugcacgaacuccuuucucgcaagcuggcccaauguggcguuauguucgacuuuuuggacugcgucgccgaucugaaagggaaagagguuaagcgggccgcgcugaaugaauugguggaaugcgugggcucaacucggggagugcugaucgagccaguuuacccagauauaauacgaaugauuucugugaacaucuuuagaacucugccaccaucugaaaaccccgaguuugauccggaagaagaugaaccuaaucucgaacccucuuggccucaucugcaauuggucuaugaauucuucuugagauuccuggaaagucccgauuuucaaccuagugucgcgaaaagguacgucgaucagaaguuugucuuaaugcugcucgaacuguuugacucagaagaccccagagagcgugaauaucuuaagacuauacuccaccgcgucuacgguaaauuucucggucuuagagcguauauucgaaagcaguguaaucauauauuccuucguuucauauacgaguuugaacacuucaacgguguagcagagcuccuggagauacuuggaucuauaauuaauggcuucgcacugccccugaaaacugaacauaaacaauuucuggucagagugcuuaucccuuugcauuccgugaaaucccuauccguguuccacgcccaguuggcuuauuguguggugcaguuucuggaaaaagacgccacacucacugagcacgugauccgaggucugcugaaguauuggcccaaaaccuguacccaaaaggaagugauguuccugggagaaauggaggaaauucucgacgugauagaaccgucccaauuugugaaaauacaggagccccuuuuuaaacaagucgcacgcugcgugaguucuccacacuuccaaguggcugaaagagcacuguacuuuuggaauaaugaauauauacuuucucucaucgaagacaauugccauacaguucucccagccguguuuggaacacucuaccaaguuucaaaagagcacuggaaccaaaccauagugucauugaucuacaauguguugaagaccuuuauggagaugaacggcaaacuguuugaugaacucacugccucguauaaacuugaaaaacagcaggaacagcaaaaggcucaggaacgacaggaauuguggcaagguuuggaggagcuacgucuuaggaggcugcagggcacucagggagcaaaagaggcuccccuccagaggcuuacaccgcaaguagccgcuaguggcgggcaguccuag

SEQ ID NO: 249065 - RNA, 1500 nt, Artificial Sequence
  Description of Artificial Sequence: Synthetic coding sequence
auggcuauggcugaaggggaacguaccgagugcgccgagccgcccagagacgaacccccugcugacggugcguuaaaacgggcugaggaacuaaaaacacaagcuaacgacuacuuuaaggcaaaagauuacgagaacgccauuaaauuuuacagucaggcuaucgagcugaauccguccaacgcuauuuacuaugggaacagaucacuagccuaucuccggacggaauguuacggauaugcccugggagacgccacacgugcaauugaauuggacaaaaaauauaucaaaggauacuacagaagagcagcuaguaacauggcucugggaaaauuuagggccgcucuucgggauuacgaaaccguggugaaggucaagccacaugacaaggaugccaagaugaaauaucaggaauguaauaaaaucguuaaacagaaggcuuucgaacgcgcuaucgcgggggaugaacacaaacgaagcgugguugauucacuagacaucgaaucuaugacuauugaggaugaauacagcgggcccaaguuggaggaugggaaggucacaauaaguuucaugaaagaguugaugcaaugguacaaagaccagaagaaauuacacagaaaaugcgccuaucaaauccuagugcaagugaaggaagucuugucgaaacucagcacccucgucgaaacuacccucaaggagaccgagaaaauuacaguaugcggggauacucauggacaguuuuacgauuuacugaauauuuucgaacucaauggccucccaagugagacuaaccccuacauauucaauggcgacuucguggacagggguuccuucaguguagaagucauccuuacucucuucggcuuuaagcuccuguacccugaccauuuccaccuguugcggggcaaucaugaaaccgauaauaugaaucagauuuacggauuugagggcgaaguuaaggccaaguacacagcucagauguacgaacucuucagugaaguguucgagugguugccucucgcucagugcauuaaugguaaagugcuuaucaugcauggaggacuuuuuuccgaggacggugucacuuuagacgacauuagaaaaaucgaacgaaaucgacaaccacccgacuccggucccaugugcgaccuucuuuggagcgacccccagccccagaacgggcguucuaucagcaaacgcggaguguccugccaauuugguccagaugucacaaaagcauuucuggaagaaaauaauuuagacuauaucauccggucacacgaggugaaggcugaaggauaugaaguggcacacgggggcagaugcguaacaguuuuuagcgcaccaaauuacugcgaucaaaugggcaacaaggcaagcuacauacacuuacaaggcagcgaccugagaccgcaguuucaccaauucacugcugugccccacccuaauguaaagccaauggccuacgcaaauacacuucugcagcugggcaugauguag

SEQ ID NO: 249066 - RNA, 696 nt, Artificial Sequence
  Description of Artificial Sequence: Synthetic coding sequence
augcggguccucggaggacgaugcggugcgcugcuugccugccuguuacuugugcugcccgugucggaagccaauuuuugccuguacuuccguaacgauuuuaucuauaaucgcgcuuguauuaguguccuggucgguuuguccggaugcaacuucuuuuauucaauauguuuucuguccaagcagcaggccucccagguucugguccggaagcgccgcgcgaacagccuccucgaagaaacuaaacaggggaaucuagaacgcgaaugcauugaggaauugugcaacaaggaggaagcgagagaaguuuucgaaaacgaucccgagaccgacuauuuuuaccccaaauacuugguuugucugagauccuuccaaaccgggcucuuuacagccgccagacaaucaaccaacgcuuauccggaccuaagguccugugugaaugcgauccccgaccaguguagcccucucccaugcaaugaggacgguuauaugagcuguaaagacggaaaagcauccuucacuugcacaugcaaacccggauggcagggcgaaaaaugugaguuugauaucaacgagugcaaggaucccuccaauaucaaugguggcuguagucagauaugugacaacacuccaggauccuaccacugcucuuguaaaaaugguuuugucauguugaguaauaagaaagauuguuag

SEQ ID NO: 249067 - RNA, 2031 nt, Artificial Sequence
  Description of Artificial Sequence: Synthetic coding sequence
augagaguauuaggcggccgguguggcgcuuugcuugcuugccucuuacuuguucuuccaguguccgaagccaauuuccugucgaagcaacaggcaagccagguucucgugcgaaagcgucgagcaaacucgcucuuagaagagacaaaacagggaaaucucgagcgcgaguguauugaggaacuguguaacaaggaggaagcaagagaaguauuugaaaaugauccagaaaccgacuauuuuuacccuaaguaccuuguaugccugcgcuccuuccagacaggccuguucacugcugcacggcaaucuaccaaugcuuacccugaccuuaggaguuguguuaaugccaucccagaccagugcucaccacuccccugcaaugaagacggauacaugucauguaaggacgguaaggcaucguucacguguacuugcaagccggguuggcagggcgaaaaaugcgaauuugacauaaaugaauguaaggauccauccaauaucaacggaggcugcucccagaucugcgauaauacuccaggaagcuaucauugcaguugcaaaaauggguuugucaugcucaguaauaaaaaggacuguaaggauguggacgaaugcucgcuuaagcccucaauuugcggaaccgccguuuguaaaaauauucccggcgacuucgaaugcgagugccccgaaggcuaucgauacaaucugaaaucaaagucuugugaggauauugacgaaugcagugagaauaugugcgcacaacuauguguuaauuacccgggcggcuauaccuguuauugcgacgggaaaaaagguuucaaauuagcccaagaccaaaaauccugcgaggugguuagcgugugucuucccuuaaaccuggauaccaaguacgagcucuuguaccuugcagaacaauucgccggggucgugcuguacuuaaaauuucggcugcccgagauuuccagauuuucugccgaguucgacuucagaacuuaugacagcgaaggcgugauucuuuaugcagaaagcauagaccacagcgccuggcuccugauugcccugaggggagggaaaauugaaguacaguuaaagaaugaacauaccucgaaaaucaccacgggcggagaugucaucaauaauggacuguggaauaugguaagcguggaggaauuagagcacaguauaaguaucaagauugccaaggaggcggugauggauauaaauaaaccgggcccucucuucaaacccgaaaacgggcuacuugagacaaaaguuuacuucgcuggcuucccccgcaaaguugagucugaacuaaucaaacccauuaacccccggcucgauggcugcauuaggucauggaaccuaaugaaacagggcgcgucagguaucaaagaaauuauucaggagaagcagaacaaacauugucuagucaccguugagaaaggaagcuauuauccuggaucaggcaucgcucaguuccacaucgacuacaacaacgucucaucugccgagggcuggcaugucaacguaacucugaauauuagaccaucaaccggaacuggcgucaugcuggcacuuguaucuggaaacaacacugucccauuugccgucucccucgucgacaguaccucugagaaaucccaagacauccuccugucaguggagaauacgguaaucuauaggauccaagcauuaucacuaugcuccgaccaacaaucucaucuggaguuuagggugaaccggaauaaucucgagcugagcaccccucucaagauagaaacaaucucucaugaagaucugcagagacagcuagcaguucuugauaaggcuaugaaggcaaaaguggccacuuaccuaggcgggcucccagacgucccauuuagcgcuacuccggucaaugcauucuacaauggguguauggaggucaacauaaacggcgugcagcuggacuuagacgaagcuauuucaaaacauaaugauaucagggcgcacucaugucccagcguguggaaaaaaacaaaaaacaguuag

SEQ ID NO: 249068 - RNA, 1269 nt, Artificial Sequence
  Description of Artificial Sequence: Synthetic coding sequence
auggcugggugcgugccucuguugcaagguuugguauuagucuuggcccuucaccgcguugaaccuuccgcuacaucccugaaagagaggcacggcuuacauuccgauagcgccuguaccggaguccaggagagucuguuucugcccgccagcaaagccaaugaugugcugguacgcuggaagagagccgguaguuacuuacuggaggaacuguuugaaggaaaucuggaaaaggaaugcuacgaagaaauuugcguuuaugaagaagcuagagaaguguuugagaaugaggugguaaccgacgaguuuuggcgacgguauaaaggaggaucaccauguauuucacaacccugccuccacaaugguuccugccaagauuccauuuggggauacaccuguacaugcuccccuggcuacgaaggaucgaauugugagcucgcuaagaaugaaugccauccagaaagaaccgaugggugucagcacuuuugccugcccggacaggaaagcuauacuuguuccugcgcccagggauaccgacugggagaagaucauaaacagugcgucccucacgaccagugcgcuugugggguccugaccagcgaaaaaagagcccccgaucugcaggaccugccauggcaagugaaacuaacaaauucugagggaaaggacuuuugcgggggcgugaucauccgcgagaacuucguauuaacaaccgcaaaguguagucuucugcaccgcaacauuaccgugaagacuuauuuuaaucguacuucucaggacccgcucaugauuaagaucacccacguccacguacacaugagauacgaugcagacgccggagagaaugaccuuucgcuguuggaacuggaauggccgauucagugccccggcgcaggacugcccguuugcacaccugagaaagauuucgcugaacaccugcucaucccaagaaccagaggauugcugucaggcugggcaaggaauggcacugaucugggaaacucacugacaaccagaccugugacucuugucgagggagaagagugcggccagguccuuaauguuaccguuaccaccagaacauauugcgagaggucaagcguggcagccaugcauuggauggauggcucagugguuacccgagagcaucgggggucaugguucuuaacuggaguccuugguagucagccagugggaggacaagcccauaugguguuaguaacgaaggucagucgguauuccuuaugguucaaacaaauuaugaauuag

SEQ ID NO: 249069 - RNA, 1203 nt, Artificial Sequence
  Description of Artificial Sequence: Synthetic coding sequence
auggcuggcugcgugccucugcugcaaggauuagugcugguguuagcacugcaccgcgucgaaccuucugucuuucuaccagcaagcaaagccaaugaugugcucguaagauggaagagggccggaucauaucugcuagaggagcuuuuugaagggaaccucgagaaagaaugcuacgaagagauuuguguuuacgaggaggcccgagagguguuugaaaacgaggugguuacagacgaauuuuggagacgcuauaagggagggagcccauguauaucucagccgugccuccauaauggcucuugucaagacucaauuuggggguauaccugcacauguucccccggcuacgaagggucaaacugcgaacuagccaagaaugagugucacccggaaagaaccgauggaugccagcacuuuugucugccaggccaagaaucguauacuugcuccugugcacaaggguauagacugggagaagaucacaagcaaugcgucccccacgaucagugugcuuguggggugcuaaccagugaaaagagagccccugaccuccaggaccuccccuggcaggugaaauugaccaauuccgaggguaaagauuucugcgguggagugauuauccgagagaauuucguuuugacaacugcuaagugcucucuacuucaucggaacauuacugugaagacauacuuuaaccggacuucccaagacccccuaaugaucaaaaucacccacgugcacgugcauaugagauaugaugcugaugccggcgaaaacgaccugucccuacuggaacuugaauggccgauacaguguccgggcgcgggcuugccugugugcacccccgaaaaagacuuugcugaacauuuauugaucccacgcacccgcggccugcucucagguugggccagaaacgguacagaccuggguaauagccuuaccaccagaccugugacccuggucgaaggagaggaguguggacaggugcugaaugugaccguaacuacaagaacuuauugugagcgguccaguguugcugccaugcauuggauggauggaagcgucguaacucgagagcauagaggcuccugguuucugacaggggugcugggaucacagcccgugggaggacaagcccacaugguacucguuacaaaaguuagcagguauagccugugguuuaaacaaauuaugaauuag

SEQ ID NO: 249070 - RNA, 1053 nt, Artificial Sequence
  Description of Artificial Sequence: Synthetic coding sequence
auggagccaaagagaauuagggagggauauuuaguuaagaagggaucaguauuuaacacauggaagccaaugugggugguacugcuugaagacggcauagaauucuacaagaagaagagcgauaacucucccaaagguaugaucccucuuaaggguaguacucuuacauccccaugccaagacuuuggaaagcggauguuuguguucaagauuacaaccaccaaacaacaagaucauuucuuccaagcagccuuccuggaggagcgagacgcaugggugcgcgacaucaaaaaagccaucaagugcaucgaggggggacagaaguuugcuagaaagaguacacgaagaucuaucaggcugcccgaaacaauugaccucggcgcccucuaccuuucuaugaaagauacugagaagggcaucaaagagcuaaaccuggaaaaggauaaaaaaauuuuuaaucauugcuucaccgggaacugcgugaucgacuggcuugucucaaaucaaagcguuagaaauaggcaggagggucugaugauagccagcagcuugcuuaaugaaggguacuugcagccagccggagauaugucgaagucugcuguggacgggaccgccgaaaaccccuuccuggacaauccugaugcguucuauuauuucccagacagcggcuuuuucugugaagaaaauaguuccgacgacgaugugauuuugaaagaggaguuuagaggcgugaucauuaaacaggggugucuguugaaacaggggcacagaaggaagaauuggaaaguccguaaauucauccugcgggaggaccccgcuuaccugcacuauuacgauccagcaggcgcagaggaucccuuaggcgcgauccaucuaagaggaugcgugguaacuaguguagagagcaauaguaacggacgaaagagcgaagaagaaaacuuauucgagauaaucacagcagaugaagugcauuacuuccuccaggccgcuacacccaaggaaagaacagaauggauaagggcuauccagauggcuucacgcacagguaaguag

SEQ ID NO: 249071 - RNA, 1236 nt, Artificial Sequence
  Description of Artificial Sequence: Synthetic coding sequence
augaaggccgcccguuucguacuccgaagcgccgggagucugaauggugcaggacucguuccucgcgagguggagcauuucucucguuacucgccauccccccucuccaugaaacaauugcuugauuuugguagugaaaaugccugcgagagaaccucauuugccuuccuuagacaagagcuacccguccggcuggccaacauccuuaaagagauugauauauugcccacccagcuagugaacacuucuuccgugcagcuggugaaaucaugguacauccaaagccugauggaccugguggaguuccacgaaaaguccccagacgaccaaaaggcccuaagcgauuuuguugacacguugauuaagguuagaaaucgccaucauaauguaguucccacuauggcacaagguauuaucgaguauaaggaugcuugcaccguugacccaguuacaaaccagaaccuucaguauuuucucgaucgauuuuacaugaauaggaucagcacgagaaugcugaugaaucagcacauccugaucuuuuccgacucacagacaggcaaccccucccacaucgguucuaucgauccuaauugcgacgucguggcuguggugcaggacgcuuucgagugcucccggaugcuuugugaucaauacuaccuguccagcccugagcuuaaacuaacacaggucaacggcaaauuuccagaucagccuauccauaucguuuauguacccucccaucuacaucauauguuauuugaguuauuuaaaaacgccaugcgggcaaccguggagcaucaggaaaaccagcccagcuuaaccccuaucgaggugaucgucguccuuggaaaagaggaucuuacuauaaaaauuagcgacagaggcggaggcgugcccuugaggauaauugacaggcucuuuucuuacacauacucuacugcucccacucccgucauggauaauucccggaacgcuccucuggcuggauuuggauauggacugccaaucucuagacuguacgcaaaauauuuccaaggggaucucaaccuuuauucucucagcggcuacggcacagaugccauuaucuaccucaaagccuuaaguuccgaaucuauugagaagcuaccaguguucaauaaguccgcauucaagcacuaucaaaugucuagcgaagcggaugauugguguauaccaagcagggaacccaaaaaucucgcgaaggaaguagccauguag

SEQ ID NO: 249072 - RNA, 1968 nt, Artificial Sequence
  Description of Artificial Sequence: Synthetic coding sequence
augacagaauguuuuuugcccccuaccaguucacccucugaacauaggcguguggaacacggaucaggucuaacccggacccccagcuccgaagaaauuaguccuacgaaauuucccgggcuguaccggacaggagaaccaucgcccccucaugauauucuucacgaaccucccgacguagucucagaugacgagaaagaucacggaaagaaaaagggcaaauuuaaaaagaaagagaagcgcaccgagggauacgcagccuuccaggaagacaguucaggcgaugaagcugaaucccccagcaaaaugaaaaggucuaaggggauucacguuuuuaagaagcccagcuuuagcaaaaagaaagagaaggauuuuaaaauuaaggagaagcccaaggaagaaaaacacaaagaagaaaaacacaaggaggagaaacacaaagagaagaagucaaaagaucuuacagccgccgacguggugaagcaauggaaagaaaagaaaaagaagaaaaagccgauucaagaaccagaagucccacagaucgacgugcccaacuugaaaccuaucuucggcaucccacuggcugacgcagucgagaggacaaugauguaugaugggaucagacugcccgccguguuccgcgaauguauagacuauguugagaaauauggaaugaagugugaggguauuuaucgcgugucgggaaucaaaucuaaaguugaugagcucaaggccgccuacgaucgagaagagaguacaaaucuggaagauuacgaaccuaauacgguggccucacuccucaaacaauaccucagagauuuaccagaaaaccuccugacuaaagaauuaaugccacgguuugaagaggccugcgggaggaccacagagacggagaagguccaggaauuucagaggcuauuaaaggaauuaccggagugcaacuaucuccugauuucguggcuuaucguacauauggaccaugugaucgccaaagaacucgagacaaaaaugaacauccagaacauuagcauuguacuuagucccacugugcagaucuccaacagaguguuauauguuuuuuucacacacgugcaggaguuauucgguaauguggugcugaaacagguaaugaaaccacuuagauggaguaauauggccacaaugccaacccuacccgaaacccaggcaggcaucaaagaggaaauaagacggcaggaguuucuuuugaacugcuugcaccgugauuuacagggcgguauuaaggacuuaucgaaggaggagagguugugggaaguucagcggauacuaacggcauugaaaaggaaguugcgggaggcuaaacggcaggagugugagacgaagauugcacaggagaucgcuagucucaguaaggaggauguuucaaaggaggagaugaaugaaaaugaggaggugauuaauauucugcuugcgcaggaaaaugaaauucugaccgaacaagaagagcugcuagcaauggagcaauuuuuaagaaggcagauagcuucugagaaggaagagauagaaaggcuuagagcugagauagcagagauccaguccagacagcagcacgggagaagcgaaaccgaagaguacuccucagagucugagucagagucagaagacgaagaggaauugcagaucauccuggaggacuugcagcgucagaaugaagagcucgaaauaaagaauaaucaccucaaccaggcgauccaugaggaaagggaggcuaucaucgaacugcgcguccaacuaagauugcuucagaugcaacgcgccaaagcagaacagcaggcucaggaagacgaagaacccgaguggcggggcggcgcuguacagccaccacgcgacggaguacuggaaccaaaagcugcuaaagaacagccuaaggcuggcaaagaacccgcgaagccaaguccuucuagagacagaaaagagaccagcaucuag

SEQ ID NO: 249073 - RNA, 1500 nt, Artificial Sequence
  Description of Artificial Sequence: Synthetic coding sequence
auggccgaucuagcaaaugaggagaaaccagccauagcaccgcccguguuuguguuucaaaaagauaagggacagaaacggagcgccggaggcaguucacccgaagguggugaggacucagaucgugaggacggaaauuauugcccccccguaaaacgcgaaagaaccagcucacugacccaguuuccuccaagucagagugaagagcguagcuccggauuuagacuuaagcccccaacccuuauccauggacaggccccaagcgcaggucuaccaagucagaagccaaaggagcagcagagguccgugcugagaccggcaguccugcaagccccacagcccaaggcccucucgcagaccgugcccuccagcggcacaaacggcguguccuuacccgcagauugcaccggugcggucccugccgccagcccugauacagcugcuuggcgaucucccagugaagcagcagacgaagugugugcccuugaggagaaggaaccacagaagaacgaguccucuaaugccuccgaggaagaagcgugcgaaaagaaagacccagcuacacagcaggcauucguguucggccagaaccucagagauagaguaaagcugauaaacgagagcguggaugaggcagauauggagaaugcuggccacccgagugcggacacuccaacugcaacaaacuauuuccuucaguacauuucaucgucucucgaaaauucgacgaacagugccgaugccucuucaaauaaauuuguguuuggacaaaauaugagcgagagagucuugaguccucccaaacugaacgaagucagcucggaugcaaaucgagaaaacgcugccgcagagucugggucugaaucaaguagucaggaagccacccccgagaaggagucacuagccgaauccgccgcggcuuauacaaaagcuacugcaagaaaaugcuuguuggagaaaguagaggugauuacaggagaagaggcugaaaguaaugugcuccagaugcaauguaaauuguucguguuugacaaaacaucccagagcugggucgaacguggcagaggccuucuuaggcugaaugauauggccucaacagacgauggaacccuccaguccagacucgugaugcggacucaaggcagucuuaggcugauacucaacacaaaacugugggcccagaugcagauugauaaggccuccgaaaaaucaaucagaaucacugccauggacacugaagaccaaggcgugaaggucuuccugauuucagcaucuagcaaagauaccggacagcuguaugcagcccuucaccaccggauccucgcccuuagaucuagagucgaacaagagcaggaggcuaagaugcccgccccagaacccggagcugccccaucaaaugaggaggaugauuccgacgaugaugaugugcuggcacccaguggagcaacggccgccggagcgggagacgaaggugauggacaaacaacugggucuacguag

SEQ ID NO: 249074 - RNA, 2190 nt, Artificial Sequence
  Description of Artificial Sequence: Synthetic coding sequence
augaguggccagccaccccccccgccaccucagcagcaacagcaacagcagcagcugucaccuccuccgcccgccgcucucgcccccgucucaggagugguauuaccagcccccccagcuguuuccgccgggucauccccugcaggcagccccggaggaggcgccggcggagaaggacuuggagcagcugccgcggcccuccuucuacacccuccccccccgccucccccagcaaccgcugcgccuccuccgccuccacccccucccccaccaccagcuucagcagcagcgcccgcaucaggcccaccugccccaccuggauuagcugccggaccuggaccagcuggaggggccccaacuccagcacugguugcuggcuccagugccgcugcacccuuuccacacggcgacagugcucuuaaugaacaggaaaaggagcugcagagacgucucaagagguuguacccagcuguggaugagcaggagacgccgcugccacgaaguuggucuccuaaggacaaauuuuccuacaucggccugucacagaacaaccuacggguccacuauaaaggacacgguaaaacucccaaggaugccgccucuguacgugcaacccaucccauuccugcagcuugcggcauauauuacuucgaggucaagauagucuccaagggaagagacggauacaugggaaucggauugucugcacaaggaguuaauaugaaccgccuuccuggcugggauaagcacagcuacggguaucacggggaugacgggcacaguuucugcuccucuggcacuggucagcccuacggaccgacauucacuacuggagacgugauuggcugcugugugaaucugaucaauaacaccugcuuuuauacuaaaaauggccauagccugggaaucgccuuuaccgacuugccuccuaacuuauaccccaccguuggacuucagacacccggcgagguggucgacgccaauuuuggacagcauccuuucguguucgacaucgaggauuauaugcgagaauggcgcacuaaaauucaagcucagaucgauagguuccccauuggggaucgcgagggagaguggcagacuaugauccagaagauggucucuaguuaucuaguucaccaugguuacugcgcuaccgcugaagcuuucgcccgcucuacugaccagaccguccuugaagaacuagcaucaaucaagaaucgccagagaauccaaaagcuuguucuagccggacguaugggcgaggccauugaaaccacccagcaacuuuauccuucccuccucgagaggaauccgaaucuacuuuuuacacucaaaguccggcaauuuaucgagaugguuaacggcaccgacucagaaguuagaugcuugggcggcaggucaccaaaaagucaggacagcuauccggugucuccacggccuuucucaagcccuucuaugagcccuucacaugguaugaacauccacaaucuggcuagcgguaaggggagcacugcucauuuuuccggauucgaaaguugcucuaacggcgucauauccaacaaggcccaccaaaguuauugccacuccaauaagcaccaaaguaguaaccucaacguccccgaacugaauaguaucaauaugucacggucccagcaggugaacaacuuuacgaguaacgacgucgacauggagacagaccacuacagcaacggcguuggcgaaacauccucuaauggcuuccucaacggauccagcaaacacgaucacgaaauggaggacugugauaccgagauggaaguggauucuucucagcucaggcggcagcucugcggagguagucaagcggcuauugagaggaugauacacuuuggccgagaguuacaggcaaugucagaacagcucagacgugauugcgguaagaauacagcaaauaaaaagaugcuuaaagaugcuuucagucuccuggcuuauagcgauccuuggaauucacccgucggaaaccagcuugacccaauacagcgagaaccugucugcucggcauuaaauucugcgauacuggaaacgcacaaucugcccaagcagccaccuuuagcccuugcaaugggacaagccacacagugccucggccucauggcuagauccggaauaggcucgugcgcuuuugcaacaguugaggacuaccuacacuag

SEQ ID NO: 249075 - RNA, 5298 nt, Artificial Sequence
  Description of Artificial Sequence: Synthetic coding sequence
augcggcggagcaaagcugauguagaacgguauguggcuucaguccuuggucugacaccuagcccucgacagaaguccaugaaaggcuuuuauuucgccaagcuauauuaugaagccaaggaauacgauuuagcaaaaaaauauaucugcacuuacaucaacguacaggaaagggauccaaaggcacauagauuucucggacuguuauaugagcuugaagaaaacacagagaaggcuguugaaugcuaccgucggagcguugaguugaaucccacccaaaaggaccuugugcugaagaucgcagaacuauuguguaagaacgacguaaccgacgggcgggccaaauacugggucgagcgagccgcaaaacuuuucccagguucuccggccauuuauaaacuaaaggagcaacuguuggauugcgagggggaggauggguggaacaaauuauuugacuuaauccaaagugagcuguaugugcguccggacgauguccacgucaacaucagacuuguugaacuguauagaaguacuaagcgcuugaaggacgcuguugcccacugccaugaagcugaaaggaauauugcgcuccgcaguucauuggaauggaacagcugcgucguacaaacacuaaaggaguaccuggaaucuuuacagugccuagaguccgacaaaagugauuggcaggccaccaauacugacuuacugcucgccuacgcaaaucugaugcuucugacacucucuacucgggacgugcaggaaaauagagaacugcuggagucuuuugacucugcuuuacagagcgccaaauccagccucggagggaacgacgaauugagcgccacuuuccucgaaaugaaagggcauuuuuacauguaugccggaucauugcugcugaaaaugggacaacacggcaauaauguacaauggcgggcucuguccgaauuggcagcacugugcuaccuuaucgcuuuucagguccccaggccaaagauuaagcugcgcgaagggaaggcugggcagaauuuacuggaaaugauggcuugcgaucgucuaagccagucaggacacaugcuguuaucgcucucucgaggcaagcaggauuuccuaaaggaggugguggaaacauucgcaaacaagaucggccaaagcgcguuauaugaugcucucuuuagcucccaaucccccaaggacacaucauuuuugggaucugacgacauugggaagaucgacguacaggaaccugagcuggaagaccuugcccguuacgaugucggcgccaucagagcgcauaauggcuccuugcagcaccuaacauggcugggacugcaauggaacucccugccagcacugccagguaucaggaaguggcucaaacagcuuuuccaccgccugccucaugagaccucuagauuagaaacaaaugcccccgagaguaucugcaucuuagaccuggagguguuccuccuuggcguuguauacacaagccaucuccaacugaaagaaaaaugcaacucucaucacagcagcuaccagccuuugugucucccuuucccugucugcaaacagcuuuguacugagcgucagaaaucauggugggacgccguuugcacucugauucauagaaaagccgugccagguaaccucgccaaacugcggcuacuggugcagcacgagaucaacacuuugcgggcucaggagaaacacgggcuccagccggcacugcucguacauugggccaaauaccuacaaaaaacagggagcgggcugaauucguuuuauggacaauuggaauauaucgguaggucagugcacuacuggaaaaagguccugccucuacuuaaaaucauaaagaagaacucaauuccggagccgaucgaucccuuguuuaaacacuuccauagcguggauauacaagccucugagauaguggaguacgaggaagaugcccacaucacauuugcaaugcuagacgcagugaauggcaacauugaggaugcuguaaccgccuuugagucaauaaaaucuguuguaucguacuggaaucuggcucuaaucuuucaccgcaaagcugaagauauagaaaacgacgcuuuaucacccgaagagcaggaagagugucgcaacuaccugacaaagacacgagacuacuuaaucaaaauuaucgaugauggcgauaguaaccucucugucgucaaaaagcucccuguaccccucgaaagcgugaagcaaauguugaauagugucaugcaggaguuggaagauuauucagaagguggaccucuuuauaagaauggcucucugcgaaacgccgacagcgaaauuaaacacuccacuccuucaccuaccaaguauucuuugaguccaagcaaauccuacaaguauuccccagagacuccaccaagauggaccgaagaccguaauucauuauugaacaugaucugccagcagguugaggcuaucaaaaaggaaaugcaagaguugaaguuaaacucguccaaauccgcgucaaggcaccgguggccaacugaaaacuacgggccugauuccgugccugacggcuaucaagguucccaaacauuccauggcgcuccucuaaccgucgccacaacugggccuucugucuacuacagucaaucuccugcuuauaauagccaguaucuguuacgacccgcugccaacgucacuccaaccaaagggucaucuaauaccgaguuuaagaguacuaaggagggauucuccaucccgguaucagcggaugguuuuaaauuuggcauaagugaacccgguaaucaggagaagaagagggagaagcccuuagagaacgauacagguuuccaggcacaggacauuaguggacgaaaaaagggccgcggagugaucuuuggucaaacaucuucaacauuuacguuugcggacguagccaagucuacaaguggcgaaggauuucaguucggaaagaaggaucuaaauuuuaaagguuuuagcggcgccggcgagaagcuguucagcuccagguacgggaaaauggcaaacaaagcuaauacaaguggcgacuucgaaaaagacgaugaugcuuacaaaacagaagauagcgacgauauccauuucgagccuguggugcaaaugccugagaaaguggagcucgugaccggggaggaaggggaaaaaguguuauacagccagggggugaaacuuuuuagguuugacgcugaggugaggcaauggaaagagcgggguuugggcaaccucaagauucugaaaaacgaagucaauggcaagcucaggaugcuaaugaggcgugagcagguucugaaagucugcgccaaucacuggauaaccaccacuaugaaucugaagccccucaguggguccgacagggcuuggauguggagcgcuagcgauuucucagacggggaugcgaaacuggagcgcuuagcagcaaaauuuaaaacccccgaacuugccgaagaauuuaaacagaaauuugaggagugucaacgcuuacugcuggauauccccuuacagacaccacacaagcucguagacaccggucgugcagccaagcugauccaaagagccgaagagaugaaauccggacugaaggauuucaagaccuuucugaccaacgaccaaacgaaagugacagaagaagagaauaaagguucagguacaggggccgccggagcaucagauacgacgauuaaaccgaaugccgagaauacuggcccuacccuggagugggauaacuacgaccucagagaagacgcccucgaugacucaguguccucauccuccgugcacgcuucuccucuggcuucuucucccgugcguaaaaaccuguuucgcuuugaugaaucuacuaccgggaguaauuucagcuuuaagagcgccuuaucuuugaguaaaucuccggcaaaacugaaucaaucugggacuucuguuggaaccgaugaggaauccguugugacacaggaggaagagcgagacggucaauauuuugaaccgguuguaccacugcccgacuugguggaagugagcuccggggaagagaaugagcagguaguguuuagucaccgcgcagaaaucuaccgcuacgacaaagacgugggccaauggaaggagagggguaucggcgacauaaaaauucugcagaauuacgacaacaagcaggucagaauuguaaugaggcgggaccagguuuuaaagcuaugcgcuaaucaucgcaucacucccgauaugagccugcaaaacaugaaggguacagaaagagugugggucuggacagcuugugauuucgcagacggagaacggaagguggagcaucuggccgugcgauucaagcuccaggacguggcagauuccuuuaagaaaauauuugaugaagccaaaaccgcccaggaaaaagacucacugauuacuccucacgucucaagaucauccaccccgcgcgaaaguccuugcggcaagauagcaguagccauucucgaagagaccacacgcgagcguaccgacgugauccagggugacgaugucgcagaugcagcuagugagguagaagucucgagcacaagcgaaacgacaacaaaggccguggucucaccccccaaauucguguuugucagugagagugugaagcgaauuuucagcagcgaaaagucaaaaccauucgucuuuggcaauuccagugcuaccggcucucucuucgguuucucuuucaacgcgccucugaaaaguaauaauucugagacuaguucaguggcccagagcgggucagaaucuaaaguagaaccaaagaagugcgagcugaguaaaaauuccgacauugaacaauccagcgacucuaaaguuaaaaaucugucagcuuccuucccgacggaggaaucgagcauuaauuacacauuuaagacaccagagaaggaacccccguuauggcaugcagaauuuacgaaagaagaacuuguccagaagcugcgaucuacaacaaagucagccgaccaucugaaugggcugcuucgagagaucgaggcuacgaacgccgugcugauggaacaaaucaaacugcuaaaguccgaaauaagaagacuugaaagaaaccaggaacgggaaaaauccgccgcaaaccucgaauaucucaagaacguucuucuucaguuuauuuuuuugaagcccggaucugagcgagaaagacugcuucccguuauuaacacuaugcuucagcugagucccgaagagaaaggcaagcuggcugccguugcucaggacgaggaggaaaaugcaucaaggucaucugguuag

SEQ ID NO: 249076 - RNA, 447 nt, Artificial Sequence
  Description of Artificial Sequence: Synthetic coding sequence
auggcccgcgcacuguguagacugccgcgcagaggacuuuggcucuuguuagcucaccaccuuuucaugaccacagcaugccaggaggcgaacuacggugcccugcuccgcgaauugugucuuacucaguuucagguugauauggaggcaguaggcgaaacccuguggugcgacuggggacggacaauuagauccuaucgagaguuagcggauugcaccuggcacauggccgaaaaauuggggugcuucuggccuaacgcagagguggauagauucuuccucgcugugcacggaagauauuuccggaguugcccuaucaguggccgcgccguaagggacccacccggaucaauccuguaccccuuuauugucguucccaucacagugacacuucugguuaccgcucucguuguuuggcagucuaagaggacugaagggaucguguag

SEQ ID NO: 249077 - RNA, 381 nt, Artificial Sequence
  Description of Artificial Sequence: Synthetic coding sequence
augaccacugccugccaggaagcgaacuacggagcacuccucagagaguuaugcuuaacacaguuucaaguggacauggaggccguaggcgaaacucucuggugugauuggggaagaacuauucguaguuaucgggagcuggcugauugcacuuggcacauggcagaaaagcuuggauguuucuggccuaacgccgaaguggauagguuuuuccucgcuguccauggaagauauuuucgcaguugucccaucucaggaagagcaguucgugaccccccagggaguauccuguauccauucauuguaguucccauaaccguaacccuuuuagugaccgcguuaguugucuggcaguccaagcguaccgagggcauaguguag

SEQ ID NO: 249078 - RNA, 381 nt, Artificial Sequence
  Description of Artificial Sequence: Synthetic coding sequence
augacuacugccugucaagaggccaauuacggugcgcuccugcgggaacucuguuuaacacaguuucagguugacauggaagccgugggugagacccuguggugugauuggggaaggacuaucagaaguuaccgugagcucgcagacuguaccuggcauauggccgagaaacucggauguuucuggccuaacgcugagguggaucgcuucuuccuggcaguucauggcagguacuuucgcagcuguccaauauccggcagagcagugagagacccaccuggaagcauacuauacccuuucaucgugguaccaaucaccguuacacuguuggucacagcauuggucguauggcaguccaagcgcacagagggaaucguauag

SEQ ID NO: 249079 - RNA, 381 nt, Artificial Sequence
  Description of Artificial Sequence: Synthetic coding sequence
augacaacagccugccaggaagccaauuacggcgcuuuguugagagagcuaugucuaacccaguuucaaguggauauggaggcuguaggggagacucuguggugcgacuggggccgcacuauccgaucauaucgugagcuugcagauugcacauggcacauggcugagaaacucgguuguuuuuggcccaacgcagaaguagauagguuuuuccuugcagugcacggaagauacuuuaggucuuguccuaucucuggcagagccguccgagaucccccuggcaguauacuauacccguucaucgugguuccuauaacagugacucugcugguuaccgcccucgucgucuggcaaagcaagagaacagaaggaauaguauag

SEQ ID NO: 249080 - RNA, 606 nt, Artificial Sequence
  Description of Artificial Sequence: Synthetic coding sequence
augguaagcuggauuaucaguagacuugucgugcuuaucuucggaacuuuguaccccgcauauuacucauacaaagcagugaaaagcaaggacauuaaagaauaugugaaguggaugauguacuggaucaucuuugcacuuuuuaccacagccgaaacguuuacggacaucuuccuguguugguucccuuuuuauuaugagcuuaagauugcguuuguagccuggcuccucucuccguacaccaagggcuccagccuuuuauauagaaaauucguucauccuacccugagcucuaaggagaaggagauagacgacugucuggugcaggcaaaggauagaucauacgaugcucuuguucacuucgggaagagaggacucaaugucgccgccacagcagccgugauggcagcuagcaaagggcaaggcgcucugucugaacgccugagaucguuuucaaugcaggauuuaacaacaauucgcggagauggcgcacccgcuccaucaggacccccuccgcccggcagcggcagggcuucaggcaaacacggucagcccaaaaugucucgcagcgccucggagagcgcuaguuccucagggacagcauag

SEQ ID NO: 249081 - RNA, 1293 nt, Artificial Sequence
  Description of Artificial Sequence: Synthetic coding sequence
augaagccuucucuuuuaugcagaccucucucuuguuuucugaugcuccuuccauggccccuggcuacucuaacaucgacuacacucuggcaaugccccccaggcgaggagcccgaucuggacccaggacaaggcacucuuugccgcccauguccuccuggcacauuuucagcugcuuggggaaguucccccugccagccucaugcucgguguucacuuuggcgacgauuggaggcucaagugggcauggcaacucgcgauacuuugugcggagauugcuggccaggcugguucggaccauggggaguuccgagggugccaugccagccauguaguugggcaccucugggcacacacggcugcgacgaaugggggagaagagcucgaaggggaguggaaguagcagcuggugccagcagcgggggugaaacgcgacaacccgguaacggaacccgggccggaggccccgaagaaaccgcggcccaguacgcugucaucgcgauuguuccgguguucugucugaugggcuuacuuggcauacuggugugcaauuuacugaagcgaaaaggguaccauugcacugcccauaaggaggugggaccagguccuggugggggcggcagcggaaucaaccccgcuuaucgaaccgaagacgccaacgaagauaccauuggugugcucguuagacucaucacagaaaaaaaggagaaugcugccgcuuuggaggaacuacugaaagaguaucauaguaagcagcucguacaaaccucccaccgcccuguuucgaaguugccacccgccccaccuaacguaccacacauuugcccacauaggcaucaucuacacacuguccaaggacucgcaucucugucuggacccuguuguucacgaugcagucagaaaaaauggccugaagugcugcucagccccgaagcuguggcagccaccaccccuguaccuucauuacugccgaaccccacucgggugccaaaagcaggggcgaaagcugguagacaaggagagauuacaauacucagcgucggucgguucagaguggcccggaucccugagcaacggacaagcagcaugguuucugaggugaagaccauuaccgaggcugguccuuccuggggagaccuucccgauuccccgcagccuggccuccccccagaacaacaagccuuacucggcuccggcggcagucggacaaaguggcucaagccccccgcagaaaauaaagcugaagagaacagauacgucguacgccugucagaauccaaucuggugaucuag

SEQ ID NO: 249082 - RNA, 1065 nt, Artificial Sequence
  Description of Artificial Sequence: Synthetic coding sequence
auggagguagaagccgugugcgguggagcaggcgaagucgaagcccaggauucggaccccgcgccagccuuuagcaaagccccaggaagugcuggccacuacgaacuacccuggguugaaaaguauagaccugugaaauuaaacgaaauaguggggaaugaagacaccgucucacgccuagaaguguucgcacgggaaggaaaugugccuaacaucauaaucgcagggccaccggggaccggaaaaacuaccaguauucuguguuuggcccgcgccuuacugggaccugcccugaaagaugcaaugcucgagcucaaugccuccaaugauagagguaucgacguugugagaaauaaaaucaagauguuugcacagcagaaaguaacucuccccaaaggcaggcacaaaaucaucauucuggacgaggcugacaguaugaccgauggagcucagcaggcucuccgccggacuauggaaauuuauucaaaaaccacacgguucgcgcuugcauguaacgccuccgauaagaucaucgaaccaauccaaaguagaugugcugugcucagauauacaaagcuuacagaugcccagauccuuacccgucugaugaaugugaucgagaaagagcggguucccuauacagacgacggacuugaggcuaucaucuucaccgcccagggagauaugcgccaggcccuuaauaaucuacagagcacuuucagcgguuuuggauucaucaacagugaaaacguguuuaaggugugugaugagccccauccuuuauuaguaaaagaaaugauccaacauuguguuaaugccaacaucgacgaagccuauaagauucuggcacaccucuggcauuugggcuauuccccagaggacaucauuggcaauauauuuagaguuuguaaaacuuuucagauggcugaguacuugaagcuggaauuuaucaaggagauuggguauacacauaugaagaucgcugaaggagucaauuccuuacuccagauggcaggauugcuggccaggcugugucagaagaccauggcgcccguagcuuccuag

SEQ ID NO: 249083 - RNA, 996 nt, Artificial Sequence
  Description of Artificial Sequence: Synthetic coding sequence
auggcacggggugggaggggaaggaggcucggccucgcucugggucuacuacucgcucuuguucuggcuccaagaguccuacgugcgaagccuacaguccguaaagagagaguggugcggccagacagcgaacugggagagagaccgccugaagauaaccagaguuuccaguacgaccacgaggcuuuccugggcaaagaagacuccaaaaccuuugaucagcugacaccugacgaguccaaggagcgucucgguaagauuguggauaggaucgacaacgauggugauggguuugugaccacugaagagcucaagacauggaucaaaaggguacagaaaagauacaucuucgacaacguggcgaaggucuggaaggacuacgaccgggacaaggacgacaaaauaagcugggaggaguacaaacaagcuaccuauggauacuauuugggaaauccagcugaguuccacgauagcucagaccaccauaccuuuaaaaaaaugcugccucgggacgaacguagauucaaggccgccgacuugaacggggacuuaacugcaacuagagaggaguucaccgccuuccuccauccugaagaauucgaacacaugaaggaaaucgugguccuggaaacccuggaagauauugacaaaaauggggaugguuucgucgaucaggaugaauacauugcugacauguuuucgcacgaggagaacggcccugagccagacuggguauuaagcgaaagggagcaauuuaacgaguucagggaucugaauaaggaugguaaacuggauaaggacgagauaaggcauuggauccuuccgcaagacuacgaucaugcccaggccgaagcucgccaccugguauacgaaagugauaaaaauaaagaugaaaaacuaaccaaggaagaaauacuggagaauuggaauauguuuguagggagucaggccacaaauuauggagaggacuuaaccaaaaaucacgaugaauuauag

SEQ ID NO: 249084 - RNA, 1422 nt, Artificial Sequence
  Description of Artificial Sequence: Synthetic coding sequence
augaagagggcaucagcuggcggaagccgauuacuagcaugggugcuguggcuucaagccuggcaaguggcugcuccaugcccaggcgccuguguguguuauaacgaaccuaaaguuacuacgaguugcccccagcagggauugcaggccgugcccguaggcauuccugccgccagccaacgaauauuucugcacgguaauaggauuucgcacguccccgccgccucauuuagagccuguaggaacuugaccauccuguggcugcauagcaacgugcuugcccgcauugacgcugcagcuuuuacaggacucgcucuguuagaacaacuggaucuguccgauaacgcucagcugcgguccgucgaucccgcaaccuuucacggcuuaggccgcuuacauacacuucaucuggauagaugcggacuucaggagcugggaccaggacuguuuagaggacuggcggccuuacaauaccuguaccuccaggacaacgcacugcaggcuuugcccgaugauacuuuccgagaucuaggcaaucugacucaucuguucuuacacggaaaccgaaucuccagcguacccgaacgcgcguuuaggggacuucauagcuuagaccgacugcuauugcaucagaauagaguggcccacguucauccccaugcuuucagagaccucggaagacugaugacacuguaccucuucgcuaacaacuuguccgcucugccaacagaggcacuggcaccauugcgugcauugcaguacuugagacucaacgacaauccauggguuugcgacugucgugcccgaccccugugggccuggcugcagaaauuccggggcagcucaagugaagugccauguagccucccccagcgccuggccggccgggaccucaaacgccuugcggcuaacgaccuccaggggugcgccguagccacgggcccuuaccauccaaucuggacaggcagagcuacggacgaggagccacugggccuuccuaagugcugccaaccugacgcugccgauaaagcauccgugcucgaacccggcagaccagccucagcggggaaugcccugaagggacgcgugccaccaggagacagccccccaggaaauggaucagguccaagacacaucaaugauucucccuucggaacucugcccgggagcgcugaaccuccauuaaccgcgguucguccugagggaucagagccacccgguuucccuacauccggaccacggaggcguccaggaugcucgagaaagaaucgcaccaggagccacugccggcuagggcaggcgggcaguggaggcggcggaacuggugacuccgaagguucgggcgcacuuccuucuuuaacuugcucucuuaccccucuaggacuggcucuuguguuauggacugugcugggaccuuguuag

SEQ ID NO: 249085 - RNA, 2949 nt, Artificial Sequence
  Description of Artificial Sequence: Synthetic coding sequence
augcuccccuccuccaguuggggcaagcgcaaauuaagggguagauuggguugggugcgcucugaugcccgcggcguuaugugggcuaggcaggagggucuucaucacccacacccgcacgcugugaucagaugccccaguaguagcucuagcucuguaucauguucgggggauucagaggaagaagacaugggauuacuggaggugagcgucuccgacaucaaaccucccgcccccgagcuggguccuaugccagaggggcucuccccgcaacaaguaguucgcagacacauuuuagggagcaucgugcaguccgaaggcucauacguagagagcuuaaaaagaauacugcaggacuacagaaacccgcugauggagauggaaccuaaagcacucagcgcccgcaaaugccaggugguguuuuucagagugaaggaaauauugcacugucacuccauguuucagaucgcacuauccagccgggucgccgaaugggacagcacugaaaaaaucggggauuuguuugucgccucggauaugcuuaagaauaccccacgcgggcacccagaccgccugagcuuacaacuggcccuuaccgaauuagagacacuugccgaaaagcugaaugagcagaaaaggcucgccgaccagguggcagagauccaacaauuaaccaaauccgucagugaccgauccucgcuaaauaagcucuuaacaucugggcaaaggcagcugcugcugugcgaaaccuuaacugagacagucuauggcgauagaggacagcucaucaaaucaaaagagcgcagggucuuccuguuaaacgacauguuaguuugcgccaacauuaacuuuaagggccagcuggagauuaguucacuggugccucugggcccuaaguacguugugaaauggaacacggcauuaccacagguccagguggucgaggucggacaagauggagguacguaugacaaggauaauguucucauacagcauaguggugcuaagaaagcguccgcuucaggccaggcccaaaauaaaguguaccucgggccuccccgucuguuucaagagcugcaggauuuacagaaagaccuggcaguggucgagcaaaucacauuauugaucuccacucugcacggaacauaccagaaucucaauaugacuguggcucaggacuggugucuugcccuacaaaggcugaugcgcgugaaagaggaagaaauccauagugccaauaaaugccgacuccgacuucuccugcccgguaaaccugauaagucugggcggccuaucuccuucauggucguuuuuauaacuccgaacccccugucaaaaaucaguugggugaaccgucuccaccucgccaagaucggacucagggaagagaaccagcccggguggcucugccccgaugaggacaaaaaguccaaagcaccuuucugguguccaauccuugccugcuguauuccugcauucagcuccagggcccugucccuucaguugggcgcuuuagugcauucccccgucaacugucccuuauuagguuuuagugccgucuccaccucccugccacaagguuacuuauggguggggggaggucaggagggagccggcggucaagucgagauuuuuagccugaauagacccuccccuagaacagugaagagcuucccucuugcagcccccguacuguguauggaauauauuccugaacucgaggaggaagccgaauccagagacgaguccccaaccgucgcggaucccagugcaacaguucaucccacaauuugcuuaggacuccaggauggaucuauucugcuguauucaagcguugauacuggaacccagugucuugucucuugccgaaguccuggccuucaaccgguacugugccuucgacacuccccguuucaucugcuggcaggguugcaagauggaaccuuggcggccuaccccagaacgaguggcggcguacugugggaucuggaaagccccccugugugccugacugugggaccuggaccuguuagaacgcuuuugucccuagaggaugcugugugggcgagcugugguccauggguuaccgugcuagaagccacgacgcugcagccccagcaaucuuucgaagcacaccaagaugaagccgugagcgucacccauauggucaaggcuggcaguggugucuggauggccuuuuccucagguacaucuaucagacuguuucacaccgagacccuugagcaucugcaagaaauaaauauugcuacccgcacaaccuuccugcugccugggcaaaaacaccugugcgugacgucuuuguugauaugccaaggacugcuuugggugggaacugaccagggcgugauagugcugcuucccgugccuagacuggaagggaucccuaagaucacuggcaaggguaugguaagucucaauggccacuguggaccuguugcauuucuugccgucgcaaccuccauuuuggcccccgacauccucagauccgaccaagaggaagcagagggcccuagggccgaggaggacaaacccgacggacaagcacacgaaccaaugcccgauagccauguaggcagagaacugacaagaaaaaaggggauucucuuacaguaucggcuccgcuccaccgcacaccugccuggaccccuucuuucgaugagagaaccggcgccagcagauggugcagcacuggagcauagugaggaggaugguucaauauacgaaauggcagaugaucccgacauaugggugagaaguagacccugcgcuagggaugcucacagaaaagagauuuguucaguugccaucauuagcggcggccagggguauaggaacuuuggaucugcccuggggagcuccggcagacaggcccccuguggagagaccgacagcacccuccugauauggcagguucccuugauguuguag

SEQ ID NO: 249086 - RNA, 4794 nt, Artificial Sequence
  Description of Artificial Sequence: Synthetic coding sequence
auggaagccgaagaggcccagcgcggugcuucaccccccaucagcgcuaucgaagaauucaguauaaucccagaagcuccgaugcguuccagccaggucuccgcccuaggauuagaagcucaggaagacgaggacccaucauacaaauggcgagaggagcaucgccuuagugcgacccagcagagcgagcugagagacgucugcgauuaugccauugagacuaugccgagcuuuccuaaagaggguucugcagacguugaaccaaaccaagagucacugguggccgaggcuugcgacacucccgagcacugggaggccguaccacagagccucgccggcaggcaagcaagaacucuugccccccccgaacuaugggcgugcccuauacagucagaacaucuugacauggcaccauucucaagcgauuuaggauccgaagaagaagaaguagaguuuuggcccggccugacaucauugacuuuggguagcggacaggcggaggaggaggaggaaacauccagcgacaauaguggacaaacgcgcuacuauucacccugcgaggaacaccccgcugaaacuaaccaaaacgaaggcagcgaauccggaaccauacggcagggggaggaacuccccccagaggaacuccaagagagccagggguugcugcauccacaagaaguacagguccuggaggagcaaggacaacaggaagccggauuucggggcgaagguacucucagggaagacgugugcgccgauggacuuuugggcgaggaacaaaugaucgagcaggugaaugaugaaaaaggagaacagaagcaaaaacaagaacagguacaggauguaauguuagguagacagggcgagcggaugggacucaccggagagccggaagggcuaaacgauggagagugggaacaagaggacauggagagaaaggcccagggacaaggaggccccgaacagggcgaggagaggaaaagagaguugcaaguacccgaagagaaccgggccgauagccaagaugaaaagucacagacauuucuggggaagucugaggaggucacaggcaaacaagaagaccacgguaucaaagaaaagggcgugcccguuucaggucaggaggcaaaggagcccgaaucuugggauggagggcgauuaggcgcaguuggcagggcgagaaguagggaagaagagaaugagcaccauggcccgucgaugcccgcccuuauagcccccgaagauuccccacacugugaccuguucccaggagcuagcuaccucaugacacagaucccaggaacccaaaccgagucuagagccgaggaacugagcccggcugcucugagcccaucccuggaacccauccgcuguagccaccagcccauaucucucuuggggucuuuccugaccgaggaaucucccgacaaggaaauagaccaaaacagccagcaagaagaauccaggcugagaaaagguaccguaucaucacaagggaccgaaguugucuuugcuagcgccagcgugacaccuccucgcacaccugauucugccccaccuuccccugcggaggcauacccgauuaccccugcaagcguuucugcacguccucccgucgcauuucccagaagagaaacuagcugcgccgcgcgggcccccgaaacugcuucugcuccacuaucuauggacgaucccagcccaugcgggacuucagaaaugugcccugccgcccuuuacggcuucccuagcacagguacuagcccuccacgccccccagccaacucaacaggcaccgugcagcaccuacguucugacuccuuccccggaucucauagaacugaacagacgccagaccuggucgguauguuguuaagcuauucacacagcgagcuuccacagaggccuccaaaaccagccaucuacaguucgguuacaccacgccgggacagacgguccggucgugauuacucuacagucucagcaaguccgacagcccugucaacccuaaaacaagauucucaggaauccauauccaaccuugagagacccuccucuccgcccucuauccaaccguggguuucaccgcacaaucccgcuuucgccacagagagcccagcuuaugggucaucucccaguuucgugucgauggaagauguacggauccaugaaccuuuacccccaccucccccccagaggcgcgauacccacccuagcguuguugagacugacggccacgcuagagucguggugcccacacuuaagcagcacagucacccaccaccauuagcucuggguaguggccuccacgccccacauaaagggccccuuccacaagccagcgaucccgccgucgcccgccagcaccgaccccuacccuccaccccugauuccagucaccaugcacaggccacaccacgauggagguacaauaagccccucccuccaacucccgaucuuccccagccccaccuaccucccaucucagccccaggcucaaguaggauuuacagaccccuuccuccacugccuauaaucgaucccccaacagagccacccccucuuccccccaaauccagaggacggucaagguccaccagaggcggacacaugaauaguggcggccaugcuaagaccagacccgcuugccaggacuggaccguuccauugcccgccucggcaggacgcacuaguuggcccccggcgacggcaaggucuacagaaaguuuuacaucaaccucccgaucuaaaucugagguaaguccaggaauggcauuuaguaacaugacaaauuuucugugucccaguaguccaacaacuccguggaccccagaacuccagggacccaccucaaaagaugaagccggcguuagcgaacaccccgaagcuccagcccgagagccacugaggaggacaacuccacaacagggagccuccggaccaggacgaaguccagucggucaagccagacagccugagaaaccaucacacuuacaccucgaaaaagccucuucauggccucacagaagagauucgggccgacccccuggagacuccucaggccaagcuguggccccaagcgaaggggccaauaaacacaagggguggucccgacagggacugagaaggccauccauccucccugaaggaaguuccgacuccagaggccccgcuguggaaaagcauccagggcccagcgacaccgugguauuuagggaaaagaaaccaaaggaagugaugggcggguucaguagaagauguucuaaacuuaucaauuccucccaacugcuguaucaggaauacucugauguaguccugaauaaagagauccagagccagcaacgauuggaaucacuuagugagacacccggaccaagcuccccccgucagccccggaaagcacuagugaguucagaaucuuaucugcaaagacugagcauggcgucuucaggaucacuguggcaggaaauaccuguuguuaggaauucaaccgugcugcuguccaugacccaugaagaucaaaaacuccaggagguuaaguuugagcuuauugucuccgaagccagcuauuuaagaucacugaacauugccguggaccacuuccagcugucaacaucccuacgagccacccugucaaaccaggaacaccaauggcucuucuccagacuucaggaugugagagacguuucagcaacuuucuuaucagaucuagaggaaaauuucgagaacaauaucuucucuuuucaggugugugacguagugcucaaucacgcucccgacuuuaggcgggucuaccuuccuuaugugacuaaccagacuuaucaagaaagaacauuucaaagcuugaugaacuccaacagcaacuucagagaagugcucgagaagcucgaguccgaucccgugugccagagacugucgcucaaaucauuucuuauucugccauuucaaagaauuacucgguuaaaguuauugcugcagaauauucuuaaacguacacagcccggaaguagcgaagaagcugaagccacuaaagcucaccaugcacucgaacagcuuauucgggauugcaauaacaacgugcagagcaugaggcgcaccgaagaacugauuuauuugucgcaaaagaucgaguucgaauguaaaauuuucccucugauuucccagucccgcugguugguuaaaagcggcgagcucaccgcucucgaauucuccgcgagccccggccugaggaggaagcuuaacacacgaccaguucaccuacaccuauucaaugacugccugcugcuuucccgacccagggagggaucccgauuccuuguguuugaccacgcgccauuuucuuccauacggggcgaaaaaugugaaaugaaguugcacggaccucacaagaaccucuuuagacucuuuuuaagacagaacacccagggcgcccaggccgaguuccucuuucggaccgaaacucaauccgaaaaacugagauggauuagcgcccuugccaugccccgagaggaacuugaccugcuagagugcuauaacagcccucaagugcagugccugcgggcuuacaagccaagagaaaaugaugaacucgcccucgagaaggccgauguagugaugguaacccagcagucgagugacggcugguuggaagggguuagacugucagauggugagagagguugguuuccaguacagcaaguagaguuuauauccaacccagaaguuagggcccagaacuugaaggaggcucauagagugaaaacggccaagcugcaauugguugagcaacaggcauag

SEQ ID NO: 249087 - RNA, 573 nt, Artificial Sequence
  Description of Artificial Sequence: Synthetic coding sequence
uaaccacaagguguugacauuagacauaacaaggauagaaagguucgccgaaaagaaccaaaaucgcaggacaucuauuugcgucuauuagugaaauuauaccgauuuuuggccagaagaacgaauucgaccuucaaucagguagugcugaagcgcuuguuuauguccagaacuaaucggccccccuugucccuuucacguaugauacgcaagaugaagcucccuggcagagagaauaaaaccgcugucgucguaggcaccauuacagaugacguacggguccaggagguccccaaacugaaagucugcgcacuccgggucaccucgcgagcaagaaguaggauccuaagggcaggcggcaagauucucaccuucgaucaauuagcucuggauagcccuaaaggcugugguacuguguuguuaaguggcccccgcaaaggacgcgagguauauagacauuucggcaaggcgccggguaccccacauucccacaccaagccuuacguucgcaguaaggggaggaaauuugagcgagcuagaggcagacgugcuucccggggcuacaagaacuag

SEQ ID NO: 249088 - RNA, 360 nt, Artificial Sequence
  Description of Artificial Sequence: Synthetic coding sequence
auggcuuucaaagauacaggcaagacuccaguugaaccugaaguagccauccaccgcauuaggaucacucuuaccucaagaaacguaaaaagcuuggaaaaagugugcgcagacuuaauaaggggcgcgaaagaaaagaaucugaaagugaaggguccggugaggaugcccacaaaaacucuuagaauaacaacacgcaagacccccugcggcgaaggaaguaagacaugggaccgguuucagaugaggauccacaaacgacugauagaccugcacucaccuucagaaauagugaaacaaauuaccaguauuucaauagaacccggaguggaaguugaaguaacuauugcagaugcauag

SEQ ID NO: 249089 - RNA, 1998 nt, Artificial Sequence
  Description of Artificial Sequence: Synthetic coding sequence
augacuagcgcaaacaaagcuauugaacuucagcugcagguuaagcagaacgcagaggagcuacaagauuuuaugcgagaucuggagaacugggagaaggacauaaaacagaaggauauggaguugcgaagacagaauggcguccccgaggagaaucugccuccaauaagaaacgguaauuucaggaagaagaaaaagggcaaggcuaaagagagcucaaagaagacccgggaagagaacacuaaaaacaggauuaagucauaugauuacgaggccugggcaaaacuugacguggacaggauacucgacgaguuagauaaggacgacagcacucaugaaagucuaucucaagaguccgagucugaagaagauggcauccacguggauucccaaaaagcguuaguucugaaggagaaaggcaauaaauacuucaagcaggguaaauacgacgaggccauugauugcuauaccaaaggcauggaugcugaccccuauaauccuguccugccaacuaauagagccucagcuuauuuccgucuuaagaaguucgccgucgcugaguccgauugcaaccucgccgucgcacugaaucguagcuauaccaaggccuacuccaggcgaggugccgcccgauuugcucuucaaaaguuggaagaagcaaagaaggacuaugagagaguauuagagcuggaaccaaauaauuuugaggccaccaacgaauuacggaaaauuucacaggcucuggcaagcaaagagaauaguuacccuaaagaagcggauaucgugauuaagagcaccgaaggagagcggaaacagauugaagcacagcaaaacaaacagcaggccauuagcgaaaaagaucggggcaaugguuucuuuaaagaagguaaauacgagagggcuauugaaugcuacaccagaggaauugccgcagacggcgcaaacgcacuguuacccgccaauagagccauggccuaccuaaagauacaaaaauacgaagaggcagagaaggacugcacacaggcuauccuuuuggauggcaguuauaguaaggcauuugcuagaagggguacggccagaaccuuucucgguaagcuuaacgaggcuaaacaggauuucgaaacugugcugcucuuggagccagguaauaaacaggcaguuaccgagcucucgaaaaucaagaaagaacugauagaaaagggccauugggacgauguguucuuagacucuacccagagacagaacguuguaaaaccuaucgacaauccuccacaucccgguaguacuaagccucuaaagaagguuauaauagaagaaacugggaaccugauucaaaccauugaugucccugauagcacaacugccgccgccccagaaaauaaccccaucaaucuggcuaacgugauugcagcuaccggaaccaccaguaagaagaauagcucccaagacgaccuuuucccuacaagcgauaccccccgcgcaaaaguguuaaaaauagaggagguaucagacacauccucccuucagccucaggccuccuuaaaacaggaugugugucaguccuauagugagaaaaugccuauagagaucgaacagaaaccugcccaguuugccacuaccguccucccacccauaccagccaauucguuucagcuugaguccgauuuucgccagcucaagucuagcccagacauguuguaucaguaccuuaagcagaucgagccgucccuguacccaaagcucuuucagaaaaaucuagaccccgauguguucaaucagaucgugaaaauacuccaugacuuuuauauugaaaaggagaaaccccuccuaauauuugagauucugcagcguuuaagugaauugaaacgauucgacauggcugucauguuuaugagugagacugagaagaaaauugccagagcucuuuuuaaucauauugacaaaucuggacuaaaagauucaagcguugaggagcugaaaaaaagauauggaggauag

SEQ ID NO: 249090 - RNA, 636 nt, Artificial Sequence
  Description of Artificial Sequence: Synthetic coding sequence
augaucagucguauggaaaagaugaccaugaugaugaaaauacugauaauguuugcccuugguaugaauuauuggaguuguagcggcuuucccguguaugacuacgaccccucaagccuccgagacgcauuaucagccaguguggugaaggugaacucucagucccugucccccuaccucuuccgugccuuccggaguucgcuuaaacgggucgaaguucucgaugaaaauaaucugguaaugaauuuggaguuuuccauccgcgaaaccaccugucggaaagauucaggagaggaccccgccacaugcgccuuccaacgggacuacuacgucucuacagccgucugucguucuaccguaaagguaucggcccagcaaguacaagggguucaugcgcgcuguuccugguccucuuccaccucagaaagcuauucuagugaggagaugauuuuuggagacauguugggcucucacaaguggaggaauaauuaccuuuuuggccucauaagugacgaaagcauuagcgaacaguuuuacgaucguagccuggguaucaugcgacgcguucuaccuccuggaaacagaagguauccuaaucauagacacagggccagaauuaacaccgacuucgaauag

SEQ ID NO: 249091 - RNA, 1323 nt, Artificial Sequence
  Description of Artificial Sequence: Synthetic coding sequence
augcgcccucaucucuccccaccguugcagcagcuccuacuaccugugcugcuggcgugcgcugcacacuccacaggcgcucuaccccgccuaugcgauguccuacaggugcucugggaagaacaagaucagugccugcaagagcuuucucgggaacaaacaggcgaucucgguacugaacaacccgugccuggaugugaggggaugugggacaauaucagcugcuggcccagcucagugcccggaagaaugguggaaguggaaugcccccgauucuugagaaugcugaccucucguaauggcucgcuuuuuagaaacugcacccaagacggcuggucggaaacauucccucguccgaauuuggcaugcggggucaacguuaacgacucaagcaaugaaaaacgccacucuuaccugcucaaguugaaggugauguauaccguaggcuauuccucaucccugguuaugcuucugguggcacucggcauacugugcgcuuuuagacgacugcacuguacccguaacuacauccacaugcaucuguuugugaguuuuauacuucgcgcucuguccaauuuuaucaaggacgccguccuauuuucuagugacgaugugaccuacugcgaugcccaccgcgccgggugcaaacuugugaugguacucuuucaguauuguauaauggcaaacuauucauggcuucucguggaaggacuauaccuccauacauuacucgcuauuagcuuuuuuagugagcggaaauaucugcagggcuucguugcauuuggaugggguagcccggcuauauucguagcucuuugggcgauugcccgacauuuucuggaagacgucggcugcugggauaucaacgccaacgcuucuaucugguggauuauucguggcccaguuauacuauccauucugaucaauuucauacuguuuauaaauauccuccggauccucaugagaaaauugcggacucaggaaacaagaggaaacgaggugucccauuauaagcgauuagcuagaucaacauuacuccugauuccauuauuuggaauucauuauaucguauuugcauucagcccugaggacgccauggagauucagcuguuuuucgaacucgcauuaggcagcuuucaaggccuugugguagcggucuuguauugcuucuuaaauggagagguccaauuggaagugcaaaaaaaauggcagcaguggcaucuacgggaauuuccacuccauccugucgcuucauucagcaacuccacaaaagcuucacauuuggaacaaucacagggaacauguagaacuagcauuauauag

SEQ ID NO: 249092 - RNA, 363 nt, Artificial Sequence
  Description of Artificial Sequence: Synthetic coding sequence
augaaacuuuuaaugguccugaugcucgccgcccucagucagcacugcuaugccggcuccggauguccccuccucgaaaacguaauuaguaaaaccaucaauccccagguuuccaaaaccgaguauaaggaacuguugcaagaauucauugaugauaaugcaacaacaaacgcgaucgacgagcucaaggaaugcuuucucaaucagaccgacgaaacccuaucaaacgucgagguguuuauggucaucucauuuucaucauacaagcuuuuuaagucucccgaucaaggucagguggguuccucuuuccuuacugauaacgcaaaagccaccuccgagcaggccuuuucuuacauagguuag

SEQ ID NO: 249093 - RNA, 1092 nt, Artificial Sequence
  Description of Artificial Sequence: Synthetic coding sequence
auggcaaugagacagacaccacucacaugcagcggucauacaagaccuguggucgauuuggcauuuaguggaaucacaccuuacgguuauuuccugauuucugcaugcaaaggcgcaggacagcaucucccucgcuuaucuggacagcaugaugguaaacccaugcuacgccagggcgauaccggcgacuggauaggaaccuuccugggucacaaaggggccguguggggcgcuacauugaauaaggaugcaacaaaagccgcaacagccgcugccgacuucacugccaaggugugggacgcggugucuggggacgagcuaaugacguuagcacauaagcacauugugaagacgguagauuuuacccaggacagcaacuaccuucugaccggcggacaagacaaacugcugcgcaucuaugauuugaacaaacccgaagccgaacccaaagaaaucaguggucacacuuccggaauuaaaaaagcucugugguguucugaagauaagcaaauucugucagcugacgauaaaacuguccgguugugggaccacgcgaccaugaccgaaguuaagucucucaauuucaauaugagcguguccagcauggaauacaucccugagggcgaaauccuaguuauuacauacggcaggucuauagccuuucacagcgcugucagucuggacccaaucaaaucauucgaggcuccugcuacaauaaacucagccagcuuacaucccgaaaaggaauucuuaguggccggaggugaggacuuuaagcucuauaaauacgauuauaacagcggcgaggaacucgaaagcuauaaaggucacuuuggcccgauacauugcgugcgcuuuucaccugauggcgaauuguaugcuucugguagugaggacggaacucucagauuauggcagacuguuguuggaaagaccuacggacuguggaaaugcguacuaccagaggaagacucaggugagcuagcuaagccaaaaaucggcuucccagagaccacagaagaggagcuugaggaaaucgcaucugaaaacucggauuguaucuucccauccgcgccagacguaaaggccuag

SEQ ID NO: 249094 - RNA, 1335 nt, Artificial Sequence
  Description of Artificial Sequence: Synthetic coding sequence
augaaagucgucccaucccuccuauugagcguacuccuugcucaaguuuggcuggucccgggucuggcacccagcccucagagucccgaaacacccgcaccacagaaccagacgucaagggugguacaagcacccaaagaagaagaggaagaugaacaggaggcuucagaagagaaagcaagugaggaagagaaagcauggcugauggccucucgccaacaacuggccaaggaaacauccaacuucggguucucucugcugcgcaagauuaguaugcgccacgauggaaauaugguguucuccccauucggaaugucccuugccaugaccggauugauguuaggggcuaccggucccaccgaaacacagauuaagcguggccuacaucuccaggccuugaagccuaccaagccgggguuacucccaucuuuguuuaagggucuaagagaaaccuugucucgaaaccuggagcucggcuuaacccaaggaagcuucgccuucauccacaaagacuuugaugugaaagagacguuuuuuaacuugagcaagcgcuauuucgauacugaaugcguaccaaugaauuucaggaacgccagccaggccaaaagacugaugaaucauuauauuaacaaggagaccagaggaaaaauaccuaaacucuucgacgaaauaaaccccgagacgaagcucauccuuguggauuauaucuuauuuaaagggaaauggcuaacaccguuugauccagucuucacagaaguggauaccuuucaucucgacaaguacaagacgaucaagguaccuaugauguacggagccgguaaauucgcaagcaccuuugauaaaaacuuccgaugccauguccuuaaacugccauaccagggaaacgcuacaaugcucguggugcugauggaaaagaugggcgaucaucuggcccucgaggacuaucuuaccaccgacuuaguugagaccuggcugcgcaauaugaagacccgcaauauggaagucuuuuuucccaaauucaagcuagaccagaaguaugagaugcacgaauuacucaggcagaugggcauucgucggauuuucucucccuuugcagaccugucggagcugagcgcaacaggaagaaacuugcaggucaguagggugcuucaacgcacaguaaucgaaguagaugaaagggguacagaagccguggcuggcauuuugagugagauuacugcuuacagcaugcccccagugauuaaaguggauagacccuuucauuucaugauauacgaggagaccuccggaauguuacuuuuuuuaggcagaguugugaacccgacccucuuguag

SEQ ID NO: 249095 - RNA, 1335 nt, Artificial Sequence
  Description of Artificial Sequence: Synthetic coding sequence
augaaggugguucccucacugcuucugagcguacuauuagcccaaguguggcugguucccggacuugcuccuucaccccagagucccgagacacccgcuccacagaaccaaaccucgcgcguugugcaagcacccaaagaagaagaggaagaugaacaggaagcuucagaggagaaggcaucagaagaagagaaagccuggcuaauggccucgcggcagcagcuugccaaagaaacauccaauuucggcuucagccugcuuagaaagauaagcaugcgccaugaugggaauaugguguucuccccuuuuggaaugucucuggccaugaccggauugaugcuuggcgcaacgggcccgacagaaacacagauuaagcggggacuccauuugcaagcccucaaaccuaccaagcccggccugcucccuucucuuuucaaaggacuccgagagacccuuagccgcaaccuugagcuugggcugacacagggaucuuucgcuuucauucauaaggacuuugauguuaaagagaccuucuuuaacuugaguaaacguuauuucgacacugaauguguuccaaugaauuuccgaaaugccucccaggcaaaacgacucaugaaccauuacauuaacaaagaaacccgcggcaagauccccaagcuauuugaugagaucaauccagagacgaagcuaauccugguagauuacauccuguuuaaagguaagugguuaaccccuuucgauccaguguucacugaaguugacacauuccacuuggacaaauauaagacaaucaaagugccgaugauguacggagccggaaaauucgcuuccacauuugauaaaaauuucaggugccaugugcugaaacuccccuaccagggaaacgcuacaauguuggucgugcuaauggagaaaaugggggaucaccuagcccucgaggauuaucucaccacagaccuaguagaaaccuggcugcguaauaugaagacucggaauauggaggucuucuuccccaaguuuaaacuggaccaaaaauaugagaugcaugaacugcugcgacaaaugggaaucaggagaaucuuuucgccuuucgcugaccugagcgaauugagugcuacuggccggaaccugcagguaucuagagugcuccagcggaccguaaucgagguugacgaaagagguacagaggcaguagcagguaucuuauccgagaucaccgcauauucgaugcccccagucauuaaagucgacaggcccuuccauuucaugaucuaugaagaaacuuccgggauguuauuguuucucggucgcguagugaaccccacccuccuuuag

SEQ ID NO: 249096 - RNA, 1335 nt, Artificial Sequence
  Description of Artificial Sequence: Synthetic coding sequence
augaaaguuguccccucccugcugcuguccguauugcuagcgcaaguguggcuugugccuggacuagcgccgucaccacaaagcccagaaacuccagccccucagaaccagaccucacggguggugcaagcgccuaaagaggaagaagaagacgagcaggaagcgucugaagaaaaggcgucagaagaagaaaaagcauggcucauggccucucgucagcaauuagccaaagagaccucaaauuuugguuucucauugcugcgaaagaucucaaugcgacaugacggaaauaugguguucuccccuuuugguaugagucuggcgaugacuggccuuauguuaggcgcgacuggaccaaccgaaacacagaucaaacgcggccugcaucuccaggcccuuaaaccuaccaaacccggauuacugccaucccuguuuaaggggcuccgggaaacccucucacgaaaccuggaacucggccuaacacagggguccuucgcauucauucacaaggacuuugaugugaaagagacuuuuuucaaucucucaaaacgcuacuuugauaccgaaugcguccccaugaacuuuagaaacgccucccaagccaaacggcugaugaaucacuauaucaacaaagagacacgcggaaagauuccuaagcuuuucgaugagauuaauccagaaacuaaguugauucucguggacuacauacucuucaagggaaaguggcucacccccuuugaucccguuuuuaccgaggucgauacuuuucaccuggauaaauauaaaaccauuaaaguaccaaugauguacggugcuggaaaauuugccucuacuuuugacaagaauuuccgaugccauguucugaaacuuccauaccagggcaaugccaccaugcuggugguacucauggaaaagaugggcgaccaccuugcccucgaggauuauuugacgacggacuuaguggagacauggcugcggaacaugaaaaccaggaauauggaaguguuuuuucccaaauuuaaacuggaucagaaauacgagaugcacgagcuccuccgacagaugggaauucggcgaauauuuaguccauucgcggaccuuagcgaacucucagccaccggaagaaaccugcaagugagcagaguccugcaacgcacugugaucgagguagacgaaagaggaaccgaggcaguggccggcauucugucugagauaacugccuauucaaugccccccguuauuaagguggauagaccuuuucauuuuaugauauacgaagaaacaucagguauguuacuguuccucggccgcguggugaauccgacucuucuguag

SEQ ID NO: 249097 - RNA, 1455 nt, Artificial Sequence
  Description of Artificial Sequence: Synthetic coding sequence
augaguaggagcacacaagaguugcuuggguaccauugucgucuucaggauaaauugcaagaacaggaaggaagucuggcagccgagggccggcauaguuuggccucagccgcugaucacaugaaagucgucccaagcuuguuacugucagugcuccuggcacaggucuggcucguucccggucuggccccauccccucagucccccgagacuccagcaccucaaaaucagacaucccgagugguccaagccccaaaagaagaggaggaggacgagcaggaagcuagcgaggaaaaggccucugaggaggagaaagcuuggcugauggcguccaggcagcaauuagcuaaagaaacuuccaauuucggauucucacugcucaggaagaucaguaugaggcaugaugguaauaugguuuucucccccuucgguauguccuuagccaugaccggccugauguugggcgcuaccggcccuaccgagacacagaucaagagaggacuucaccuacaggcccugaaaccuacuaagccuggauugcuucccucacuguuuaaaggacugagagaaacacugucacgcaaucucgaacuggggcuaacgcaaggcucuuuugcauucauccacaaagacuucgacgugaaagagaccuuuuucaaccugagcaaacgguacuuugacaccgagugugugccuaugaauuuucgcaacgcuucccaggccaagcggcugaugaaucauuauaucaacaaggagaccagaggcaagauucccaagcuguucgaugaaaucaacccagaaacgaaacucauacugguggauuauauccuauuuaaagguaaguggcugacccccuuugacccuguuuucaccgagguagauaccuuucaccuggauaaguacaaaaccauuaaaguaccaaugauguacggcgcggguaaauucgccuccacauucgauaaaaauuuucggugccauguucugaaacugccuuaccagggaaacgcuacuaugcuuguuguucuuauggaaaaaaugggugaccaccuggcuuuagaggauuaccugacuacugaucugguggaaacuugguugcgaaacaugaaaacaaggaauauggaggucuucuucccuaaauucaaacucgaccagaaguacgaaaugcacgagcugcugcgccagaugggaauacgacggaucuuuagcccuuuugcagaccucagugaacugagcgccaccggcagaaaucuccaaguuuccagagugcuccagaggacagugauagaagucgaugaacgaggcacugaagccgucgccgggauucucuccgagauaacagcuuauucuaugcccccaguuaucaaaguggauaggcccuuccauuucaugaucuacgaagaaaccuccggaaugcuucuauuccuuggcagaguagucaaccccacuuuacuauag

SEQ ID NO: 249098 - RNA, 1197 nt, Artificial Sequence
  Description of Artificial Sequence: Synthetic coding sequence
augaacuggcaucucccccuauuuuuauuggcauccgugacacuuccguccauauguucccacuuuaauccucucagccuugaggaauuaggcucuaauaccggaauucagguguucaaucagauugucaagucacggccucaugacaacauagugaucucaccucacgguaucgccagcgugcuuggaaugcuacaguugggcgcugaugggagaacuaaaaagcaguuggccaugguuaugcgguauggugugaacgggguaggcaaaauucuaaaaaaaaucaacaaggcaauagugagcaagaaaaauaaagauauugucaccguggccaacgcuguuuucgucaaaaacgcauccgagauugaagugccauucguuacgaggaauaaagacguuuuucagugcgaaguacgaaacgugaacuucgaagaccccgccuccgccugugauucuaucaacgccugggugaaaaacgagacuagggauaugauugauaaccuacugucaccggauuuaaucgacggggugcugaccagacucguauuagugaaugcuguuuauuucaaaggacuguggaaaucucgguuccaaccugaaaacacaaagaaacgcaccuuuguggcagcagacggcaaaucguaucaagugccaaugcucgcacagcucucuguguuccgcugugggaguacauccgcaccaaacgacuuaugguacaacuucaucgaacugccauaccacggagaaagcaucucuaugcugaucgcccuucccaccgagucuuccaccccccuuuccgccaucaucccucacaucucuaccaaaacaauugacucuuggaugaguaucauggugcccaaacgaguucaagucauacuuccaaaguuuacagcagucgcccaaaccgauuuaaaagagccacugaaagugcuuggaaucacagauauguuugauagcaguaaagcaaauuuugccaagauuacuacaggcucagaaaaucuacaugucucucauauccuucagaaggccaaaauugaaguaucugaggaugguaccaaggcauccgcugcuacgaccgccauuuugauagcucgcuccagcccuccuugguucauuguugaucgcccguuucuguucuuuauucgucacaauccaacgggagccguuuuguuuauggggcagaucaauaagccguag

SEQ ID NO: 249099 - RNA, 1194 nt, Artificial Sequence
  Description of Artificial Sequence: Synthetic coding sequence
augaauuggcauuuaccccucuuccuauuggcaaguguaacgcuacccucgauuuguucccauuuuaacccauugucgcucgaagaacuugggucaaacaccggcauccaggucuuuaaccagauaguaaagagucgcccccaugacaauauuguaaucucuccacacggcaucgcuucagugcuuggaaugcugcaacuaggggcagacgggagaaccaagaagcaguuggccauggugaugcguuauggugugaauggaguugguaagauucugaagaagaucaauaaagcuaucgugucaaaaaaaaacaaggacauugugacgguugcuaaugcuguguuuguaaaaaaugccuccgaaaucgagguuccuuucgucacacgcaauaaggauguauuccaaugugaaguccgcaacgugaauuuugaggauccugcuuccgcuugcgacaguauuaacgcuugggucaagaaugagacacgugacaugaucgacaaucuccuuagcccagaucugauugauggcgugcugacucgccuuguguugguuaaugccguguacuuuaaaggacuguggaaaucaagauuucagccggagaacacuaagaagaggaccuuugucgcagcugacggcaaaagcuaccaaguucccaugcucgcgcaauugucuguguuucgaugugguagcacuucugcacccaaugaucuuugguauaacuuuaucgaacugccauaccauggagaaagcauuuccauguugauagcccugcccacugaaucuuccacuccuuuguccgcuauuaucccccauaucuccaccaagacuaucgacagcuggaugucuauuaugguuccaaagcgaguccaggugauacugccuaaguucacugccguagcacagacugauuuaaaagagccuuugaagguuuuagguauaacugacauguuugauagcaguaaagcuaauuuugcaaaaauuacaagauccgagaaucuccaugugucacacauucuccagaaggccaaaauugaggugagcgaagacggcacaaaagcgagcgcugcaacuaccgcaauccugaucgccagaucuaguccuccuugguuuauaguugacagaccuuuucuguuuuucaucagacacaauccaaccggcgcugugcuguuuaugggacagaucaauaagccguag

SEQ ID NO: 249100 - RNA, 1194 nt, Artificial Sequence
  Description of Artificial Sequence: Synthetic coding sequence
augaacuggcaucuuccccucuuucuccuugcuagcguuacucucccguccaucuguucacacuucaacccccugaguuuggaagaacucggcagcaacacuggaauucaggucuuuaaccagauugugaaaucucggccucacgauaauauuguaauuucaccgcauggaauugccuccguccuagggaugcuucagcucggugcagacgggaggacgaagaaacaacuugccauggucaugagauauggcgugaauggggucggaaaaauuuuaaagaaaauuaacaaggccauagugaguaaaaaaaauaaggacauugugacaguugccaaugccgucuuuguuaaaaacgcuucagaaauagaagugcccuuugugacaagaaauaaagacgucuuucagugugagguuaggaacguuaacuuugaagaccccgccagugccugcgacucaauaaaugccuggguaaaaaaugagaccagagacaugauugauaaucuguuaagucccgaucugaucgacggugugcugacccgacucguccucgugaacgcuguguauuucaagggccucuggaagucacgauuucagcccgagaauacuaagaagcgcacguuugucgcugcagauggaaaaucuuaccaaguaccuaugcuugcccaguuguccguguuccgauguggcucgacauccgcuccuaaugaccucugguacaauuuuauagagcucccuuaucacggggaaucaauuagcaugcuaaucgcccuuccaacugaaaguaguacaccacugucagcgauuaucccacauauaucuacuaagaccaucgauucauggaugucuauaaugguaccaaaacgcgugcagguuauccuuccuaaauuuaccgccguggcccaaaccgaccugaaagagccauuaaaagugcuuggaauuacugacauguuugauucaagcaaagcaaauuucgccaagauaacacguucugaaaaccugcacgugucucacauccuucagaaagccaaaauugaaguuagcgaggauggcacgaaagcuagcgcagccacuacagcaauucucaucgccaggaguuccccaccaugguucaucguggaucggccguuccuguucuucaucaggcacaauccgacuggggcaguucucuuuaugggccagauuaauaagccauag

SEQ ID NO: 249101 - RNA, 129 nt, Artificial Sequence; identical to SEQ ID NO: 248495
  Description of Artificial Sequence: Synthetic coding sequence

SEQ ID NO: 249102 - RNA, 831 nt, Artificial Sequence
  Description of Artificial Sequence: Synthetic coding sequence
augaauuggcaccucccccuguuccugcuggcauccguuacucugccauccaucuguucucacuucaacccacugucacuugaggaguuaggaagcaauacagggauacaaguguucaaccagaucgucaaaucgagaccucacgacaauauagucaucuccccucacggaauagccaguguucuagggaugcugcagcugggcgcagacggacgcaccaagaaacagcucgccaugguuaugcgauaugggguaaacggcguaggaaaaauacugaagaagaucaauaaggcuauugucucaaagaaaaauaaagauauugucaccguagcaaaugcuguguuugugaaaaaugcuagcgagauagaggugcccuucguaacucgcaacaaagauguguuccagugugaaguuagaaacgucaauuuugaagacccugccuccgccugcgacucuaucaacgcaugggugaagaacgagacgcgcgauaugauugacaaucugcugaguccugaccugauugauggugugcuuacacgccuggucuuagugaaugcaguauauuucaaaggucuuuggaaaucuagauuccagccugaaaacaccaaaaaacguacuuuuguugcugccgauggaaaaaguuaucaggucccaaugcucgcccagcuaagugucuucagaugugggagcaccuccgccccaaaugaccucugguauaacuuuaucgaacugcccuaccacggagagucuauaagcauguuaaucgcgcuccccacagaguccaguacaccucuaagcgcaaucaucccucacauauccaccaaaacuuag

SEQ ID NO: 249103 - RNA, 1230 nt, Artificial Sequence
  Description of Artificial Sequence: Synthetic coding sequence
auguccgauugcagaagcucucucguggagggaacaaugaacuggcaucugccucucuuccuguuagcauccgugacccugccuaguauaugcucccacuuuaauccuuuaucacucgaggagcucgguuccaauacuggcauucagguguucaaccagaucguuaaaucucggccacaugauaauauagugaucaguccgcacgggauagccucuguucuggguauguuacaacuuggcgcugacggacggacuaaaaagcagcuugccauggugaugagauacggcguaaauggagugggaaagauuuuaaagaaaaucaacaaggcaauuguauccaaaaaaaauaaagauauuguaacuguagcaaacgcuguuuuuguaaagaaugcaucugagaucgagguacccuuugugacaaggaauaaggauguuuuucagugcgaaguacgcaacguaaauuucgaggacccugccuccgcgugugacuccaucaacgccuggguaaagaacgagacaagggacaugauugacaaucuguuaaguccagaucuuaucgacggaguauuaacacggcuggugcuaguaaacgcaguuuacuucaagggcuuguggaaaucaagauuccagccugaaaacaccaagaaacguacuuucguagcagcugacgguaaaagcuaccagguucccaugcuggcccaacugucuguguuucguugugggagcacuuccgcaccuaacgaucugugguacaauuucaucgagcugcccuaucacggcgaguccauuucuaugcugaucgcccuuccuacugaaucaucaaccccucucucagcuaucaucccgcacauuucuacuaagacaaucgauagcuggaugucaauuauggucccuaagagagugcaggucauccuccccaaguucacagccguagcucagacagaccugaaagagccccucaaaguucuuggcauuacagauauguucgauucaaguaaagcaaacuucgccaagauaacuagaucugaaaauuuacacgucucucauauucuccagaaggccaagauagagguauccgaggaugguacaaaggcuucggcugccacuaccgcuauccugaucgcccgguccuccccaccaugguuuauugucgaucgccccuucuuguuuuucauuagacacaauccuacaggcgcugucuuauuuaugggccagauuaacaaaccuuag

SEQ ID NO: 249104 - RNA, 264 nt, Artificial Sequence; identical to SEQ ID NO: 248498
  Description of Artificial Sequence: Synthetic coding sequence

SEQ ID NO: 249105 - RNA, 426 nt, Artificial Sequence
  Description of Artificial Sequence: Synthetic coding sequence
auggaaauguugcaaggcuuguuauugcugcuccuccugaguaugggaggcgcaugggccaguagggaaccucugcgucccuggugccauccaauaaacgcuauccucgcagucgagaaggaaggauguccagucugcaucaccgugaauacgacaaucugugcuggguacuguccgacuaugaugagaguacuccaagcugugcuaccccccuugccccaggucguaugcacuuacagagaugugcgguucgaauccauaagauugccuggcuguccuagagguguagaccccgucgugaguuucccuguagcccucaguugccgguguggcccaugucgcagaagcacaucagauugcggaggaccaaaagaccacccacugacuugugaccauccccagcucucgggccuguuguucuuguag

SEQ ID NO: 249106 - RNA, 1491 nt, Artificial Sequence
  Description of Artificial Sequence: Synthetic coding sequence
auggggacgcaaaaagucacccccgcucugaucuucgcuauaacugucgccacuaucggcagcuuucaguucggauacaauacuggcguuaucaaugcucccgagaaaaucauuaaagaguucaucaauaagacacucacagacaagggaaacgcccccccuucagaaguccugcugacaagcuuguggagccucucugucgcaauauuuucuguuggugggaugauaggcuccuucucagucggauuguucguaaauagguuuggccggagaaauucaaugcucauugugaaucugcuugccgugaccgggggguguuucaugggucuuugcaagguggccaaaucaguggaaauguuaauccugggcagauuaguuauuggacuguuuugcggucucuguacugguuuugucccuauguauaucggcgaaauaucaccaaccgcccuucggggagcuuuuggcaccuuaaaucagcuuggcaucguugugggcauccuugucgcucagauuuucggauuggaguucauacuugggagcgaagaacucuggccucugcugcugggcuucacaaucuugccagccauucugcagucugcagcacugcccuuuuguccagagucuccccgcuuccugcuuauuaauagaaaagaagaagagaacgcuaaacagauccuucaaaggcuguggggcacccaggaugucagucaagauauacaggaaaugaaggaugaguccgcccggaugucucaggagaagcaggucacagugcuggagcucuuccguguuucgaguuacaggcagccuaucaucauuucaauuguccuacagcuaagccaacaacugucagggaucaacgcaguuuucuauuacagcacaggaauuuucaaagaugccggaguacaggaaccaaucuacgccacuaucggcgcuggcguuguaaauaccauuuucaccguaguuagccuguuccuggucgagagggcuggccggcgaaccuugcacaugauugguuugggagguauggcguuuugcucuacuuugaugaccgugagucuucugcucaaagacaacuacaacgguauguccuucgucuguauuggagcuauccuuguguucguugcuuuuuuugagauuggccccggacccauccccugguuuaucguggcagagcucuuuucucaggggccucggccugcagccauggcagucgcuggauguagcaauuggaccucaaacuuuuuggugggucuguuguuccccuccgcagcacauuacuugggagccuacguguucaucauuuuuaccggauucuugauaaccuuccuggccuuuaccuucuuuaaaguaccagaaacacgcggcagaacuuucgaggauauuacuagagccuucgaaggccaagcgcauggagcugaucgaagcggaaaggauggcguaauggaaaugaacucuauagaaccugccaaagaaacaacgaccaauguguag

SEQ ID NO: 249107 - RNA, 2097 nt, Artificial Sequence
  Description of Artificial Sequence: Synthetic coding sequence
augaaaauugagacuagugguuacaauucagacaagcuaauuugcagaggcuucaucgguacuccugcuccuccagugugugauuccaaauuuuugcucucaccuucuucagauguaagaaugaucccuugccgcgcagcucuuacauucgcuaggugcuugauucgcaggaaaaucgugacccuagauucuuuggaggauacuaagcuguguaggugucuuuccacuauggaccuuauugcucugggaguuggcaguacauuaggggcugggguguacguccucgccggagaaguggccaaggcugacagcggccccagcaucguaguaucuuuucuaauagcagcccucgccuccgucauggcuggacuuuguuaugccgaauuuggggcaagggucccaaagaccggcucagcauaccucuacacguauguuaccgugggugaacuuugggccuucaucaccgguuggaaucucauccucuccuaugucaucgguaccagcagcgucgcccgggcauggagcgguacauuugaugaauugcuuucgaaacagaucggccaguuccuucgcaccuauuuccgcaugaauuacaccggccuggccgaguaccccgacuucuucgcugugugucugauccuccugcuagcaggacuccuuucguucggcgucaaggaaagugcaugggugaauaaagucuucaccgccgugaauauucuuguacugcuguuugucaugguggcugguuucguaaagggcaacguggcuaauuggaaaaucuccgaagaauuccugaagaauaucucagccagcgcuagggaacccccuucagagaaugguaccucuauuuacggagcugguggguuuaugccuuaugguuucacuggcacucuugcaggcgcagcaacaugcuuuuacgccuuugucggguucgauuguauugcaaccacuggcgaagaaguccgcaauccacaaaaagccauccccaucggcauuguuacaucccugcuugucugcuuuauggccuauuucggcgucucugcugcccucacacuuaugaugccuuacuauuugcucgaugagaagagcccucugccaguugcuuucgaauauguggggugggguccggccaaguaugucguggccgcugggucgcuaugugcccucucaacaucucugcuugguucuaucuuuccuaugccuagggucauuuacgccauggccgaagaugguuugcucuuuaagugccucgcucaaauuaacaguaaaacuaaaacaccaaucauugccacccucuccagcggugcggucgcagcuuuaauggccuuccucuucgaucuuaaggcuuuaguugacaugaugagcauuggcacacucauggcuuauuccuuaguggcugccugcguccuuauuuugagguaucagccagggcucucauacgaccagccgaaauguagccccgagaaggaugggcuuggaucuucuccucgagugacuuccaaguccgaaagucaggugaccaugcuccagagacaaggguuuucaaugagaacucuguucuguccuuccuuacugccaacacaacagucggcuucccuggugaguuuucuagucgguuuucuagcauuucuuguccucgguuugagcguccucaccacauauggggugcaugccauuacccgccucgaagccuggucacucgcauugcuggcccucuuucuaguccucuucguugcuaucgugcucacuauuuggagacagccacaaaaucaacagaagguggccuuuauggugccuuuucugccuuuccugcccgccuuuucuauccugguuaauaucuaucugauggugcagcugucagccgacaccugggugagauucucaaucuggauggccauaggguucuugauuuauuuuaguuaugggauccgccacucccuugaaggacaucuuagggacgagaauaacgaagaagaugccuacccagauaauguccacgccgccgcugaagaaaaaucugcgauccaggcaaacgaccaccacccaagaaaccuguccuccccuuuuauuuuucaugaaaagacuagugaguuuuag

SEQ ID NO: 249108 - RNA, 1464 nt, Artificial Sequence
  Description of Artificial Sequence: Synthetic coding sequence
augggggacacuggccuaaggaagcggagagaagaugaaaagagcauacagagccaggaaccaaagacgacuaguuuacagaaagaacugggacuaauaagcgggauaucaauuauuguggguacgaucaucgguagugggauauuugugucaccaaagaguguuuugucuaacaccgaggccgucggccccugccucaucauuugggccgcuugcggcgucuuagcuacucucggcgcacuauguuucgccgaacugggaaccaugauuacgaaaagcggcggcgaguauccauacuugauggaagccuauggccccauucccgcauaucuauuuaguugggcgucccuuaucgugauuaaacccacuucuuuugcuauaauuugucugucuuucagcgaauaugugugugcuccuuuuuacgugggaugcaaaccuccacaaauugugguuaagugccucgccgcggcugccauuuuguuuauuucuacugugaauagcuugaguguuagacuuggaaguuacguucaaaacauuuucacggcugcuaaacuggugauugucgcuauuauuauuaucuccggacucguccugcucgcccaggggaacaccaagaacuucgacaauucauucgagggcgcucagcugagcgugggggcaaucagucucgcguuuuacaauggacuuugggcauacgauggauggaaucaacugaacuauauuacagaagaacugcguaacccuuaccgcaaccucccacucgcuauuauuauaggcaucccacugguuacugcuuguuauauccuaaugaacgucucuuacuucacugugaugacagccacagagcuuuugcagagucaggccgucgccguuaccuuuggggacagagucuuguacccugcuucauggauugugccacucuuugucgcguucagcacaauuggagcugcaaaugguaccuguuucacugccggccgccuaauauacguagcuggaagagagggacauaugcugaaaguccugaguuacauuucugugcgacgacucacuccugcaccugcgaucauuuuuuauggaaucauugcaacuaucuauaucauuccaggagauauuaacagccuugucaacuacuuuaguuucgccgcuuggcucuuuuacggcuuaacaauucuagggcucaucgugaugagauucacaaggaaagagcucgagaggccuauuaaaguucccgucguuauacccguccugaugacccuaaucagcguguuccuggucuuggcaccaaucaucucaaaacccacaugggaguaucucuacuguguucuuuucaucuuguccggccugcuguuuuacuuuuuauucguccacuacaaauucggcugggcccaaaaaauuucaaagccaaucacaaugcaccuccaaaugcuuauggaagugguacccccagaagaggauccugaauag

SEQ ID NO: 249109 - RNA, 1311 nt, Artificial Sequence
  Description of Artificial Sequence: Synthetic coding sequence
augcugaagguguccgcuguccugugugugugcgcugccgcuuggugcucacagucauuagcagccgcggcggcagucgcagcagccggcggaagaagugacggagggaacuuucuggacgauaagcaguggcuuacaacaauuagccaguacgauaaagaaguuggccaguggaauaaguuuagagaugaaguagaggaugauuacuucagaaccuggagccccggaaagccauucgaccaggcccuugauccugcuaaagauccaugcuugaaaaugaaaugcucuagacacaagguuugcauagcucaggauucucagacugccgucuguauuagccaccgaagacugacccauaggaugaaggaggcaggagucgaccaccggcaguggagaggcccaauucuuucaacaugcaaacagugccccguuguguaucccucgccagugugcggaagcgauggacacacuuauucauuucaguguaagcuugaguaccaggccuguguucuggggaaacagaucagcgugaaaugugaaggccauugcccuugucccucggacaagccaacuaguaccagcagaaauguuaaacgugccugcuccgauuuagaguuuagagaaguagcuaaccggcugagagauugguuuaaggcccugcaugaaagcgggucacagaacaagaaaaccaaaacccugcucagaccugaacguuccagauuugauaccucaauuuuacccauuugcaaagacucauugggauggauguucaaccgccuggauacuaacuaugauuugcuacuugaccaauccgaacugagguccaucuaucucgauaaaaaugagcaaugcacuaaggcuuucuuuaacagcugcgacacuuauaaagacucucugauuuccaacaaugaauggugcuauugcuuccagaggcagcaggaucccccuugccaaacugaacuaucaaauauccagaagagacaaggcguaaagaaauuacucgggcaguacauaccccucugugaugaagacggcuauuauaaaccuacacaaugucaugggucuguuggacagugcuggugcguagauagauauggcaaugaaguuauggguagucgcaucaauggaguggccgacugugccaucgauuucgagauuagcggcgauuucgcgucgggagacuuccacgaguggacagaugaugaagaugacgaggacgauauuaugaacgaugaggaugaaauagaagaugacgacgaagaugaaggggaugacgacgacgguggcgaugaccaugauguguauauauag

SEQ ID NO: 249110 - RNA, 1302 nt, Artificial Sequence
  Description of Artificial Sequence: Synthetic coding sequence
augcugaaggugucagccguacugugugugugcgcugcagccugguguucacaaucucucgcugccgccgcagccguggccgccgccggaggcagaagcgacggaggaaauuuccuggaugacaagcaaugguugacaacgauuagccaguaugauaaggagguggggcaauggaauaaauucagggaugacgacuauuuuaggaccuggagcccuggcaagccuuucgaucaggcucuugaccccgcuaaagacccaugccucaaaaugaaauguucgcgccacaaaguguguauugcucaggauagccaaacggcugucuguauuucccaucgaagacugacacaccggaugaaagaggccggaguggaccacaggcaauggagggggcccaucuuauccacgugcaaacaaugucccgucguuuacccaucucccgucugcggaucagacggccacacauauagcuuccaguguaaacuagaguaucaggcaugcgugcucggcaagcaaaucagugucaaaugugaaggucacugcccgugccccuccgauaaaccuacaagcacuagccgaaacgugaaacgagcuuguuccgaucuagaauuccgcgaagucgcuaaccgccugcgggacugguuuaaggcgcuucacgagagcggcucccagaacaaaaagacuaaaacauugcugaggcccgagcggagcagguucgauaccucuauccuccccaucuguaaggauucacugggcuggauguuuaauagacucgacacuaacuacgaccucuugcuggaccagucagagcucaggaguauauaccuagacaagaaugagcaaugcacaaaagcuuuuuucaacucgugugauacauauaaagacaguuugaucuccaacaaugaaugguguuacugcuuucagaggcagcaagaccccccaugucagacagaacugagcaacauucagaagagacaggguguaaagaaauuacucggacaguacauuccccuaugcgaugaggauggcuacuacaagccgacacagugccacgggucuguuggccagugcuggugcgucgaccgguaugggaaugagguuaugggcucaaggauuaacgggguugcugacugcgcgaucgauuuugaaaucaguggggauuuugcgucaggagacuuucaugaguggacagacgaugaggaugacgaggaugauauuaugaaugacgaagacgaaaucgaggacgacgacgaggaugagggagaugacgaugauggaggcgacgaucaugacguauauauuuag

SEQ ID NO: 249111 - RNA, 1158 nt, Artificial Sequence
  Description of Artificial Sequence: Synthetic coding sequence
augaucacacaggaccacauccauaugagcagcggccugucucaggacgacuacuuucguacauggagccccgguaagccauucgaccaggcccuugaucccgccaaagauccuugcuuaaaaaugaagugcucacgacauaagguuuguaucgcucaggacucacagacagcaguuuguaucagucacagaagacucacccauagaaugaaggaagcaggcgucgaucaucgccaguggagaggccccaucuuaucaacuugcaaacaauguccugucgucuauccuaguccagucuguggcagugacggccauacauacucauuucaauguaaacuggaauaucaggcauguguuuuagggaaacagauuagcgugaaaugugaaggccauugcccgugccccagcgacaagccaaccucuaccucucgcaacguaaaacgagcaugcuccgaucuagaauuuagggaagucgccaauaggcuccgagacugguuuaaagcauuacaugaauccgggagccaaaauaaaaaaaccaagacccugcugcgucccgagaggucucgauucgacacaaguauccuucccauuugcaaggauucccuggguuggauguucaacagacuagauaccaauuaugaccuccuccuggaucagagcgaacugcgcaguauuuacuuagacaaaaaugaacaaugcacaaaagcuuuuuucaacagcugcgacaccuacaaagacucccugaucucuaacaaugagugguguuacuguuuccaacgccagcaagaucccccuugucagacugaacugaguaacauacaaaaacgccaaggagugaagaagcugcucggacaguauaucccacugugugacgaggacgguuauuacaaaccuacucagugccaugggucaguugggcaaugcuggugugucgauagguacggaaaugaagugauggggagucggaucaacggcguggcggauugcgcaauugacuuugaaauuucaggugauuuugcaagcggugacuuccacgaguggacagacgacgaagacgacgaggaugauauaaugaacgacgaagaugaaauugaagaugacgacgaagaugagggggacgacgaugaugguggggaugaucacgauguguauauauag

SEQ ID NO: 249112 - RNA, 1311 nt, Artificial Sequence
  Description of Artificial Sequence: Synthetic coding sequence
augcucaaggucagcgccgugcugugcguaugugcggccgccuggugcagucaaucccuagcugcugcggccgcuguggcagccgccggagggcggagcgacggggggaauuuucuggacgauaagcaguggcucacaacgaucagccaguacgauaaagaaguaggacaguggaauaaguuucgugaugaagucgaagaugauuacuuccgaaccuggagcccgggaaaaccuuuugaccaggcauuagacccagccaaggacccuugcuugaagaugaaauguaguagacauaaaguaugcauugcccaggauucccagaccgccgugugcauuagucaucgacgcuugacacauagaaugaaggaagcaggaguugaucaccgccaauggcgcggaccuauucucucaaccuguaaacagugcccagucgucuacccuucccccgugugcggaucggacggacacaccuauuccuuccaauguaaauuggaguaucaagcuugcguacuuggaaagcaaaucagcgucaagugugagggccacugccccuguccuucagauaaacccaccagcaccaguagaaacguuaaacgggccugcagcgaccuggaguuucgcgaagucgcaaaucgccuucgagauugguuuaaagcauugcacgaguccggcagccaaaauaaaaagacaaagacacuguugcgacccgaacgcagcagguucgacacgucaauacucccgauaugcaaagauagccuuggauggauguucaacagauuagauacaaauuaugaccuccuuuuagaccaaucugagcuucggagcauauauuuggacaaaaaugaacaauguacaaaagcuuucuuuaacucaugugacacuuauaaagauucccugaucagcaacaaugaaugguguuacuguuuucagcggcagcaagacccaccaugucagacagagcugagcaacauucaaaaaagacagggugucaagaaacugcugggccaauacaucccucucugcgaugaagauggauauuacaaacccacucagugucauggaucuguaggccagugcuggugcguggacagguauggaaaugaagugauggguagcaggaucaacggcguggcugauugcgccauugauuucgagauaucgggcgacuuugccaguggcgauuuucaugaauggaccgacgacgaggaugaugaggacgacauaaugaacgaugaagaugaaauugaagaugacgacgaggaugagggagaugaugaugacggcggagaugaucaugauguguacauauag

SEQ ID NO: 249113 - RNA, 1302 nt, Artificial Sequence
  Description of Artificial Sequence: Synthetic coding sequence
augcucaaggucuccgcuguccucugcguaugugcagcugcauggugcucccaaagccuggccgccgcagccgcaguggcugcagcgggaggaagaucugacggagggaacuuucuggacgauaaacagugguugacgacaauuucccaguaugacaaagaggugggacaauggaacaaauuuagggacgacgacuacuuccgcacuugguccccaggcaaacccuucgaccaggcccuugacccagcaaaggacccgugccugaaaaugaaaugcagccggcauaaggugugcaucgcucaggacucccagacagcaguauguaucucucauagaaggcugacacaccgcaugaaggaagcugggguggaccaucgacaguggcgaggcccuauccuuucuacauguaagcaaugccccguugucuacccuucuccgguuugcggauccgacggccauaccuauuccuuccaaugcaaacuugaguaucaggcuuguguguuagguaaacagauaucagugaagugugaaggacauugccccugcccaucagauaagcccaccucgacaagccguaacgucaagagagcguguucagaucuugaauuucgugaaguggccaacagauuacgagacugguucaaggcucuucaugaguccggaucucagaauaaaaagaccaaaacauuauuaagaccugaacgaucaagauuugauacaagcauucuucccaucuguaaggacucguugggcuggauguuuaauagauuggacacaaacuaugaucugcuccuugaucaaagugaacugcgguccauuuauuuagacaaaaaugaacaguguacgaaggcuuucuucaacucaugcgauaccuauaaggauagucugauuagcaauaaugagugguguuauuguuuccaaaggcaacaagauccacccugccaaacagagcugagcaauauucaaaaacgacaaggagugaaaaaacuguuaggacaguauauaccucuuugcgaugaggauggauacuauaaaccuacccaaugccaugguagugucggacaguguuggugugucgacagguacgggaaugagguuaugggcaguaggaucaauggcguggccgacugugcuauugacuuugagauuaguggugacuucgcaucaggggacuuucaugaauggacugacgaugaggaugaugaggaugauauaaugaaugaugaagaugaaauugaggaugacgacgaggacgagggugaugaugaugacgguggagacgaccacgacguguauauuuag

SEQ ID NO: 249114 - RNA, 348 nt, Artificial Sequence
  Description of Artificial Sequence: Synthetic coding sequence
auguuaaagguauccgcaguguugugugucugugcagcagcguggugcucccagucccuagccgcugcugcugcugucgccgcagccggcgggcgcagugauggggggaacuuccuggacgacaaacaguggcuaaccacaaucagccaauaugacaaggaagucggucaguggaauaaauuuagagacgagguugaagacgacuauuuucgaacauggagcccaggcaaaccauucgaucaggcauuggaccccgcaaaagauccuuguuugaaaaugaaguguucaaggcacaaggugugcaucgcccaagauucccagaccgcaguguguauuucccacagguag

SEQ ID NO: 249115 - RNA, 1311 nt, Artificial Sequence
  Description of Artificial Sequence: Synthetic coding sequence
augcugaaaguuagcgccguguuaugugugugcgcugccgccugguguucacaaucccucgccgccgccgcagcuguggcagccgccggaggcagaagugauggggggaauuuccuggacgacaagcaguggcugacaaccauuucacaguaugacaaagaaguuggucaguggaauaaauuuagagaugagguugaggacgacuauuuucguaccuggucaccagggaagccauucgaucaagcucucgauccagcaaaagacccuugccugaagaugaaauguagcaggcacaaaguguguaucgcucaagauucucagacugcaguuugcaucucccauagaagacugacccaucggaugaaggaggcuggcguugaucaccgacaauggcgaggccccauuuuguccacaugcaagcagugccccguuguguacccaagcccagugugugguucagacggccacacuuauuccuuccagugcaaauuggaauaucaagccugcguucucggaaagcagauuucugucaagugcgaaggacauugccccugucccagcgacaaacccacguccaccucucguaauguuaaacgggcauguagugaucuugaauuccgcgaaguggcaaaccgccuuagagauugguuuaaagcacuucaugagagugggagccagaacaagaagaccaagacccugcuuagacccgaacggucucgauucgauacuucaauucugccuaucuguaaggacucccuggguuggauguuuaaucggcuagacacaaauuacgaccuccugcuugaucagucggaacucagaucuauuuacuuggauaaaaacgagcaguguaccaaggcauuuuucaacucaugcgauacguacaaggauucucugauaagcaauaacgaguggugcuauugcuuucaacgacagcaggacccucccugccagacagagcuguccaauauccaaaaaagacagggcgucaagaaacuccugggccaguauaucccucugugcgacgaggacggauacuauaaaccuacucagugccacggcucugugggccaguguugguguguagaucgguacgggaacgaagugaugggaagccgaauuaauggaguggccgauugcgcaauugauuucgaaauuucaggggacuuugcaaguggggacuuccaugaauggacggaugacgaggacgacgaagacgauauaaugaacgacgaggacgagauagaagaugacgacgaggaugagggugacgacgaugacgggggagaugaucaugauguauauaucuag

SEQ ID NO: 249116 - RNA, 486 nt, Artificial Sequence
  Description of Artificial Sequence: Synthetic coding sequence
augcucaaggugagcgcaguccugugcgucugugcugcagcuuggugcucccaaagucuggcugcugcugcugcuguggcugcagcaggcgguagaagcgacgguggaaauuuuuuggaugacaagcaguggcuuacaacuauuucucaauaugacaaggaggucggucaauggaauaaguucagagacgaugacuacuuuagaacauggagcccagguaaacccuucgaucaagccuuagacccagccaaagaucccugucucaagaugaagugcagcagacauaaagugugcaucgcucaggacucccaaaccgcugugugcaucucccauagaagacuuacccaccgcaugaaggaggcaggaguggaucaccggcaguggcgaggaccaauccuuucuacaugcaaacagugccccgucguauaucccagucccguuuguggaucagauggucauacguacucuuuucaaugcaagcucuag

SEQ ID NO: 249117 - RNA, 522 nt, Artificial Sequence
  Description of Artificial Sequence: Synthetic coding sequence
augcugaaagucucugcuguucugugugugugcgcggccgcaugguguagucagagcuuagccgccgccgccgccguugcugccgccggcggaagaucugaugggggcaauuuccuggaugacaaacaguggcugacaacgaucucacaauaugacaaagaaguuggacaguggaauaaauuucgagaugaugacuacuuccgcaccugguccccuggaaaacccuuugaccaggccuguagugaccuugaguuucgcgagguagcuaaccgacugagggacugguuuaaggcccuccacgaaucuggcucccaaaacaaaaaaacuaagacccucuugcggccugagcgcucgcguuuugauacuucuauucucccaauuugcaaagauuccuugggcuggauguucaaccggcucgauacaaauuaugaccuucugcucgaccaaagugaacugcgaucaaucuaccucgacaaaaaugagcagugcaccaaagccuucuucaauaguugugauacauag

SEQ ID NO: 249118 - RNA, 1182 nt, Artificial Sequence
  Description of Artificial Sequence: Synthetic coding sequence
augcugaaagucucugccguguuaugcgugugugcagcagcuuggugcucacagagccuggccgcagcagcugcaguggcagcagcggggggcagaagcgauggagggaauuuccuagacgacaaacaguggcugacgacgaucucucaguaugauaaagaagugggacaguggaacaaguuucgagaugaugacuacuucagaacuuggaguccugguaagccguuugaccaagcccuugacccagccaaagauccuugccucaaaaugaagugcagcaggcacaaaguuugcaucgcccaggacucacaaacugccguuugcauuucccaucgacgauugacacacagaaugaaagaggcuggcgucgaucacaggcaauggcgagguccuauucugagcacaugcaaacagugucccgugguguauccuagccccguuuguggcagcgauggacacaccuauucuuuucaauguaagcuggaguaucaggcgugcguuuugggaaaacaaauuagcgucaagugcgaaggccauugucccugucccucagacaagcccacauccaccagccggaacgucaagagggguuucgauaccucuauucugcccaucugcaaagauagucuuggauggauguuuaauaggcuggacacuaacuaugaccuucuucuggaccagagugaacuacgcucgauuuaccuugauaagaaugagcagugcacuaaagcuuucuuuaacuccugcgacacuuacaaagauucucugauuucuaauaacgaguggugcuauuguuuccagcgccagcaagauccgccuugucagacagagcuuucaaauauacagaagcgccagggcgucaaaaaauuguugggacaauacauuccgcuuugugacgaggauggauacuauaaaccuacucaaugucaugguucugugggccaguguuggugcguggaccgguaugggaaugaaguuauggguucuaggauuaaugggguggcugauugcgcaaucgacuuugaaauuucuggggacuuugcgucaggcgauuuucaugaauggaccgaugaugaggaugaugaggacgacauuaugaacgaugaagaugagaucgaggaugacgaugaagaugagggagacgacgaugaugggggcgaugaucacgacguguacauauag

SEQ ID NO: 249119 - RNA, 1302 nt, Artificial Sequence
  Description of Artificial Sequence: Synthetic coding sequence
augcucaaaguaucugcagugcugugugugugcgccgccgcgugguguagccagagucuagccgccgcugcagccguugcugccgcaggagggagaagugacgggggaaauuuuuuggaugacaagcagugguugacaacuauuagucaguaugacaaggaagugggacaauggaauaaauuuagagaugaugacuacuuucguaccugguccccugguaaaccauucgaccaggcccuggauccagccaaggauccuugucugaaaaugaaguguucaaggcauaaagugugcauagcccaggauucccaaacugcaguguguauaucccauaggaggcuaacccaccgcaugaaggaggccggcguagaccaccgacaguggcgcggacccauccuguccacauguaagcagugcccugugguauauccgagucccgucuguggcagcgacggccacacguacaguuuucaguguaagcuagaguaccaagccugcguucucgguaagcaaaucucagugaagugcgaaggacauugccccugcccuucagauaaaccaaccucuaccucacgaaacguuaaaagagcuugcagcgaucuugaguuccgggaaguagccaacagauuacgugauugguucaaagcccugcacgaauccgguucccagaauaaaaagaccaagacgcuuuugcgcccagagcguagccguuucgauacuucaauccucccuauuugcaaggauucccugggcuggauguucaaccgccuggauacaaauuaugauuuguuacuggaccaaucggaacuccgauccauuuaccuugacaaaaacgaacaauguacuaaagccuuuuucaauucgugugauacguauaaagauucacuaauuaguaacaacgagugguguuacuguuuucaacgccagcaggacccaccgugccagaccgaauugucaaauauccagaagagacagggcgugaagaagcuuuuagggcaguauaucccacugugugacgaagauggauacuacaaaccuacucagugucauggaaguguggggcaguguugguguguggaucgauaugggaaugaaguaauggggaguagaaucaacggaguagcagacugcgcuaucgacuucgaaaucaguggcgauuucgcaucaggcgauuuucaugaguggacugacgaugaggaugacgaggacgauauuaugaacgaugaagacgagauugaagacgacgaugaagaugagggugaugaugacgacgggggggacgaucacgauguguauauauag

SEQ ID NO: 249120 - RNA, 1311 nt, Artificial Sequence
  Description of Artificial Sequence: Synthetic coding sequence
augcugaagguauccgccguuuuauguguuugugcugccgccuggugcagccagagccuugcagccgccgccgcagucgcagcugcuggcggaaggucagauggaggcaauuuucuugaugauaaacagugguugacuacuauuagccaguaugauaaggaagugggccaauggaauaaguuuagagaugaaguagaagaugauuauuuucggaccuggaguccuggcaagcccuucgaccaagcgcucgaccccgcgaaagacccaugucugaaaaugaagugcucucgacauaaagugugcauagcucaggauucccaaacugccgugugcaucucucacaggcgccuuacucaucgaaugaaggaagccggcgucgaucauagacaguggcgaggacccauccucaguacuugcaaacaaugcccuguuguauacccaagccccgucuguggaucagacggccauacuuacuccuuucagugcaaacuggaguaccaagcgugcguucuuggaaagcagaucuccguuaagugcgagggucacugccccugccccagugauaagcccacaucuacaucacgaaacguuaaacgggcuugcagcgacuuggaguuccgugaaguggcaaaccggcugagggauugguuuaaggcgcuccaugaaagcgguagccagaacaagaaaaccaaaacacugcugcgacccgaacggucccgauuugauacauccauacuuccuauuugcaaggauuccuuaggcuggauguucaauaggcuggacacaaacuaugaucuguugcuggaccaaucagaacugagauccauuuaucuagauaagaaugaacaauguacgaaggccuucuucaacaguugugacaccuacaaagauucccugaucaguaauaacgaaugguguuauuguuuucagaggcaacaagacccaccgugucagacagaauuaucuaauauucaaaagcggcagggcgugaaaaaacuccugggacaauacauaccucugugugacgaggaugguuacuauaaaccaacucagugccacggcuccguuggccagugcugguguguggauagauacggaaacgaggugauggguucaaggauuaaugggguugcagauugugcaauagacuucgaaauuucaggagacuucgcgaguggggauuuccaugaauggacugacgacgaagaugacgaggacgauauaaugaaugacgaggacgagaucgaggaugaugaugaagacgagggagacgaugacgacggaggcgacgaccaugauguguauauuuag

SEQ ID NO: 249121 - RNA, 348 nt, Artificial Sequence
  Description of Artificial Sequence: Synthetic coding sequence
augcugaaagugucugccguucugugugucugcgcagcagccuggugcucacaaucccuggcagcagcugccgcuguugcagccgcugguggucgcuccgacggagguaauuuccuagaugauaagcaguggcucacaaccaucucccaguaugacaaagaagugggccaguggaacaaauuucgcgacgagguggaagaugacuauuuuagaacuuggaguccuggaaagccuuucgaucaagcuuuagaucccgcuaaagacccgugcuugaagaugaagugcucacggcauaagguguguauugcucaagacagucaaaccgccgugugcauaucccaucgauag

SEQ ID NO: 249122 - RNA, 942 nt, Artificial Sequence
  Description of Artificial Sequence: Synthetic coding sequence
augcugaaaguauccgccgucuuguguguuugugcugcugccugguguagccagagccucgccgccgccgcugcuguagccgcugcaggaggccgaagcgauggaggcaacuuucucgacgacaaacaguggcuuacaacaauaucucaauaugauaaggagguuggacaauggaacaaguuucgagaugaugauuacuuuagaacauggucuccaggcaagccauucgaucaggcauuagacccugcuaaagaccccuguuugaagaugaaaugcaguagacauaaggugugcauugcccaggauucucagacggcagucugcauuucacaccgacgccucacacauagaaugaaagaagcggguguugaucaccgccaguggaggggcccaauucuaucuacauguaagcaguguccaguuguguacccauccccgguuugcggauccgacggucauacauacagcuuccaauguaagcucgaauaccaagcaugcguucugggcaaacagauuucugucaagugcgaagggcauugcccuuguccaucugauaaaccuacuagcaccagccguaauguuaaacgagcuuguucugacuuggaauuucgagaggucgccaacagacucagagauugguuuaaggcauuacacgagagcggcucucagaauaagaagaccaagacccuauuacgcccagaaaggucacgauucgacacuucaauuuuaccaaucuguaaggauucucucggauggauguuuaacagguuggauacaaauuacgaccuauuacuugaccagucggaacuucgaaguaucuauuuggacaaaaacgaacaguguaccaaggcuuucuuuaauucaugcgauacguauaaggauucacugauuucuaacaacgaauggugcuacugcuuucagcgucaacaggguaagagauag

SEQ ID NO: 249123 - RNA, 1017 nt, Artificial Sequence
  Description of Artificial Sequence: Synthetic coding sequence
augcuaaaggucagugcgguguugugcgugugugcugccgcuuggugcagucaaagccuggcagccgccgccgcaguggcagcggcuggaggccguucggacgguggaaauuucuuagacgauaaacaguggcugaccacgauuucucaguacgauaaggaaguuggacaguggaacaaguuucgggauuguaaguuagaguaccaggcaugcguacucgguaagcagauuaguguuaagugcgaaggucauugccccugccccuccgacaagccaacgucuacaucccguaacgugaagcgcgccuguucagaccuggaauucagagaaguugccaacagguugagagauugguucaaagcauuacacgaaucagguucacaaaacaaaaaaaccaaaacucuacugaggccugaaaggagcagguuugacacgucaaucuugcccaucuguaaagacuccuugggguggauguucaauagacucgacacuaauuaugaccuauuacuugaccagagugaguuacguagcaucuaucucgauaaaaacgagcaauguaccaaggccuucuuuaacuccugcgauacauauaaggauagcuugauuaguaacaaugaguggugcuauuguuuucaaaggcagcaagacccgcccugccagaccgagcuguccaacauucagaaaagacaagggguaaagaagcugcugggacaauacaucccuuuaugcgaugaagacggguauuauaaacccacgcaaugccacggaagcgucggccagugcuggugcguggauagauaugggaaugaaguuauggggucuagaaucaauggaguggcugauugcgcaauugacuucgagauuucaggggacuucgcgagcggagauuuccacgaguggacagaugacgaggacgaugaggaugauauaaugaacgaugaggacgaaauagaagaugaugacgaggaugaaggcgaugaugacgauggaggggacgaucacgacguguacauuuag

SEQ ID NO: 249124 - RNA, 1023 nt, Artificial Sequence
  Description of Artificial Sequence: Synthetic coding sequence
augaucaacaacgggucuccccagagucuguccaugacaagaaagagugauagcgggaccaacucugaaaccaugaaggaagccgggguagaucaucgucaauggagaggucccauacuuucaacuuguaaacagugcccagucguguacccuagccccgucugcggaucugauggacauacuuacucuuuucaguguaaauuagaguaccaagccugugugcucggcaaacagaucuccgugaaaugcgaaggacauugucccugcccuagcgauaagcccacuucuaccucaaggaaugugaaacgcgcgugcagugaccuugaguuccgggaaguugccaaucgccugagagauugguucaaagccuugcacgagagcgggagucagaauaaaaagaccaaaacucuccuucggcccgaacgcucacgauuugauaccagcauucuucccauuugcaaagacucucuuggauggauguuuaaucgccuggauacuaacuacgaccuccugcuagaccagagcgaacugcgcagcaucuaccuggacaagaaugagcaauguacuaaggcuuucuuuaauaguugcgacacauacaaggauucccuaauuucuaacaacgaauggugcuauugcuuccaaaggcaacaagauccuccaugucagacugaauuaaguaacauccaaaagcggcagggugugaaaaaacugcugggccaguauauaccuuuaugugacgaagauggcuacuauaagccuacucagugccauggcucugucggacagugcuggugugucgaucgauacgggaaugaggugauggguuccagaauaaacggcguagcagacugcgcgaucgacuuugagauuuccggugauuuugccaguggcgauuuccacgaguggaccgaugacgaagacgacgaagaugacauuaugaacgacgaggacgagauugaagaugacgaugaggacgagggggaugacgaugauggaggggaugaucaugacguauauaucuag

SEQ ID NO: 249125 - RNA, 915 nt, Artificial Sequence
  Description of Artificial Sequence: Synthetic coding sequence
augaaguguagccgccauaaaguaugcauugcccaggacucccagacagccgugugcauuucccacaggcgauuaacucaccguaugaaggaagccggagucgaccaucgucaauggagggggccaauucugucgacuugcaagcaguguccaguugucuaccccagcccagugugcggaagcgauggccauaccuacucuuuccaauguaaguuagaauaucaggcauguguauugggaaaacagaucagcgucaaaugugagggccacuguccuuguccauccgauaaacccacuuccacaucaagaaaugugaagagaggcuucgauacaaguauucugccgaucugcaaggauucucuugguuggauguuuaaccggcuugauaccaacuacgaccugcuacucgaccaauccgaacuuagaucaauuuaccucgauaaaaacgagcaaugcaccaaagccuuuuuuaacuccugcgauacuuacaaagauagccugaucagcaauaaugaaugguguuacuguuuccagagacagcaagaucccccgugccagacugaauuaucaaauauacagaagaggcagggaguuaagaagcucuuagggcaauacaucccauugugugacgaggacggcuauuauaaaccuacgcaaugucacgguagcguugggcaauguuggugcguggaccgcuacgguaaugaggugaugggaagcaggaucaacgggguagcugacugcgcuauugauuuugagauuucaggagacuuugcaucaggagauuuccaugaguggacugaugaugaagaugaugaggaugauauaaugaacgaugaagacgaaauugaggaugacgaugaagacgaaggcgacgaugaugaugggggggacgaccaugacgucuauauuuag

SEQ ID NO: 249126 - RNA, 951 nt, Artificial Sequence
  Description of Artificial Sequence: Synthetic coding sequence
augaaggaggccggcgucgaccacagacaauggagagggccaaucuuaaguacgugcaagcaauguccagucgucuaucccucccccgugugcggcucugauggacauaccuauuccuuccaaugcaaacuugaauaucaagccugcgugcucggcaaacagauuagcgugaagugcgaaggccauugcccguguccaagugauaaaccaaccaguacauccaggaacguuaagcgagcgugcuccgaccuagaauuucgggaaguugcaaaccggcugcgggacugguucaaggcucugcacgagaguggcagccaaaacaaaaagacuaagacccuccugcggccggaacgcucucgguuugacacaucaauccugcccaucugcaaggacucacuagguuggauguuuaaucgccuugacacgaacuaugaccuucuccucgaucaaucagaauugcggagcauauaccuugacaaaaaugaacaauguacuaaggccuucuucaauaguugcgauaccuauaaggauucucugauuucgaauaacgaguggugcuauugcuuccagcgucagcaggaccccccuugccaaacugaauugucaaauauucagaaacgacagggaguaaaaaagcuucuuggacaauacauaccauuaugcgacgaagacggguacuauaaacccacucaaugucacggaucugucgggcagugcuggugugucgaccgauacgggaaugaagugaugggcucaagaauuaauggcguggcagauugugccauagacuuugaaauuuccggagauuuugcaagcggggacuuucacgaguggaccgacgacgaagacgacgaagacgauauuaugaaugacgaggaugagauugaagacgacgacgaggacgagggggacgacgaugacggcggggaugaucaugauguguauauuuag

SEQ ID NO: 249127 - RNA, 1017 nt, Artificial Sequence
  Description of Artificial Sequence: Synthetic coding sequence
auguuaaaaguuucugcaguguuaugcgugugugccgcagcuugguguagucaaucucucgccgccgccgccgccguggcugccgcugggggacgcagcgauggcggcaacuuucuugacgacaagcaguggcugaccacuauaagccaguacgacaaagaaguaggacaguggaauaaguuuagagacuguaaguuagaauaucaggccuguguguugggaaaacagaucagcguaaagugcgaaggccacuguccuugccccucggauaagccaacaucaacuucuaggaaugucaaacgcgcuugcucagaccuggaguuccgagaagucgcuaauaggcuaagagacugguucaaagcacuacacgaaucugggucgcagaauaaaaaaacuaaaacccuccugagaccagaaagaagccgguuugauacuucgauccuucccaucugcaaagacucucugggcuggauguuuaaccgacuggauacaaauuacgaucuccuguuagaccagagugagcugcgaaguaucuaucuugauaagaaugaacagugcacaaaggcauuuuuuaacucaugugacaccuacaaagacagcuugauauccaauaaugaaugguguuacugcuuccaaagacagcaggauccgccuugucaaacagagcuuaguaauauccagaagagacaaggcgucaaaaaguuauuaggacaguacauuccccugugcgaugaggacggcuacuacaagcccacacagugucacggcucaguaggacagugcugguguguggacagauacgggaaugaaguuauggggucaaggaucaacggaguggcggauugcgcuauagacuuugagauaucaggagacuucgccucuggggauuuccacgaguggacugaugacgaagacgacgaagacgauauaaugaacgacgaggaugaaauugaagacgaugaugaagaugagggagacgacgacgacggaggugacgaucaugacguuuacauuuag

SEQ ID NO: 249128 - RNA, 2409 nt, Artificial Sequence
  Description of Artificial Sequence: Synthetic coding sequence
augcucggagcccgugcguggcuuggucggguccucuugcuuccuagagccggagcagggcuagccgcuagcagacggugccccgguguuuggccuaggacauggccgcacagaucucccucgagaggcagcucaaguagggacaaagaccgcagcgccaccguuucaagcagugucccaaugccagcuggcggaaaaggcucacaccccagcuccaccccucagcgagugccuaaccgucuuauacacgaaaagucaccauauuuacugcagcacgcuuacaacccuguggacugguaucccuggggucaagaggcguucgauaaagcccguaaagagaacaagccaauuuuccucucaguaggguauuccacuugccacuggugucacaugauggaagaagaaagcuuucagaacgaagagauugggcgccugcugucagaagacuucgucagugugaaaguggaccgcgaggagcggccagauguugauaaaguauauaugaccuucguacaggcuacaucaucggggggagguuggcccaugaauguuuggcucacaccuaaucugcagcccuucgugggagguacguauuuucccccagaggacggauugaccaggguuggcuuccgcaccgugcuccuuaggauccgagagcaguggaaacagaacaagaauacauugcuggaaaacucccaacgggugacaaccgcucugcuagccagauccgagauaucuguuggagacaggcaauuaccaccaagcgccgcaaccguuaauaauagaugcuuucagcagcuugaugaaggcuaugacgaagaauacggaggguuugcugaggcgccuaaguuuccuacaccagugaucuuaucauuucuguucaguuauuggcugucgcacagacugacccaggauggaagccgagcucagcaaauggcacugcacacccuuaagaugauggccaauggagggauccgagaucacguggggcaaggcuuucaccgcuacuccacagauaggcaguggcacgucccucauuucgagaaaauguuguaugaccaggcacagcuagccgucgcauauucccaggcauuccaguuauccggcgaugaauuuuauagugacguggccaaagggauccuccaauacguugcccguagucucucccauagguccggcggauucuauuccgcugaagacgccgacagucccccagaacguggacagcggccaaaagaaggcgcauacuacguuuggacagugaaggaaguacaacagcuacugccggagccuguacugggggcuaccgaaccacugaccagcggucaauugcugaugaagcacuauggccuaacugaagccgggaacauaucuccaucccaggacccaaaaggcgaguuacagggacagaacguuuugaccgugcgcuauucauuagaacucaccgccgcuagauucggucuggacguagaagccgugagaacccugcucaauucuggcuuagagaaguuguuccaggcccggaagcauagaccuaaaccccaucuggauucaaaaaugcuagccgcuuggaacgggcugauggugucuggguacgcgguaacuggagcaguccuuggucaggacagacuuaucaacuacgcuacaaauggagcaaaguuuuuaaagaggcacauguuugauguagcaagcgggcgccuaaugagaacaugcuacacaggaccuggcgguaccguggagcauagcaacccuccauguuggggcuuuuuggaggacuacgcauucgucguuagaggacuucuggaccuuuacgaggcaucccaggagucugcuugguuagaaugggcccuuaggcuucaagacacucaggacaaacucuuuugggacucucaaggggggggcuauuuuugcuccgaagcagaacuuggcgccggccuuccucuucgcuugaaggaugaccaagacggggcugaaccguccgcuaauucagugagcgcccacaaccuucuucgccuucacggcuucacugggcauaaagauuggauggacaagugcguaugccuccugacagcauucucugagcguaugagacgagugcccgucgcccugccugaaaugguucgcgcucucagcgcucagcaacaaacuuugaagcagauugugauuuguggcgaucgccaggccaaagauacuaaagcucugguccagugcguccacuccgucuauauccccaauaaaguacuuauccucgcggacggugaccccuccucauucuugucacgccagcugccuuuccuguccacacugagaagacucgaggaucaggcaacagccuauguuugcgaaaaccaagccugcuccguuccuauuaccgauccuugcgagcugcggaagcugcuccaucccuag

SEQ ID NO: 249129 - RNA, 1377 nt, Artificial Sequence
  Description of Artificial Sequence: Synthetic coding sequence
auggauggcagccgccgaguucgcgccacuuccguccugccacgauauggaccccccugccucuuuaaaggucaccucaguacuaaaaguaacgcguucuguacagauucauccucccuuagacucucaaccuuacagcuugugaaaaaucacauggcaguacacuauaacaagauucuaucugcuaaagcugcaguugacugcagugucccaguauccgugucaaccaguauaaaguacgcugaccagcagagacgugaaaagcugaagaaagagcuggcacagugugaaaaggaauuuaagcucacaaagacagcgaugcgcgcuaacuacaagaauaacuccaaaucccuguucaacacccuccaaaagccaaguggggagccucaaauugaagaugauauguuaaaggaggaaaugaacggcuuuuccucauucgcccggucccucgucccuagcucugaacgucuccaccucucucugcacaagucuagcaaggugauuacaaauggccccgagaaaaacucuagcucuucuccaaguagcgucgacuaugccgcuagcgggcccaggaaauugagcuccggugcccucuacggucgcagacccagaucaacauucccaaacagccauagguuccaacuggugauuagcaaggcucccuccggugaucugcuagacaaacacagcgagcucuucucaaacaagcaauuacccuuuaccccacgaacauugaaaaccgaggcuaagaguuuccucucucaguaccguuauuacacccccgcaaagagaaagaaggacuucaccgaccagagaauugaagcagagacucaaacggagcucucuuucaaauccgaacuggggaccgccgagacuaaaaacaugacagauagugagaugaauaucaagcaagcauccaacugcgugaccuacgaugccaaggaaaaaaucgcccccuuacccuuagagggacacgauucgaccugggaugaaauuaaggacgacgcucugcagcacuccuccccaagggcuaugugccaguacucgcuuaagccuccaucuaccagaaagauuuacuccgaugaagaagaacuccuguacuuauccuucaucgaagacgucacugacgagauacugaaacugggccuauucaguaaucgguuuuuagaacgccuuuucgaacgccacauuaagcagaauaagcaccuggaagaagaaaaaaugcgacauuugcuacacgugcucaagguggaucugggaugcaccagugaagaaaacucauucucauccguuaagggcgauaacaaccacgacauggagcuuucaacccuaaagauuauggaaaugaguauugaagacugcccccuggacgucuag

SEQ ID NO: 249130 - RNA, 990 nt, Artificial Sequence
  Description of Artificial Sequence: Synthetic coding sequence
auggucuccaagucccgcuggaaacucuuggcaaugcuggccuugguccucguggucaugguuugguauucgauuagcagggaggacucauuuuauuuccccauaccugagaaaaaagagccaugccugcagggugaggcagaguccaaagccagcaaauuguuuggcaauuacucaagggaccaaccgauauuccuacggcuugaagacuacuuuugggugaaaacucccucagcauacgaguugccuuaugguacuaaaggaagugaagaucugcuuuuaaggguacuugcuauuaccuccucaagcaucccuaaaaacauucaaaguuuaagaugcagaaggugcguuguggugggaaacggacauagacucaggaacagcucucuuggcgacgcuauuaacaaguacgaugucguuauucgccugaacaaugccccuguagcuggguacgagggggacguggguuccaaaacaaccaugcgacuuuucuacccugagagugcccacuucgauccuaagguggagaacaacccugauacacuacuugucuuaguggccuucaaagcaauggauuuucauuggauagaaacuauuuugucagacaaaaaacgggugagaaagggcuuuuggaagcagccacccuuaaucugggauguuaauccaaaacaaauccgaauucuaaaccccuucuucauggagauagcagcugacaaacugcuaucgcuuccuaugcagcaaccucgcaaaaucaaacaaaaaccaacgacugggcuccuagcuauaacacuggcacuccaccugugcgaucuuguccacaucgcugguuucggguauccagacgccuacaacaaaaaacagacuauacacuacuaugagcagauuacgcuaaaaaguauggcaggcagcggucacaaugucucccaggaagcccuugcuaucaaaaggauguuggaaaugggcgccaucaagaaccuuaccuccuucuag

SEQ ID NO: 249131 - RNA, 744 nt, Artificial Sequence
  Description of Artificial Sequence: Synthetic coding sequence
augcuccagaacagcgccguguuacugguccuugugauuuccgcguccgcaacccacgaagccgagcagaaugauuccguuagcccuagaaaaucccguguggccgcacagaacuccgcggagguggugagaugucugaauagugcucugcagguaggauguggugcauuugcuugucuggagaauaguacgugugacaccgauggcauguaugauauuuguaaaagcuucuuguacucagccgcaaaauuugacacucaagguaaggcauuugugaaagagucucugaaauguaucgcaaauggcgugaccagcaaaguuuuucucgcaaucagacgaugcaguacguuccagagaaugaucgcagagguacaggaggaguguuacucaaagcuaaauguaugcucuauugcuaagcgcaaccccgaagcaauaaccgaaguuguccagcucccuaaccacuucucuaaccgcuacuauaaccgacugguccgcagcuuacuagagugcgacgaggacaccguuucuacaauacgagacagccucauggaaaagauuggaccuaacauggccucacucuuucacauucuucagacagaucauugcgcacaaacccacccaagagccgacuuuaauaggcgccggacaaaugagccccaaaaacugaaaguacucuugagaaaccugcgcggagaggaagauucgccaagucacauuaaacggacaagucacgagagugccuag

SEQ ID NO: 249132 - RNA, 537 nt, Artificial Sequence
  Description of Artificial Sequence: Synthetic coding sequence
auguaugauaucugcaaguccuuucucuauucugccgccaaauucgauacccagggaaaagccuucgugaaagagagccucaagugcaucgcaaacggagucaccucuaaagucuuuuuggcaauaaggaggugcagcacauuccagaggaugaucgccgaaguucaggaggaguguuacagcaaacugaaugucuguaguauagcuaaacguaauccagaggccauuaccgagguugugcagcucccaaaccauuucucuaaccgguauuacaaccgccuaguucgaagccucuuggaaugcgaugaggauacaguauccacuauucgggauucuuuaauggagaagaucggaccaaacauggcaagcuuauuucacauccuucaaacugaccauugugcacagacccaucccagagcagacuuuaaccgccgcaggacaaacgagccccaaaaguugaaaguucugcugcgcaauuuacgaggcgaagaggauuccccuucccacaucaagcgaaccagccacgagagcgcauag

SEQ ID NO: 249133 - RNA, 537 nt, Artificial Sequence; identical to SEQ ID NO: 248527
  Description of Artificial Sequence: Synthetic coding sequence

SEQ ID NO: 249134 - RNA, 705 nt, Artificial Sequence
  Description of Artificial Sequence: Synthetic coding sequence
augaaccaccuccccgaagauauggaaaacgcgcugacggggucucaaaguucucacgcaagucuccgaaauauccacucuaucaaucccacgcagcucauggcgagaaucgagucuuacgaggggagagagaaaaagggcauuagcgauguucguaggaccuuuugucuuuucgugaccuuugaccuacuguuugugacauuguuauggauaauugaacucaacguuaauggagguauugagaauacacucgaaaaagaaguaaugcaguaugacuacuacucuuccuacuuugacauuuuccugcuggccguguuccgcuuuaaaguccuuauccuggccuacgccguguguagauuacgacacuggugggccaucgcucucacaacugcagucacuuccgccuuucuuuuagccaaggucauccuuuccaaacuguucucucaaggggcuuuuggguacgugcuaccuaucauuagcuuuaucuuagcauggaucgagacuugguuccuugauuucaagguucucccccaggaagcagaggaagaaaaucgacugcuaaucguucaagaugcaucugagcgugccgcccuaauuccuggaggauuaucagacggucaguuuuauucucccccggaaagcgaggcagguagcgaagaagccgaagaaaagcaggauuccgagaaaccccuguuggaacucuag

SEQ ID NO: 249135 - RNA, 1935 nt, Artificial Sequence
  Description of Artificial Sequence: Synthetic coding sequence
auggacgacaucgcugacagaaugagaauggaugccggugaaguuacacuggucaaucauaauagcguauucaaaacccaucuguugccacagaccggcuucccugaggaucaauuaagccugagcgaccagcagauucugucuucccgccagggucaccucgaucggucuuucacuugcucuacacgcagcgcagcuuacaaccccaguuacuauuccgacaauccaagcuccgacucguuccucggaucuggcgacuuaaggaccuuugggcagagcgcuaauggucaauggcgcaacaguaccccaagcucuagcuccagcuuacaaaagagucgaaacagcagaucccuguaucucgagacccgcaagacaucuucuggauuaucuaacuccuuugcuggaaagagcaaucaucauugucauguaucagcuuaugagaagagcuuccccauuaagccagucccaucaccuagcuggagcgguucuuguagacgcagucuccuuagcccuaagaaaacacagcggcgucacguauccacagccgaagagaccguucaggaagaggaaagagagaucuaucgccaacuguugcagaugguaacgggcaaacaguucaccaucgccaaacccacuacacauuucccccuucaccucagccgaugccuuuccucaucuaagaacacccugaaagauagcuuauuuaaaaacggaaacuccugugcuagucagauuaucgguucggauacgaguucauccgguagugcuucuauucugaccaaccaggagcaguuaucgcacagugucuacagccuguccucuuauaccccagacguagccuucggcucuaaggacucaggaacacuucaucacccccaucaccaccacagcgucccucaucaaccagacaaucuggccgccagcaacacacaaagugagggcuccgacucugugauccugcugaaagugaaagacucucaaaccccaacucccucaaguaccuuuuuucaagccgagcuguggauuaaagaacuuaccucggucuacgauucucgagcucgggaacgacugcggcaaaucgaagagcaaaaggcacuggcccuccaacugcagaaccaacggcuccaggaaagagaacauagcgugcacgacucugucgagcugcacuuaagaguuccucucgagaaggagauuccaguaacuguagugcaagagacccagaagaaaggccacaaacugacugauagugaggacgaguuccccgaaaucaccgaggagauggaaaaggaaauuaagaauguguuucgcaacgguaaccaagacgaaguuuugagugaagcguuccgcuuaacgauuacccggaaggauauacaaacccuuaaucacuuaaacugguugaacgaugaaauuaucaauuuuuacaugaacaugcuuauggagagguccaaggaaaagggccuucccucagugcacgccuucaacaccuucuuuuucaccaaacucaagaccgcgggcuaucaggcagugaaacgcuggacaaagaagguggauguuuuuagcguggauauccuucucgugccuauccaucugggcguucacuggugccuggcagugguugauuuuaggaagaagaauauuaccuauuaugacucgaugggaggcauuaauaacgaggcauguagaauacuacuccaguaucugaaacaggaguccaucgacaagaaaagaaaggaauucgauacuaacggcuggcagcuauuuucuaaaaaaucccaagaaauuccccaacagaugaacggcuccgacugcgggauguuugccuguaaauacgcagacuguauaacaaaagaccgcccuauuaacuuuacccaacaacacaugcccuauuuccggaaacgaauggugugggaaauucugcacagaaaacuguuauag

SEQ ID NO: 249136 - RNA, 1281 nt, Artificial Sequence
  Description of Artificial Sequence: Synthetic coding sequence
augguucucagcguaccagucaucgcccucggcgcaacacucgggacugcuacaaguauucucgcccucugcggcguuacuugucuuugccgucacaugcauccuaagaaaggacuguugccacgcgaccaggaccccgaucuggagaaagcaaagcccagccugcuaggauccgcccagcaguuuaacgugaagaaaucaaccgaaccuguccagccuagagcucugcugaaauucccagacaucuacggcccucggcccgcuguuacagccccugaaguuaucaacuacgccgacuacuccuuaagaaguaccgaggaaccaaccgcccccgcaaguccucagccucccaaugauagccgacugaagcgccaggucacagaggaauuauuuauccugccccagaauggugugguggaagaugucuguguuauggaaacauggaauccugaaaaggccgcaucuuggaaccaggcucccaagcuucauuacugccuggauuacgauugccagaaggccgaacucuucgucacacgacucgaagccgugaccagcaaucaugacggcgggugugauugcuauguucagggcagcguugcaaaucgcaccggauccguggaagcacaaacagcacuaaagaagaggcagcugcauacaacaugggaagagggccucguucugccuuuggcugaggaggaacucccaacagcaacccugacucuuacacugcggacuugugaccgauucucgaggcauucagucgcuggugaguugaggcugggauuggacggcacguccgugccacuuggugccgcccaguggggagaauugaaaacaucagcuaaagaaccuagugcuggcgcuggagaaguccugcuuucaauaucauacuugccugcagcuaaccguuugcuaguggugcuuauaaaagcaaagaaucugcacaguaaucagucuaaggagcuccucggcaaggauguuagcguuaaggucacucucaaacaccaggcccguaagcuaaaaaagaaacaaacaaagagagccaagcauaagauuaaccccguguggaacgagaugauuauguucgagcuuccagacgaccuccuucaagcuuccucaguagagcuggaaguuuuggggcaagaugacuccggccaaucaugcgcuuuaggacauugcagccucggacuacauacaagcggauccgagcgcucacacugggaagaaaugcugaagaacccccgacgacagauagcaauguggcaucaacuacaucuguag

SEQ ID NO: 249137 - RNA, 234 nt, Artificial Sequence; identical to SEQ ID NO: 248531
  Description of Artificial Sequence: Synthetic coding sequence

SEQ ID NO: 249138 - RNA, 366 nt, Artificial Sequence
  Description of Artificial Sequence: Synthetic coding sequence
augagaauuaugcugcuauucacugcuauccucgccuucucucuggcccagucauucggggcgguaugcaaagaaccucaggaagagguaguuccggguggcggaagguccaaaagagauccugaccuauaccaauuacuucaacgacuguuuaaaucacacuccagccucgagggacucuugaaggcgcugucacaggcuuccacagaccccaaggaaucuaccagcccagaaaaacgcgacaugcacgauuucuucgucggccuuaugggcaaaagaagcguucaaccugauagcccuacugauguuaaccaagagaacguaccuucuuucggaauuuuaaaguacccuccaagagccgaguag

SEQ ID NO: 249139 - RNA, 366 nt, Artificial Sequence
  Description of Artificial Sequence: Synthetic coding sequence
augcgaauaaugcuccucuucaccgccauacuugcuuuuucccuggcccagagcuuuggcgcuguauguaaagaaccacaagaggagguggucccaggcgggggcagaucaaagcgugauccugaccuguaucaguuguuacagaggcucuuuaagucacauucuagucuggaaggucugcuuaaagcccuaagucaggcuucgacggacccuaaggaaagcaccucuccagaaaaacgagacaugcacgacuuuuuuguuggccugauggguaaacggagcgugcaaccagauuccccuacugaugugaaccaggaaaaugugccgucauuuggaaucuugaaauacccaccccgcgccgaguag

SEQ ID NO: 249140 - RNA, 312 nt, Artificial Sequence
  Description of Artificial Sequence: Synthetic coding sequence
augcggaucaugcuacuauucacggccaucuuggcauucucacuggcacaaucuuucggcgccguguguaaagaaccucaagaggaggugguaccuggcggcggacguuccaagagagaccccgaccuuuaucagcuccuacaaaggcucuuuaagucccauagcucgcuagaaggccuacucaaagcauugucacaggcuucuaccgacccuaaggaaucaaccucucccgagaagcauucuccaaccgacgucaaucaagaaaacgugcccucguuuggaauauugaaguacccuccgcgcgcggaguag

SEQ ID NO: 249141 - RNA, 366 nt, Artificial Sequence
  Description of Artificial Sequence: Synthetic coding sequence
augcggauaauguugcucuucacagcgauccuggcuuuuucauuggcucagaguuuuggcgccgugugcaaagagccccaagaggaggucguccccgggggcgguagauccaagcgugaccccgaucucuaucaacuguuacagagacucuuuaaaucccauagcucucucgaaggccuccugaaagccuuaucccaggcauccacggacccgaaggagucaaccucacccgagaagcgcgacaugcaugauuuuuuugugggacuaauggggaagagaaguguucaaccugauuccccuacagacguuaaucaggagaacgugccaucauucggaauucuaaaguaccccccucgcgcagaguag

SEQ ID NO: 249142 - RNA, 4866 nt, Artificial Sequence
  Description of Artificial Sequence: Synthetic coding sequence
auggaaugggugcuugcugaggcccuccugucacaaagcagagaccccagagcacuguuaggcgcacugugucagggggaggccagcgcagagcggguugaaacccuccgguuccugcuucaaagacucgaggacgaagaggcuagagguucuggcggcgcgggggcucuucccgaagccgcucgggaggucgcugcgggcuauuugguccccuuauuacggagccuccggggacgccccgcuggggggcccgauccaucucuccagccgaggcaucgacgacgcgugcugagagcagcaggcgccgcacuccgaaguugugugcggcuggcuggcaggccucaguuggcugcugcgcuugccgaggaggcucuccgcgauuugcuugccgguuggcgcgcuccaggugccgaggccgcuguugaaguucuagcugcuguggggccaugucugcgaccacgcgaagacgguccucugcuggaacgcguagcagggacugcuguggcucuagcccuggggggcggaggagauggagacgaggccggaccugcugaagaugcugcugcccuuguagcggggcgccuacuucccguacuaguucagugcggaggggcugccuugcgugcagucuggggcgggcuugcagccccaggugcuagcuuaggaagugggcguguugaagagaaacuuuugguucucucugcgcuggcugagaaauugcuccccgaaccugguggagacagagcgcgcggcgccagagaagccgggccugacgcaaggagauguuggagguuuuggcggaccguccaggcuggacuagggcaagcugaugcccuuacacggaagagagcuagauaucuacuacaacgggcaguugaagugucagcugagcucggggcugacugcacuuguggcccucaagaaggcaauggccccucuuuguuuugguggucagagaggaaaaaagaugaguugcuuaaauuuugggaaaacuacauucuuauuauggaaacccucgaaggcaaucagauacacgucauaaaacccguguuaccaaaacugaauaacuuguuugaguaugcaguuagcgaagagaauggcuguuggcucuuucauccguccuggcacauguguaucuacaagcggauguucgagagcgaaaacaagauuuuaucaaaagaaggggugauccauuuucuggaacuguaugaaacaaagauccugccuuuuucuccugaauuuagugaguucaucaucggcccuuuaauggacgcccuuagugaaagcucccucuacagccggagcccuggccaaccuauaggaucaugcucucccuuaggacucaaacuccaaaaauuccuugucaccuauauaucccuccugcccgaagagaucaaguccuccuuccuccucaaguuuauucgcaaaaugaccagucggcacuggugcgcaguaccaaucuuguucuuauccaaggcgcuagcuaacgugccccgccacaaagcacuagguauagacggacugcuggcacugcgcgauguuauccauuguacuaugauaacucaccaaauucuacucaggggugcugcacaauguuaucuccuccaaaccgcaaugaaccuguuggauguugaaaaaguauccuugucugaugucucaacuuuccugaugucacuuagacaggaagagagucucggucgagggacgucucuguggaccgaguugugugauuggcuccgcgugaacgagucauacuucaaacccucgccuacuuguagcagcauagggcuccauaaaacgucccugaaugcuuacgucaaaucaaucguacaggaauacgugaagagcagcgcaugggagacaggggaaaauuguuucaugcccgauugguucgaggcuaagcuaguaagccugaugguguuguuggcaguugauguggaaggaaugaagacacaauauucugggaagcaacgaacagagaauguccuucggaucuuuuuggacccauuacuggacgugcugaugaaguuuaguacaaacgcauacaugccgcucuuaaaaaccgauagaugccugcaacugcugcuuaaacuguugaacacaugccgacugaaagguucuucugcacaggaugaugaaguguccaccguccugcaaaacuucuuuaugucuacaacugaaagcaucuccgaauuuauauugcggcgccugaccaugaacgaauugaacucuguaucagaccuggaucggugucaucucuaccuaauggugcuaaccgaacugauuaaucugcacuugaaaguuggguggaaaagaggaaacccaaucuggcgcgugauuucacuuuugaaaaaugccuccauucagcaccugcaggagauggacucaggacaagagcccacuguggggagccagauccaaaggguggugagcauggccgcccucgcaaugguuugcgaagcaauugaucagaaaccagaacuacaacucgauucacuccacgccggcccucucgaaagcuuuuugucuucucuccaacucaaccagacccuccagaagccccacgcugaagaacagaguagcuaugcacauccauuggaaugcucaucugugcuggaggaaagcaguagcagucagggauggggaaagauuguugcccaauacauacacgaucaguggguaugccugucuuuccuucucaaaaaguaucacacgcugauuccaaccacgggcagugaaauucuugagccuuuccucccagcaguacaaaugccaauuaggacuuugcagagcgcccuugaggcacucacuguacucucuuccgaccaggugcuccccguguuccauuguuuaaaaguguugguuccgaaacuccuuaccaguuccgaauccuuguguauagaauccuuugauauggcauggaaaauuauuagcagccucagcaauacacaguugaucuucugggcgaaucuuaaagccuuuguucaguuuguauucgacaauaaaguacugacaauugccgcaaaaauaaagggccaggcuuacuuuaagauaaaggagauaauguacaaaauaaucgaaaugucugcuauuaagacaggcgucuuuaauacacugauaucauacugcugucagagcuggaucgucuccgccucuaacgucagccaaggaucacuaucauccgccaaaaauuacucagaauuaauucucgaagcuuguauuuucggaacaguguuuagacgggaccagcggcugguccaagacgugcaaacauuuauugagaaccuaggucaugacugcgcagcaaacaucgucauggagaauaccaagagggaagaccauuaugugaggaucugcgcggucaaauuccucugucuacucgacgggucaaauaugucccacaaauuauucaucgaggaucuugccauuaaacuuuuagacaaagaugagcuaguuaguaaaucaaagaaaagguacuacguuaauucccugcaacaccgcgugaaaaauagaguuuggcaaacucuucuuguucuuuucccacggcuggaccagaacuucuuaaacggaaucaucgaucgaaucuuccaagcaggauucacaaauaaucaagcuaguaucaaguacuucaucgaauggauaauuauccucauccugcacaaguuuccucaguuucugcccaaguuuugggauugcuuuucauacggggaggaaaaucuuaaaacuagcauuuguacguuccuugcuguauugucacaccuugauauaaucacacagaacauacccgagaaaaaacuaaucuugaaacaggcccuuauagucguguuacaauggugcuucaaucacaacuucucaguucgccuguacgcccucgucgccuuaaagaaacuguggaccgucuguaagguccugucaguggaagaauucgaugcgcucacuccugugauagaguccagccuacaucaaguugaaagcaugcacggagccggcaaugcgaaaaagaauuggcaacguauacaagagcacuucuucuuugccacauuucacccccuaaaagacuauugccuggagaccauuuucuacauacugccccgccugucuggacucauugaggacgaauggauuaccauugacaaauuuacccgauucacugauguuccucucgcagccggcuuccaaugguauuugucccagacccaacugaguaagcucaagccaggggacuggagccagcaggauaucggaacaaaccuugucgaagcagauaaccaggccgaguggacugaugugcagaagaagauuaucccguggaacagucggguuagugauuuggauuuggaacuccucuuucaagaccgugccgcacgucucggaaaaaguauaucaaggcugauugucguggcaagccugauagauaaaccuaccaacuuaggaggccugugcaggaccugugaggucuucggagccagcgugcuuguaguggguuccuuacaguguaucuccgauaagcaguuccaacauuuguccgucucugcugagcaaugguuaccuuugguagaggugaaaccuccgcaauugaucgacuaccuccagcagaagaagaccgagggauauacaaucaucggcguugagcagacagcaaaaucuuuggacuugacacaguacugcuuucccgaaaaaucucugcuacuacuaggcaacgaacgcgaaggaauucccgcaaaucuaauucaacagcuagaugucugcgucgaaaucccccagcaagguaucauucggagccuuaacgugcacgucaguggcgcacuguuaaucugggaauacacgcgucagcagcuccugucacacggcgacacuaaaccauag

SEQ ID NO: 249143 - RNA, 759 nt, Artificial Sequence
  Description of Artificial Sequence: Synthetic coding sequence
augggcguacuucuuacucagcgcacucuccuuucccucguauuagcauuacuauuuccaucaauggccucuauggcugcaaucgggagcugcuccaaagaguacagaguacugcugggucaacuacagaagcagaccgaccuuaugcaggacacaucucgacuguuggacccauauauuaggauccaaggccuggaugugcccaagcugcgggagcauugucgugaaaggccaggcgcauuucccagcgaagagacccuccgaggacugggccggcgagguuuucuacagaccuugaacgccacauuggguuguguucugcaucgccuagcagacuuggaacagagauugcccaaggcucaggaucuggagagaucgggguuaaacaucgaggaccuggagaagcugcaaauggccaggccaaacauucucggccucagaaauaauauuuauugcauggcccaacugcuugacaacagugacaccgcagaacccacaaaagcuggaaggggcgcaucacagccacccacccccacacccgcaagcgaugcuuuucagaggaaacuggagggauguagguuucugcacgguuaccauagauuuaugcacuccgugggacgaguguucagcaaauggggcgaguccccaaacagaucccgcaggcauucuccacaucaggcuuugagaaaagguguccggcgaacccguccuucgagaaaaggaaaaaggcuuaugacuagaggccagcugccacgguag

SEQ ID NO: 249144 - RNA, 2049 nt, Artificial Sequence
  Description of Artificial Sequence: Synthetic coding sequence
augugccccgggcuauacccguacuccagucuacuugaauaugggcgguccaugaucauuuacgaacaggaaggcgucuacauccauaguaguugugguaagacuaacgaccaagacggacuuaucuccgggauccugagagugcuggagaaagaugcggaagugaucguagacuggaggccgcuugacgaugcucuugacucuuccagcauuuuauaugccagaaaggacagcuccuccgucguagaauggacucaggcccccaaagagcgaggacaccgagguucugaacaccuaaacuccuaugaggcagaaugggauauggugaacacggucaguuuuaaaagaaaaccacauacuaacggugaugccccaagccauagaaacggcaaaaguaaaugguccuuccuguuuagucuaacggaucugaagagcaucaaacagaauaaagaaggaauggguuggagcuaccuuguuuuuugucuuaaggaugacgugguauugccugccuuacauuuccaucagggggauagcaaguugcugauugagagucuggagaaauauguggugcuuugugaauccccgcaagacaagcguacgcucuugguaaacugucagaacaaaagccucucccaauccuucgaaaaucuccuggacgaaccagccuacggacugauccaaaaaauuaaaaaagauccauauaccgccacaaugaucggguucucuaaggucacaaauuacaucuuugacagcuugaggggcuccgauccuucgacacaucagagaccaccuucugagauggccgacuuucuuuccgaugcaauccccgguuugaagauuaaccagcaggaagagccuggcuucgaggugaucacacgaauugacuuaggggagcgaccugugguccagcggagggagccaguuagccuugaggaauggaccaagaacauagauagugagggacggauucuuaauguggauaacaugaaacaaaugaucuuuaggggcggacuaucgcaugcguugaggaaacaggcauggaaguuccuucuaggguauuuucccugggacaguaccaaggaggaacggacacaauuacagaagcagaagacggacgaauauuuccggaugaaauuacaguggaagaguaucagucaagagcaggaaaaaaggaauaguagacuaagggauuaccggagccugauagaaaaggacguaaacaggacugaucgaaccaauaaauucuacgaaggucaggauaaccccggccucauucugcugcacgauauucuuaugaccuacuguauguaugacuucgauuuaggguauguccagggcaugucagaucuacucuccccauuguuauacgucauggagaacgagguggaugccuuuuggugcuuugcgucuuauauggaucaaaugcaucagaacuucgaggaacagaugcaagguaugaagacucagcucauucagcucucgacauuguuacggcuccuugauaguggauuuuguaguuacuuggagucucaggauucuggauaucuauacuucuguuuucgcuggcugcuuauacguuucaaacgcgaauucucuuuucucgacaucuugcgcuugugggaaguaauguggaccgagcuacccugcacgaauuuucaucuucuauugugcugcgccaucuuagaauccgagaagcagcagauaauggaaaagcacuacgguuucaacgagauccugaaacacauuaacgaauuguccaugaaaaucgacguggaggacauucucugcaaagccgaggccauuucucugcaaauggugaaguguaaagaacuuccucaagccgucugcgaaauccuuggacuccagggcucggaagugacuacaccugauucugauguaggagaagaugagaacgucgucaugaccccuuguccuaccuccgccuuucaaucaaaugcuuugccuacccuuagugcuucaggcgccagaaaugacucacccacgcagaucccugucucaucagacgugugucgucucaccccggcguag

SEQ ID NO: 249145 - RNA, 1338 nt, Artificial Sequence
  Description of Artificial Sequence: Synthetic coding sequence
augauugguuuuucaaaggucaccaacuacauuuucgauucccugagaggauccgauccaucuacgcaucaaagacccccaucugagauggccgacuuccuuucugacgcaauccccggcuugaagauaaaucagcaggaagaaccaggcuuugaaguuaucaccagaauugacuuaggugagcgucccgucguacagcggagagagccgguuucauuagaggaauggacaaagaacaucgauucagaaggacguauucugaacguagauaacaugaagcaaaugaucuucaggggaggauuaucacaugccuugaggaaacaagcauggaaguuccuccucgguuacuuccccugggacuccacaaaggaagagcguacacagcugcagaaacaaaaaacagacgaguacuuuagaaugaaacuacaguggaaauccauuucacaggaacaggagaaacguaacagccggcuacgagauuacaggagccugauugaaaaagaugugaaccgcacggauagaaccaacaaauuuuaugaagggcaggauaacccaggucugauauugcugcaugauaucuuaaugaccuauuguauguaugauuucgaccuuggcuaugugcaaggaaugucugaccuuuuguccccgcuacuguaugugauggaaaaugagguagaugcuuuuugguguuuugcgucuuacauggaucaaaugcaucagaacuucgaggaacaaaugcagggaaugaagacucaguugauccagcuauccacacuccuucgucuauuggauucaggauuuuguucguaccuggagagccaggacucaggauaccucuauuucugcuucaggugguugcuuauuagauucaaaagggaauuuucauuuuuggauauccuuagacugugggaggugauguggaccgaacuaccaugcacuaauuuucaccuccuacuuugcugcgcaauacuugaauccgagaagcaacagauaauggagaagcacuacggguucaaugaaauccugaaacauauuaaugaacucagcaugaagaucgacguggaagauauacuguguaaggcagaagccauaaguuugcaaaugguuaaaugcaaagaacugccacaggccguaugcgagauacuaggccuacaagguucugaagucacaacaccugauuccgaugucggagaggacgaaaauguugugaugacaccaugccccaccucugccuuccaaaguaacgcccugcccacacucagugccucuggcgcgcgcaacgauucuccaacacaaauccccguaucuucagaugucugcaggcugacccccgccuag

SEQ ID NO: 249146 - RNA, 2025 nt, Artificial Sequence
  Description of Artificial Sequence: Synthetic coding sequence
auggcggcagcggggguggucucaggcaagauaaucuaugaacaggaaggaguauacauccauaguucuuguggcaagaccaacgaccaggauggccuaauuucuggaauccuuagaguacucgagaaagaugcggaagucauuguggauuggcgucccuuggaugacgcccuugauucaaguagcauucucuacgcacgcaaagacagcucuagugucgucgaguggacucaagcgccuaaagagaggggccacaggggcagcgaacaucugaacucauacgaagcggaaugggacaugguuaauacuguguccuuuaaaagaaagccucauaccaacggagaugcaccuucucauagaaauggaaaauccaaguggaguuuccuguuuucauuaaccgaccugaaaagcaucaaacagaauaaggagggaaugggguggagcuaccuagucuucugucucaaggaugaugugguguuaccugcgcugcacuuccaccagggcgacucaaaacuuuuaauagagagccuggaaaaauacgucguccugugcgagucaccucaggauaagcggaccuuacuugucaauugucaaaacaaaucuuugucccaguccuuugagaaucugcucgacgaacccgccuauggucugauccagaagauuaaaaaagaccccuacaccgcgacuaugauugguuucucaaaagugacaaauuauauuuucgauagccugcguggcucggacccuagcacucaccagagaccuccaucugaaauggcagacuuccucucagacgccaucccuggacugaagauuaaucaacaagaggagcccggguucgaaguuaucacuaggauugaccuuggagaacgaccuguaguacagagacgggaaccggucagccucgaggaguggacuaagaacauugacucggaagguagaauacuuaacguggacaauaugaaacaaaugauauuccggggcggacuaagccacgcacuucguaaacaggccuggaaguuccuccuagguuacuuuccaugggauagcacuaaagaagagcgaacucaacugcagaaacagaagacggaugaguacuuccggaugaaguuacaguggaaaucgauuagucaggagcaagaaaaaaggaacaguagacuccgcgauuaccgcagcuuaauugaaaaggaugugaacagaaccgaucguacuaacaaguucuacgagggacaggacaauccuggacugauucuucugcacgacaucuugaugaccuauuguauguacgacuuugaccugggcuacgugcaggguauguccgaucuucuuucgccacuccuguacgucauggagaaugaaguggaugcuuuuugguguuuugccagcuauauggaucagaugcaucaaaauuuugaggaacaaaugcagggcaugaaaacacaguugauacaauuguccacucuucugcgcuuacuggacucuggguuuugcucauauuuggaaagccaagacuccggguaucucuacuuuuguuuccgguggcuccuaauccgauuuaaacgugaguuuuccuuucuugauaucuuacggcuaugggaagugauguggaccgagcucccaugcaccaauuuccaccuucuacugugcugcgcuauccuugagucagagaaacaacagaucauggagaagcauuauggguucaaugaaauuuuaaaacauauuaacgaacuuaguaugaaaauugauguggaggacaucuuguguaaagccgaggcgauuucacuucagauggucaagugcaaggaacuaccacaggccgucugugagauccucggccugcaaggcagcgaggugacuaccccagacagugacguuggcgaagaugagaauguagugaugaccccaugcccuaccuccgcguuccagagcaaugcucugcccacauuguccgcguccggugcaagaaacgauuccccaacacagauacccgugagcucagacguuugucgucuuaccccagcuuag

SEQ ID NO: 249147 - RNA, 2076 nt, Artificial Sequence
  Description of Artificial Sequence: Synthetic coding sequence
auggcagcggcaggcguggugucaggcaagaucaucuacgaacaggaaggcguuuacauacauucuucauguggaaaaacuaaugaucaggacggacucaucucuggaauacugagaguucuggaaaaggacgcggaaguuauaguagacuggagaccacuggaugacgcucuggauagcucgaguauccucuaugcaagaaaggauaguucuucugugguagaauggacucaagcuccuaaggaacgaggacacagagguucagaacaccugaauucguacgaggcagagugggauauggugaauacaguuucuuuuaagcggaagccgcacaccaauggcgaugcaccgucccaucgaaauggcaagagcaaaugguccuuccuuuuuuccuuaacugaucuaaaaucaaucaagcagaauaaagaagguaugggcuggaguuacuuggucuucugucucaaagaugaugucguuuuacccgcccuccacuuccaccagggcgacucaaagcuucucauugagucuuuagaaaaauacguaguccugugugagaguccccaagauaagcgcaccuugcuggugaacugccagaauaagucucuaucacaaaguuucgagaaucuguuagacgaaccugcuuacggacugauacaagcuggguugcuggaccggaggaagcuccucugggcuauucaccauuggaagaaaaucaaaaaagacccuuacacugcuacaaugauuggcuuuucuaagguaaccaauuacauauuugacucucuuagaggcuccgaucccuccacacaucaaagaccuccauccgaaauggccgacuuucuauccgaugccaucccuggccucaaaaucaaucaacaggaggaaccggguuuugagguuaucacccgcaucgaucuaggagagagaccuguggugcagagacgagaacccgugucauuagaggaguggaccaagaacaucgauagcgaaggucggauucuaaauguggacaacaugaaacagaugauauuuagggggggacuuagccacgccuuaagaaagcaggccuggaaauuucugcucggcuauuuuccuugggacucaacaaaagaggagagaacgcagcugcaaaaacaaaagacagaugaauacuuuaggaugaaauuacaguggaaaagcauuucacaggagcaggaaaaacguaacagucgccuacgggacuaccgaaguuugauagaaaaagacgugaaucgaaccgacaggaccaacaaguuuuaugaaggccaggacaaucccggcuugauucuacugcacgacaucuugaugacuuauuguauguaugauuuugacuugggguacguucaagguauguccgacuuacugagcccucuucuguacgugauggagaaugagguggacgcuuuuugguguuucgcaucuuacauggaccagaugcaucagaauuucgaagagcaaaugcagggaaugaaaacccagcugauacagcugucaacacugcugagacucuuagacagugguuucuguagcuaccuggagagucaagacucggguuaccuauauuuuuguuuuagguggcuucuaauuagauucaaacgcgaguucuccuuucuggacauuuuacgcuuaugggaagugauguggacagagcugcccugcaccaacuuucacuuauuguuaugcugcgcaauccucgaaagcgaaaaacagcagauuauggaaaagcacuauggcuucaaugaaauucucaaacacaucaaugaacuguccaugaagaucgaugucgaagacauuuuguguaaagcagaagcaaucucacugcagauggugaaaugcaaggaacuuccucaggcaguuugugagauccugggccuucaaggaucugagguuacaacccccgauuccgacgugggcgaagaugaaaaugucguaaugacgcccugccccacuucugccuuucagucuaaugcccugccaacccucagcgccuccggcgcccgcaacgauucuccuacccagauacccgugagcucagaugugugucgguuaacccccgcuuag

SEQ ID NO: 249148 - RNA, 5514 nt, Artificial Sequence
  Description of Artificial Sequence: Synthetic coding sequence
augggugcuaugacacaauugcuggcgggcguguuucucgccuuucuggcucuugcuacugaagggggcguguuaaaaaaggugaucagacauaaaaggcaguccggcguuaaugccacacucccagaagagaaucagcccguuguguuuaaccacguguacaauauaaagcugccugugggcucucaaugcaguguagaucucgaaagcgcuucaggagaaaaggaucuggccccuccuagcgaacccagcgaaucuuuccaagagcacacuguggacggagagaaccagaucguauucacacauaggauuaauaucccccgcagagcguguggaugcgccgcagcaccugacguuaaggaacuucugucacgguuagaggaguuagaaaacuuggucagcucucuacgcgagcagugcaccgccggcgcaggcuguuguuuacagcccgccacgggcagacuggauacccgcccauucuguagcggccgggggaauuucagcacugaagggugcggcugcguuugugaaccaggguggaagggacccaacugcagugagccagagugucccgguaauugccaucuucgaggucguugcauagacggucagugcauaugugacgauggcuuuacaggagaagauuguagucagcucgccugcccauccgauugcaaugaccagggaaagugcgugaauggugucuguauuugcuuugaggguuacgcuggugccgauuguucccgggagauuugucccgugcccuguuccgaagagcacggcaccuguguggacggccuaugugugugccaugauggcuucgcuggagaugacuguaauaagccguugugcuugaacaauuguuauaauaggggccgcugcguggaaaaugagugcguuugugacgaaggcuuuacuggagaagacuguucagagcugaucugcccuaacgauugcuucgacagggguaggugcauaaaugggacuuguuauugugaggagggauuuacgggggaggacugcggcaagccaacaugcccccacgccugucacacccaagggaggugcgaagaagggcaguguguuugugaugaggguuuugcagguguggacuguuccgaaaagagaugccccgcagacugucacaaccgggggagaugcguggauggucggugugaaugugaugauggcuuuacaggagcggacuguggcgagcuaaaauguccuaaugguugcucuggccacggcagaugugugaauggacaguguguuugcgaugaaggauacacaggggaggauugcucacagcugcgcuguccgaacgacugucacagcagggggaggugugucgaaggaaaaugugucugcgaacaggguuucaagggcuacgacuguagugacaugaguuguccuaacgacugucaccagcauggaagaugugugaacgggauguguguaugugaugauggcuauacaggcgaggacugcagggauagacagugcccaagagacuguagcaacagaggacugugcguggaugggcagugcguaugcgaagaugguuucacagggccagacugugcugagcugagcuguccuaaugauugccacggccaagggcgaugcgugaacgggcaguguguaugccacgagggguucaugggaaaggauuguaaagaacagaggugcccuagcgauugucauggacagggacgcugcgucgaugggcagugcauuugccacgaaggauucacaggccuggauugcggacaacacucgugccccagcgauugcaauaaccuuggucaguguguguccggacgaugcauuugcaaugaggguuacagcggcgaagauugcagugagguuagcccaccaaaagacuuaguugugaccgaggugacggaagagacaguaaaccuugccugggauaacgaaaugcgcguuacggaauaccucgucguuuauacgccaacucaugaaggaggccuggaaaugcaguuccgcgugccaggggaucagacuagcaccaucauucaggagcuggagccaggaguggaauacuuuauccgcguuuuugcuauacuggagaauaaaaaauccauccccgugagcgcccguguugcaacauaccucccggcacccgaaggcuuaaaguucaaaaguauuaaggaaaccaguguugaagucgagugggacccccuggacauugccuuugaaacgugggaaauaaucuuuagaaacaugaauaaagaggacgagggagagauuacaaagagccugagaaggccugagacgagcuacaggcagaccggacuggcaccuggacaggaguacgagauaagucugcauauugugaaaaacaauacucggggcccuggccugaagaggguuacaacaacccgccuggacgccccaucccaaauagaggugaaagacgugacugauacaaccgcccuuauuacuugguuuaagccccucgcagagauugacggcaucgagcuuacguauggaauuaaggauguccccggagacagaacuaccauagaucucacugaggaugaaaaucaauauagcauugggaaccuaaaaccugauacggaauaugagguuagccuaauuagucgucggggagauaugagcucuaauccagcaaaagagaccuucacaaccggcuuagacgccccaagaaaucucagacggguaagccagacugacaauucuauaacccuggaauggagaaacggcaaggcugcaaucgauucguauaggauuaaauaugcccccaucagcggaggggaccaugcagaaguugauguucccaaaucacagcaggccacuaccaaaacaacuuuaacuggacugaggccggguacugaauaugggaucggugucucagcaguaaaagaggauaaggaaucuaauccagccaccauuaacgcugcaacagaacuagacacuccuaaagaucuucaggucucugagacggccgaaacaagccugacccuguuauggaaaacaccacuagcuaaguuugaucgauaccgccucaauuauucucuaccaacgggacaaugggugggggugcagcucccuagaaauacuacuucauacguccugcgaggacuagagccgggccaggaauacaaugugcugcugaccgccgagaagggacggcacaagucuaaaccagcucgcgugaaggcuucaaccgcuaaagaacccgagauagggaaucugaauguuuccgauaucaccccagaaagcuuuaacuuauccuggauggcgacagacggaauuuucgaaacuuuuaccauugagauuaucgauuccaacagacugcuagagacugucgaguacaacauaucuggugccgaacguacagcacacauuuccggccugccccccuccacggauuuuauuguuuauuugaguggccuagcuccuuccaucagaacaaagacuauuucugcaaccgccacaaccgaggcccugccucuuuuagagaacuugaccauaucugauaucaaccccuauggcuucacugucagcuggauggccagugagaaugcguuugacucguuucucguuacagugguggauuccggcaaacuccucgacccucaagaguucacccugagcggcacccagcguaaauuggaacuccgcggucugauaacaggaaucggcuaugaagugaugguaucuggguuuacccagggccaccagacgaagccccugagggcagaaaucguaacggaagcugagccagaaguggacaacuuguuaguguccgacgcuacuccagacggcuuucggcuaucauggacugcugaugaagguguguucgacaauuucguacuaaagauccgcgauacuaagaagcaaagugaaccccuggagauaacgcuccuggcccccgaaagaacgcgcgacaucacaggacuucgugaagcgacagaauacgaaauugaguuguauggcauuuccaaaggacgccgcucucaaaccgugucugcuauugcuacaacggcuaugggaagcccaaaagaagugaucuucucggacauaaccgagaacuccgcgaccguauccuggagagcuccuaccgcucaaguugaaaguuucagaaucaccuaugugcccauuaccggagggacaccuucaaugguaacuguugacgguacuaaaacgcagacuagacucguuaaauuaaucccgggcguggaauauuuaguuagcaucaucgccaugaagggcuucgaggagagugagccagugagcgguucuuuuaccacagcgcuugauggccccucaggacucguuaccgccaauauaaccgacucagaggcccuggcacgguggcagccagcaauugcgaccguggacagcuacgucaucaguuauacaggugaaaaagugccagaaauuacccgcaccgucucaggcaauaccguggaauaugcccugaccgaccuugaaccggccacagaguacacucugcgcauauucgccgagaaggguccgcaaaaguccuccacaaucaccgcuaaguucaccacagaccuggauucuccaagagaucuaacugccaccgagguucaaagcgaaacugcauuacuuacauggcggcccccaagggcaagugucacgggcuaccuccuugucuacgaaagugucgauggcacaguuaaggaagugaucgugggucccgauacuacuuccuauucuuuagccgaucugucccccuccacccacuacaccgcgaaaauccaagcacucaauggcccgcugagaucgaacaugauacagacaauuuucaccacuauuggccuguuauaccccuuucccaaagauugcagucaggcaaugcugaacggugacaccacgaguggccuauauacaauuuaucugaauggagauaaggccgaagcucuggaaguuuuuugcgacaugacuagugacgggggcgguuggauuguguuucugcggaggaaaaacggacgugaaaauuucuaucaaaacuggaaggcauacgcggcuggauuuggugaucgccgggaagaauucugguugggacuggauaaccugaacaaaauaacagcacaggggcaauaugaacugaggguagaccuaagagaccacggggagacagcauucgccguauacgacaaauuuucagugggagaugcuaaaacaagauacaagcugaagguggaaggcuacucagggaccgcaggcgacaguauggccuaccacaauggcagaucauucucuacguucgauaaggacacagacucagcuaucacuaauugugcucuaaguuauaaaggagccuucugguaccgcaacugccacagagucaaucuuaugggaagguauggagacaacaaucauucacagggggugaauugguuccacuggaaagggcacgaacacucuauucaauuugcugagaugaaauugagaccuucaaauuuucggaaucuagagggcagacguaaacgggcuuag

SEQ ID NO: 249149 - RNA, 4695 nt, Artificial Sequence
  Description of Artificial Sequence: Synthetic coding sequence
augggcgcaaugacgcaguuacuggcuggggucuuccuggccuuucuggcauuggccacagaaggggggguguugaagaagguuauucgacauaaacgccaaaguggaguuaaugcaaccuuaccugaagaaaaccagccugucgucuuuaaccauguauauaacauuaagcuuccagugggcagccagugcaguguugauuuagagucugcaagcggggaaaaagaccuagcacccccguccgaaccuagugagucguuucaggagcauacgguugacggagagaaucaaauuguuuucacccauagaaucaauaucccuagacgcgcauguggaugcgccgcagccccugaugucaaagaacuucugucaaggcuagaggaauuggaaaaccugguaagcucauuacgcgagcaguguacagccggagccggaugcugucugcaaccggccaccgggagauuggauacgagaccauucugcuccgggcgggguaacuuuucuaccgaggguugcggcugugugugcgaaccugguuggaaggguccuaacugcagcgaacccgaaugcccuggcaauugucaccucagagguagguguaucgacggccaaugcaucugcgacgacggcuuuacgggagaggauuguagccaacucgcuugccccagcgauuguaacgaucaggggaaaugcgugaacggcgugugcauuuguuucgaaggguaugccggagccgauugcagccgggaaauauguccuguuccaugcucggaagaacacgguacauguguggaugguuuaugugugugucacgaugguuucgccggagaugacuguaacaagccacuuugucuuaauaacugcuacaauaggggacgaugcguagagaacgagugcguaugcgacgagggcuuuacaggcgaagauuguuccgaauugauuugcccuaaugacugcuucgauaggggccgguguaucaacggcacuuguuauugcgaggaagguuucacaggagaagauuguggcaagccuaccugcccgcacgcaugucacacccaggggcggugugaggaaggccagugugugugcgaugaagguuuugcagguguggauuguagcgaaaagagaugucccgccgacugccauaauaggggaagauguguggauggaaggugugaaugcgaugauggguucacuggcgccgacugcggagagcuuaaaugcccuaauggcuguucgggccauggccgauguguaaauggccagugcguuugcgacgagggauacacaggagaggacugcucacaguuacgguguccaaacgacugccacaguagggggagguguguagagggcaaauguguaugugaacaggguuucaaaggcuacgauugcucagauaugaguuguccaaaugacugucaccagcacggccgcugcguaaauggcaugugcguaugcgacgacgguuacacaggagaagauuguagagauagacagugucccagagauugcagcaacagagguuuauguguugacggacaaugugugugcgaggacggcuuuacaggaccggacugugcggaacucuccugcccuaaugauugccauggucagggaagaugcguaaacggacaaugcgugugccacgagggcuucaugggcaaggacuguaaggaacagagaugccccucggacugucaugggcagggucgcuguguggacgggcaguguaucugccacgaagguuucaccgggcuggauugcggacaacacucuuguccuuccgauuguaacaaccugggacaaugugugucagggagaugcauaugcaaugagggauauaguggcgaggauuguagugaagucagcccuccaaaggaccuggugguaacagaggugacggaggagacaguuaaucuggccugggauaaugaaaugcgaguuacugaguaccucguaguguacacaccaacgcacgaaggcggacuggaaaugcaauuucgcguuccaggggaccaaacaucaacaaucauacaggagcuggaacccggcguugaguauuuuauucguguguuugcaauacucgagaacaaaaagagcauaccuguguccgcccgcguugcgacuuauuugccagccccggaaggacuaaaauuuaaaucuaucaaggaaacuagugucgagguugaaugggaccccuuggauauagcguuugagacgugggagauuaucuucaggaacaugaacaaggaagaugaaggagagauuacuaagaguuuacgaaggccugaaaccuccuaccggcagaccgguuuagccccaggacaggaguacgagaucaguuuacauauugucaagaacaauacucgggggcccggacucaagagaguuaccacuacucgccuugacgcuccuagucagaucgaaguaaaagauguuacagacacaacugcucugauuacaugguucaagccacuggccgaaaucgacggcaucgagcucacauauggaauaaaggaugugcccggcgaucggaccacaaucgaccuuacggaagacgagaaccaauacuccauuggaaaccuaaagccagacacagaauacgaggugucgcugaucucaaggcggggagauaugucaagcaauccagcuaaggagaccuucacaacuggccuugaugcuccuagaaaccucagaagggugucacagacagacaacuccauuacccuagaguggcggaacgggaaagcugccauagacaguuaucgaaucaaauacgccccaaucucagguggugaccacgccgaagucgaugugccaaaaucccaacaggcgacgacuaagacuacacuaaccggacugcgcccuggcacugaguacggcauuggcgugagugccguuaaagaagacaaagagucuaauccagcaacaaucaacgcggccacagaguuagacaccccaaaagacuuacaggugagugagacagcugaaacuucuuuaaccuuacuauggaaaaccccucucgcaaaauucgauagguaccggcugaauuacucucugcccacaggacaaugggugggcguucagcuaccucgcaauaccacaaguuacguucuaagggggcuggaaccaggccaggaguauaauguccugcucacagcagagaaaggccgucauaaaucuaagccagccagggugaaggcuagcaccgcaaugggaaguccuaaagaagugaucuucuccgauaucaccgagaacagugcuacugucagcuggcgcgcccccaccgcacaggucgaaagcuuuagaauuacauacguccccauuacuggcggaacucccagcaugguuacaguggacggcaccaagacccagacucgcuugguaaagcucauuccgggugucgaauaccuagugucaauaaucgccaugaaggguuuugaagaauccgaacccgugucaggcuccuuuacgacugcccuggacggacccaguggccuggugacagcaaauauuaccgacuccgaagcucuggcaagguggcagccagccaucgcaacuguggauuccuacgugauuagcuacaccggcgaaaaaguccccgaaaucacacgaacaguuagcgguaauaccguugaguaugcauugacagaccuugagccagcuacugaguauacauugaggaucuuugccgaaaaggggccucagaaaucaucuacgauaacggcgaaauuuacuaccgaucuggacuccccacgagaccugacagcaacagaaguucaguccgagaccgcacugcugacuuggagaccuccucgagcauccgugacaggauaccugcuuguuuaugaguccguggauggcaccgucaaggagguaauagucggucccgauaccacuucauacagccuagccgauuuaaguccgucaacccacuauacagcaaagauacaggcacucaauggcccgcuaagauccaacaugauacaaacaauuuuuaccacaauugguuuguuauaccccuucccuaaagacugcagccaggccauguugaacggagauacuacaucuggauuguacacgauuuacuugaauggggauaaggcugaagcccuggagguguucugcgauaugacuagugauggcggagguuggauuguguuccuccgaaggaagaacggccgcgagaauuuuuaccaaaauuggaaagcuuaugccgcuggguucggagacaggagagaggaguucuggcuaggacuagauaacuugaauaagauaacagcucaaggacaauacgaauugcggguggaccugcgggaucauggagagacagccuuugcuguuuacgacaaauuuuccguuggggacgcuaagacaagauacaaacugaagguggagggguauagcggaacugcaggggauucuauggccuaucauaauggccgaucguucucaaccuuugauaaggauacagacagcgccaucacuaacugugcucugagcuacaagggcgcauuuugguaccgcaacugucaccgagucaaccugaugggccgguacggcgauaacaaucauucacaaggcguaaacugguuucauuggaagggacaugaacacaguauacaguuugccgagaugaaacuacgaccuagcaacuuccguaaccucgagggacgucgaaaacgcgcguag

SEQ ID NO: 249150 - RNA, 4968 nt, Artificial Sequence
  Description of Artificial Sequence: Synthetic coding sequence
augggagccaugacccagcugcuugccggcguguuccucgccuucuuagcucuggcaaccgaggggggggugcucaaaaaagucauuagacauaagagacaguccggagugaacgcuacccuuccugaagaaaaccagccuguagucuucaaccacgucuauaacauaaaacugccuguaggcucucaaugcucuguagaccucgagagcgcaucuggggagaaggaccuggcaccaccaagcgaaccuucugaguccuuccaggaacacaccguagacggggaaaaccagaucguauucacacaccgaaucaacaucccacggcgagcuugugggugcgcugccgcuccagaugugaaagaacuucuuagccgacuggaagaauuggaaaaccucguuucaucccuuagggagcaaugcaccgcgggagccggcugcugccugcaacccgcaacuggcagacucgacacucgccccuuuugcucuggacgugggaauuucucuaccgagggcugcggcugcguuugugaacccgguuggaaaggcccuaauugcuccgaacccgagugucccggcaauugccaucugaggggcagguguauagacggucaguguauaugugacgacggguucacaggggaggacugcucucaguuagcguguccaucugacuguaaugaucaaggaaagugcgugaacggcgucugcaucuguuuugaggguuaugccggagccgacugcucgagagagauauguccugugcccugcagcgaagaacaugggaccugcguugacggccuguguguuugucacgauggguucgccggagaugacugcaacaaacccuuauguuugaauaacuguuacaauagaggacguugcgucgagaacgagugugugugugaugaaggauuuacaggggaagauugcucugaacugauuugucccaacgauuguuuugauaggggucgaugcaucaaugguaccuguuacugugaggagggcuucacuggagaagauugcggaaaaccaaccugcccucaugcaugucauacgcaaggccggugugaagagggccaaugcgucugugacgagggauuugccggcgucgauugcucugaaaagagguguccggccgauugccacaauagagggaggugcguggaugggaggugugagugugacgacggguucacuggggcugacugcggcgaacuuaaaugcccuaauggauguagcggacacggaagaugcgugaauggacaaugcguuugcgacgaagguuacacaggcgaggauuguucucaacucaggugccccaaugacugccauagcagagggaggugcguggaaggcaaguguguuugcgaacagggauuuaagggcuaugauuguagcgauaugucaugcccuaaugacugucaucagcauggacgaugcgugaacggaaugugcguaugcgacgaugguuacacuggugaggauugccgugaccgccaauguccacgagacugcaguaaucggggccuguguguagauggccagugugucugcgaagacgguuuuacagggccagacugugcugagcugaguugucccaacgauugucacggacaggguaggugcguaaacggucaaugcgugugccaugaaggauuuaugggcaaagauuguaaggaacagagauguccuagugauugccacggccaaggaagaugcguugauggccaguguaucugucacgagggauuuacaggguuggauugcggacagcacagcugucccagcgauuguaacaaccugggacaauguguaagugggcgcugcauuuguaaugaaggguacaguggugaagauuguuccgaagugagcccuccaaaggaccuugucguuaccgaagucaccgaagaaacugugaaucuggcuugggacaaugaaaugcgagugacugaguaucuugucguguauacuccuacccacgaagguggacuggaaaugcaguucagaguaccuggugaucagacuucgaccauuauccaagagcuugagcccgggguagaauauuucauccgcguuuuugcaauccucgagaacaaaaaaucaauacccgugagugcacgcguagccaccuaccucccagccccugagggcuuaaaguuuaaaucgauaaaagaaacaagcguagaaguggagugggacccauuggacauagcauucgagaccugggagaucauauuuagaaacaugaauaaagaggaugagggggaaauuacaaagagcuuacgacgcccugaaacaagcuaccgacagaccggguuagcucccggucaggaguacgagaucucauugcauaucguuaagaacaauacccgcggccccggacugaaacgagucacgacgacccgcuuggaugcaccuucacagaucgaagugaaagacguaacagacacuacagcccugauuacuugguuuaaaccacuggccgagaucgacgguauagagcucacguacggcaucaaggacguccccggggauaggacuaccaucgaucucacugaggacgagaaccaguacuccaucgguaaccuuaaaccugacacagaauacgaaguuucauugaucagccggagaggcgacaugucuuccaaccccgcuaaagaaacauuuaccaccggccuugacgcccccagaaauuuaagacgaguaagccagacagauaacagcaucaccuuggaauggaggaacggcaaggcugcuaucgauaguuauaggaucaaguaugcucccauuaguggaggagaccaugcagaaguagaugugccgaaaagucagcaggcgacuacuaaaacgacacuaaccgggcugagaccugggacugaguacggcauuggagucagcgccgugaaggaagauaaagagagcaacccugccacgaucaacgcugccaccgagcuggauacacccaaagaccuacaggugagugagacugcagaaaccagucugacauugcuguggaagacuccucucgccaaauuugacagauacagguugaauuauaguuugcccaccggacaguggguuggcgugcaacucccuagaaauacuacaucauacguccucagagggcuggaaccuggucaggaauacaauguucugcucacugcugaaaagggccggcauaaguccaaacccgcuagagugaaggcuucuacagaagcugagcccgaaguugauaaccuccucgugucugacgccaccccggauggcuuucgccugucauggaccgcagaugaaggcgucuuugauaauuucguucugaagauucgugauacuaagaagcaaucagaaccucuggagaucacccucuuagcacccgaacggacccgagacauuacuggccuuagggaggcaacugaguaugaaauagagcuauacgggauaucuaaaggucgacggucacagacggucuccgccaucgcuacgacugcaauggguagccccaaggagguuaucuucagugacaucacagaaaauucagcuacgguguccuggcgggcccccacugcccaaguugagucauuccgcauaaccuacguccccauuacagggggcacaccgaguauggucacuguugacggcacuaaaacccagacccgccucgugaaauuaaucccuggcguggaguaccugguuuccaucauagcaaugaaaggguuugaagaaagcgaaccugugagugggucuuucacaacugcucuggaugggccauccggacuggucacugcuaacauuacagauuccgaagcccuggcuagguggcagccagccauugcgaccguggauagcuacguuaucaguuauacuggggaaaaggucccagagaucacaaggacaguuagugggaauaccgucgaauacgcacugaccgaccucgagcccgcaaccgaauacacccugagaaucuucgcugaaaaaggcccucagaaaucguccacaauaacugcuaaauuuacuacugaucuggauucuccacgcgaccugacugccaccgaaguucaaagugaaacggcccuacugaccuggagacccccaagggcaagcguuacaggauaccuccugguguacgaauccgucgauggcacugugaaggaggugaucguggggcccgacaccacaucuuacucucucgcagaucuaucuccaagcacucacuacacagcuaagauacaggcguuaaacggaccacuccguagcaacaugauacagacaaucuucacgaccaucggacuccuguaccccuuccccaaggauugcucccaggccaugcugaauggcgauacgaccagugggcuuuauaccauuuacuugaacggcgauaaagcagaggcucucgaaguauuuugcgacaugaccagugacggaggcggcuggauugucuuuuuacggaggaaaaauggaagagagaauuucuaucagaauuggaaagcuuacgccgcagguuuuggcgaucgacgcgaagaguuuuggcugggguuggacaaucugaauaaaauaacugcccaaggacaguacgaacuucggguggaccugcgagaccacggugaaacagcauuugcgguguaugacaaauuuucaguaggggacgcuaagacuagguacaagcucaaaguugagggauauucagggacagccggugacucaauggcuuaccauaauggaagguccuuuucaacauuugacaaagauacugauagugcgauuaccaauugugcacucucauacaagggcgccuuuugguacagaaacugccaucguguuaaucugaugggacguuauggugacaacaaucacagccaaggugucaauugguuucacuggaaaggucaugagcacaguauucaauucgcugaaaugaaguugagacccucaaacuuccgcaacuuagaaggccgccguaagcgcgcuuag

SEQ ID NO: 249151 - RNA, 6606 nt, Artificial Sequence
  Description of Artificial Sequence: Synthetic coding sequence
augggcgccaugacccagcugcuggcaggcguauuuuuggccuuccuggcucucgcuacugaaggcgggguccucaaaaaaguuauuagacauaaaagacaauccggagucaaugcaacccucccagaggaaaaucagccugucguguuuaaucacguguacaauauuaaauugcccgugggaagucaaugcucugucgauuuggagucggccuccggcgagaaagaucucgcucccccuuccgagccgagcgaauccuuucaagaacacaccgucgacggcgagaaucagauuguauucacacaccgcaucaacauuccacguagagccugcgguugugccgccgcgccagauguuaaagagcuccuuagucgauuggaagaauuagaaaauuuggucuccucacugcgcgagcaauguacugccggagccggaugcugcuugcaaccugccacagggagguuagacaccaggcccuuuugcucuggacgaggaaauuucagcaccgagggcuguggaugcgucugugaacccggauggaaaggcccgaacuguagcgagcccgaaugcccugguaauugccaucugagaggucgauguaucgaugggcagugcaucugcgacgacggcuucacgggggaggauuguucacaauuagcauguccaucugacuguaacgaccagggaaaaugugugaauggagugugcauuugcuuugaaggcuacgccggcgcugacuguagcagggagauaugcccggugccuugcagugaagaacauggaacuugcguugaugggcuuugcgucugucacgaugguuuugcuggcgaugacuguaauaagccccuguguuugaacaauuguuauaauagagggcgauguguugaaaaugaguguguuugcgaugagggauucaccggggaggauugcucugaacucaucuguccuaacgacugcuucgacagaggacgaugcaucaacggaacauguuacugcgaggaaggguucacuggggaggauugcggaaaaccaaccugcccacaugccugucauacccagggcagaugcgaagaaggacagugcgugugugacgagggcuuugccggaguggauuguagugaaaagaggugcccagcugauugucacaaccgagguaggugcguagauggccgaugcgaaugugaugaugguuucacuggagcagauuguggagagcuaaaaugcccuaauggaugcaguggacacggcagaugcguaaaugggcagugugugugugaugagggcuacacaggggaagacuguagccaacugagaugcccuaaugauugucauucgcggggacggugcguugaggggaaaugcguuugcgagcaggguuucaaaggguaugacuguagcgacaugagcuguccaaacgauugccaucaacauggacgcugcguuaauggcaugugugugugcgacgacggcuauaccggggaagacugucgagaucgccagugucccagagacugcucuaacagaggacuguguguugauggccagugcgugugcgaggacggguuuacaggcccagauugugccgaacugaguugccccaaugauugccaugggcagggccgaugugugaacgggcagugugugugucacgaggguuuuauggggaaggacuguaaagagcaaagaugcccaucagacugccauggacaggggagaugcguagauggacaguguauuugccacgaaggcuuuacuggucuugacuguggacagcacucuuguccuucugacuguaacaacuuaggucagugcguaucugggagauguaucugcaacgaagguuauagcggggaggauuguuccgaggucucaccuccuaaggaucucguugugaccgaagugacggaggagacagugaauuuggcaugggacaacgaaaugcgagugacggaauaccuuguaguauacacaccaacacaugaaggcggccucgaaaugcaauuucgcgugccaggggaccagacuagcaccauuauccaggaguuagaacccggcgucgaguauuucauaagaguauuugcgauucuugaaaacaagaagagcauuccugugagcgcuagaguggccaccuauuuaccugcucccgaaggacuuaaauuuaaaagcaucaaagagacaucugucgaaguggagugggauccccuggacaucgcauucgagaccugggagauuaucuuucgcaauaugaauaaggaagacgaaggggagauaacaaagucccugcguagacccgaaaccucuuauagacaaacuggucuugcgccaggacaggaguacgagaucucuuuacauauuguuaaaaacaacacacgcgggcccgggcugaagagagugacaacuacacgacucgacgcgccuagccagauugagguuaaagaugugaccgauacuacagcccucaucaccugguucaagccacucgcagagauugacgggaucgaacugacuuacggcauuaaagacgugccuggcgaccgcacaacuauugaccugacugaggacgagaaccaauauagcauuggcaaucucaaaccugauaccgaguacgaggugagccugauuagccggcgaggagauaugucaucaaaucccgcaaaggagaccuuuaccacaggacucgacgccccacgcaaccuuaggcgagugucccagaccgauaacuccaucacucuugaguggcggaauggcaaagccgcaaucgauagcuacaggaucaaauaugcccccaucucuggaggcgaucacgcagagguugauguuccaaagucacagcaggccacaacgaagacaacacuuacgggacuuagaccgggcacagaauauggaauaggaguuucugccgugaaagaagauaaagaguccaacccagcaacuauuaaugcagcgaccgaacucgacacaccaaaggaucuacaggugucugaaaccgcagagacgagucucacucuguuauggaaaacuccuuuggccaaguucgauagguaucggcugaacuauagucuaccaacuggacaaugggucggaguucagcucccgcggaacaccacuucauacguucuaaggggucucgagccaggucaagaauauaacgugcuccugacagcugagaaagguagacauaaguccaagcccgcacgcgugaaagcuuccacggaacaggcaccagaauuagagaauuuaaccguuacagaaguugggugggauggcuuaagacugaacuggaccgcugccgaccaggccuaugaacacuucaucauucaaguucaggaggcuaauaaggucgaagcugcacgcaaccucacugugcccgggucacugagggcugucgauauuccgggauuaaaagcugcuacccccuacaccguuucaaucuauggcguuauacaggguuacaggacuccaguguugagugcagaagcuaguacaggggagacuccuaauuuaggggaaguggucguggcugaagugggcugggacgcacugaagcuuaauuggacagcacccgagggggcguacgaguauuuuuuuauccagguucaagaagcugacacaguggaagcugcgcaaaauuugaccgugccaggcggacuccguucuacugacuuaccgggacugaaggcugccacacacuacacaauuaccauuaggggcgugacacaggacuucucuacuacaccucucaguguggaaguguugacagaagaagucccagacauggguaauuugaccguuaccgaggugagcugggaugcccugagauuaaacuggacuaccccggacggaaccuacgaucaauuuacaauccaagugcaggaggcggaucagguugaagaagcacacaaucuaaccguucccggcucccuuagaaguauggagaucccaggccugcgcgcggguacacccuacaccguaacacugcacggggaaguacguggccauuccacaagaccgcuggccguugaagucgugacagaggaucuuccucaauugggugaccucgccguguccgaagugggaugggacggucugaggcucaacuggacagcagccgauaacgcuuacgagcauuuugugauccaaguacaggaagugaacaaggucgaggcugcccagaacuugacacuucccgggucacuucgugccgucgacaucccuggguuggaagccgccacuccuuauagagugucuauuuacgguguuauaagggguuauagaacaccgguccugagcgcagaagcgagcacagccaaggaaccagagauuggaaauuuaaacgugagugacauuaccccagagucuuuuaauuuaagcuggauggccacagauggcauauuugagacuuucacaaucgagaucauugauucaaauagacuucuugagacgguggaguauaacaucagcggcgcugaacguaccgcacacauaucugggcugcccccaaguacagauuucaucgucuaucuuuccggccucgcucccagcauucggaccaagaccauaucagcuacugcuaccacggaggcucugccauugcuugagaaccuaacaauuagcgacauaaauccuuacggauucacgguauccuggauggcuagugagaacgcauucgacucguuuuuagugacugucgucgacucuggaaagcugcuugauccucaagaauuuacucuauccggaacccaacguaagcucgagcuccgaggucucaucaccggcauuggauacgaaguaaugguuagcggauuuacucagggccaucagacaaaaccauuaagagccgagauugugaccgaggccgaaccugaaguggacaaccugcuggugucugacgccacccccgacggauucaggcugagcuggacugcugacgagggagucuucgauaauuucgugcuuaagauccgcgacaccaagaagcaaagcgagcccuuggagaucacgcuccuggcaccagaaaggacucgagacaucacaggauuacgggaagcaacugaauaugaaaucgaacucuacgggaucucgaaaggacgaagaucacagacaguaagugcaauugcuacgacagcaaugggaagcccuaaggagguuaucuucuccgacauuacagagaauuccgcuaccgugagcuggcgugcuccuaccgcucaaguagaaaguuuucgcaucacauacgucccaauuaccggagguacucccucaaugguaacggucgacggcacaaagacccagacccgccugguaaaauugauccccggaguagaguaccuugugaguauuauagccaugaaaggauucgaagagagcgaaccuguuucaggaagcuucacaaccgcccucgacggucccagcgggcucguaacagccaacauuacagauagugaagcucuugcucgauggcagccggcaauugcuacaguggauaguuacguuaucagcuauaccggagagaagguaccugagauuacacguacaguaagcggcaauacaguagaauaugcacuaacagaucuggaaccugccacagaauacacucucaggauuuucgccgaaaaagguccccaaaaaucaucuacuauaacugcaaaauuuacuacggaccucgacucaccuagagaccugacagccacggagguccagagugaaaccgcgcugcugacuuggaggcccccucgcgccucaguuacuggauauuuacucguguacgaguccguggauggaaccgucaaggaagucauugugggcccagauacaacaucuuacucucucgcugauuuaucgccaagcacccacuacaccgccaagauucaagcgcuuaauggcccucuaagguccaauaugauccagaccaucuucacaacuaucgggcuucuguacccguuucccaaagacugcagucaagccaugcucaauggcgacacaacuuccggccuauauaccaucuacuugaacggugacaaagcagaggcucucgagguguuuugugacaugaccagcgauggggggggauggauagucuuucuaaggaggaaaaauggcagggagaauuucuaccagaauuggaaggcauaugcggcuggguuuggugacagacgggaggaauucuggcuugggcuugacaauuugaacaaaaucaccgcccagggacaguacgaacugaggguggaccugagggaucauggugagaccgcauuugcuguuuaugauaaguuuagugugggagaugcaaagacccgguauaaauugaagguugagggcuauagcggaacugcuggggauuccauggccuaucauaaugggagaucuuucagcacauuugauaaagacaccgacagcgcuauuaccaacugugcgcugagcuacaagggcgcuuuuugguaccgcaauugccaccgcgugaaccucaugggcagguacggcgacaauaaucacucucagggcgugaacugguuucacuggaagggucaugaacauagcauucaguucgcggagaugaaacugagaccuagcaauuucaggaaccuggagggacgacggaagagagcuuag

SEQ ID NO: 249152 - RNA, 3240 nt, Artificial Sequence
  Description of Artificial Sequence: Synthetic coding sequence
augggugccaugacacagcuacuugccgguguauuccuagcuuuuuuggcccuggcaacagaagggggcguucucaagaagguuauuagacacaaaagacagaguggcgugaaugcuacgcuacccgaagaaaaccaaccagucguguucaaccacguuuauaacaucaagcuucccguuggcagucagugcuccguagaucuugaaagugccaguggugagaaagacuuggcuccaccaagugaaccuagcgagucauuccaagagcauacgguugauggugagaaucaaauuguguucacacauagaaucaauauuccgcgccgcgcuugcgggugcgccgccgccccagauguuaaggaacugcugucucgucucgaggaacuggagaaucugguaucaagucuccgcgaacaguguacagcuggcgccgggugcugccugcagcccgcaacagggcgccuggacacgcgacccuuuugcagcggaagagggaauuuuucgacggaaggcuguggaugcguaugcgaaccaggcuggaaaggacccaauugcucagagccagaaugcccaggcaacugucaccuaagaggaaggugcauagauggccagugcauuugcgacgauggauucaccggcgaagacuguucucagcuggccugcccaucugauuguaaugaucaggguaaaugugucaacggugucugcauuuguuuugaaggguacgcuggggcugacugcucaagggaaauuuguccugugccauguucagaagaacacgggacuugcguggauggguuaugcgugugucaugaugguuucgcaggggaugauugcaacaaaccacugugccugaauaauuguuauaauagaggcagauguguggaaaacgaguguguaugugaugagggauuuacuggggaagacugcucugagcugaucuguccaaacgacuguuuugaucgcggacgguguaucaaugguacauguuacugugaggaaggcuuuacaggggaagacugcgguaaaccaacaugcccccaugcuugucacacccaaggacguugugaagaagggcaguguguuugugacgaaggauucgcuggcguggauugcucugaaaaaaggugcccugcugauugccauaaccgcggaagaugugucgacgguaggugugaaugcgacgacggauuuacuggagcagauugcggugaauugaaauguccaaacgguugcagugggcaugggagaugugugaauggacagugcgugugugacgaagguuauacgggggaagauugcucacagcuaagguguccuaaugauugccauucuaggggccgaugcgucgaggguaagugugugugcgagcagggcuucaagggcuacgacugcucagacaugucaugucccaaugauugccaccagcacggucguugcgugaauggaaugugugugugugaugauggcuacaccggggaagacugccgcgaccgucaguguccgcgugauuguucaaaccgcgguuuauguguugaugggcagugcgugugugaggacggcuuuacgggccccgacugcgcggagcugucaugccccaaugacugccacggccaggggagguguguuaacggucagugugugugucacgagggauuuaugggaaaggacuguaaggagcagagaugcccauccgauugccacggccaggggagaugcguggauggacagugcauuugucacgaaggauucaccgguuuggauugcggccaacauaguugccccucugacugcaauaaccugggacaguguguuagcgggcgauguauuuguaaugagggauacucuggugaggacugcagcgagguuaguccaccuaaagaccuuguggugacugaagugacagaagaaacugugaaucuggcaugggauaaugagaugagggugacugaguacuugguggucuauacuccgacacaugaggguggucucgaaaugcaauuccgaguuccgggugaucaaaccaguacuauuauccaggaguuggagccagguguggaauacuuuaucagaguuuuugccauccuggaaaacaagaaauccauuccagucagugcucgcgucgccacuuaccugccugcaccugagggauuaaaguucaaaucuaucaaagagacauccgucgagguagaaugggauccgcuugacauagcuuucgaaaccugggaaaucaucuucagaaacaugaacaaagaggacgaaggagagaucacaaagucacugagacgccccgaaacgucauaucgacagacugggcuugcaccagggcaggaguacgaaauuagccugcauauuguuaagaacaacacccguggcccugggcugaaaagaguuacaaccacgagacuggaugcucccucccagauugaagugaaggauguaacugauacaaccgcacucaucaccugguuuaagccacucgcugagauugauggcauagaacuuacauacggcauuaaggacguacccggcgacagaacuacgauugaucugacugaagacgaaaaccaguacucuaucggaaaccuuaagccugacaccgaauacgaagucucccuaaucucuagaagaggugacauguccucgaacccugcaaaggaaaccuuuaccacuggacuagacgcaccucggaaucugcgccgggucucacaaaccgacaauagcaucacauuggaguggaggaauggaaaagccgccauagauagcuaccgcauuaaauacgcaccuaucucaggcggagaucaugcugaaguugaugucccaaagucgcagcaggcuacaacuaaaacaauuacugcuaaauucaccaccgaucuugacaguccacgggacuugaccgcgaccgagguccagagcgaaaccgcccuucucacguggcgccccccucgagcaucgguuaccggguaccuauuggucuaugaaaguguagacggaaccgucaaagaagugauagugggccccgauaccacgagcuacucccuugcugaccugagcccccccucucucuuccuucacuuuauucaacagaagccagagaagcaguauuguuuccauuuuaaggauaugaucaauauaauuaacauuauuaugaugaugaugaugaugaaaacuaaggauuucucucgcgaccugucuuuccaaaacaucuccggccaguaccugaucgucuuuuuuuucuag

SEQ ID NO: 249153 - RNA, 279 nt, Artificial Sequence; identical to SEQ ID NO: 248547
  Description of Artificial Sequence: Synthetic coding sequence

SEQ ID NO: 249154 - RNA, 5241 nt, Artificial Sequence
  Description of Artificial Sequence: Synthetic coding sequence
augggcgcuaugacgcaguuguuggccgguguauuuuuagcauuccuagcccuggccaccgagggcggcgucuuaaaaaagguaauaaggcauaagcgacaaucagggguuaaugcaacucucccugaggagaaucagccagucguguucaaccauguuuauaauaucaaauugccuguagggucucagugcagcguggaccuggaguccgcaucaggggagaaagaucucgccccaccauccgagccuuccgaaagcuuccaggagcauacaguggacggggaaaaucaaauaguuuuuacacaucggauuaacauaccacgacgagccugugguugugcggcugcuccagaugugaaggaauuguugagucgucuggaggagcucgaaaauuuaguguccagcuuaagagaacaaugcaccgcuggugcgggcugcugccuucaaccugcaacagggcgccucgauacccgucccuuuuguucaggcaggggcaacuuuaguacagaggggugcgguuguguaugcgaaccuggauggaagggccccaauugcuccgaacccgaguguccagggaacugccaccuccgcggaagguguauagauggacaguguauuugcgacgacggcuuuacgggcgaagacuguucccaauuagccugcccuuccgacuguaaugaucaggggaaaugugucaacggaguauguaucugcuucgaaggguacgcuggugcagauuguucccgagaaauaugcccuguaccuuguucagaggaacaugggaccuguguggauggcuuauguguuugccaugacggguucgcgggcgacgauugcaacaagccccuaugcuuaaauaacugcuacaaucggggucgguguguggaaaacgagugugugugcgacgaagguuuuacaggcgaggauuguagugaacucaucuguccuaacgauuguuucgauagagggagguguauuaauggcacuugcuauugugaggagggguuuacaggcgaggauugcggaaagccuacaugcccucaugcuugucauacccagggccggugugaagagggccagugcgugugugacgaaggguuugcuggaguggauuguucagagaagcgauguccugcagauugucauaauagagggaggugcguagauggaagaugcgagugcgaugacggauuuacaggggcggauugcggagaguuaaagugcccaaauggaugcagcggccauggaaggugcguuaauggccaaugugugugugacgaaggcuacaccggggaagauugcucccagcugagauguccaaacgacugucacucccgaggccggugcguagagggaaagugugugugcgaacagggcuuuaaagguuacgacugcagcgauaugaguugcccuaacgauugucaucaacacgguagguguguuaacgggaugugcgugugugaugacggauacaccggggaagauugcagagauaggcaaugccccagggauuguuccaauagaggccugugcguggacggccaauguguuugcgaggacgguuuuacaggucccgacugcgcugaacugaguugucccaacgacugucacggacagggcagaugugugaacggccaaugcgugugucaugagggauuuaugggaaaagacuguaaagaacagagauguccuagcgauugccaugggcaggggcguugcguagacggacaaugcaucugucaugaagguuuuaccggccuggacugcggacaacauucaugcccuucugauuguaauaaccugggucaaugcgugaguggaagguguauuugcaaugaagguuauucaggagaggauuguucugaagugaguccacccaaggaccuggucguaacugaggugacggaggagacagucaauuuagcgugggauaaugagaugcgagugacagaauaucugguuguguauaccccgacccacgaaggcggccuugagaugcaguuucgagucccaggugaucaaacuucuacuauaauucaggaacuggaacccggcgucgaauacuucauuagagucuucgcuauuuuagaaaacaagaagucaaucccagucucagccagggucgcgacauaucugcccgcuccugaagggcucaaauuuaaaucaauuaaggagacuaguguagaaguagagugggauccucuggauauugcauucgaaacuugggagauaauuuuuaggaacaugaacaaggaggacgagggagagauuacaaaaaguuuacggcgaccagagacaaguuacagacaaacagggcuugcgcccggucaggaguacgagaucagccuccacauugugaaaaacaauaccaggggcccaggacuaaagagggugacaaccaccaggcucgaugcacccucucagaucgaaguuaaagaugugacugacaccacugcucugauuacuugguucaagccucucgcugagauagacggaauugaauugaccuacgggauuaaagacgucccaggugacaggaccacuaucgauuuaaccgaagaugaaaaccaguacuccaucggcaaccugaaaccugacaccgaguacgaagugagucucaucucaagacggggagacauguccuccaauccugcgaaagagacauuuaccaccggccuagaugcuccuagaaaucuacggaggguaucucagacugacaauucuaucacacucgaguggaggaacggcaaggcggcgaucgauaguuaccggaucaaauaugcuccaauuucuggaggagaccacgcugaaguggauguaccaaagucccaacaggccaccaccaaaacaacucugacagguuuacggccggguacagaauacgguaucggagugagugcaguaaaagaagauaaagaaagcaaccccgcuacaaucaaugcagcgacagaacuggauaccccuaaggaccugcaggucucugaaaccgcagaaacaagcuugacacugcuguggaaaaccccucuggccaaguuugaucgcuaccgccugaacuacucccucccuacugggcagugggugggugugcaacucccuagaaauaccaccaguuacguccucagaggucuggaaccgggacaggaauauaaugugcugcuuacugcagagaaaggcagacauaaaaguaaaccugcaagaguuaaagccuccacagcuaaagaaccagaaauugguaaucuuaacguuucugacaucaccccagaaaguuucaaccuuagcuggauggcuaccgaugggaucuucgaaacauucaccaucgagaucaucgauuccaauagacuucuagagacugucgaauacaacaucuccggagcagagcgaacugcccacaucucuggccucccaccaagcaccgauuucauaguguaccucucaggguuggcaccuuccauccgcaccaaaacuaucuccgcgaccgcaaccacugaagccgaacccgagguggauaaccuccuggugagcgaugcaacgccggacggauuuagacugagcuggacagccgaugaaggaguuuucgacaauuucgugcuaaagauucgcgacacaaaaaagcagagcgagccacucgaaaucacucuucuggcuccagaacgcacuagagauauuacaggacuccgggaggccacagaguaugagaucgaacuauacggaauuucaaagggucgaaggucacagacuguuagugcuaucgcaacuacagcaauggggucgccuaaggagguuaucuuuucugauaucacugagaauuccgccacugugucauggagagcccccacagcgcagguugaaucauuuaggauuacuuacgugccuauaaccggugguacccccucuauggugaccguugaugggacaaagacucaaacccgacucgugaaacugaucccuggaguagaguauuugguguccauaaucgccaugaaagguuuugaggaaagugagccagucuccgggucuuucacuaccgcucuggauggcccuuccggccuggugacagcaaauaucaccgauagcgaggcacuggcaagauggcaaccagcgauugccacaguugacucuuacgugaucucuuacacuggagagaaaguaccagagauuacacggaccgugucaggaaacacaguggaauaugcacuaacugaccucgaaccagccacagaauacacccugcgcauauucgccgaaaagggaccucagaaaucgaguacgauaacagcuaaguuuacuacagauuuggauucuccucgagaucuuacugccacagagguucagucagagacagcucuccugaccuggagaccaccuagagcuagcguuacugguuaccuguuaguguaugaguccguagacggcaccgugaaagaaguaaucguuggacccgauacaaccucuuacuccuuggccgauuugucacccucgacacauuauacagcuaaaauacaggcuuugaauggaccgcuaagaucuaauaugauacagaccauauucacuacuauuggcuuacuguacccauuuccuaaagauugcucucaggccaugcugaacggcgauaccaccuccggcuuguauacaauuuacuugaacggcgauaaagcagaagcucucgaaguguucugcgauaugaccuccgaugguggcggguggauaguuuuccugcgucggaaaaauggucgugagaacuuuuaucagaacuggaaagcauaugcagcaggauuuggggaccgaagggaggaauuuuggcugggacuggauaaucucaauaaaauuaccgcccagggacaauacgagcugagagucgaucugcgcgaccauggagagaccgccuucgccguguacgacaaauuuucuguaggcgacgccaaaacccgauacaagcucaaaguggaaggcuacuccggaacugcuggugacaguauggccuaccacaauggaagaucuuucaguacuuucgacaaagauacggauucugcaaucacaaacugcgcacucucguauaaaggggccuuuugguacaggaacugccacagaguaaaccugauggggagauauggagauaacaaccacagucagggcguaaacugguuucacuggaaaggucacgagcauuccauacaguuugcugaaaugaaacugaggcccaguaauuuuaggaaccuagaggggaggagaaagagagccuag

SEQ ID NO: 249155 - RNA, 5517 nt, Artificial Sequence
  Description of Artificial Sequence: Synthetic coding sequence
augggagccaugacucaacugcuggcggggguguuccuagcuuuuuuagcuuuagcaaccgaggggggaguacuaaaaaaagucauucgccauaagagacagagcggagucaacgcuacacuucccgaggagaaccagcccguuguguucaaucauguguacaacauuaaguugcccguuggaagccaguguucaguagaccuggaaagcgccucuggagagaaagaucuggccccucccagcgagccgagcgaaucauuccaagagcauaccguggauggcgagaaccagaucgucuucacucaccguauaaacauuccaaggagagccugugggugcgccgccgcucccgaugugaaagaauuacuuucccgccuggaggagcuggaaaauuuagugagcagccugcgagagcaauguacggcaggggcugggugcugccuacaaccugcaacgggccggcuagauacuagacccuuuuguagcggacggggcaacuuuagcacagaaggcugugggugugucugcgagccaggguggaaggggccaaacugcagcgagccugagugucccggaaacugccaucuccgcggacgaugcauugacggccagugcauuugcgacgacggauucaccggggaagauuguagccaguuggcguguccauccgauuguaaugaccaggggaaguguguuaacggcgucuguauuuguuuugagggauaugcuggggccgauugcuccagagagaucuguccaguaccaugcuccgaagaacauggaaccugugucgaugggcuaugcgucugccacgaugguuuugcuggagaugauugcaauaagccacucugcuugaauaauuguuacaauaggggaaggugcguggaaaaugaaugcgucugugacgagggcuuuacuggugaggacugcuccgaacugaucuguccaaaugacuguuuugaccgcggacggugcaucaaugguacauguuacugcgaagaaggauuuaccggcgaggauuguggaaaaccuacaugcccacacgcuugccauacucagggaagaugugaggagggucagugcgucugugaugaaggauuugcaggagucgauuguuccgagaaaaggugucccgcagauugucauaaccgagggagaugcguugacgggagaugcgagugugaugauggauuuacaggugcggauuguggcgagcuaaaaugccccaauggcuguaguggacauggcagaugugugaauggucaaugugugugcgacgaaggauacaccggggaggacuguucucagcugcgaugcccaaaugacugucacucgagggguaggugcgucgaggggaaaugcgugugcgaacaaggauuuaagggauacgauuguucagauauguccugcccuaaugacugccaccaacaugggagauguguuaaugggaugugcgugugugaugacggcuauacuggugaggauugucgagaccgccagugccccagagauugcucuaauagagggcuguguguugaugggcaaugcguaugcgaagauggcuuuacaggacccgacugcgcugaacucucauguccuaacgacugccacgggcagggaagaugugugaacggucaaugugugugccaugagggcuucaugggcaaggauuguaaagaacagagauguccuucagauugccauggccagggccgaugcguggauggccaauguaucugucaugagggguuuaccgggcucgauugcggccagcacagcugccccagcgacuguaauaaucucggccagugcgucuccggacgguguauuugcaaugagggauauucuggcgaagauuguucugagguuagcccucccaaagaucuggugguaaccgagguaacagaagagaccgucaacuuagccugggacaacgaaaugcgagucacugaauaucuaguaguauacaccccuacucacgagggcggacucgagaugcaauuuagggugccgggggaucagacgucuaccauaauccaggaacuggaaccaggcgucgaguauuucauuagaguguuugccauccucgaaaacaaaaagucuaucccugucucagcacgagucgcaaccuauuuacccgcccccgagggauuaaaauuuaaauccauaaaagaaacuagcguggaggucgagugggauccgcuggacaucgcauuugagacaugggagauuaucuuccgaaauaugaacaaagaagacgaaggugagaucacaaagagucuccgcaggccugagaccuccuaccggcaaacuggccucgcaccaggacaggaguaugaaaucucucugcacauugucaagaacaacaccagaggacccgggcugaagagaguaaccacuaccagacuagaugcacccucucagaucgaagugaaggaugugacugauacuaccgccuuaauaacuugguuuaagccccuggcugagauugaugggauagaauuaaccuauggcauuaaagaugugcccggugacagaacaacaauugacuuaaccgaagaugagaaccaguauagcauugguaaccugaaaccugacaccgaauaugaagugagccugaucucccgccgaggggacaugaguagcaacccagcaaaggagacuuuuacuaccggccucgacgccccuagaaaccucaggcgggugucucagacagacaauucgaucacucucgaauggcggaacggcaaggcugcaauugauagcuauagaaucaaguaugcaccuaucuccgguggagaucaugcagagguagacguccccaaaagucagcaagcaacgacgaagaccacgcucaccggccucagaccuggaaccgaauacggcauuggcguaucagcuguuaaggaagauaaagagagcaauccugccacuauuaacgcugccaccgaauuggauaccccuaaggauuugcagguaagugaaacagcagaaacuucacucacacuccuauggaagacgccacuggccaaguuugaucgauaucgccuuaacuauucauuacccaccgggcagugggucgguguucaacuccccagaaacacuacuucauauguucugagaggucuggagccaggacaagaauacaauguacuucugacagccgagaaagggaggcauaaauccaaaccugccagagucaaagccaguacugccaaagagcccgagauaggcaaucugaauguuagcgacauaacaccggagucauucaaucuuuccuggauggcaaccgauggaaucuucgaaacauuuacuaucgaaaucauagacuccaauagauuauuagaaaccguugaauacaauaucaguggggcugaacggacugcacacauuuccgguuugccacccuccacagacuuuauuguauaccucucuggacuggcuccaaguauccguacuaagacaauuucagcuaccgccacuaccgagccuaaaccucaacuggguacucuaaucuucagcaauaucacgcccaaaucuuuuaauauguccuggaccacacaggcaggccucuuugcuaaaauuguuaucaacgugagcgacgcacauuccuuacaugagucucagcaguuuaccgugagcggcgacgccaaacaggcacacaucaccgggcugguggagaauacaggcuacgacgugucugucgcuggaacaacucucgcuggggaucccacucgaccccugacugccuuuguuaucaccgaagccgaaccugaaguggauaaccuucucgucucugacgcuacccccgauggauuccgccuaaguuggacagccgacgaaggaguguucgacaauuucguucuaaaaauccgcgauacaaaaaaacagucagagccauuggagauuacgcuucuggcacccgaacgcacucgagauauuacaggacucagagaagcgacagaauacgaaaucgaauuguaugguaucagcaaaggccgcaggucucaaacggugucugccauagcgaccacagcgaugggaucuccuaaggaaguaaucuucucugacaucacagaaaauucagcuacaguaucguggcgugcucccacugcacagguggagucauuucgaauuacuuaugucccuauuacgggaggcacucccaguauggugaccguugacggaaccaagacccagaccagacucgugaagcucauuccuggcgucgaguaccuagugucuauuaucgcaaugaaagguuucgaagagagcgaacccguuuccggguccuucacaacugcuuuggauggaccaucaggccucgugaccgccaauauuaccgacucugaagcauuggcccgcuggcagccagcgauugcuaccgucgauagcuauguuaucucuuacacaggcgaaaagguccccgaaauuacaagaaccguuagcggcaacaccguugaguacgcccuaacggauuuagagcccgccacugaauauacacuucguauuuuugcugaaaagggcccgcagaaaucaaguacaauaacagcaaaauucacuacagaccuugacucuccaagagaucucacugccacagagguccaaagcgaaacugcauuacucacauggagaccaccuagagcuagcgugacaggauaccucuugguguacgagucugucgacggcaccguuaaagaaguuauuguggggccugauacaacaucuuauucccuggcagauuugucuccaaguacacauuauaccgcaaaaauucaagcucuuaacggcccacucagaagcaauaugauucagacaauuuuuaccacaauaggccuucuuuauccuuuuccuaaagacugcagccaggcgaugcugaacggagauacaacgagcgggcucuacacuaucuauuuaaacggagacaaagccgaagcccucgaggucuuuugcgacaugacaagugauggcggcgguuggauuguguucuugagaagaaaaaauggccgggagaauuucuaccaaaacuggaaagccuaugcagcgggguuuggugaucggcgggaagaguucuggcuuggacuagauaauuuaaauaagaucaccgcucaaggccaauaugaacuccguguggaucuccgggaucauggcgaaaccgcuuuugcagucuacgauaaauucagcgucggagacgcuaaaacuagauauaaacuuaagguagagggguacaguggaaccgcgggggauucuauggcauaucacaacggacgaucauuuucaacguucgacaaggauacagacucagcgauuacaaacugcgcucuaucuuauaaaggcgcuuucugguaucgcaacugccaucggguuaaucugaugggacgcuacggagauaauaaccauucacagggcguaaauugguuccauuggaaaggacacgagcacucaauccaauucgcagaaaugaaauugaggccaucaaauuuuaggaacuuagagggccggagaaaaagggcguag

SEQ ID NO: 249156 - RNA, 720 nt, Artificial Sequence
  Description of Artificial Sequence: Synthetic coding sequence
auggcuaggggaugccugugcugccuaaaguacaugauguuccuauucaaccucauuuucuggcucugcggaugugguuuacugggcgugggcaucuggcuaucagugucucaagggaacuuugccacuuucucuccaucauuuccaucauuaagcgcugcaaacuuagucauugccauaggaacuaucgucauggugacuggauuucugggcugucucggugcuauuaaggagaauaaaugucuucuucuuucauucuucauuguucuguuggugauccugcucgcagaguuaaucuuauugauucuuuucuucguguacauggauaaagucaaugaaaaugcuaaaaaggaucuuaaagagggccugcuccuguaucacacugaaaauaauguaggguugaaaaaugcauggaauauuauucaggccgagaugcgcuguuguggggugacagauuauacagacugguauccaguuuugggagagaauaccgugcccgauagaugcuguauggaaaacucgcagggaugcgggaggaacgcuaccacuccucuuuggagaacaggcuguuacgagaaaguaaaaaugugguuugacgacaauaaacauguucuugggaccguuggaauguguauccucauuaugcaaauccucggcauggccuucucuaugacucuguuccaacacauccaucgcacuggcaaaaaauacgaugcuuag

SEQ ID NO: 249157 - RNA, 720 nt, Artificial Sequence
  Description of Artificial Sequence: Synthetic coding sequence
augccgaaaaguugcgccgcccggcagugcugcaaccguuauaguucaagaagaaaacagcugaccuuccaccgguuuccuuuuuccagacccgaacuccugaaagaguggguguugaauauuggaagagggaacuucaaaccgaaacaacauacagugaucuguucagagcauuuccgacccgaguguuucucugccuuuggaaaccgaaagaaccuuaaacacaacgcagugcccacagucuucgcauuccaggacccuacacaacagguacgcgaaaauacggacccagcuagugagcgcggaaacgccucaaguucacagaaagagaaggugcucccugaagcaggcgccggagaggauagcccuggacgaaacauggauaccgcacucgaggaacuacagcucccaccaaaugcagaaggucacguuaagcaggucuccccccgcagaccacaggcgaccgaggcugucggcagaccaacugggccagccggccuuaggcgaaccccuaacaaacagccaucagaccauagcuacgcccuccucgacuuagauucgcugaaaaaaaagcuuuuucuuacucucaaggagaaugaaaaacuuagaaagcgacugcaggcucagcgacucguuaugagaagaaugucuucccgguugcgugcauguaagggacaccagggacuacaggcucgccugggaccggaacagcaaaguuag

SEQ ID NO: 249158 - RNA, 135 nt, Artificial Sequence; identical to SEQ ID NO: 248552
  Description of Artificial Sequence: Synthetic coding sequence

SEQ ID NO: 249159 - RNA, 135 nt, Artificial Sequence; identical to SEQ ID NO: 248553
  Description of Artificial Sequence: Synthetic coding sequence

SEQ ID NO: 249160 - RNA, 135 nt, Artificial Sequence; identical to SEQ ID NO: 248554
  Description of Artificial Sequence: Synthetic coding sequence

SEQ ID NO: 249161 - RNA, 135 nt, Artificial Sequence; identical to SEQ ID NO: 248555
  Description of Artificial Sequence: Synthetic coding sequence

SEQ ID NO: 249162 - RNA, 3042 nt, Artificial Sequence
  Description of Artificial Sequence: Synthetic coding sequence
augggacucggcacucugucuccaagaaugcugguuuggcuuguggcuaguggcaucguuuuuuauggagagcucuggguuugcgccggacuugacuacgauuacacauucgaugggaacgaggaggacaagacagaaacgaucgauuauaaggaucccuguaaggcagccguguuuuggggcgacauugcucucgaugacgaggauuuaaauaucuuucaaauagauagaacuauugaucugacucagaaccccuucggaaaucugggacauacaaccggaggccugggugaucaugcgaugaguaagaagaggggggcuuuauaccaacuaauugauaggauccgcagaaucggguuugggcuugagcagaacaacaccgucaagggcaaagugccucugcaguuuagcggacaaaacgaaaaaaaccggguuccuagagcugcuacauccagaacagagcggauauggcccgguggagugauaccuuacgugauuggggggaauuuuaccggaagccagcgugcaauguuuaaacaagcuaugcgucacugggaaaaacauacgugcgugacauucauagaacggagugacgaagaauccuacaucguguuuacauauagaccaugcggauguuguaguuaugucgguaggaggggaaauggcccgcaggcaauaagcaucggaaaaaacugcgacaaguucgguaucgucguccacgagcugggacaugucaucggauuuuggcacgagcacacaaggccagaucgagauaaucacgucacaaucaucagagaaaauauccagccaggacaagaguacaauuucuugaaaauggagcccggagaagucaacucccugggcgagcgcuaugacuuugauuccaucaugcacuaugcgagaaauaccuucucacggggcauguuccuagacaccauucugccguccagagaugauaauggaauccgucccgccaucggacagcggacgagguugucaaaaggagacauugcucaagccagaaagcucuaccgauguccagcaugcggagaaacauugcaggaaucgaaugguaaucuaucuagccccggcuucccaaauggguacccgagcuacacgcauuguauauggcgcgucucuguaaccccaggcgagaaaauugugcugaauuucacuaccauggaccucuauaaauccagcuuguguugguaugauuauauugaagugcgagauggauauuggagaaagaguccacuuuugggacguuuuuguggggauaagcugccagagguccugaccagcacagacagccguauguggauugaauuucggagcaguucuaacugggugggcaaagguuucgccgcuguguacgaggcuauauguggcggagaaauuagaaagaacgaagggcagauucaaagucccaacuauccugacgacuauaggccuaugaaagaaugcguguggaaaauaacugugucagagaguuaccacgucggccugacuuuccaguccuuugaaauagagcgccacgacaauugugcuuacgauuaccuggaaguucgagauggcaccagcgaaaacagcccgcucaucggacgcuuuugcggguaugacaagcccgaagacauccgaucuacuucuaauacucucuggaugaaauucguuuccgacggaaccgugaauaaggccggauuugcagcaaacuuuuucaaagaggaagaugagugugccaaaccugacaggggugggugugaacaacguuguuugaauacucugggcuccuaccagugcgcgugugaacccggcuacgaacucggcccugaccgccgguccugugaagccgcauguggcgggcucuugacaaagcugaauggaaccauaacgaccccaggcuggccuaaagaauauccccccaacaagaauugugucuggcaggugguggccccaacccaguaucggaucaguguaaaguucgaauuuuuugagcuugaaggaaaugagguauguaaguaugauuacgucgaaauuugguccggcuuguccuccgagaguaagcugcacggaaaauucuguggcgccgaggugccugaagugauuaccucccaguuuaacaacaugaggaucgaauuuaaauccgauaacacagugucaaaaaaggguuucaaggcucacuuuuucagcgauaaagaugaaugcucuaaggauaacggagggugccagcaugaaugcgucaauacaauggguucuuacaugugccagugccgaaauggauuugugcuccaugacaauaaacaugacugcaaagaggcugagugcgaacagaagauccacucuccaucaggacugauuacgucuccaaacuggccagacaaauaccccaguagaaaagaguguacgugggagauuucagccacgccaggccaucgaaucaagcuggcguuuucugaguuugaaauugaacagcaccaagaaugcgcuuacgaccauuuagaaguguucgacggcgaaacagaaaaaaguccaauccucggccgccucuguggcaacaagauuccggauccucugguugcuaccggcaauaagauguuugugcgcuuuguauccgaugcuucugugcaaagaaagggcuuccaagccacacacuccacagaaugcggcgggcggcuuaaggcagagucaaaacccagagaccuguauucacacgcccaauucggagauaacaacuaccccggacagguggacugugagugguuacugguuagcgagagagguaguagacucgagcuuagcuuucagaccuucgaaguugaggaggaagccgauuguggcuacgacuacgucgaguuguuugaugggcucgauagcacggccgugggacuuggaagguuuuguggcaguggcccucccgaggaaaucuauucuauuggagacucaguccuuauccacuuucauacugacgacacuauuaauaagaaaggguuucacauaagauauaagagcauccguuaucccgauaccacacacaccaagaaguag

SEQ ID NO: 249163 - RNA, 1596 nt, Artificial Sequence
  Description of Artificial Sequence: Synthetic coding sequence
augaucuccccugacccacggccgagccccggauuagcacgcugggcugagucauacgaagcgaaaugcgaaagaaggcaagaaauccgagagaguaggagaugucgccccaacguuaccaccugccgccaaguggggaaaacgcugcggauccagcaaagagaacaguuacagagggccagguugcaacaguuuuuccgccgccgcaaucuugaacuugaagagaaagguaaggcccagcauccucaagcccgcgaacagggcccuucuaggcgccccggccaggugacagguaccuccagcgaagucuuuccugcucaacaucccccaccguccgguaucugcagggacuugucugaccaccucucuucccaggcuggaggacugccaccccaggauacacccauaaagaagcccccaaaacaucaccgcggcacgcagaccaaggcagagggccccacaaucaagaaugacgcaucgcagcaaacuaacuacggcguugccguucuugacaaggaaaucauucagcuuagcgauuacuugaaagaggcucugcagcgagaauugguacuaaaacagaaaauggucaucuuacaagaucuucuuaguacacuuauucaggcaagcgacaguaguuggaagggucagcucaacgaggacaagcuuaagggcaaacugcgcagccuagagaaucaacuguacacuuguacccagaaauacagcccuuggggcaugaaaaagguacuauuggagauggaggaucagaagaauucauacgagcagaaagccaaagagagcuugcagaagguacucgaggaaaagaugaacgccgaacagcaacuacagaguacgcagagaucucucgcccuggccgaacaaaaaugugaggaguggcggucucaguaugaagcuuugaaagaagauuggcgcaccuugggaacgcagcacagagaguuagagucacagcuccacgugcuccaaucuaaauugcagggcgccgacagccgggacuugcagaugaaucaagcccuuagguuucuggaaaacgagcaccagcaguuacaggcaaagauagaaugucuacagggggauagagaccucuguaguuuggauacccaagaccuccaggaucagcuaaagagaagugaagcagagaaguuaacuuuggugacaaggguucagcaguuacagggccugcuacagaaucaaucacugcagcuacaagaacaggaaaagcuucucaccaagaaagaccaggcauuaccuguguggucaccgaaaucguuucccaaugagguagaacccgaggguacagguaaagaaaaagauugggaccugagagaucaauugcagaagaaaacacugcaacugcaggcaaaggaaaaggaaugucgugagcugcacuccgaauuagauaaccugagugacgaguauuuaucaugcuuacgcaagcuccagcacugccgggaggaacuuaaccagagucaacaauugccaccuagaaggcagugcggaagauggcucccuguguuaaugguugugaucgcugcagcacuugccguauuucucgccaacaaagauaacuuaaugauuuag

SEQ ID NO: 249164 - RNA, 1359 nt, Artificial Sequence
  Description of Artificial Sequence: Synthetic coding sequence
auguccacuacuuuucccggauugguacacgaugcagagauaagacaugaugggucaaauucuuauaggcuaaugcagcucggcugccuugagagcguggccaacagcacaguugcuuacuccucgagcuccccucugaccuacuccacuaccggaacugaauucgccagcccauauuuuucaacuaaucaccaguacacaccgcuucaccaucagagcuuccacuacgaauuccagcacucccacccugcugucacgccagaugcauacucgcuaaacucccugcaccacagccagcaguauuaucaacagauccaucacggggaacccaccgacuuuauuaaucuccauaacgcuagggcucugaagucaaguugccucgacgagcagaggagagaacugggcugccuggaugccuaccgccgucaugaccugagccugaugagucacggcucacaauacgggaugcauccugaucaaagacuccuucccggaccuucucucggucuggccgcagcaggcgcugacgauuugcaaggaagcguggaagcccaaugcggacugguacugaauggccagggcggcgugauacgaagagggggaacaugcgucguuaaccccacagauuuauucuguuccgugccgggacggcugaguuuguugucaagcaccuccaaauauaaagugacuauugcagagguaaagcgccgccuaaguccuccagaguguuugaacgcaagucuacucggugggaucuugcgacgcgcuaaaucgaagaacggcggacguugccugcgcgagaaacuugaucgccugggacuuaaccuucccgcuggccgacgaaaagccgcuaaugugacccuccuaacuagccuggucgaaggagaagcucugcaucuggcucgagauuuuggauauacaugugagacugaguuuccagcuaaagcuguaggcgagcaccucgcucgucagcacauggaacaaaaagaacaaacggcccguaaaaaaaugauucuggcuaccaagcagauuuguaaagaguuucaggaucuauugagccaggacaggucaccccucggcagcuccagaccuacucccauucuugaucuagacauucagagacaccugacucacuucucucuuaucacacacggauucgguacucccgccaucugcgcagcgcuguccaccuuucagacugugcugucugaaaugcugaauuaccuagaaaagcacaccacacauaaaaacggaggagcagcagauucggggcaggggcaugcuaacucagaaaaggccccauugcguaaaacuucagaggccgcuguuaaggaagggaaaacagaaaaaacugauuag

SEQ ID NO: 249165 - RNA, 2244 nt, Artificial Sequence
  Description of Artificial Sequence: Synthetic coding sequence
auggcugaugaagcagcuuuggcgcuacaaccugguggaagccccuccgcugcuggcgcugaucgggaagcggcgucaagccccgccggagagccgcuuagaaagcgucccaggcgcgauggacccggacuggaaagaagcccaggagagccuggcggugccgcaccggagcgagaaguccccgcagccgcuaggggcugucccggagccgcugcugccgcgcucuggagggaggcugaggcagaggccgcugcugccgggggcgaacaagaagcacaggcaaccgcggcagccggggaaggcgauaacgggccaggguugcaagguccuucaagagaacccccacuggccgacaaccuguaugaugaagaugaugaugaugaaggggaagaagaggaggaggcagccgcugcggcuaucggauaucgcgacaaccuucuguuuggagacgaaauuauuaccaauggguuccacuccugcgaguccgaugaagaagacagagcaucacaugcuucuucauccgauuggaccccacgaccuaggaucggucccuacacauucguccagcaacacuuaaugauuggaaccgacccacggacaauccuuaaggaccugcugcccgagaccaucccgccaccugagcuagacgacaugacacuuuggcaaaucgugauaaauauucuguccgagccccccaagagaaagaagagaaaagauauuaauacaauugaagacgccgugaaacuacugcaagaauguaagaagaucaucguacugacaggugcuggggucagcguuagcugcggcaucccugauuuccgcagucgugacggaauuuaugcucgauuggcuguggacuuuccugaucucccugacccccaggccauguuugacaucgaguacuuuagaaaggauccacgcccauuuuuuaaguuugccaaggagauuuaucccggucaguuucagccaagccuuugucauaaguuuauugccuugucagauaaagaaggaaaguuacuaaggaauuacacccaaaauaucgacacacucgagcaaguagcaggaauccaacggauaauucagugucaugggagcuuugcaacagccucuugccucauuuguaaauauaaggucgacugcgaagcggugcggggugauauuuucaaccaggucgucccaagaugucccagaugcccagcagacgagccccuagcaauaaugaagccagagaucguuuucuuuggugaaaacuuacccgagcaguuccacagggccaugaaguacgacaaagacgaggucgacuuauuaaucgugauuggauccucccugaaaguccgaccugucgcccuuauucccuccucuaucccucaugaaguaccccagauauugaucaaccgcgaaccauugccgcaucugcacuuugacgucgagcuccugggcgauugugacgucauaauuaaugaacugugucacagauuagguggugaauaugccaaacugugcugcaacccagucaaacucucugaaauaaccgagaagccaccucgaacacagaaagaacuugccuaccucuccgaacuccccccaacuccucuccacgucucggaagacaguucaucccccgagcgcacauccccacccgacucuuccgugaucgugacucuucuugaccaggccgcaaaaucaaaugacgaccuugacgugagcgaaagcaaagggugcauggaggagaaaccacaagaaguccagacuagucgaaauguugaaucuauugcagagcagauggagaaccccgaccuaaagaaugucggaagcuccacaggcgagaaaaacgaacguaccagugucgcgggaaccguuaggaaauguuggccaaaccggguggccaaagaacagaucuccagaagacuggacggcaaccaguaucucuuuuuaccuccuaaucgguacaucuuucauggggcggagguguauucugauucagaagacgauguauugucuaguucaagcugcgggagcaacagcgacagcggaaccugccaauccccuucccucgaggaaccaauggaggaugaaucagaaauagaagaguuuuauaauggucuggaagacgagcccgacgugccugagagagcugggggagcaggauucggcaccgacggcgaugaccaagaagcgaucaacgaagcuaucuccgugaaacaagaagucacugacaugaacuacccaagcaacaaaucauag

SEQ ID NO: 249166 - RNA, 3498 nt, Artificial Sequence
  Description of Artificial Sequence: Synthetic coding sequence
augcaagauguucagggcccacggcccggcucacccggagacgcugaagaccguagggagcugggauugcaucgcggagaaguaaacuuuggaggaaguggcaagaaacguggaaaguuugucagagugccuucuggaguggcucccagcguccuguuugaccugcuucuugcagaauggcaccuccccgcaccaaaucucguggucucccuugucggagaggagcaacccuucgcuaugaaauccuggcugcgggauguccuuagaaagggccuugugaaagccgcacagaguaccggugcguggauucuaaccagugcuuugcgggucggccucgcucggcaugugggccaagcuguucgggaccauucacuggcuucuacuucaacuaaaguccgcgucguggccguuggaauggcgucucuuggacgcguguuacaccgccgaauccuagaagaggcccaggaagacuucccaguccauuacccagaagaugacggcgggucccaagggccucuuugcagucuggacucuaaucucucccacuuuauucuggucgaaccagggccccccggcaaaggcgauggauugaccgagcugcgccugcggcuggagaaacacauaucagaacagcgcgccggauacggagguacaggcucuauugaaauacccguucugugcuuacuugugaauggagauccuaacacguuggaacggaucucuagggcugucgaacaggccgcaccuuggcucauacuggugggaagcggugguaucgcugacgugcuugcugcccuugugaaccaaccccaucuguuaguuccuaagguagcagagaaacaguucaaagaaaaauuccccagcaaacacuuuucuugggaggacauugucagauggacaaaacugcuacaaaacauuacgucucaccagcacuuguugacugucuacgacuuugagcaggaaggcucagaagaacuugauacugugauccucaaggcucuggugaaagcguguaaaucccauucacaagaaccccaggacuaccuugacgaacugaaguuagcagucgcaugggaccgaguggacaucgcuaagucugagaucuucaauggagauguggaguggaagagcugugaucucgaggaaguaaugguggaugcgcuuguuagcaauaagccugaauuugugcgacuguucguggauaauggggcagacgucgccgauuuccugacauauggucggcugcaagagcuguacagaucggugucucgaaaaucguugcucuucgaucuguuacaacgcaagcaagaagaggcuagacugacucucgcaggacucggcacucagcaggcuagagaaccacccgccggcccccccgccuucucauugcacgagguuucaaggguuuuaaaagauuuccugcaggacgcaugccgcggcuuuuaccaggacgguaggccaggggaucgaagacgcgccgagaaaggccccgcgaagagaccuacuggacagaaauggcugcuagaccuaaaucagaagucagaaaaucccuggagagaucuguuuuugugggccgugcuucaaaaucgccaugaaauggcaaccuauuucugggccaugggacaggaggguguggccgcugcccuggccgcuuguaagauucuaaaagaaaugucucaccuggagacugaggcugaagcugcacgagccacucgcgaagcaaaguaugaaagauuggccuuggaucuguucucugaaugcuauuccaacucagaggcucgcgcuuuugcacuccuugugcggaggaaccgcugcuggucaaagacaaccugucuacaucuugccaccgaggcugacgccaaggcuuucuuugcacacgauggcgugcaggcauuuuugacaagaaucugguggggggacauggcagccggcacccccauccuccgucugcugggugcauuucucugcccugcuuuaguguacacaaaucugaucacguuuagugaagaagcuccucuccgcaccggucuagaagauuugcaagaccuggacucacuggauacagaaaaauccccccuguacggcuuacagucucgcguggaagaacuaguugaggcgccaagagcacagggagaucgcggacccagggccguguuuuugcucacucgcuggcggaaauuuuggggcgcuccagucacaguuuuccuuggaaauguggucauguauuuugccuuccuguuccucuucacuuacgucuugcucguggacuuuagaccaccuccucaggggccuuccggucccgaaguaacgcucuauuuuuggguguuuacacugguucucgaagaaauaagacagggguuuuuuacugaugaagauacccauuuagucaaaaaauuuacacucuaugucggagacaacuggaauaaaugugauaugguggccauuuuucucuuuaucgucggugugacgugccgcaugcugcccagcgccuuugaggcugggcgaacugugcuagcuauggacuucauggucuuuacacuccgccugauccacaucuuugcuauccauaaacagcugggcccaaaaauaaucguuguugagagaaugaugaaagacgucuucuuuuucuuguuuuucuugucagugugguugguggcauacgguguuaccacacaagcucuccuacacccccacgauggcaggcuugaauggauuuuuagacgaguucucuacagaccuuauuuacagauuuuuggucagauuccccuggaugaaaucgaugaagcccgaguaaacugcucaacucauccucugcugcucgaagauucaccauccugcccaucacuguaugccaauuggcuuguaauccugcuccugguuacuuuccugcucgugaccaacgugcuccucaugaaccuucugaucgccauguucagcuauacuuuucaggugguccaagggaacgcugacauguucuggaaauuucaacgauacaaccugauaguggaauaucacgagagacccgcgcucgccccuccuuuuauccuacugucucaucuuucucuaacacuccgacggguuuuuaagaaagaagcugagcauaaaagagaacaccucgagagggaccugcccgacccccuugaucaaaaagucgugacaugggaaacagugcagaaagagaauuuccuuucuaagauggagaaacgaaggcgggauagugagggagagguccuaagaaaaacggcccaucgaguugacuuuauugcuaaguauuuaggcggucuacgcgaacaggagaaacggauuaaaugucuggaaucacagauaaacuacugcuccgucuuaguuagcucgguggcagauguuuuagcacagggcgggggacccaggaguucacagcauugcggugagggaagucaacugguggcugcagaucaucguggcggguuagacgggugggaacagccuggcgcaggacaacccccaagcgacaccuag

SEQ ID NO: 249167 - RNA, 828 nt, Artificial Sequence
  Description of Artificial Sequence: Synthetic coding sequence
augcucaaccuucuguuacuagcuuuaccgguucuugccucccgcgccuaugcugcgccagcucccggacaagccuuacagaggguagggauuguggggggacaagaagccccaaggaguaaauggcccuggcagguaucauugcgcgugcacgguccuuacuggaugcacuuuuguggcgguucuuugauucauccccaaugggugcuuacagccgcccacugcguagggccggacgugaaagaccuggcugccuugaggguucaauuaagggagcagcaucuguauuaccaggaccagcugcugcccgucagccguauuauaguacauccacaguuuuacaccgcucagauuggcgcagacauugcucuucuggaauuggaagaacccguuaauguaucaagccacguccauaccguaacucuuccucccgcuuccgaaaccuuucccccaggcaugccaugcuggguaacaggguggggggauguugauaaugaugaaaggcucccacccccauuuccccucaagcaggugaagguucccauaauggaaaaccacauaugugaugccaaguaccaccugggcgcauacaccggcgaugacgugagaaucgugcgcgacgacaugcuaugugccggcaacacgcgacgugauuccugccagggugauagcggaggcccacuagugugcaaaguuaacggcacuuggcugcaagccggaguggugucauggggcgaagggugcgcacagccuaacagaccgggcauuuauacaagagucacauacuaucuagacuggauccaucauuaugugccuaagaagccguag

SEQ ID NO: 249168 - RNA, 849 nt, Artificial Sequence
  Description of Artificial Sequence: Synthetic coding sequence
augcugcuccucgccccccagaugcugaaccugcuccuucuggcauuacccgugcuugccucucgcgcguaugccgcacccgcccccggacaggcucuccagcgcgucggaauaguggguggucaagaggccccacgaucuaaguggccuuggcaggugucguugcgaguccacggcccuuauuggaugcacuuuuguggaggaucccucauccauccccaauggguacugacagcagcccauugugugggcccugauguaaaagaucuggccgcccugaggguacagcuucgagaacagcaccuauacuaucaggaccaguuacuuccagugagccgcauuaucguucauccucaauucuauacugcacagaucggcgccgauaucgcccuccuugaguuagaagagccagugaaugucagcucccacguucauacaguuacuuugccccccgccagcgaaaccuuuccgcccggaaugcccuguugggucacuggauggggggauguagacaacgacgaacgucucccacccccuuucccucugaagcagguaaaagucccuauuauggaaaaccauaucugugacgcaaaguaucauuugggugccuauaccggugacgaugugcggaucgugcgcgaugacaugcugugugcaggaaauacgagacgggauucuugccagggggacucaggggguccacuugucugcaaggucaaugggacuuggcuccaggccggcguggugagcuggggggagggcugugcucaaccuaacagaccuggaaucuacacuagagugacauauuaucuugauuggauucaccauuacguucccaagaagccuuag

SEQ ID NO: 249169 - RNA, 492 nt, Artificial Sequence
  Description of Artificial Sequence: Synthetic coding sequence
auggcagagggaggcgggcaaaaucaccacgaggucguuaaguucauggacgucuaucagcggagcuacugucaucccaucgaaacgcucguugacaucuuucaagaguacccagaugaaaucgaguacaucuucaagccuagcugcguuccuuuaaugagaugugggggaugcugcaacgacgaagggcucgagugugucccuacagaagagagcaauauuacaaugcagaucaugcgcauuaaaccccaccaaggccagcauauaggagaaaugaguuucuugcaacauaauaaaugcgaaugcagacccaagaaggaccgagcccgacaagagaauccuuguggcccauguagcgagcgccguaaacaccuuuuuguucaggacccacagacuugcaagugcagcuguaaaaacacugauagcagguguaaggccagacaacuagagcugaaugagcgcacguguagaugugacaaaccacgacgauag

SEQ ID NO: 249170 - RNA, 555 nt, Artificial Sequence
  Description of Artificial Sequence: Synthetic coding sequence
augcugcagauggccggccaaugcucccaaaaugaauauuucgacagucugcuucaugcguguauaccuugccagcugagaugcucuagcaacaccccaccccuuacgugccaaagguauugcaacgcaucagucacaaacuccguaaaaggcaccaaugcaauccuguggacuugucuuggccucagucuuauuauuagccuggcagucuucguucugauguuccuccucagaaagauaaauucugaaccccuaaaggaugaauuuaagaauacaggguccggucuccugggaauggcuaacauugauuuagaaaaguccaggaccggugacgaaaucauucucccacgaggacuggaauauacaguugaagaauguacaugcgaagauuguaucaaaaguaagcccaagguugacuccgaccauuguuucccuuugccggccauggaagaaggcgcuaccauccugguaacuaccaaaacaaaugauuacuguaagucccugccggcugcuuugucugccacagagaucgaaaaaagcauuucagcccgcuag

SEQ ID NO: 249171 - RNA, 567 nt, Artificial Sequence
  Description of Artificial Sequence: Synthetic coding sequence
augauaauuuacagagaucucauuagccaugaugaaauguucagcgauauuuauaaaaucagggagauugccgauggccuuugcuuagaagucgagggaaagaugguuucuaggacagaaggaaacaucgaugauaguuuaaucggcgggaacgcgucggccgagggacccgagggagagggaacagagaguaccguaauuaccggaguugacaucgugaugaaccaucaucuucaggagacuucauuuacaaaagaggcuuauaaaaaguacauaaaagauuacaugaaauccauuaaggguaagcuagaagagcagaggcccgaacgugugaaacccuucaugaccggagcggcagaacagauuaagcauauacuggcgaacuuuaagaacuaccaauucuuuaucggagaaaacaugaacccagacggcaugguggcucugcuugauuacagggaggacggaguuacuccuuacaugauuuuuuucaaggacggucuugagauggagaaaugcguaucaacaagaaaauggguuaaaauaaacaaugugaaaaagacuuucuag

SEQ ID NO: 249172 - RNA, 417 nt, Artificial Sequence
  Description of Artificial Sequence: Synthetic coding sequence
auggucagcaggacugaaggcaacauugacgauucauuaaucggaggaaaugcaagugcagaagguccagagggggaggggacagaaucgaccguuauuacuggggucgacauugugaugaaccaccaucugcaggagacuaguuucaccaaagaggccuacaagaaguauauaaaggacuacaugaagucgauuaaagggaagcuugaggagcaaagaccugaacgaguuaaacccuucaugacaggagcugcugagcaaauaaaacacauacuugcaaauuuuaagaauuaccaguucuuuauuggcgagaauaugaauccugauggaaugguggcauuacucgacuacagagaagacggaguuacuccuuauaugauuuuuuucaaggaugggcuagaaauggaaaaguguuag

SEQ ID NO: 249173 - RNA, 417 nt, Artificial Sequence
  Description of Artificial Sequence: Synthetic coding sequence
auggugucucggaccgaaggcaauauugaugacagccuuaucggugggaaugcaagcgcagaaggacccgagggggaagguacagaaucuacaguuauaacuggagucgacaucgugaugaaccaucaucugcaggagaccucauuuaccaaggaagcuuacaaaaaguacauuaaagauuacaugaaaagcauuaagggaaaacuggaggaacagcgaccugaacguguuaaaccuuuuaugaccggcgccgcugagcagaucaaacauauucuggcuaacuuuaagaauuaccaguuuuuuaucggcgaaaacaugaaccccgacggcaugguagcacuccuugacuauagagaagacggcgucacuccauauaugauauucuucaaggauggcuuggaaauggaaaaguguuag

SEQ ID NO: 249174 - RNA, 483 nt, Artificial Sequence
  Description of Artificial Sequence: Synthetic coding sequence
auguuuagcgauaucuauaagauucgggaaaucgcggauggacugugucucgaagucgaagguaagaugguuucaagaacagaggguaauaucgaugauagucugauagggggcaaugcaagcgccgaggguccugaaggagagggcacugagucaaccgugauuacaggcgucgacaucgugaugaaucaucaccugcaggaaacuucuuucaccaaggaggcuuacaagaaauacauuaaagacuacaugaaaaguauuaagggcaaauuagaagaacagaggcccgagagagugaaacccuuuaugacaggagccgccgaacagaucaaacauauuuuagcaaacuuuaaaaacuaccaauuuuuuaucggagagaacaugaaccccgacggcaugguggcauugcuggauuaucgcgaggauggcgugacacccuauaugaucuuuuuuaaggacggauuagaaauggaaaaguguuag

SEQ ID NO: 249175 - RNA, 519 nt, Artificial Sequence
  Description of Artificial Sequence: Synthetic coding sequence
augauuauuuacagagaccugauuucccacgacgagauguucucugauaucuacaagauccgggaaauugccgauggacucugucucgaaguggaaggcaaaauggucagccguacggagggaaauauugacgauucacucauuggcgggaacgcaagcgcagagggaccagaaggagagggaacugaaucaaccgugauuaccggaguugacaucgugaugaaccaccaccugcaggagacauccuuuacuaaggaggcuuacaaaaaguacauuaaagacuacaugaaaagcaucaagggaaagcuggaggagcagcgcccggagcgcguaaagcccuucaugacuggagcagcggaacagauuaagcacauuuuggcaaacuucaaaaacuaccaauucuuuauaggcgaaaacaugaacccggauggaaugguugcacugcuggauuaccgcgaagacggcguuacacccuacaugauuuuuuucaaagauggacucgaaauggaaaaaugcuag

SEQ ID NO: 249176 - RNA, 1278 nt, Artificial Sequence
  Description of Artificial Sequence: Synthetic coding sequence
auggcaggugccgaaggagcugccggucgucagagugaguuggaaccuguggucucacucgucgauguccucgaggaggaugaagagcucgagaacgaggccugcgcuguucugggaggcuccgauagugaaaaaugcaguuacucucaggguuccgugaagagacaagcacucuaugccuguaguacuugcaccccugaaggcgaagagccugccggcauaugucuagccuguuccuacgaaugccacggaucacacaagcuguuugaauuguauacuaaacggaacuucaggugcgauugcgggaacagcaaauucaagaaccuggaaugcaaguuacuaccugacaaggccaaagugaauaguggaaauaaguauaaugauaauuuuuucggacuguauuguaucuguaagcgaccuuaucccgacccggaagacgagauccccgaugagaugauacaguguguaguaugcgaagauugguuucacggaaggcaucugggggcuaucccacccgaaagcggagacuuccaggaaauggugugccaagcauguaugaagaggugcucuuuccugugggccuaugccgcccaacuggcaguaacuaaaauuaguacggaagaugacgggcugguccggaauaucgauggcauuggugaccaggaagugauuaagccugagaauggcgaacaccaggacuccacucuuaaggaagacgucccugaacaggguaaagaugacgugagggaaguuaaaguggaacaaaacagcgaaccgugcgcagguaguucuagcgaauccgaucuccagacugucuuuaaaaacgagucccucaaugcugaaaguaagucugguuguaagcuccaggaacucaaagcaaagcagcugauuaaaaaggacacagccacguauuggccacugaacuggagauccaaauugugcacaugccaggacuguaugaagauguacggagaucuagacguucuguuccugaccgaugaauacgauacaguacuggcuuaugaaaacaaagggaagauugcacaggcaacggaucgcagugacccguugauggacacuuuaagcagcaugaacagaguccaacagguagaguugauaugugaguauaaugaucugaaaacugagcuuaaggacuaccucaagagauuugcugacgagggaaccguuguuaaaagagaagauauccagcaguuuuucgaagaauuucagagcaaaaagagaaggcgcgucgaugguaugcaguacuacuguaguuag

SEQ ID NO: 249177 - RNA, 3234 nt, Artificial Sequence
  Description of Artificial Sequence: Synthetic coding sequence
augaccgccgagcugcagcaggaugacgcagcaggcgccgccgauggacauggcagcuccugccaaaugcugcugaaccaacugagggagaucacagguauucaggacccaucauuccuccaugaagcacugaaagccagcaauggggauaucacacaggccguaucuuugcuaacagaugaaagagucaaggagccuucccaggacacaguugcuaccgaaccaagugaagucgaggggucugccgccaacaaggagguccucgccaagguuaucgaucucacucacgauaauaaggacgaccugcaagccgcuauugccuuaucccugcuggaaagcccaaagauucaagccgacggccgagaccuuaaccguaugcacgaggccacaucugcugaaacuaaacgaucaaagagaaagagaugcgaaguauggggugagaaccccaauccaaacgauuggagacgagucgacggguggccugucgggcugaagaauguuggcaacacuugcugguucucggcugugauccaaucucuauuccaacuaccugaguuccggcgccugguacugaguuauucacucccgcagaaugugcuggagaauuguagaagccauaccgagaaacguaauauuauguucaugcaggagcuucaauaccuguucgcucucaugauggguagcaaucggaaauuugucgacccuuccgcagccuuggaucuguuaaaaggagccuucagaaguagcgaggaacagcagcaggacgucucugaauuuacacacaagcuacuggacuggcuggaagacgcuuuccaacuggccgucaauguuaacagcccccgcaacaaaucagaaaaccccauggugcagcuguuuuacgggacuuucuugaccgagggggugcgcgaaggaaaaccauuuuguaacaaugagaccuucggccaguauccucuacaaguuaacggguaucgaaaucuggacgagugucuggaaggggccaugguugaaggcgaugucgaacugcugccauccgaccacuccgugaaauacggccaggagcguugguucacgaaacugccaccaguguuaacuuuugagcucuccagauucgaguuuaaucaaagucuuggucaaccagaaaagauucacaacaagcuugaguucccccaaaucaucuacauggacagguauauguaucgaucaaaggaacugauuagaaauaagagagagugcaucagaaaacucaaggaagaaauuaagauccuccaacagaagcucgagcgguauguaaaauacggaagugguccggcacgguucccacuacccgauaugcugaaguaugugaucgaguuugcaagcaccaaaccagccucugaaucuuguccuccggaguccgauacccauaugacccugccauuaaguuccgugcauuguucuguuuccgaccaaacuucaaaggagucaaccuccaccgaaucuaguucgcaagauguggaaaguacguuuucuucaccugaggauucucucccuaaauccaagccucugacaucuagccgcucaaguauggagaugccuagccagccagcuccuagaaccgucaccgacgaagagauaaacuuugugaaaacgugccugcaacgauggcggagugaaaucgagcaggauauccaggaccucaaaacuuguaucgcauccaccacccagacaaucgaacaaauguacugcgauccccuucugaggcaagucccauacagauugcacgcugugcugguccaugagggucaggcuaaugcaggacauuacugggcauauauauauaaucagccccgucaaagcugguuaaaguacaaugacauuagugugaccgaaucaucuugggaggaaguggaacgggauucauacggaggguuacguaacguuagcgccuauugcuugauguacaucaacgauaaacugcccuauuuuaaugccgaggcggccccuacagaaagugaccagaugucagaggucgaagcucuguccguggaguuaaagcacuacauucaggaggauaacuggagguucgaacaggagguggaagaaugggaggaagagcagucauguaaaauuccucagauggaaaguagcaccaacaguucaagucaggacuauagcacuucccaggagccuucuguagccucuucucacggcguacggugucuuucaagcgaacacgcuguuauaguaaaagagcaaaccgcccaggccaucgcaaacacugcucgcgcauacgagaaauccgggguagaggcugcccuaagcgaagucaugcuuucuccugccaugcagggaguuauuuuagcaauugcgaaggcaagacagaccuuugaucgggaugguucggaagccggguugauaaaggcauuucaugaggaauacucccggcuauaccaacucgcaaaggaaacacccaccagccacagcgaccccagacuccaacacguauuagucuacuuuuuucagaacgaggcgcccaagcgugugguagaacguaccuuacuagaacaauuugcugacaagaauuugagcuacgacgagcgguccaucagcauuaugaaaguugcacaggccaagcugaaagagauagguccugacgauaugaacauggaagaauauaaaaaauggcacgaagacuacucauuguuccgaaaagugagugucuaccugcugacaggacucgaacuuuaucaaaaggggaaauaccaggaggcucucaguuaucucguguaugcuuaccaaucuaacgcagcucuguugaugaagggcccuaggagaggcgugaaagaauccguaaucgcucucuaucguaggaaaugccugcuugaauugaacgccaaagcagcuucacuguucgaaacaaacgacgaccacagugugacggaagggauaaauguaaugaaugaacuuauuauucccuguauucaucugaucauuaauaaugacauuucaaaggacgaccucgacgcaauagagguaaugagaaaccauugguguucauauuugggccaggauaucgccgaaaaccuucagcuuuguuugggcgaauuucugccaaggcugcuugauccaucagcggaaauaauaguucuuaaagagccucccaccauucguccuaauagcccuuacgauuuauguucccgauucgccgcggucauggaaagcauccagggggucuccacagugacugucaaguag

SEQ ID NO: 249178 - RNA, 2274 nt, Artificial Sequence
  Description of Artificial Sequence: Synthetic coding sequence
auggugccagauaccgccugugugcuccugcuuacccuggccgcccugggcgcguccggucagggacaguccccccuuggcucagaucuugguccucagaugcugcgugagcuacaagaaacaaaugcagcacuucaggaugucagggagcuacuucgacagcaggugcgugagauuacuuuucuaaagaacacugucauggaaugugacgccugcggaaugcagcaaucugugcggacaggccuccccagcguccguccacuuuugcacugugcccccggcuuuuguuuccccggcgucgcguguauccagaccgagagcggugcacgcugcgggcccugcccugcaggauuuacagguaacggaagccacuguaccgauguuaaugaaugcaaugcccauccauguuucccccggguucguuguaucaauacaaguccgggauuucgaugugaggcuugcccaccgggauauucuggcccgacucaucagggagucggacuugccuucgcaaaggcuaauaaacaaguuugcacagacaucaaugagugugaaacuggccagcauaauuguguuccuaauagcguaugcaucaacacuagaggaagcuuucaaugugguccaugucagccaggguucgugggagaucaggcaaguggcugucagaggcgugcccaaagguuuuguccagauggauccccuagugagugccaugagcaugccgacuguguccuggaacgcgacggcucaaggucaugugugugugccguugggugggccggcaacgggauauuaugcgggagagauaccgacuuagacggauucccggaugaaaagcuccgaugcccagaaagacagugcagaaaagauaacugcgugacugugccaaacagcgggcaagaggacguugaccgggacggaauuggagaugcaugcgauccugacgcugacggugacggugugcccaacgagaaagauaauugcccccugguaaggaacccggaucaacgcaacacugacgaggacaaguggggcgacgcuugugacaauugcagaucacagaaaaaugaugaccagaaagauaccgaucaggauggccgaggggaugccugcgacgacgauauagauggcgaucggauaagaaaccaagccgacaauugcccucgggugcccaacucugaccagaaggacuccgauggcgauggaauaggugacgccugugauaauugcccgcaaaaguccaacccugaucaggcagacguagaucaugacuuugucggcgacgcuugcgacagcgaucaagaccaggauggcgacggacaccaagacucgagagacaacugcccaacaguaccuaacuccgcacaagaagauuccgaccaugauggccagggcgacgcuugcgacgacgaugacgacaacgacggagugcccgauuccagagauaacugccgcuuggucccuaauccaggccaggaggaugccgauagagacggggugggagacgugugccaagaugauuuugaugcggacaaagugguugacaagauugauguauguccagagaacgcugaggucacccuuacagacuuucgugcauuccagacaguuguucucgacccagagggcgaugcgcagauugaucccaauuggguagugcugaaccagggccgcgaaauaguacagacuaugaacuccgacccuggacucgccgucgguuacacugcuuuuaacggcguagacuuugagggaacuuuccaugugaacacugugacugacgacgacuaugcuggauucauuuuuggguaucaggacagcucuucguuuuaugucguaauguggaaacagauggaacagacauacuggcaagccaacccguuucgugcaguggccgagcccggcauucaguuaaaagcugucaaaucaucuaccggcccaggugaacaacugaggaaugcacuguggcacacaggugauaccgagucccaagugcggcuguuguggaaagauccuagaaacgucggauggaaggauaaaaagaguuacaggugguuucuacaacaucgcccucaggucggcuacauuagagugcgcuucuacgaaggaccggaauugguugcugauagcaacguaguacuggacacaacaaugagaggcggccgauugggcguguuuugcuucagucaggaaaauauuauaugggccaaccugcgcuaucgauguaacgacacaauucccgaagauuaugagacccaucaguugagacaggcuuag

SEQ ID NO: 249179 - RNA, 2700 nt, Artificial Sequence
  Description of Artificial Sequence: Synthetic coding sequence
auggauaggaaaguugccagggaguuuagacauaaaguggauuuuuugaucgaaaaugaugccgagaaagauuaucucuaugauguucugagaauguaccaccagaccauggacguggcugugcuugucggugauuuaaagcuuguuauuaacgaacccagccgguugccucucuucgaugcaauucguccgcucauaccccucaagcaccaaguugaauacgaccaacucaccccacgcaggucaaggaagcuuaaggaaguuagacucgaccggcuccaucccgagggacugggucucucagugagagguggguuagaauuuggcuguggacuauucauuucacaccugaucaaaggggggcaagcagauagugucgggcugcaggugggagaugagaucgugaggaucaacggauauucgauuagcagcugcacacaugaagaagucaucaaccugauccguaccaaaaaaaccguuagcauuaaagugaggcauaucggacucauacccgugaagucgagucccgaugaaccccugaccuggcaguacguugaccaguuuguuagugaaucuggcggcgugagagggagucugggcagcccgggaaauagggaaaauaaagagaagaaaguguucauuagccuugugggaagcagaggacucggcuguagcaucagcaguggcccaauccaaaagccugguauuuucauaagccacguuaagccugguuccuuauccgcagagguaggauuggaaaucggagaucagaucguugaggugaauggcguagacuuuagcaaccucgaccauaaggaagccgugaauguccucaagucuagcagaagccugaccaucagcauuguggccgccgcggggcgggaguuauuuaugacugaucgcgaaagacuagccgaggcaagacaaagggaauugcagcgucaggaacugcuuaugcaaaagcgcuuggccauggaguccaauaagauucugcaggaacagcaagagauggagagacagaggaggaaagagauagcucagaaggcagcagaggagaacgaaagauacaggaaagaaauggagcagauuguugaggaggaggagaaguuuaaaaagcagugggaggaggauugggggucgaaggaacaacuucuguugccuaaaacaaucacugcagaagugcauccuguuccucugagaaagcccaaaucauucgggugguuuuaucgguacgaugguaaauuucccacaauccguaagaaggggaaggauaaaaaaaaggcuaaguacgggagccugcaagaccugagaaagaacaagaaggaguuggaguucgaacagaagcuguauaaagagaaggaagaaauguuagagaaggagaaacaacugaaaaucaaucgacucgcacaggaagucuccgagacagaacgcgaagaucucgaggagagcgaaaagauacaguacuggguagaacgccugugccagacgcgacuggaacaaaucucauccgccgauaaugaaaucucggagaugacaaccgggccuccucccccuccacccucugugucaccuuuggcuccaccccuucgaagauucgcuggaggccugcaucugcacaccacugaccucgacgacauuccuuuggauauguucuauuauccccccaagaccccauccgcucuucccguuaugccccaucccccucccucaaauccuccucacaagguccccgccccucccguccuuccccuguccggacacguuagugccagcucgucaccaugggugcaaaggacuccgccaccuauaccaaucccaccaccacccaguguccccacucaggaucugaccccgacucgcccauugccaagugcccuagaggaagccuuguccaaucaucccuuucgcaccggugauaccggcaaccccguggaagacugggaagcaaaaaaccacuccggaaagcccaccaauucccccgucccagagcaaucauucccaccuaccccgaaaacauuuugccccagcccucagccgccaagaggaccuggggucuccaccaucuccaaaccugucauggugcaccaagagcccaauuucauauauagacccgccgugaaaagcgaaguccugccucaggaaaugcuuaagagaaugguuguauaucagacugcuuuuaggcaggacuuuagaaaguacgaagaagguuucgaucccuacagcauguuuacgccugagcaaauuaugggaaaggacgugcggcuuuugaggauuaagaaagaaggcucucuggaucuggcucuggaaggugguguagacuccccaaucggcaaggugguggugucagcaguuuaugagcggggugccgcagaacgccauggaggcaucguuaagggcgacgaaauuauggcaaucaacggcaagauagugacggacuacacguuggcagaggcugaggcagcgcugcagaaagcauggaaucaaggaggugacuggaucgauuuagugguggcggugugccccccaaaggaauaugacgaugagcuggcuucuuuacccuccagcguggcugaaagcccacaacccgucagaaaacugcucgaagacagagcagcgguacauagacauggauuuuuguuacagcuggagccaacagaucuccugcucaaaagcaaaagaggaaaccagauucacagguag

SEQ ID NO: 249180 - RNA, 825 nt, Artificial Sequence
  Description of Artificial Sequence: Synthetic coding sequence
augauuauuucacacuuuccuaaguguguagccguguucgcgcuucuggccuuaucugucggcgcccuugacaccuucauugcagcaguguaugaacaugccgucauucugccaaaccguacugaaacaccuguuagcaaggaggaggcucugcuucugaugaacaaaaauauugauguccucgaaaaagcugucaaguuggccgcgaaacagggagcucauauuauugugacgcccgaagacgggaucuauggauggauauucaccagggaaucaaucuaucccuaucuugaagacauccccgaccccggcgucaacuggauacccugccgugacccauggagauucggcaauaccccaguucagcagcgacuguccugucucgccaaggauaacucgauuuacgucgucgccaauauaggagauaagaaaccuugcaacgccagcgauagucagugccccccggacggaagguaccaguacaacacugaugugguguucgacagccaggguaaauuacuagcacgcuaucauaaguauaauuuauucgccccagaaauucaauucgauuucccuaaggacucagaacucguaacguucgacacaccuuuugguaaguuugguauuuuuaccugcuucgauauuuuuucccacgauccggcgguagucgugguggacgaguuccagcuaacagccuuuucgacaccucagcauggcaccacucgaugucccucuucacgccucuuucccucuauucaacauggaccuagaccaugggaaagcauuuaccuccuucagauccccacuaccccagcaugcaccuag

SEQ ID NO: 249181 - RNA, 444 nt, Artificial Sequence
  Description of Artificial Sequence: Synthetic coding sequence
augaucaucucccauuuccccaagugcgucgccgucuuugcucugcuagcacuaucaguaggcgcccuggauaccuucauugcugcugucuacgaacaugcggugauuuuaccuaaccggacagaaacccccgugaguaaggaagaagcucuccuccuuaugaacaagaauauugaugugcuggaaaaagccgugaagcucgccgccaagcagggugcucacauaaucguuacuccugaggaugguaucuaugguuggaucuuuacgagagaaaguauuuaccccuaccucgaggacauccccgaccccggaguuaacuggauucccugucgcgacccauggaggaaaaguaagaagaugaacgaacccguaucaaaggaacuuugcuaucacugccacagcgaaugcaaucaauauggccaauggaagcuguacaggacauag

SEQ ID NO: 249182 - RNA, 624 nt, Artificial Sequence
  Description of Artificial Sequence: Synthetic coding sequence
augauuauaucucacuuuccuaaguguguagcuguguucgcacucuuggcccuguccgucggcgcucucgauaccuuuauagcugccgucuacgagcacgccgucauucucccaaaucgaacugagacuccugucagcaaagaggaggcccuccuacuaaugaacaaaaacauagauguacucgaaaaggccgucaagcuugccgccaagcagggcgcccauauaauuguaaccccagaggacggcauauauggcuggaucuucacccgagagucgauuuacccuuaucucgaggauaucccggaucccggggugaacuggauccccugcagagacccauggcgcuuuggaaauacccccguacagcaaaggcugagcugucuggcuaaagacaacagcaucuauguaguugccaacauuggugacaagaagcccugcaaugcaucugauucacaguguccaccagacgguagauaccaguauaacacagacgugguguucgacucacaagguaaauuauuggcaagguaccacaagggcgucgagaguaccccucagaagcaaucucgauguacuacuaugacauggaagcagcgagugguuuccugcugcuaccaaaauuag

SEQ ID NO: 249183 - RNA, 303 nt, Artificial Sequence; identical to SEQ ID NO: 248577
  Description of Artificial Sequence: Synthetic coding sequence

SEQ ID NO: 249184 - RNA, 1110 nt, Artificial Sequence
  Description of Artificial Sequence: Synthetic coding sequence
augagagccuguaucagccucguccuugcaguacuguguggacuugcuugggcugaggaccacaaagaaucagaaccacuaccucagcuggaggaggaaacugaggaagcucucgcuucaaaccuuuacucugcgcccacuucuugccaggggagguguuaugaagcguuugauaaacaccaucaaugucacuguaaugcucggugucaagaauuugggaauuguugcaaagacuuugagucccuguguucugaucaugaagugucucacucaucagaugccaucacaaaagaggagauccagaguaucucagagaaaaucuacagggccgauacgaacaaggcacagaaagaggauauugugcugaauagccagaauuguauaaguccauccgaaacgcgaaaucagguggauagauguccuaagccuuuauuuacauaugucaaugagaaauuguucaguaaaccaacauacgccgcuuuuauuaaucuccucaauaacuaccaacgagccacagggcauggcgagcacuuuucagcccaggagcuggccgagcaggaugccuuuuuacgcgagauuaugaaaaccgccgugaugaaggaguuauauucauucuugcaucaucagaaccgcuacgguagcgaacaggaguuugucgacgaucugaaaaacaugugguuuggacuauauuccagagguaacgaggagggggauagcagcggcuuugagcaugucuuuaguggggaggugaaaaaaggcaaaguuacaggauuucacaacuggauacgcuucuaccuagaagagaaagaggggcugguugacuauuacucacacauauacgacggcccgugggauaguuauccugauguuuuagcaaugcaguuuaacugggacggguacuacaaggaagugggcucagcuuuuaucgguagcucaccugaguuugaguuugcguuauauucacucugcuuuauugcuagacccggaaaagucugucaacugucccuaggaggauacccacuggccgugagaaccuacaccugggauaaauccacuuacgguaacgggaaaaaguauaucgccaccgcuuacaucguuagcucaacguag

SEQ ID NO: 249185 - RNA, 852 nt, Artificial Sequence
  Description of Artificial Sequence: Synthetic coding sequence
augugcaauacaccaacauacugcgaucucgguaaagcagcaaaggauguuuucaauaaaggauacggauucgguauggugaagauagaucucaagacaaagaguugcucugguguugaguucucaaccuccggccacgccuacacugacaccgguaaagccagugggaaucuggaaaccaaauauaaaguguguaacuauggacuuacuuuuacucaaaaauggaacacggacaauacucuggggacugaaauuucaugggagaacaaacucgcagaaggacucaaguugacucuggacacuaucuuugucccuaauacuggaaaaaagagcgggaaacugaaggcaucuuauaagcgggacuguuucuccguuggcaguaauguggauaucgauuucuccggccccacuauuuauggaugggcugugcucgcuuucgaaggcuggcuggccgguuaccagauguccuuugacacagcuaaaucaaagcucucccagaacaauuuugcucuaggcuacaaggcagcggacuuccagcuacacacccaugucaacgacggaacugaguucggugguaguauuuaccaaaagguuaacgagaaaauagaaacaagcauaaacuuggccuggacagccggcagcaacaacacaagguucggcaucgcugcuaaauacauguuggauugcaggacgucccuuagcgcaaaagucaacaacgccucccugauuggacuuggcuauacccaaacucuccgucccggugugaaacucacucucuccgcucucauugauggaaagaauuuuucggcaggcggacacaaaguaggacuuggauuugaacucgaagcauag

SEQ ID NO: 249186 - RNA, 621 nt, Artificial Sequence
  Description of Artificial Sequence: Synthetic coding sequence
auggccgccaacaaacccaagggacagaacagucuggcuuuacacaaggugauaaugguaggcucaggcggggugggcaaaucagcucuuacucuccaguuuauguacgaugaauuuguggaagauuacgaaccaacaaaggcugauaguuauaggaaaaaggugguauuagauggagaagaggugcagaucgacaucuuggacaccgcuggccaagaggacuaugccgccauacgggauaauuacuucagauccggcgagggcuucuugugcgucuuuucaaucacagagauggaaucuuucgccgcaaccgcagacuuucgcgaacagauuuuacggguaaaggaagacgaaaaugugcccuuucuuuugguaggaaacaagagcgaucuggaggacaagaggcagguuucuguugaagaggcaaagaaucgggcagagcaguggaaugucaauuacguugagaccagcgcuaagaccagggcaaauguggacaagguuuucuucgaccucaugagggagauuagagcacggaagauggaggauucuaaggaaaagaacgguaaaaaaaagagaaagucacuugccaaaaggauacgcgagaggugcugcauauuauag

SEQ ID NO: 249187 - RNA, 1170 nt, Artificial Sequence
  Description of Artificial Sequence: Synthetic coding sequence
augcuggaagaaccccggccccggccccccccgucagguuuagcugggcuccuguuccucgcccugugcucuagagcauuguccaaugaaauucugggucuuaaacucccuggcgaaccaccgcuuacagccaauaccguguguuuaacccucuccggacugagcaagcgacagcucgggcugugucuucguaauccagauguaaccgcuucagcacuucagggguuacauaucgccgugcacgagugucaacaccaacugagagaucagagauggaacuguagcgcccuggagggagggggcaggcugccacaccauucagcgauuuuaaagaggggauuucgcgaaucugcauucaguuucucaaugcucgcggcuggggugaugcaugcuguugcuacugcuugcucccuuggcaaguuggucucuugcggaugcggauggaaggggucaggugagcaggaucgccugcgggcaaaauuguugcaacuacaagcacugagccgggguaaaagcuuuccucauucucuacccagccccggaccaggaaguucaccaaguccuggcccucaggacaccugggaaugggguggauguaaccacgacauggauuuuggggagaaguucaguagggauuuuuuggauucaagagaagcaccacgcgauauccaagccaggaugagaauacauaacaauagagugggaagacagguggugaccgaaaauuuaaagaggaaguguaagugccacgggaccagcggcucuugucaguuuaaaaccuguuggcgagcugcucccgaguuucgggcugucggugcugcucugcgcgaaagacugggccgggccaucuuuauugauacacauaauagaaauagcggcgcauuccagccacgacuacggccuagacggcucucaggugaguuggucuacuuugaaaagucccccgacuucugugaacgcgauccaacuauggggaguccuggcacacgggguagggccuguaacaagacuucaaggcuucuugacggaugcgguucucugugcugcggccgugggcacaacguucuccgccagacucguguggaaagaugccauuguagguuccauuggugcugcuauguccugugugaugagugcaaggugacagaguggguuaaugucugcaaguag

SEQ ID NO: 249188 - RNA, 576 nt, Artificial Sequence
  Description of Artificial Sequence: Synthetic coding sequence
auguuagaggaaccacggccccgacccccucccucuggcuuggcgggacuuuuguuccuugccuugugcuccagagcccugucgaaugagauucugggucugaaacugccuggcgaaccuccccucacggccaauaccgugugucuuacauuguccggcuuauccaaaaggcagcucgguuuaugccugcgcaacccugacguaacugcaucagcucugcagggacugcauaucgccguccacgagugucagcaucaguuaagagaccaaagguggaauugcuccgcgcuugaaggaggcggcagacugccacaucauuccgcuauacugaagagaggcuuucgagagagcgcauuuuccuucucaaugcuagccgcggggguuaugcaugccgucgcuacugcuugcucucugggcaaacuugugagcugugguuguggguggaaaggcuccggcgaacaggaccgucuucgagcaaagcuccuccaguugcaggcccuaucaagagggaagcuuccaggaacuagucgccaugagugcgagucaacuacgacggguuggggagcucgaugguag

SEQ ID NO: 249189 - RNA, 309 nt, Artificial Sequence
  Description of Artificial Sequence: Synthetic coding sequence
augcuggaagaaccgagaccacgaccuccaccgucaggacuagccggucuacuuuuccuggcucucugcagcagagcacuguccaaugagauauuggggcugaagcucccgggagaaccgccccuaacagcuaauacagucugucuaacacucucaggcuugucaaagaggcagcucggccugugucuccgcaaucccgacguaacugcguccgcucugcagggccuucacaucgcaguccacgaaugccagcaucagcucagagaccaaagguggaauugcuccgcccuugaggggggugggcgauag

SEQ ID NO: 249190 - RNA, 1050 nt, Artificial Sequence
  Description of Artificial Sequence: Synthetic coding sequence
augcacaggaauuucaggaaguggauuuuuuauguauuccucugcuucggaguucuuuacguaaaacuuggugcucugucguccgucguggcucuaggugcuaauaucaucugcaacaaaauaccuggacuggccccucgccagagagcuauuugccaaagccggcccgacgcgaucaucguuauuggagaaggagcccagauggggauuaacgagugucaauaccaauuuagguuuggccgauggaauuguuccgcucucggugagaagaccguauuuggacaggaguugagggucggaaguagagaggcagccuuuacuuacgcaaucacagcagcagguguggcccacgcagucacugcugccugcucccaggguaacuugaguaauugcggcugugaucgggagaagcaaggguauuauaaccaagcagaaggauggaaaugggggggguguuccgcagacgucagauacgggaucgacuuuaguaggagguucguggacgccagggaaauuaaaaaaaaugcuagacgacuuaugaaucugcacaauaacgaggccgggcggaaagugcuggaagaccguaugcagcucgagugcaaaugucacggagugaguggaucaugcaccaccaagaccugcuggacuacucuaccgaaguuucgagaagucgggcaucuacugaaggagaaguacaacgcagcaguccaggucgagguuguacgagcuucacgccucagacaaccaacauuccuuaggauuaagcagcuccgcucguaucagaaaccuauggagacagaccugguuuacaucgaaaagucccccaacuauugugaggaagacgccgcaacaggauccguaggaacgcagggaagauuauguaauagaacaucccccggcgcugauggcugugacacaaugugcugcggacgagguuacaauacacaccaguacacgaagguuuggcaaugcaacuguaaauuucacugguguugcuuugucaaaugcaauaccugcucugagcggaccgaaguuuuuacauguaaauag

SEQ ID NO: 249191 - RNA, 1062 nt, Artificial Sequence
  Description of Artificial Sequence: Synthetic coding sequence
auguugcugcucucacccagauccgcccucguaagugucuacugcccucaaauuuuucuuuuacugucuucaggcucauaucucgcucuuagcuccguggucgcguuaggcgccaauaucauaugcaacaaaaucccuggccucgcuccgaggcaacgcgcuaucugucagucccgcccggacgccaucaucgucauuggggagggagcccaaauggguauuaacgagugucaguaccaguuccgguuuggacgguggaacuguucggcccuuggugaaaaaacgguguucggacaggaacugagaguuggaagccgagaggcagcauucacuuacgccaucacugccgcaggcguggcccaugcagucaccgcagcuugcagccaagggaaccugucuaauugcggcugugaccgggaaaaacaaggauauuauaaucaggccgaaggauggaaauggggggggugcuccgccgaugucagauauggcaucgacuucaguaggcgguuuguggacgcaagggagaucaaaaaaaacgcaagacggcucaugaaccuccauaauaaugaggccgguagaaaaguacuugaggauagaaugcagcuagaguguaaaugucauggagucaguggaagcugcaccacaaagacguguuggacuacccugccaaaguuccgggaagucggacaucugcucaaggaaaaauauaacgcugcaguucaaguggagguagugcgggcaucccggcugcggcaaccgaccuucuugaggaucaagcaguuacgaucauaccagaagccaauggaaacugaccuugucuauauugagaagucacccaauuacugugaggaggaugcugccaccggaaguguaggaacccaagguagacuguguaaccggacuaguccuggcgcagaugggugcgauaccaugugcugugggagaggcuacaacacucaucaauacaccaaagucuggcaguguaauuguaaguuccauuggugcugcuucguuaaauguaauaccugcucagagcgaacugaaguuuucacuuguaaauag

SEQ ID NO: 249192 - RNA, 618 nt, Artificial Sequence
  Description of Artificial Sequence: Synthetic coding sequence
augcaucggaacuuccggaaguggauuuuuuacguguuccucuguuuugguguccuguacgugaaacugggcgcauuaagcucuguuguggcuuuaggagcuaacaucauuuguaacaagauuccuggacucgccccgcgccagcgcgcaaucugucagagccggcccgacgcgauuauuguaauaggcgaaggcgcacagaugggaaucaacgagugucaguaccaguuccgcuuugggcgguggaauugcucugcccucggcgaaaagacaguuuucggucaggaacuacgggugggaucccgcgaggcugccuucaccuaugcgaucacugcagcugggguggcucacgcaguaacggccgccugcucucaggguaauuugagcaacuguggaugcgaucgggagaaacagggguauuacaaucaagccgaaggguggaaaugggggggguguagcgcugacgugcgguaugguaucgacuuuucacgcagauuuguggacgcccgagagaucaagaaaaacgcucgaagacugaugaaucuccauaauaaugaagcaggaagaaagggacuucucggucagcccaggguaacuucaagcccccuguuccccuag

SEQ ID NO: 249193 - RNA, 1002 nt, Artificial Sequence
  Description of Artificial Sequence: Synthetic coding sequence
auguccgcuccaccauucuacagagcccugucgucugugguugcccugggggccaacaucaucugcaauaaaaucccuggacuggccccaaggcagagagccaucugucagagccgcccagacgcuauuauugucaucggcgaaggagcccagaugggcauuaaugagugccaauaccaauucagauuuggacgauggaauugcuccgcccugggagagaaaaccguauucggacaagagcuaagggugggauccagagaagccgcauuuacuuacgccauuaccgcagccggcgucgcacacgcugucacugcagcuugcucucaaggcaaccuuucuaacugcggcugcgaucgagaaaaacaggguuauuacaaucaggcagaaggcuggaaaugggggggcugcuccgccgaugugagguacggaauugacuuuucuagaagguucguagaugcacgggaaaucaaaaaaaacgcucgcaggcugaugaaccugcauaacaacgaggccggucgcaaaguuuuggaggacaggaugcaauuagagugcaaaugccacggagugucuggaucauguaccacaaaaacauguuggacgacacugccgaaauucagagaggucggucacuuacugaaggagaaauauaacgccgccguccagguagaagugguacgggcgucccgccugaggcaaccuacguucuuacgaaucaagcagcuccggucauaccaaaaaccuauggaaaccgaccugguuuacaucgagaagucaccuaauuacugugaggaagacgcagccaccggaucuguugggacacaggggagacuguguaauaggaccucaccaggagcagacggaugugacacaaugugcuguggccggggcuauaauacacaccaauauacaaagguguggcaaugcaauugcaaauuccacuggugcugcuucgugaaaugcaacacuugcucugaaagaacugaggucuuuacauguaaauag

SEQ ID NO: 249194 - RNA, 174 nt, Artificial Sequence; identical to SEQ ID NO: 248588
  Description of Artificial Sequence: Synthetic coding sequence

SEQ ID NO: 249195 - RNA, 1119 nt, Artificial Sequence
  Description of Artificial Sequence: Synthetic coding sequence
augaacaagcggcgccuccuauacccaagcggcuggcugcacggcccaagcgauaugcagggacuucuuuucuccacccuccuccuggccggcuuggcccaguuuuguuguaggguucagggcaccggcccccuugacacuaccccugaaggaagaccaggagaaguuagugaugcaccucagagaaagcaguucugucauuggcccugcaaguguccacagcagaaaccaagaugucccccuggcgucucucucgugagagacggcugcgguuguugcaagaucugcgcaaaacaaccaggcgaaauuugcaaugaggcugauuugugugauccucauaaaggcuuauacugcgacuacucagucgaccggccuagguaugaaacaggcgugugcgcuuaucuugucgcugucggcugcgaguuuaaucagguucauuaccacaacggccaaguuuuucaaccuaauccacucuucuccugucucugcguguccggcgccaucggcugcaccccacuauucauuccaaaacuggcugggucucacuguucaggugcaaagggaggcaaaaaauccgaccagagcaauuguucacucgagccacuacuccagcaauugagcacguccuauaaaaccaugccugccuacaggaacuuaccucugaucuggaagaaaaagugccuggugcaagcaacaaaguggaccccuuguucccggaccugcgguaugggcauuuccaauagggucaccaaugagaauucuaacugcgagaugagaaaagagaagagacuguguuacauccaaccaugugacuccaacauccugaaaaccauuaaaauaccuaaaggaaaaacaugucagcccacauuucaauuaagcaaggcagagaaauucguauuuagcggcuguaguucuacccagucauauaaaccuacuuucugcgggaucugccuggacaaacgcuguugcauuccuaacaagucaaagaugaucacgauucaguucgacugccccaacgaggguuccuucaaguggaagaugcuguggauaacuagcugugugugccaacgaaauugcagagaacccggcgacaucuucucagaacucaagauucucuag

SEQ ID NO: 249196 - RNA, 996 nt, Artificial Sequence
  Description of Artificial Sequence: Synthetic coding sequence
augaaaauaucucgaggaaggguguguuuagagagugagaacaaggacgcuggugucgcaggaagaaaacaguucugccacuggccauguaaguguccccagcagaagccuagguguccgccaggagugagccuuguuagagauggcugcggauguuguaagauuugcgcgaagcaaccuggcgagauauguaacgaagcugaucugugcgacccacacaaaggacucuauugugauuacuccgucgaucggccacgauacgaaaccggaguuugcgcauguaaauccguaggcugugaauuuaaucagguacauuaucauaacggucagguguuucagccuaauccccuauuuucuugucugugugucagcggcgcaaucggaugcaccccccucuuuauccccaaauuggccggaucccauugcagcggugcuaaaggcgggaaaaaguccgaucagucuaauugcucucuggagccucuccuacaacagcuguccaccuccuauaagacaaugcccgccuaucgcaaccuacccuugauuuggaagaaaaaaugucugguccaggcaacaaaguggaccccaugcucucgcaccugcgguauggguauuuccaacagaguuaccaaugaaaacaguaauugugagaugagaaaggagaagcgauuaugcuauauacagcccugcgacucaaacauccucaaaacaauuaaaauuccaaaagguaagacaugccagcccacauuccagcucaguaaagcagaaaaauuuguguuuaguggaugcaguucuacucagucauacaaaccaacuuuuuguggaaucugcuuagauaaacgcugcugcauuccaaauaaauccaaaaugauuacuauucaguucgacuguccaaacgaaggcucauuuaaguggaaaaugcuauggauuacaucuuguguuugccagaggaacuguagagaacccggagauauauucagcgaguugaaaauucuguag

SEQ ID NO: 249197 - RNA, 1065 nt, Artificial Sequence
  Description of Artificial Sequence: Synthetic coding sequence
augcaagguuugcuguuuucuacacugcugcuggcaggauuagcacaguucuguugccgcgugcaggguacgggaccauuagauaccacuccagaaggacggccaggugaaguuagugacgcgccccaacgaaaacaguucugccacuggccguguaagugcccccagcagaagccgagaugcccccccggcgugagccugguccgcgacggauguggaugcugcaaaaucugugcgaagcaaccaggagagaucuguaacgaagcugaucugugugacccgcauaaagggcucuacugcgauuauagcguagaccgaccuagauacgaaaccggagugugcgcauacuuaguggcaguagggugugaguuuaaccagguucacuaccauaacgggcagguguuccagccaaacccuuuguuuucaugccuuugugucagcggcgcuaucgguuguacacccuuguucauaccaaagcuggccgguucucauugcuccggggcgaagggagggaaaaaauccgaccaaucuaacugcucacuugaaccgcugcuucaacaacuguccaccagcuauaagacgaugcccgcuuaccguaacuuaccucuuauauggaagaaaaagugcuuaguucaagccaccaaguggacccccuguucgcggaccugcgggaugggaauaucaaacagagugacaaacgaaaacuccaauugcgaaaugagaaaagagaaacgccuguguuacauucagcccugugacagcaauauucugaaaacuauaaagauucccaaggguaagaccugccagcccacauuucaacuuucgaaggccgaaaaguuugucuucuccggguguaguuccacacagucuuacaagccaacuuucugcggcauuugccuggacaagcggugcugcaucccuaauaagucaaagaugauuacgauacaguucgauugccccaacgaaggcucauucaaguggaaaaugcuguggauaacaagcugcgugugccaacgcaauugcagagaaccuggugauauuuuuagcgaauuaaaaauucuuuag

SEQ ID NO: 249198 - RNA, 693 nt, Artificial Sequence
  Description of Artificial Sequence: Synthetic coding sequence
augcagggccuucuguuuucuacacuccuucuagcgggauuggcucaguucugcuguagagugcaggggaccggacccuuggacacaaccccugagggaaggcccggcgaagugagugaugcuccccaacgaaaacaguucugucauuggccauguaagugcccucagcaaaagccccgguguccaccaggcguaucuuuagugcgggacggaugcggaugcugcaaaauuugcgcuaaacagcccggcgagaucugcaaugaagccgaccugugcgacccucacaaaggccuuuauugugacuauucuguagaccggcccagguacgaaaccggcguuugcgccuauuuagucgccgugggcugugaguuuaaucaggugcacuaccauaauggucagguauuccaacccaacccacucuucucuugucucugugucuccggugcaauaggcugcacuccgcucuuuaucccuaaacucgcaggaagccacuguagcggcgcaaaaggcgggaaaaaaagugaccagaguaacugcucuuuggagccccugcugcagcaacuuucuacuuccuacaaaacaaugccagcuuaucggaacuugccccugauuuggaaaaagaacguucucugcaaacaacaaaauggccugccagccccugaacacguuggaugggaauaucuuacgggcuag

SEQ ID NO: 249199 - RNA, 393 nt, Artificial Sequence
  Description of Artificial Sequence: Synthetic coding sequence
augggcaucucuaaccgaguaacaaaugagaauuccaauugcgagaugaggaaagagaagcgauuauguuauauucagccgugcgauucuaauauccuuaagacgauaaaaauuccaaagggcaagacaugucagccuaccuuucaauuauccaaggcagaaaaguuuguguuuuccggauguucaucuacccaaagcuauaagcccacauuuugcggcauuugccuugacaagcgguguugcauuccuaacaagaguaaaaugauuacaauucaguucgacugccccaaugagggcucauucaaauggaagauguuguggauuacuucuugcgucugucagcgaaacugccgcgaacccggggacaucuuuucagaacuuaaaauucucuag

SEQ ID NO: 249200 - RNA, 462 nt, Artificial Sequence
  Description of Artificial Sequence: Synthetic coding sequence
auguaccgcaugcaacugcucuccuguauagcucucucucucgcacucguuaccaacuccgcucccacaucuucgucgaccaagaaaacacagcugcagcuagagcaccuucugcuugaccuccagaugaucuugaacgggaucaacaacuauaaaaauccaaaacucacaaggaugcuuacauuuaaauuuuacaugccaaaaaaagccacugaauugaaacaccugcagugccuggaggaagagcugaagccucuugaggaaguauugaaccuggcccaguccaaaaacuuucaucugcggccccgggaucucauaaguaauaucaaugucauuguucucgagcucaaaggcagcgaaaccaccuuuaugugcgaauaugcugaugaaaccgcuaccaucguggaauuucugaaucguuggaucaccuuuugucagaguauuaucucaacccuuacuuag

SEQ ID NO: 249201 - RNA, 984 nt, Artificial Sequence
  Description of Artificial Sequence: Synthetic coding sequence
auguuuccuucuagacgcaaggcugcccagcuccccugggaggacggccgaucaggguugcugucugguggacuuccccgcaaauguuccguguuucaucuguuugucgccugccuuucguugggcuuuuucucccugcucugguugcagcugaguugcagcggggauguggcccgcgccguucggggucaaggacaggaaaccagcggccccccuagagcuuguccaccugaacccccuccggagcacugggaagaggaugcaucuuggggaccccaucgucuagcuguccuaguccccuucagagaacgcuucgaagagcugcuuguguucgugccgcacaugcgcagauuccucagucgaaaaaaaauucgucaucacauuuacguucugaaucaaguggaccauuucagguuuaacagagcugcccugauuaacguuggauuucuugaauccuccaacucaacagacuacauugcaaugcaugauguugaucuccuuccauugaaugaggagcucgauuauggauuuccugaggccggcccuuuucaugucgcauccccagaacugcauccacucuaccauuauaaaaccuauguggggggcaucuuguuacugagcaagcagcauuauaggcuguguaauggaaugaguaauagguuuuggggcuggggaagagaagacgacgaauucuacaggcgaaucaagggcgcuggacugcaguuauuccguccaucugguauaaccacuggguacaaaaccuuuaggcacuuacaugacccugccuggagaaaacgagaucaaaaaaggauagccgcacagaagcaggaacaguucaagguggaucgagaagggggucucaauacugucaaauaucacguugcaucuaggacagcucugagcguagguggggcccccuguaccgugcucaauauuaugcucgauugugacaaaacugcaacaccauggugcacuuucucuuag

SEQ ID NO: 249202 - RNA, 2598 nt, Artificial Sequence
  Description of Artificial Sequence: Synthetic coding sequence
augguugcaagcgcuagagugcagaaacuagugagaagguacaaacuagcuaucgccacggcuuuagccaucuuacugcugcaaggacucgugguuuggucauucucagggcuggaagaggaugaagcaggggaaaaaggccggcaaagaaagccgagaccccuggaccccggagaagggaguaaagauacggacuccucugcagggaggaggggcucaacuggcaggaggcacggacgcuggagaggcagggccgagagcccaggcgugccaguugccaaaguaguccgagccguaaccagccgacagagggcaagucgacgcgugccucccgcccccccacccgaggccccagggaggcagaauuugucuggcgcagcagccggagaggcuuuagucggcgccgccggauuuccaccucacggugauacaggcuccguugagggugcgccucaaccgacagacaacggcuuuacacccaagugcgagauagucggaaaagaugcacucuccgcccucgcaagggccagcaccaagcagugccaacaggaaaucgccaauguugugugccuucaucaagcagguagccugaugccuaaagcagucccacgacacugucaguugaccgguaagaugagccccgguauccagugggaugagucucaagcacagcaaccaauggauggaccccccgugagaaucgcuuacaugcucgucguucacgggagagccauucgacagcucaaacggcugcugaaagccgucuaccacgagcagcacuucuucuauauucacgucgacaagcgcuccgauuacuuacaccgcgaggucguagaacuugcccaggguuaugacaaugucagagugacacccuggcgcaugguuacuauuuggggaggcgcuuccuuacugcgcauguaucugaggaguaugcgggaccuccuugaagugccaggaugggcgugggacuucuucauuaacuuaagcgccacugacuacccuacaaggacaaaugaagagcuggucgccuuucuguccaagaaccgagacaaaaacuuucuuaagucccacggacgcgacaauucaagauuuaucaaaaaacagggccuagacagguuauuucacgaaugcgacucucacauguggcgacugggagagaggcaaauuccggcuggaauugugguggauggggguagugauugguucguccuuaccaggucauuuguggaauacguggucuacacugacgacccacugguggcccaauuacggcaguuuuauaccuauacccuccucccggcugagaguuucuuucauaccgugcucgagaacagccuggccugugagacccuuguugauaauaauuuacgggucacaaauuggaacaggaaauuaggauguaaaugucaauacaagcauauuguggauugguguggcugcuccccaaacgacuuuaaaccccaagacuuucuccgacugcaacaaguuagccgccccacguucuuugccagaaaauucgagucgacugucaaucaggaggucuuagaaauccuugauuuccaccuguacggaucuuaccccccuggcacccccgcacuaaaagcauauugggaaaacaccuacgaugcagcagacgggcccagcggucuaucagacguuauguuaaccgccuauacugcauucgcccgacuuucacugcaccaugccgcaacagcugcuccacccaugggaaccccucuuugcagguucgagccuagggggcuccccucaagugugcaucuguacuucuaugaugaccacuuccaaggguaccugguuacacaggccguccagccuucugcucagggucccgcugaaacccuugagaugugguuaaugccccagggaagucuuaaacugcucggccgaucagaccaagccucgcgucuucagucguuggaggugggaacagauugggaccccaaggagagacuauuuaggaacuucggaggccugcuugguccucuagacgaacccguggccguucagagaugggcaaggggacccaaccuaacugcgaccguuguguggauagauccuacuuacguggucgcuacuucuuacgacaucaccguugacacagaaacagaggucacucaguacaagcccccacuuucuaggccacugcggccagggccuuggaccgugcgccuuuuacaguucugggaaccacuaggugagacucgguuccucgugcucccccugaccuuuaaccgaaaacuuccccuuagaaaggacgacgcauccugguuacacgccggcccuccccacaacgaauauauggaacagaguuuucagggguuaucgagcauucugaaucucccucagcccgaacuggcugaagaagccgcucagagacacacucaauuaacuggcccugcguuggaagcuuggacggaccgggagcugaguuccuuuuggucuguugccggccugugugcuauuggcccuucuccuuguccuucucuagaacccugucgccuuacauccuggaguagccugaguccggacccaaaaagcgagcuuggcccugugaaagccgauggaaggcuucgcuag

SEQ ID NO: 249203 - RNA, 1503 nt, Artificial Sequence
  Description of Artificial Sequence: Synthetic coding sequence
augaucauuagucauuuuccuaagugcguggccguauucgcccugcuggcacugagugucggugcccuggacacauucauagcagccguuuacgagcaugccgucauccugccuaaucgcacugaaaccccagucagcaaagaggaagcacuacugcucaugaauaaaaacaucgaugugcucgaaaaagccguuaaacuggccgcaaagcagggggcucauauaauuguaacaccugaagauggaauauauggauggaucuuuacacgggaaucaauuuacccauaccuagaagacauuccugauccaggcgucaauuggaucccuugcagagacccguggagguucgguaacacaccuguucaacaaagacugucauguuuggcgaaagauaauagcaucuacgucgucgcuaauaucggagauaagaagcccugcaacgcuuccgauucccagugcccuccagacggcagauaccaauauaacacagacguaguauucgauucccaggguaaacugcuagcuagguaccauaaguacaaucuguucgcccccgagauucaauuugauuucccuaaggacucagaacuggugaccuucgauaccccuuuuggcaaauucggaauuuuuacaugcuuugauaucuuuucgcacgauccagcagucguuguuguugaugagucgaucgauucuauucuguaccccacagccugguauaauaccuugccucugcucuccgccgugccguuccacuccgccugggcgaaggcaaugggagucaaucuccucgccgcaaacacccauaauacuucuaugcacaugacaggaucaggaaucuaugcaccagaagccgucaagguuuaccauuaugacauggaaacugaauccgggcagcuguuacuguccgaauugaaaucccgcccacgccgagagccuaccuauccugccgcaguggacuggcacgcuuaugccucaaguguuaagcccuuuaguucagagcagagcgacuuccucgguaugauuuacuucgacgaauuuaccuuuacgaaacugaaacgcaauaccgguaauuauaccgcaugccaaaaagaccugugcugucaccugacauacaagaugagcgaaaagcgaacagaugagauauaugcccugggcgcuuuugacggacuucacacaguagaggggcaguacuaucuccagauuugugcccuauugaagugccagacuaccgaccuggaaaccugcggcgaaccagugggauccgcauuuaccaaguuugaggacuuuucuuuguccggcaccuucggaacuagauauguguucccccagaucauccugucuggcucccaguuggcucccgaacgucacuacgagauauccagggacggucgcuugagaaguagaucaggggcccccuuaccugucuuaguuauggcauuauauggacgcguuuuugaaaaagaccccccacgccuggggcagggaagcggcaaauuccaauag

SEQ ID NO: 249204 - RNA, 10704 nt, Artificial Sequence
  Description of Artificial Sequence: Synthetic coding sequence
auggaaacaugugauucaccuccuaucagccggcaagagaauggccagucuacaagcaagcuaugugggacgacccagcuugauaaugaggugcccgaaaagguugcaggaauggaacccgaucgagagaauucuucuaccgacgauaacuuaaagacugaugaaagaaaaucggaggcccugcucggguucaguguggaaaacgcagccgccacucaggucacuagugcuaaggaaaucccguguaaugaaugugccacuagcuuuccaucccuucaaaaguauauggaacaccacugccccaacgcacgccugccuguucuuaaagacgauaacgaauccgaaaucucagagcuagaggacagcgauguggaaaacuuaacuggagaaauuguguaucagccagauggcucugcauauauuauugaagacagcaaagaaagcggccagaacgcccaaacaggcgccaacagcaaacucuucuccaccgcaauguuuuuggacucauuagccuccgcaggggagaaaucugaccagucugccucggcuccuaugagcuucuacccucagauuaucaacacauuucauaucgcgaguuccuugggaaaacccuucacugccgaucaggcuuuuccaaauacaagcgccuuagcaggcgugggacccgugcugcauagcuuuaggguuuaugaccuucgccacaagcgagaaaaggauuacuuaacaucugacggaucugccaaaaauagcugcgugucaaaggacgugccuaauaauguggaccuuaguaaauucgauggcugcgugucugaugguaagagaaaacccgucuuaauguguuuccuguguaaauuaucuuuuggauauauccgcagcuucguaacacaugccguccacgaccauagaaugacauugaaugacgaagaacaaaagcugcuuaguaauaagugugugagcgccauaauacagggaauugggaaagauaaagagccacucauuucauuccuggagccuaagaaguccaccuccgucuacccccacuucagcacaaccaaucuuaucggacccgaucccacuuucagagggcugugguccgcuuuucacgucgagaauggugacucacugccagccggauucgcuuuucuuaagggcuccgcaucaaccucguccuccgcagagcagccccugggcaucacccagaugcccaaagccgaaguuaaucuggggggguuguccagcuugguagugaauaccccaaucacgagcgugagucugagucacucuuccagugaauccaguaaaaugagugaaucuaaagaucaggaaaauaacugugagcguccuaaagagagcaacguguugcacccaaauggugaaugcccuguuaaguccgaaccuaccgagcccggcgacgaagaugaagaggaugccuauucgaaugagcucgacgaugaagaagugcuuggagaguugacagacuccaucgggaauaaagacuucccacuuuuaaaccagagcauaaguccuuugucauccaguguauugaaguucauugagaagggaaccucuucuagcucagcuacagucuccgaugauacagaaaagaagaaacagacagccgcagugagagcauccggcaguguugcuuccaauuacggcauuucugguaaagauuucgcagacgcaucagccuccaaggacagugccacugcugcgcaccccucagagauagcccgaggcgaugaagauagcagcgcgacaccacaccagcauggauucacaccauccacaccgggaacuccgggcccugguggggaugggucacccggcagcggaaucgaaugccccaaaugugacacgguacugggaagcuccaggucgcugggcggccacaugacaaugaugcacagucggaauucaugcaaaacuuugaagugcccaaaaugcaacuggcauuauaaguaccaacagacacuagaagcgcacaugaaagaaaagcauccagaaccaggaggcucuuguguauauugcaaaacaggucagccucauccacgcuuagcacgcggcgagucuuacaccugcggauacaagccuuuccgcugcgaggucugcaacuauucuacuacuaccaagggaaaucuuucaauccauaugcaauccgacaaacaccugaacaauguccaaaacuuacaaaacggaaauggggaacaaguuuucggccacagcgcuccagcccccaacacuucucuuucagguuguggaacgcccucuccaucaaagccuaagcaaaagcccacauggcggugcgaggugugcgauuacgaaaccaauguugcacggaaccuccgaauucacaugacuuccgagaaacacaugcacaauaugaugcuucugcaacagaauaugaagcagauucagcauaaccuccaucuaggacuggcaccagcagaagcagaacuguaccaguacuaccuggcacaaaacaucggccucacuggaaugaagcuugaaaaccccgcggacccccaacucaugaucaaccccuuucaacuggauccggccaccgccgcagcacuagccccaggucucggagaguugucacccuauauuucugacccagccuuaaaacuauuucagugugccgugugcaacaaauucacuagugacaguuuagaagcccugucagugcacgucagcucugaacgcagccugccagaggaagaauggcgcgcagucaucggagacauuuaccagugcaaacugugcaacuacaacacccaacuuaaggcuaacuuucaguugcacugcaaaacagauaagcacaugcagaaguaucagcucguagcucacauaaaagaaggaggcaagucaaacgaguggcgccugaaauguauagcgaucggcaaccccguucauuuaaaauguaacgcaugugacuauuacacaaacuccgucgacaaauugagguuacacacuacaaaucauagacaugaagccgcucuuaaacuauauaagcaucuacagaagcaggaaggcgcuguuaaccccgaaaguugcuacuacuacugugcagugugugacuauacuacuaaagugaagcugaaucuggugcaacacgucagaucagugaaacaucaacagaccgaagggcuuagaaaacugcagcuccaccaacaggguuuggcccccgaggaagauaauuugucggaaaucuucuuuguuaaagacugcccuccgaaugaacuggagacugcuucauuaggggcacgaacaugcgaugacgauuugaccgagcaacaugaggaagccgaaggagcaaucaagccaacagcagucgcagaagacgacgagaaagacaccagugagcgcgacaacagugaaggaaagaacucuaauaaggacucagugaguguggccggcggcacucaaccuuugcuccuugcaaaagaggaggauguugcuacuaagaggaguaagccuacggaggauaauaaguuuugccaugagcaauuuuaucaaugcccauauuguaacuauaauuccagagaccagagcaggauucaaaugcaugugcugucccagcacuccguacagcccgugaucuguugcccucucugccaggacguguuaagcaauaaaaugcacuugcagcugcaccuaacucaucuccauucaguguccccagauuguguagaaaaguugcugaugacgguuccagucccagacguaaugaugccuaacuccaugcugcugccugcugcagccuccgagaaaucagagcgggauacuccagccgccgugacagccgaaggaucuggcaaguauaguggcgaaagucccauggacgauaaaagcauggccggucuagaagauuccaaagccaacgucgaggugaaaaacgaggagcaaaaacccacuaaagaaccgcuggaggucuccgaauggaacaagaauagcuccaaggacgugaaaaucccugauaccuuacaagaccaguuaaaugaacagcagaagcgccagccucugagcgugagcgacagacaugucuauaaguaccguuguaaucauugcucacuagcguucaagacgaugcagaaauugcaaauacacucgcaguaccacgcaauuagagcagcuaccauguguaaucugugccaaagauccuuucgaacuuuucaagcacucaaaaagcaccuugaggccggacauccagaacucucagaggcagagcuccaacaacuauaugcgucauuaccggugaacggggaauuaugggcagaaagcgagacaaugagucaagaugaccacggccuggaacaggagauggagagagaauacgaaguagaucacgaggguaaagcuagcccugugggaagugauaguuccagcauuccagacgauaugggaagcgaaccaaaaagaacacugccuuuucgcaaggggcccaauuucacaauggagaaauuccuggacccaagcaggccauauaaauguacggugugcaaagagucuuuuacccaaaagaacauacugcugguccauuacaacagugucucacacuuacauaagcucaaaaaaguauuacaggaagccuccagcccagugccacaggagacuaacucgaacacugauaauaagcccuacaaguguaguauuugcaacgucgccuacucucaauccagcacucucgaaauccacaugaggagcguucuccaccagacuaaagcaagagcagccaaacuugaaccaaguggacauguggccggcggucacagcauagcugcaaauguuaauucuccggggcagggaaugcuugauucuaugucacucgccgccgucaauaguaaagacacacaccuggaugccaaagaauuaaauaaaaagcagacccccgaucucaucagugcccagcccgcccaucauccaccccaaucucccgcucagauccagaugcaguugcagcaugaacuccagcaacaagccgccuuuuuccaaccucaguuucugaaccccgcauuccugccccacuucccaaugaccccugaggcccucuugcaguuccagcaaccccaguucuuguucccuuuuuacauccccgggacagaguuuucauuaggcccugauuuaggacugccaggcagugccaccuuugguaugccaggaaugacaggaauggccggaagccuccucgaggacuugaagcagcaaauccagacucagcaucacgucggacaaacucaacugcagauccuccagcagcaagcccagcaguaucaagccacucagccacagcugcaaccccagaagcaacaacagcagcccccaccaccccaacagcaacagcagcaacaggcaucuaaauuauuaaagcaggagcaaucuaauaucgucagcgcugacugucagauuaugaaggacguuccaaguuacaaggaggcagaggacauuucugagaagcccgaaaaaccaaagcaagaauucaucagcgaaggagagggacuaaaggagggcaaggacaccaaaaagcagaaaagucucgaacccagcauaccacccccccggauagccaguggagccagagggaaugcggcaaaagcccuccuggagaauuuuggguuugaacuggucauccaauauaaugaaaacagacagaagguucagaaaaaggggaagucuggugaaggagaaaauaccgauaaacucgaaugcgguacauguggcaaacuuuucucuaacguccucauucugaaaucccaucaagaacauguccacggccaguuuuucccauacgcggcacucgagaaauuugcuaggcaauaccgagaagccuaugacaaacuuuaccccauuaguccaucuucacccgaaacccccccuccgccucccccuccacccccacuaccacccgccccgccacagccuagcucaaugggcccugugaaaauuccuaacaccguguccacgcccuugcaggccccaccuccuaccccaccaccuccuccuccgccgccccccccuccaccuccaccacccccuccaccgccuccuagcgcccccccccagguacagcucccuguaagccuugauuugccacuguuucccuccaucaugaugcagccuguacagcacccagcccugccuccacagcuugcccuucaacuaccacaaauggaugcucuaucagcugaucuuacucagcugugccagcagcaauuaggccucgacccaaacuuucuucgacacagccaguuuaaacgccccaggacuaggauuaccgaugaucagcugaaaauucuacgggccuacuucgauauuaacaacagccccucagaagaacagauccaagagauggccgagaagagcggguugagccagaaagugaucaagcauugguucaggaacacacucuucaaggaaaggcagagaaauaaagacuccccauauaacuuuucuaaccccccuauuaccguacuugaggacauuaggaucgacccucagccgacuucuuuagaacauuauaaaucagacgcuucauuuagcaaaagaucuucgcggacccgauucaccgauuaucaacuccgagugcuacaagacuuuuuugauaccaacgccuaucccaaggaugacgaaauugagcagcugaguacagugcugaaccugccaacacgcgugauuguggucugguuccagaacgcacgccagaaagcaagaaaaucguaugaaaaucaggccgagaccaaagauaaugaaaaaagagaacugaccaaugaacguuauauucgcaccuccaauaugcaguaccaauguaaaaaaugcaaugugguuuuuccaagaauuuucgaucucauaacacaucagaagaaacagugcuacaaggaugaggaugaugaugcacaggacgagucucaaacagaagauucaauggacgcaacugaccagguuguguacaagcacugcaccguguccggccagacugaugcagcaaaaaaugcggccgcgccugccgccagcagcgggagcggaaccaguacuccacucauuccuucgccaaaacccgaacccgaaaagacauccccuaagcccgaguacccagcggaaaagccaaaacaguccgauccaagcccaccaucacagggaacuaaacccgcccuucccuuagccaguacauccuccgaccccccucaggccagcacugcacaaccucaaccccaaccacaaccuccgaagcagccacagcuuaucgguaggccccccucagcuucacaaaccccugucccuucauccccccugcagaucaguaugacuucucuccaaaauagccucccaccgcagcuccuccaguaccagugugaccaaugcaccguggcuuuuccuacguuagaacuguggcaggaacaccagcacaugcacuuucucgccgcucaaaaucaauuccugcacucucccuuucuagaacgcccaauggacaugccguacaugaucuuugauccaaauaacccucucaugaccggacaguuacuugguucuucucucacacagaugccgccacaagcuagcaguagccauacaaccgcucccacaacaguugccgcuuccuugaagagaaagcuggacgauaaggaagauaauaauugcagugagaaagaaggcggaaacucaggggaagaccaacacagggacaaacgcuugagaacaacaauuacuccugaacaacuagaaauccuguacgagaaguaucuguuggauuccaaccccacaagaaaaauguuggaucacauugccagagaagugggccugaagaaaagggucguucaggucugguuucagaauacgcgcgcccgcgaacgaaagggccaguuuagagcagucgguccagcccagucccacaaaagaugcccuuucugucgcgcccucuucaaagcaaaaucugcgcuggagucccacauuaggagucggcauuggaacgaagguaagcaggcaggauacucucuuccuccaucaccacuuauuuccaccgaagauggcggcgagaguccccagaaauacaucuacuucgauuauccauccuugccccucaccaaaaucgaccucuccagugagaaugaguuagcaagcacugugaguaccccagucagcaagacagccgaacuaucccccaaaaaccuccugagucccucuagcuuuaaggccgaguguucagaggacguggagaaccugaacgccccacccgcagaggcagguuacgaucagaacaagacggacuuugacgaaacauccuccauaaacacugcuauuuccgacgcaacuaccggagacgaagguaacacugaaauggaguccaccaccgggaguucaggugaugugaaaccugcccuuucaccaaaagagcccaaaaccuuggauacacuuccuaaaccugccacuaccccgaccaccgaaguaugcgacgauaaguuccuguucucgcucaccucacccagcauccauuucaaugacaaagacggcgaucaugaccagucauucuacaucaccgacgaucccgaugauaaugcagaucgauccgagacaucuucuauugcugaucccucaucaccgaacccauuuggauccagcaacccuuuuaaaaguaagucaaacgauaggccuggccauaagcgauucagaacccaaaugagcaaucuccaauugaaaguucucaaggcguguuucagcgauuacagaaccccuacaaugcaggaaugugaaaugcuugggaacgagauuggucugccuaaaagaguggugcaggugugguuccaaaaugcuagagccaaggaaaaaaaguuuaagauuaauauagguaaaccauuuaugauuaaccagggagggaccgagggcaccaaacccgagugcacauugugcggcguuaaguacucugcucgucugagcaucagagaucacauauucagcaagcagcauauaagcaaagugagagagacagugggaucacagcucgacagggagaaagauuaucuggccccuacuacaguccggcaacuuauggcccagcaagaacucgacaggauuaagaaggccucugacgugcucgguuugacggugcaacagccaggcaugauggauucaagcagcuuacacggaaucagccucccuacagcuuacccaggcuugcccgggcucccaccgguccuacuacccggcaugaacggccccaguuccuugcccggguucccccagaacuccaauauugcaucaggcauguuaggauuuccuacaagcgcuaccuccucucccgcccugagccucucuucagcucccaccaagccccugcugcagacccccccuccucccccacccccccccccaccacccccauccuccagccuuuccggucagcagacagagcagcagaacaaagagucagaaaaaaaacagaccaaaccaaacaaagugaaaaagauaaaggaagaggaguuagaagcgacaaaaccagagaaacacccgaagaaggaagaaaaaauuaguagugccuuauccguccugggaaagguggucggcgagacccauguggauccaauucaacuacaggcacugcagaaugcaauagcaggagauccagccuccuuuauugggggccaguuucuucccuacuuuaucccuggauucgccuccuacuuuaccccccagcuccccggcacaguccaaggaggguauuuuccacccgucugcgggauggaaucacuguuuccauacggcccaacgaugccucagacacuggcuggauuaucuccaggcgcccuacuucagcaguaucagcaguaucagcagaacuugcaggaaagucuucagaagcagcaaaagcagcagcaggagcagcagcaaaaaccaguucaagcuaagaccuccaaaguagagucagaucagccccagaauucaaacgaugccuccgagacaaaagaagacaagagcaccgccaccgaaaguacuaaagaagagccccaacuggagucuaaguccgccgauuuuucugacacuuaugugguuccauucguuaaguaugaguuuauuugucgcaagugccaaaugauguucacagaugaggaugccgcugugaaccaccaaaaguccuuuugcuacuucggacaaccucugauagacccccaggagaccgugcugcgcguuccuguuaguaaguaccaaugcuuggcaugugacguggccauaucugggaacgaggcucuuucccaacacuuacagucuucccuacacaaagaaaaaacuaucaaacaggccaugcgaaaugcuaaagaacauguccgucuucucccccacagcguguguuccccuaaccccaauacaaccucuaccagccagucagccgcaucuucaaauaacaccuacccacaccugagcugcuucaguaugaaguccuggccuaacauccuauuucaggcauccgcccgacgagccgcgagcccccccaguuccccucccucccuguccuugccgaguaccgucacuucaagccuguguuccacauccggagugcaaacuagccugcccacagagucaugcagcgaugaguccgacucugagcugagccaaaaacuggaggaucuugauaacucacuugaagugaaagccaaaccagccaguggccucgaugguaauuucaauagcauucguauggauauguucuccgucuag

SEQ ID NO: 249205 - RNA, 1821 nt, Artificial Sequence
  Description of Artificial Sequence: Synthetic coding sequence
augacucugcugacauucagggacguugcuauugaauucagccuggaagaauggaagugucuggaccuagcacagcagaaccucuacagggaugugauguuggagaacuaccguaauuuauuuucugugggccucaccgucuguaagcccggauuaauuacaugucucgagcaaaggaaagaaccuuggaaugucaagcgccaagaagccgccgacggacacccagaaauggguuuucaucaugccacccaagcgugucuggagcugcugggaucgagcgaccugccggccucugcaagccagagcgccgguauaacaggcguuaaccaucgugcacagccugggcucaacguguccguagauaaguucacagcgaugucuucccacuucacucaggauuuguugccagagcaggggauccaggaugcuuuuccuaaacgcaucuugcguggcuacgguaacuguggacucgacaaucuguacuugagaaaagauugggaaagcuuagacgaaugcaaauuacagaaggacuauaacggguuaaaucagugcagcuccaccacucauagcaagaucuuccaguauaauaaauacguaaaaaucuuugacaacuuuucaaaucugcacaggcgcaauaucucaaacacaggcgaaaagccauuuaaaugccaagaaugcgguaagucguuucaaaugcucucauuccuaacagaacaccagaagauccauaccggcaagaaguuucagaaguguggugaaugugggaagaccuuuauucaauguagccauuucacugaacccgaaaacaucgacacgggggagaaaccuuacaaaugccaggagugcaauaacguuauuaagacuugcucuguauuaaccaaaaaccgaauuuaugccggaggcgagcauuacagaugcgaggaguucggaaaaguguucaaccagugcagccauuuaacugaacaugagcaugguacggaagaaaaaccauguaaguacgaggaguguucaagcguguucaucuccuguucguccuuaaguaaccagcaaaugauauuggcuggggaaaaacucucuaaaugcgaaacaugguauaaaggauuuaaccacucucccaacccgucaaagcaccagcgaaacgagauuggcggaaagccguuuaagugcgaagaaugugauuccaucuucaaaugguucuccgaucugacgaagcacaaaagaauucacacaggagaaaaaccuuauaagugcgacgagugcggcaaggcuuauacucaaucaucacaucugagcgaacaucgacgcauacauacaggagaaaaaccauaccagugugaggagugcggcaaaguguuccggacauguagcagucuguccaaucacaaacgaacccauucagaagaaaagcccuacacuugcgaagaaugugguaacauuuucaaacaguugucugaucuuaccaagcacaaaaaaacccauacgggugaaaaacccuacaaaugcgacgaauguggcaaaaacuuuacccagucguccaaccugaucguccacaaacggauccauacgggggagaaaccauacaagugugaagaaugcggcaggguguucaugugguucucagacaucacuaaacacaagaaaacccauacuggagaaaaaccguauaaaugugacgaauguggcaagaauuucacccaguccagcaaccucauuguccauaaaagaauacacaccggagaaaaaccuuacaaaugcgagaaaugcggaaaggcuuucacucaguucagucaccuuacaguccacgagucaauacacacauag

SEQ ID NO: 249206 - RNA, 3804 nt, Artificial Sequence
  Description of Artificial Sequence: Synthetic coding sequence
augggcgauaugaaaacacccgacuuugacgauuuacuggcugcuuuugacaucccagacccaacuucacuagacgcuaaagaggcaauacaaacacccagcgaggagaaugagucaccccuuaagccacccggcauuuguauggacgaguccgugagccucagccauuccggaagcgcaccagaugugccagcaguuagcgucaucgucaaaaacacuucuagacaggaaucauuugaggccgaaaaagaccauaucacaccaucucuccugcauaacggauuccgagggucugaucugccaccugauccacauaacugcggcaaguucgacucuaccuucaugaauggggacuccgcccgaucauucccuggaaagcuggaacccccgaaaucugaaccucugccaacauucaaccaguuuagcccuauuagcucaccugagccugaggaccccauuaaagauaacggcuuuggcauuaaacccaagcauagcgacucuuauuucccccccccguuaggcugcggagcugugggcgggccuguccuggaggcguuagccaaguuucccguucccgagcuucacauguucgaccacuucugcaagaaggaaccuaaaccagagccauugccacucgggucucagcaagagcacgaacaguccggacagaacacaguggagccucauaaggauccugacgcuacucguuuuuucggcgaagcacucgaauucaacucacacccgagcaauaguauaggagagucaaaaggcuuagcucgcgaauugggaaccuguuccucagucccuccucgacagcgacuuaagccggcacacuccaaacugucuucaugcguugcagcauuaguagcccugcaggcaaagcgcguggcuagcguuaccaaggaggaccaaccaggccacacgaaggaccugagcggacccacaaaggaaagcucaaaggguucaccaaaaaugcccaagaguccuaaauccccccguucaccacucgaggccacccgcaaaucaauuaagccaagcgauagucccagaaguaucuguucugauuccuccucuaagggcucaccauccguggccgcuucuuccccucccgccaucccuaaaguacguauuaaaaccaucaagaccagcucuggcgagauuaaaagaaccgugaccagaauucucccugaccccgacgaccccuccaaaaguccugucgggaguccacugggauccgcaauagcugaagccccaucugaaaugccuggcgacgaagugcccguagaggaacacuuccccgaggcugguacuaacagcggaucaccccaaggagcgcguaagggcgaugaaucuaugaccaaggccuccgacucaucuagcccguccuguucauccggccccagagugccuaaaggagccgccccaggcucacagaccggcaagaagcaacagucuacagcacugcaggccucuacacuggccccagccaauuugcugccuaaagcgguccaucuagccaaccugaaucucgugccacacagcguugcagcgagcgugaccgccaaauccuccguucaaagaaggucccagccccaguuaacccagaugucugugccauuaguccaccagguaaagaaggcugccccccugauuguggaaguguucaacaaggucuugcacuccucaaauccaguaccccuauaugcccccaauuuauccccccccgccgacucucggauacaugucccagccucugguuacuguugucucgagugcggugacgccuuugcucuugagaagagucugucucagcacuauggucgucgcucuguucauauugaaguuuuguguacucuguguagcaaaacccuguuauucuucaacaaauguagccugcuaagacacgcucgagaccauaaguccaaaggccuugugaugcagugcagucagcuauuagugaaaccaaucagcgccgaucagauguucgugagcgccccggugaacaguacagccccagccgcaccagccccaaguucaaguccaaaacaugggcucaccucagguagugcaucuccgccaccucccgcacuaccgcuauacccagauccaguacgccuaauuagguauucaauaaagugccuugagugucacaaacagaugcgcgacuacauggugcuagcugcucacuuucagaggaccacggaggaaacggagggccugacaugucaggugugccaaaugcugcuucccaaccagugcucuuucugcgcccaccagagaauucaugcccacaaguccccuuacuguugcccugaaugcgguguucugugccgcucugcauauuuucaaacgcacgugaaagaaaauugucugcauuacgcccgaaaagucggcuauaggugcauccacugcggcguagugcaucucacccucgcgcugcugaagucccauauacaagaaaggcacugccaggucuuucacaagugugcuuuuugccccauggccuucaaaaccgcuagcucuaccgcggaccacagcgccacucagcaccccacucaaccgcaucggccuucccagcucauuuacaaaugcucaugcgaaaugguguucaacaaaaaaagacacauacaacagcacuuuuaccagaaugucaguaagacucaggucggcgucuucaaaugucccgaguguccccuccuguuugugcaaaagccugaauuaaugcagcauguaaaguccacacauggaguaccuagaaauguugacgaacuuagcagccugcaaucauccgccgacacauccucuucucguccugggagucggguucccacagaaccaccagccacaagcgucgcagcaagaucuaguucacucccuagugggagauggggacgcccagaggcacaccgccguguggaagcacgcccucgacuucguaauacugguuggaccugucaggaaugucaggagugggugcccgacagggagaguuaugugagucacaugaagaaaagucaugggcguacucuuaaacgguacccaugucgccagugugaacagagcuuccauaccccuaacucacuaagaaaacacaucagaaacaaucaugacacagugaagaaauucuacacuugcggauauuguaccgaagacucccccagcuuuccaagaccuucccuacuagagucucacaucagccucaugcaugggauccggaacccagaccucagccaaaccuccaagguuaagccucccggcgggcacuccccacaaguaaaucaucuuaagcggcccguuuccggcgugggugacgccccaggaacaaguaauggagccaccgucucaagcacaaaaaggcacaaaucacucuuucagugugcgaagugcuccuuugccacggauucaggucuggaauuucagucccacauuccccagcaucaggucgacuccagcacggcccaaugucuacucuguggacucugcuacacuuccgccucaagcuuaucccgucauuuguucauuguucauaagguacgcgaucaagaagaagaagaagaagaagaggccgcugccgccgaaauggccguggaaguugcugagccugaagaagguaguggcgaggaggugcccauggaaacgagagaaaaugguuuagaagaaugcgcuggcgagccguuaucagcugauccggaagcacgacgccucuuaggacccgccccggaggaugauggaggacacaaugaucauucacagccccaggcuagucaggaccaagauucacacacguugucaccucagguuuag

SEQ ID NO: 249207 - RNA, 2406 nt, Artificial Sequence
  Description of Artificial Sequence: Synthetic coding sequence
auggacgaagacgaguucgagcuccaaccacaggaacccaacaguuuuuucgacggaaucggggcggaugcgacucacauggacggcgaucagauugugguggaaauucaagaagcaguguuuguuucaaacauagucgacucagacaucacggugcauaacuuuguuccugaugacccagauuccguggucauucaggacguuguggaagacguaguaauagaggaagauguucaauguuccgauauucuggaagaggcagaugugagcgagaaugugaucaucccagaacagguguuggacagcgacgucacagaagaagugagccucccacacugcaccgucccagaugauguccuggccucugacaucacuagcacaucaaugucuaugccugagcacguuuugacuucugaguccaugcaugugugcgauauuggucacguggagcacauggugcaugauucugucguugaggccgagauuauaaccgacccucugacuucagauauugugagcgaggaaguauuagucgcugauugugccccagaagcagugauagacgcaucuggaauuaguguugaccaacaagacaacgauaaagcaagcugugaggauuaucucaugauuagccuggaugaugcugggaagauagagcaugaugguucaaccggggugacgaucgacgcugagucugagauggacccuugcaaaguugauagcacaugcccugaaguuauuaaaguguacauuuuuaaagcugaccccggcgaggaugaccugggcggcacaguagacaucguggaguccgagcccgaaaaugaccacggagucgaacuguuggaucaaaacagcuccauucgcgugccaagagagaagaugguguauaugacugugaacgacagucaacaggaggaugaagaucucaauguugcugaaaucgcagaugagguguauauggaaguaauugugggugaagaggaugccgcuguggccgccgccgcggcugccgugcacgaacagcaaauagaugaggaugaaaugaagacuuuugugccuauugccugggcugccgccuauggaaauaauuccgacgggauugagaaucgcaauggcacagcuagcgcacugcuucauauugacgagucggccggauuaggcagguuagcaaagcagaaacccaagaagaaacggagaccugacagcagacaguaucaaacagcaaucauuauuggucccgauggccacccuuugacaguuuauccaugcaugaucugcggcaaaaaguuuaagagucgcggcuuucucaaaagacauaugaagaaucacccagaacaccuggccaagaagaaguaccacuguacagauugcgauuauaccacaaauaagaagaucucacuccacaaucaccuggagucccacaagcugacuagcaaagcagaaaaggcuauugaaugcgacgagugcggcaaacauuucucccacgccggagcccucuucacccacaaaaugguucacaaggagaagggugccaauaaaaugcacaaguguaaauucugcgaauacgaaacagccgaacagggccugcugaaccgacacuuacucgcagugcauagcaagaacuucccacacaucugcgucgaaugugguaaaggauuucgccacccaucagaacugcgaaaacauaugcgcauacacacaggggagaaacccuaucagugccaauacugcgaauauaggucagccgacucuucuaaccugaaaacccauaucaagacaaaacauaguaaagagaugccauuuaagugcgauauuuguuugcuuacuuuuucagauaccaaagaagugcagcaacauacucuuguucaucaggaauccaagacccaucagugucuucauugcgaccacaaaucgaguaauagcagcgauuuaaagaggcacgugaucuccgugcacacaaaagauuauccccacaagugcgagaugugcgaaaaaggcuuccaccggccuucugagcugaagaaacauguagcgguacacaagggaaaaaaaaugcaucaauguagacacugcgauuuuaagauugccgaccccuuugugcugagcagacauauucucagcguccauacgaaggaucuccccuuuagauguaagaggugucgaaaaggguuucgccaacagaacgaauuaaagaaacauaugaaaacucauucugguagaaaaguauaucagugugaauauugcgaguacuccaccaccgacgcauccggcuuuaaacgacacgucauuuccauccacaccaaagauuauccgcaccguugcgaauacugcaagaaaggguuucgucgaccuagugaaaagaaucaacauaucaugcgacaucauaaagagguuggguugccuuag

SEQ ID NO: 249208 - DNA, 1176 bp, Artificial Sequence
  Description of Artificial Sequence: Synthetic coding sequence
atggcctcccacaaactgttagttaccccgccaaaggccctcctgaagcccctatccatccccaaccagctgcttttgggcccgggaccctccaacctgcccccccggatcatggcggcaggaggtttacagatgatcggcagcatgtcaaaggatatgtatcagattatggacgaaatcaaggagggaatccaatatgtgtttcaaacacgcaatcccctgacattggtcatttcgggaagcggtcactgcgccctagaagccgcccttgtaaatgttctggagcccggagactcctttctggtgggcgcaaacggcatctggggacagcgcgcagtggacatcggggagaggattggcgctcgggtccacccgatgaccaaagaccccgggggccactacaccctgcaggaggtggaggaaggactggctcagcacaaaccggtgctgttgttcctcacccacggagagtcgagcaccggcgtgcttcagcccctcgacgggttcggcgagctgtgtcaccgatacaagtgcctcctattagtggacagcgttgccagcctcggaggaacacctctgtatatggatcgccagggcatcgatatcctgtatagcggttcccagaaggcgcttaacgcgccgcccggcacatcactgatctctttcagtgataaagcaaaaaagaaaatgtactcacgtaagactaaaccattcagcttttatctcgatatcaaatggctagcaaacttttggggatgtgacgaccaaccccgcatgtatcaccacaccatccctgttatttctctctactccctgcgggaatccctggcactgattgcggagcagggattagaaaattcgtggcgccagcatcgtgaggccgccgcatatctacatggtcggttgcaggccctcgggcttcagctcttcgtcaaggacccagcgttgaggctgccgacggtgacgacggtagctgtgccggccggatacgattggcgtgacatagtgtcatatgtaattgatcatttcgatatcgagatcatgggggggcttggcccgagcaccgggaaggtgctgcgcatcggtttactgggctgtaatgccacccgggagaatgtcgacagagtgacagaggcgctgcgagccgccctgcaacactgtccgaagaagaagctg

SEQ ID NO: 249209 - DNA, 1176 bp, Artificial Sequence
  Description of Artificial Sequence: Synthetic coding sequence
atggcaagtcataagcttctggtcacaccccccaaagccttactgaaacctctttccattcccaatcaactgctcctcggccctgggccgagtaacctgcccccccgcatcatggctgccggtggactgcaaatgattggttccatgtccaaagacatgtaccagatcatggacgaaatcaaagaaggcattcagtatgtgttccagactcgaaacccactgacgctggtaatttcgggatctggtcactgtgctctcgaggccgcactggtcaatgttttggaaccaggcgattccttccttgtaggagcaaatggaatttgggggcagcgagccgtcgacattggggaaagaatcggcgcaagggtgcaccctatgacgaaagaccctggcgggcactacacactccaggaagtcgaggaaggtttagctcagcataagcccgtgttactcttcctgactcatggtgaaagctcgacgggggtgcttcaaccgttagatgggttcggcgagctgtgtcataggtataaatgtctcctcctggttgatagcgttgcctcacttggtggtaccccgctatatatggacaggcagggaatcgatatcctctacagtggatctcagaaggctttaaatgcgccgccaggcactagcctgatcagcttctccgacaaggctaagaaaaagatgtacagcaggaagaccaagcccttctccttttatctggatatcaagtggttggccaacttttgggggtgtgacgaccagccacgcatgtaccaccacactatccccgtcatctctctttattctcttagagagtccctcgccctcattgctgagcaggggctggagaattcatggagacaacatagggaggccgctgcttacttgcatggacgactccaggccctgggactgcagctatttgtgaaagacccagccctgaggctccccactgtcaccactgtggcagtccccgcagggtatgattggagggacatcgtgagttacgtgatcgaccacttcgatatcgaaattatggggggattaggcccttctactggcaaggtccttaggattgggcttctagggtgcaacgccacccgagagaacgtggatagagttacggaggctttgagggctgcactgcaacactgccccaagaagaagctg

SEQ ID NO: 249210 - DNA, 1176 bp, Artificial Sequence
  Description of Artificial Sequence: Synthetic coding sequence
atggcgtcccataagctgctggtgaccccgccgaaggccctcctcaagccgctttcgatcccaaaccagctcctgctgggtccaggaccgagcaatctgcccccgcgcatcatggccgcaggaggactgcaaatgatcggatcgatgtccaaggacatgtaccagattatggacgaaatcaaggaagggatccagtacgtgttccaaactagaaatccactgaccctggtcatctcgggatcgggacattgtgccctcgaagccgccctggtcaacgtgctcgaaccaggagactcgttcctggtcggagccaacggaatttggggacaacgcgccgtggatatcggggaaaggatcggcgctcgcgtgcatccgatgaccaaggacccaggagggcactacacgttgcaggaagtggaagaagggttggctcagcacaaaccagtccttctcttcctgacccatggagaatcatcgaccggagtgcttcaaccacttgacggattcggagagctctgccacagatataagtgcctgctgctggtggacagcgtcgcctcccttggcggaactccgctgtacatggaccggcaaggaatcgacatcctgtacagcggaagccagaaagcgctgaatgcgcccccaggtacctcactgatttcgttctcagataaggcaaagaaaaagatgtactctcgcaaaaccaagccgttctccttctacttggacatcaaatggctggctaacttttggggctgcgacgaccagccgcggatgtatcatcacaccatacccgttatctcgctgtactcactgagagagtccctggccctcattgccgaacagggactcgaaaactcgtggcgacagcaccgggaggccgcagcctacctccatggaagattgcaggcactgggcctccagctgttcgtcaaggacccagcgctgcggctcccgaccgtgactacggtcgctgtcccggctggctacgactggagagatattgtgtcgtacgtgattgaccactttgacatcgagatcatgggtggcctgggaccctcgactggtaaggtgctgcgaattggcctcctggggtgtaacgcaacgcgcgagaatgtggatcgggtgacggaggcactgcgcgccgctttgcagcactgccccaaaaagaaactg

SEQ ID NO: 249211 - DNA, 1176 bp, Artificial Sequence
  Description of Artificial Sequence: Synthetic coding sequence
atggctagccacaaactccttgtcacacctcccaaggctctcttgaagcccttgtctattcccaatcagctcctcctcggcccgggccccagtaatctcccacctcgaatcatggctgccggggggcttcagatgatcggctccatgagcaaagacatgtaccaaatcatggacgagatcaaggagggtattcagtacgtgttccagactcgcaatccactgactctcgtgatcagtgggtccgggcactgtgccctggaggctgccttggttaacgtgctcgaaccaggcgattctttcttggttggcgcaaacgggatctggggacaaagagccgtggatatcggtgagagaatcggtgctcgcgtccacccaatgacaaaggatcccggcggccactatactttgcaggaggtggaagagggtcttgcccagcacaagccagtcctgctgttcctgactcacggggaatcctctaccggtgttctgcagcccctggacgggtttggggaactgtgccataggtataagtgtctgctcctggttgacagtgtcgcctccctgggcgggacacctctgtacatggaccgacagggtattgacattctctacagcggatcccagaaggcactgaacgctccaccagggacgtctctcatcagcttcagcgacaaagcaaagaagaagatgtattctagaaagacaaagcctttcagtttctacttggacattaagtggctggccaacttttggggctgcgacgaccagccccggatgtatcatcatactatcccagtgattagcctgtactctctgcgggaatctctcgccctgatagctgagcagggtcttgaaaattcctggcgccagcatcgggaagcggcggcatatctgcacggccggctgcaggcccttgggttgcagctgttcgtgaaggacccagctttgcgcctgcctactgtcactaccgtggccgtacctgccggctatgattggcgggacattgtttcctatgttatagaccacttcgatatagagattatgggagggctgggcccgtctactggtaaggtgctcaggatcggtcttttgggctgcaatgccactcgcgaaaatgtggatagagtgaccgaagcgctccgagcagcgcttcagcattgtccaaaaaaaaaactc

SEQ ID NO: 249212 - DNA, 1176 bp, Artificial Sequence
  Description of Artificial Sequence: Synthetic coding sequence
atggcctcccataaacttctcgtgactccgccaaaggcattgctgaagcccctgtcgattccgaaccaacttcttcttggacctgggccaagcaatctgcctcctagaattatggccgctggagggcttcaaatgattgggtcgatgagcaaagatatgtaccagattatggacgagattaaggaagggatccagtacgtctttcaaacgcgtaatccccttacccttgtgatatctggtagcggacactgtgcacttgaagcagcactggtgaatgttctggaacccggagatagctttttggtgggtgcaaacggaatctggggccagagagcggtggatattggcgaaagaattggggctcgtgtgcatccaatgaccaaggaccccggcggccactacactcttcaagaagtggaggaagggcttgcgcagcataagcctgtccttttgtttctgacccatggagaaagctccaccggggtgcttcaaccactggatggatttggagagctctgccaccggtacaagtgcttgcttctggtcgactccgtggcatccctgggtggaacccccctctacatggaccggcagggtattgatattctttactccggatcacagaaggcactgaacgcacctccgggaacttcgctgattagcttttccgataaggcaaagaagaagatgtattcgcgtaagaccaaacctttctcgttttacttggacatcaaatggctggcaaacttctggggttgtgacgaccaaccacggatgtaccatcatacgattccggtgatctcattgtacagcctgcgggagtccctcgccctgatcgcagagcagggactggaaaacagctggaggcagcatcgggaagccgccgcttacctgcatggtagactccaggcacttgggctgcaattgtttgtgaaggacccagctttgcgtctgccaactgtcactactgtcgcagtccctgcaggttacgactggcgcgacattgtctcgtacgtcattgaccatttcgatatcgagatcatgggcggtctgggcccatccactggcaaggtccttagaattgggcttcttggttgcaacgccaccagagagaatgtcgatcgggtgaccgaagccctccgcgccgctctccaacactgcccaaagaaaaaactt

SEQ ID NO: 249213 - DNA, 1176 bp, Artificial Sequence
  Description of Artificial Sequence: Synthetic coding sequence
atggcctcccataagttacttgtaacgccgcctaaggcacttctgaaacctctatccatacctaatcagctccttctaggccccggccccagcaacctgccaccccggatcatggccgcaggggggctgcagatgatcggttctatgtccaaagatatgtaccagatcatggatgaaattaaagaaggaatacagtatgtttttcagacccgcaatccattgactctggtgatcagtggttctggtcattgcgcccttgaagccgcattagtgaatgtgcttgagccaggggactcgtttcttgtaggcgctaatggaatctggggccagcgggctgtggatatcggagagcgcataggcgctagggtccaccccatgaccaaggatccaggtggtcactataccctgcaagaagtggaggaggggcttgcccagcataaaccagtgctcctgttcctaacgcacggagagagtagcacgggcgtcctgcagccactcgacgggttcggcgaattgtgtcaccggtacaagtgtttactgctcgtcgactccgtcgcttctctgggggggaccccactgtacatggatagacagggaatcgatatcctgtacagcggctcccaaaaagcgctcaacgcacctccagggacatctctgatctccttttctgataaagctaaaaagaaaatgtactcacggaagacgaaacctttttccttctatctcgatattaaatggttggctaatttttggggatgtgacgaccagcctagaatgtatcaccatactatccctgtcatctccctgtactcactgagggaatcgctcgcgctgattgcagagcaggggttggagaattcgtggagacagcaccgcgaagcagcggcttatctacatggccgcctacaggctttgggcctgcagttattcgtgaaagatccagccctcagactgcccactgtcactaccgtggccgtccccgccggctacgactggagggacatcgtaagctacgtgatagaccacttcgacatcgagataatgggtgggctcgggccatcaacgggaaaagtgctgagaatcggcctactgggctgcaatgcaacacgggaaaacgtggaccgcgttacagaggctttgcgtgcagccttgcagcactgtcctaaaaaaaagctc

SEQ ID NO: 249214 - DNA, 1176 bp, Artificial Sequence
  Description of Artificial Sequence: Synthetic coding sequence
atggcttcccataagctgttggtcacgccgccgaaggccctgctcaagcctctttcgatccccaaccagctgttgttgggtcccggaccttcgaatctgccccccaggatcatggccgctggcggtttacaaatgataggctccatgtccaaagacatgtaccagatcatggatgagattaaagagggcattcaatacgtctttcagactaggaaccccctgacgcttgtcatatcgggaagcggtcattgtgcattggaggccgctctggtgaacgtcctggagccgggcgactctttccttgtcggtgcgaatggtatctgggggcagagggccgtcgatatcggtgagcgtattggtgcacgtgtgcaccccatgaccaaggacccgggcgggcattacaccttgcaggaggtggaggagggcttggctcagcacaaaccagtccttctgttcctcacccacggcgagagctccactggggtgctccaaccgctggacggcttcggtgagctctgtcaccgttacaagtgcctcttgctcgtggactcggtcgcctcactgggaggcacccctctgtacatggatcgccagggtatagacatcctttactccggtagtcagaaagccctgaacgccccccctggtacttccctgatttccttttccgataaggccaagaagaagatgtatagtcgcaagaccaagcccttcagcttctacctcgacatcaaatggctcgctaatttctggggttgtgacgaccagccacgcatgtatcaccacaccatcccagtcatctccctgtacagcctgcgcgaaagtttggctctaatcgcggagcagggactggagaactcttggcgccagcatcgagaggcagccgcgtatttgcatggcagactgcaggccttaggcctgcagttgttcgtcaaggatcccgcgcttcgcctgcccaccgtgaccaccgttgccgttcctgctggctatgattggcgcgacatcgtctcttacgtgattgatcacttcgacattgaaatcatgggtggtcttggaccatctaccggtaaagtgcttcgcatcgggctcctcggttgcaacgctacgcgggagaacgtggaccgcgtcaccgaggcactcagagccgctcttcagcattgtcctaagaagaagttg

SEQ ID NO: 249215 - DNA, 1176 bp, Artificial Sequence
  Description of Artificial Sequence: Synthetic coding sequence
atggcgtcgcataaattattagtaacgccgccgaaagcgctactaaaaccgctatcgataccgaatcaactattattaggtccgggtccgtcgaatctaccgccgcgtataatggcggcgggtggtttacaaatgataggttcgatgtcgaaagatatgtatcaaataatggatgaaataaaagaaggtatacaatatgtatttcaaacgcgaaatccgttaacgttagtaatatcgggttcgggtcattgtgcgttagaagcggcgttagtaaatgttttagaaccgggtgattcgtttctagttggtgcgaatggtatatggggtcaacgtgcggttgatataggtgaacgaataggtgcgcgagttcatccgatgacgaaagatccgggtggtcattatacgctacaagaagtagaagaaggtctagcgcaacataaaccggttttattatttctaacgcatggtgaatcgtcgacgggtgtattacaaccgctagatggttttggtgaactatgtcatcgatataaatgtctattactagttgattcggttgcgtcgttaggtggtacgccgttatatatggatcgacaaggtatagatatattatattcgggttcgcaaaaagcgctaaatgcgccgccgggtacgtcgctaatatcgttttcggataaagcgaaaaaaaaaatgtattcgcgaaaaacgaaaccgttttcgttttatttagatataaaatggttagcgaatttttggggttgtgatgatcaaccgcgaatgtatcatcatacgataccggttatatcgttatattcgctacgtgaatcgttagcgctaatagcggaacaaggtttagaaaattcgtggcgtcaacatcgtgaagcggcggcgtatttacatggtcgtttacaagcgctaggtttacaattatttgtaaaagatccggcgttacgtctaccgacggttacgacggtagcggttccggcgggttatgattggcgagatatagtatcgtatgtaatagatcattttgatatagaaataatgggtggtctaggtccgtcgacgggtaaagtactacgaataggtttattaggttgtaatgcgacgcgtgaaaatgttgatcgtgtaacggaagcgttacgagcggcgttacaacattgtccgaaaaaaaaatta

SEQ ID NO: 249216 - DNA, 1176 bp, Artificial Sequence
  Description of Artificial Sequence: Synthetic coding sequence
atggcgtcgcacaaactgctggtgactccgcctaaagccctgctcaagccgctcagcatccctaaccaactcctcctgggcccgggaccatccaaccttcccccacgaatcatggcggccggaggcttgcaaatgatcggatccatgtcaaaagatatgtaccaaatcatggacgagatcaaggagggaattcagtacgtgttccagactcgcaacccgctgactctggtgatcagcggatcaggacattgcgcgctggaagcggcactggtgaacgtcctcgaaccaggtgacagctttctggtgggagctaacggcatttggggtcagagggcagtggacatcggtgaacgcatcggagctcgggtgcacccaatgactaaggaccctggcggacattacacgctgcaggaagtggaagagggactggcccagcataaacctgttctgcttttcctgacccacggagaatcctccactggcgtcctgcaaccgctggacggattcggagaactgtgtcacaggtacaagtgcttgttgcttgtcgattctgtcgcctccttgggaggaactcctctgtacatggatagacaggggatcgacattctctacagcggatctcagaaagccctgaacgcgcccccgggaacctcgctgatctcattctccgacaaagccaagaagaagatgtattcacgcaagaccaaacccttctcgttctacctggatatcaagtggctggccaacttttgggggtgtgacgaccaacccagaatgtaccatcacaccatcccggtgatctccttgtattcgcttcgagaatccctggcactcattgccgagcagggactggaaaattcctggcgccaacacagggaggccgctgcctacctccacggccggctccaggccctgggcctgcagctgtttgtgaaggacccggcactgcggctgccaaccgtgaccaccgtggcggtgccggccggatacgactggcgggacatcgtgagctacgtgatcgaccacttcgatatcgagattatgggtggacttggaccatccaccggaaaggttcttcgtattggcctgctgggatgcaatgcgacccgcgaaaacgtcgaccgcgtgaccgaggcgctgcgggccgcattgcaacactgcccaaagaagaaactt

SEQ ID NO: 249217 - DNA, 1176 bp, Artificial Sequence
  Description of Artificial Sequence: Synthetic coding sequence
atggcttctcacaagctgctggtgaccccccccaaggcactcttgaaacccctctccattccaaatcagttacttctgggcccaggccccagtaacctgcctcctcgtattatggcagccggcgggttgcaaatgattggttcaatgtctaaggacatgtatcagattatggacgagattaaagagggtatccaatatgtcttccagacacggaatcctttaaccttggtcatctctggatcgggacattgcgccctggaggccgctttggtgaatgtgctcgagccaggggacagttttctagtcggagctaacggcatctggggccagcgtgccgtggacatcggggaaagaatcggggcacgggtgcacccgatgaccaaggatcctggaggccactacaccctccaggaggtggaagaaggcctggcacagcacaagccagtgttgctgtttctaacacacggagaatcaagcaccggagttctgcaacccttggacggatttggggagttatgccataggtacaagtgcttgttgttggtggactcagtcgcatccttgggcggaacgcccctgtacatggaccggcaaggcattgatattctctactccgggagccagaaggctttgaacgccccccctggaacctccttgataagcttctccgacaaggccaagaaaaagatgtactcgagaaagacaaagccctttagcttctacctggatattaaatggctggcaaacttttgggggtgcgacgatcagccgcgcatgtaccaccacacgatcccagtgatcagcttatacagtctgagagaaagcttggctctgatcgccgaacagggtttagaaaattcctggcggcagcacagagaagcagctgcatacttacacggccggctacaggcattgggactgcagttgtttgtgaaagatcccgcgttgcgcctgccaacagttactaccgtagccgtgcccgcgggatatgattggagagatattgtgagttacgtgatcgaccactttgatattgagatcatgggaggcctggggcccagcacaggaaaagttctacgaattggactgttgggttgtaatgcgacacgcgagaatgttgatagggtcactgaggcactgcgggctgccctccagcactgtcccaagaagaaactg

SEQ ID NO: 249218 - DNA, 1176 bp, Artificial Sequence
  Description of Artificial Sequence: Synthetic coding sequence
atggcctctcataagctgttggtgacaccgcccaaagctttactgaagccactgtcgattccaaatcagctgctgttaggccccggtccatccaaccttcccccacgaattatggccgccgggggcctacagatgatcgggagcatgagcaaggatatgtatcaaattatggacgagatcaaagagggtattcagtatgtgtttcagacacggaatcctctgaccctagtgatatctgggtccggccactgcgccctggaggccgccttagtgaacgttttggaaccaggagacagttttttagtcggcgcaaatggaatctggggacagagagccgtggacatcggagaacggattggcgcaagggtccatcccatgaccaaggaccccgggggccattacacactacaagaggtcgaagaaggcttagcgcagcataagcctgtcctcctcttcctaacacacggagaaagctcaaccggggtcctgcaaccactggacggctttggcgagttatgtcacaggtacaagtgccttctgctggtggacagtgttgcctctctgggtggaactcctttgtacatggacaggcagggtattgacatcctgtatagcggttctcagaaggcgcttaatgcaccacctggaacgtcactgatctcctttagcgacaaagctaagaaaaaaatgtattcaagaaagaccaaaccatttagcttctacctagacataaaatggctggccaacttctggggttgtgacgatcagccccgaatgtaccatcatacaatcccagtcattagtctctactcgctgcgcgagagcctcgccctcattgctgagcaaggactagagaacagctggcggcagcaccgagaggccgcagcttacctgcacggcaggctacaggccctgggacttcagctgttcgtgaaggacccagctctccggcttcctactgtcacgactgtggccgtccccgctggctacgattggcgcgacattgtgagctatgttattgatcattttgatatcgaaattatgggcggtctgggcccctcaacaggaaaggtgctaaggattgggttacttggatgcaatgctaccagggaaaacgtggatcgggtgacagaggctcttcgcgcagcactgcagcactgtcctaaaaagaaacta

SEQ ID NO: 249219 - DNA, 1176 bp, Artificial Sequence
  Description of Artificial Sequence: Synthetic coding sequence
atggcttcccacaaattgctcgtgacgccccctaaggcactccttaagcctctttccattcccaaccagctccttctcggtccagggccttcgaatctcccacccagaattatggcagcaggtggcctgcagatgatcggttcaatgagcaaggacatgtaccagattatggatgaaatcaaggaaggaatacaatacgtgttccagaccagaaacccactcacccttgtgatctccggctccggacactgcgcactcgaagccgcactggtcaatgtgctcgaacctggagatagctttctggtgggagcaaatggcatatgggggcaacgcgcagtggatatcggagagcggattggagcccgggtgcaccctatgacgaaggaccctggaggacactacacccttcaggaagtggaagaggggctggcacaacacaagccagtgctcctgtttcttactcacggcgaatcctcgactggagtgctgcaacctctggatgggtttggtgaactgtgtcacagatacaaatgtctccttctcgtggattcggtcgcttctcttggagggacccccctgtacatggatcggcaggggattgatatcctttactcaggctcgcaaaaagctcttaacgcgccaccaggtacgtcgctgatttcatttagcgataaggcaaagaaaaagatgtactccagaaagaccaagccttttagcttttacctggacatcaagtggttggccaatttctggggatgcgatgaccaacctaggatgtaccatcacactattcctgtgatcagcctgtactctcttcgcgaaagcctggctcttattgcagaacaaggtcttgaaaactcgtggaggcagcatcgggaagcagctgcatacttgcacggaaggctgcaggcgctcggacttcagctcttcgtgaaggatcctgcacttcggcttcctaccgtgaccaccgttgcagtgccggcaggctatgactggcgggacatcgtgagctacgtgatcgaccattttgacattgagattatgggaggacttggcccttccaccggaaaagtccttcgtattggtctgctgggctgtaacgctaccagggagaacgtggacagagtgaccgaggcattgcgagcggcgctccagcattgtcctaaaaagaagctc

SEQ ID NO: 249220 - DNA, 1176 bp, Artificial Sequence
  Description of Artificial Sequence: Synthetic coding sequence
atggccagtcataagctgctggtcaccccacccaaagctttgctcaagccacttagcatccccaatcaattactactgggcccggggccttctaatcttcccccccggatcatggcggccggcggattgcaaatgatcggctccatgtcgaaggatatgtaccaaattatggatgagattaaggagggcatccagtacgtattccagacccgaaatcctctgacactggtgattagcggctccggacactgcgcgctcgaggccgccctggtgaacgttttagaaccaggtgactcatttctggtgggcgcaaatgggatctggggtcagagggcagtggacatcggtgagcgaataggcgcacgggttcaccctatgacgaaagatcctggaggccattatactctgcaagaggtggaagaaggactagcacaacataaacccgttctgttgtttctaacccacggtgaaagttccacaggcgtcctccagcccctcgatggcttcggggagctgtgccatcggtataagtgtctgctgctagtagacagcgtggctagtctggggggtacacccctctatatggatagacagggaattgacatcttgtactcaggctctcagaaggcacttaatgctcctcctgggacgagcctgatctctttcagcgataaagccaaaaagaaaatgtatagtaggaagactaagccgttttcgttttacctagacatcaagtggctggccaatttttgggggtgtgacgaccagcctaggatgtatcatcatacaatcccagtgatctcgctgtattccctgagggaatccctagctctgattgccgagcagggtctcgaaaattcatggcgtcagcaccgtgaagccgccgcgtatcttcacggcaggttacaggctctgggcttgcagctgttcgttaaagatcccgctctgagattgcccactgtgacaactgtagctgtgcctgccggctatgactggcgcgatattgtaagctacgtaattgaccatttcgatattgagattatggggggcctgggtccctcaacagggaaagtgctccgaatcgggctgcttggatgtaatgctaccagggaaaatgtggaccgggtaaccgaagccctgcgtgccgccctccaacactgtccaaagaaaaagctt

SEQ ID NO: 249221 - DNA, 1176 bp, Artificial Sequence
  Description of Artificial Sequence: Synthetic coding sequence
atggccagccacaaactgctggtgaccccgccgaaagcactgctcaagccgctgtctattccgaaccaactgctcctggggccggggccgtccaacttgccaccgcggatcatggcggctggaggactgcaaatgatcgggtcgatgagcaaggacatgtaccaaatcatggatgaaatcaaagagggaatccagtacgtcttccagaccagaaaccctctgaccctggtgatctccggatcgggacactgcgccttggaggccgcgctcgtgaacgtgctggagcctggagactcgttccttgtcggcgccaacggtatttggggacaacgtgcagtcgatatcggagagcgcatcggagcgcgcgtgcacccaatgaccaaggacccgggtggtcattacaccttgcaagaagtcgaagaaggactggcgcagcacaagcctgtcctgttgttcttgacccatggagagtcctcgactggagtgcttcagccactcgatggattcggggaactgtgccacagatacaaatgtctgctcctggtggattcggtggcaagcctcggaggaactccgctgtacatggaccggcagggtattgatatcctctacagcggatcacagaaggctctgaatgcaccaccaggaacctcactgattagcttcagcgacaaggccaagaaaaagatgtactcgcgcaagactaagccgttctccttctatttggacatcaagtggctggcaaatttctgggggtgcgacgaccagccccgcatgtaccatcacactatcccggtgatttccctttactccctcagagaatccctggccctgatcgccgaacagggccttgaaaattcatggcggcaacaccgggaagctgccgcctatctgcatggaaggctccaggcgctgggattgcagctttttgtgaaagaccctgcactccggcttccaactgtgaccactgtggcagtgccggccggatacgactggcgggatatcgtgtcatacgtgattgaccacttcgacatcgagatcatgggagggctgggacctagtaccggaaaggtgctgcgcatcggactgctgggatgcaacgcgactagagaaaacgtggaccgcgtgactgaagccctccgtgcggctttgcagcattgcccgaagaaaaagctg

SEQ ID NO: 249222 - DNA, 1176 bp, Artificial Sequence
  Description of Artificial Sequence: Synthetic coding sequence
atggcctcccataagcttctcgttacacctccaaaggccctgctgaaacccctctccattcctaaccaattgctcctgggtcctggaccgagcaaccttccaccgagaataatggctgcaggcggcttgcagatgatcggatccatgtcaaaggacatgtatcagatcatggacgaaataaaagagggaatacaatatgtgtttcagacgagaaatccattaactctggtcataagtggttctggccattgtgccctggaagccgcactggtgaatgtgctggagcccggggactcgttcttagtcggcgccaatggaatttggggtcagcgagcggtggatatcggtgaacggattggagcccgcgtccaccccatgaccaaagatccaggcgggcactatacactccaggaggtggaagaaggtctagctcagcataaacccgtccttctgttccttacacacggcgaatccagtacaggggtgttgcaacctcttgacggattcggggaactctgccatagatacaagtgcctgctgctggtggattcagtggcatccttgggggggacaccactgtacatggacagacagggaatcgatatcctgtattcgggtagtcaaaaggccttgaacgcgcctcccgggacctcccttatttctttctccgataaggctaagaaaaagatgtacagccgcaaaactaagcctttctcgttctatctggatattaagtggcttgcaaatttttgggggtgtgacgaccaaccccgaatgtatcatcatactatcccagtcatatccctctattcattacgcgagtcactggccctcatcgccgaacagggcctggagaactcttggcggcagcatcgcgaagccgcggcatatctgcacggaagactccaggctctaggactgcagctgtttgtcaaggacccagctctccggctgccaacagttacaacagtcgctgtgcctgccggctacgactggcgtgatatcgtgagctatgtcattgaccacttcgacattgagatcatggggggcctcggcccctctaccgggaaggttctccggatcgggcttctggggtgtaatgccacacgcgagaatgtagatcgtgtcaccgaagctcttagagccgccctgcagcactgtccaaaaaagaaactg

SEQ ID NO: 249223 - DNA, 1176 bp, Artificial Sequence
  Description of Artificial Sequence: Synthetic coding sequence
atggccagccataagctgttggtgacaccccccaaggcactcctgaagcccctctccatccctaatcagctgctcctggggcccggcccctcaaaccttccaccccggatcatggcggcaggtggcctgcagatgattggttcaatgtcaaaggatatgtaccagattatggatgagatcaaagagggtatccaatatgtcttccaaactcgtaatcccctcacactggtgattagtggctccggtcattgtgcactggaggcagctcttgtgaatgtgttagagcccggtgacagtttccttgttggcgctaacggcatctgggggcagcgggctgtggacattggagagcgcatcggggccagagtgcacccaatgacaaaagaccccggcggacactacacactgcaggaagtggaggagggtctagcccagcataagcccgtgctgctattcctaactcacggggaaagctcaacaggtgttctgcagcccttggacggttttggagagctctgtcatcggtataagtgtttgcttttggtggattctgtggcctcgctgggcgggacgccactgtatatggacaggcagggcatagatatcctgtattcaggaagccagaaggcactgaatgcacctccaggcacctccctcatctcctttagcgataaggccaagaagaaaatgtactcaagaaagacaaagcctttcagtttttacctggatataaagtggctggccaacttctggggctgtgacgaccagccgaggatgtatcaccataccatcccggtaatttcgctgtattccttgcgagagagccttgcgctgatcgccgagcagggcctggagaatagctggaggcagcacagagaggctgcggcatatctgcacgggcggcttcaagcacttggactgcagctgtttgtgaaagaccccgctctacgccttcctacagtgaccaccgtggcggtgccagcaggatacgactggcgagatattgtctcttatgtcatagatcactttgatatcgagatcatggggggtttaggaccgtctacagggaaggtgctgcgaataggcctcttaggatgtaatgcaacgcgcgagaacgtggatcgagtgaccgaagcacttagagctgcgctgcagcattgtccaaaaaaaaaacta

SEQ ID NO: 249224 - DNA, 1176 bp, Artificial Sequence
  Description of Artificial Sequence: Synthetic coding sequence
atggccagccacaagttgttggtcaccccacctaaggccctgctcaaacccctttcaatccctaaccagctcctgctggggccgggcccgtcgaacctgccgccccgcatcatggcggctggtggcctgcaaatgattggatcaatgtctaaggatatgtatcaaatcatggacgagatcaaagagggcatacagtacgtgttccagacccgtaacccgctgaccctggtcatttctggcagcggtcactgcgccctggaggcagctctggtgaatgtgctggagccaggcgactccttcctggtgggagctaacggtatctggggacagcgagccgtggacatcggagaacgaatcggggcgagagttcatccaatgactaaggatccgggcggacactacaccctccaggaagttgaggaagggctcgcccaacacaagccagtactcctgtttctcacccatggtgagtcgagcaccggagtgctccagcctcttgatggattcggagagctgtgccatcggtacaagtgtttgctcctggtggattccgtggcaagcctcggaggaactcccctctacatggaccgccagggaattgatatcctctactcgggaagccaaaaggcgctgaacgcaccacctggaacctccctcatctccttctcggataaggcgaagaagaaaatgtacagcagaaagactaagcctttctccttctatttggacattaagtggctcgccaatttctggggatgcgatgaccaaccgcgcatgtatcaccacaccattccagtgatcagcctctactcactccgcgaaagcctggccctgatcgcggaacagggcctggagaactcatggcgacaacatcgcgaggcagcggcttatcttcacggacgcctgcaagccctgggactgcagttgttcgtgaaggaccccgcgctccgcctcccaactgtgactaccgtggcagtcccggctggatacgactggcgggacatcgtgtcctacgtgatcgaccacttcgacatcgaaatcatgggcggcctgggccctagcactggaaaagtcctgcggatcggattgctgggatgcaacgccacccgcgaaaatgtggacagggtgactgaggccctgcgggctgcactgcagcattgccccaagaaaaagttg

SEQ ID NO: 249225 - DNA, 1176 bp, Artificial Sequence
  Description of Artificial Sequence: Synthetic coding sequence
atggctagtcacaagctgctggtcactcctcctaaggccctgctgaaaccactatctattcccaaccagctgctgctcggccctggcccatccaacctgccaccaaggatcatggctgctggcggtctgcagatgattggctcgatgtctaaagatatgtaccagatcatggacgagataaaggaagggatccaatatgtgttccagactaggaaccccttgacgttggtcatttctgggtccggacactgtgccttggaagcagctctcgtcaacgtgctcgagccgggcgattccttcttggtgggggccaatgggatttggggacagcgggccgtcgacatcggcgagagaataggcgcacgagtgcatccaatgacaaaggatccagggggacactacactctgcaggaggtggaggaaggactggctcagcacaagcctgtccttctatttttgactcacggcgagagctccactggtgtcttgcagccccttgatggcttcggggaactgtgtcacaggtacaaatgcctcctccttgtggacagcgttgcttcactggggggaacacctttatatatggatcggcagggcattgacatcctgtactcaggaagccagaaggctctgaatgccccccctggcacctcgcttatctccttctcagataaggcgaagaagaaaatgtatagcagaaagacgaagccattttctttctacctggacataaagtggctcgccaatttttggggctgcgacgatcagcctcgcatgtatcaccacactatccctgtcatttcgttgtatagcctcagggaatccctggccctgattgctgaacaaggactcgagaactcttggcggcagcaccgagaggccgctgcatacctccacggtagactgcaggccctgggattgcagctgttcgtcaaggacccagccttacggcttcccaccgtaactaccgtcgccgtccccgccggttacgattggcgtgatatcgtgtcctacgttatcgatcattttgatatcgaaatcatggggggtcttgggcctagcaccgggaaggttctccgcattggcttacttggctgcaatgccacgcgcgaaaatgtggatcgggtgacagaggcgctacgagccgccctacaacattgccccaagaaaaagctg

SEQ ID NO: 249226 - DNA, 1176 bp, Artificial Sequence
  Description of Artificial Sequence: Synthetic coding sequence
atggcaagccacaaattgctcgtgactccgcctaaagcgttgctcaaaccactctcaatcccaaaccagcttctgcttggtccgggaccctccaacctcccacctagaattatggcagcaggaggacttcaaatgataggatcaatgtccaaagatatgtaccagattatggatgagattaaggaaggaatccaatacgtgtttcaaacgcgcaaccctcttactctggtcatttcgggttccggacattgtgctcttgaagcagcactggtgaacgtgctggaacctggcgattcgttcttggtcggagcgaatgggatttggggtcaaagggccgtggacataggggagcggattggtgcccgagtgcatccgatgaccaaggatccagggggtcattacacgttgcaggaagtggaggaagggctcgcgcagcataagccagtcttgcttttccttacccacggtgaaagctcgaccggcgtgcttcagcctctcgacggctttggggaactgtgtcacagatacaaatgccttcttctggttgattcggtggcgtcgctgggcggaaccccactttacatggataggcaaggaatcgacattttgtattcgggctcacaaaaagccttgaatgcaccgcccggaactagcttgatttccttctcagacaaggcaaagaagaagatgtactctaggaaaactaagccttttagcttttaccttgacatcaagtggctggcaaacttttggggctgtgacgatcaaccacggatgtatcatcacaccatccccgtgatatcgttgtattccctcagagagtcacttgccctgattgcagagcaaggactcgaaaattcatggagacagcaccgcgaggcagcggcttacctccacggtcgacttcaagcactcgggctgcagctgtttgtcaaggacccagccctccgccttcccaccgtgactaccgtggcggtccccgcgggctacgattggagagatatagtctcctacgtgattgatcatttcgacatcgagattatgggcggcttgggaccatcgaccggtaaggtgctgagaatcgggcttcttggatgcaacgcaactcgggaaaacgttgatcgcgtcactgaagcactgagagccgcgctgcagcattgtcctaagaagaaactt

SEQ ID NO: 249227 - DNA, 1176 bp, Artificial Sequence
  Description of Artificial Sequence: Synthetic coding sequence
atggcctcccacaagctgctggtaactccccctaaggctcttcttaagcccctttcaattcctaaccaactgctgttgggacctggaccatcaaatttgcccccccggataatggccgccggcgggctgcagatgattgggtcaatgtccaaggacatgtaccagattatggatgagatcaaggaggggatacaatatgtctttcagaccagaaacccactgaccctcgtcatttctgggtccggtcactgcgccttggaggcagcactggtgaatgttttggaaccaggggacagctttctcgtaggagcaaatgggatttggggccagagagccgttgatatcggtgaaagaattggtgcccgcgtgcaccccatgactaaggaccccggcggacattatactctgcaagaggttgaagaggggctggcacagcacaagccagtccttctatttcttacacacggtgagtcttcaactggcgtcttgcagccccttgacggattcggcgaattgtgccaccgctacaagtgtctgctgctagtcgactctgttgccagcctgggcggcacacctctgtacatggacaggcaaggaattgatatcttatattctgggagccagaaagcactcaacgccccccccggaactagtcttatcagtttcagtgataaagcgaagaagaagatgtactctcggaagactaagcccttctctttctacctcgatataaaatggctagccaacttttggggttgcgacgatcagcctagaatgtaccatcacaccattcccgtgatctctctttactcgttgagagagtctcttgcacttatagcagagcaaggccttgagaattcctggaggcagcacagagaggccgccgcttatctgcatggcaggctgcaagcgctgggacttcagctctttgtcaaggaccccgccctgcgtctaccaactgtaaccactgtggccgtgccggccggctatgactggcgggacatcgtgtcttacgtgatcgatcactttgacatcgaaatcatgggtggtttgggacccagcacagggaaagtcctgcgcattgggttgttgggatgcaatgccacgcgtgaaaatgtagacagagtaacagaagcactgcgagcagcactgcagcactgccccaagaaaaagtta

SEQ ID NO: 249228 - DNA, 1176 bp, Artificial Sequence
  Description of Artificial Sequence: Synthetic coding sequence
atggcgagccacaaactgctggtcaccccacctaaggctttgcttaagccgctctcgatcccaaatcagctccttctcgggccaggaccatcaaaccttccgccaaggattatggcagcaggtggactgcaaatgataggatcgatgtccaaggacatgtaccagattatggacgaaatcaaggaaggaatacaatatgtctttcagactcgaaatccacttactcttgtcatttcaggctccgggcattgcgcccttgaggcagctcttgtgaatgtgcttgagcctggtgattcatttcttgtgggagcaaatggaatctggggtcaacgcgcagtcgacatcggagaaagaattggtgctagagtccatccaatgaccaaagacccaggaggacattataccttgcaggaagtggaagagggactcgcccaacataaacctgtgctgctgtttctcacccatggagaaagctcgactggagtgttgcagcctcttgatggattcggagaactctgtcacagatacaagtgtctgctgctggtcgattcggttgcatcactgggcggaactccactgtacatggataggcaaggtatagacattttgtactccgggtcccagaaagccctgaacgcgcctcctggtacttccctgattagtttcagcgataaggcaaagaagaaaatgtactcccgtaagaccaaacccttttcattttacctcgatatcaagtggctggctaacttttggggctgtgatgatcaaccacggatgtatcatcacaccatccctgttatatcgctgtactctctcagggagagcctggctctgattgcagaacaaggtctggaaaacagctggaggcaacacagggaagccgcagcctatcttcacgggaggctgcaagcccttgggcttcagctttttgtgaaggatcctgcacttcgactcccaaccgtgaccacggtggcagtgcctgcgggctacgattggcgagacattgtgtcgtatgtgatcgatcattttgatatcgagattatggggggactggggccttccactgggaaagtgctccggattggactgctgggctgcaacgcaacccgggagaatgtggaccgcgtcacggaagcactgagagccgcactgcagcattgcccaaagaagaagctc

SEQ ID NO: 249229 - DNA, 1176 bp, Artificial Sequence
  Description of Artificial Sequence: Synthetic coding sequence
atggcctcgcacaagctcctggtgactccaccgaaggctctcctgaagcctctctcaatccccaatcaactgctcctgggccctggaccttccaatttgcctccgcgaatcatggccgcagggggactccaaatgatcggtagtatgtcgaaagacatgtatcagatcatggacgagattaaagaaggaatccaatacgtgttccaaactaggaatcccctgaccctggtgatcagcgggtccggacactgcgcgctggaagctgccctggtgaacgtcctggaaccaggcgactcgtttctcgtgggcgcgaatggaatctggggacagagagctgtggacatcggagagcggatcggtgcgcgcgtgcacccgatgactaaggaccctggcggacactatactttgcaggaggttgaagagggactcgcgcagcacaaaccagtcctcttgtttttgacccacggagagagcagcactggcgtccttcagccgctcgacggcttcggagagctttgtcaccggtacaaatgcctgctgctcgtcgactccgtcgcctccttgggaggcactcctctctacatggatcgccaggggattgacatcctctactcgggctcgcagaaggcactgaatgcaccgccaggaacttcccttatctcattttcagataaggctaaaaagaaaatgtacagccgcaaaaccaagccattcagcttctacctcgacatcaagtggctggccaacttctggggctgcgacgaccagccgcgcatgtaccaccacaccatccctgtgattagcctgtattcactccgcgaatcgctggcgctgattgccgaacaggggctcgaaaactcctggagacagcaccgggaagcggcagcatatctccacggccgtctgcaagccctgggcctccaactcttcgtgaaggatccggccctgagacttccgactgtcactactgtggccgtcccggcaggctacgattggcgcgatatcgtgtcatacgtgattgatcacttcgacatcgagatcatgggaggcctgggaccgtcgaccggtaaggtgcttcggatcggactgctcggatgcaacgccactcgcgaaaacgtggatcgcgtaaccgaagccctgcgggccgcactgcagcactgcccgaagaagaaactt

SEQ ID NO: 249230 - DNA, 1176 bp, Artificial Sequence
  Description of Artificial Sequence: Synthetic coding sequence
atggccagtcacaaactgcttgttacaccacccaaagcccttctgaagccgttgtccattccaaatcagcttctcctaggccctggaccaagcaatctcccccctcgcataatggcagcaggaggactgcagatgattggatcaatgagcaaggacatgtatcaaatcatggacgaaatcaaagaggggattcagtatgtgttccagacccggaatccactgactttggtgatctctggatccgggcattgtgccctggaggccgccctcgtcaacgtcctcgaacccggggacagcttcctcgtgggagctaacggcatttgggggcagcgggccgtcgacatcggcgaacgcatcggtgcaagggtgcatcctatgacaaaggatcccgggggtcattacactctgcaggaggtggaggaagggttagcccaacacaaaccagtccttctcttccttactcacggggagagctcaactggtgtcctacaaccactggacggcttcggtgaactgtgccatcgatacaagtgtctactcctggttgattccgtggcctctttgggggggacccccctgtacatggatcggcaaggcatagacatcctgtatagcggctcccagaaagcgctgaatgcgccacctggaacctccttgattagcttttccgacaaagcgaagaaaaagatgtactctagaaagacaaaacccttcagtttttatctagacatcaagtggctggccaacttctggggctgcgatgatcagcctcggatgtaccatcataccatccctgtaatctccttatactctctgcgtgagagtcttgccctcatagctgagcagggcctcgagaacagctggcgtcagcacagagaggcggcggcttacctccatggtaggctccaggccctgggcctgcagctattcgtcaaggatcccgccctgaggcttcccacagtaactacagttgcagtacctgccgggtatgattggcgtgatatcgtgtcttatgtgattgaccactttgatattgagatcatgggaggcttaggaccttccactggtaaagtcctaagaatcggattgctaggttgtaatgctaccagagaaaacgtggatcgggtcaccgaagccctccgagccgcactgcagcactgccctaaaaaaaagctg

SEQ ID NO: 249231 - DNA, 1176 bp, Artificial Sequence
  Description of Artificial Sequence: Synthetic coding sequence
atggcgtcccacaagctcctcgtgactccgccaaaggcccttctcaagcccctctcaatccctaaccaactgctgcttggtccgggtccttcgaaccttccacctagaatcatggcagccggtggactgcagatgatcggttcgatgtcaaaagatatgtaccagattatggacgagattaaagaggggattcaatacgtgtttcaaactcgcaacccattgaccctggtgattagcgggtcaggccactgcgcccttgaagcagcgctcgtgaacgtgctggagcccggtgactcgttcctggtgggagccaacgggatctggggacagagagccgtggacatcggagaacggatcggtgcacgtgtgcaccctatgactaaggatccaggtggccattacactctgcaagaggtggaagaaggactcgcccagcacaaacctgtcctcctctttcttacccacggagagtccagcactggagtcctccagccactggatggcttcggtgaattgtgccaccgctataagtgtctcctgcttgtggacagcgtggcatcactgggaggtacgccgctgtacatggatcgccaggggattgacattctgtatagcggctctcagaaagccctgaacgcaccacccggaacttcacttatctccttctcggacaaggcaaagaaaaagatgtactctaggaaaactaagccattttcattctaccttgacattaagtggctggccaacttttgggggtgtgacgaccagcctaggatgtaccatcatactattcctgtgatctcgctttactcactgcgagaatcccttgcccttattgcggagcaaggacttgaaaattcgtggagacaacatcgggaagcagcggcataccttcacggtcggcttcaggctttgggtctgcagttgttcgtgaaggatcctgcactgcggctccccaccgtcaccacggtggcggtgcctgcaggctacgactggcgggacatcgtgtcctacgtgatagatcactttgatatcgagattatgggaggcctcggaccttcgactggtaaagtgcttcggattggactgctggggtgtaatgcgaccagggagaatgtggatagggtgactgaggcactgcgagctgccctgcagcattgtcctaaaaagaagttg

SEQ ID NO: 249232 - DNA, 1176 bp, Artificial Sequence
  Description of Artificial Sequence: Synthetic coding sequence
atggcgtctcacaagctgctggtgacacctcctaaggccctcctcaaaccactcagcatccctaaccagctgctgctaggacccggacccagcaatctgcccccgaggataatggccgccgggggccttcaaatgataggtagcatgtcaaaggatatgtatcagatcatggacgagatcaaggagggaatccagtacgtgttccagacccgcaaccctctgacattagtgatttccggctccggccactgtgccctcgaagcggcgttggtgaatgtgctggaaccaggggattcctttctggttggtgctaatggaatttggggccagagagccgttgacataggcgaacggatcggagcgcgcgttcaccccatgactaaggatcctggcggacactacacactgcaggaagtggaggagggtttggcccaacacaaacctgtgctcctgtttttgacacacggcgagtcttccacaggcgtactgcagcctctggatggcttcggcgaactctgccatcgctataagtgccttctgcttgtggattccgtcgcaagtttgggaggcacacccctgtatatggatcgacagggtatcgacatcctatattccggaagtcagaaggccttaaacgcaccccctgggacttccctcataagcttttctgacaaagccaaaaaaaagatgtattctagaaagacaaagcccttctccttctatttggacattaagtggttagccaatttttggggttgtgacgatcagccgaggatgtaccatcacaccatacccgtgatctcgctctactctctccgtgaatctctagccctcatcgctgagcaggggctcgagaacagctggaggcaacaccgcgaggccgccgcttatcttcacggcaggctccaggccctgggactgcagttgttcgttaaagacccagctttacggctgccgacggtgaccaccgtggcagtgcctgcaggctacgattggagagatatcgtgtcatatgtgatcgaccacttcgacatcgaaatcatgggagggctgggtccctctacaggcaaagtgttgcggataggactgcttggttgtaacgccacgcgggaaaacgtcgaccgtgttacagaagctctacgtgcagccctgcaacactgccctaagaaaaagctc

SEQ ID NO: 249233 - DNA, 1176 bp, Artificial Sequence
  Description of Artificial Sequence: Synthetic coding sequence
atggccagccataaacttcttgtgactccgccaaaggctctgttgaagcccctgtccattcccaaccagctgctgctcggaccaggtccgtccaatctgcctccaaggatcatggcagcaggaggacttcagatgattggttcgatgtcgaaggatatgtaccaaatcatggatgagattaaggaaggcattcagtatgtctttcaaactcgaaaccctcttactctggtgatcagcggctctgggcattgcgcacttgaagcagcgcttgtgaacgtgcttgaaccaggagacagctttcttgtcggtgcaaatggaatctggggccaaagagctgtcgacataggggagagaatcggagccagagtccatcctatgactaaggatccaggcggccactacacccttcaagaagtggaggaaggtctggcccagcataagcctgtgctcctgtttcttacgcatggagaatccagcaccggagtcctccaacctcttgatggatttggcgaactttgtcatcggtacaagtgtctcctgctcgtggatagcgtggcatccctgggtgggactcctctgtacatggacagacaaggcattgatatcctctacagcggtagccaaaaggcattgaatgcaccccctggaacctcgcttatctcgttcagcgacaaggcgaaaaagaaaatgtactcccgtaagacgaagcctttctctttttacctggatatcaagtggctggccaacttttggggatgcgatgatcagcctcgtatgtaccatcatactataccagtgatctcactgtactcgcttcgcgagtcactggctctgatcgctgagcaaggactggaaaactcatggcggcaacatcgagaagccgcagcgtacctgcacggtcggttgcaggcccttggtttgcaactcttcgtgaaagatccagcactgaggctgccaactgtgactactgtcgcagtgccagcgggttacgattggcgggatatagtgtcatacgtgatcgaccatttcgacattgagattatgggtggcctcggcccatcaaccgggaaggtgcttaggatcgggctcctggggtgcaatgcgaccagagagaatgtggatcgcgtcactgaagcacttagagccgccctccaacattgccctaaaaagaagttg

SEQ ID NO: 249234 - DNA, 1176 bp, Artificial Sequence
  Description of Artificial Sequence: Synthetic coding sequence
atggcctcacacaagctgctcgtgactccgccgaaggcgctgctgaaaccgctgagcattccaaatcaactcttgctgggaccgggaccttcgaatctcccgcctcggataatggcagccggcggactccagatgatcggctcaatgtcgaaggacatgtaccaaatcatggatgaaatcaaagaaggtatccaatatgtgttccaaactcggaaccccttgactctggtcatcagcggatccgggcactgcgctctggaagcagctttggtcaacgtcctggaacctggtgattccttcctggtgggagctaacgggatttggggtcagcgcgcagtcgatattggagagaggataggcgctagagtccacccgatgaccaaggaccccggcggacattacactctccaagaggtggaagaaggtctggcgcagcacaaaccagttctgctgtttttgacccacggagagtcgtcgactggcgtgctccagcccctggatggctttggcgaactgtgtcatcggtacaagtgcctgttgctcgtggattcagtcgcaagcctcggcggaactcccctgtacatggataggcagggaatcgatattctgtactccggatcacagaaggcactgaacgccccgccaggaacctcgctgatctcgttctctgataaggcgaaaaagaaaatgtacagcagaaagacgaagcctttctccttttatctcgacatcaaatggttggcgaacttctggggctgcgatgaccaaccgcggatgtaccaccacaccatcccagtgatctccctctacagcctccgagaatccctggccctcattgcagagcaggggttggagaattcatggcggcagcatcgggaggccgccgcctacttgcatggtcggcttcaggccctcggcttgcagctctttgtgaaggacccggccctgcgccttccaactgtgaccacggtggccgtcccggctggttacgactggcgggacatcgtctcctacgtgatcgaccatttcgacatcgagattatgggcggattgggaccttccaccggcaaggtgcttcggatcggactgctcggttgcaacgctactcgcgagaacgtggacagagtgaccgaagccctccgagcggcgctgcaacactgtccaaagaaaaagctc

SEQ ID NO: 249235 - DNA, 1176 bp, Artificial Sequence
  Description of Artificial Sequence: Synthetic coding sequence
atggctagccacaagttgttggtgactcctcccaaagcccttctgaagcccctgtcaattcccaaccagttgcttctgggtccaggaccttcaaatttgcccccacgtatcatggctgccggtggtttgcaaatgatcggatccatgtctaaagatatgtaccaaatcatggatgagatcaaggagggtatccagtatgtatttcagaccaggaacccactgacactcgtgatatctggaagtggccattgtgcactcgaggccgccctggtcaatgtgctggagcccggagattctttcctcgtcggcgcaaatggcatttggggacagcgcgcagtggatataggcgagcgcatcggagcccgcgtgcaccctatgactaaggaccccggcggtcactacactctccaagaggtagaggagggactggcacagcacaaacccgtattgctctttctgacccacggagagagcagtactggcgtcctccagcccctggacggcttcggagagctttgccacaggtacaagtgtctgctgttggtggattcagtcgctagcctgggaggaaccccactctatatggaccgccagggaatcgacatactgtattccggatctcagaaggccttgaacgctccacctggtacttctctcatttccttctctgacaaggctaagaagaaaatgtacagcaggaagactaaacctttctcattttacctcgatatcaagtggctggctaatttttggggttgcgacgaccagcctaggatgtaccaccataccattcctgtaatcagtctctacagcttgcgcgagtcactggctctcattgcagagcaaggcctggagaactcatggcgccaacatagggaagccgctgcctacctccatggtcgtctgcaagctctcggccttcagctcttcgtcaaagaccctgccctgagactgccaaccgttaccactgtcgccgtgcccgccggctacgattggcgcgatattgtgagttatgtaatcgaccactttgacatcgagatcatgggaggcctgggtccttcaactggaaaggtactgagaatcggattgctgggatgtaacgctacccgtgagaatgtcgacagggtcaccgaagccctcagagcagcactgcagcattgccccaaaaaaaagctc

SEQ ID NO: 249236 - DNA, 1176 bp, Artificial Sequence
  Description of Artificial Sequence: Synthetic coding sequence
atggcaagccacaagctcctcgtcacgccgccgaaagcgctgctgaagccactctcaattcctaatcagctcttgctggggccgggtccttccaatctgcctccgcgcatcatggccgcaggtgggctgcaaatgatcggtagcatgagcaaagatatgtatcaaattatggacgagatcaaagagggaatccagtacgtattccagacccgaaatcctctgacactcgtaattagcgggagcggtcactgcgccctcgaagccgccctggtgaacgttctggaaccgggtgattcctttttggtgggcgccaacggcatttggggacagcgtgcggttgacatcggtgagcgcattggcgcccgggttcatcctatgaccaaagatccagggggccattacacattgcaagaggtagaggaaggtctagcacaacacaaacctgtccttctgtttctgacccacggtgaatccagcaccggtgtcttgcagcccctggatggtttcggtgagctatgtcaccgctacaagtgtctgctccttgtcgatagcgtggcatcactgggtggtactccattatatatggacagacaaggtatagacatcctgtattccggaagccaaaaagctttgaatgcaccacccggcacaagcttgatcagcttcagcgataaagcgaagaagaagatgtactcacgaaaaacgaagcctttcagcttctatttggacatcaagtggctggcgaacttctggggttgtgacgatcaaccgagaatgtaccaccataccattccggtcatctctctgtattccctccgcgaatcattagcgctaatagcggagcaagggttggagaacagttggcgccaacatcgcgaggctgcggcctatctgcatggtcgcttgcaggctctgggcctgcaactattcgttaaagatccggctctccgtttgccgactgttaccacggtggccgttcctgcgggatatgattggcgcgacatagtctcctacgtgattgaccactttgatatcgaaattatgggaggtctgggtccaagcaccgggaaggtgctgcgcatcggcctgctggggtgtaacgctacccgggaaaacgtggatcgcgtcaccgaggcactccgggcggccctccagcattgcccgaagaaaaagtta

SEQ ID NO: 249237 - DNA, 1176 bp, Artificial Sequence
  Description of Artificial Sequence: Synthetic coding sequence
atggcgagccataaactcctcgtgactcccccgaaggccttgcttaaaccgttgtcaattccaaaccaactcctgcttggacctggcccatcgaaccttccgccccgcataatggcggccggaggcctgcaaatgattggatccatgtccaaggacatgtatcaaatcatggatgagatcaaggaaggaattcagtacgtctttcagacccggaaccctctcacgctggtcatttccggaagcggacactgcgcacttgaagcagcactcgtgaatgtgctggagccaggggattcatttctggtaggagcaaacggaatttggggccagagagccgtggacataggggagaggattggcgctagagtccatcctatgactaaggaccccggtggtcactacaccctgcaagaagtggaagaaggcctggcgcaacataagcctgtgcttctgtttttgacccatggagagtcctcgactggggtgctccagccactcgacggttttggggaactttgtcataggtacaagtgccttctgctggtggattccgtggcgtcgctgggaggaactccactgtacatggatcggcagggtatcgatattctttactcgggatcgcagaaagcacttaatgcccctcctgggactagcctgatctccttttcggataaggctaagaagaagatgtacagcagaaagaccaagccattctcattttacctcgacatcaaatggcttgccaacttctggggctgtgatgatcagccccggatgtaccaccataccattcccgtgatctccctgtacagcctccgagagagccttgcgctcatcgcagaacaaggcctggaaaattcttggaggcaacatagagaagcggcggcgtaccttcacggtcggttgcaagcactgggcctgcaattgttcgtgaaagatccagcccttcgacttcctactgtgacgactgtcgcagtaccggcaggttacgactggcgtgatattgtctcgtacgtgatcgaccacttcgatatcgagattatgggagggcttggtccttcgaccggtaaggttctcagaattggactgctcggatgcaatgcaacccgggaaaacgtagatcgcgtcaccgaagccctgcgcgctgcactccaacattgtcctaagaaaaaactc

SEQ ID NO: 249238 - DNA, 1176 bp, Artificial Sequence
  Description of Artificial Sequence: Synthetic coding sequence
atggcgtcgcacaaacttctggtgacgccgccgaaggctctgctgaaaccgctctcgatccccaaccagttgctgctgggacctggaccttccaacctgccgccgcgcatcatggccgcggggggcctgcaaatgatcggctccatgagcaaagacatgtaccaaatcatggacgaaatcaaagaggggattcaatacgtctttcagacgcgcaacccactgactctcgtgatttcgggcagcggacactgtgctctcgaagcggccctcgtgaacgtgttggaacctggagactcgttcctggtgggagcaaatggaatttggggccaacgcgccgtggatatcggagagcgtatcggcgcaagagtgcatccgatgaccaaggatcctgggggacattataccttgcaggaagttgaggaggggcttgcacaacacaaaccggtgctcctgttcctgactcatggagagtcaagcactggagtgctccagcccctcgatggattcggtgaactgtgtcaccgatacaagtgcctgctgcttgtggacagcgtggctagcctgggcgggactccgctgtacatggaccggcaaggaatagacatcctctacagtggatcccaaaaggctctgaatgccccgcccggcaccagcctgatcagcttctcggacaaggcaaagaagaagatgtactcccgcaaaactaagccctttagcttctacttggacatcaaatggctcgcgaacttctggggctgcgatgatcagccgaggatgtaccatcacactatcccagtgatttcgctgtactcccttcgggaatcacttgcactcatcgcagaacagggactggaaaattcatggagacagcatcgggaggctgcggcgtacctccatggacgtttgcaagccctgggactgcagctctttgtgaaggatcccgcgctccgcttgcctaccgtaacgaccgttgcggtccccgcaggatacgactggcgagacatcgtttcgtacgtgatcgaccatttcgatattgagataatgggaggtctgggaccgtccactggaaaggtcctccggattggcctcctcggttgcaatgcaactagagaaaacgtggatcgggtgaccgaagccctccgcgccgccctgcaacactgcccaaagaagaaactg

SEQ ID NO: 249239 - DNA, 1176 bp, Artificial Sequence
  Description of Artificial Sequence: Synthetic coding sequence
atggcatctcataaacttctggtgacacctccgaaggcactgctgaagccgctgagtattcctaaccagctcctgttgggtcctggccctagtaacttaccgcctcgtattatggcagcaggcgggcttcaaatgattggttcgatgtcaaaggatatgtaccagattatggacgaaataaaagaaggcatccagtatgtgtttcagaccaggaacccgctgacgcttgttatctctgggtccggccactgcgccttggaagctgcactggtgaacgtgcttgagccaggcgacagttttctggtgggcgctaacggtatctggggccagcgggctgtcgatataggagaacgcatcggggctcgggtccatccaatgaccaaggaccctggaggtcattacaccctccaggaggtcgaagaaggactcgcgcagcacaagccggtcttacttttcctgacccacggagagtcaagcactggggtgttgcaaccactggacggctttggcgagctatgccacaggtacaagtgtctgttgttggtagattcagtagccagtttagggggcaccccactgtatatggacaggcagggcatcgacatattgtacagtgggtcacagaaagctctgaacgctccacctgggactagtttgatctcattttctgataaagctaaaaagaagatgtattccaggaagacaaagcctttcagcttctatctcgacattaaatggctggcgaacttctggggatgcgacgatcagccgcgcatgtaccaccatacgatccctgttatttccctgtactccctgcgtgagagccttgcgcttattgcagaacagggtttggaaaatagctggagacagcatcgagaagccgcggcctatctgcacggccgactacaggcgttgggtttacagctgtttgttaaagatcccgccctgaggttgcctactgtaactaccgtggcggtgcccgccggatatgattggagagacatcgtgagttacgtaattgaccatttcgacattgaaatcatgggtgggttgggtcctagcaccggcaaggtgcttcggatcggtctgctggggtgtaatgcaactcgggaaaacgttgatcgggtcaccgaagctctacgcgcggctctgcagcactgcccgaaaaagaagctt

SEQ ID NO: 249240 - DNA, 1176 bp, Artificial Sequence
  Description of Artificial Sequence: Synthetic coding sequence
atggcctctcataagcttctcgtgactccaccgaaggccctcctcaagcccctgagtatcccgaatcaacttcttctggggcccgggcctagcaacctaccccctcggatcatggccgccggagggcttcagatgattggctcaatgagcaaagatatgtaccaaataatggacgagattaaagaaggtatccaatacgtattccagaccagaaacccactcacattggtgatttccggatccggacattgtgccctggaggccgcactggtaaacgttttagagcctggtgacagcttcctggttggtgcaaatgggatttggggccaacgcgccgtcgatattggggagagaataggggctcgagttcatcctatgacaaaagatcccgggggccactacaccttgcaggaggtggaggaggggctggcgcaacataaacctgtgctgttattcctaacacatggggagtcatccaccggagttcttcagccactggacgggttcggcgagctctgccatagatataagtgcctgctgctggttgacagtgtggcttcattgggggggactcctttgtatatggacagacagggaattgacatactgtactccgggtcccagaaagctctcaacgcccccccagggacgtcactcatttctttttccgacaaagccaaaaaaaagatgtactcacgcaagaccaaaccgttctccttctacctcgatattaaatggcttgccaacttttgggggtgtgacgaccagcctaggatgtaccatcatacgatccctgttatttctctgtactctctgcgagaaagtctggccctgatcgcagaacagggtctcgagaatagttggcggcagcatcgagaggcagccgcttacttgcatggacgccttcaggcccttggactgcaactcttcgtgaaggatcctgccctgagactgcctactgtgacaaccgtggccgtcccggccggatacgactggcgtgacattgtgagctacgtaatcgaccatttcgacatcgaaattatgggaggcctggggccctcgaccgggaaagtgttaaggatcggacttttgggctgcaatgccaccagagaaaacgtggaccgtgtcaccgaggccctgagagcggctttacagcactgtcctaagaagaagctc

SEQ ID NO: 249241 - DNA, 1176 bp, Artificial Sequence
  Description of Artificial Sequence: Synthetic coding sequence
atggcctcgcacaagctgctggtgacgccaccaaaagccctgctgaagccgctgagcatccctaaccagcttttgcttggcccaggaccgtcgaatctccctccgcgcatcatggccgcggggggactgcagatgatcgggtcaatgtcgaaggatatgtaccagatcatggacgagatcaaggagggaatccagtacgtgtttcagacccgcaaccccctcacccttgtcatcagcggatcaggtcactgcgccttggaagccgccttggtgaatgtcttggagccaggggatagctttctggtcggagcgaatggtatctggggccagcgcgcggtggatatcggtgaacgcatcggagcacgggtgcatccgatgaccaaggatccggggggacattacactctgcaagaagtggaggaaggactggcgcagcacaagccggtgcttctgtttctcacccacggtgaaagcagcactggggtgctccaacctctggatggatttggagagttgtgccatcggtacaaatgcttgctcctggttgattcggttgcgtcgctggggggaactccactgtacatggacaggcagggaatcgacattctttacagcggctcccagaaggccctcaacgcccctccgggcaccagtctgatctccttctccgacaaagcgaagaaaaagatgtactcccgcaagactaagcctttttcgttctaccttgacatcaaatggctggcaaacttttggggttgcgacgatcaaccgcgcatgtaccatcacaccatccccgtgatctcactttactccctgcgcgagtcactggcgcttatcgccgaacagggactggaaaacagttggcggcaacacagagaggcagctgcttaccttcacggacgcctgcaggccttgggactccaattgttcgtgaaggatccagccctgcggctgccgaccgtgaccaccgtcgctgtgcccgccggatacgattggagagacatcgtgtcatacgtgatagatcacttcgatatcgagattatgggaggtctgggccctagcactggaaaagtcctcagaattggactcctgggatgcaacgcaaccagggaaaatgtcgaccgcgtgaccgaagcgctcagagccgctctgcagcattgtcctaagaagaagctg

SEQ ID NO: 249242 - DNA, 1176 bp, Artificial Sequence
  Description of Artificial Sequence: Synthetic coding sequence
atggcctctcataaactgttggttaccccgcctaaggctttactgaaacccctcagtatccctaatcagctcctcctggggcctggcccttccaacctgccaccgagaatcatggctgccggcggccttcagatgatcggatctatgagcaaagacatgtaccagattatggacgagattaaggaaggcattcagtatgtgttccagactcggaatccactcacccttgtgatttcgggtagcggccactgcgcgttagaagctgcactagtgaatgttctggagcctggtgatagttttctggtgggagcaaatggcatttggggacagcgcgccgtggatatcggcgagagaataggagcacgcgtccaccccatgaccaaggaccccgggggtcactataccctgcaggaggtggaagaagggctcgcacaacataagcctgtgctgctgttcttgacacatggcgaatcctcaaccggagtgcttcagcctctcgacggatttggcgaactgtgccacaggtacaaatgcttgctcctggtggatagcgtggcgtccctggggggtacaccactgtatatggatagacaaggaatcgatatactgtatagcgggagtcagaaagctctaaacgcgcccccaggaacaagtctgataagcttttcagataaggccaagaaaaaaatgtatagcagaaaaacgaaaccattctccttttacctggatatcaagtggctggcgaatttttggggatgtgacgatcagccgagaatgtatcatcataccattcctgttatatccctgtatagcctgcgggagtcactcgctctgattgctgagcaggggctggaaaattcatggcgccagcatcgagaggccgccgcctacctgcacgggcggcttcaggctctcggcctgcaactgttcgtgaaggaccccgcactccgtctgccaaccgtgacgactgttgcagtccccgccggctatgattggcgcgacatcgtttcatatgtaatcgatcacttcgatatcgagattatgggagggttagggccctccactggcaaagtgctgaggattggcctgctgggctgcaatgccacgagagagaatgtggacagagtcacagaagccttgcgagccgcgctgcaacattgcccaaaaaagaaactc

SEQ ID NO: 249243 - DNA, 1176 bp, Artificial Sequence
  Description of Artificial Sequence: Synthetic coding sequence
atggctagtcacaaattgctcgttactccaccaaaggctttgcttaagccgctttctatccctaatcagttactgttaggtcccggtccgtcaaacctgccacccaggatcatggctgcaggtgggctgcagatgattggttctatgagtaaggacatgtaccagataatggacgaaattaaagaaggcatccagtatgtgtttcagactcggaaccctctgacgttagtgatctcaggcagtggtcattgcgccctcgaggccgccctcgtgaacgtgcttgaaccaggggatagcttcttggttggcgccaatgggatctggggccagcgcgctgtggacattggtgaaaggatcggagcacgtgtccaccccatgactaaagatcctgggggtcattatacgttgcaggaagtcgaagagggacttgctcagcataaacctgtgctcctattcctgactcacggagaatcttccacaggtgttctgcagcccctggatggattcggtgagctttgccaccgatacaagtgcctcctgcttgtagattcggtggcaagcctcggcgggactccactgtatatggacaggcaggggatcgacatcctttacagtggtagccagaaagcgctgaacgccccgccagggacctcgctgatctcattcagtgataaggcaaagaaaaaaatgtattctcgtaaaacaaagccctttagcttttatctggacataaagtggctggccaacttttggggatgtgatgatcaaccaagaatgtatcatcatacaatccccgtgatctctctgtactctctgagagagagcctggccttgatagccgagcagggtctggagaatagctggagacaacatcgagaggcagctgcttatctccatggacgcctccaggctctcggtcttcagttgttcgtcaaagaccccgccctgcgtttgccgacagtgactaccgtggcagtgccagccggctacgactggcgggacatcgtatcatacgtaattgatcacttcgatatagagatcatgggtggtttggggccctcgactggcaaggtgctgcggatcgggttactgggttgtaacgcaacgcgggagaacgtcgaccgcgtgacagaagccctgcgcgctgctttacagcactgtcccaagaagaaactg

SEQ ID NO: 249244 - DNA, 1176 bp, Artificial Sequence
  Description of Artificial Sequence: Synthetic coding sequence
atggcctcacataagttgctggtgacgccacccaaggcgctcctcaagccgctgtcgatcccgaaccagctcctcctgggaccggggccatcgaacctgccaccgcggattatggccgctggcggactgcagatgatcggttccatgagcaaggacatgtaccagattatggacgagattaaggaaggaatccagtacgtgttccagacccggaatccgctcaccctcgtgatctccggatcaggacattgcgccctcgaggccgctctggtgaatgtgcttgaaccaggggatagttttctcgtgggagcgaatggcatctggggacaacgggcagtcgatattggtgagaggatcggcgctcgcgtccatcctatgaccaaagaccccggaggacactacacgcttcaggaggttgaagaaggactggcccagcacaagccggtgcttctgtttctgacgcatggcgagtcaagcacgggcgtgctgcaaccgttggatggcttcggcgagctctgccatcgctacaaatgcctccttctggtagactccgtggcaagcctgggaggaactccactgtacatggaccgccaggggatcgatatcctgtactcaggatcgcaaaaggccctgaatgcacctccgggaacttcgcttatctccttcagcgataaggccaaaaagaaaatgtactcaagaaagactaaacctttcagcttctatctggatatcaaatggctcgccaacttttggggttgcgatgatcaaccccggatgtaccaccataccatccccgtgatctcactgtactcactgcgcgagtccctggcgctcatcgctgagcagggcctcgaaaactcctggcggcaacacagagaagcagcagcatacttgcatggacgattgcaggcactcggactgcaacttttcgtgaaagacccagccctgagactcccaaccgttaccactgtcgccgtgccggccggctacgactggcgcgacatcgtctcgtacgtgatcgaccatttcgacatcgagattatgggtgggcttggaccatccactggtaaggtcttgcgaattggccttcttgggtgtaacgccactcgtgagaacgtggaccgagtgaccgaggctctgagagcggcgctccagcattgcccaaagaagaagctc

SEQ ID NO: 249245 - DNA, 1176 bp, Artificial Sequence
  Description of Artificial Sequence: Synthetic coding sequence
atggcgtcacacaagcttctggttaccccccccaaggcacttttgaagcctctgtcaataccgaatcagcttttgcttggacccggaccttctaacttgccccccagaatcatggccgctggtggtttgcagatgatcggctctatgtcaaaggacatgtaccagatcatggatgaaatcaaggaaggaattcaatacgtatttcagactaggaatccgttgacgctcgtgattagtggctcaggccattgtgctttggaggcggctttggtgaacgttctcgagcccggcgactcttttcttgtaggtgctaacggcatctggggccaaagggctgtggatatcggtgagaggataggagcccgcgtacatccaatgactaaagatcccggaggtcactataccttgcaggaggtggaagagggtcttgctcaacacaaacctgtccttctgttcctgactcatggagagagtagtacaggcgtactgcaacctttggatggcttcggtgaactgtgccaccgctacaagtgcctcctcctcgtagacagcgttgcatcactgggtggcacaccgctgtacatggacaggcagggaattgatattctctactcaggctcacaaaaagctttgaatgcccctccaggcacctctcttatatccttctctgacaaagcaaaaaagaaaatgtacagtaggaagaccaagccgttctctttctacctggacattaagtggcttgctaatttttggggctgtgacgaccagccaagaatgtaccatcacaccatccccgttatatctctttatagtctccgcgaaagcctggctctcatcgcggagcagggcctggaaaattcctggagacaacaccgcgaagccgcagcttatctgcacggcagattgcaggcgttgggtcttcagttgttcgtaaaagaccctgctctgagactgcctaccgtcaccaccgtcgcagtgccggccggttatgattggagggatattgtctcatacgtgatcgaccacttcgacatcgaaatcatgggtggtctcggtccaagtacgggcaaagtactgagaatcggtctccttggctgtaatgccacgagagagaatgtcgacagagtaactgaagctcttagggccgctctgcaacactgtccaaagaaaaagctc

SEQ ID NO: 249246 - DNA, 1176 bp, Artificial Sequence
  Description of Artificial Sequence: Synthetic coding sequence
atggcctcacacaagctgctagtcacaccacctaaagcgttgcttaaacctctgtctatcccaaaccagctccttttggggcctggaccctcaaacctccctcccagaattatggccgcaggtggactgcagatgatcggtagcatgtcgaaagacatgtatcagatcatggacgaaatcaaagaaggaatccagtacgtttttcagactagaaatcctcttaccctcgtgatctccggatcaggccattgcgccctagaagccgccctggtgaatgtgttagaacctggtgattcgtttctggtcggggcaaacggaatctggggccagagagcagttgatatcggagagagaataggagcccgcgtgcaccccatgactaaagaccccggcgggcactacacactgcaggaggttgaagaaggattggcacagcacaagccagtcctcctttttctgacacacggtgaaagttcaacgggagtcctgcagccactcgatggcttcggcgagctgtgccatcgctataagtgcctgctgctggtggattccgtggcctcgctaggaggcaccccgctgtacatggatcggcaaggcattgacatcttatactctggaagtcagaaggctctcaatgcaccccctggaacatctctgatctcttttagcgacaaagccaagaagaagatgtacagtagaaaaacgaaacccttttctttctatctggacataaaatggttagcgaatttctggggttgtgacgatcagcctagaatgtaccatcacacgatccccgtcataagtctttattctttgcgagagtcactcgcattgatagccgagcagggtcttgaaaactcctggagacagcaccgagaggccgccgcatacttgcacggaagactccaagccctgggtctgcagctgttcgtgaaagatcctgccctgaggttaccaaccgtgactacagtggctgtgcccgctggttacgattggagggatattgtcagttatgttatcgaccacttcgatatcgagattatggggggattgggtccctctactggtaaggtcctccgaatagggctcctgggttgcaacgcaacacgcgaaaacgtagatcgcgttaccgaggccctgcgtgcagctctgcagcattgccccaagaagaagttg

SEQ ID NO: 249247 - DNA, 1176 bp, Artificial Sequence
  Description of Artificial Sequence: Synthetic coding sequence
atggcatcgcataaactgcttgtcaccccacccaaagcacttctgaagcccctgtccattcccaatcagctcttgctcggacctggaccaagcaacctcccacccaggattatggcagcaggtggtctgcagatgattggcagcatgagcaaggacatgtaccagatcatggacgaaatcaaggaaggtatccaatacgtgtttcaaacccgcaacccacttacgcttgtcataagcggatccggtcactgtgcgctggaagcagctcttgttaacgtccttgaaccaggtgattcgtttcttgtgggcgcaaacggaatttgggggcagagagcggtggatatcggagagcgcattggcgctcgtgtccatcccatgaccaaggatcctggtggacattacaccttgcaggaagtcgaagaaggactcgcacaacataagcctgtgctgctttttctgactcatggtgaatcctcgactggcgtgctgcaacccctggacggatttggagaactttgtcatcgatacaagtgcctccttttggtcgattccgtggcatcacttggcggtaccccgctgtatatggacaggcagggtattgatatcctttactccggaagtcaaaaggctctcaatgcaccccccgggacctcattgatctcattttcagacaaggcaaagaagaagatgtactcccggaaaacgaagccgtttagcttctacctcgacattaagtggctggcaaatttctggggttgcgatgaccagcctcggatgtaccaccataccatccctgtgatatcactgtacagccttagagaatccttggcgctcatagctgagcaaggactcgaaaattcttggcgccagcatagagaggccgcggcgtacctgcatgggcggctgcaggcacttggacttcagctttttgtcaaggatcctgcattgcgacttcccactgtcaccactgtcgctgtgccagcaggatatgactggcgcgatattgtcagctacgtgattgatcactttgatatcgagattatgggtgggctgggcccatccaccgggaaggtgctgagaattggacttctcggttgcaatgcaacccgagagaatgtcgatcgggtcactgaagctctgagagccgcactccaacattgtcccaagaaaaaactt

SEQ ID NO: 249248 - DNA, 1176 bp, Artificial Sequence
  Description of Artificial Sequence: Synthetic coding sequence
atggccagccacaagctcctcgtgactccgcctaaagcactcctgaagccgctcagcatcccgaaccagctgctgctggggccgggaccttccaaccttccgccgagaatcatggcagcaggaggattgcagatgatcggctcaatgagcaaagacatgtaccagattatggatgaaatcaaggaggggattcagtacgtgttccaaaccagaaaccctctgactctggtgatttcaggctcaggccattgcgccctggaggccgcacttgtgaacgtcctcgaacctggggactcattcctcgtgggcgccaacggaatctggggtcaacgggctgtcgatattggagaaaggatcggagcgagggtgcaccccatgaccaaggatccaggaggacattataccctgcaagaggtggaagaagggctggcgcagcacaaaccggtcctgctctttcttacccacggtgaaagctccaccggggtgctgcagccgctggacggattcggggaactgtgtcacaggtacaagtgcctgctgctggtcgattcggtggctagcctcggaggaaccccgttgtacatggaccgccagggtatcgacatcctgtactcaggaagccagaaagcactgaatgccccgccgggaacttcacttatctcattctcggataaagcaaagaagaagatgtactctaggaaaactaagccattcagcttctacctggacatcaagtggctggcaaatttctggggctgcgacgaccagccgcgcatgtatcaccataccattcctgttatctcgctgtactccctgcgggagtcattggccctcattgcggaacagggcctcgaaaactcctggagacaacatagagaggcggcggcatacttgcacggccgcctccaggcacttggactccagctgttcgtgaaggatcctgccctgcgcctcccgaccgtgactacggtggcagtgccggccggatatgactggcgcgacatcgtctcctatgtcatcgaccactttgacatcgagatcatgggaggcctgggaccgagcacggggaaggtgctgcgcattggattgctgggatgcaacgcaactcgggaaaacgtcgatcgcgtgactgaagcgctgcgcgctgctctccaacattgtccaaagaaaaagctg

SEQ ID NO: 249249 - DNA, 1176 bp, Artificial Sequence
  Description of Artificial Sequence: Synthetic coding sequence
atggcatcccataaactactcgttacacctcctaaagctcttcttaaaccactctccatccccaatcagctgctattggggccaggaccaagtaatctccctccccggataatggcagccggggggcttcagatgatagggtccatgtccaaagatatgtaccagatcatggatgaaataaaggaagggatacagtatgtgtttcagacacgaaatccacttacactggtcattagtgggtcaggacactgtgctctggaagccgccctggtgaatgttctggaaccgggggatagtttcctggtgggagccaacgggatctgggggcagcgagctgttgatatcggggaaagaatcggagctagagtgcatcccatgactaaagacccaggagggcactacacattacaggaagtggaagaaggactcgctcagcataagccagtgctgctgtttctgactcacggggagtcttccacaggggttctacagccacttgatggatttggagagctatgtcatcgatataaatgtctgctgcttgtagattccgtggcttcccttggaggaacaccgttatatatggataggcagggaatcgatattttgtattcaggatcccagaaggccctcaatgcccccccagggacttctctcatctctttttctgataaggctaaaaaaaaaatgtatagtcgcaaaactaaacccttttctttttatttagatatcaaatggcttgcgaatttctgggggtgtgacgatcagcctcgcatgtatcatcatacaatccccgttatttctttatattcactgcgggaatccctagcccttatcgcagagcagggactcgaaaactcgtggcggcagcacagggaagccgcagcatatctccacgggcggctccaagccctcgggctgcagctgtttgtaaaagatcctgccctccgacttccaacagtgactacagtggccgtaccagctggatatgactggagggacatagtatcctacgtcattgaccacttcgatatcgaaatcatgggagggctggggccttcaacagggaaagtgcttaggattgggcttctggggtgtaacgccacaagggagaacgtggatagggtcacagaggcccttcgagccgctctgcagcactgccctaaaaagaaattg

SEQ ID NO: 249250 - DNA, 1176 bp, Artificial Sequence
  Description of Artificial Sequence: Synthetic coding sequence
atggcgtctcataaacttctagtgacgccgccaaaggcattgctgaagccgctttcaatccccaaccaactgctactcggcccaggtccctctaacctgcccccgcgcattatggctgccgggggactgcagatgattggctctatgtccaaagatatgtatcagatcatggatgagatcaaggaaggcatccagtacgtgttccagactcgaaatccgcttacgttggtcatttctggtagtggtcactgtgcattagaggctgccttggtcaatgtgctcgaacccggggacagttttctggtgggagccaatggaatctgggggcagcgggccgtagacattggcgagcggatcggggcccgcgttcacccaatgacgaaggatcccggtggccactacactctacaggaagtggaagaaggcctcgcccagcataagccagtgctgttattcctaacacatggtgaaagctccactggggtcctgcagcccctagacggattcggcgagctatgtcaccgctataagtgcttgctactagtggattccgtagcaagcctgggaggcacaccgctgtacatggaccggcaggggattgatatcctgtattctgggagtcagaaagcattgaatgcacctccgggcacaagcttgatctccttttctgacaaagccaagaagaagatgtactcccggaagaccaaaccgttctccttttacctggatatcaagtggttagctaacttttggggatgtgacgaccagcctaggatgtaccatcacactattccggtgattagcctttactccttgcgggagtcattggctcttatcgctgagcagggcttggagaactcttggcggcagcatcgcgaggccgcagcttacctgcacggcaggcttcaggctttagggctgcagctgttcgtgaaagacccagccctccggctgccaactgtgactacagtggcggtcccagccggctacgattggcgcgatattgttagctacgtcatcgaccacttcgacatagagataatggggggacttgggccttcgacaggcaaggtgctgcgcattggcctgttaggatgcaacgctacccgggagaatgtcgaccgggtcacagaggccctgcgcgctgccctgcaacactgtcctaagaaaaaactg

SEQ ID NO: 249251 - DNA, 1176 bp, Artificial Sequence
  Description of Artificial Sequence: Synthetic coding sequence
atggcctcccacaagttactagtcaccccaccaaaggcactactcaagcctctgagtatccctaaccagctcctgctgggccccggtccctctaacctgccaccccgaatcatggcagccggcggcctgcagatgattgggagtatgagcaaggatatgtatcaaatcatggatgagattaaagagggcattcagtacgttttccagacccgaaatccactgaccctcgtcatcagcggctctggccactgcgccctggaagccgctctggtgaacgtgctggagcctggagacagttttctggttggtgctaacgggatttggggacaaagagccgttgacatcggagaaaggattggcgctcgagtccatccaatgactaaagatccaggtggccactatactttgcaagaggtggaagagggcctggcccaacacaagccagtgctgttattcttaacccacggcgaatctagtacaggtgttttgcagcctctggacggattcggcgagttatgccacaggtacaagtgcctgctcctcgtcgatagcgtggcctccctgggtggcacccccctatatatggacaggcagggaatagacatcctgtactccggctcacagaaggccttaaacgcccctcctggtaccagtctaataagctttagtgataaagccaaaaagaagatgtacagtcgcaagaccaagccattctccttttacctggacatcaaatggttagccaacttctgggggtgcgacgatcaacctaggatgtaccatcacacaataccagtgatttcactctatagtctgagggagtccctggctctgatcgctgaacagggtctggagaactcttggcgccaacatcgggaggctgctgcatacttacatgggcgcctgcaggctctgggcctgcaactgtttgtcaaagaccctgctctgcgtctccctactgttaccacagtcgccgtccctgctggatacgactggcgagatatcgtgagttacgtgatagatcattttgatatagaaatcatgggggggctgggccctagtactggcaaagtgctgagaatcggcttgctgggctgtaacgccacaagagagaatgtggaccgggtcacagaggctctgagagcagccctccagcattgcccaaagaaaaagctg

SEQ ID NO: 249252 - DNA, 1176 bp, Artificial Sequence
  Description of Artificial Sequence: Synthetic coding sequence
atggcgagccataagctcttggtgactccaccgaaggccctgctgaagcctctaagcataccaaatcagcttctcctcggcccaggacccagtaacctgcctccccggattatggccgcggggggcctgcagatgatcggctcgatgtcgaaagatatgtaccagattatggatgaaatcaaggaaggaattcagtatgtgttccagacgcgtaatcccctaacccttgtaataagtgggtcaggtcactgtgctctggaggctgctctggtgaacgtgctcgagcctggggactccttcctcgtaggagctaatggcatttggggtcagcgagccgtagacattggcgagaggattggcgctcgtgtgcatcccatgacgaaagaccccggaggccattacaccttgcaggaggtagaggaggggctggcacaacacaagccagtgttgcttttccttacccatggagagtcatcaactggagtgctgcagcccctcgacgggtttggtgagctgtgtcatcggtacaaatgcctgctgcttgtggacagtgtggcctccttgggaggtaccccactttacatggacagacagggcatcgatatcctttactccggctctcagaaggccttgaacgctcctcccgggactagcctgatttcattttccgataaagccaaaaaaaagatgtattcccggaaaaccaaaccattttccttctacctagatatcaagtggttggccaacttctggggctgtgacgaccagccacgaatgtaccaccacactatccccgtcatttctctctactcactgcgggaatcactagcactgatcgctgaacaagggctcgaaaactcttggagacaacaccgcgaagccgcagcatatttacatggcagattgcaagccctcggacttcaactttttgtgaaagatccggccctgcgcctccccacagtgaccaccgtcgctgtgcctgcagggtatgactggcgggacatcgtgtcctatgtgatcgaccacttcgatatcgagatcatgggaggtctgggtccaagcactggcaaggtgcttcggatcggcctgcttggttgtaacgccaccagagagaatgtggaccgcgtgactgaggcacttcgggccgcactccagcactgtccaaaaaagaaactc

SEQ ID NO: 249253 - DNA, 1176 bp, Artificial Sequence
  Description of Artificial Sequence: Synthetic coding sequence
atggcatcgcataaacttctggtcaccccaccgaaggccctgctgaaacccctttcgatccccaaccagctgctgctgggaccgggcccatcgaacctgccgccgcggattatggccgcgggaggactccagatgatcggatccatgagcaaggacatgtaccagattatggatgaaatcaaggagggaatacaatacgtctttcagactcgcaatcccttgacccttgtgatctccggttctggacactgcgctctggaggctgcccttgtcaatgtgctggagcctggcgattctttcctggttggagccaatggaatttgggggcaacgggcggtggatatcggcgaaaggatcggcgcaagagtgcatcccatgactaaggacccgggaggccactacaccctgcaagaggtggaagagggcttggctcaacataaaccagtcctccttttcttgactcacggagaatccagcacgggcgtcctgcagcctctcgacggtttcggagaattgtgtcaccgctacaagtgcctcctgctggtggatagcgtggcgtcacttggagggacccccttgtacatggaccggcagggaatcgatattctgtactccgggtcacagaaagccctgaacgccccaccgggcacctcattgatctcattctccgacaaggccaagaagaaaatgtattcaaggaaaaccaaacctttctcgttctacctggacatcaagtggcttgctaacttttggggatgtgacgatcagcctcggatgtatcaccacacgatcccagtgatctctctctactccctcagagagtcgctcgctctgatcgcggaacagggattggaaaactcgtggcgccagcacagggaagccgccgcatacctccatggccgcctccaagccctgggacttcaattgtttgtgaaagacccagcactccgactcccgaccgtgactactgtggctgtgccggcggggtacgattggcgcgacatcgtttcctacgttatcgatcacttcgatatagagatcatgggaggcctggggccgtcgacgggcaaggtcctgaggataggactgctgggctgcaacgccactcgggaaaatgtggacagagtgaccgaggccctcagggcagcgctccaacattgcccgaagaagaagctg

SEQ ID NO: 249254 - DNA, 1176 bp, Artificial Sequence
  Description of Artificial Sequence: Synthetic coding sequence
atggctagccataagttgctcgtgacgcccccaaaagccctattgaaaccactgtccattccaaatcagttgctgcttggccccggaccctcaaacttgcccccacgtataatggccgctggcggtctgcagatgataggctctatgagcaaagatatgtaccagataatggatgaaattaaagagggcattcagtacgtcttccagacccggaacccacttaccctggtcatttctggcagcggccattgcgcactggaagcagccttagtcaatgtgctggagccgggcgatagctttctggtgggtgcaaacgggatctgggggcagagggcggtggacataggcgaaaggatcggtgctagagtgcaccctatgacgaaggacccaggcggacattatacactgcaggaggtcgaggagggactggcacagcacaaaccggtgctgctgttcctgacccatggtgagtcttccacaggagtgctgcagccactggatggcttcggcgaattgtgtcaccggtataaatgcctgcttctggtggattctgttgcaagtcttgggggcaccccattgtacatggatagacaaggaatagacattttgtattcagggagccaaaaggcattaaacgctcctcctggcacgtcactcataagtttctcagacaaggcaaaaaaaaaaatgtacagcaggaagaccaaaccgttttctttctacctagacatcaaatggctcgccaacttttggggatgtgatgatcaaccccggatgtaccaccataccatcccagtgatctctctgtactccctaagggaatccctcgcgttgatcgctgagcaaggccttgagaactcatggaggcagcatcgggaggcagccgcctacttacacggtcgcctgcaagctttggggctgcagctcttcgtaaaagatccagctctccgattgccaaccgtgactacagtagctgtccccgccggctacgactggcgggacattgtgtcttacgttatagaccacttcgatatcgaaatcatgggcgggctgggccctagtacaggcaaggtcctccgaatagggctgcttggatgcaatgctactagggagaacgtggaccgagtgacagaggccttgcgtgccgcattacagcactgtcctaaaaaaaaactg

SEQ ID NO: 249255 - DNA, 1176 bp, Artificial Sequence
  Description of Artificial Sequence: Synthetic coding sequence
atggcatctcataagctgttagttaccccccctaaggcattgctgaagcctttaagtattcccaatcagcttttactaggccctggcccttcaaatctccccccacggatcatggcggctggtggacttcagatgattgggagtatgagtaaagatatgtaccaaatcatggatgagattaaggagggaatccagtatgtttttcagacccggaatcctctaactttggtcatcagcggttccggccattgcgctcttgaggccgcactggtgaatgtcctggagccaggcgactcgttccttgtaggcgcgaacggtatctggggacagagagctgtggatattggagagagaattggcgctcgggtgcaccccatgaccaaggaccccggcgggcactatactctgcaggaggtggaagagggactggctcaacataagcccgtgctattatttctcactcacggtgagtccagcaccggtgtactccagccactggacggtttcggcgaactgtgccatagatacaagtgtctgctgctggtcgactccgtagcatcactcgggggcactcccctttatatggatcgccaggggatagacatcctctactcggggagccaaaaggcgctaaacgcaccaccggggacatctctcatatccttcagcgacaaggccaagaaaaagatgtacagtcgtaagacaaagcctttcagcttttacctggacattaaatggttggccaacttctgggggtgtgatgaccagccacgcatgtatcaccacaccatcccagtcatcagtttgtacagcctgcgagagtctctggcattaatagcggagcagggcctggagaattcctggcgtcagcacagggaagcggcagcctacctgcatgggcgtctccaggccctgggattgcagctatttgtgaaagatcctgccctccggttacctaccgtcacaaccgttgctgtccccgctggctacgactggcgtgatatcgtctcttatgtgatagatcatttcgatattgagattatgggcggattgggtccatcaacgggaaaggtgctccgcatcgggctgctggggtgtaatgccactcgggagaacgtcgaccgggtgacggaagccctgcgggcagcactgcagcactgccccaagaagaagctc

SEQ ID NO: 249256 - DNA, 1176 bp, Artificial Sequence
  Description of Artificial Sequence: Synthetic coding sequence
atggcaagccataagttgcttgtcaccccgccaaaggcactgctcaaaccactttcgatccctaatcaacttctgctgggccctggtccgtcgaacctgccgcccagaattatggcggcaggtggactccagatgattggatcgatgtccaaggatatgtaccaaatcatggatgagataaaagagggaattcagtacgtgtttcagacccgaaaccccctgacccttgttattagcggcagcggccattgcgcccttgaagcggcgctggtcaacgttctggaaccaggggattcctttctggtgggagccaacgggatttggggacagcgagcagtcgacatcggggaaaggattggagcacgggttcaccccatgactaaagatcctggtggacattacaccctgcaggaagtggaagagggtcttgcacaacataagcctgtgctgttgtttttgacgcatggtgaatcgagcaccggggtgcttcagccgcttgatggatttggtgaactgtgtcacaggtacaaatgccttttgctcgtggactcagtcgcaagcctcggtgggacgccactgtacatggataggcagggcattgatatactttactccggtagccagaaggcacttaatgcacctccgggtacctcactgattagcttttcagataaggccaagaaaaagatgtactcccgcaaaaccaagcctttttcgttttacctcgacattaagtggctcgccaatttctggggctgcgatgatcaacctcggatgtatcatcacaccatcccagtgattagcctgtactcattgcgggagtccttggcactcatcgcagagcaagggctggaaaactcatggagacaacaccgggaagcggcagcctacctgcatgggcggcttcaagcactcgggcttcaactctttgtgaaagaccctgcacttcgcctccctactgtgaccactgtggccgtgccggcaggttatgactggagagatatcgtgagctacgtgatcgaccattttgatatagagataatgggcgggctgggaccctccaccggaaaggtgctgcgaattggactgcttggatgtaacgcaactcgggaaaacgtcgaccgggtgacggaggccctgagagcagcgctgcaacactgcccaaagaagaagctg

SEQ ID NO: 249257 - DNA, 1176 bp, Artificial Sequence
  Description of Artificial Sequence: Synthetic coding sequence
atggcttctcacaagttgcttgtgactccaccgaaggctcttctgaaaccgctctctatccctaatcaactgctcctgggaccgggaccgtcgaacctgcccccgcgcatcatggctgctgggggcctccagatgatcggatctatgtcgaaggacatgtaccagattatggacgaaatcaaagaaggaattcagtacgtctttcaaacccgcaatcctctcaccctggtcatctcaggcagcggccactgcgcgttggaagcggcgttggtcaacgtgctcgagccaggtgactccttcctcgtgggcgcaaacggcatctggggacagagggcagtcgatatcggcgagcggatcggcgcgcgggtgcatcccatgaccaaggatccgggcggacattacaccctgcaggaagtggaggagggactcgcacaacacaagcctgtgcttctgttcctgacccatggagagtcctccactggtgtgctgcagccgctcgacggatttggagagctctgccaccgctataagtgcctgctccttgtggattccgtcgcctccctcggaggaactcccctctacatggatagacaaggcatcgacatcctgtactcaggtagccagaaggccctgaatgccccaccaggcacttcgcttatctccttctccgataaagccaagaagaaaatgtactccagaaagactaagccattttcgttctatctcgacattaagtggctggcaaacttctggggttgcgacgatcagccgagaatgtaccaccatacgatcccggttatttctttgtactcgctccgggaatcactcgcacttatcgcagaacagggtctggagaacagctggcggcagcaccgcgaagccgcggcctatcttcatggtaggctgcaggcgctgggactgcaactgtttgtgaaggacccggccttgcggctgcctaccgtcactacggtggccgtcccagcgggttacgactggcgagacatcgtaagttacgtgatagaccattttgatatagaaatcatgggaggcctcggacctagcactgggaaggtgctgaggatcggcctgctgggatgtaacgccacccgcgaaaacgtggaccgggtcaccgaggctctgagagcggccctgcaacattgcccgaaaaagaagctg

SEQ ID NO: 249258 - DNA, 1176 bp, Artificial Sequence
  Description of Artificial Sequence: Synthetic coding sequence
atggcctctcacaagctgttggtcacccctccgaaggcgctcctgaaaccgctgtccatcccgaatcaactcctcctggggcctggaccatccaacctcccacccagaatcatggccgctggaggcctgcagatgatcggatcgatgtctaaagacatgtaccagataatggatgaaatcaaagagggtattcagtacgtgttccagaccaggaacccgctcaccctggtgatctcagggtcagggcactgtgccctggaagccgccctcgtgaacgtcctggaaccaggtgattcgttcctcgtaggagctaatggaatctggggccagagagccgtggacattggcgaacggatcggcgctagggtgcatccgatgaccaaggacccgggaggccactacactctgcaggaggtggaagaaggactcgctcaacataagccggtgctgctcttcctgacccatggagagtcgtccactggtgttctccaaccgctggatggattcggagagctctgccaccgctacaagtgccttttgctggtggactccgtcgcctcgctgggcggcactccattgtacatggatagacagggaatagatatcctctatagcggatcacagaaggcactgaatgcccctccaggaaccagcctgatttcgttctcagataaggccaaaaagaagatgtactccaggaaaaccaagccattcagcttctatctggacatcaagtggctcgccaacttttggggatgcgacgaccaacctcgaatgtaccatcacaccatcccggtcatctcactgtacagcctgcgcgaatcgctggccttgatcgcggaacaggggctggagaactcgtggcgccagcaccgcgaagccgctgcttaccttcatggccggctgcaggcgttggggctgcaactgttcgttaaggacccagccttgcggctcccgaccgttactactgtggccgtcccggctggatacgactggcgcgatatcgtttcatacgtgattgaccacttcgacatcgagattatgggaggattgggcccttcgacgggcaaagtgcttcgcatcggcttgctgggttgtaacgctacccgcgagaacgtggatcgcgtgacggaggctctgcgggcagccttgcaacattgcccaaagaaaaagctc

SEQ ID NO: 249259 - DNA, 1176 bp, Artificial Sequence
  Description of Artificial Sequence: Synthetic coding sequence
atggcgtcgcacaaactcctcgtgactccgcccaaagcgctcctgaagccactgtcgatcccaaatcagctccttcttggaccgggaccgtcaaacctcccacctaggattatggccgccggaggactgcaaatgatcggctccatgtcaaaagatatgtatcaaatcatggacgaaatcaaggagggaatccagtacgtgtttcagacgaggaacccactcacgctcgtcatttcaggaagcggccattgcgctctggaagcagcattggtgaacgtgcttgagccgggagattctttcctggtgggggcaaacgggatctggggacagagggctgtagatatcggtgagcgcattggagcgcgtgtgcaccctatgaccaaggatcccggaggacactacaccctgcaggaggtggaggaaggactggcccagcataagccggtgctgctgtttctgacccacggtgagtcgtcgaccggggtgctgcagccgctcgatggattcggagagctctgtcatcgctacaaatgtctgcttctggtggactccgtggcatccctgggaggtactcctctgtacatggacagacaaggaatcgatatcctgtactccgggtcacagaaggccctcaacgctccgccaggcactagccttatctcgttctccgacaaggcaaaaaagaagatgtactcgagaaagaccaagccattctcattctacctcgacattaagtggctcgctaacttctgggggtgcgacgaccagccaagaatgtaccatcacactatcccggtcatttccctgtactcccttcgggaaagcctggcacttatcgctgaacagggccttgagaacagctggcgacaacatagagaagccgcggcatacctgcatggaaggctccaggcactgggactccaactcttcgtcaaagatcctgctctgcgcctcccgaccgtcacgaccgtggcggttcctgcaggttacgactggcgcgacatcgtgtcatatgtgatagaccactttgatatcgaaatcatgggaggcctgggaccttcgaccggaaaggtcctgcgtatcggactgctgggatgcaatgccactagagagaatgtggacagagtcaccgaagcactgcgcgcggccctgcaacactgcccaaagaaaaaactc

SEQ ID NO: 249260 - DNA, 1176 bp, Artificial Sequence
  Description of Artificial Sequence: Synthetic coding sequence
atggcttctcacaagctcctggtaacgcctccaaaggcactgctgaagcctctgtcaattcccaatcagctgctgttaggccccgggcctagtaatctgccacccaggatcatggcagcagggggtttgcagatgatagggtcaatgagtaaagacatgtatcagatcatggatgagattaaagagggcatacaatatgtgttccagacgcgtaatccgctgacgctcgttatcagtgggagtggacactgcgcactagaggccgcccttgtgaatgttcttgagcctggagattcattcctggtgggggccaacggcatctggggccagcgggctgttgatattggcgagcggatcggggctcgagtgcacccaatgaccaaggatcctggaggccattataccctacaggaagtcgaggaaggtcttgcacagcacaaacctgtgctgctcttcctgactcatggggaaagctctacgggggtgctccagcctcttgacgggttcggggaactgtgccatcgctataagtgtctgttactggtagattcagtggcctctttaggaggtacgccactctacatggatcggcagggaatagacatactctactctggcagtcaaaaggctctgaatgcccctccagggacgagtctcatcagcttcagcgataaggcaaaaaagaaaatgtacagcaggaagaccaaaccattcagtttctatctggatatcaaatggctcgctaacttttggggatgtgatgaccagccgaggatgtaccatcatactatacccgtgattagcctctatagcctgcgcgaatctttggctctcatcgccgaacagggcctggaaaatagctggcgccagcaccgcgaggcggcggcctatctgcatggaaggctccaggcattaggcctgcagttgtttgttaaagacccagcactgagactccctaccgttaccactgtggcagtgcccgcgggctatgactggagagatatcgtcagttatgtgatcgaccattttgatatcgagatcatgggcggtcttgggccatccacagggaaagtcctgcggatcggtcttttagggtgtaacgctacgcgcgaaaatgtggacagggtcacagaggccttaagggccgctcttcagcattgcccaaaaaaaaagctg

SEQ ID NO: 249261 - DNA, 1176 bp, Artificial Sequence
  Description of Artificial Sequence: Synthetic coding sequence
atggcatcgcataagctccttgtcactcctcctaaggccctgctgaaacccctctctattcccaaccagcttctgctcggacccggacctagcaacctgccacctagaattatggccgcgggaggtttgcaaatgatcggatctatgtcgaaagacatgtaccaaatcatggatgaaatcaaggaaggaattcagtatgtgttccagactagaaatcctctcactcttgtgattagcggctccgggcactgtgcactggaggcagcgttggtgaacgtcctcgaaccgggagattcgtttctcgtcggtgcgaacgggatttggggtcaaagggcagtggacatcggagaacggattggtgcccgggtgcatcctatgaccaaagatccaggagggcactacaccttgcaagaggtcgaagaaggtctggcccaacacaagccggtgttgcttttccttactcacggagaaagctcaaccggggtcctccaaccactcgatggatttggtgaactgtgccacagatacaagtgtttgcttcttgtggattccgtggcctcgctcggcggaacccccctctacatggatcggcagggaatcgacatcctgtattcgggctcccagaaagcactcaacgcaccgcctggtaccagcttgatctcgttctcggacaaagccaaaaagaaaatgtactccagaaagaccaagccattttcgttttacctcgatatcaagtggctcgcaaacttttgggggtgtgatgatcagccacggatgtaccatcacaccattccagtgatctcgctgtactcgcttcgcgagtccctggcactgatcgcggagcagggacttgagaatagctggagacaacatagagaagctgcagcataccttcacggacgtctgcaggcactgggcctccagctgtttgtgaaggatcctgcacttagactcccgaccgtgacgactgtcgctgtgcccgcaggatacgactggcgcgatattgtgtcgtacgtgattgaccactttgatatagaaatcatgggaggactggggccgtcgaccggcaaggtgctgaggatcggtctgctgggctgtaacgccactagagaaaatgtggatcgggtcacggaggcgcttcgagcggcacttcagcactgtcctaagaagaagctc

SEQ ID NO: 249262 - DNA, 1176 bp, Artificial Sequence
  Description of Artificial Sequence: Synthetic coding sequence
atggcttcccacaagctgcttgtcacacctcccaaggcattgctgaagcccctttccatacctaaccagctgctgcttggccctgggccttccaatctgccccctaggataatggccgctgggggcctccagatgatcgggtccatgtccaaggacatgtaccagattatggatgagatcaaggagggcatacagtacgtctttcaaaccagaaatccactcaccttggttattagtggcagcggccactgcgctttggaggcagccctggttaatgtgctggaaccaggcgatagcttcttggtgggagccaacggaatatggggtcagcgcgccgtggacataggcgagaggattggagcaagggtgcacccaatgacaaaagaccctggggggcattacactttgcaggaggtcgaagaagggttggcccagcacaaaccagtgttgctgtttctgacacacggcgagagttcaaccggggttctgcagccacttgacggattcggcgagctgtgtcatcgctataagtgtctgctgctggtcgactccgtggcctctctcggaggtacccccctttacatggaccgccaaggaattgacatcctgtactctggatcacagaaggccctgaacgcccccccaggtacttcactcatatccttctccgataaggcaaagaagaaaatgtacagccggaaaaccaagccattctctttctacctggacataaaatggctggccaatttttgggggtgcgacgaccagccacggatgtatcatcacacaatacctgtgatctccctttacagcctgcgcgaatctctggcgctcattgccgagcaaggtttggagaacagttggagacagcatcgggaggccgctgcctatctgcacggaaggctgcaggccctcggactgcaactctttgtaaaagaccccgcactgaggctgcccaccgtgactaccgttgcagtaccggccggatatgactggagagacatagtatcatacgtgattgaccattttgacattgaaattatgggtggcctcggcccctcaacaggcaaagtactgaggatcggcttgctgggctgtaacgctacccgcgaaaatgttgatcgagtaacagaggcccttcgcgcagctctgcagcattgcccgaagaagaagctc

SEQ ID NO: 249263 - DNA, 1176 bp, Artificial Sequence
  Description of Artificial Sequence: Synthetic coding sequence
atggcttcacataaactcttagtgacacctccaaaagccctgcttaaacccctgagtataccaaatcagcttctgttggggccagggccatctaacttaccacccagaataatggccgctggggggctccagatgatcggatccatgtcaaaagatatgtaccagatcatggacgaaatcaaagaagggattcagtatgtgtttcagacaaggaacccactgacacttgtaatatctggatccggacactgtgctcttgaagccgctctagtcaacgttctggaaccaggagattcgttcctggttggagcgaacggaatatggggacagcgagctgtcgatatcggggagcggatcggggctcgggttcatcctatgactaaggatcccggaggacattatactcttcaggaagtagaagaagggctcgcacagcacaaacctgtcctccttttcctgacacacggagaatcttctactggagtgctccagcctttagatgggtttggagagctttgtcatcggtataaatgtcttctgctggtggacagtgttgccagtcttggggggacacctctctatatggatcgacaggggattgatatattatattcagggtctcaaaaagcgcttaatgctccacctgggacatctctcatctctttctccgataaagctaaaaaaaaaatgtactccagaaaaacaaaaccattcagtttttatctagacatcaaatggctcgccaatttctggggatgtgatgatcagcctcggatgtatcaccacactataccagtgatatcactatattcactgcgggaatctctggctttaatagctgagcaggggttagaaaactcctggagacagcaccgggaggccgccgcatatctccatggaaggttgcaggctctggggctgcagttatttgtgaaagatcccgccctcaggctccctactgtcacaacggtggccgtaccagccgggtacgattggagggatatcgtgtcctatgtgattgatcattttgatattgaaattatgggggggcttgggccatccactgggaaagtgctaaggataggactgctcgggtgcaacgccactcgcgaaaatgtggaccgggtgacagaagccctgcgggctgcactacagcactgccccaagaaaaagctt

SEQ ID NO: 249264 - DNA, 1176 bp, Artificial Sequence
  Description of Artificial Sequence: Synthetic coding sequence
atggctagtcataagcttctggtcacccccccaaaagcactgttgaagcctctttcgattccgaaccaactcctcctgggtccagggccgtcgaatctcccccctcgtataatggcagcggggggactccaaatgatcggctcgatgtcaaaagacatgtatcagatcatggacgagatcaaggaggggatccagtatgtcttccagacccggaatccccttacactcgtaatctcgggttcgggtcattgcgcactcgaggccgccctggtcaacgttcttgagccaggagacagctttctggttggagctaacggtatatggggacaaagagctgttgatatcggtgaacgaataggggcaagagtacaccctatgacgaaggaccctggtggccactacacgttgcaggaggttgaggaaggactcgcgcaacataagccggtcctcctgtttctgacacatggtgagtcttctactggggtcctgcaaccattggatggctttggggaactctgccacaggtacaagtgtctcctgttagtagattccgttgcatcgctgggtggtacccccctctacatggatcgacagggcatagatatactttacagcggtagtcagaaagccctaaacgccccacctggcacgtcacttatatcattttcggataaggctaaaaagaagatgtactcaaggaagacgaagcccttcagtttttacctcgatatcaagtggcttgctaatttctggggctgtgatgatcagcctcgaatgtatcatcataccattccggtcatctccctctacagtctgcgcgaatctctggcccttattgctgagcaggggctcgagaattcgtggcgccagcaccgcgaagcggccgcgtacctccacggccgcctccaggctcttggattacagcttttcgtgaaggatccggcactgagattgccgacagttaccacagtcgcagtacctgctgggtacgactggagagacatcgttagttacgttattgatcactttgatatcgagattatgggaggtcttggtccatcaaccggaaaagtcctccgcattggactcctgggatgcaacgccacgcgtgagaatgtggatcgcgtaacagaggcgttgcgtgccgcactccaacactgtcccaaaaagaaattg

SEQ ID NO: 249265 - DNA, 1176 bp, Artificial Sequence
  Description of Artificial Sequence: Synthetic coding sequence
atggcaagccacaaacttctggtgaccccaccgaaggcgctgctcaagccactttcgatccctaaccaacttctgttgggccctgggcctagcaacctgccacctagaataatggcagcgggtggcttgcaaatgataggaagcatgtccaaggacatgtaccagatcatggatgagattaaagaagggatccaatacgtttttcaaacgcgcaacccgctcaccctggtgattagcggatcgggtcattgtgcattggaagcagcacttgtgaatgtcctggaaccgggggactcctttcttgtgggcgcaaacggaatctggggccaaagagcagtggacataggagaacgtatcggtgctcgagtgcatcctatgaccaaagatcctggaggacattacacgctgcaagaagtggaagaaggactggcacagcataagcctgtgctcctctttctgacccacggagagtcgagcacgggtgtgctccagccactggatggttttggagaattgtgtcatcggtacaagtgcctcctgttggtggattcagtggcatcgcttggtgggacgcctctctacatggaccggcaagggattgacattctttacagcggatcgcaaaaggcccttaacgctccacctggcacctctctgatttcgttttccgataaggcaaagaagaaaatgtacagccgtaagaccaagccattttcattttacctggacatcaagtggctggccaacttttgggggtgcgacgatcaaccaaggatgtaccaccacaccatccctgtgatttccctgtacagccttcgggaatcgcttgcacttattgcagagcaaggacttgaaaatagctggaggcaacatagagaggcggcggcatacctgcatggccgtctccaagcactgggcctgcagcttttcgtgaaagatcccgccctcagattgcccactgtgactactgtggcagtgcccgcaggatacgactggcgcgacatagtgtcgtacgtcattgaccacttcgatatcgagatcatgggagggctgggaccgtcaaccggcaaagtgcttcgaattggactcctgggatgcaacgcaacccgagaaaatgtggacagagtgaccgaagccctcagagctgccctgcagcattgccccaaaaagaaactt

SEQ ID NO: 249266 - DNA, 1176 bp, Artificial Sequence
  Description of Artificial Sequence: Synthetic coding sequence
atggctagtcacaaacttctggtgactccacctaaagctctgttgaagcccctctccattccaaaccagttactgctgggaccagggccttccaatttgcctcccagaataatggctgccggtgggttgcagatgatcgggagcatgtcaaaagacatgtatcaaatcatggacgaaattaaggagggtatccagtacgtgtttcagacccgcaacccgctgactctggtcatcagcgggtcaggacattgtgctctggaagcggccctggtcaacgtgctggagcccggcgacagctttctagtgggagctaatggcatctgggggcagagggcggtcgatattggcgagaggattggtgccagagtacaccctatgacaaaggatcctggtggacattataccttgcaggaagttgaagaaggcctggcgcagcacaaaccggttctgctgttccttacccatggggaatctagcacaggcgtactgcagccactcgatggatttggagagctgtgccatagatacaaatgtttgttgctggtggactcagtggcctccctgggtggcaccccgctgtatatggacaggcagggaatagacatcctgtattcaggttctcaaaaagcactgaatgcgccaccagggacgtctttgatcagcttttctgacaaggctaagaaaaagatgtactcaaggaagactaaacccttttctttctatctcgacatcaagtggcttgccaatttctggggttgcgatgaccagccccggatgtaccaccacactattccagtcattagtctgtactccctcagagaaagcttagcactgatcgcagaacaaggactcgaaaatagctggaggcaacatcgagaggccgcggcctatctgcacgggaggctccaggctctgggattacaactgttcgtgaaggatccagctttgcgactacctaccgtgactaccgtggccgttcctgctgggtatgactggcgggacatcgtaagttatgtgatagatcactttgatattgagatcatgggcggattgggtcccagcactggtaaggtgcttaggatcggactccttggctgcaacgctacacgggagaatgtggaccgagtgacagaggcattgcgtgccgcattacaacactgcccaaagaaaaagtta

SEQ ID NO: 249267 - DNA, 1176 bp, Artificial Sequence
  Description of Artificial Sequence: Synthetic coding sequence
atggcaagccacaagctgctcgtcacacctccaaaggcccttttgaagccactgtccatcccaaatcaactgctcttgggaccaggcccaagcaatctcccgccaagaatcatggccgccgggggcctgcagatgatcggatcaatgtcaaaagacatgtatcagattatggatgaaattaaggaaggaatccaatacgtgttccaaactaggaatcctttgactctggtcataagcggcagcggccactgtgcccttgaggccgctctcgttaacgtgctcgagcccggtgactcctttcttgtaggtgcgaacggcatatgggggcaacgcgccgtcgatatcggtgagagaattggagctagggtgcaccccatgacaaaggaccctgggggccattacactcttcaggaggtggaagaggggcttgcccagcacaaaccagttctgctgttcctcacccatggcgaatcaagcacgggggtgctgcagccattggatggctttggggagctgtgtcatagatacaaatgcctgctgctggtcgatagcgtggcaagtctggggggcacaccactgtacatggataggcaaggtatcgacatactgtactctggctcccaaaaagccctcaacgccccccccgggacctcccttatatctttctccgataaagcaaagaagaaaatgtattctaggaagaccaaaccctttagcttttacttggacatcaaatggctggctaatttctgggggtgcgacgatcagccgcgcatgtaccaccacacgatccccgtaatctctctctactctctgagggagagtcttgccctgattgctgaacagggtcttgaaaactcctggcgccaacatcgagaggccgcagcgtacctgcacggcaggttgcaggctctggggctgcagttgttcgtgaaagaccctgctctcaggctgcccacagtgaccaccgtggctgtcccagctggatacgactggagagatatcgtgtcctatgtgatcgatcacttcgacatcgagatcatgggagggctcggtcctagtacaggtaaagttctccggatcggattgctcgggtgcaatgccacgcgcgaaaacgtcgacagagtcaccgaagccctgagggcagcgcttcagcactgccccaaaaagaaattg

SEQ ID NO: 249268 - DNA, 1176 bp, Artificial Sequence
  Description of Artificial Sequence: Synthetic coding sequence
atggccagccacaaattgttggtgactccacccaaagcacttcttaaacctttatccatcccaaaccaacttttgctgggacctggaccgtctaatctgccaccccgtattatggctgcaggtggattgcagatgattggttccatgtccaaagatatgtatcaaattatggacgagattaaagaaggtatccagtatgtattccagacacgaaacccgcttactcttgtgatctccggaagcggacactgtgcactcgaagcagctttggtcaatgttttggaaccaggagattcgttcctcgtgggagctaacggaatatggggtcaaagagctgtggatatcggagagagaattggagctcgggttcaccctatgacaaaggacccgggaggacactacacattacaagaggtggaggaaggattagctcaacataaaccagtcttacttttccttactcatggtgaatcttcaacgggggtacttcaacccctagatggctttggagagctctgtcatcgatacaagtgcttactcctggtggatagtgtggcgtcgctggggggaactccattgtatatggatcgacaaggtatagatatcctgtattcaggatcacaaaaagcacttaatgctcctccggggacttcactcattagtttctctgataaggctaaaaagaagatgtattctcgtaaaacaaaaccattttccttttatcttgatataaaatggcttgccaatttttggggatgtgatgatcaacctcgcatgtatcaccatacaattccagttattagtctttactctttgagagagtcactggccttgatagcggagcagggtctcgaaaactcatggagacaacaccgcgaggctgctgcatatttacatggtagattacaagctttgggattgcaacttttcgttaaggatcccgcattacgactcccaactgtcactacggtggcagttccagcaggatatgattggagagatattgtatcttacgtaattgatcatttcgacattgagatcatgggaggactcggcccaagtacaggaaaggtgcttagaatcggactgttgggatgcaacgcaactagagagaatgttgatagggttacagaagcactgcgtgcagcactgcaacactgtccaaagaagaaactc

SEQ ID NO: 249269 - DNA, 1176 bp, Artificial Sequence
  Description of Artificial Sequence: Synthetic coding sequence
atggcctcccacaaactgttggtgacaccaccaaaggcccttttaaagcctttgtcaattcccaaccaactgctccttgggcccggacccagtaatttaccccctaggattatggcagcagggggactgcaaatgatcggtagtatgtctaaagatatgtaccagataatggatgaaatcaaggaaggaattcaatacgtgtttcagacaaggaatcctctgactctggtaattagtggatccgggcactgcgcgcttgaagcagcgttggtgaatgtgctcgaaccaggggacagtttcctcgtgggcgctaatggaatctggggccagagagctgtggacattggggaaagaataggggcccgtgtacaccctatgacaaaagacccgggcggtcactacacgttacaagaagtggaagagggcctggcacagcataagcctgtactgcttttcctcactcatggggagtcaagcacaggcgtcctccagcccctggacggtttcggggagctgtgccaccggtataaatgccttttgctcgttgatagcgtggccagcctgggcgggacgccactgtacatggaccgccaggggattgacatactctacagtggaagccagaaggctttgaatgctccaccgggaactagtctcatttcctttagtgacaaagccaaaaagaagatgtatagtaggaaaaccaagcctttctcattctacttagatattaagtggctggccaatttttggggttgcgatgaccagcctcgcatgtaccaccataccatcccagttatttccctctacagcctgcgtgaatccctggcgctcatcgcagagcaggggcttgaaaattcctggagacagcatcgggaagcagcagcatacctgcatggcagactgcaggccctgggcttacaactgttcgttaaagatcccgcccttcgtttacccacagtaacaacagtagccgtacccgctggatatgattggagagacattgttagctacgtcatcgatcactttgacattgaaatcatggggggccttggtccctctactggcaaggttctgaggatcggcctcctgggatgcaatgccacacgggaaaacgtggaccgggtcacagaggctcttcgggcagccttacagcattgtcccaagaagaagctg

SEQ ID NO: 249270 - DNA, 1176 bp, Artificial Sequence
  Description of Artificial Sequence: Synthetic coding sequence
atggcatcacataagctgctggtgactcctccaaaggctcttctcaagcctctgtccattcctaaccagcttcttcttggtcccggaccttccaatctccctcccagaattatggcagccggaggactccagatgattggtagcatgtccaaggatatgtaccaaatcatggacgagatcaaggaaggtatccaatacgtgttccaaactcggaaccccttgactctcgtaatttccggtagcggacactgtgcactggaggcggcgctcgtgaacgtccttgaacctggagactcgttcctcgtgggagcaaacggcatttggggacaaagagcggtggatatcggggaaagaataggagcgcgcgtgcatcctatgacgaaggatcctggaggtcactacaccctccaggaggtggaggaaggactggcccagcataagccggtgctgctgtttctgacgcacggggagtcatcgactggtgtgctgcaacctcttgatggttttggagaactttgccatagatataagtgtctgctcctggtggactcggtggcgtcactcggtggtacccctctgtatatggataggcaaggtatcgatattctctatagcggatcacagaaggcactgaacgccccacccggtactagcctgatctcattcagcgataaggcaaaaaagaaaatgtactcgcgcaagaccaaacctttttccttctaccttgacattaagtggctggcaaacttttggggttgtgacgaccagccaagaatgtaccaccatactatccctgtgatttcgctgtacagcctcagagagtctctcgcactgattgccgaacaggggctggaaaacagctggcggcaacatcgtgaggcagcagcgtaccttcatggacgcctgcaagccctcggccttcaactgttcgtgaaggatccagcacttagacttcctactgtcaccaccgtggcagtgcctgccgggtacgattggagagacatcgtctcctacgtgatagatcattttgacattgaaatcatgggtggccttggtccttccacgggcaaggtgttgcgcattggacttttgggatgtaatgcaaccagagaaaacgtggatcgggtgaccgaggctttgagggcggccctgcagcactgtcccaagaaaaaactt

SEQ ID NO: 249271 - DNA, 1176 bp, Artificial Sequence
  Description of Artificial Sequence: Synthetic coding sequence
atggcatcgcacaaattattagttacaccgcctaaagcgctccttaagccgctgtctatccctaaccaacttctgcttggccctggtccgagcaatcttccgccgaggatcatggcagcaggcggactgcagatgattggctcaatgagcaaagatatgtatcaaattatggacgagatcaaggagggaatccaatacgtttttcagacacgtaatccactgacattagtaatttcaggctccggccattgcgcgctggaagctgcccttgtcaacgtgttggagccgggagactcattccttgtcggtgccaatggaatttggggccaacgggctgtggatattggagagcgcataggtgcaagagttcatcctatgacaaaagaccctggaggacattacacgttgcaagaggttgaggagggactggcccaacacaaaccggtgttgctttttctaacccatggcgaaagctcaacaggggttcttcaacctctggacgggtttggggagctctgtcatcgttataaatgcttactcttggtggatagtgtggcatcactcggcggcacgccgttatatatggaccgccaaggaattgatatactttacagcgggagccagaaagcattgaacgccccaccgggtacatcattgatttccttttctgataaagcaaaaaagaaaatgtatagtaggaaaactaaaccatttagtttttatttagatattaagtggttagcgaacttctggggctgtgatgatcagccgagaatgtatcatcatacaatcccggtgatctccctttacagtttaagagaaagcttagcgttaattgccgaacaaggacttgagaattcatggcgtcaacacagggaagccgcagcctatcttcatggcaggttacaagcgcttggccttcagttatttgtgaaagatccagccttgagattaccaacagtcacaacggttgccgtgccagctggatatgattggagagatatcgtatcatacgtgattgatcattttgatattgaaataatggggggcctgggaccgtctacaggcaaagtccttagaattgggctgcttggttgtaacgcgacaagagagaacgttgatagagttacagaggcattgagagctgcgctgcaacattgtccgaaaaaaaaactt

SEQ ID NO: 249272 - DNA, 1176 bp, Artificial Sequence
  Description of Artificial Sequence: Synthetic coding sequence
atggcctcccataagctgctcgtgacccctcctaaagcgcttctcaaacctttgagcatacccaatcagctcctccttggccctggcccatccaacctgcctccgagaatcatggctgctggcggactccagatgatcggatcaatgtccaaagacatgtaccagattatggatgaaatcaaggaaggaatccagtacgtctttcaaactcggaaccctctgactctggtgatctcaggaagcggacactgcgccctggaagccgccctcgtgaacgtgttggaaccaggagattcatttctggtgggcgccaacggcatctggggccaacgtgccgtcgacatcggagagagaatcggcgctagagtgcacccgatgaccaaggacccgggaggacactacactctccaagaggtcgaggaaggactcgcgcagcataagcctgtgctcctcttcctgacgcatggtgagagctcgaccggagtgctgcagcctcttgacggattcggagaactgtgtcaccgctacaagtgtctgctgttggtcgacagcgtcgcatcgctcggaggcaccccgctgtacatggatcggcagggaatcgacatcctttacagcggatcgcagaaggcgctcaatgctccaccaggaaccagcctgatcagcttcagcgacaaggcgaaaaagaaaatgtacagccgcaaaaccaagccgttctcattctatctcgacatcaaatggctcgcgaacttctggggctgcgatgaccaaccgaggatgtaccaccacactataccggtcatttcgctctactcgcttcgcgaatcgttggccttgatcgcagaacagggactggaaaattcctggcgccaacatagagaggctgccgcgtacttgcatggacggctgcaggcacttgggctccaactgttcgtgaaggacccggccctgcggctgccgaccgtgactactgtcgcagtgccagccggatacgactggagagacatcgtgagctacgtcatcgatcatttcgacattgagatcatgggaggacttggaccctctactggaaaggtcctgcgcatcgggctgctgggatgtaacgcgactcgggagaacgtggatcgcgttactgaggcactgcgcgctgccctccaacattgcccgaagaagaagctg

SEQ ID NO: 249273 - DNA, 1176 bp, Artificial Sequence
  Description of Artificial Sequence: Synthetic coding sequence
atggcttcacacaagcttcttgttacaccccctaaagctctgcttaagcctctgagcatccccaatcagctccttttggggcccggacccagcaacctgcctcctcgaatcatggccgctgggggactccaaatgattgggagcatgagcaaggatatgtaccagattatggatgaaatcaaggagggtattcaatacgttttccagacacggaacccccttactctggtgatcagcggaagcgggcattgcgccctcgaggcggcactggtgaacgtgctggagccaggagattccttcttggttggcgccaacgggatttggggacaacgcgctgtggacataggcgaaaggattggcgctcgcgtgcatccaatgaccaaagatcctggtgggcactataccctccaggaggtggaggagggacttgcccagcataaacccgtgctgctgtttttgacacatggagaaagcagcaccggagttcttcagcctttggacggctttggcgaactgtgccaccggtataaatgtctgctcttggtcgacagcgtggcatccctcggagggactcctttatatatggatcgacagggaattgatatactgtactctgggagtcaaaaagccctgaacgctccccccgggacatctctgatcagtttctctgataaggccaaaaaaaaaatgtattcaaggaaaaccaagccattctcattctaccttgacatcaaatggttggctaacttctggggctgcgatgatcagccacggatgtaccatcacacaattccagtgatttctctgtatagcctgagagagagcctggctcttatcgccgaacagggtttggaaaactcctggagacagcatcgcgaagccgccgcatatttgcacggaagactgcaggctctcgggctccagctgttcgtgaaggaccctgctctgcgactcccaacagtcacgactgttgccgtacctgccggatacgattggagggacatcgttagttatgtcatcgatcatttcgatatcgaaatcatgggcggtcttgggccatctactggaaaagtcctgcggattggcctcctggggtgtaatgctaccagagaaaatgtagacagggttaccgaagcactgagggcagcacttcagcactgtccaaaaaagaagctg

SEQ ID NO: 249274 - DNA, 1176 bp, Artificial Sequence
  Description of Artificial Sequence: Synthetic coding sequence
atggcttcacataaacttttagttacaccacctaaagctttattaaaaccattatccattccaaatcaattattattaggaccaggacctagtaatttaccaccacgtattatggcagctggaggacttcaaatgattggatctatgtctaaggatatgtatcaaattatggatgaaattaaagaaggaattcaatatgtttttcaaacaagaaatccattaactcttgtaatttctggatctggtcattgtgctttagaagctgcattagttaacgttttagaaccaggagattcattcttggttggagcaaacggaatttggggacaaagagcagtagacatcggagaaagaattggtgctagagtacatccaatgacaaaggatccaggaggacattatactttgcaagaagtagaagaaggtcttgcacaacataaaccagttttattgtttttaacacatggagaatcttctacaggagtattacaacctttagatggattcggagaactctgtcacagatacaagtgtcttttattagttgatagtgtggcttcattaggaggtacaccactttatatggatagacaaggtattgatattctttattctggaagtcaaaaagctttaaatgcaccaccaggaacatcacttatatcattttcagataaagcaaaaaaaaagatgtactcaagaaaaactaaacctttctctttctatctcgatattaaatggttagctaatttttggggatgtgatgatcaaccaagaatgtatcatcatactattcctgtaatttcattatattcacttcgagaaagtcttgctcttattgcagaacaaggtcttgaaaattcttggaggcaacatagagaagctgctgcatacttacatggaagattacaagctttaggtttacaattatttgttaaagatccagctttaagattacctacagttacaacagtagctgtaccagctggatatgattggcgagacattgtctcatatgttattgatcattttgatattgaaattatgggaggtttaggtcctagtacaggaaaggttttaagaataggattattaggatgtaatgctacaagagaaaatgtagacagagtaacagaagctttaagagcagctttacaacactgtccaaaaaaaaagcta

SEQ ID NO: 249275 - DNA, 1176 bp, Artificial Sequence
  Description of Artificial Sequence: Synthetic coding sequence
atggcctcccacaaactgctggtaaccccccccaaagcccttctgaaaccactgtccatacccaatcagctcctcctgggcccaggaccatctaaccttccgcccaggataatggccgccggcggactacaaatgatcgggtcaatgtccaaagacatgtatcaaattatggatgaaatcaaggagggcatccaatatgtttttcagacaagaaaccccctgacactcgttatctctggctctgggcactgcgctctagaggccgcactggtgaatgttctggagcctggagattctttcctcgtgggagctaacggcatttggggccagcgagcagtcgacataggggaacgaatcggtgctcgagttcaccccatgaccaaagatccaggagggcattataccctccaggaagtggaggagggattggctcagcacaaaccagtgctcctatttttaacccatggtgagtcctccactggcgtgctgcagccattagacggcttcggggaactgtgccatcgctataaatgcctacttctcgttgattctgttgcttccctgggggggactcccctgtatatggacaggcagggcattgacattctgtattccggctcccagaaggccttgaatgcccctccgggaactagcctcatatccttctccgacaaagcaaagaagaagatgtactcccggaagaccaagcctttctctttctacttggacattaagtggctggcaaatttctgggggtgtgacgaccaaccgcggatgtatcatcatacgattcccgtcattagtctctattccttgcgggagtcgctcgccctcatagcggaacagggactcgagaacagttggagacagcaccgcgaagctgccgcatacctgcacgggcgcctccaggcactcgggctccagctgttcgttaaggatcctgccttgcgcctgcctaccgtcacaaccgttgctgtccccgcgggatatgattggcgggatatcgtcagttatgtgattgaccacttcgatattgagataatgggcggcctcggaccatccacaggtaaggttctacgaatcggactgctggggtgtaatgccacgagagagaatgtggatcgagtgactgaggcactgcgggctgcgctgcagcattgtccgaagaagaaattg

SEQ ID NO: 249276 - DNA, 1176 bp, Artificial Sequence
  Description of Artificial Sequence: Synthetic coding sequence
atggcgtcacacaagctgcttgtgaccccaccgaaagcactcctgaagcctctgtccattcctaaccaacttctgctgggacctggtccttccaatttgccaccgcgaattatggcagcaggaggtttgcagatgattgggagcatgagcaaagatatgtatcagataatggatgagattaaggaggggattcagtacgtgtttcaaacccgtaaccctcttaccctggtgatctcggggagcggacactgcgctctggaagcggcccttgtcaacgtgcttgaaccgggagattcgtttcttgttggtgccaacggaatctggggacaacgggcagtggatataggcgagcggattggagctcgtgtgcaccccatgaccaaagatcctggcggtcattacactctccaggaggtggaagagggacttgcacagcacaaaccagtgcttttgtttctcactcatggagagtcctccaccggtgtcctccaaccactcgatggctttggggaactgtgtcatcgatataagtgtctcctgcttgtggattcggtcgcgagcctgggaggaactccactgtacatggaccgccaaggcatcgatattctttactctggcagtcagaaggcacttaatgctcctccggggacctctcttatttcgttcagcgacaaggccaagaagaagatgtactccaggaaaaccaagccattttccttctacctggacataaagtggttggctaacttttggggatgtgacgaccagcccaggatgtatcaccatacgatacccgtgatctctctttattcgctgcgcgagtctcttgcactcatcgccgaacaaggtctggaaaattcctggaggcagcaccgggaggcagcagcataccttcatggtagactccaggctctgggcctccagctgttcgtgaaggacccagcactccggcttcctactgtgactactgttgccgtccccgcaggttacgattggagagacattgtgtcctacgtcatcgatcattttgacattgagattatgggtggacttggaccttcgactggtaaagtgctcaggatcggccttctcggatgtaacgcaactcgcgaaaatgtggatagggttaccgaagcacttcgcgccgctttgcagcattgccctaagaaaaaactg

SEQ ID NO: 249277 - DNA, 1176 bp, Artificial Sequence
  Description of Artificial Sequence: Synthetic coding sequence
atggcttcccataagttattggtgacaccccctaaggcgctcctcaagccccttagcatcccaaaccaattgttgttggggcctgggccttctaaccttcctcctagaattatggcagctggtggattgcaaatgattggcagtatgtctaaagatatgtaccagataatggacgagatcaaggaaggaatacagtatgttttccaaaccaggaaccctttgactctcgtcattagcggttccggtcattgcgctttggaggctgcccttgttaatgtcctggaacccggagactctttccttgttggggccaatggtatatgggggcaaagggcagttgatattggtgaaagaataggggcaagggtccacccaatgactaaagatcctggcgggcattatactcttcaggaagttgaggaaggtcttgctcaacataagcctgtgttactttttctaacacatggtgagagcagcactggcgttcttcaaccccttgatggctttggcgagctctgccatagatacaaatgcttgcttcttgtagattcagtagcaagcctaggcgggaccccactttatatggatagacaggggattgatatattatacagtggaagtcaaaaggccttaaacgctccgcctggtacgtcacttatttccttttccgacaaggccaaaaagaagatgtatagcagaaagacaaaaccattttcattttatttggatattaaatggctcgctaacttctggggttgcgatgatcaaccaagaatgtatcatcatactattccggttatcagtttgtactccctcagggaatcacttgcattaatagcagagcagggattagagaactcatggcgtcaacaccgagaagctgctgcatatttacatgggcggttgcaagctctcggtcttcaactgttcgtgaaggatccggctttgcgactccctacagttactactgtggctgtcccggcaggctacgactggagagacattgtctcatacgtaattgaccatttcgacattgaaattatggggggtttaggaccgtccactggcaaggtcctgcgaattggattgcttggatgcaatgctacccgtgagaacgttgatagggttacggaggccctcagagccgctctacagcattgcccgaaaaagaagttg

SEQ ID NO: 249278 - DNA, 1176 bp, Artificial Sequence
  Description of Artificial Sequence: Synthetic coding sequence
atggcttcccacaagttgctggtgaccccgccgaaagctctcctcaagccactgtcgatccctaatcaactgttgttgggaccggggccatctaatctgccgcctcgcatcatggccgcgggcggactgcagatgatcggttccatgagcaaagacatgtaccagattatggacgagatcaaagaggggatccagtacgtctttcagacgcgcaatcccctcactctggtgatttcgggaagcgggcattgcgccctggaggccgccctggttaacgtgctggaacctggtgattcgttccttgtcggtgcaaacggaatttggggacagcgggcagtcgatatcggtgaacggatcggcgccagagtgcacccaatgactaaagacccgggaggacactacaccctgcaggaggtagaggaaggactggcacaacacaaaccagtcctcctcttcctcactcatggggagtcgtcaactggagtcctgcagccactggatggctttggtgagctgtgccatcgctacaagtgtctgctgctggtggactcggtcgcatccctgggtggcacccccctctacatggacagacaagggatcgacatcctgtactccggttcccagaaggccctgaatgccccgccgggaacctccctcatctcattctcggacaaggccaaaaagaaaatgtacagcagaaagaccaaaccattctccttctacctcgacatcaagtggctggccaacttctggggctgcgacgaccagcctcggatgtatcatcacacgattccggtgatctcgctgtattcgctgcgggagtctttggccctcattgcggaacagggcctcgaaaacagttggcggcagcaccgggaggctgcggcatacctgcacggcagactccaggcgctgggactgcaactgttcgtcaaggatccggcactgagactccccactgtgacgactgtcgcggtgcctgctggatacgattggagagatatcgtgtcgtacgtgatcgaccacttcgacatcgagattatggggggccttggaccttcaactgggaaggtgctgcgcattggactgctcggctgcaatgccacccgggagaatgtggaccgcgtgactgaggcgctgagagccgcgctgcaacactgcccgaagaagaaactc

SEQ ID NO: 249279 - DNA, 1176 bp, Artificial Sequence
  Description of Artificial Sequence: Synthetic coding sequence
atggcttcccacaagctgctcgtgactccccctaaagcactgcttaagcctctgtcaatcccaaaccaactgctgctgggacctgggccctcgaatctcccacctcggatcatggcagcggggggcttgcaaatgattggttcaatgtctaaagacatgtaccagatcatggacgagattaaagaagggatccaatacgtttttcaaacccgtaatcccctgacgcttgtgatatcgggtagcggacattgcgccctggaagcagcacttgtgaatgtgcttgaacctggcgactcgtttcttgtcggggcaaacgggatttggggccagagagcagtcgacattggagaacgcattggagcgcgcgtgcatccaatgaccaaggacccaggaggtcactatacgctgcaggaagttgaggaaggcttggcgcaacacaaaccggtcttgcttttcctgacgcacggcgaaagctcaaccggggtccttcaaccactggatggatttggcgagctgtgccataggtacaagtgtctgctgctggtcgattcggtcgcgtcgcttggtggtactccactgtacatggatcgacaaggaatcgatatactttactctggatcacagaaggctctgaacgcacctccaggtacttccctgatcagcttctcagacaaggcgaagaagaagatgtactcccgtaagaccaagccgttttctttctacctcgacatcaaatggctggccaacttttggggttgcgatgatcagcctcggatgtaccatcatactattcctgtgatatcactgtattccctccgagaatccctggcgctcatcgcagagcaaggacttgaaaactcctggcggcagcatcgagaagctgcagcctatcttcatggacgccttcaagcactgggtttgcagctgtttgtgaaagatcctgctctgaggctccctactgtcaccaccgtggcagttcccgctggctacgactggcgggatatcgtttcgtatgtcatcgatcattttgatatcgaaatcatggggggcctgggaccaagcacgggaaaggtcctgaggattggccttctcggatgtaacgccactagagagaacgtggacagggtgaccgaagccctcagagcagcacttcagcattgtcctaaaaagaagctg

SEQ ID NO: 249280 - DNA, 1176 bp, Artificial Sequence
  Description of Artificial Sequence: Synthetic coding sequence
atggcctcacataagttactagtgacaccaccaaaggccctgctcaagcccctgagtattccaaatcagttgctgctgggcccgggcccatctaacttgccgccacgcatcatggcagctggaggcctgcaaatgattggtagtatgtcgaaggatatgtaccagattatggatgaaattaaggagggaattcaatacgtcttccagacccgcaatcccttgaccctggtgattagcggttccggacactgcgccttggaagccgcgctcgtaaatgtcctggagccgggcgatagcttcttggtgggcgcgaacggcatctggggacaacgagcggttgacataggcgagcggataggagcgcgagtacaccctatgaccaaagatcccggaggccactacacgctccaggaagtggaggagggccttgcccaacacaagcctgtgctgttgttccttacccatggcgagtctagcacgggcgtcctccagcccttggacggctttggcgaactgtgccaccgttacaagtgtctgctgctggtcgatagtgtggctagcctcggcggaactcccctctacatggacaggcagggcatcgacatcctgtactcgggatcgcagaaggccctgaacgccccgccaggaacgtcgctcatttccttctcggacaaggcaaagaaaaagatgtactcgcgtaagactaagcccttctccttctatctagatatcaagtggctcgcaaacttttggggctgcgacgaccaacctcgcatgtaccaccatactattccagtcatctccttgtacagcttgcgggagtctctggcgctgattgcagagcagggcctggagaattcctggaggcagcatcgtgaggcagctgcttaccttcacggacgtctacaagcattgggcctgcagttatttgtgaaagatcccgcgctccgtctaccgacggtgacaacggttgcagtgccagccggttacgattggagggacatcgtgtcctacgtcatcgatcatttcgatattgagattatgggcggcttaggcccctcgaccggtaaggtcctgcgcattggcctgctgggatgtaacgcgacccgcgagaacgtggatagagtgacagaagcgttacgcgccgccctacagcattgcccaaaaaagaaactg

SEQ ID NO: 249281 - DNA, 1176 bp, Artificial Sequence
  Description of Artificial Sequence: Synthetic coding sequence
atggcatcccacaagctcctcgtcacaccgccaaaggccctactgaagccgctgtccatcccaaatcaactgctcctcggcccaggaccttccaacctgccgccccgcattatggccgctggaggcctgcagatgattgggtcaatgagcaaggatatgtaccagatcatggatgagatcaaagaaggcatccagtacgtgtttcagaccaggaaccctttaacattggtcatctcaggatctggccactgcgctctggaggccgctctggtgaatgttctggaaccaggagatagcttcctggtcggcgccaatggaatctggggacaaagggcagttgacatcggcgaacgcattggagctcgcgtgcacccaatgaccaaggaccccggaggccactacactctgcaggaagttgaagagggtcttgcccagcacaagcctgtgttactttttctcactcacggagaaagttcgacaggtgtccttcagccactggacggattcggcgaactgtgtcatcgctacaaatgtttgcttcttgttgactccgtggcctctctggggggtacccccctgtatatggaccggcagggaattgacatcctgtatagtgggtcacagaaggctctcaacgccccccccggtacgagtttgatctccttcagcgacaaggcaaagaagaagatgtacagtcggaagaccaaacctttctccttttacctcgacatcaaatggctggccaacttctgggggtgtgacgaccagccacgcatgtaccatcacaccatccccgtcatctcactctacagtttaagagagtcccttgcactgatcgccgaacagggcctggagaactcctggcgccagcaccgggaggccgccgcttacctgcatggcaggcttcaagcgctcggcctccaattatttgtgaaggatcccgccttacgcctgcccacagtgacaacagtggctgtgcccgccggatacgactggcgcgacatcgtgagttatgtaatcgatcactttgatattgagattatgggcggactgggtccgagcaccgggaaagttctccggattgggctgcttgggtgtaacgccactagggagaatgtcgaccgagtgacggaggcactgcgggccgcgttacaacattgtcccaaaaagaagtta

SEQ ID NO: 249282 - DNA, 1176 bp, Artificial Sequence
  Description of Artificial Sequence: Synthetic coding sequence
atggcttcgcataaactccttgtgacgccccctaaggctcttctgaaacccctctcgatacctaaccaactccttcttggacctgggccttcgaatctcccaccacgcattatggctgcaggtggacttcagatgatcggaagcatgtccaaagacatgtaccagattatggacgaaatcaaggaaggaattcagtacgtgttccagacccgcaatccgctcactctggtgatctcaggatccggccattgtgcgctggaagcagcacttgtgaacgtgttggagcctggagattcgttcctggtgggggccaacggcatatggggtcagcgcgcagtggatatcggagagagaattggggcacgggtgcatcctatgaccaaagaccctggtggtcactacaccctgcaggaagtggaggagggacttgcacagcataagcctgtgttgctgtttcttacccatggagaatcgtcgacgggggtgctgcaacctcttgacggttttggagaactgtgtcatagatacaagtgccttctccttgtggattccgtcgcctcgttgggaggcacgcccctttacatggatcgtcaagggatcgatattctttattcagggtcgcagaaggcactcaatgcaccccctggaacctcgcttatttcctttagcgataaggcaaagaagaagatgtactctcgtaaaaccaagccattttcattctacctggacatcaagtggctggcaaatttctggggatgtgatgaccagccaagaatgtaccaccatactattccagtcatttcattgtactcgttgcgggagtcgctggcactgattgccgaacaaggactggaaaactcgtggcgacagcacagagaagcggcagcatacctccacggaaggcttcaagctctgggacttcaactttttgtgaaggacccagcgctgcggcttccgactgtgactaccgtggcagtgcccgcaggctacgattggcgggatattgtgagctacgtgattgaccactttgacatcgagattatgggcggtctgggaccttcgactggcaaggtcctgcgcattggactgttggggtgtaatgcaaccagggaaaacgtcgacagggtcactgaggcacttagggctgctctgcagcactgtcctaagaagaagctg

SEQ ID NO: 249283 - DNA, 1176 bp, Artificial Sequence
  Description of Artificial Sequence: Synthetic coding sequence
atggcctcacacaagttgcttgtgaccccacccaaggcacttttgaaaccactgagcataccaaatcagttgttactgggccctggcccctcaaacctgccaccaagaattatggctgccggtggcctacaaatgatcggatccatgtcaaaggatatgtatcagatcatggacgagatcaaggagggcattcaatacgtgttccagaccaggaaccctctcacattagtcatctcaggatcgggccactgtgccctggaagcggccctggttaatgtgctggagcccggggattcctttctcgtgggggcaaatggcatctgggggcagagggctgtggacataggggaacggatcggcgctcgagtgcaccctatgacaaaggaccctggcggccattacaccctccaagaagtggaagagggcctggcgcagcataaaccagtgctgctctttctgacacatggagagagtagcaccggggtgctccagcccctggacggctttggcgagctctgccatcgttacaagtgcctgttgctggtagattccgtggcttcgctcggtggcaccccgttatacatggatcgacaagggatagacattctgtacagcggatcccagaaggccttgaacgcgccaccagggacctctctcatttctttctccgacaaggcgaaaaaaaaaatgtacagcaggaagacaaaaccattctctttttatctcgacatcaagtggctggccaacttttggggatgcgatgatcaaccaaggatgtatcaccataccatcccagtgatctccctgtactcccttcgagaatctcttgccctgattgccgaacagggactggaaaactcatggcggcagcatagagaggccgccgcttacctgcatggccgcctgcaggcgctcgggctgcaactgttcgtgaaagaccctgcgctccggctacctactgtgaccacagtggcagtgcccgccggatacgattggcgagatatcgtctcatacgtgatcgaccacttcgatattgagatcatggggggcctcggcccatcaacgggcaaggtgctgcgaatcgggttactgggctgcaacgccacacgggaaaacgtggaccgcgtcacggaggcactgagggccgctctccagcactgccccaagaaaaaactg

SEQ ID NO: 249284 - DNA, 1176 bp, Artificial Sequence; identical to SEQ ID NO: 249208
  Description of Artificial Sequence: Synthetic coding sequence

SEQ ID NO: 249285 - DNA, 1176 bp, Artificial Sequence
  Description of Artificial Sequence: Synthetic coding sequence
atggcgtcgcataaacttctggtgactccacctaaggcattgctgaaaccgctctccatcccaaatcagctgctgctgggacctggaccaagcaatctcccgccgcggatcatggcagcagggggcctgcaaatgatcggatcgatgagcaaggatatgtaccagatcatggacgaaattaaagaaggaatccagtacgttttccagacccgcaatccgcttaccctggtgatttccgggagcggacattgcgcccttgaggccgccttggtgaacgtcctcgagcccggagattcgttcctcgttggagcgaacggaatctggggccaaagagcagtcgacatcggcgaacgcatcggagcccgcgtgcacccaatgactaaggacccgggtggtcactacaccctgcaggaagtcgaggaaggactggcgcaacataagccggtgctcctgtttctgacccacggcgagagttcaaccggcgtcctgcagccgctggatggtttcggggagctgtgccaccggtacaaatgcctccttctggtggactccgtcgcctcattggggggaacccctctctacatggaccggcaaggcatcgacattctgtacagcgggagccagaaggctctgaacgcgcccccgggaacttccctcatctcattctcggataaagctaaaaagaagatgtactcccgtaagactaagcccttctctttttatctggacatcaagtggttggcgaacttctggggctgcgatgatcaaccaagaatgtaccaccacacgatcccagtgatctcgttgtacagcctcagggagtcgctcgccctgattgccgaacagggactggaaaattcgtggcgacaacaccgggaagcagcggcctacctgcatgggagactgcaggctctcggcctccagctcttcgtcaaagaccctgccctccggctgcctactgtgacgaccgtggctgtgccggctggttacgattggagagacatcgtctcatatgtgatagaccactttgatatcgagatcatgggcggactgggaccctccactggtaaggtgctgcgcatcggactgttgggatgtaacgcgacccgcgaaaacgtggaccgcgtgactgaggcccttagggccgcactgcagcattgtccgaagaagaagctc

SEQ ID NO: 249286 - DNA, 1176 bp, Artificial Sequence
  Description of Artificial Sequence: Synthetic coding sequence
atggccagccataagttgctggtgactccaccgaaagctcttctcaagccactgtctatacctaatcagctgctgttgggccctggcccaagtaacctgccaccaaggatcatggccgccggtggactgcagatgatagggtccatgtcaaaggacatgtatcagattatggacgaaatcaaagaaggtattcaatacgtgtttcagacccgaaatccgctgacccttgtcatctccggaagcggacactgtgcccttgaggccgctctggtcaacgttctggaaccaggggatagcttccttgtgggggctaacggtatctggggccagcgggccgtggacataggcgaacggatcggcgcccgagttcatcccatgactaaggacccagggggccattacactttgcaggaagtagaagagggcctggcacagcacaagcccgtactgctttttctgacccatggggagtcttccaccggagtactgcagcccctggacggctttggagaactgtgccataggtacaagtgcttattactggtggacagcgtagccagtttagggggaaccccgctctacatggatcgccaggggatcgatatactgtacagcgggagccaaaaggctctgaacgccccccctggcaccagcttgatctcattcagcgataaagccaaaaagaaaatgtatagtaggaaaactaagccattttccttctacctagatataaaatggctggctaacttctggggctgcgatgatcagcctcgtatgtatcatcatactatcccggttatcagcctgtattccctgcgggagtccttggctctgattgccgaacaaggtctggagaattcatggagacaacatagagaagctgccgcatatttgcatgggagacttcaggccctgggcctacaactgttcgtcaaagatccagccctgcggctccctactgttactaccgtcgctgttccagccggctatgactggcgcgacattgtgtcgtacgttatcgatcatttcgatatcgagatcatggggggcttgggtccgagtaccgggaaggtgctgcgtattggactcctcggatgcaacgcaaccagagagaacgtggacagggtgactgaagcgctgcgagcggctctccaacactgcccaaaaaaaaagtta

SEQ ID NO: 249287 - DNA, 1176 bp, Artificial Sequence
  Description of Artificial Sequence: Synthetic coding sequence
atggcgtcacataagctcctggtgaccccaccaaaagcacttctcaagccactgtccatacccaaccaacttctgcttggtccgggtccttccaacctgccgccacgtattatggccgccggaggactgcagatgattgggagcatgtcgaaggacatgtatcagattatggatgagatcaaagagggaatccaatacgtttttcagacgcgaaacccgctgactctggtgatttcgggctctggccactgcgcacttgaagcagcactggtgaacgtgcttgagccgggtgattcgtttcttgtgggcgcaaacggtatctggggacagagagccgtcgacattggtgaaaggataggagcacgtgtgcatcctatgacgaaggatcctggcggccattatacccttcaggaggtggaagaggggctggcacaacataaacccgttcttctgttccttactcatggagaatcgtcgaccggcgtcttgcaaccactcgacggattcggggaactgtgtcatagatacaagtgtcttttgttggtggatagtgtcgcatcactgggaggcacgcccctgtacatggatagacaaggaattgacattctttactctggatcccagaaagccctcaacgcacctcccgggacctctctgatctccttcagcgataaagcaaaaaagaagatgtattcccgtaagactaagccattttcgttttacctcgatatcaagtggcttgctaatttctggggttgtgacgatcaacctcggatgtaccatcatactatccctgtcatttcactttacagccttcgcgaatcactggcccttatcgcagaacaaggccttgaaaattcgtggagacaacatagggaagctgccgcctaccttcacggacgcctccaggcactgggactgcaactttttgtgaaagatcctgctctgaggctcccaactgtgaccaccgttgcggtgccagccgggtacgactggcgcgatatagtgtcgtacgtgatcgatcatttcgatattgagattatgggtggattgggaccctccaccggtaaagtcttgagaatagggctgcttggatgtaacgcaacgagagagaatgtggatcgagttacggaagctcttcgcgcagcacttcaacattgtcctaagaagaaactc

SEQ ID NO: 249288 - DNA, 1176 bp, Artificial Sequence
  Description of Artificial Sequence: Synthetic coding sequence
atggcttctcataagcttttggtaactcctccaaaggctctgctcaagccactttccatcccaaatcaacttcttctggggccaggaccgagtaatcttccgccacgcatcatggccgccgggggcctgcagatgatcggctctatgtcaaaagatatgtatcagatcatggatgagatcaaagagggaatccagtatgtgttccagacacggaaccctctaacactcgtcatttctgggtcgggtcactgtgcacttgaggccgccctggtgaacgtgttggaaccgggggatagctttttagtcggcgccaatggaatttggggacagcgggcagttgatatcggggagcgtattggagctagagtccacccaatgactaaggatcctggcggccattatactctgcaggaggtcgaggaaggcctggctcaacataagccggtgctgctctttctaactcacggggaatcttctaccggggtgctccagcccctcgatggattcggagagctgtgtcaccggtacaagtgtctcctgctggtagacagcgtggcctctctcggaggcactcccctgtatatggataggcaggggattgatatcctctattctggctcgcagaaggctctgaatgccccaccgggcacctcccttattagtttctctgataaggccaaaaagaaaatgtactcccgtaaaacgaagccattcagtttttatctagacattaagtggctcgcgaacttttggggctgtgacgatcagcctcgtatgtaccatcatactatacctgtgatcagtctctattcactacgcgaaagcctggcgttaattgcggagcagggcctagagaatagttggcgacaacatagggaagcagcagcttacctccacggacgtctccaggccctggggttgcagctttttgttaaggatccggccctccgcttgcctacagtgacaacagtggctgttcccgccggctatgactggcgagacatagtgagttatgtaattgatcacttcgacattgagatcatgggtggcctcggacccagtacaggaaaggtcctccgcataggcttgctcggctgtaatgcgactcgggaaaacgtggaccgggtgacagaagccctccgagcggcactccagcactgcccgaaaaagaagttg

SEQ ID NO: 249289 - DNA, 1176 bp, Artificial Sequence
  Description of Artificial Sequence: Synthetic coding sequence
atggcgtcgcacaagctgcttgtgaccccacctaaggcccttctgaagcctttgtcgatccctaatcaactgctcctcggacccggtccatcaaacctcccgccgaggattatggctgccggagggctgcaaatgatcggctcaatgtccaaggacatgtaccagattatggatgagatcaaggaaggaatccagtacgtgttccagaccaggaatcccctcaccttggtgatctcaggttcagggcattgtgccctcgaagcggccctggtgaacgtcctggagcctggagattccttcctggtgggcgccaacggcatctggggacagcgggcagtggatatcggcgaaagaatcggcgcgcgcgtccaccctatgaccaaggacccggggggtcattacacccttcaggaggtggaagaaggcctcgctcagcacaagcccgtcctcctcttcctgacgcatggagaatcgtccacgggggtgctgcaaccactcgatggattcggcgagctgtgccatcgctataagtgcctcttgctggtggattccgttgcttcgctcggaggcaccccactgtacatggatcgccagggtatcgacattctgtactcgggatctcagaaggcgcttaatgccccgccgggaacttcactgatttccttctcagacaaggcgaagaagaaaatgtattcaagaaagactaagccattctcgttctacctcgatatcaaatggctcgcgaacttttggggctgcgacgaccagcctcgcatgtaccatcacaccatccctgtcatctcgctgtactcacttagagaaagcctggccctcatcgccgaacaggggctggaaaacagctggcggcagcaccgcgaagctgccgcctaccttcatggacgcctgcaggccctcgggctgcagctcttcgtgaaagacccggcgctccggctgccgaccgtgaccaccgtggccgtgccggcgggatacgactggcgggatattgtgtcgtacgttattgaccacttcgacatcgaaatcatgggcggactgggtcccagcactgggaaagtgctccgcatcggactgctcgggtgcaatgccactcgggaaaacgtggatagagtgaccgaagccctgcgcgccgcgctccaacactgtcctaagaagaaactt

SEQ ID NO: 249290 - DNA, 1176 bp, Artificial Sequence
  Description of Artificial Sequence: Synthetic coding sequence
atggctagccacaaattattagtgaccccacccaaagccctcctgaaaccattatccatcccgaatcagctgcttctcggccctgggccttctaatcttcctcccagaatcatggccgccgggggcttgcagatgattggctcgatgagcaaggacatgtatcagatcatggacgagataaaggagggcatccaatatgtgttccagacaaggaaccctctgactttagtcatctccggatctggacattgcgcccttgaggccgctctggtgaacgtcctcgagcccggagattcgtttctggtcggcgccaatggcatttggggtcagagggctgtcgatataggagagaggattggggctcgcgtgcacccgatgaccaaggatcctggaggacattacacacttcaggaggtagaggagggcctggcccagcacaaaccggtcctgttgtttctcacccatggcgagtcaagtacaggcgtgttacagccactggatggtttcggcgagttatgtcacaggtataagtgcctgctcttagtggattccgtagctagtctgggtggcacgcctctctacatggaccgtcaggggattgacattctgtactcagggagtcaaaaggcgctgaatgcacctcccggaacctctctgatctcttttagtgacaaggctaagaagaagatgtacagccggaagacaaaaccgttcagcttttacctggatatcaagtggctcgctaatttctgggggtgtgacgatcagcctcggatgtatcatcacacgatccctgtgattagcctctactccctacgtgaaagcctcgccctgatcgctgagcaaggcctcgagaactcttggcgtcaacaccgagaggccgctgcatatttacacggaaggttgcaggccctgggactgcagctcttcgttaaggaccccgcactccggctccctacagtaaccaccgtggctgtgcctgctggatacgattggcgcgacatcgtttcctacgttatcgaccatttcgatatcgagatcatgggcggcttgggtccatctacaggtaaggttctgcgtattggtttgctggggtgcaatgcaactcgggaaaacgtggatcgggtaactgaagccctgagagctgccttgcaacactgcccaaaaaagaagcta

SEQ ID NO: 249291 - DNA, 1176 bp, Artificial Sequence
  Description of Artificial Sequence: Synthetic coding sequence
atggcaagccacaagctcctcgtgaccccgcccaaggcgctcctcaagccgctcagcatcccgaaccagttgctgctggggccgggaccatccaacctgccgcctcgcatcatggcagcgggagggctccaaatgatcgggtccatgtcaaaggacatgtaccaaatcatggacgaaatcaaggagggaatccagtacgtctttcagaccaggaaccccctgacgctcgttatttccggatcaggtcattgtgccttggaggccgctctggtgaacgtgctcgaaccgggcgattccttccttgtgggagcgaacggcatctggggccagcgcgccgtggacatcggcgagcggattggggctcgcgtccatcctatgacgaaagacccaggaggacattacaccctgcaggaggtggaagaaggactcgcgcaacataagccggtgctgctgttcttgacgcacggagaatcatcgactggcgtgcttcagccattggatggcttcggcgaactgtgccatcgatacaagtgcctgctcctcgtggactcggtggcctctctgggcggcaccccgctgtacatggataggcagggcatcgatatcctgtacagcggatcacagaaagctctgaatgcgcctccgggaacttcactgatctccttttcagacaaggctaagaagaagatgtactcgagaaaaactaaacctttctcgttttacctcgatatcaagtggctcgctaacttctggggatgcgatgatcagccgcgcatgtaccaccacactatcccggtgatctccctctactcgctgcgggagtcgctcgccctcattgctgagcaggggctggaaaactcctggcgccagcacagagaggccgccgcctacctgcatggacgcctccaggcactgggtctgcagctctttgtgaaggatccggccctgcggctgcctactgtgaccaccgtggctgtgccggcgggatacgattggagggacatcgtctcgtacgtgatagaccacttcgatatcgagatcatgggagggctgggcccgtccacgggcaaggtgctgagaatcggcctgctgggatgcaacgcgacccgcgagaacgtggaccgcgtgactgaggcgcttagagcggccctgcagcattgcccaaagaagaaactc

SEQ ID NO: 249292 - DNA, 1176 bp, Artificial Sequence
  Description of Artificial Sequence: Synthetic coding sequence
atggcatcgcataaactgctggtgacccctcccaaagcgctcctgaaaccgctttccattccaaaccaactgctcctgggacccggaccaagcaacctgcctcccagaatcatggcagcggggggccttcaaatgataggctcgatgtcaaaggatatgtatcaaatcatggacgaaatcaaggaaggaatccagtacgtgtttcagactagaaatccactgacgctggtgatctcgggctcaggccattgtgcactggaagcagcactcgtcaacgtgctggaacccggagacagctttctggtcggagccaatggaatctggggccagagagcagtcgacattggtgaacgcatcggagcgagagtgcaccctatgactaaggatcctggaggtcactacactcttcaggaagttgaggaaggactggcgcaacataagcctgtcctcctcttcctcactcatggcgagtcgagcaccggggtgctccaacctcttgacggttttggtgagctgtgccaccgctacaagtgcctgcttcttgtcgatagcgtggcctcactgggaggcacccctctttacatggatcgacaggggatcgatatcctttactcggggtcgcaaaaggcacttaacgcgccccctggtacctccctcatttcgttttccgataaggcaaaaaagaaaatgtactcacgaaagaccaagcccttttcattttaccttgacatcaagtggcttgcaaacttttgggggtgtgacgatcagccgcgtatgtaccaccataccatcccggtcatttcactctactcgcttagagaatcactggcactgattgctgaacaggggctcgaaaactcgtggaggcagcacagggaagctgccgcctacctgcacggtagactgcaggctctcggccttcaactgtttgtgaaggaccctgcgctgcggcttcctactgtcaccactgtggcagtgcctgccgggtacgactggcgggatatcgtgtcctacgtgatagatcatttcgatattgagattatgggagggttgggtccatcaactggaaaagtcctccggattggcctcttgggctgcaacgcaactcgcgaaaacgtggatagagtgactgaagcactgcgagcagccttgcaacattgtccaaagaaaaagctg

SEQ ID NO: 249293 - DNA, 1176 bp, Artificial Sequence
  Description of Artificial Sequence: Synthetic coding sequence
atggctagccataaactcctggtcaccccacccaaggcccttctgaagccccttagcattccgaaccagctgctcctgggacccggcccatctaatctgcctcccagaatcatggcggcagggggcctgcagatgataggcagcatgtctaaagatatgtaccaaatcatggatgagatcaaagagggaatccagtacgttttccagactaggaaccccttaaccttagttatctctggttcaggccactgcgccctcgaagcagccctcgtcaacgttctggagcctggagatagctttctggtaggtgccaacggaatttggggtcagagggctgtggacataggggaaaggataggagctcgcgtgcatcccatgacgaaggaccccggaggtcactataccctgcaagaagtggaagaggggttagctcagcacaaacccgttttgttgttccttacgcatggcgagtcaagcacaggagtcctacagcccctcgatggattcggcgaactctgccatagatacaagtgcttgctcctcgtcgattccgtggctagtcttggaggcacaccgctgtacatggatagacaaggaatcgatatcctgtatagtggctctcaaaaagccctgaatgctcccccgggaacttccctgatctctttcagcgataaagctaagaagaagatgtactcgcgaaagacaaagcctttttcattctatctggatattaagtggcttgctaacttttgggggtgcgatgatcagcccaggatgtatcaccataccatccctgtaatctcgctttatagtttgcgcgagagtctcgctctgatagctgaacaaggcctggaaaactcctggaggcaacacagggaagccgctgcgtacctccacggacgcctccaagctctcggcctccagctcttcgtcaaggatccagcgcttcgtttgcctaccgttaccaccgttgcggttccggctgggtatgactggagggatatcgtttcatacgtgattgatcactttgacatcgagataatgggcggacttggaccctctaccgggaaggtcctgaggatcggcctgcttggatgcaacgctacccgcgaaaacgtggaccgggtcaccgaagctctgagagctgccctgcagcattgccctaaaaaaaaactc

SEQ ID NO: 249294 - DNA, 1176 bp, Artificial Sequence
  Description of Artificial Sequence: Synthetic coding sequence
atggcatcacataaacttctggttacacctcccaaggctctgcttaaacctcttagtatccccaaccagctcctgcttggccccggcccgagtaatttgccacctcgcatcatggccgctggggggcttcagatgattggatccatgtccaaagatatgtatcagataatggatgagatcaaggagggaattcagtacgtttttcagacacgaaatcctctgaccctagtcatctccggctcaggacactgtgccctggaggcagcattagtgaatgtgttagaacctggcgactcctttctggtgggagccaacggtatttggggacagcgagccgtagatatcggtgaaaggatcggcgctagagttcaccctatgacgaaagatcccggcggccactacacacttcaggaggtggaagaaggtctggcccagcacaagcctgtactgctgttcttgacccacggagaaagcagtacgggagtgctgcagcccctggacggattcggcgaactctgccacaggtacaagtgtctgttgcttgtggatagcgttgcctctctaggcggcacccccctatatatggacagacaaggtatcgacattttatattccggaagccagaaggctctcaacgcgccacctggcacatccctcatttcgttttctgataaagccaaaaaaaaaatgtacagtaggaaaaccaagcccttcagtttctacttggacattaaatggttagctaatttttggggttgtgatgatcagcctaggatgtatcaccacaccattccggtcatttccctgtattctttgcgcgaatcactagccctgattgccgagcaggggttggagaacagttggcggcaacatcgtgaggcggccgcatacctgcacggccggctacaagcactgggtctgcagttatttgtaaaagatccggctctaaggcttcctactgttacaaccgtggccgtacctgccggttacgattggcgggatatcgtttcatatgtaattgatcatttcgacatcgagataatggggggtctgggcccatctacgggtaaggtcttgagaatcggactgttgggctgcaacgcgacccgcgagaacgtagatcgcgtgacagaagccctgcgggccgcgcttcagcattgccctaagaaaaagctg

SEQ ID NO: 249295 - DNA, 2007 bp, Artificial Sequence
  Description of Artificial Sequence: Synthetic coding sequence
atgaaatgggtgtcatttatctcacttctgtttcttttctcgtcggcatactccgggtcgttggacaagcggcacggcgaagggacctttacgtccgatgtctccagctacctcgaaggacaggccgctaaagagtttatcgcctggcttgtcaagggacggcacggggagggcaccttcacctccgacgtgagctcctaccttgagggacaagccgccaaggaattcatcgcttggctcgtgaagggacgagatgctcacaagtcagaagtcgcccaccggtttaaagatctcggcgaagagaactttaaggcactggtcctcattgccttcgcacaatatcttcagcagtgcccctttgaggaccatgtgaaactggtgaacgaagtgacggaattcgccaagacctgtgtggcagacgaaagcgccgaaaattgtgacaagtcgctccataccctgtttggtgataagctgtgtaccgtggcaacgctgcgagaaacttatggtgaaatggccgattgttgcgctaagcaggaacccgaacgtaacgagtgttttttgcagcataaggacgacaacccgaatcttcctcgcctggtgcggccggaagtcgatgtgatgtgcactgcgtttcatgataatgaggaaacttttctcaagaaatacctctacgagattgcgcgtagacatccttatttctacgcgcctgaactgcttttctttgcaaaaagatacaaggcagcatttaccgagtgctgccaagccgcagataaagccgcttgtctgttgccgaaacttgatgagctgcgcgacgaaggtaaagcatccagcgcaaagcaaaggcttaagtgtgcaagccttcagaaatttggcgaacgggcattcaaagcctgggcggtcgcacgcctgtcccaacgcttccccaaggcagaatttgcagaagtgagcaagctcgtcaccgatctgaccaaggtccataccgagtgttgtcacggagacttgcttgagtgcgcagatgacagagcagatctggcgaagtacatatgcgaaaatcaagacagcatttcatccaagttgaaagagtgttgcgaaaaaccattgctggagaaatcccactgtatcgccgaagtggaaaatgacgaaatgccggcagatctcccttcgcttgcagctgatttcgtggagtccaaagatgtgtgcaagaactacgccgaagctaaggatgtgttccttgggatgtttctttatgaatacgcaagaaggcatccagattacagcgtcgtgcttcttctgaggctcgccaagacttatgaaaccactctggagaagtgctgtgcagcagcagatccacatgagtgttacgccaaggtctttgacgagtttaaacctcttgtcgaggagccacagaatctcattaagcagaactgtgaactttttgagcaactgggagaatacaagtttcaaaacgccctgctcgttcggtacaccaagaaggtgcctcaagtgtcgactcctactctggtggaagtgtcccgcaacttgggaaaggtcggctcaaagtgctgcaaacacccagaagcaaagagaatgccatgcgctgaggattacctgtcggtcgtgttgaaccaactttgtgtgttgcatgaaaagacccccgtttcggacagagtgacgaaatgttgtaccgagagcctcgtgaacaggaggccatgtttctcggcgcttgaagtcgatgaaacctacgttcctaaggagttcaacgctgagactttcacctttcatgctgatatttgcactctgtcggaaaaggagagacagattaagaaacaaacggcactcgttgaactcgttaaacataagccaaaagccactaaagaacagctgaaggcagtgatggatgacttcgctgcatttgtcgagaagtgttgtaaggctgatgataaggaaacgtgttttgcagaagaagggaagaagctggttgcagcgtcacaagcggcgctgggcttg

SEQ ID NO: 249296 - DNA, 2007 bp, Artificial Sequence
  Description of Artificial Sequence: Synthetic coding sequence
atgaagtgggtgtcttttatcagcttgctcttcctcttctcgtcagcatatagcggttcgctggataagcgccatggagaagggaccttcactagcgatgtgtcatcgtacctggaaggacaagccgccaaagagttcatcgcgtggctcgtgaaaggacgccacggcgaaggcaccttcacctccgacgtgtcctcgtacttggaggggcaggccgcgaaagaattcattgcttggctggtgaagggacgcgatgcgcacaagtctgaggtggcgcataggtttaaggacctgggtgaagaaaacttcaaggcgttggttctcatcgcatttgcccagtacctgcagcaatgccctttcgaggaccacgtcaaactggtgaacgaggtgactgaattcgccaagacttgcgtcgcggacgaatccgcagaaaactgcgacaagtcgctgcacactctcttcggcgacaagctctgcactgttgcgacgctgagagaaacttacggcgagatggccgactgttgcgcgaagcaggaaccggaacggaacgagtgtttcctgcagcacaaggatgataacccgaacctgccgcggctggtgcggccggaagtcgacgtgatgtgcaccgctttccacgacaacgaggagactttcttgaagaagtacttgtacgagattgcgagacggcacccctacttttacgcccctgaactgctgttcttcgccaaaaggtataaggctgcttttactgaatgctgtcaggcagccgacaaagcggcctgcctgcttcctaagctcgacgaactccgggacgaaggcaaggcgtcgagcgccaaacagcgcctcaagtgtgcgtccttgcagaagttcggggaacgggctttcaaggcctgggccgtggcgcgcctctcgcaacgctttccaaaggccgaatttgccgaggtgtccaagctggtgaccgatctgacgaaggtgcacaccgaatgttgtcacggagatctcctggaatgtgctgatgatcgggccgatcttgcaaagtacatttgcgaaaaccaggactcgatctcttccaagctcaaagagtgctgtgagaagcctctcttggaaaagtcgcactgcatcgcagaggtggagaacgatgaaatgccggcggacctcccgagcctggccgctgatttcgtggagtcgaaggacgtctgtaagaattatgcagaagcgaaggacgtgttcctcggcatgtttctgtacgagtacgcaagaaggcatcccgactactcggtggtcctgctgctgcgcctcgccaaaacttacgagactaccctggaaaagtgctgcgcagcggccgatccgcatgaatgctatgcgaaggtgtttgatgaattcaagcctctggtggaagaacctcagaacctcatcaaacagaactgcgaacttttcgaacaattgggagagtacaagtttcaaaatgcgctcctggtccggtacaccaagaaggtcccccaagtgtccaccccaaccctggtggaggtttcccggaacctgggaaaggtgggatcgaaatgttgcaagcacccggaggccaagagaatgccatgcgctgaggactacctgagcgtggtgttgaaccagctgtgtgtgctgcatgaaaagaccccggtgtctgacagggtgacgaagtgctgcactgagtcactggtgaaccgccgaccatgtttttccgcgctggaggttgacgaaacctacgtgcctaaggaattcaatgccgaaacgttcacctttcacgcggatatctgcacgttgtcagaaaaggagaggcagatcaagaaacagaccgccttggtggagctcgtgaagcataagccaaaagctaccaaggaacaactgaaagcggtcatggatgactttgccgcatttgtggagaagtgctgcaaagctgatgacaaggaaacctgtttcgcggaggaggggaagaagttggtggccgcctcacaggcggccctcggactt

SEQ ID NO: 249297 - DNA, 2007 bp, Artificial Sequence
  Description of Artificial Sequence: Synthetic coding sequence
atgaagtgggtatcatttatctctctgttattcctattcagcagcgcttacagcggcagtttggataagaggcacggcgagggtactttcacatctgacgtcagctcatacctggaagggcaggccgcgaaagagttcattgcttggctggtgaaagggaggcacggagagggtacctttacctccgatgtgtcgagttaccttgaaggtcaggctgccaaagagttcatcgcctggctggtaaagggtcgggacgcccacaaatctgaggtagcccaccgttttaaggacctgggcgaggagaatttcaaggctctggtcctgatagcattcgcccagtacctgcagcaatgccccttcgaagatcacgtgaaattggtgaacgaggtcaccgaatttgccaaaacatgcgttgcggacgaatctgcagaaaactgtgataaaagtctgcatacgctgttcggtgacaagctatgcaccgttgccactctccgggagacctacggcgagatggcagactgttgcgcaaagcaagagccggaaaggaacgagtgctttttgcagcataaggacgataaccccaatctgccgagactggtgcgcccagaagttgacgtgatgtgtacagcgtttcacgacaacgaggagactttccttaagaagtacctgtacgagatagcccggcgccacccttacttttatgccccggaacttctgttcttcgcaaagaggtacaaagctgcctttacagagtgctgtcaggctgcagataaggcggcctgtttgctcccgaagctcgacgagttacgggacgagggcaaagcctcgagtgccaaacagaggctgaaatgtgccagcctacagaagttcggcgagcgagccttcaaggcctgggccgtcgcacggttaagtcagaggtttcccaaggcggaatttgccgaagtttcgaagctggtcacagacttaaccaaagtgcatacggaatgctgccacggagacctgctggagtgtgctgacgatcgcgccgatctggctaaatatatctgcgagaaccaggattccattagctcgaaactgaaagagtgttgtgagaaacctttactcgagaagagtcattgcatcgcggaagtagagaacgatgagatgccggccgatctcccaagcctggctgccgattttgtcgagtctaaagacgtctgcaagaattacgcagaagccaaggacgtcttcttggggatgtttctttatgagtatgccaggcgtcatccggactactctgtggtgctgctcttgcggctggccaagacatatgagacaacactggaaaagtgctgcgccgctgccgacccacacgagtgctacgcaaaggtctttgatgagttcaagccgcttgtagaagaaccacagaatcttatcaagcagaactgcgagttattcgagcaactcggtgaatacaagttccagaacgccctcctcgtgaggtacacaaaaaaggtgccacaggtgagcacacctacactggtagaggtgtcaaggaatctcggaaaagtgggatctaagtgttgtaagcacccagaggcgaaacggatgccttgcgcagaagactacctttccgtcgtgcttaaccagctctgcgtgctgcacgaaaaaacacccgtatctgatcgtgtcacaaagtgctgcaccgagtccctagttaatcgacgtccgtgcttctctgctttagaagtcgacgagacttacgtgcccaaggagttcaatgccgaaacgttcacatttcatgctgacatctgcacccttagcgaaaaggaacggcagataaagaagcagaccgccctggtggagctcgtcaaacacaagcctaaagccaccaaagagcagttaaaggcagtgatggacgatttcgctgcgttcgttgaaaagtgttgtaaagcagacgacaaagagacatgtttcgccgaggagggcaaaaagctcgtggcagcttcccaggcagcccttggcttg

SEQ ID NO: 249298 - DNA, 2007 bp, Artificial Sequence
  Description of Artificial Sequence: Synthetic coding sequence
atgaaatgggtttcttttatttccctgttgtttctgttctcatccgcatatagtggctctctggacaagagacatggcgaaggcacgttcactagcgacgtgtccagctacctggagggacaggcggccaaagagttcatcgcttggcttgtgaaggggcgccatggagaggggaccttcactagcgatgtgtcctcctaccttgaggggcaggcagccaaagaatttatcgcctggcttgtgaaaggtcgagacgctcacaaatcagaagtggctcacaggttcaaggacctgggcgaggagaacttcaaggcgctcgtgttgatcgcttttgcacagtacctgcaacagtgtccgtttgaggatcacgtgaagctagtgaatgaagtaactgagttcgcgaagacctgcgttgctgacgagagcgcagaaaactgtgataagtccctgcacacactgttcggcgacaaactgtgcaccgtcgcaacgctgcgcgaaacttacggggagatggcagattgctgcgctaagcaggaacccgagaggaatgagtgctttttgcagcacaaagacgataaccctaacctcccccggctggttcggcctgaagtagacgtgatgtgtactgcatttcacgataatgaagagactttcctgaagaagtatctgtatgaaattgcacggcgtcacccatacttctatgcacccgaacttctgttcttcgctaagaggtacaaggcggcatttacagagtgttgccaagctgcagacaaagccgcctgcctattacctaaattggacgaactgcgcgacgaaggcaaagcttcaagtgcgaaacagaggttgaaatgtgcctctctgcaaaaatttggagagcgagcattcaaggcatgggctgtcgcccgcctgagtcagaggtttcccaaagcagagtttgctgaggttagcaagttggtgaccgatctcaccaaggtacatacagagtgttgtcatggggacctgctggagtgtgccgatgacagagccgatttggccaagtatatttgcgaaaaccaggactcgatttccagcaagctgaaagagtgctgtgaaaagccattgctcgagaaatcccattgcattgccgaagtagagaatgacgagatgcccgcggatctgccatctctagctgccgacttcgtcgagtctaaagacgtctgtaaaaattatgcagaggctaaggatgtatttttgggcatgtttctgtacgagtacgcccggagacacccggattatagtgtggtgcttcttctgaggttagccaagacttatgagaccaccctggaaaagtgttgtgctgcagcggacccgcacgaatgctacgccaaggtgtttgacgagtttaagcccctggtcgaagagccacagaacctgataaagcagaactgtgagctcttcgagcaacttggagaatataaatttcaaaacgctctgttggtgaggtatactaagaaggtcccccaagtctcaacacccacactggtggaagtgtcccggaacctgggaaaggttggaagtaagtgttgtaagcatcccgaggccaagcgcatgccgtgtgccgaagattacctgagtgtggtcctgaatcaactttgtgtgctgcacgaaaagacacccgtgtccgatagagtcactaaatgctgcaccgagagtctggtgaacaggagaccttgctttagcgcacttgaagtggacgaaacctacgtaccgaaggaatttaatgctgagactttcacctttcatgccgatatatgtactcttagtgaaaaagagcggcagattaagaagcaaaccgccctggttgaattggtcaagcataagcctaaggccactaaagaacagctcaaggctgttatggacgacttcgctgccttcgtggagaagtgctgcaaggccgatgacaaggaaacctgcttcgccgaggagggcaagaagctcgtcgcagcttcacaggccgccctggggttg

SEQ ID NO: 249299 - DNA, 2007 bp, Artificial Sequence
  Description of Artificial Sequence: Synthetic coding sequence
atgaagtgggtcagcttcatctccctgctctttctcttctcatccgcctactcaggatctctcgataaacggcacggagagggaaccttcacctcggacgtgtcatcatacctggagggacaagcagctaaagagttcatcgcctggttggtcaaagggcggcacggggaaggtactttcacctccgacgtatcctcgtacctcgaggggcaggctgcaaaggaattcatcgcttggctggtgaagggacgggacgcccataaaagcgaagtcgcgcatcgcttcaaagatctgggagaagagaatttcaaggcccttgtgcttatcgcctttgctcaatacctccagcaatgtcctttcgaggaccatgttaagctcgtgaacgaagtgaccgagtttgcgaagacttgcgtcgcggacgaatcggccgagaactgtgacaaatcacttcatacgttgttcggcgataaactgtgcactgtggccaccctccgagaaacctacggggagatggccgactgctgcgcgaaacaggaacctgaacgcaacgagtgttttctgcagcacaaggatgataacccgaatctgcctcgcctcgtgcggccggaggtggatgttatgtgtactgcgtttcacgacaatgaagaaacgttcctgaagaagtatttgtacgagatagctcgcagacatccgtacttctacgccccagaactgttgttcttcgccaaacggtacaaagcagcgtttactgaatgctgtcaggcggcagacaaggcggcctgcttgcttccaaagctcgatgaattgcgcgacgaaggaaaagcctcgtcagccaagcagagactcaaatgcgcctcgctgcagaagttcggagagcgcgcattcaaggcatgggcggtggcccgcctgtcgcagagattcccgaaggccgagttcgccgaggtgtccaaattggtcactgacctgaccaaggtgcatacggaatgctgtcacggcgaccttttggaatgtgcggatgacagagctgaccttgccaagtacatatgtgaaaaccaagattccattagctccaagctgaaagagtgctgcgagaagccactgctggaaaaatctcattgtattgcggaggtcgagaatgacgaaatgccggcagatctcccgtcgctcgcggcagactttgtggaaagcaaggacgtgtgcaagaactacgccgaggcgaaggatgttttccttggcatgttcctctacgagtacgcgcgccggcacccagattactccgtcgtgctgctgctgcggctggcaaagacctatgaaactaccctggagaagtgttgcgcggcggcggatccgcacgagtgctatgccaaggtcttcgacgagttcaagcctcttgtggaagagccgcaaaacctgatcaaacagaattgcgagctgttcgagcaactgggcgaatacaagttccagaacgccctgcttgtgcgctacaccaagaaggtgccacaagtgtcgactcccactttggtagaggtatctcgcaacctcggtaaggtgggatcgaaatgctgtaagcacccggaggcaaagaggatgccctgcgctgaagattaccttagcgtggtcctcaatcagctctgtgtcctgcacgaaaagacgccggtgtccgacagagttactaagtgctgcaccgaatcgctggtgaacaggcggccgtgcttcagcgccctggaagtggacgaaacgtacgtgccaaaggagttcaacgcagaaaccttcaccttccacgccgatatctgcaccctcagcgagaaggagagacagatcaagaaacagactgcgctcgtcgaacttgtcaaacacaaaccaaaagccactaaggaacaactgaaggctgtcatggacgattttgctgcgttcgtggaaaagtgctgcaaggcagacgacaaagaaacctgctttgcggaagagggtaagaaacttgtggctgcctcccaggccgccctgggtttg

SEQ ID NO: 249300 - DNA, 2007 bp, Artificial Sequence
  Description of Artificial Sequence: Synthetic coding sequence
atgaagtgggtgagcttcatttcactgctttttctgttctcgtctgcctactccggttccctcgacaaaaggcatggcgaggggacgtttaccagcgatgtgtcatcctacctcgaaggacaagcagcaaaggagtttatagcatggctcgtcaagggtcgtcacggtgagggaacttttacctcagatgtcagctcctacctggaaggtcaggcagcaaaagagtttattgcctggttggtgaaagggagagacgcccacaaatcagaagtggcccatagattcaaggatttgggtgaggagaatttcaaggctcttgtgctcatcgcttttgcccaataccttcaacaatgtccctttgaggaccacgttaagctggtgaacgaagtgaccgaatttgctaagacttgtgtggccgacgaatcggcggaaaattgcgataagtccttgcatactctgtttggagacaagctctgtactgtcgcaacgctgagagaaacctacggagagatggcagactgttgtgccaaacaggaaccggaaagaaatgaatgctttctgcagcataaggacgacaatccaaacctgcctcgtctggtgaggcctgaggtggacgtgatgtgcaccgcgtttcacgacaacgaagagacttttctcaagaaatacctgtacgagattgcccgacggcacccatacttttacgcccccgagcttctgttctttgcaaagcggtataaggctgcttttaccgaatgttgtcaagcagcagacaaggcggcatgtttgcttcctaaacttgatgaactcagagacgagggaaaggcatcgtccgcaaagcagagattgaagtgtgcttcgttgcagaaattcggagagcgcgcatttaaggcatgggcagtcgcacgactttcccagagattccctaaggcagagtttgcagaggtgtcgaaactcgtgactgaccttactaaagtgcatactgaatgctgtcacggtgatcttctggagtgtgcagatgatagagcagatctggcaaagtacatatgcgaaaaccaggattccatcagcagcaaactcaaggagtgttgcgagaagcctcttctggagaaaagccactgtattgcggaagtcgaaaatgatgaaatgcccgccgacctcccatcgttggctgcagatttcgtggaatctaaggatgtgtgcaagaattacgcagaagcgaaagacgtgtttcttggaatgtttctctacgaatatgcgcgccggcatcctgattactcggtggtgcttttgctgcgacttgcaaagacttacgagacgactctggaaaagtgttgtgcagccgcagatcctcacgaatgctacgccaaggtctttgatgagttcaagccccttgtcgaagaacctcaaaacttgattaagcaaaactgtgaactgttcgaacaactcggggagtacaaattccagaacgcacttctggttcgatacactaagaaggtgcctcaggtgtccacgcctacgcttgtggaggtcagcagaaacctgggtaaggttggatcgaagtgctgcaagcatcctgaggcaaagagaatgccgtgtgctgaggattacctgagcgtggtgctgaaccaactttgtgtgttgcacgaaaagactcctgtgtccgatcgagtgactaagtgttgcactgagtctcttgtcaaccgcagaccttgcttttcagcacttgaagtggacgaaacctacgtgccaaaagaattcaacgcggagactttcacctttcatgcagatatttgtaccctttcagaaaaggaaagacagattaagaaacaaactgcactggtggaactggtgaaacacaaacctaaggcaactaaggaacagcttaaggcagtgatggacgactttgccgctttcgtcgaaaagtgctgtaaagccgatgataaggagacttgttttgcagaagaaggcaagaaactcgtggcagcgtcgcaggccgccttgggcctc

SEQ ID NO: 249301 - DNA, 2007 bp, Artificial Sequence
  Description of Artificial Sequence: Synthetic coding sequence
atgaagtgggtgtcattcatttcactgctgtttctcttctcctcggcgtactctggatcccttgacaagcgccatggagaaggaacgttcacttctgacgtgtcgagctatctcgaaggccaggcggcgaaggagtttatcgcttggctcgtgaaggggcggcacggggagggaaccttcacttcggatgtgtcctcgtacttggagggtcaggcggccaaggagttcattgcctggctggtgaagggtcgcgatgctcataagtccgaggtggcacatcggtttaaggatctgggagaagagaactttaaggctctcgtgctgatcgcgtttgcccagtacctgcaacaatgtccgttcgaggaccacgtgaagctggtgaacgaagtcaccgaattcgccaagacttgcgtggcagacgaatccgcggaaaattgtgacaagagcctgcacactctctttggcgataagttgtgtaccgtggcgactctcagagagacgtacggcgaaatggctgattgttgtgccaagcaggagcctgagcgcaacgagtgctttctgcagcataaggacgacaatccaaacctgcctagacttgttcgcccggaggtggatgtcatgtgtaccgcattccacgataacgaagaaactttcctcaagaaatacctgtacgaaatcgctcgccggcatccatacttctacgccccggaacttctgttcttcgccaagagatataaggccgccttcaccgaatgctgccaggcggcggacaaagccgcctgtctcttgccgaagttggacgagctgcgcgatgaaggaaaggcgtcaagcgcgaaacaacggctgaagtgcgcctcgctgcagaagttcggagaacgggctttcaaggcctgggccgtggctagactctcccagcgtttccctaaggccgaattcgcagaggtgagcaaactggtcaccgacctgactaaggtccatactgaatgctgccacggagacttgttggagtgcgcggacgacagggcagatttggcgaagtatatctgcgaaaaccaggactcaatctcaagcaaacttaaagaatgttgcgaaaagccactcctcgaaaagagccactgtatcgccgaggttgagaacgacgaaatgccagccgaccttccgtcgctggccgcagactttgtcgagtctaaggacgtgtgtaagaattacgcagaggccaaagatgtgtttctgggaatgttcctgtacgaatacgccaggcgacacccggattactccgtggtcctccttctgcgcctggcaaagacctacgaaaccaccttggagaaatgttgcgccgcggcggacccacatgagtgctacgccaaggtgttcgatgaattcaagccactggtggaggaaccacaaaatctgatcaaacaaaattgcgaactgttcgagcagctgggcgagtacaaattccaaaacgccctcctggttaggtacaccaaaaaagttcctcaagtctccactccgactctggtggaggtgagccggaacctcggcaaggtggggtcaaagtgctgtaaacacccggaggcgaagagaatgccgtgcgcagaggactacctctcggtggtgctgaatcagctgtgcgttcttcacgaaaaaactccagtctcggaccgcgttaccaaatgttgtacggagtctctggtgaaccggcgtccatgtttctccgcgctggaagtggacgaaacctacgtgccaaaggaattcaatgcagaaacttttacctttcacgcagatatatgcacgttgtctgaaaaggaacggcaaatcaaaaagcagaccgccttggtcgaactcgtaaagcacaagccaaaggccactaaggagcagcttaaggcggtgatggatgacttcgcagcattcgtggaaaagtgctgcaaagcagatgacaaggagacttgcttcgctgaggaagggaagaagctcgtcgcagcgagccaggccgccctgggactc

SEQ ID NO: 249302 - DNA, 2007 bp, Artificial Sequence
  Description of Artificial Sequence: Synthetic coding sequence
atgaaatgggttagcttcatctccttgctgtttctttttagcagcgcctactcaggatctctggacaagaggcatggcgagggcaccttcaccagcgacgtgagcagctacctggagggccaggctgcaaaagagtttatcgcttggctggtgaaaggaaggcacggagagggtaccttcacctcagatgtctccagttatctggaaggccaagcggccaaagaatttattgcctggttggttaagggcagagatgcccacaagagcgaggtagcccaccgattcaaagacctcggcgaagagaactttaaggctttggtgctcatcgcctttgcccagtacctgcaacagtgccccttcgaggaccacgtcaagctcgtcaacgaggtgaccgaattcgccaaaacctgcgtggcagacgagagcgctgagaattgtgacaagtctctgcatactctgtttggcgacaagttatgcactgttgctacacttagagaaacctatggagaaatggcagactgctgtgctaaacaggaacccgagcgaaacgagtgctttctgcagcacaaagacgacaacccaaacctgccccgcttggtccgccccgaagtcgatgtcatgtgtacagcctttcacgacaatgaggagacttttttgaaaaaatacctgtatgagattgctagacgtcatccttacttttatgctcctgagctcctgttttttgctaagaggtataaagccgcatttactgagtgttgccaagccgcggacaaagccgcctgtctattgcccaagctggatgaactgcgcgatgagggaaaggcttcatctgctaaacagcgcctcaaatgtgcttctcttcagaaattcggggaacgcgctttcaaggcgtgggccgtggccagactgtcacagagattcccaaaagccgagttcgcagaggtgagcaagttggttactgatctcacgaaggttcacaccgaatgttgtcacggtgatcttcttgagtgcgccgacgatcgtgccgatctggctaaatacatctgcgaaaaccaagacagcatcagctcaaagcttaaggagtgctgcgagaaacctctgctagaaaagtctcactgtatcgctgaagtggaaaacgacgagatgcccgcagacctgccgagtttagctgcagactttgtggaaagcaaggacgtgtgcaagaactatgcagaggctaaagacgtcttcctgggcatgtttctctatgagtacgcgcgtaggcacccggactacagcgtagttcttttgctacgcctcgcaaaaacctacgagaccacattagagaaatgttgcgctgcagcagatccccatgagtgttatgcaaaggtgtttgatgaatttaaacctcttgttgaagaacctcaaaacctgattaaacagaattgcgaactgttcgaacagctgggtgaatacaaattccagaatgccctgttggtgcgatataccaaaaaagtgcctcaggtctctactccaactctggtcgaggtgagtagaaaccttggcaaagtgggcagcaagtgctgcaaacacccagaagcaaagagaatgccgtgtgctgaagactaccttagtgtcgtcctgaatcagctgtgtgttctccacgagaaaacacctgtcagtgatagggtgacgaaatgctgcaccgaaagccttgtcaaccgccgcccatgcttctcggctctcgaggttgacgaaacctacgtgcccaaggaatttaacgctgagacctttaccttccacgcagacatttgcaccctcagcgagaaagagcgccagatcaagaaacagactgctttggtggagctggtgaagcacaagcctaaggcaacaaaggaacagcttaaggcagtcatggacgatttcgctgcctttgtagagaagtgctgtaaagccgatgataaggagacctgctttgccgaagaaggcaaaaagcttgtggctgcgagccaggccgccctggggctc

SEQ ID NO: 249303 - DNA, 2007 bp, Artificial Sequence
  Description of Artificial Sequence: Synthetic coding sequence
atgaaatgggtgtcattcatatccctcttgtttctcttttctagcgcctactcaggcagcctcgacaaaagacatggagagggcacatttacaagcgatgtgagttcttatctggagggtcaggctgcaaaagaatttatcgcttggctcgttaagggcagacacggagaaggcacttttactagcgacgtgagctcgtacctagaggggcaagcagctaaggaatttatcgcttggctcgtgaaaggacgcgacgcgcacaagagtgaggtggcacaccggttcaaagatctgggcgaagagaatttcaaggccctcgttctgatagcatttgcccagtacctccagcagtgcccgttcgaggaccacgtcaagctggtcaatgaagtgactgagtttgccaagacgtgcgtggcagatgaatccgctgaaaattgtgacaagagtttacacaccctgttcggtgataagctgtgcacagtggcaactctcagagagacttacggagagatggctgattgttgtgctaagcaggaaccagagcgtaatgagtgcttccttcagcacaaggatgacaatcccaacttgccgaggctcgttcgacccgaggtcgacgttatgtgcaccgcatttcacgataacgaggagacattccttaaaaagtatctgtatgaaatcgcccggagacatccctacttttacgctcctgaactcctgttttttgccaaacgttataaagctgcttttacagagtgctgtcaagccgccgataaggctgcatgcctattgcctaaactggatgagctccgagatgaggggaaggcaagtagtgcgaagcagaggttgaagtgtgccagcttgcagaaatttggtgaaagggctttcaaagcctgggccgttgcacgtctcagccagagatttcccaaagctgaattcgccgaagtgagtaagttggtcacagacttgactaaggtgcacacggagtgttgtcatggagatctgttagagtgcgccgatgacagagctgatctggccaagtacatctgcgaaaatcaggatagtattagcagcaagctgaaggagtgctgcgaaaaacccttactggagaaatcccattgtatcgccgaagtggaaaacgacgagatgcctgctgatttgccgagcctggccgctgatttcgtggagtccaaagacgtctgtaaaaactacgcagaggcaaaggacgtattcctcggaatgttcctgtatgagtacgcccgaaggcatccagactactcggtagtcctgttgctgcggctggcgaaaacttatgagaccaccctggagaagtgctgtgccgcagcagaccctcacgaatgctacgccaaggtttttgacgagttcaagcccctggtcgaagaacctcagaatctcatcaagcaaaactgtgagttgttcgagcagctgggtgaatacaaatttcagaacgctctcctagtaaggtatacaaagaaggttccccaggtatccacgccgaccctcgtggaggttagtcgcaatcttggcaaagtaggatctaagtgttgcaagcaccccgaggcaaagcgcatgccttgtgccgaagactatctgagcgtggtgctgaatcaactgtgcgtgctgcacgaaaagacgcccgtgtccgatagggtgaccaaatgctgtactgaaagcctggtgaatcggcgcccctgctttagtgcgctggaagtcgacgagacctatgtgccgaaagagttcaatgcagagacttttactttccatgcggacatttgcactctcagcgagaaggaacgacaaatcaaaaagcagactgccctggtagagctggtgaaacataaaccaaaggcaacaaaggagcagttaaaagccgttatggacgatttcgctgcatttgtggagaagtgctgcaaggcagacgataaagaaacctgctttgccgaagaaggtaaaaaactagtggcagcctcacaagctgccttgggcctg

SEQ ID NO: 249304 - DNA, 2007 bp, Artificial Sequence
  Description of Artificial Sequence: Synthetic coding sequence
atgaagtgggtgagctttattagcctcctgttcttgttctccagtgcttacagtgggtctctagacaaacgtcatggagagggcacattcacaagcgatgtcagcagctacctagaagggcaggctgccaaggagtttatcgcgtggctcgtcaagggtagacatggagagggaacttttacctctgacgtcagttcatatctggagggtcaggcggccaaggagttcatagcatggttagtgaaggggagagacgcgcacaagtctgaagtggcccaccgcttcaaggatctcggagaggaaaattttaaggctctcgtactgatcgcctttgcccagtatcttcagcagtgccccttcgaagatcacgttaagctggtgaacgaggtgactgaatttgccaagacatgcgtggcggatgagtcagcagaaaattgcgacaagtccctgcacacactgttcggggacaaactctgcaccgtcgcaaccctccgtgagacctacggcgaaatggctgattgctgtgctaaacaggaaccagagaggaacgaatgttttctccaacacaaagacgataaccctaacctcccccgccttgtcagacctgaggttgatgtgatgtgcactgcctttcacgataacgaggagacatttttgaaaaaatacctgtacgaaatcgctcgaagacacccttatttctacgcgcctgaactgctgttcttcgcaaaacgatataaagcagccttcacggagtgctgtcaagccgctgacaaggctgcttgtttactacctaagctggatgaactgagagatgagggaaaggcgagctctgccaaacaacggctcaaatgtgcttctctgcaaaaattcggggagcgggccttcaaagcatgggcagtcgctcggctgtcccagagattccctaaggctgagttcgctgaagtgagcaaacttgtcaccgatttgactaaagtgcacaccgagtgctgccacggggatctgctcgaatgcgccgatgacagggccgacctggcgaagtacatctgcgaaaatcaggatagcatttcatccaagttaaaggaatgctgcgagaagccgttactggaaaaaagtcactgtatcgctgaagttgaaaatgacgaaatgcccgccgacctcccctcgctcgcggcggacttcgtagagagtaaagatgtctgtaaaaattacgcagaggccaaagatgtgtttctgggtatgtttctctacgaatatgcccgacgacaccccgattacagtgtggtgctgctactcaggctggctaaaacatacgaaactacactggaaaagtgctgcgccgctgccgacccccatgagtgttatgcaaaagtctttgacgaatttaagcccctggttgaagagccccagaacctgatcaagcagaattgcgaactgtttgagcagttgggggagtacaagttccagaacgctctgctggttcgttacacgaaaaaggttcctcaagtatcaaccccgacactggtggaagtgtcccggaatctggggaaggtagggtctaagtgctgcaaacaccctgaagccaagcggatgccttgtgcagaagattatctgtctgttgtgttaaaccagctttgcgtgctgcacgaaaaaactcctgtctccgatagagtgaccaagtgctgtactgagtccttggtaaatagacgaccctgcttctctgctctggaggtcgacgagacatatgttccgaaggagttcaacgcagagactttcaccttccatgcagacatatgcacgctttctgaaaaggagcgacagataaagaaacaaaccgccctagtggaattagtgaagcacaagcccaaggccaccaaggagcaactgaaggccgtaatggacgatttcgcggctttcgtggagaaatgttgtaaggccgacgataaagagacatgctttgctgaagaaggtaaaaaattggtcgcagctagccaagcggccctgggactt

SEQ ID NO: 249305 - DNA, 2007 bp, Artificial Sequence
  Description of Artificial Sequence: Synthetic coding sequence
atgaagtgggtctccttcatcagtctgctcttcctattttcatctgcatatagtggatctctggataaaaggcatggagagggcacttttacctcggatgtgagctcctatctggaggggcaggcggcaaaggagttcatcgcctggctggtaaagggccgacatggagagggtacttttacaagtgatgttagttcgtacctggagggccaggccgccaaggagttcatcgcctggctcgtcaaaggaagggatgctcataagagcgaggtggcccataggtttaaagacctgggggaagaaaacttcaaggccttggtgctgatcgcttttgcccaatacctgcagcagtgtccctttgaggaccacgtgaagctggtaaacgaggtgacagaattcgcaaaaacgtgcgtcgccgatgagtcagcagaaaattgcgacaagtcactacacaccctgttcggagataagttatgtacagtagccaccttaagagaaacatacggagaaatggcagattgttgcgctaaacaggaaccagaaagaaatgaatgtttcctgcaacacaaggatgacaacccaaatttacccagacttgtacgacccgaagtcgacgtcatgtgtaccgccttccacgacaacgaggagacatttttaaaaaagtacctctacgaaattgctcggaggcatccttacttctacgcgccagagctactattttttgcaaagcgctacaaggcggctttcacggagtgttgccaggctgctgataaggctgcttgtctcctgcccaaactggacgagctgcgggacgagggcaaagcatcaagtgccaaacagagattgaagtgtgcttccttgcagaagtttggggagcgcgcctttaaagcttgggcagtcgcccgtctctcccagcggtttcccaaggccgagttcgcggaggtgtcaaaactcgtcaccgacctaacgaaggttcatacggagtgttgtcacggggacctgctggagtgtgcggacgatcgcgccgacctggccaaatacatatgtgaaaatcaggactccatttccagcaaactcaaggagtgttgtgagaagcccctcctggagaaatcgcactgtattgcggaggtggaaaacgatgaaatgcccgctgatcttccttccttagccgctgatttcgtcgagtccaaggatgtctgtaaaaattacgccgaagctaaggacgtattcctggggatgttcctttacgagtacgccaggagacatcctgactacagcgttgttctactcctgaggctggctaagacctatgaaacaacccttgaaaagtgttgtgctgcggcagatccccacgaatgttatgctaaggtgttcgacgaattcaagcctctggttgaggaacctcagaacttgatcaagcagaattgcgagctcttcgagcagctcggcgaatacaagttccagaacgctttgctggtgcggtacacaaaaaaggtgccccaggtcagtaccccaaccctggtggaagtgtcacgcaacctcggtaaggtggggagcaagtgctgtaaacatcccgaagcaaaacggatgccctgcgctgaagactacttatccgtggtcctgaatcagctgtgtgtcttacatgagaaaaccccagtcagcgatagggtgacgaagtgttgcacagagtcactcgtcaacaggcgtccttgctttagcgcccttgaagtggatgagacatatgtgcctaaagaatttaacgccgagacatttacctttcacgccgacatctgtacgctgagcgagaaggaaaggcagattaaaaagcagaccgcgctggtagagctcgtcaagcacaagcccaaggcaacgaaggaacaactcaaagctgtgatggatgatttcgcggccttcgttgagaaatgctgtaaggccgacgacaaggagacatgtttcgccgaggagggaaaaaagctggtggccgcaagccaggccgcacttggactt

SEQ ID NO: 249306 - DNA, 2007 bp, Artificial Sequence
  Description of Artificial Sequence: Synthetic coding sequence
atgaagtgggtgagcttcatcagtctgcttttcctttttagcagcgcctactctggatctctggacaagaggcacggcgagggcacattcacctcggacgtgagcagctacctggaaggacaggccgccaaggagttcatcgcatggctggttaaaggccgccatggtgaaggtacttttacctccgacgtttcatcgtatctagaaggccaggccgcgaaggaatttatcgcatggctggtgaaaggccgagatgctcacaagagtgaagtggcacaccggttcaaggacttgggagaggagaactttaaggctctcgtcctgatcgcgtttgcacagtacctacagcagtgtccattcgaggaccacgtaaaactggtaaatgaggtcacagagttcgcaaaaacctgcgtcgctgatgaaagcgcagagaactgcgacaagtctctgcatacattatttggtgataaattgtgcactgtcgcaacgctgcgcgagacgtacggcgaaatggctgattgttgtgcaaaacaggagccagaaaggaatgagtgcttcttacagcacaaggatgataatccaaacctgccccgactggtccgccccgaggtggacgtgatgtgcacagcctttcacgacaacgaggaaacgttcctaaaaaaatacctgtacgaaattgcccgacgccatccttacttttatgcccccgagcttctgttcttcgcgaaacgttacaaggccgcttttacggaatgttgtcaggccgcggacaaggctgcgtgcctccttccgaagcttgatgagctccgcgatgaaggtaaggcatcttctgctaagcagcggctgaagtgtgcctccctgcagaagtttggcgagagggccttcaaagcttgggccgtagcacgattgtcgcagagattccctaaggcggagttcgcagaagtgtcaaaactagtcaccgatttgaccaaggttcacacggagtgctgtcacggtgatcttctcgagtgtgccgatgaccgcgccgacctcgccaaatacatctgtgagaatcaggactcaataagctccaagcttaaggaatgctgcgaaaaacctctgctcgaaaagtcgcactgtattgccgaggtagagaatgatgagatgccggcagacctgccttcactcgcagcagatttcgtggagagcaaagatgtgtgcaaaaattacgcagaggctaaagatgtctttcttggaatgttcctatatgaatatgctaggcgccacccagactactcagtggtgctccttcttaggctcgccaaaacgtacgagactaccctggagaaatgctgcgctgccgccgacccccacgagtgctatgcaaaagtgtttgatgaattcaagcccctagtggaggaacctcagaacttgataaaacagaactgcgaactcttcgagcaactgggcgagtataagtttcagaacgcccttttggtacggtacactaaaaaagtcccgcaggtgtccacccctaccttggtcgaggtatctcgcaatctcgggaaggtcggatctaagtgctgtaaacaccccgaggccaagcgcatgccgtgcgcagaagactatctgtctgtggttctgaaccagctgtgtgttctgcatgaaaaaactcccgtaagcgatagagtgacaaagtgctgtaccgaatctctagtaaaccgcagaccctgcttttcggccttggaagtggacgagacgtatgttccgaaagaattcaatgctgaaacattcactttccacgcagatatctgtacactttctgagaaggaacgccagattaagaaacaaacggccttagttgagcttgtcaaacacaagcccaaagcaaccaaagagcagcttaaggccgtgatggatgacttcgccgcctttgttgagaagtgctgtaaagcggacgacaaggaaacctgtttcgcggaagagggcaaaaagctcgtggcagcttcccaggcagcactgggcttg

SEQ ID NO: 249307 - DNA, 2007 bp, Artificial Sequence
  Description of Artificial Sequence: Synthetic coding sequence
atgaagtgggtgtcgtttattagtctgctttttttatttagttcggcctacagtggttcattggataaaaggcacggcgagggcacatttaccagtgacgtgtcgtcctaccttgaaggccaagccgcaaaagagtttatcgcgtggttggtgaaaggccgacacggagaggggacatttacttccgacgtcagttcatacctggagggccaggcagccaaagaattcatcgcatggcttgtaaagggacgcgacgcccacaaatcagaagtggcccaccgatttaaggacctgggagaggaaaatttcaaggccctggtgctcatcgccttcgctcagtacctgcagcaatgtcctttcgaggaccatgtcaaacttgtgaatgaggtaacggaattcgccaagacttgcgtggccgacgagtcagctgagaactgcgacaagagtctacataccttgtttggggacaaactctgtaccgtcgcaacgctgcgggagacatacggagaaatggctgactgttgtgctaagcaggaacccgagcgaaacgagtgttttctgcagcataaggacgacaaccccaatctcccacgtctggtgaggccagaagttgatgtaatgtgcacggcatttcacgataatgaggaaacgttcctgaaaaagtacttgtatgaaatcgccaggcgccacccttacttctatgctccggagctgctgttttttgctaagaggtacaaggctgccttcaccgagtgttgccaggcagccgacaaggccgcctgcctgctacccaaactcgatgaactcagggatgagggcaaagcctcgtctgcaaaacaacgcctcaaatgcgcctctctgcagaagttcggcgagagagccttcaaggcctgggccgtggctaggttatcccagcgatttcctaaggccgagtttgctgaagtttccaagcttgtgactgacctgacaaaggtgcacaccgagtgctgtcatggcgaccttctggaatgtgcggatgacagggcagacctggcaaaatacatctgtgagaaccaggattctatctcatccaaactgaaagagtgctgcgagaaacccctattggagaagagccattgcatcgctgaggtagaaaatgatgagatgcccgccgatcttcccagcctggctgcggacttcgtcgagtcaaaagacgtctgtaaaaactacgctgaagctaaggacgtgttcctgggaatgtttctctatgaatacgccagacgtcacccagattactccgtcgtgctgctgcttagactggccaagacttacgagacaaccctggagaagtgttgcgccgctgctgatccgcacgagtgctacgcaaaggtcttcgacgagttcaagcccctggtcgaggaaccgcaaaaccttatcaagcagaactgtgagctctttgagcagttgggggagtataaattccagaacgctctgcttgtccgctacacgaagaaagtccctcaggtgtcaacgcccaccttagtagaggtcagtcggaacctgggaaaagtagggtccaagtgctgcaagcaccctgaagctaaacgcatgccatgtgcagaggactatttaagcgtcgtactgaatcagttatgtgtattgcatgagaaaacacctgtctccgacagagttactaaatgttgtacggaatcacttgtgaaccgcagaccatgtttcagcgccctcgaagtggatgagacatatgttccgaaggagtttaacgcagaaaccttcacgttccatgccgacatatgcacactcagcgaaaaggagcggcagatcaagaagcagacagccctagttgagcttgtgaagcacaagcctaaagccaccaaggagcaattgaaagccgtaatggacgactttgccgctttcgtcgaaaagtgctgtaaggcagacgacaaagaaacttgcttcgctgaagaagggaaaaagctggtggcggctagtcaggcagccctaggactc

SEQ ID NO: 249308 - DNA, 2007 bp, Artificial Sequence
  Description of Artificial Sequence: Synthetic coding sequence
atgaaatgggtctcttttatctcactactgtttctgtttagctcggcatacagcggctcccttgacaagcgacacggggagggtacgtttacaagtgacgtgtccagttatctagaaggccaggctgcgaaagaatttatcgcatggttagtaaagggccgccatggggaaggcacatttactagcgatgtaagctcataccttgaaggacaggccgcgaaggaatttatcgcgtggctcgtgaaggggcgggacgctcataaatccgaggtcgcccacagattcaaggatctcggggaagaaaacttcaaagccttggttctgatcgccttcgcccaatatctgcagcagtgccctttcgaggaccatgttaaactggtcaacgaagtgacagagtttgctaaaacctgcgtggctgacgagagcgctgagaactgcgacaagtcgttacatactctgttcggggacaagctttgcaccgtggctaccctaagggagacatacggcgagatggcagattgctgcgccaaacaagaaccagagcggaacgaatgtttcctgcagcacaaagatgacaatccaaatttgcctcgactggtccggccagaggttgatgttatgtgtacagcctttcacgacaacgaagaaacattcctgaagaaatacctatacgagatcgcaaggaggcacccatacttttacgcgcccgaactcctgttctttgctaagaggtacaaggccgcattcacagaatgctgccaggcggctgataaggcagcttgtttgttacctaagctcgacgagctgagggatgaggggaaggctagttccgccaagcagcggttaaaatgtgcctcgctccagaaatttggtgagcgggctttcaaggcttgggccgtggctaggctctctcaacgcttccctaaggccgagtttgcagaggtgagtaagctggtgactgacctcacaaaagttcacacggaatgctgccacggtgatctcctggagtgcgctgatgaccgcgcagatttagctaagtacatctgcgagaatcaggacagcattagctcaaagctgaaggagtgttgcgagaagcctctgttggagaagtctcattgcatcgccgaggtggagaatgacgaaatgcctgctgacctcccgagcctggcagccgacttcgtggagtctaaggacgtttgcaagaactatgcagaggcgaaagacgtgtttctggggatgttcctgtacgaatacgccaggcggcacccggactattcggtcgttctattgttgcggcttgcaaaaacttacgagacaactttagagaagtgctgcgccgctgccgatcctcacgaatgctatgcgaaggtgttcgacgaattcaagcctctagtcgaagagccccagaacttaatcaagcagaattgcgagctgtttgagcaactcggcgagtataagttccagaatgccctactcgttaggtacacaaagaaggtcccccaagtgtcgacccccactctggttgaggtgagccgcaacctagggaaggttggaagcaaatgctgtaagcaccccgaagccaagcgcatgccttgcgcggaagattacctctcagttgtgctgaatcagctctgcgtgctccacgagaaaactcctgtttcagatagagtcaccaaatgttgcacagaatcccttgtcaatcgaaggccgtgtttcagtgctttggaggtggatgagacctatgtgccgaaagagtttaacgcagaaactttcacatttcacgccgacatttgcaccttatctgagaaggagcgtcaaatcaagaagcagactgcattggtggaactggtgaaacacaaacccaaggctacaaaagagcagctgaaggctgtcatggacgattttgctgcattcgtcgaaaaatgttgtaaggctgatgataaagagacctgcttcgctgaggaaggaaagaagctggtggctgccagtcaggccgcgctgggcttg

SEQ ID NO: 249309 - DNA, 2007 bp, Artificial Sequence
  Description of Artificial Sequence: Synthetic coding sequence
atgaagtgggtttcctttatatcactactctttctcttcagtagtgcatactctggctccctcgacaaacgacacggcgagggtacttttacttcagacgtgtcttcctacctggagggacaggccgcgaaggaatttattgcatggctggtgaaaggccgacacggagaaggcaccttcacgtccgatgtcagcagctacctagagggccaggcggcgaaggagtttatcgcctggctggtcaaagggcgggatgcccacaaatcggaggtagcgcatcgatttaaggacctgggtgaggagaatttcaaggctctcgtactcattgcgttcgcacaataccttcagcagtgccccttcgaggatcacgtcaaattagtcaacgaggtgaccgagtttgccaaaacatgcgttgcggatgaatcagcagaaaactgtgataagtcactgcatacattgttcggagataaactgtgtacagtcgccacgctcagggaaacttacggagagatggcggactgttgcgccaagcaagagcccgagcggaatgaatgtttcctgcagcacaaggacgacaatccgaatttaccacgcttggtgagaccagaggttgacgtgatgtgtacggcttttcacgataatgaggagacgttcttaaagaaatacctgtatgaaatagcaaggaggcatccatacttctacgccccggagttgcttttcttcgcgaagcgatataaggccgcttttacggagtgttgccaggccgccgacaaggccgcctgtctcttgccaaaactggacgagttgcgcgacgagggaaaagcaagtagtgccaaacagcgcttgaagtgtgcatccctgcaaaagtttggagaaagggccttcaaagcctgggccgtcgctaggttaagccagcgcttccctaaagccgagtttgccgaggtgtctaaactggtgaccgatctaactaaggtgcacactgagtgctgccatggcgatctcttggaatgtgctgatgatagagcagatctcgctaaatatatctgtgagaatcaagattccatttcctctaaactcaaagaatgttgcgaaaaaccactattagagaagagccactgtatagctgaggtggagaatgacgagatgccagccgatctcccatctctggctgcagacttcgtagaatcaaaagatgtgtgtaagaattacgctgaggccaaagatgtattcctgggcatgtttctgtatgaatacgcccggaggcaccccgattacagtgtggtactgctactaaggttagccaagacatatgaaacgaccctggagaaatgctgtgctgcagcagacccacacgagtgctatgctaaggtatttgacgaattcaaacctctggtggaagaaccgcagaacctgatcaaacaaaactgcgaactatttgaacagcttggtgagtacaagtttcagaatgctctgctagtgcggtacacgaaaaaagtgcctcaggtgagtacacccaccctggtggaagtgtcccgcaacctcggtaaggtggggtctaagtgttgtaaacatcccgaggcaaaacgtatgccgtgcgcggaagattacctgtcagtagttctcaatcagctgtgcgtgctgcatgagaagacaccagtgagcgacagggtgacgaaatgctgcaccgaatccctcgtgaatagaagaccctgtttctccgccctcgaagtagacgagacatacgtgccaaaagagttcaatgccgagacttttacttttcatgccgatatttgtacattgagcgaaaaggagaggcaaataaagaaacaaactgccctggtggagctggtcaaacataaacctaaggccaccaaagagcagctgaaagccgtaatggatgactttgctgcttttgtggaaaaatgctgcaaggctgacgacaaggaaacctgttttgcagaggagggcaagaagcttgtcgctgcttcccaagctgccttgggtctg

SEQ ID NO: 249310 - DNA, 2007 bp, Artificial Sequence
  Description of Artificial Sequence: Synthetic coding sequence
atgaagtgggtgtcattcatttccctcttgtttctcttttcaagcgcctattcgggatcacttgataagagacacggagagggaacgtttacgtcggatgtgtcctcatacctggaaggacaagctgccaaggaattcatcgcctggcttgttaagggacgacatggtgaagggacctttacttcggacgtgtcaagctacctggaaggccaggcagcgaaggagttcattgcctggcttgtgaagggcagggatgcacataagtcagaagtcgcccatcgctttaaagaccttggcgaagaaaacttcaaggccctggtcctgatcgcatttgcacagtacctccagcaatgtccatttgaagatcatgtgaaacttgtgaatgaggttaccgaatttgcgaaaacttgtgtcgcagacgagagcgcagagaactgtgataagtcacttcatactctgttcggagataaactttgtaccgtggcaaccctgcgcgaaacttacggtgaaatggctgattgttgcgcaaaacaagagccagagaggaacgaatgttttctgcagcataaggacgataatcctaacctgccacgtctcgtccgtccagaagtggatgtgatgtgtaccgcctttcacgacaatgaagaaacctttcttaagaagtacctgtatgaaatcgcccggcggcacccatacttctacgcaccggaactgctcttttttgccaaaagatacaaggccgcgttcactgagtgttgtcaagcggccgataaggcagcatgcctgctgcctaaactggacgaactgagagatgagggaaaagcctcatccgcaaaacaaagactgaagtgcgcatccctgcagaagttcggagaacgtgcatttaaggcatgggcagtggctcgcctttcccaacgcttccccaaggcagagtttgcagaagttagcaagctcgtgaccgatctcaccaaagtgcacactgagtgctgtcatggcgacctgctcgaatgtgcagacgaccgagcagatcttgcaaaatacatatgcgaaaaccaggactcgatttcctcgaagctcaaagagtgctgtgagaagccccttctggagaaatcgcattgtatcgcggaggtcgaaaatgacgaaatgcctgccgacctgccaagcctcgcggcagactttgtcgagtcgaaggatgtgtgtaagaattacgctgaagcaaaggacgtgttccttggcatgtttctttacgagtacgctaggaggcacccagattactcagtggtacttctgctccgcttggcaaaaacctacgagactaccctggagaagtgttgtgcggcagctgacccacacgaatgctacgccaaagtgtttgatgaattcaaaccactcgtcgaggagcctcaaaacctcattaagcaaaactgcgagctgtttgaacagctgggagaatacaagttccaaaacgccctgctggtgcgctacactaagaaagtgcctcaagtctccactcccactctcgtggaggtgtctcggaacctggggaaagtggggagcaagtgctgtaagcatccagaagcaaaaaggatgccctgtgccgaggattacctgtctgtcgtcctgaaccagctctgcgtgcttcatgaaaaaacgccagtctccgacagggtgaccaagtgttgtaccgaatcgctcgtgaatcgtaggccatgtttctcggccctggaagtggatgagacttacgtgcctaaggaattcaacgccgagacttttactttccacgccgatatatgtaccctctcagagaaggaaaggcagattaagaaacaaactgccctggtcgagctggtcaagcataagccaaaggcaaccaaagagcaacttaaggcagtgatggacgatttcgcggcatttgtggagaaatgttgcaaagccgatgacaaggaaacctgcttcgcagaagaggggaagaagctggtcgcagcctcgcaagcggcgctggggctt

SEQ ID NO: 249311 - DNA, 2007 bp, Artificial Sequence
  Description of Artificial Sequence: Synthetic coding sequence
atgaagtgggtttcgttcatttcgcttttgtttctgtttagcagcgcatactcaggttcattggataagcggcacggcgaaggtacgttcacctcagatgtctcctcctaccttgagggacaggcagccaaagaattcatcgcatggcttgtcaaaggtcggcacggagaaggtactttcacgtcggatgtcagctcgtaccttgagggccaagcagcaaaggaattcatcgcctggctcgtgaagggcagagatgcacacaagtctgaagtcgcccatcgattcaaagacctgggagaggagaatttcaaggcactggtccttatagcatttgctcaataccttcagcagtgtccatttgaggaccatgtcaaattggtcaacgaggtgactgagttcgcgaaaacttgcgtggctgatgaaagcgcggaaaactgcgataaaagcctgcatactctgtttggggataagctgtgcaccgtggcaactctccgtgagacttacggggaaatggcagactgttgtgccaagcaggagcctgaaaggaatgagtgctttctccagcataaggatgacaaccctaacctgccgcggcttgtgaggccggaggtggatgtcatgtgcaccgcgttccatgataacgaagagacgttcctgaagaagtacctctacgagatcgcccgtcggcatccttacttttatgctccagaattgctgttttttgctaaaaggtataaagccgcgtttacggaatgttgtcaagccgcagataaagccgcttgcctccttccgaaactggatgaacttcgggatgagggaaaggcaagttcggccaagcaaagactgaaatgcgcatccctgcaaaagtttggagagagagcctttaaggcgtgggcagtggccagactgtcccaacgttttcctaaagcagaattcgcagaggtcagcaagctggtgaccgacctgactaaggtgcataccgagtgttgtcacggagatctgcttgagtgtgccgatgacagagccgatctggcaaagtacatttgtgaaaaccaagattctattagctcaaaacttaaggagtgttgtgaaaaacccctgctcgagaagtcacattgtatcgccgaagtggaaaacgatgagatgccagcagatctcccctcgcttgcagcagacttcgtggagtctaaagatgtttgcaaaaactacgcggaagcaaaggacgtctttctgggtatgttcttgtacgaatacgcgagacgccacccggactactccgtcgttctcctcttgagactggcaaagacctacgagactacccttgaaaaatgttgtgcagcggcggacccccacgaatgttacgcgaaggtgtttgacgaattcaagcctctggtggaggagcctcagaatctcattaagcaaaattgcgagctgtttgaacaactgggcgagtataagtttcaaaacgcgctgttggtgaggtacactaagaaggtgccgcaagtctccacccccacgctcgtggaagtgtccagaaacctcggcaaggtgggatcgaagtgctgcaagcatcccgaagcaaagcggatgccgtgtgcagaggactacctctctgtggtgcttaatcagctgtgcgtgctgcacgaaaagactcctgtgagcgacagggtcaccaagtgttgtaccgaaagcctcgtcaatagacgtccgtgcttttctgccctggaagtggatgaaacctacgtgcccaaggagtttaacgcagaaacttttacttttcatgcagatatttgtacgctgagcgaaaaggaacgccagattaagaagcaaactgctcttgtggagctggtaaagcataaacctaaggcaaccaaggaacagcttaaggcagtgatggatgatttcgcagcattcgtcgaaaagtgctgtaaagcggacgacaaggaaacctgttttgccgaggaagggaaaaaacttgtggcggcatcgcaggcagcccttggtctg

SEQ ID NO: 249312 - DNA, 2007 bp, Artificial Sequence
  Description of Artificial Sequence: Synthetic coding sequence
atgaagtgggtaagtttcatctcactgctcttcttgttcagttccgcttattcaggatctctggataagcgccacggtgagggcaccttcactagcgacgtcagcagctatctggagggtcaagctgctaaagagtttattgcctggctggtgaaaggcaggcatggagaaggaactttcacatctgatgtgtcatcatatcttgaaggtcaggcagccaaggaatttattgcatggctggtgaagggacgcgacgcgcataaatccgaagtcgctcaccgcttcaaggatcttggagaggagaacttcaaggccctggtccttatcgccttcgcgcagtacctccaacaatgcccctttgaggaccacgtcaaactcgtcaacgaggtaactgaatttgccaagacttgtgttgccgatgaatctgccgagaactgcgataaatctctgcacaccctgtttggagataaactctgtacagtagcaactcttcgcgagacatacggcgagatggctgactgttgtgccaagcaggaacccgaaaggaatgagtgcttccttcagcataaggatgataacccaaacctgcctagattggtccgccctgaggtggacgtaatgtgtaccgctttccacgataatgaagaaacattcctgaaaaagtatctgtacgagatcgctagaaggcacccatacttctatgctccagaactgctgttttttgcaaagagatataaagctgccttcacagagtgctgccaagccgctgacaaggctgcctgcttgctgcctaaactcgacgagctgagagatgaaggaaaagcttctagcgctaagcaacgccttaagtgcgcttcacttcagaaattcggcgagagagccttcaaggcgtgggctgtggcaaggctttcacagcgcttccccaaggcggagttcgctgaggtaagtaagctggtgacggatcttactaaggtacatacagagtgttgccacggagatctgctggaatgtgctgacgatagggctgacctggccaagtacatctgtgagaaccaggactccatctcctccaagttgaaggaatgctgtgaaaagcctctgctcgagaagagccattgtatcgctgaagtggagaacgatgaaatgccggctgacctcccttcactcgctgccgactttgttgagagtaaagacgtgtgtaagaattacgcggaagccaaagatgtgtttctgggaatgttcctttatgaatacgccagaaggcacccggattatagtgtggtgcttttgcttagactggctaagacctacgagactaccttggagaagtgctgcgctgctgccgacccacatgagtgctacgcgaaagttttcgacgaattcaaaccccttgtcgaagagcctcaaaatctcatcaagcagaactgcgaattgtttgagcaacttggagaatataagttccaaaacgcactgctcgttaggtatacaaagaaggttcctcaggtgtcaacacccactttggtcgaggtaagcaggaatctgggtaaagttggttctaagtgctgtaaacacccagaggcgaaacgcatgccctgcgctgaagattacctctcagtagtgctcaatcagctctgtgtgctccacgagaagacccccgtgtccgacagggtcacaaagtgttgcaccgagagtctggtgaatcgccgcccttgcttcagcgctttggaggtggatgaaacctacgtccccaaagagttcaatgccgaaacctttacatttcacgcagatatatgtaccttgagtgaaaaagagaggcaaatcaagaagcagactgctttggtggagctggtgaaacataaacctaaggccaccaaggaacaactgaaggcagttatggacgactttgcagccttcgtcgagaaatgctgtaaagctgatgataaggagacttgttttgccgaagagggaaagaagctggttgccgcttcccaggctgccttgggtctg

SEQ ID NO: 249313 - DNA, 2007 bp, Artificial Sequence
  Description of Artificial Sequence: Synthetic coding sequence
atgaagtgggtgtcattcatctcactgctcttcctcttttcgagcgcctactcaggatctctcgacaaacggcacggagagggcactttcacgtcggatgtgtccagctacttggagggccaagccgccaaggaattcatcgcttggctggtgaagggtagacacggcgagggtactttcacctccgacgtgtcgtcatacctcgagggacaagcggctaaggagttcatcgcctggttggtcaagggacgggatgcccacaaatccgaagtggcacatcgcttcaaggaccttggagaggaaaacttcaaggctctggtcctcatcgcgttcgcccagtacttgcagcaatgcccattcgaggaccatgtgaagctggtcaacgaggtgaccgagtttgccaaaacttgcgtggccgacgagtcagccgaaaattgcgataaatctttgcatacgctctttggagataagctctgcactgtggcaactttgagagaaacctacggtgaaatggccgattgttgtgccaaacaggagccagagcggaacgagtgtttcctccagcacaaggatgataacccgaacctgccgcgcttggtcagaccggaggtcgatgtcatgtgcaccgctttccacgataacgaggaaactttcctcaagaaatacctgtacgagatcgcccgccggcacccttacttctacgctccagagctgctgttctttgcaaagcgctacaaggcagctttcactgaatgctgccaagcagctgacaaggcagcctgcttgctgccgaagctggatgagcttcgcgacgagggcaaagcatcctcagccaagcagcggctgaaatgcgcctcactgcagaagttcggtgaacgggcatttaaggcttgggccgttgcgaggctcagccagcgctttccgaaagcggaattcgccgaagtctcgaagctcgtcaccgacctgactaaagtgcacaccgaatgctgtcacggcgatctgctcgaatgcgccgacgacagagctgacctggcgaaatacatctgcgagaaccaagattcgatttcgagcaaactgaaagaatgttgcgagaagccactgctcgagaagtcgcactgtatcgctgaggtggagaatgacgaaatgcctgccgatttgccatccctggcagccgactttgtggaatctaaggacgtgtgcaaaaactacgcggaggccaaggacgtgtttctcggaatgttcctgtacgaatatgcacgccgacacccggattactcggtggtcctgcttcttcgcctggctaagacgtatgaaacgactctggaaaagtgctgcgcggctgcggacccgcatgaatgctacgcgaaggtgttcgatgaattcaaaccgctcgtggaagagccgcaaaatctgataaagcagaactgtgagctgttcgagcagctgggcgaatacaagtttcagaatgcgctgcttgtcagatacactaagaaagtgccgcaggtgtctaccccgactctggttgaagtgagccgtaatctgggaaaggtgggatccaagtgctgtaaacatccggaggcgaagcgcatgccttgtgcggaagattacctctcggtggtgctgaaccagttgtgcgtgctgcatgaaaagacccctgtgtcggaccgcgtcaccaagtgctgcaccgaatcgctcgtgaatcggcgcccctgcttctcagcactggaagtcgatgaaacctacgtcccgaaggaattcaacgccgagactttcaccttccacgcagacatttgtaccttgtcggagaaggaacggcagatcaagaagcaaactgcactggtcgagcttgtgaagcacaagccaaaagccactaaagaacagctcaaggcggtgatggacgactttgcagccttcgtggagaaatgctgcaaagccgacgacaaagaaacttgtttcgcagaggaagggaaaaagttggtggcggcgtcccaagccgccttgggactg

SEQ ID NO: 249314 - DNA, 2007 bp, Artificial Sequence
  Description of Artificial Sequence: Synthetic coding sequence
atgaaatgggtttcgtttataagcttattatttttattcagtagcgcctattccggttctttagataagcgccacggcgaaggtacttttacctcagacgtttcctcatatctcgaaggacaggctgcaaaggagtttattgcatggctggtgaaggggcgacacggagaaggaacatttacatctgatgtttcttcttatctggagggacaagctgcaaaagagttcattgcctggcttgtcaaaggacgtgacgcacataaatcagaagttgcgcatagattcaaggatttgggcgaagagaactttaaggctttagttctgattgcttttgcgcaatatttgcaacagtgcccgtttgaagatcatgtcaaattggttaatgaggttacagaatttgcgaaaacctgcgttgccgatgaaagtgccgaaaactgcgacaaatctctgcatacgttattcggagacaaactgtgcactgttgctaccttaagagaaacatatggggaaatggcggattgttgtgcaaagcaggaacctgaaaggaacgagtgtttccttcaacataaggacgataatccaaatttaccgcgcctagtacgacctgaagtagatgttatgtgtacagcattccacgataatgaagaaacatttctgaaaaaatatctgtacgaaatcgcacggcgccacccatatttttatgctcctgaactcctttttttcgccaaacggtacaaagcagcatttaccgaatgctgtcaagcagcagataaagctgcgtgcctactgccgaaactggatgagttaagagatgaaggtaaggcatcctccgcaaaacaacgtttaaaatgtgcgtctttgcagaaatttggcgaacgtgcatttaaagcttgggctgttgcccgtttgtcccaacgatttccgaaagccgagtttgctgaagtctcgaaattggttactgacttaactaaagttcatacagaatgctgccatggggatctgctggagtgtgcagatgatagagcggacctggctaaatatatttgtgagaatcaggactctatctcaagcaaattgaaagaatgttgcgaaaaacccctgctggaaaaatcccattgcatagcagaagtagaaaacgatgaaatgccagcggacttaccgagtctagcggcggattttgtggaaagtaaggatgtctgcaagaattatgcggaggccaaagatgtctttttaggaatgtttttgtatgagtatgcgagaagacatccggattactctgtggtattacttctccgcctcgcgaaaacatatgaaactacactcgagaaatgctgcgcagcggcagacccgcatgaatgttacgcgaaggtctttgatgaattcaaaccccttgttgaagaaccgcaaaatcttatcaaacaaaactgcgagttgtttgaacaattgggggagtataagtttcaaaatgcactccttgttcggtatactaaaaaagtgcctcaagtatcgacgccgacacttgtcgaggttagtcgtaatctcgggaaagttgggagtaaatgctgtaaacatcctgaagcaaaacgaatgccgtgtgcggaagactatctgagtgtcgtgcttaatcagctctgcgtacttcacgagaagacgcctgtctctgatcgcgttactaagtgttgcaccgaatcccttgtcaatcggagaccgtgcttcagcgcacttgaagtagatgaaacatacgtgccgaaggagttcaatgcggagacatttacattccatgccgatatctgcacattgtcagaaaaagaaagacaaatcaagaaacaaacagccttagtagaactggtaaaacataaacccaaagctacaaaggaacagctgaaggccgttatggatgatttcgctgcattcgtcgaaaaatgctgcaaagcagacgataaagaaacgtgttttgccgaagagggaaaaaaattggtagcagcgagccaagccgcacttggactt

SEQ ID NO: 249315 - DNA, 2007 bp, Artificial Sequence
  Description of Artificial Sequence: Synthetic coding sequence
atgaagtgggtgtcctttatctccttgctgtttctgttctcatccgcctactcaggatcgcttgataagagacatggtgagggaacttttactagtgacgtttcatcctacctcgaaggccaggcagcaaaggagttcatagcgtggcttgtcaaggggaggcatggtgaaggtacttttactagcgacgtgtcgagctacttggagggccaagcagcaaaagaattcatcgcctggctggtgaaaggtcgagatgcacacaaaagcgaagtcgcacaccgtttcaaagatcttggagaggaaaacttcaaggcgcttgtgcttattgcttttgcacagtaccttcaacaatgccctttcgaggatcatgtgaagttggtgaatgaggtgaccgagtttgcaaaaacttgtgtcgctgacgagtcggcagaaaactgcgacaagtcacttcacacgctgtttggcgacaaactgtgtactgtggcgaccctcagggaaacttacggcgaaatggcagattgttgtgcaaagcaggagcctgaacgaaatgaatgctttttgcaacataaggacgacaacccgaacctgccaagacttgtacgtccagaagtcgacgtcatgtgtaccgcgttccatgataacgaagaaacttttcttaagaagtacttgtacgaaatagcgcggcgccatccctatttctacgcacctgaacttctgtttttcgcgaagaggtacaaagcagcgttcactgaatgttgccaagctgcagataaggccgcttgtctgctgcccaagctggacgaactgcgggacgaaggtaaggcaagctccgcaaaacaaagacttaagtgtgcctcgctccagaagtttggggagagagcatttaaggcctgggccgtcgcacgtctctcacagcgatttcctaaagccgaattcgccgaagtgtcaaaacttgttactgatcttactaaagtacacaccgaatgctgccatggcgatctcctggagtgtgcagatgatcgcgccgatctggcaaagtacatttgtgaaaatcaagactccatctcctcgaagttgaaagaatgctgcgagaaaccgctgctcgaaaagtcacattgtatagccgaagtcgaaaacgatgaaatgcctgcggatctcccttcacttgccgcagactttgtggaaagcaaggatgtctgtaagaactacgcagaagcaaaggacgtctttctgggaatgttcttgtatgaatatgccagacgacatcccgattacagtgtggtgcttctgctgcgcctggcaaagacttatgaaactacccttgaaaagtgttgtgctgccgcagacccccacgagtgttacgccaaggtctttgatgagtttaagcctctggtcgaggaaccacagaacctgattaagcagaactgcgaacttttcgaacaactgggagagtacaagtttcagaatgcactgttggtgagatacaccaaaaaggtgccgcaagtgagcactcctacccttgtggaggtcagccgcaatctgggtaaggtgggaagcaaatgttgtaaacatccagaagcaaagaggatgccttgcgccgaagattatctttcggtggtgttgaaccaactttgtgtgctccacgagaaaactcctgtgagcgatcgggttaccaaatgctgtaccgaatcgcttgtcaatcggcgaccatgcttttcggcgctggaagtggatgagacttacgtcccaaaagagtttaacgcagaaacctttactttccacgcagatatttgcacgctttccgagaaggaacgccagataaagaagcagactgcactggtggagctggtgaagcataagccaaaagccaccaaggaacaactgaaggcagtcatggacgactttgcagcctttgtcgagaaatgttgcaaggccgatgacaaagaaacctgtttcgccgaagagggaaaaaagctcgtggcagcttcacaggcagcgctgggcctg

SEQ ID NO: 249316 - DNA, 2007 bp, Artificial Sequence
  Description of Artificial Sequence: Synthetic coding sequence
atgaagtgggtgtcttttatatcccttctgtttctattttccagtgcctattccggctccctcgataaacggcacggggaaggaactttcactagcgatgtgtcttcttatctggaaggccaggcggctaaggaatttatagcttggctggtcaagggaaggcacggcgagggaactttcaccagcgacgtgagttcttatcttgaaggccaggcagctaaggaatttatcgcctggcttgttaagggccgggacgctcacaaatccgaggtggctcatcgctttaaggacttgggagaggagaactttaaagccctagtgctaattgctttcgctcagtatctccaacagtgtccctttgaggatcacgttaagctggtcaatgaagtgacagaatttgcaaagacgtgtgtcgcggatgaaagtgccgagaactgtgataagagtctgcataccctattcggagacaaactgtgcactgtcgccaccctacgtgaaacctatggcgaaatggcggactgctgtgctaagcaggaaccagaaagaaacgagtgttttctgcagcacaaggatgacaatcctaatctgccaaggttggtgcggcccgaagttgatgtgatgtgcactgcctttcacgataacgaggagaccttcttaaaaaagtatttatacgagatcgcccgccgtcacccatatttttacgcccctgaactgctgttcttcgcgaagcggtataaggccgcattcacagagtgctgccaggccgccgacaaagctgcctgccttcttccgaaacttgacgagcttcgggatgagggcaaggcatcatctgcaaaacagaggctcaaatgcgcaagtctgcagaaatttggcgaaagggcattcaaggcatgggccgtggcccgactctcccagagattccctaaagcggaatttgccgaggtgtctaaactcgtcacggacctgacaaaagtgcataccgaatgttgtcatggcgatctgctcgaatgtgcagacgaccgcgctgacctggccaaatacatctgcgaaaaccaagactctatctcaagcaagctgaaagaatgttgcgagaaacccctgcttgagaaatcacattgtatagccgaggtggagaatgatgaaatgccagcagacctcccgtcactggctgcagacttcgtggaatccaaagatgtgtgcaaaaactatgctgaggctaaggatgtgttccttggtatgttcctctatgagtacgcgcgcagacatcccgactactctgttgttctattgctgcggctcgccaagacatacgaaacaactttagaaaagtgctgtgccgcggcggaccctcacgagtgctatgccaaggtcttcgatgagttcaaacccctggttgaagaaccgcagaatctgatcaagcagaattgtgaactgttcgagcagctcggggagtacaaattccaaaacgccctgctggtgcggtacacaaagaaagttccacaggtctctacccccactctcgtcgaagtatcaaggaacttgggtaaggtggggtcaaagtgttgtaaacatccagaagctaagcgaatgccttgtgcggaggattacctaagtgtcgtactgaatcagttatgtgtccttcatgagaagactcccgtatcagatcgggtaacaaaatgctgtaccgagtctttggtcaaccggcgaccatgcttcagcgccctagaagtggacgagacatacgtcccaaaagaatttaacgccgagaccttcaccttccatgctgacatatgtaccctctctgagaaggagcggcagatcaagaagcagacagccctggtggaactggtgaagcacaagccaaaagccacaaaggaacagttaaaggccgtgatggatgactttgcagccttcgtggagaaatgctgcaaggccgatgacaaagaaacatgttttgccgaggagggaaagaaattggtggctgcgagccaggcagccctaggactc

SEQ ID NO: 249317 - DNA, 2007 bp, Artificial Sequence
  Description of Artificial Sequence: Synthetic coding sequence
atgaaatgggtgtctttcatctcactgctatttctgtttagtagcgcctacagtgggtcactagacaagagacacggagagggcactttcaccagcgacgtatcaagttatctcgaagggcaggcagcgaaggagttcatagcctggcttgtgaagggcagacatggagagggcacgtttacatctgatgtatccagctatcttgagggccaggctgcaaaagagtttattgcttggctggtgaagggccgggacgcccacaagagtgaggttgcacatagattcaaagacctgggggaagagaacttcaaagccttagtcctcattgccttcgcacagtatctgcagcagtgcccctttgaggaccacgtgaagttagtgaacgaggtcaccgagtttgccaaaacttgtgtagccgatgagagtgcagagaactgcgataaaagcctgcacaccctgttcggagacaagttgtgcacggtggcaactttgcgggagacttatggcgaaatggccgactgctgcgccaagcaggaacccgaaaggaacgagtgctttctccagcataaagacgataatcccaacctgccacgtctggtcaggcccgaggtagatgtgatgtgcaccgcgttccacgacaacgaggagacgtttctcaaaaaatatttgtacgagatcgcaagacgacacccgtatttttacgctccagagcttctcttcttcgccaaaaggtataaagcagccttcacggagtgctgtcaggctgcagacaaggctgcatgtcttctgcccaagttggatgagctgagagatgaggggaaggcatcgtcagccaagcagagactgaaatgtgcaagtctacaaaaatttggagaaagagcattcaaggcatgggcagttgctcgactgtcacagcgatttccaaaggctgaatttgccgaggtcagtaagctggtgaccgatctgactaaagttcataccgagtgttgtcatggggatctgctggaatgcgccgatgatcgagccgacctagcaaaatatatctgtgagaatcaagactccatctcttctaaattgaaggaatgctgcgaaaaacccttactggaaaagtctcactgcatagccgaggtagagaatgacgaaatgccagccgacctcccttcccttgctgccgacttcgtggagtctaaggatgtgtgcaagaattacgccgaagccaaagacgttttcctaggaatgtttttatacgaatacgctcggcgacaccccgactatagcgtcgtcctgctgctgcggctggcaaaaacttacgaaaccacactcgaaaagtgttgtgccgcagccgatccccacgaatgctatgctaaggtcttcgatgagtttaagcccctcgttgaagaacctcagaatctgatcaaacagaactgcgaactgttcgagcagttaggcgagtacaagtttcagaatgcactcctggtgcgatacaccaagaaggtaccccaggtgagcactccaactctcgtcgaagtcagccggaacctaggcaaagtcggcagcaagtgctgtaaacaccctgaagcaaaaagaatgccgtgcgccgaagactacttgagtgtagtcctaaaccagttatgtgtcctgcacgagaagacgccagttagtgaccgcgtgaccaaatgttgcactgagtcactggtcaaccgaaggccctgcttttccgcacttgaggtggatgaaacttacgtacccaaggaattcaatgctgaaacgtttacttttcacgccgatatctgtacactctcagaaaaagaacgacagattaagaagcagactgcgttggtcgaactggtcaaacacaagcccaaagctaccaaggagcagttgaaggccgttatggatgactttgcagcattcgtggagaagtgttgcaaagcagacgataaggaaacttgtttcgcagaggagggaaagaagctggtcgctgcctctcaagctgcactgggtctc

SEQ ID NO: 249318 - DNA, 2007 bp, Artificial Sequence
  Description of Artificial Sequence: Synthetic coding sequence
atgaaatgggtttcttttatttcattattattcttattttcatcagcttattcaggatctttagacaagagacatggagaaggtacatttacatcagatgttagtagttatcttgaaggacaagctgcaaaagaattcattgcttggttagtcaaaggaagacatggagaaggtacatttacaagtgatgtttcatcttatttggaaggacaagctgctaaagaatttattgcttggcttgtaaaaggtagagatgcacataagtcagaagttgcacacagatttaaggatttaggagaggaaaatttcaaagcattagtacttatagcttttgcacaatatcttcaacaatgtccatttgaagatcatgttaaattagtaaatgaagttacagaatttgcaaaaacatgtgttgcagatgaaagtgcagaaaattgtgataaaagtttacatacacttttcggagataagttatgtacagttgctaccttaagagaaacttatggagaaatggcagattgttgtgctaaacaagaacctgaaagaaatgaatgttttttacaacataaagatgataatccaaatttaccacgtttagtaagaccagaagttgatgttatgtgtactgcttttcatgataatgaagaaacttttcttaaaaagtatttatatgaaattgctagaagacatccatatttctatgcaccagaattattattttttgctaaacgatataaagctgctttcactgaatgctgtcaagcagctgataaagcagcttgtcttttgccaaaacttgatgaacttagagatgaaggtaaagcatcttctgctaaacaaagacttaaatgtgcatcattacaaaaatttggagaaagagcatttaaagcatgggctgttgcaagactttcacaaagatttccaaaggcagaattcgcagaagtttcaaagttagttactgatttaaccaaggttcatactgaatgttgccatggagatttattagagtgtgccgatgacagagctgatcttgcaaagtatatttgtgaaaatcaagattcaatctcttctaaattgaaggaatgttgtgaaaaaccacttttagaaaaatcacattgtatagctgaagtagaaaatgatgaaatgcctgcagatttaccatcactcgctgcagacttcgtagaatctaaagatgtttgtaagaattatgcagaagcaaaagatgtatttcttggaatgttcctttatgaatatgcaagaagacatcctgactacagtgttgttttattattacgacttgcaaagacatatgagacaactcttgaaaaatgttgtgcagctgcagatccacatgaatgttatgccaaggtttttgatgaatttaagccacttgttgaagaaccacaaaatttaattaaacaaaattgtgaattattcgaacaattaggagaatataaatttcaaaatgctcttttagtaagatatactaaaaaagtaccacaagtttcaacaccaacattggttgaagtttctagaaatcttggaaaagtaggatcaaaatgttgtaaacatccagaggctaagcgaatgccatgtgcagaagattatttatctgttgttttaaatcagttgtgtgttcttcatgagaaaacacctgtttctgatagagttacaaagtgttgtacagaatcattagttaatagacgaccatgcttctcagcactagaagttgacgaaacttatgttccaaaagaatttaatgcagagacatttacatttcatgctgacatttgtacactttccgaaaaagaacgacaaattaaaaagcaaacagctttagtagaacttgttaaacataaacctaaagctactaaggaacaattgaaagctgttatggatgattttgctgctttcgttgagaaatgttgtaaagctgacgataaagaaacatgttttgcagaagaaggaaaaaagttagtagcagcatcacaagcagcattaggttta

SEQ ID NO: 249319 - DNA, 2007 bp, Artificial Sequence
  Description of Artificial Sequence: Synthetic coding sequence
atgaagtgggtgtccttcatctccctcctgttcctcttctcgtcagcgtactccggatcgctggacaaacgccatggagaaggaaccttcacctccgacgtgtcctcgtacctggaagggcaggccgccaaagaattcatcgcatggctcgtgaaggggcgccatggagagggtacttttactagcgacgtcagctcttacctcgaggggcaggcggcgaaggagttcatcgcctggctggtgaaggggcgggatgcacacaagagcgaagtggcccaccgctttaaggatctgggtgaggaaaacttcaaagccctcgtccttatcgcctttgcacagtacctgcaacagtgtccgttcgaggaccacgtgaagctggtgaacgaagtgacggagtttgcaaagacttgcgtggccgacgagtctgcagaaaattgcgacaagtcactgcacactctgttcggagacaagctctgcaccgtggcgaccctccgggaaacctacggagagatggctgactgttgtgccaagcaggagccagaacgcaatgagtgcttcctgcagcacaaggatgataatcctaacctgccgcggctggtgcggccggaagtcgacgtgatgtgcactgcatttcacgacaatgaggaaactttcctcaagaaatacttgtacgaaatcgcccgccggcatccttatttctacgcgccggagctgctgttcttcgccaagcggtacaaggccgctttcaccgaatgctgtcaagccgccgacaaggcagcgtgcctgttgcccaagctcgacgaactgcgggacgaggggaaggcttcgtctgcgaagcaaaggttgaagtgcgcctccctccaaaagttcggagagcgcgcgttcaaggcgtgggccgtggccaggctcagccagcggtttcctaaggctgagtttgccgaggtttcgaaacttgtcaccgacttgacgaaggtccacaccgagtgttgccacggggatctgctggaatgcgcagacgaccgcgccgatcttgctaagtacatttgcgagaaccaggattcaatctcgagcaagttgaaagagtgctgcgaaaagccactgctggaaaagagccactgcatcgcggaggtggagaatgacgaaatgccggcagacctcccaagcctcgctgcagacttcgtggaatccaaagacgtctgcaagaactacgcagaagccaaggacgtgtttctgggaatgtttttgtacgagtacgcccgccgacacccggactacagcgtggtcctcctgctccggttggccaagacttacgagactactctggaaaaatgttgtgcggccgcggacccgcacgaatgctacgcgaaggtctttgacgagttcaaaccccttgtggaggagccgcagaacttgatcaaacaaaattgtgaattgtttgagcaactgggagaatacaagtttcagaacgccctgttggtgagatacaccaaaaaggtgccacaggtgtcgactccgactctggtcgaggtgtcgcggaacctggggaaggtgggctccaagtgttgtaagcaccctgaagccaaacggatgccgtgcgccgaggactacctgtccgtggtgctcaaccagctctgcgttttgcacgagaaaacccctgtgagcgatcgggtgaccaaatgctgcactgagagcctggttaacagaaggccgtgtttctcggcacttgaagtggacgaaacttatgtgcccaaggaattcaacgcagaaactttcacgtttcacgcggacatctgtaccctctcagagaaggagagacaaatcaaaaaacagactgctctggtggagctggtgaagcataagccaaaggccaccaaggagcaactcaaggctgtgatggacgacttcgccgccttcgtggagaagtgctgcaaggccgatgataaagaaacttgcttcgctgaggaaggcaaaaaactggtcgcggcttcgcaggcggcgctggggctg

SEQ ID NO: 249320 - DNA, 2007 bp, Artificial Sequence
  Description of Artificial Sequence: Synthetic coding sequence
atgaaatgggtaagctttatctcattgttgttcttgttctcgtcggcatattcgggtagcttggataaaagacatggtgaaggaacatttacgtctgatgtatcctcctatctcgaaggacaagcggcaaaggagttcatagcgtggctcgttaaaggaagacacggagaagggacctttacgtcagacgtttcttcatatctcgaaggacaagcagctaaggagttcattgcatggttggttaaaggacgtgatgcccataagtccgaagttgcccatcgatttaaggatctgggagaagaaaacttcaaggcattggttcttatcgctttcgctcaatatctccaacaatgtccgtttgaagatcatgtgaagcttgttaatgaagttaccgaatttgcaaagacttgtgttgccgatgagtctgctgagaactgtgataaatctctgcatactctttttggagataaactttgcacagtcgctaccctgcgcgaaacttatggagagatggcggactgttgtgcaaaacaagaaccagagaggaatgagtgcttcctccaacataaagatgataatccaaatcttccgagactggttaggccggaggtcgacgtaatgtgtacggcattccacgataatgaagaaacttttttaaaaaagtatctatatgagatcgcacggcgacatccatacttctacgctccagaactgctgttctttgccaagcgctacaaagcggcttttaccgagtgttgccaagctgctgataaagcagcttgtttgctcccaaagctggatgaattgagagatgaagggaaagcaagttctgccaagcaaagacttaagtgcgcaagtttgcaaaaattcggcgaaagagccttcaaggcatgggctgtagcccgtctttcacaacgattccctaaagctgagtttgcagaggtttcgaagctggttacagacctaacgaaagttcatacggaatgttgccacggtgatcttctggagtgtgctgatgatagagcggacctagcgaaatatatttgtgaaaaccaagactctatctcaagtaagctcaaggaatgctgtgagaagccattgttggagaaatctcattgcatcgccgaagtagagaacgacgagatgcctgccgatctaccatcattggcggcagatttcgttgagagcaaagatgtatgtaaaaattatgccgaagctaaagatgtgtttctcggaatgttcctgtacgaatatgctcgccgtcatccagattacagtgtcgttcttctattacgacttgctaaaacatatgagaccacactagaaaaatgttgcgccgctgcagatcctcacgaatgctatgctaaagtctttgatgaattcaaacctttggttgaagaaccccagaatttgatcaagcaaaactgcgaactttttgagcagttgggtgaatataaatttcagaacgctctgttggttcgctatacaaaaaaagtaccgcaggtttctactcccacactcgtcgaagtttcacggaatctcggaaaggttggaagtaaatgttgcaagcacccagaagcaaaaagaatgccatgcgccgaagactatttgtctgtggtattaaatcaattgtgtgtgcttcacgaaaaaacaccagtttctgaccgggtaacaaaatgctgcacagagtctcttgtgaatagacgcccttgcttctcagcgttggaggttgatgaaacctacgtgcctaaagagttcaatgcagaaacattcacttttcacgccgacatctgcacactttctgaaaaagagagacagattaaaaaacaaaccgctcttgtagagttggtaaaacataaaccaaaagccacaaaggagcaactgaaagctgtcatggatgatttcgctgccttcgtagagaagtgctgcaaggcagacgataaagaaacttgtttcgccgaagagggtaagaaactagttgccgcatcacaggcagcgcttggactt

SEQ ID NO: 249321 - DNA, 2007 bp, Artificial Sequence; identical to SEQ ID NO: 249307
  Description of Artificial Sequence: Synthetic coding sequence

SEQ ID NO: 249322 - DNA, 2007 bp, Artificial Sequence
  Description of Artificial Sequence: Synthetic coding sequence
atgaaatgggtgtcgtttatctcgctgttgttccttttctcatcggcgtactccggatcgctcgataagagacacggtgaaggaactttcacttcagacgtgtcctcctaccttgaaggacaggcagcaaaagaattcattgcatggcttgtgaagggaaggcatggggaaggcacctttacctcagatgtttcttcctacctggaaggccaggccgcgaaggaattcatcgcatggctcgtgaaagggcgcgatgcacacaaatccgaggttgctcatcgtttcaaagatctgggcgaggaaaactttaaagcactggtgcttattgcgtttgctcagtaccttcaacaatgcccattcgaggatcatgtgaagttggtcaacgaagtcaccgaattcgccaagacgtgcgtggcagatgaaagcgcggagaactgtgacaagagccttcatactctgtttggtgataagctctgtaccgtggcaaccctgcgcgaaacttacggagagatggcagattgctgtgcaaagcaagagccggaaaggaacgaatgttttctccaacataaggacgacaaccctaatcttcctcgtctggtgcgtcctgaagtcgatgtgatgtgtactgcctttcacgataacgaagagacttttctgaagaaatacctctacgaaatagcgcgcaggcacccatacttttacgcacctgaacttctcttttttgcaaagcgatacaaagcagctttcaccgaatgttgccaggccgcagacaaggcagcctgtctcttgcctaagctcgacgaacttagagatgagggtaaggcatcatcggcaaagcagcggttgaagtgcgcgagcctgcaaaagttcggagaaagagcatttaaggcgtgggcagtcgccagattgagccagaggtttccaaaggccgaatttgcagaagtctcgaagttggtgacggacctgaccaaggttcatactgagtgttgtcacggcgatctgctggaatgcgcagatgaccgggcagatctggcaaagtatatctgcgagaaccaagattcaatatcatcgaaattgaaagaatgctgtgagaaaccactgctggagaagagccactgcatagccgaggtggaaaacgacgaaatgcctgcagatttgccatcgctggcagccgatttcgtggagagcaaggatgtgtgcaagaattacgctgaggccaaagacgtgtttctggggatgtttctttacgagtacgcacgacgtcacccagattattccgtcgtgttgcttcttaggctcgccaagacctatgaaactacccttgaaaagtgctgtgcagcagcagacccacatgaatgctacgcaaaagtgtttgatgaattcaaaccactcgtggaagagccacagaatctgataaagcaaaactgtgaactgtttgagcaactcggcgaatacaaattccagaatgccctccttgtgcgctacaccaagaaggtgccccaagtctcgactccaacccttgtggaagtgtcgagaaacttgggtaaggtgggttcaaagtgctgcaaacatcctgaagcgaagcgtatgccctgtgccgaggactacctttccgtggtgctcaaccaactgtgtgtgctccatgaaaagacccctgtgtcagacagagtgaccaagtgctgcactgagtcccttgtcaaccgacggccctgtttttcggccctcgaggtggatgagacttacgtgcctaaagagtttaacgccgaaacgttcacttttcatgccgacatctgtacccttagcgagaaagaacggcaaatcaagaagcaaaccgccctggtcgagctcgtgaaacacaagcctaaggcaactaaggagcagctgaaagcagtgatggatgattttgcagcgtttgtggagaaatgttgtaaggcagatgataaggaaacgtgctttgcggaagagggcaaaaaacttgtcgcggcgtcccaagctgctctgggtctt

SEQ ID NO: 249323 - DNA, 2007 bp, Artificial Sequence
  Description of Artificial Sequence: Synthetic coding sequence
atgaaatgggtgagcttcatcagtctgctctttctgttctcgagcgcctactcaggatcgctggacaagcggcacggcgaaggtactttcacttccgacgtgtcgtcgtatctcgagggacaagcggccaaggagttcatcgcttggctcgtgaaaggacggcatggagaaggcacttttacgtcggatgtgtcctcatacttggagggccaggctgccaaggaattcatcgcgtggctggtcaaggggagagatgcccataagagcgaggtcgcccaccggttcaaggatctgggggaggaaaacttcaaagccctggtgctgatcgcattcgcacagtacctccagcaatgccccttcgaagatcatgtgaagctggtgaacgaagtcaccgagtttgcgaaaacttgtgtggccgatgaatccgcggaaaattgcgataagtcactgcacactctgtttggagacaaactttgtaccgtggcaacccttagagaaacctacggagaaatggccgactgctgcgcaaagcaggaacctgagcggaacgagtgctttctccaacataaggatgataatccgaacctcccgcggcttgtgcggcctgaggtggacgtgatgtgcacggcgtttcacgacaatgaggagactttcctgaagaagtacctgtacgaaatcgctcgtcgccacccatacttttacgccccggagttgctcttcttcgcgaaacgctacaaagcagcgttcactgaatgttgccaggccgcggataaggctgcgtgtctgctcccgaaactggatgaattgagagacgaagggaaagcatcatcagccaagcaaagactgaaatgcgcgtcgctccaaaagttcggggaacgcgccttcaaagcgtgggctgtcgcgagattgtcgcagcggtttcctaaggccgagtttgccgaagtgtcgaagctggtcaccgacctgaccaaagtgcatactgaatgctgccacggcgacctcctggagtgtgccgacgatcgcgcagacctggcaaagtacatctgcgagaatcaggattctatttccagcaaacttaaagagtgctgcgagaagccgctgctggaaaagtcgcactgcatcgcagaagtggagaacgacgagatgccggcggacctgccgtcattggcagcagactttgtggaaagcaaggatgtgtgtaagaattacgcagaagctaaagatgtgttcttgggaatgttcctgtatgaatacgcgcggcggcacccggattactccgtcgtgctcctgctgagacttgcaaagacttacgaaactactcttgagaagtgctgcgcagctgcggacccgcacgaatgttacgccaaagtctttgacgagttcaaaccactggtcgaggagccgcaaaacctgattaagcaaaactgcgagttgttcgaacagctgggcgaatacaagttccagaacgcgttgctggtgcgctacactaagaaggtgccgcaagtctccactccgactctggtggaggtcagccgcaacctcggaaaagtgggatcgaagtgctgcaaacacccagaagcgaagcggatgccatgcgcggaggactacctgtccgtcgtattgaaccagctctgcgtcctccacgaaaaaactccagtgtcggaccgcgtgactaaatgttgcactgaaagcctcgtcaaccggcgcccatgcttctcggccttggaggtggatgaaacttacgtgccgaaggaattcaatgccgaaactttcaccttccacgcagacatctgcaccctgtccgaaaaggaacggcagatcaagaagcagactgctcttgtcgagttggttaaacacaagccgaaggcgactaaggaacaactgaaggctgtgatggacgactttgccgctttcgtggagaagtgttgtaaggccgatgacaaggaaacttgtttcgctgaagaaggaaagaagctcgtcgcggcctcgcaggcggcgctgggactg

SEQ ID NO: 249324 - DNA, 2007 bp, Artificial Sequence
  Description of Artificial Sequence: Synthetic coding sequence
atgaagtgggtatcattcatttccctgctgttcctgttctcgtctgcgtactcgggctcgcttgacaaacggcatggcgagggaacgtttaccagcgatgtgtcctcctacctggaaggtcaggcagcaaaggagttcattgcgtggctggtgaaaggtcgtcatggggaaggaacctttacttcggatgtctcctcatacctggaaggacaggcagctaaggaattcatagcctggcttgtcaaaggaagagacgcccataagtcggaagtggcccatagattcaaagacctgggagaagaaaacttcaaggcgcttgtgcttattgcctttgcacagtaccttcagcaatgccccttcgaagatcacgtgaagctcgtcaatgaggtgaccgagtttgcaaaaacgtgcgtggctgatgaatccgcagaaaactgtgataagagcctccataccctttttggagacaagttgtgtactgtggccactctgagagagacttacggggagatggctgattgttgtgcaaagcaagagcctgaacgcaatgaatgttttctccaacacaaggatgataacccgaatctccctcgcttggttcgcccagaagttgatgtcatgtgtacggcgtttcatgacaacgaagaaaccttcctcaagaaatacctgtacgagattgccagaaggcatccgtacttttatgcaccagaactgctgttttttgcaaagagatacaaggccgcttttaccgaatgctgtcaggccgcagataaggcagcctgcctgctgcctaaacttgacgagctgagggatgaaggaaaggcatcgtcagccaagcagcgcctgaagtgtgcctcccttcaaaagtttggcgagcgtgcatttaaggcctgggccgtcgccagactgtctcaacgatttccaaaagcagaatttgctgaagtgtctaaacttgtgactgatcttactaaggtgcataccgaatgttgtcatggagatcttctggaatgtgcagatgatcgggccgatctggcaaaatacatatgtgaaaatcaagattcaatttcgtcgaagctgaaagagtgttgcgagaaacctttgctggaaaagtcccactgcattgctgaggtcgagaatgacgagatgcctgctgatttgccatcgctcgctgcagatttcgtggaaagcaaggatgtctgtaagaactacgcagaggcaaaggacgtgtttcttgggatgttcctttacgaatacgcacggagacatcctgattactcagtcgtgcttcttcttagactggcaaagacttatgaaactacccttgagaagtgttgcgcagcagcggatcctcacgaatgttacgcaaaggtgttcgacgaattcaagccccttgtggaggagccgcagaacctgatcaagcaaaactgcgagctgtttgagcaactgggtgagtacaaattccagaatgcactcttggtgcgctataccaagaaagtccctcaagtgagcactcctactctggtggaagtgtcgcggaatcttggaaaggtgggctcaaagtgttgcaagcatcctgaggcgaagcgcatgccctgtgctgaggactacctgagcgtcgtgcttaatcaactttgcgtcctgcacgaaaagacgccagtgtcggaccgggttaccaaatgttgtacggaaagcctcgtgaaccgacgcccttgcttttcggccctggaagtggatgaaacttatgtgcccaaggaattcaatgcagaaacctttaccttccacgcagatatttgtactctcagcgagaaagaaaggcaaatcaagaaacagaccgcgctggtggagctggtcaagcataagcccaaggccacgaaggagcagttgaaagcggtgatggacgactttgccgcattcgtggaaaagtgttgtaaggcagacgataaagagacttgttttgccgaagaggggaagaaacttgttgcagcaagccaagcggcgctgggtttg

SEQ ID NO: 249325 - DNA, 2007 bp, Artificial Sequence
  Description of Artificial Sequence: Synthetic coding sequence
atgaagtgggtctcatttatctccctgcttttcctgttttcctccgcctactctggcagcctcgacaaaagacatggggagggaacattcacttcagacgttagctcgtacttggagggtcaagccgccaaagagttcattgcttggctggtgaaagggagacacggcgagggcacctttacgtctgacgtttcctcgtatttggaaggtcaagccgccaaagaattcatcgcttggctggtaaaaggaagagatgcccataagagcgaggtggcgcaccgcttcaaggatttgggagaagagaatttcaaagccctggtcctgatcgcatttgcgcagtatctccagcagtgccctttcgaggaccacgtgaagctagttaacgaggttacagaatttgcaaaaacctgtgtagcagatgaaagcgctgagaattgtgacaagagccttcacactctctttggagataagctatgcacagtagccaccttgcgggagacctacggggaaatggctgactgttgcgccaaacaagaacctgaaagaaatgagtgcttccttcagcacaaggatgataatcctaatctgccgaggttagtgcgtccagaggtagacgttatgtgcacggcttttcacgataacgaggagaccttcctgaagaaatatttgtacgaaatagcccgaagacatccgtacttctatgcccccgagcttttgtttttcgcgaagcgctacaaggccgctttcaccgagtgctgccaggccgccgacaaagccgcttgccttctacccaaacttgatgaactcagggatgagggcaaagcatcttctgcgaaacagagactcaagtgcgctagccttcagaagtttggagaaagagcttttaaggcatgggccgtggccagacttagtcagagattcccaaaggcggagttcgccgaagttagcaaactggtcaccgatctgacgaaagtgcataccgaatgctgtcacggggacctgttggagtgtgcagatgaccgtgccgatctcgcaaagtacatttgtgaaaatcaggatagcattagttcaaagttgaaagaatgctgcgaaaaacccctcctcgagaagtctcactgcatcgcggaggtggagaatgatgaaatgcctgcagatctccctagtttagcggcggattttgtggagtccaaggatgtgtgcaaaaattacgcggaagcaaaagacgtgttccttgggatgtttttgtatgaatacgcgaggaggcatcccgattactcagtggtgctgctactgcgacttgcaaaaacatatgagaccaccctggagaagtgctgtgccgctgccgacccccacgaatgctacgccaaggtgtttgatgaatttaagccactggtagaagagcctcaaaacttgattaaacaaaattgcgaactgttcgagcagctaggagagtataaatttcagaatgccctgttagtgaggtacaccaaaaaagttccccaggtgtccacccctaccctagttgaagtctctcggaacttggggaaagtcggctcaaaatgctgcaaacaccccgaagccaagcgtatgccatgtgccgaagactacctttccgtggttctgaaccagctctgtgtgctgcacgagaagactccagtttccgatagagtgactaaatgctgtaccgagtcactggtaaataggaggccatgtttcagcgctcttgaagtagacgaaacatatgtaccgaaggagtttaatgcagaaacctttactttccatgccgatatttgtacactgtccgaaaaagaaaggcagataaagaaacaaaccgccctggtggagttggtgaagcacaagcctaaagcaactaaagagcagctaaaggcagtgatggacgattttgccgcattcgtagagaaatgctgcaaagccgacgacaaggagacctgtttcgcggaagagggcaaaaagctcgtggccgcctcacaagccgccttgggtctg

SEQ ID NO: 249326 - DNA, 2007 bp, Artificial Sequence
  Description of Artificial Sequence: Synthetic coding sequence
atgaaatgggtttcctttatcagcctcctgttcctattctcgtccgcctattcaggcagcctggacaaacggcacggagaagggacttttactagcgatgtgtccagttacctagagggccaggctgcaaaagaattcatcgcctggttggttaaaggacgccatggcgaaggtacattcacatctgacgtgtcttcttatttggagggccaagccgccaaggaattcatcgcctggttagtcaaaggtagagatgcccataagtccgaagtggcacaccgcttcaaggatctcggtgaggagaattttaaggcgttggtacttatcgcatttgcccagtacttacagcagtgcccgtttgaggaccatgtcaaactcgtgaatgaggttaccgagttcgcaaagacatgcgtggctgatgaatccgcagagaactgtgacaagtccctgcataccttgtttggagacaagctctgcacagtggccaccctgcgagagacatatggggagatggccgattgttgtgctaaacaggagcctgaacgcaacgaatgtttcctgcagcataaagatgataatccaaatctgccccggctggtacggccggaggtagacgtgatgtgcactgcgttccatgacaatgaagagaccttcctgaagaagtacctttatgagatcgcgcgaagacacccctacttttatgcccccgagctgctgtttttcgccaagcggtacaaggcagccttcacggagtgctgtcaggcggccgataaggccgcatgtctcctcccgaagctcgacgagctccgcgacgaggggaaggcgtcctctgcgaagcagaggttaaagtgcgcctctctccagaagtttggcgagcgcgcttttaaagcgtgggcagttgctaggctgagccagaggtttcccaaagcagagttcgcagaggtcagcaagctggttacagacttgacaaaagtgcacacagaatgttgtcatggtgacttgctggaatgtgccgatgatcgtgccgacctcgctaagtacatctgcgagaatcaagactcaatctcgagtaagttgaaggagtgttgtgagaaacccctgctcgagaagagtcactgcattgccgaggtggagaacgacgagatgcccgcagatctccccagtctcgccgcagattttgtggagagtaaagacgtctgcaaaaattatgctgaggctaaggacgtctttctgggaatgtttctctatgaatatgcacgtcggcacccagactactccgtcgtcttgttattgaggttggctaagacgtatgagactacactcgagaagtgctgcgctgctgccgacccacacgagtgctacgccaaagtgttcgacgaatttaaacctcttgtggaagaaccgcagaatctgatcaagcaaaactgtgagttattcgaacagctaggggagtacaaattccaaaacgccctgctcgtaaggtacacaaagaaagttccccaggtatcaactcctactctagtcgaagtgtctaggaatttaggcaaggtggggtccaagtgttgcaaacatccagaggctaaaagaatgccttgcgccgaggactatttgtcagtcgtgctgaaccagttatgcgtgctgcatgagaagacacccgtgtcagatagggtgactaaatgctgcacggaatctctggtgaacagaagaccttgcttttccgctctggaggtagatgaaacctacgtgccaaaagagtttaatgctgagacgtttacatttcacgcagacatttgtacactctcagagaaagagcgccagataaagaagcagaccgccttggtagaactggtgaagcataagcctaaggcaacaaaagagcagctcaaagccgttatggacgacttcgcggctttcgtcgagaaatgctgcaaagctgacgataaagaaacatgctttgccgaagagggcaagaaattggtggccgcttcgcaggctgctctcgggctg

SEQ ID NO: 249327 - DNA, 2007 bp, Artificial Sequence
  Description of Artificial Sequence: Synthetic coding sequence
atgaagtgggtctcattcattagcctgctgttcttgttcagttcagcttactcaggatccctcgataaacgccatggcgaagggactttcactagcgacgtctcctcttatttggaagggcaagccgccaaggagttcatcgcttggttggtgaagggacgccacggagaaggcacattcacatccgatgtaagcagttacctcgaggggcaggcagctaaggagtttatagcctggttggtgaagggccgggatgcccacaagtctgaggttgctcatcgttttaaagatctcggcgaggagaactttaaagccctggttttgatcgcctttgcgcaatatctccaacagtgcccattcgaggatcacgtgaaactagtgaatgaagtcaccgagttcgctaagacatgtgttgcggacgagtctgcggaaaattgcgataaaagcttgcatactttatttggcgacaagctttgcactgtggcaactctccgagagacttacggcgagatggcagattgctgtgccaagcaggagccggagcgaaatgagtgttttctacagcataaggatgacaaccctaacctgccgcgtctcgtgaggccagaggttgatgtcatgtgtaccgcgttccatgataatgaggagaccttcctgaaaaagtatctctacgagattgcaagaaggcatccgtatttctatgcacctgaacttctgttctttgcaaagagatacaaggccgcttttaccgaatgttgtcaagccgcagataaagcagcttgcctgctgcctaagcttgacgaacttcgagatgagggaaaggcttccagcgcaaagcagcggttgaagtgtgccagtctgcagaagtttggggaacgtgcttttaaagcttgggcggtggctcggctgtctcaaagatttcctaaagccgagttcgcggaggtgagcaaattagtgactgatctcaccaaagtgcatacagagtgctgccatggcgatctgttagagtgcgctgacgacagagctgatctggccaaatatatatgcgagaaccaggactccatctcctctaaacttaaggaatgttgcgaaaaaccccttctggaaaagtcccattgtattgccgaagttgaaaatgatgagatgccagcggatcttccttctctggctgctgacttcgtggagagtaaggatgtttgtaagaattacgccgaagccaaggatgtgttcctgggcatgttcctatacgaatacgctcggcggcatcctgattactctgtcgttcttttgctcagattagctaaaacttacgagacgacgttagagaagtgctgtgccgcagcagatccccacgagtgttacgccaaggtttttgacgagtttaaaccattggtcgaagagccacagaatctcataaagcagaactgcgaattgtttgaacagttaggagaatataaatttcagaacgccctgctggtgcgttacacaaagaaagttcctcaggtgtccacccccaccctcgtcgaagtttcgagaaaccttggaaaagtgggatccaagtgttgtaaacatcccgaggcaaaacgaatgccatgcgctgaagactacctaagtgtggtgctgaatcagctctgtgtgcttcatgagaagactcccgtgagtgatcgggtgactaagtgctgtactgaatcgcttgttaatcgcagaccctgtttctccgccctggaggtggatgagacatacgttcccaaggaatttaatgcagagacatttacatttcatgccgacatctgcactctctcagagaaggaaagacagatcaaaaagcagaccgcactcgtggaattagtcaaacacaaaccgaaggccactaaagagcaactgaaggcagtgatggacgacttcgctgcattcgtggaaaaatgttgcaaagctgacgacaaagagacatgctttgcagaggaggggaagaagctggttgccgcgtctcaggctgccctcggtctg

SEQ ID NO: 249328 - DNA, 2007 bp, Artificial Sequence
  Description of Artificial Sequence: Synthetic coding sequence
atgaagtgggtcagcttcatttcccttctgtttctgttctcctctgcctattccggctctcttgacaagaggcatggagagggcacctttaccagcgacgtaagttcctacctggagggccaggccgctaaagaatttatcgcatggttagtgaagggacgacatggcgagggcaccttcacatctgatgtgagtagttacttagaggggcaagccgctaaagagtttatcgcctggctggtcaaaggccgggacgcccataagtctgaggttgcccaccgatttaaggacttgggcgaggagaatttcaaggccctcgtgctgatagctttcgcccagtacctccagcagtgcccattcgaagaccatgttaaactggtgaacgaggtgactgaatttgctaagacttgtgtggcagatgagtccgctgagaactgtgacaaatctctacatactctgttcggagataaactctgcaccgtggctactttaagggaaacctacggcgaaatggctgactgctgcgccaagcaggaacccgaacgcaatgagtgttttttacaacataaggacgacaacccaaacctgccaaggttagtcagacctgaggtagatgtgatgtgtaccgcttttcatgataacgaggaaacctttttaaaaaagtatttatacgaaattgctcggcgccatccttatttctacgctcccgaactgctgttttttgctaaacgctataaggctgctttcacagaatgctgccaggcagctgataaggctgcctgcctgctgcctaaactcgatgaactgagggacgagggaaaggcctcctcagctaagcagagactgaaatgtgccagccttcagaaatttggcgagagagcctttaaagcttgggccgtcgccaggctgtcacaacgctttccaaaagccgagttcgccgaagtgtccaaactcgtgacagacttgacaaaggtgcacactgagtgctgtcacggtgacttattggagtgcgccgacgatagagctgacctggctaagtacatatgcgaaaatcaggatagcattagctccaaattaaaagagtgctgtgagaagcccctcctggagaaatctcattgcattgccgaagtggaaaacgacgagatgcctgccgacctgccttcactagccgcagattttgtcgagagtaaagacgtgtgtaagaactatgctgaggcaaaggatgtttttcttggcatgtttctatacgaatatgcccggcgccaccccgattattccgtggttttgcttctcaggctggctaagacctatgaaaccaccctggagaagtgctgcgccgctgctgacccccatgagtgctatgccaaggtgtttgacgagttcaagcctctagtggaagaaccacagaacctgataaagcagaattgcgagctctttgagcagttaggggagtataaattccagaatgcactgcttgtgcgctacaccaagaaggtgcctcaggtgtccacaccaacactagtcgaagtgagccgcaatctgggtaaggttggctccaaatgctgtaagcacccagaggccaagcgaatgccatgcgcagaagattacctaagtgttgttctcaatcaactgtgtgtgctgcacgaaaaaactcctgtgtctgatcgagtgacaaagtgctgtaccgagagcctggtgaatcgacgaccatgtttttctgcactggaggtggacgagacttacgtgccaaaggagttcaatgccgagacattcacattccacgcagacatttgtacactgtctgagaaggagcgccagataaagaagcaaacagccctagtggaactcgtcaaacataaacccaaggccacaaaagagcagctgaaagcagttatggacgacttcgctgccttcgtggaaaagtgttgcaaggccgatgataaagaaacttgttttgcagaagaaggcaaaaaactggtcgctgcatctcaggccgccttaggtctg

SEQ ID NO: 249329 - DNA, 2007 bp, Artificial Sequence
  Description of Artificial Sequence: Synthetic coding sequence
atgaagtgggtatccttcatttccctcctgtttctgttttcttccgcctactctgggtcactggacaagagacatggagagggaacattcacaagtgatgtttcttcatacttggaaggacaggccgcgaaggaatttattgcgtggttggttaagggacgacacggagaagggacgtttacatctgacgtgagctcgtatctcgagggccaggcagcgaaggaattcatcgcctggcttgtaaagggccgtgacgcccataagtctgaggtggcacatcgttttaaggatctcggcgaagagaatttcaaagctcttgtgctcatagcctttgcgcaatacttgcaacagtgcccgtttgaggaccatgtgaaacttgtgaacgaggtgacggagttcgcaaagacctgcgtcgcggacgagagcgccgaaaactgtgacaagtctcttcacacgctgtttggcgataagttatgcacggtggcaaccctacgcgaaacttatggggaaatggctgactgctgcgccaaacaggagcccgaaagaaacgagtgcttcctacagcacaaagacgataatcccaacctgccccggctggttaggcctgaggtcgacgtgatgtgcacagccttccatgataacgaagaaacgttcctcaagaagtacctctacgagatagcacggcggcatccctacttctacgctcccgaacttctattcttcgcgaagaggtacaaggctgcgttcaccgagtgttgccaggccgctgacaaggctgcctgcctgcttcccaagctcgacgagctccgggacgaaggaaaggccagcagtgcgaagcagaggctgaaatgtgcctctcttcagaaattcggggagcgcgcctttaaagcatgggctgtggcacgtctgtctcagcgtttccctaaggccgaattcgcagaagtcagcaaactggttaccgacctgactaaagtacataccgagtgctgccacggggatctgctggaatgcgcagacgacagagccgatctagccaagtatatctgcgagaatcaggactccatatccagcaagctgaaagaatgctgcgagaagccgcttctcgaaaagtcgcactgtattgccgaggtggaaaatgatgaaatgccagccgacctgccttccttggctgcagacttcgttgagtcaaaggacgtctgcaagaactacgccgaggctaaggacgtgtttctcgggatgttcctgtatgaatacgcacgccgacatcccgactatagtgtagtccttctgctgcgtctcgccaaaacatacgagacaaccctggaaaaatgttgtgcggctgccgatccccatgagtgctacgcgaaagtgttcgacgagtttaagccccttgttgaggaaccacagaacttgataaagcagaactgcgaattgttcgagcagctgggcgaatataagttccaaaatgccctgctcgtgcggtataccaaaaaggtacctcaggtttctactccaacactagtagaagtgtctcggaatctcgggaaggtggggtccaagtgctgtaagcatccagaggcaaagcggatgccatgcgctgaggactacctctccgttgtgctgaatcagttgtgcgtgttgcacgagaagacacccgtgtccgacagggtcacgaagtgctgtaccgagtctctggtgaatagacgcccttgttttagcgcccttgaggtcgacgaaacctatgttccgaaagagttcaacgcggaaacgttcacctttcacgcagacatttgtacgctgagtgaaaaagaacgccaaatcaagaagcagaccgcactcgtcgagctggtcaagcataagcctaaggccaccaaagaacagttaaaagctgtgatggacgatttcgccgccttcgtggagaaatgttgcaaagcggatgacaaggagacctgtttcgcggaggagggaaaaaaacttgtggccgccagccaggccgcattgggactg

SEQ ID NO: 249330 - DNA, 2007 bp, Artificial Sequence
  Description of Artificial Sequence: Synthetic coding sequence
atgaaatgggtcagcttcatcagcttgctgtttcttttttctagcgcctacagcggcagcctcgataaaagacacggcgagggcactttcacgagcgatgtgtcatcttatctggaaggccaggctgctaaagaattcatcgcctggctggtcaagggccgccatggagaaggcaccttcacgtctgatgtgagctcctaccttgagggtcaggccgcaaaggaatttatcgcatggttggtgaaaggccgagacgctcacaagtcagaagtcgctcatcgctttaaggatctcggagaggagaactttaaagctctggtgctcattgctttcgctcagtatctccagcagtgcccttttgaagatcatgtgaaactggtgaatgaggtgaccgagtttgccaagacatgcgtcgccgacgagtccgcagaaaattgtgacaaatctctgcacacgctgtttggcgataaactatgcacagtggccaccctcagagagacctacggggaaatggccgattgctgcgcaaagcaggagcctgaacgaaacgagtgtttcttgcagcataaggacgataaccccaacctgccacgcctggtcagaccagaagtggacgtaatgtgtaccgcgttccatgacaacgaggaaacatttctgaagaagtatctgtatgaaatcgctaggagacacccctacttctacgccccagagttgcttttctttgccaagaggtataaggcagctttcaccgagtgttgccaggccgctgacaaagcagcctgcctcctccccaaactggatgaacttagggacgaagggaaagccagcagtgccaagcagagactgaagtgcgcatctcttcagaaattcggggaacgagcctttaaggcttgggcagtagcacgacttagtcagcgatttcctaaggcagagttcgctgaggtgagcaagcttgtgaccgacctgacaaaggtgcatacggaatgctgccacggggacctccttgagtgtgccgacgaccgggcagacctcgctaaatatatctgcgagaatcaagacagcataagctctaaactcaaggaatgctgtgagaagccattgctggagaagtcccactgcatagccgaagtggagaacgacgagatgcccgccgacctcccaagtttggcagctgactttgtcgagtccaaagatgtctgtaaaaactatgcggaagcgaaagacgtgttcctgggcatgttcctgtatgaatacgccagaagacatcctgattattccgtggtcctgctgctcaggctcgccaagacgtacgagacaacgctggagaagtgttgcgccgccgcagaccctcacgagtgctacgcaaaggttttcgacgagtttaaacctctcgttgaggaacctcagaacctgataaaacagaattgcgaactctttgagcagcttggagagtataagttccagaatgccctgctggtccgctacaccaaaaaggtgccacaggtgtcaacccccaccctggttgaagtcagcaggaatctcgggaaggtcggctctaagtgctgcaaacatcccgaggccaaacgtatgccctgcgccgaagactacctgagtgtggtgttgaaccagctgtgtgtgctgcatgagaaaactcccgtctctgatcgcgtgacgaagtgctgtacagagtcccttgtgaacaggaggccctgtttttcagctctagaggtagatgagacttacgtgccaaaagaatttaatgcagaaacctttactttccacgccgatatctgtacgctcagcgaaaaggagcgtcagattaaaaaacaaaccgccctggtcgagctggttaaacataagcccaaagcgaccaaggaacagcttaaggcggtgatggatgactttgccgcattcgtcgaaaaatgttgtaaggcggatgataaagaaacatgctttgcggaggaggggaagaaactggtggctgcgtctcaggccgcactcgggctc

SEQ ID NO: 249331 - DNA, 2007 bp, Artificial Sequence
  Description of Artificial Sequence: Synthetic coding sequence
atgaagtgggtttcgtttatcagcctcttgtttctgttttccagcgcatacagcggctcgctggataagcgccatggcgagggaactttcacctccgatgtgagcagctaccttgaaggtcaggcagccaaggaattcattgcatggcttgtgaaaggcaggcacggcgaaggcacctttacctcagatgtgagctcttacctggagggacaagccgcaaaggagtttattgcctggcttgtcaaagggagggatgcacacaaatcagaggtcgcacatcgatttaaggacctgggagaagaaaactttaaggccctggtcctgatcgcctttgctcaatacctgcagcagtgcccattcgaagatcatgtcaaactcgtgaacgaggtgaccgaattcgcaaagacttgtgtggcagatgaaagcgcagaaaactgtgataagtcgcttcatactttgtttggagataaactttgtactgtggccaccctccgagaaacctatggtgaaatggcggactgttgtgcaaagcaggaaccagagcgcaatgagtgttttctgcagcacaaggacgataacccaaatctccccagactggttagaccagaagtggacgtgatgtgtactgctttccacgacaacgaagaaacttttcttaagaagtatctctacgagattgccagacgtcatccttacttttacgcaccagaattgctgtttttcgcaaaacgctacaaggcggcatttaccgagtgttgtcaagcagcagacaaggcagcatgtctgctgcccaaactggatgagctccgcgatgaaggaaaggcttccagcgctaaacagagactgaagtgtgcatcgcttcaaaagtttggggaacgggcatttaaggcatgggcagtggcgcgactgtcgcagcgttttcctaaggcagaattcgcagaagtgtcaaaacttgtgactgatcttaccaaggtgcatactgaatgctgccatggcgatcttctggagtgtgctgatgaccgggcagatctggcaaaatacatttgcgagaatcaggactccatttcgagcaaactgaaggagtgttgcgaaaagccacttctcgaaaagagccattgcatcgcagaagtggaaaacgacgagatgcctgcagatctgccatcgcttgcagcggacttcgtggaatccaaggacgtgtgtaagaactacgctgaagcgaaagacgtgttcctgggaatgtttctgtacgagtacgcacgtcggcatcctgactactcagtcgtgctccttcttaggttggcaaagacctacgaaaccacccttgagaagtgttgtgctgcagcagatccccatgaatgttacgccaaggtgtttgatgagtttaaacccctcgtggaagaacctcagaacttgattaagcaaaactgcgagcttttcgaacagcttggagaatacaagtttcagaacgctctccttgtgcgttacactaagaaggtgccgcaagtgagcactccaactctcgtggaagtgtcgcgaaacctggggaaggtgggaagcaagtgttgtaagcatccagaagctaagagaatgccctgtgcggaggactacctctccgtggtgttgaatcaactttgtgtcctgcatgagaaaactcctgtctcagatcgtgtcactaagtgctgtaccgaatcacttgtgaacaggaggccttgtttttccgcactcgaagtcgatgagacttatgtgcctaaggaattcaatgcagaaactttcacttttcatgccgatatttgcaccctgtcagaaaaggaacggcaaatcaagaagcaaaccgcacttgtcgagctcgtgaagcacaagcctaaggccaccaaggagcagcttaaagcggtgatggacgactttgcagcttttgtggagaaatgctgcaaggcggacgataaggaaacttgtttcgcagaagagggtaagaaactggtggcagcaagccaagcagcactgggtctg

SEQ ID NO: 249332 - DNA, 2007 bp, Artificial Sequence
  Description of Artificial Sequence: Synthetic coding sequence
atgaaatgggtcagcttcatttcccttctttttctgttcagctctgcttactccggcagccttgataaaaggcatggcgagggcaccttcacctccgacgtgtcaagctacttggagggacaggcggccaaggagttcatagcatggctcgtgaaaggcaggcatggcgaaggaacgttcacttccgatgtgagtagctacttggagggacaggccgcaaaggagtttattgcctggctggtaaaaggaagggatgcgcacaagagcgaggttgcccaccgcttcaaggatctgggggaggaaaacttcaaagccctcgtcctcatcgccttcgcccagtatctgcagcagtgcccgtttgaggaccacgtaaagcttgtgaatgaggtaaccgagtttgccaagacctgcgttgccgacgagtcagcggaaaactgtgacaagagccttcatactctcttcggggacaaactctgtacagtggctaccctcagggaaacctacggggaaatggctgattgttgcgctaaacaggagcccgagcgcaatgaatgcttcctccaacataaagatgacaaccctaatctgccacggctcgtgcggcccgaggtggacgtaatgtgtactgctttccacgacaatgaagagacgtttctgaaaaaatatctgtacgagatagctagaagacacccatacttttacgccccagaactgctgtttttcgccaaacggtacaaggccgccttcaccgagtgttgtcaggctgccgataaggctgcgtgtttgttgcccaaacttgatgaactgcgcgatgagggtaaggcatcctctgctaaacagagactgaaatgtgccagtctgcagaaattcggcgaaagagccttcaaggcctgggccgtggctagactctcccaaaggttcccaaaggcagaattcgctgaggtgtcaaaactggtgacggacctgactaaggtgcataccgagtgctgccacggggacttgctcgaatgcgcagacgatcgcgccgacctggccaagtatatatgcgaaaatcaggactctatttcaagcaagctgaaggagtgttgtgaaaagcccctgttggagaagtcccactgcattgcggaagtggagaatgacgaaatgccagcggatctcccctcactggccgccgacttcgtggagtcaaaagacgtatgcaagaattacgctgaggcaaaggacgtgttcctgggtatgtttctgtatgagtacgcccgccggcaccctgactattctgtcgttctgctgctccgcctggcgaagacttacgagacaacattggagaaatgctgcgcagctgccgaccctcatgagtgctacgccaaggtcttcgacgaattcaaacctctggtcgaagagccgcaaaatttgattaagcagaattgcgagctgttcgagcagcttggcgagtacaaattccagaacgctctgctcgtgcgctacacgaaaaaggtgccgcaagtgtccactcccaccctggtagaagtgtcaaggaatttgggcaaggtagggtctaagtgctgtaagcatccggaggctaagcggatgccatgcgcggaggactacctgtccgttgtgctgaaccagttgtgtgtgcttcacgagaaaacccccgtaagtgaccgagtcactaaatgctgtaccgagtccctggtcaacaggcgcccatgcttttccgcgctggaggtggatgaaacatacgttcctaaagaatttaacgcggagactttcacctttcacgccgacatttgcacattgtcagaaaaggagagacaaattaaaaaacagaccgccttggttgagctggttaagcacaagccaaaagcaactaaggaacagctcaaggctgttatggatgacttcgccgccttcgtggagaaatgctgcaaggccgatgacaaggagacttgctttgctgaggaaggtaaaaaacttgtagccgcctcccaggcagcactggggctg

SEQ ID NO: 249333 - DNA, 2007 bp, Artificial Sequence
  Description of Artificial Sequence: Synthetic coding sequence
atgaaatgggtttctttcatctccctgctcttcttgttctcatctgcctactctggctcactggacaagagacacggcgaaggcacctttacttccgatgtcagctcttatctcgagggacaggctgcaaaggagttcatcgcctggcttgtgaagggccgtcacggagaaggcacttttacctccgacgtaagcagttatctcgagggacaggcagccaaggagttcatcgcctggctcgttaagggccgcgatgcccacaagagtgaggtcgcccatcgctttaaggacctcggtgaagagaattttaaagcacttgtactgatcgcatttgcccaatacctgcagcagtgcccatttgaggatcacgtgaagctggtcaacgaagtgactgaattcgccaagacatgcgtggctgatgaaagtgccgaaaattgcgataagagcctccataccctgtttggtgataagctgtgcacagtcgccacccttcgtgagacctatggcgaaatggccgattgctgtgccaagcaggagcccgagagaaacgagtgtttcttgcagcataaggacgacaaccccaatctgccccgccttgtccgccccgaggtggatgtgatgtgcaccgcttttcacgataacgaagagacctttctcaagaagtacctctatgagatcgcccgcaggcacccatacttttacgctcccgagttgctgtttttcgctaagcgctataaggccgctttcaccgagtgttgtcaagctgctgacaaggccgcatgcctcctgcctaagcttgacgagctgagggacgagggaaaggcttcatcagcaaagcagcgcctgaagtgtgcatctctgcaaaagttcggagagagggcattcaaggcatgggctgtggctcgcctttctcaaaggttcccaaaagctgagttcgccgaggtgtctaagctggttaccgatctcactaaagtgcacacagagtgctgccatggagatctgctcgagtgtgccgacgacagggcagatcttgctaagtatatatgtgagaatcaagattctatatcctccaaactcaaggagtgctgcgaaaaacccctgttggagaagtctcactgtatagccgaggttgagaacgacgagatgccagctgacctgccaagcctggctgctgactttgtggagtccaaggatgtctgtaagaactacgcagaagccaaggatgttttcctgggtatgttcctgtacgagtatgctaggaggcaccccgattattccgtggtgctcttgctgaggctggcaaaaacatatgagaccaccctcgagaagtgttgcgctgcagcagatccacatgaatgctatgccaaggtattcgatgagttcaaacctctggtcgaagagccacagaacctcatcaagcagaactgcgaactcttcgaacagcttggtgagtacaagttccagaatgctttgttggtcaggtatactaaaaaggtgccccaggtgagtactcctaccttggtggaggtgtcaagaaaccttggaaaggtgggcagtaaatgttgcaagcatccagaagctaagcgcatgccttgtgcagaggattatctcagcgtcgtgttgaaccagttgtgcgtgcttcatgagaagacaccagtaagtgatagggtgaccaagtgctgcaccgagtcattggttaacagacgcccttgtttctccgctttggaagtagacgaaacctacgtccctaaagaattcaacgctgagaccttcactttccacgccgatatttgcactctgtctgagaaggagaggcagattaaaaagcaaacagcactggtcgagcttgtcaaacataaacccaaggctaccaaagaacagctcaaggcagttatggatgacttcgctgccttcgtggagaagtgctgcaaagctgacgacaaagagacatgcttcgccgaggaaggcaagaagctggtggccgcaagccaggctgctctgggtttg

SEQ ID NO: 249334 - DNA, 2007 bp, Artificial Sequence
  Description of Artificial Sequence: Synthetic coding sequence
atgaaatgggtatcgtttatcagccttctttttctgtttagctccgcatattcgggctcgctggacaagcgtcatggagaagggacctttacctcggatgtgtcgtcgtacctcgaaggccaagcagctaaggagtttattgcttggcttgtgaaaggccgccatggggagggaacttttacgtcagatgtctcgtcttaccttgagggacaagctgcaaaggagttcatcgcatggctggtgaagggtagagatgcacataagagcgaggtggcgcaccggtttaaggaccttggagaggaaaacttcaaggcccttgttctgatcgcattcgcccagtacctgcagcagtgtcctttcgaagatcatgtcaagctggtgaatgaagtgacggagttcgcgaaaacctgcgtcgccgacgaaagcgcggaaaactgtgataagtcccttcatactctttttggtgataaactttgtactgtggcgaccctgcgcgagacttacggtgaaatggcagactgctgcgctaaacaagaacctgaaaggaatgaatgtttccttcagcataaggacgacaatcctaaccttccccgactggtgcggcctgaagtggacgtgatgtgtactgcgttccacgataacgaggagactttccttaagaagtacctgtacgagatcgcacgtaggcatccctacttttacgctccggagctcctgtttttcgccaaaagatacaaggcagcattcactgagtgttgtcaggccgcagacaaagcagcatgtctgctgccaaagctggatgagctccgggatgaagggaaggcctccagcgcaaaacaacgccttaagtgtgcaagcctgcaaaagtttggtgagagagcatttaaggcatgggccgtcgcgcgtctgtcccagcgattccccaaagcagaattcgcagaggtgtcaaaactggtgactgatctcaccaaagtccataccgaatgttgccatggtgacctgcttgaatgtgcagatgaccgagccgaccttgcaaagtacatctgcgaaaaccaagattcgatttcgagcaaacttaaggagtgctgtgaaaaaccgctgttggaaaagtcccactgtattgccgaggtggaaaacgacgaaatgcctgcagatctcccgtcacttgcagctgattttgtggaatcgaaagatgtgtgtaagaattacgcagaggccaaggacgtgttcctcggcatgttcctgtacgaatatgcgaggcgccatccagattactcagtggtgcttctcctcagacttgcaaaaacctacgaaaccacccttgaaaagtgctgcgccgcagccgatcctcacgaatgttacgcaaaggtgtttgacgagtttaagccgcttgtggaggaaccccaaaacctcatcaaacagaattgtgagctttttgaacagctgggagaatacaagtttcagaacgccctccttgtcagatacactaaaaaggtgccacaggtgtcaaccccaactctggtagaggtgagtaggaatcttggaaaggtgggatccaagtgttgtaaacaccctgaagccaaaaggatgccatgtgcagaagattacctttccgtcgtcctgaaccaactctgtgtgctgcatgaaaagacgccagtcagcgatagagttaccaaatgttgcactgagagcttggtgaaccgacggccttgtttttccgcacttgaggtggatgagacgtacgtgcccaaagaattcaatgcagagactttcacttttcacgccgacatctgtaccctctccgagaaggagcgacagatcaaaaaacagactgcgctggtggagctggtgaagcataagcccaaggcaaccaaagagcagcttaaagcagttatggatgattttgcggcattcgtggagaaatgctgtaaggcagatgataaggaaacgtgttttgcagaggaagggaaaaaactggtcgctgcctcccaggctgcactgggactc

SEQ ID NO: 249335 - DNA, 2007 bp, Artificial Sequence
  Description of Artificial Sequence: Synthetic coding sequence
atgaagtgggtgtccttcataagtctcctcttccttttctccagcgcgtatagtgggtcactcgataagcgccacggcgaaggcacattcacctccgatgtgtcaagttacctggaaggtcaggccgctaaggaattcatcgcttggctagtgaaggggcgacacggggaagggacatttacctcagatgtgtcatcctatctggaaggccaggctgctaaggaattcatagcgtggttagtcaaaggtcgggatgcccataagagcgaagtggcacataggttcaaggacctcggcgaggagaatttcaaggctctagttcttatagccttcgctcagtacttgcagcagtgtccatttgaggatcacgtcaagctggtgaacgaagtaaccgaatttgctaaaacctgcgtggccgacgagagtgccgagaactgcgataaatcccttcacaccttgtttggagataaattgtgcaccgtggccacactccgcgaaacctacggagaaatggccgactgctgcgcaaaacaggaaccagaaagaaatgagtgcttcctccaacacaaagatgataatccaaacctgccacgtctggtcaggcccgaggttgacgttatgtgcacagctttccatgataatgaggagacttttctaaagaagtatctctacgagatcgcaaggcgccacccctatttctatgcccccgagcttctcttctttgcaaagaggtataaggccgccttcaccgagtgctgccaagccgccgataaggccgcttgcctgctcccgaaactagacgaattacgcgatgagggtaaagcatcgtctgccaagcaacggctgaaatgtgcctcactccagaaattcggggagcgcgcgttcaaagcatgggccgtcgcgcggctgagtcagcgattcccaaaagcagagttcgcggaggtaagcaagctggtaaccgatttgactaaggttcacacggagtgttgccatggggatctactggaatgtgctgacgatagggccgacttggccaagtacatctgcgaaaatcaggacagtatctcctctaaactcaaagagtgttgtgaaaagcctctgcttgagaagtcccactgcatagccgaagtcgagaatgatgaaatgcctgcagatctgcctagtctggctgcggactttgtcgagtctaaggatgtctgtaaaaactacgccgaggcaaaggacgtgttcctgggaatgttcctttatgagtacgctcggcgacaccccgattactccgtcgtcctccttctgaggcttgccaagacttatgaaactaccctggaaaagtgttgcgccgcggctgatcctcacgaatgttacgccaaggtgtttgacgagttcaagcctctcgtggaggaaccccaaaatctgattaagcaaaactgtgaattgttcgagcaactgggggaatataagtttcaaaatgctttgctggttagatataccaagaaggtgccccaggtcagtacccctaccctggttgaagtctctaggaatctgggaaaggtgggatctaagtgttgcaagcaccccgaggcgaagaggatgccatgcgcggaggattacctctctgtggttctcaaccagttgtgcgttctgcacgagaagaccccggtctccgatcgggtgacaaaatgttgtaccgagagcttggtcaaccgcaggccctgcttctccgcgctggaggtggacgagacttatgtgcctaaggagttcaatgcggaaacattcacatttcatgctgacatttgcactctgtctgaaaaagaacgccagatcaaaaagcagacagcactcgtggagcttgtcaagcacaagcctaaggcgacgaaggagcaactaaaagcggtgatggacgactttgcagcctttgttgagaagtgctgtaaagctgacgacaaggagacctgcttcgccgaggaaggtaaaaaactagtagcggccagccaggccgccctcggccta

SEQ ID NO: 249336 - DNA, 2007 bp, Artificial Sequence
  Description of Artificial Sequence: Synthetic coding sequence
atgaagtgggtttccttcatatctctgctcttcctgttctcgagcgcctactccgggtccctggacaagaggcacggagaaggcacctttacctccgatgtgtccagctaccttgaaggacaggcggcgaaggaattcattgcgtggttggtcaagggtagacatggtgagggcacgtttacttcggacgtctcaagctacctggaggggcaggccgcaaaagagttcatcgcttggctcgtgaaaggacgcgacgcacataagtcagaggtggcgcacaggttcaaggacctgggtgaagaaaactttaaggctctcgtgctcatcgccttcgcgcaatacttgcagcaatgcccattcgaagatcatgtgaagctggtcaatgaagtcaccgagtttgccaagacttgcgtcgccgatgaatcagccgagaactgtgataagtccctgcacaccctgttcggcgataagctgtgcactgtggcaacgctgcgggagacttacggagagatggcggactgctgtgctaagcaggaaccagagcggaacgagtgctttctccagcacaaggatgataatccgaacctcccccggttggtgcggccagaggttgacgtcatgtgcacggccttccacgacaacgaggaaactttcctgaagaagtacctctacgaaatcgcgagacgccacccttacttttacgctccggaacttctcttcttcgcgaaacgctacaaggccgcgttcactgaatgctgtcaggccgcagataaagccgcatgcctgttgcctaagctcgatgaactgcgggatgaaggaaaggcttcctcggcgaagcaaaggcttaagtgcgcgagcctgcagaagttcggagaaagggcgttcaaggcctgggcagtggccagactgagccagcggttccccaaagcggaattcgccgaagtctctaagctcgtcactgatctgaccaaggtccatactgaatgttgccacggggacctcctggagtgtgccgacgacagagccgatctggccaagtacatctgcgaaaatcaagactctatcagttcaaagctgaaagagtgctgcgagaagcctctgctcgagaaaagccactgcatcgcggaagtcgagaatgatgagatgcctgctgatcttccgtcgctcgccgccgattttgtggaatcgaaagacgtgtgcaagaactacgcggaggccaaggatgtctttctgggcatgttcctgtacgagtacgccagaaggcatccagattactcggtggtgctcctcctgcgcctggcgaaaacctatgagactaccctggagaagtgctgtgccgccgcagatccgcatgagtgctatgcgaaggtgtttgacgagtttaagccgcttgtcgaagaaccgcagaacctcattaaacaaaattgcgaactcttcgaacagctgggcgaatacaagttccagaacgccctgctggtgcgatatactaagaaggtacctcaggtgtcgaccccgaccctcgtcgaagtgtcccggaacctgggaaaagtgggctccaagtgctgcaagcatccagaggcgaaacgcatgccgtgcgccgaggactacctgagcgtggtgctgaaccagctctgtgtgctccacgaaaaaactccggtgagcgaccgcgtgacgaaatgctgcactgagtcgctcgtaaacagacgtccctgtttctccgcccttgaagttgacgagacttacgtgccgaaggagttcaatgccgagactttcacctttcatgccgatatctgcactctgagcgaaaaggaaaggcagattaagaaacagactgcgctggtcgaactggtgaagcacaaaccgaaagccactaaggagcaactcaaagccgtgatggacgacttcgccgccttcgttgagaagtgttgcaaggctgacgataaagagacgtgctttgcggaagaaggcaaaaagctggtggctgcctctcaagccgcacttgggctt

SEQ ID NO: 249337 - DNA, 2007 bp, Artificial Sequence
  Description of Artificial Sequence: Synthetic coding sequence
atgaagtgggtttcattcatctcactcctcttcctcttctcttcggcgtacagcgggagcttggacaagagacacggagaaggaactttcacttcagatgtgtcctcgtacctggagggccaagcggctaaagaattcatcgcatggttggttaagggtcgccatggtgagggaactttcacgtccgacgtctcctcgtacctcgaaggccaagccgcgaaggaattcatcgcctggttggtgaagggccgggacgcccataagagcgaggtcgcgcaccggttcaaagatttgggagaagagaacttcaaagccctggtcctcatcgcattcgcccagtacctgcaacagtgcccctttgaagatcatgtaaaactggtgaacgaggtgaccgaatttgctaagacctgcgtggccgatgaatccgctgagaactgtgataagtcgctccacacccttttcggcgacaagctgtgcaccgtggcgaccctccgtgaaacctatggagagatggctgactgctgcgcaaagcaggagcccgaacgcaacgagtgttttctccagcacaaggacgacaatccgaatctccctcgactggtccgccctgaagtcgacgtgatgtgtaccgcgttccatgataacgaagaaacctttctgaagaaatacctctacgaaatcgcccggaggcacccgtacttttacgcgccggaacttctgttctttgctaagcgatataaggcggccttcaccgaatgctgccaagccgccgataaggccgcatgtctcctcccgaagttggacgagttgcgggacgaggggaaggcctcgtcagcgaagcagcggctgaagtgcgcctcgctccagaaatttggagagcgcgcgttcaaggcctgggccgtcgcccgcctctcccaaagattcccaaaggccgaattcgccgaagtttcgaagttggtcacggacctcactaaagtgcacaccgagtgctgtcacggtgatctgctggaatgcgcggatgaccgcgctgacctcgccaagtacatctgcgaaaaccaagactctatctcgtcaaagctcaaggaatgttgcgaaaagccactcctggagaaatcgcactgcatcgcagaggtggaaaacgatgaaatgcccgccgatctcccatccctggcagcggatttcgtggaaagcaaggacgtgtgcaagaattacgcagaggcaaaggacgtgttcctcggaatgttcctgtacgaatacgctcggcgccacccagactactcagtagtcctgctgctgcggctggctaaaacctacgaaactacccttgagaagtgttgcgcggcagctgacccacacgaatgctacgctaaggtgtttgatgagtttaagccactcgtcgaggagccccaaaatctgatcaagcaaaattgcgagctgtttgaacagctgggggaatacaagtttcagaatgcgctgctggtgaggtacaccaagaaggtgccgcaggtgtcaaccccaaccctggtggaagtgtctcggaacctgggaaaggtgggaagcaaatgctgtaaacacccagaagccaagcgcatgccctgcgccgaagattatctgtccgtggtcttgaaccagctgtgcgtgcttcacgagaaaactccggtgtccgaccgggtcaccaagtgttgcactgagagtctggtgaaccgccgcccttgcttctcagcgctggaagtcgatgaaacctacgtccccaaggagttcaacgcagagactttcaccttccatgccgatatatgcaccctgtcggagaaagagcggcagatcaaaaagcagactgcactggtcgaactggtcaagcataagcccaaggccacgaaggaacaactgaaggccgtgatggatgactttgcagctttcgtcgagaaatgctgtaaggcggatgacaaagaaacctgttttgcggaggaaggtaagaagctcgtggcggcctcacaagcagcactgggactt

SEQ ID NO: 249338 - DNA, 2007 bp, Artificial Sequence
  Description of Artificial Sequence: Synthetic coding sequence
atgaaatgggtctcctttataagtctgcttttcctgttttcgagtgcttattccggaagtctggataagaggcatggcgaggggactttcactagtgacgttagttcctatctggaggggcaagccgcgaaagaattcatcgcttggctcgttaaaggcaggcacggcgagggcacgtttacctccgacgtttcttcatacctggaggggcaagccgcaaaagaatttattgcctggttggtcaagggacgcgacgctcataagagcgaggttgcccacaggtttaaggatctgggtgaggagaacttcaaggccctcgtgcttatcgcatttgcgcagtacctgcagcagtgcccctttgaggatcacgttaaacttgtgaacgaggtcaccgaatttgctaagacgtgcgttgccgatgagagtgcggagaattgcgataaatccctgcacaccctgtttggtgacaagctatgcaccgtagccacgctgcgcgaaacctacggcgaaatggccgactgttgtgctaaacaggaacctgagaggaacgaatgctttctgcagcacaaggacgataatcctaatctccccagactggtgaggccagaagtggacgtaatgtgtaccgccttccacgacaacgaagaaactttcctgaagaaatacttgtacgagattgcgagacgccacccgtacttttacgcccctgaacttctattctttgcaaaaaggtacaaggcagccttcaccgaatgctgtcaggcagccgacaaagccgcttgcctgctgccaaagctggatgagttgcgagacgaagggaaggcaagcagtgccaagcagaggttaaagtgcgcctcattgcagaagttcggggagcgggctttcaaagcttgggccgtggctcggctgagccagcggtttccaaaggccgagttcgccgaggtgtcgaagttggtcactgacttgactaaagtgcacaccgaatgctgccatggggaccttcttgagtgtgctgacgaccgagctgatcttgccaagtacatctgtgagaaccaagattccatatccagcaagttgaaggaatgttgtgaaaagcccctgctggagaagtctcactgcattgcggaggtggagaatgatgaaatgccggcagatctaccatctctggccgcagacttcgttgaaagtaaggacgtttgcaagaattatgcagaggccaaagacgtcttcctgggtatgtttctgtacgaatatgcccgtaggcatccagattattcagtcgtgctgctattgagactggcaaagacctatgagaccaccctcgagaaatgctgtgcagcagctgatccgcacgaatgctacgcaaaagtctttgatgagtttaaaccactggtagaggagcctcagaatctcattaagcaaaactgcgagctgttcgagcagctcggcgagtacaagttccagaacgccttgttagtgagatacaccaagaaagtcccacaggtgtctacccccactttggttgaggtatctagaaatctaggaaaggtggggtctaagtgttgcaagcatccagaagcaaagagaatgccctgcgccgaggactatctgtctgtggtgctgaatcaactttgcgtgcttcacgagaaaacgcccgttagcgatcgtgtgactaagtgctgcacggagtctctcgtgaatagacggccttgtttcagtgcactcgaagtcgatgaaacatatgtgcctaaggaattcaatgcagaaacctttaccttccacgcggacatctgcaccttgagtgaaaaagagcggcaaattaagaagcagacagccctggtggaactggtgaagcacaagcccaaggcaacaaaggagcagcttaaagccgttatggatgatttcgccgcattcgtggagaaatgctgtaaagccgatgacaaggagacttgttttgccgaggaggggaagaagctcgtcgcagcgtcacaggcggcactggggctc

SEQ ID NO: 249339 - DNA, 2007 bp, Artificial Sequence
  Description of Artificial Sequence: Synthetic coding sequence
atgaagtgggtgagctttatatctctattgtttctgttcagtagtgcctacagcggttcattggataaacggcatggcgagggaacatttacttcggatgtctcctcctaccttgagggccaggcggctaaggaatttattgcttggcttgttaaaggtcggcacggagagggcacctttacatctgatgtttcatcatatctggaaggccaggcggccaaggagtttatcgcatggttggtaaagggacgggatgcgcataaatctgaagttgctcataggtttaaagatctcggtgaggagaatttcaaagccctggttctcatcgccttcgcccagtacctacagcagtgtcccttcgaagaccacgtcaagttggtcaacgaagtgactgagtttgctaaaacctgcgtcgcggacgagagcgctgagaactgcgataaaagtctgcacactctgtttggagacaaactgtgtaccgtagccacactgagagagacctatggagagatggccgattgttgtgctaagcaagagcccgaaaggaacgaatgcttccttcagcacaaagacgacaacccaaacctgcctaggcttgttcgcccagaggtggacgttatgtgtacagccttccacgataatgaagagaccttcctcaaaaagtacctttacgaaatagcacgacggcacccgtacttttacgctcccgagctgctgttctttgctaagaggtacaaggccgcatttaccgagtgttgccaggccgctgataaagctgcctgcttactgccaaaactcgacgagttgcgggacgagggcaaggctagcagtgcaaagcagcgcctgaagtgcgcttccctccagaagttcggggagagagcctttaaggcctgggcagtggctcggctcagtcagaggtttccaaaagcagaattcgctgaagtaagtaaactagtaacagacctcaccaaagttcatacagagtgttgtcacggcgatttgctggaatgtgcagatgacagagccgacttggctaagtatatctgtgagaatcaagattccattagtagcaagttgaaagagtgttgcgaaaaacctctgttggaaaagagccactgcatagccgaggtggagaacgatgaaatgcctgcggatctacccagcctagccgccgattttgtggaatccaaagacgtttgtaagaattacgccgaagccaaggacgttttcctgggtatgttcctctatgaatatgccagaaggcatccggattatagcgtggtgctgcttctccgccttgcgaaaacgtacgagacgacccttgaaaaatgctgtgctgctgctgatccacacgaatgttacgccaaagtcttcgacgagtttaagcctctcgtggaagagccccagaaccttatcaaacagaactgcgaactattcgaacaactgggagagtataaattccaaaatgccctcctggtccgatacactaagaaggtaccacaagtaagcactcctacgctggtggaagtctcccgcaacctgggcaaggttggctctaagtgctgcaagcatccagaagcaaagcgaatgccctgtgccgaggactacctgagtgtggtgctgaaccagttatgcgtgctccacgaaaagacgccagtttcagacagagtgactaaatgctgtactgagtcacttgtaaatcggcggccctgtttttcagccctggaggtcgacgaaacatacgtaccgaaggagtttaatgctgagacgttcacctttcacgcggatatctgcactctcagcgaaaaggagcggcagatcaaaaagcaaactgccctggtggaacttgtcaaacataagcccaaggctaccaaagagcagctgaaagccgtaatggatgactttgcagcctttgtggagaaatgctgcaaggcagacgacaaggagacctgtttcgccgaggaagggaaaaagcttgtcgctgcctcacaagccgctcttggatta

SEQ ID NO: 249340 - DNA, 2007 bp, Artificial Sequence
  Description of Artificial Sequence: Synthetic coding sequence
atgaagtgggtcagcttcatttctttgcttttccttttcagctctgcatatagtggaagcttggacaaaaggcacggagagggaacatttacctcagatgtttcttcttacctagaagggcaagcggccaaggaattcatcgcctggcttgtaaaaggaaggcacggggagggtacgttcacttccgacgtttcctcctatttggagggtcaggccgctaaagaatttatagcgtggctggtaaaaggaagagacgcgcacaagtcagaagtggcccacagatttaaagatttgggtgaggaaaattttaaggcactggtgctcatcgcctttgctcagtacctccagcaatgtcctttcgaagaccacgtgaaacttgtcaatgaggtgaccgaatttgcaaaaacgtgcgtcgctgacgagagcgcggagaactgcgacaagagcctgcatacactgttcggagataaattatgcaccgttgcgacacttcgcgaaacgtacggggaaatggctgactgttgcgccaagcaggaacctgagcgtaatgaatgctttttgcagcataaggacgacaaccccaacctgcctaggctagtacggcccgaggtggatgtgatgtgtactgcattccacgacaacgaggagacattcctgaaaaaatacctctatgagatcgcaagacgtcatccttacttctacgcccctgaacttctgtttttcgccaaaagatacaaagcggccttcacagagtgttgtcaggctgccgacaaggcagcctgcctccttcccaagcttgacgagctgcgagacgaagggaaagctagctctgccaagcagcgtctgaagtgcgcttcactccagaagtttggagaacgcgcttttaaagcgtgggcagtcgcaagactgtcccagcggtttcccaaagcagaatttgccgaagtgagtaaactggttactgacctcaccaaggttcatacggagtgttgtcacggtgacctcctcgaatgtgcggacgatagggcagatttggcgaagtacatctgcgagaaccaggactcgatttcaagcaaattgaaagagtgctgcgagaaaccacttctcgagaaatcacactgcatcgctgaagtggagaatgacgagatgcccgccgatctgcccagcttggccgccgacttcgtagaatccaaagacgtctgtaaaaactatgccgaggctaaagacgtgtttttagggatgtttctgtatgagtacgcccgcagacacccagattactcagtggttttgttgctgagactcgcaaaaacctacgagactaccctcgaaaagtgctgtgccgccgctgatcctcatgaatgttatgctaaggtcttcgacgagtttaagccgcttgtcgaagaaccccagaatttgatcaagcagaactgcgagctatttgaacagctgggcgagtataagttccagaacgcccttctcgtgcggtatacgaaaaaagtcccacaggtgtcaacgccgactctagtcgaagtgtcacggaacctggggaaggtgggtagtaaatgctgcaagcaccccgaagccaagaggatgccttgtgcagaggactacctgtccgtggtacttaaccagttgtgcgtgctccacgagaaaactcccgtctcagatcgggtgaccaagtgttgtacggaatctttagtcaaccgccgcccctgtttttccgctctggaagtagacgaaacctatgttccaaaagaatttaacgcagagacctttacctttcacgctgacatatgtacccttagcgagaaagaacgtcagattaagaagcagaccgctctggtggaactggtcaaacacaaacctaaggctacaaaggagcaactgaaagcggttatggatgattttgccgctttcgtggagaagtgttgtaaagctgacgataaggaaacgtgctttgccgaagagggcaagaaactagtggccgcgagccaagcagccctcgggtta

SEQ ID NO: 249341 - DNA, 2007 bp, Artificial Sequence
  Description of Artificial Sequence: Synthetic coding sequence
atgaaatgggtgtcttttatttcactattatttctgttttcatccgcctatagtggcagtctcgacaaaagacacggagagggaacgttcacttctgacgtgtcttcatacctggagggtcaagcggccaaggaattcatagcttggctggttaagggtcggcacggcgaagggacatttaccagtgacgtcagcagctatttggaaggccaggcagccaaggagtttatcgcctggctggtgaagggccgggacgcccacaagagtgaagtggcccaccggtttaaagacctcggtgaggagaactttaaagccctggtccttatagcgttcgctcagtacttgcaacagtgcccatttgaggaccacgtcaagctggttaatgaggtgacagaatttgctaaaacctgtgtggctgatgagagcgcagagaactgtgataagtcattgcatacgctttttggcgacaagctgtgtacagtggccacattaagggagacgtacggggagatggcggattgctgtgctaaacaggagcctgaacgtaacgagtgctttctccagcataaagatgacaatccaaatctgccccgcttggttaggccagaagtagacgtaatgtgtacagcttttcatgataacgaggagacctttttaaagaagtatctgtacgagattgcgcgtcggcatccgtacttctacgcccctgaactgttatttttcgcaaagagatacaaggctgcctttactgaatgctgccaggccgcagacaaggccgcctgcctgttacccaaattagatgaacttagggatgagggcaaagcctcctcagccaagcagcgcttaaaatgcgcatcattgcagaagtttggcgaaagagcctttaaagcttgggcagtcgctagactaagccagaggtttcccaaagcagaattcgccgaggtgagcaaactcgtcaccgacctgacaaaagtccatacggagtgctgccacggcgatctgctggaatgcgccgacgaccgcgcagacttagcaaaatatatatgtgaaaaccaggactccatctcaagtaaacttaaggagtgctgtgagaaaccactgctcgagaaatcccattgtatcgcagaagtcgagaatgatgaaatgcccgcagacttgccttctctcgccgccgacttcgtagaatcaaaagacgtgtgcaagaattatgctgaagccaaagacgtgtttttaggaatgttcctctatgaatatgcacgccgccatccagactattcagtggtattgctgctgaggctcgccaagacctacgaaaccacactggaaaagtgttgcgccgcagctgacccccacgagtgctacgcaaaagtgttcgacgaatttaagccactggtggaagagccccagaatctcataaaacagaattgcgagctgtttgaacagctgggggagtacaagtttcagaatgctttgctggtacgctacactaaaaaggttccacaggtttctacgccaaccctggttgaggtcagccgtaatctgggaaaagtggggagcaaatgctgcaagcacccagaggcaaagaggatgccctgcgcagaggattatctgtctgtagttctgaaccagctgtgcgtgttgcacgaaaagacacccgtttccgaccgcgtcaccaagtgttgtacggaaagcctggttaatcggcggccatgctttagcgcccttgaagtagatgagacctacgtgcccaaggaattcaacgcagagacatttacattccatgcggatatatgcaccctatccgagaaagaaaggcaaatcaagaagcagacagctttggtcgagttggtgaagcacaagcccaaggccacgaaggagcagttaaaagccgtgatggacgatttcgccgccttcgttgagaagtgttgtaaggctgacgacaaggaaacatgtttcgctgaggaagggaagaagctcgtggcggcttcccaggctgctttgggcctg

SEQ ID NO: 249342 - DNA, 2007 bp, Artificial Sequence
  Description of Artificial Sequence: Synthetic coding sequence
atgaagtgggtgagcttcatttcactgctgttcctcttttcctccgcctactcaggatcactggacaagcgccacggagagggtacctttacgtcggatgtctcgagctacctcgagggacaagccgccaaggaatttatcgcctggctggtgaagggccgacatggagagggaaccttcacctccgatgtttcgtcgtatctggaaggtcaagcagctaaggaattcatcgcgtggcttgtcaagggacgggatgctcataaatccgaagtcgcccatagattcaaagacctcggagaggaaaatttcaaggcacttgtgctgatcgccttcgcgcagtacttgcagcagtgtccgttcgaggaccacgtgaaactcgtcaatgaagtgaccgaattcgcgaaaacttgcgtcgccgatgaatcagccgagaattgcgacaagtccctccacaccctgttcggcgacaagctctgtactgtcgcgacccttcgcgaaacttatggtgagatggccgattgctgcgccaaacaagaaccggagcgcaacgagtgcttcctgcagcataaggacgacaaccctaacttgcctagactggtgcggcccgaggtcgatgtcatgtgtaccgcctttcatgataacgaagaaacgttcctgaagaagtacctgtacgaaatcgccagacgccacccgtacttctacgcgcctgaattgctgtttttcgccaagaggtacaaggctgcattcaccgagtgctgccaagcggcggataaggcggcatgtctcctgccgaagttggacgagttgcgggacgaggggaaggccagctcggctaagcagaggctgaagtgcgcatccctccagaaattcggggagagggcatttaaggcttgggcggtggcgcggctctcgcaacgcttcccaaaggcagaatttgcggaagtgtccaagctggtgaccgacctgacgaaggtgcacacggaatgctgccacggggacctcttggaatgcgcagacgaccgggctgatcttgcaaagtacatctgcgagaaccaggatagtatttcatcaaaactgaaagagtgctgcgagaagcccctgctggaaaaatcccactgcatcgccgaagtcgaaaacgatgaaatgccagcagacctcccatcgctcgccgccgactttgtcgaaagcaaggacgtgtgtaagaactacgcggaggccaaggatgtgttcctgggcatgttcctttacgagtacgcgcggagacacccggactacagcgtggtgctcctgctgagactggctaaaacttacgaaaccactctggagaagtgctgcgccgctgcggacccgcatgagtgctacgccaaggtgttcgatgagttcaagccgctggtggaggaaccgcaaaacctgatcaaacaaaactgcgagctgtttgaacagctcggagaatacaagtttcaaaacgcactcctggtccgctataccaagaaagtccctcaggtgagcaccccgaccttggtggaggttagccgcaatctcggaaaagttggcagcaagtgttgtaaacacccagaagcgaagcggatgccatgcgccgaggattacctgtctgtggtgctgaatcagctttgcgtgctccacgaaaaaactcccgtctccgatcgcgtcactaagtgttgcactgaatcgctggtgaatcgccgtccatgcttctcggccctggaggtggacgagacttacgtgccgaaagaatttaacgcagaaactttcaccttccacgcggacatctgtactttgtcagagaaagagcggcagatcaagaagcagactgccctcgtggaactggtgaaacataagcctaaggctaccaaggagcagctgaaggctgtgatggacgacttcgccgccttcgtggaaaaatgctgcaaggccgatgacaaggaaacttgtttcgccgaagaaggcaaaaagctcgtagcagcttcgcaggcagctctgggactt

SEQ ID NO: 249343 - DNA, 2007 bp, Artificial Sequence
  Description of Artificial Sequence: Synthetic coding sequence
atgaaatgggtgagctttatctcgctccttttcctgttttccagcgcatatagtggctctctggataagcgtcacggggagggcactttcactagtgacgtgtctagttacctagaaggacaagcagctaaggaatttattgcatggctggtgaagggtagacatggtgagggcactttcacctccgacgtgtcaagctacctcgaggggcaagcagccaaggagttcatagcttggttggtaaaaggaagggacgcacataaatcagaagtggcccatagattcaaagacctgggagaggagaattttaaggccttagtgctgatcgcttttgctcagtacctgcaacagtgtccgtttgaggaccacgtaaaactcgtgaacgaagttaccgagttcgcaaagacatgtgtggctgacgagagcgccgagaattgtgataaatcgttacacacactgttcggtgacaagctgtgtacggttgccacactccgggagacttatggcgagatggccgactgctgcgcaaaacaggagcccgagcggaacgagtgctttctccagcataaggacgacaaccctaacctgcctcggctagttaggcctgaggtggatgtcatgtgtacagccttccacgataatgaggaaacattcctcaagaagtacctgtacgagatcgcgcggcggcatccctacttttatgccccagagctgctgttcttcgctaaacggtataaagccgcattcacagagtgttgtcaagccgctgataaagccgcttgcctcctgccaaagctggatgaactgcgggatgaaggaaaggcctccagcgctaagcagcgactgaagtgcgctagtctgcaaaagtttggggaaagagcgttcaaggcctgggccgtggctagactgtcccagcgtttcccgaaagccgagtttgcagaggtctcaaagctggtaactgacctgactaaagtccacacagagtgttgtcacggggatctgttggaatgtgccgatgatcgcgcagacctcgccaagtacatttgcgagaaccaggattcaattagttccaaactcaaagaatgctgcgagaagccacttctcgagaagagccattgtatcgccgaggtggagaatgacgagatgcccgccgatctgccttcattggctgctgacttcgttgagtcaaaggacgtctgcaagaactatgcagaggccaaagatgtgtttctgggcatgtttctgtatgaatacgcccgccgccacccagactactccgtcgtcctgttgctgcggcttgccaagacttatgaaaccaccttggagaagtgctgcgccgccgctgatccccacgagtgttacgcaaaagtgttcgacgaattcaagcctctggtggaagagcctcagaacctaattaagcagaactgtgaactgtttgaacagcttggcgaatacaaatttcagaacgccctgcttgttaggtacactaaaaaagtgccccaggtgtccacccccaccctggtcgaggtgtcacggaacctgggaaaggtggggtccaagtgctgtaagcaccctgaggctaagaggatgccgtgtgcagaggattacttgtcagtggtgctgaaccagctgtgcgtgctgcatgaaaagacaccagtgtccgatcgcgtcactaaatgttgcactgaatccctggtcaaccgacggccttgcttcagtgccctggaagtggatgagacctatgtgcccaaggagtttaatgccgaaacatttacctttcacgcagacatttgcaccttgagtgaaaaggagaggcagatcaaaaagcaaacagctctcgttgagcttgtgaagcacaagcctaaagccactaaggaacaattgaaggccgtcatggatgattttgccgctttcgtggagaagtgctgcaaggcagacgacaaagaaacgtgttttgccgaagaggggaagaaactcgtcgcggcctcccaggccgcgttggggctt

SEQ ID NO: 249344 - DNA, 2007 bp, Artificial Sequence
  Description of Artificial Sequence: Synthetic coding sequence
atgaaatgggtctctttcatttcgcttctatttctcttttcatctgcatatagtggatccctcgataagaggcatggggaaggaacatttactagtgacgtcagttcctatctggaaggacaggctgctaaagagttcatcgcatggctcgtaaagggacgccatggagaagggactttcacaagtgatgtgtcctcatacctggaaggacaggcagccaaagaatttatagcctggcttgtgaaaggaagagatgcacataaatccgaagttgctcacagatttaaagatttaggagaagaaaattttaaagcccttgttctcattgcctttgctcagtatctccagcagtgcccctttgaagaccatgtcaagcttgtgaacgaagtgactgaattcgcaaaaacttgtgtggccgatgaatcagcagaaaattgcgacaaatccctccatacactattcggggataaactgtgtactgtggcaactcttagggaaacatatggggaaatggccgattgctgtgccaagcaggaaccagaacgcaatgaatgttttttacagcataaagatgataatcctaacctaccgaggctggttcgacccgaagttgacgtcatgtgcacagctttccacgataacgaagagactttccttaaaaaatacttgtatgagattgccaggagacatccttatttctacgcccctgaactcctctttttcgctaaacgctataaagctgctttcactgaatgttgtcaggcagccgataaagctgcgtgtctcttgcctaaactcgatgaactacgggatgaaggaaaagcctcctcagcaaagcagcggctcaaatgcgcatctctgcagaaatttggggaacgcgcctttaaggcttgggctgtcgctagactctctcagcggttcccaaaagcagaatttgctgaagtgtcaaaactagtgacagatctaactaaggtgcacactgaatgttgtcacggagatctgctggaatgcgcagatgatagagcagatcttgctaaatacatatgtgagaatcaggactccatatcatctaaactgaaagaatgttgtgaaaaaccattattggaaaaaagtcactgcatagccgaagtggagaatgatgaaatgcctgctgatctcccttcgctcgccgccgatttcgtggaatccaaagatgtttgtaaaaattatgccgaggccaaagatgtgttcctaggaatgtttttgtacgaatatgctaggcggcatcccgattattcagtggtactgctactacggctcgcaaaaacttatgaaactactctggaaaagtgttgtgccgccgccgacccgcatgagtgttacgctaaagtattcgacgaattcaaacccctcgtcgaagaaccacagaacctcatcaaacaaaactgcgagctgtttgagcagttaggggaatacaagtttcagaacgcactgctggttcgatacacaaagaaagtaccacaggtaagtacgcccacactggtggaggtgtctcggaacttagggaaagttggatctaagtgctgtaaacaccccgaggcgaaacgaatgccatgcgcagaagactatctctcagtagtgctcaaccagctttgtgtgttacatgaaaaaactcccgtatcagatagagttacaaagtgttgcacagaaagtctcgtgaaccgccgcccctgcttctccgcgctggaagtggatgaaacttatgtgcccaaagagttcaacgctgaaacatttacttttcatgctgatatctgtacactttctgaaaaagaacgacagataaaaaaacaaacagccctagtggagttagttaaacataaaccgaaggcaactaaagaacagcttaaagcagtgatggatgattttgctgcctttgtggaaaagtgctgcaaagccgacgataaggaaacatgtttcgccgaagaagggaagaaactcgtggccgccagtcaggcagcccttggactc

SEQ ID NO: 249345 - DNA, 2007 bp, Artificial Sequence
  Description of Artificial Sequence: Synthetic coding sequence
atgaagtgggtgtccttcatcagcctcctcttcctgttctcatcggcttactcaggatccctggacaagagacacggagaaggaaccttcacctcggatgtgtcctcctacctcgaaggacaagccgccaaagagttcatagcctggctcgtcaaaggacggcacggtgagggtacctttacgagcgacgtgtcctcttacctggagggacaagcagccaaggaattcatcgcatggttggtgaaggggcgcgacgcacataaaagcgaagttgcccaccggttcaaggatctgggcgaagaaaacttcaaggccctggtcttgatcgctttcgcgcaatacctccagcagtgtccgtttgaggaccacgttaagctggtcaatgaagtgactgagttcgcaaagacctgtgtggcggacgagtcggccgagaattgcgataagtcattgcataccctcttcggggacaagctgtgcaccgtggcaacgctgagagagacttatggagaaatggcggactgctgcgctaaacaggaacctgaaagaaacgagtgcttcctgcaacataaagacgacaatccgaatctgccacggctggtgaggccagaagtggatgtgatgtgcactgccttccatgacaacgaggaaaccttcctcaagaagtacctctacgagatcgcgaggcgccatccatacttctatgcgccggagttgctgttcttcgctaagcggtacaaggcagccttcactgagtgctgccaggccgctgacaaagcggcctgcctgcttcccaagctcgacgaactgcgagatgagggaaaggccagcagcgcgaaacagaggttgaaatgtgccagcctccaaaagtttggcgaacgcgctttcaaagcgtgggcggtggcccgcctctcccaacggttcccgaaggcggaattcgccgaagtgtcgaaacttgtgactgatcttacgaaagtccacaccgaatgctgtcatggtgatctgctggagtgcgccgacgacagggcagatctggcaaagtacatctgcgagaaccaagactccatctcaagcaaactgaaagaatgctgcgaaaaacctctcctcgaaaaatcccattgtatcgccgaggtggagaatgacgaaatgccggctgacctgccgagcctggcagcagattttgtggagagcaaggatgtttgcaagaattacgcagaagcgaaagacgttttcctcggtatgttcctgtacgagtacgcacggcgccatccagattactcagtggttctgctgctgcgcttggccaaaacctacgaaaccaccttggaaaagtgctgtgcagcggccgatccacacgagtgctacgctaaggtgtttgacgagttcaagccgctcgtggaggaaccccagaacctgattaagcagaactgcgaattgtttgagcaactgggagaatacaagttccagaacgcattgcttgtccgctacactaagaaggtaccgcaggtgtcgactcctaccctggtggaagtgtccaggaacctgggaaaggtgggctccaagtgctgcaaacacccggaggccaagcggatgccgtgcgccgaagattacctgtcggtggtactgaaccagctgtgtgtcctgcacgagaaaactcctgtgagcgatcgcgtcaccaagtgttgcactgagtccctggtgaacagacggccgtgttttagcgccctcgaggtggacgaaacctacgtcccgaaggagttcaacgccgagactttcactttccacgccgatatctgcaccctgagcgaaaaggaacgccagatcaagaaacagacggccctggtggaactggtcaagcacaagcccaaggcgactaaggagcagttgaaggcggtcatggacgattttgcagccttcgtcgagaagtgctgtaaagctgacgacaaggaaacctgcttcgccgaggaaggaaagaagctcgtagccgcctcgcaggccgccctcggattg

SEQ ID NO: 249346 - DNA, 2007 bp, Artificial Sequence
  Description of Artificial Sequence: Synthetic coding sequence
atgaagtgggtgagttttattagtctgctcttccttttctcctccgcatactctggctcgctcgacaagaggcatggtgaagggacttttacttctgatgtctcttcctacctcgaaggccaggcggccaaggagtttattgcctggctagtaaaggggagacacggggaaggaacatttacaagcgacgtgagcagctaccttgagggtcaggcagccaaagagtttatagcttggttggtcaagggaagggatgcccacaagagcgaagtggcacaccgatttaaagatctgggagaggaaaactttaaggccctcgtcctgatagcttttgcgcagtacctgcagcagtgcccctttgaggatcacgttaaactggttaacgaggttacagagtttgctaagacctgcgtggctgatgagtccgcagaaaactgtgataagtctttgcatacccttttcggcgacaaactgtgtacagttgccactctcagggagacttacggggaaatggctgattgttgtgccaaacaagaaccagagcggaatgagtgttttctgcaacacaaggatgataatcccaatcttcctcggcttgttcgacctgaggtcgacgtaatgtgcacggctttccacgacaacgaggagactttccttaagaaatacctgtacgagattgcacggaggcatccctatttctacgcacccgagctgttattttttgccaaacgctacaaggctgcattcacagaatgctgtcaggcagccgataaagcggcctgcttgttgccaaaactggatgagctgcgtgacgaaggaaaggcgtcttctgccaagcagagactgaagtgcgcgagcttacagaaatttggggaaagagcgtttaaagcgtgggccgtggcccgtcttagtcagcgatttcccaaggcagagttcgccgaggtgagcaagttagttacagatcttaccaaagttcacaccgagtgttgccacggcgatcttttggaatgcgccgacgacagggccgatctggccaagtatatttgcgaaaaccaggattccatttcatctaagttaaaggagtgttgcgaaaagccactgttagagaagtcacactgcatcgccgaagtcgagaacgatgaaatgcccgcggatctgccgagcctggccgcagatttcgtcgaatctaaggacgtctgcaagaattacgcagaagcgaaagatgtgttcctgggaatgtttctctacgagtacgcccggcgccacccagattatagcgtggtgttgctccttcggctggcaaaaacctatgagacaacattggagaaatgctgtgctgccgcagacccacatgaatgctacgccaaagtgtttgacgagtttaagccgttggtagaagagccccagaacctcattaagcaaaactgtgagctgttcgagcagttgggagaatacaagttccagaacgcactgttagttcgctacacaaaaaaagtccctcaggtgtccaccccaacgctcgtcgaggtttcacggaacctcggtaaggttggcagcaagtgttgtaaacaccctgaggcaaaaaggatgccttgtgcagaggattatttgtcagtggtgctgaaccagttgtgcgtcctgcacgaaaagacgcctgtgtccgacagagttaccaagtgctgtacagagtctctggtcaaccgtagaccctgtttctctgcgttggaggttgatgagacatacgtgcccaaggaattcaacgctgagacattcacgtttcatgccgacatttgcaccctgagcgagaaggagcgacagatcaagaagcagacagcattggtagaactcgttaagcataagcccaaggctacaaaggaacagctgaaggcggtaatggacgacttcgccgcattcgtggaaaagtgttgcaaagccgatgataaggaaacttgcttcgccgaggagggaaaaaagcttgttgcagcatcacaggcagcactggggctc

SEQ ID NO: 249347 - DNA, 2007 bp, Artificial Sequence
  Description of Artificial Sequence: Synthetic coding sequence
atgaagtgggtctcttttattagtctcctgttcctgttctcttccgcctatagcgggtcattagataaaagacacggggagggcacatttacgtcagacgtgagctcatacctcgaaggccaggccgcgaaagagttcatagcttggcttgtgaagggccggcacggggaaggaacgtttaccagcgacgtgtcttcttacctagaagggcaagccgcaaaagagtttatcgcctggcttgttaagggaagggacgcacataaatcagaggtggcgcatagatttaaggatttgggcgaagaaaacttcaaagctcttgttctcattgcctttgcacagtaccttcagcagtgtcccttcgaagatcacgtcaagctggttaacgaagtgaccgaattcgccaaaacttgtgtggctgatgagtcagccgagaattgtgacaaatccctgcacactttgttcggagataagttgtgtacagtagccactttgcgagagacatacggtgaaatggcggactgctgcgccaaacaagaacctgagagaaacgaatgcttccttcaacacaaagatgacaaccctaacctgccaagactggtgcggcccgaagttgatgtaatgtgtaccgctttccacgataatgaggagactttcctaaagaagtatctgtatgaaatcgccagaaggcacccctacttctatgcgccagaactgctgtttttcgccaagcggtataaagcagcgttcacagaatgctgtcaagccgccgacaaagcggcctgcctcttgcctaagttggacgaactgagagatgaaggtaaggcctcaagcgctaagcaaaggctaaaatgtgccagcctacaaaagtttggcgaaagagcctttaaggcatgggctgtcgctcgcttgtcccagcgattcccaaaggcagaatttgccgaggtatctaaactggtcactgaccttacgaaggtgcatacggagtgctgccatggagatcttctagaatgtgccgacgaccgcgcagatttggctaagtatatctgtgaaaaccaggacagcatctcctcaaagcttaaagagtgctgcgagaaaccactgctggagaagtctcactgcatcgctgaagtggaaaatgacgagatgcctgctgacctgcccagccttgccgctgattttgtagaatccaaagacgtgtgcaaaaattacgctgaagccaaggacgtgttcttgggaatgttcctctacgagtacgcccggcggcatcctgattactctgtggtccttcttctgcgccttgcgaaaacatacgaaacgacattagaaaaatgctgcgcggctgctgacccccacgaatgctacgccaaggtgttcgatgagttcaagccgttggtggaggaaccacaaaacctcataaaacagaattgcgagctctttgaacagttgggcgagtacaaattccagaacgcgttgctggtcaggtacaccaaaaaagtcccccaggtgtccactcccacactggtggaagttagtcgaaacctgggcaaagtcggatccaagtgttgcaaacatcccgaggccaaacgtatgccttgtgctgaagattacttgagtgtcgttctgaaccaactttgcgtcctgcacgagaagaccccggtttcggacagagtgaccaagtgttgcactgaaagcctggtcaaccgccgtccttgtttctctgcattagaggtggacgagacttatgttccaaaggaattcaacgcggagacgtttaccttccatgcagacatttgtactcttagcgagaaagagcgtcaaatcaagaagcagacagctttagtggagctcgtgaaacacaaaccaaaggccacaaaggagcagcttaaggctgtgatggacgacttcgccgccttcgttgaaaaatgctgcaaagcagacgataaagagacctgtttcgcagaagaaggaaagaaactcgtcgccgcttcacaggcagccctgggattg

SEQ ID NO: 249348 - DNA, 2007 bp, Artificial Sequence
  Description of Artificial Sequence: Synthetic coding sequence
atgaaatgggtgtcatttatctcactgttgttcctgttcagctctgcgtattcaggttctctcgacaaacgccacggtgagggcaccttcacgtcagatgttagttcttacttggaggggcaggccgctaaagagtttatagcgtggctggtcaaagggagacacggggaggggactttcacttctgacgtgtccagttatttggaagggcaagcagcgaaggagtttatcgcttggctggtgaagggcagagacgcacataaatctgaggtcgcacacaggttcaaggacctgggagaggagaatttcaaggccctggtactgatagccttcgcccagtatcttcagcagtgtccctttgaggaccatgttaaactggtgaacgaggtgaccgagttcgcaaaaacgtgcgtggcagacgagtctgccgaaaattgtgataagtctctgcacaccttgtttggcgacaagctctgtaccgtggccacattgagagaaacttacggtgagatggctgactgttgtgccaagcaggaaccagaaaggaatgaatgctttctccagcataaggatgataaccctaatttgcctagactggtgcggccggaggttgatgtcatgtgcacagcatttcacgacaatgaagagactttcctgaaaaaatatctgtacgaaattgcaagacggcatccctatttctatgctcccgagctgctctttttcgctaaacggtacaaagccgccttcacagaatgctgccaggctgcggataaggccgcatgcctcttgccgaagctcgatgagttgagggacgaagggaaagctagttcagccaaacagcgactgaagtgtgctagcctccaaaaatttggcgagagagcttttaaggcttgggcggttgctcgactgagccaaaggtttccgaaggcggagtttgcagaggtgtccaagctcgtgactgaccttaccaaagtgcacacagaatgctgccatggcgatttgctcgagtgtgccgacgacagggccgacctggctaagtacatctgtgagaatcaggactctattagctcaaagctcaaggaatgctgtgagaaaccactgctcgagaagagccattgcatcgcagaggtggagaatgatgagatgcccgccgatctccccagtcttgcggccgattttgtggagtccaaggacgtgtgcaagaactacgcagaggccaaggatgtgttcctgggaatgttcctctacgagtatgccagacggcatccagattacagcgtagtcttgcttcttcggctcgcgaagacatatgagaccaccctcgaaaagtgttgcgccgctgcagaccctcatgagtgttatgctaaggtcttcgatgaattcaagccactggtggaagagcctcagaacctgatcaaacagaattgcgagctgttcgaacagctgggggagtataaatttcagaacgccctgctggtccgatataccaaaaaggtgccgcaggtttccactccaactttggtcgaagtttcacggaaccttggaaaggtgggtagcaaatgctgtaagcatcccgaggcgaagagaatgccctgcgctgaggactatctgtctgttgttctcaaccaactttgcgtactgcatgagaagacccctgtctctgatagggtcacaaagtgttgcaccgagtctctcgtcaatcgaaggccatgtttcagcgcactggaggttgacgaaacctacgtcccgaaggaatttaatgcggagaccttcacatttcatgcagacatttgcaccttgtcagagaaggagcggcagattaagaaacagaccgctctggttgaactcgtgaaacacaaacctaaggccactaaagagcagctcaaagccgtcatggacgatttcgctgcttttgttgaaaagtgctgtaaggccgatgacaaggaaacatgcttcgctgaggaagggaagaaattggtggccgcctctcaggccgcactgggactg

SEQ ID NO: 249349 - DNA, 2007 bp, Artificial Sequence
  Description of Artificial Sequence: Synthetic coding sequence
atgaaatgggtaagcttcatctctcttctgtttctgttcagctctgcgtattccggttctctcgataagagacacggcgaggggactttcacttctgatgtgtcttcctatctcgagggccaagctgccaaggagtttatcgcttggctggtgaaaggccgccacggagaaggtacctttacctccgacgtgtcatcttacttggaaggacaagctgcgaaggagttcatcgcatggctggtgaaaggaagggacgcacacaagtcggaggtggcccaccggttcaaagaccttggagaggaaaacttcaaggccctagtcctgatcgcgttcgcccagtatctgcagcagtgtcccttcgaagaccacgtgaagttggtcaacgaggtgacagagtttgccaagacttgcgtggcggatgagtccgccgaaaactgtgacaaatctttgcacacactgttcggagataagttgtgtaccgtggcaacactacgggaaacatatggtgagatggcggactgctgcgcaaagcaggaacctgagagaaacgagtgttttctgcagcataaggatgataaccctaatctgcccaggcttgtcagacctgaagtggacgtaatgtgtaccgcttttcacgacaacgaggagacattcctgaaaaagtacttgtacgaaatcgccagacgccatccctacttttacgcccctgagcttctctttttcgccaagcggtataaggccgcctttaccgagtgttgtcaggcagcggataaggcagcttgcctcttgcctaagttggacgaactccgagacgaaggcaaagccagctcagctaaacagagactcaagtgcgcctcattgcagaagtttggagagcgagctttcaaagcttgggcagtcgcacgcttgagccagcgctttcccaaggctgagtttgccgaagtgagcaagctggttacagatcttactaaggtgcacactgagtgctgccacggagatctcctagaatgcgctgacgaccgggctgatctggccaagtacatttgcgagaaccaagactctattagctcgaagctaaaggaatgctgtgaaaagcctctcttggagaaaagccactgtattgcagaagtggaaaacgatgagatgccggctgacctgccctccctcgcagccgactttgttgagagtaaggatgtctgtaagaattacgcagaggcaaaagacgtgttcctcgggatgttcctttatgagtacgcgcggaggcaccctgactattccgtggtcctcctgctgcgactggctaagacttacgaaacaactctcgagaagtgctgcgcagccgctgacccacacgaatgctacgctaaggtcttcgatgagtttaagcctctcgtggaggagccacagaatcttatcaaacaaaactgtgaactgtttgagcagctgggagaatacaaattccaaaacgcacttctagttagatatacaaaaaaagtgccccaggtgtcaacccccacgctcgtggaggtcagcaggaacctaggcaaggtcggaagcaagtgttgcaagcatcctgaagccaagcgaatgccctgtgcggaggactatttaagtgtggtgctgaaccagctgtgtgttctccatgagaaaacacctgtgagcgatagggtcacaaaatgctgcaccgagtctttagttaaccggcggccttgcttttccgcgttagaggtcgatgagacatacgtccccaaagaattcaacgcagaaacttttacatttcacgccgatatatgtactctttctgagaaggaacggcaaatcaaaaagcaaacggctttggtcgagttggttaagcacaagccaaaggccacaaaggaacaactgaaggccgttatggacgattttgccgctttcgtggagaagtgctgtaaggctgatgataaggagacgtgcttcgccgaagaaggaaagaaattggtggctgcttctcaggctgctctggggctg

SEQ ID NO: 249350 - DNA, 2007 bp, Artificial Sequence
  Description of Artificial Sequence: Synthetic coding sequence
atgaagtgggtgtcctttattagcctgctgtttttattcagctccgcctattccggtagtttggacaagcgacatggagaggggactttcacttcggatgtgtccagttacctagagggacaagccgcaaaggagtttatcgcttggcttgtcaagggacgtcatggcgaaggcacgttcacctccgatgtctcttcgtacctggaaggtcaggcggccaaagagtttattgcttggctcgtgaagggacgtgatgcgcataagagtgaagtcgcgcataggttcaaggatttgggagaggaaaactttaaagcactggtcctcatcgcgttcgcccagtacttgcagcaatgtcccttcgaagatcatgtcaaactcgtgaatgaggtcacggaatttgctaaaacttgtgtggccgacgagagcgccgagaattgcgacaaaagcttgcacaccttgtttggagacaaactttgtaccgtggctaccttacgcgagacttacggggaaatggcggactgctgcgcgaagcaagagcctgagcgaaatgagtgcttcctgcagcacaaggatgataaccccaacttgccccgtctagtccgccccgaggtcgatgtcatgtgcacggcttttcacgacaacgaagagaccttcctgaagaagtacctgtatgaaatcgcccggcgccacccctatttctacgctcctgaactgctctttttcgccaagcgatacaaggcggcattcaccgagtgctgtcaggcagctgacaaagcggcatgccttctacccaaactcgacgagctccgtgatgaggggaaggcatcctcagccaagcagcggttaaagtgcgcgagcctgcagaaattcggagagagggcatttaaggcctgggctgtcgcgcgcctctcacagcgctttcccaaggccgagtttgccgaggtatcaaagctcgttacagacctcaccaaggtacataccgagtgctgccacggagacttgctggagtgtgcggacgatcgcgcagacctggccaagtatatctgcgagaatcaggatagtatttcttcgaagcttaaggagtgctgcgagaaaccccttctcgagaaatcgcactgcatcgccgaagttgagaacgacgaaatgcctgccgatcttccaagcctggccgccgacttcgtcgagtcgaaggatgtgtgtaaaaactacgcagaagctaaggatgtctttctcgggatgttcctgtacgaatacgcccgtcgacaccccgattactcggttgtgttgctactccgtctcgccaagacgtatgagacaacgctggagaaatgctgcgcagccgcagacccacacgagtgctacgcgaaagtcttcgatgaatttaagcctctggtcgaggagccacaaaatttgataaagcaaaactgtgaactgttcgaacagttaggcgagtataagtttcagaacgcactcctggtccggtacacaaaaaaggtcccacaagtgtccaccccaactctagtggaggtgtcacgtaaccttggcaaggtgggaagcaagtgttgcaaacatccggaggcgaagcgtatgccgtgcgccgaggattacttgtccgtcgttctgaatcagctatgtgtgctgcatgaaaagactccggtttctgatcgggttacgaagtgttgtactgagagcctggtcaatcggcgcccgtgtttcagcgcactggaggttgatgagacttacgtacccaaggagttcaacgcagagacattcaccttccacgcggatatctgtaccttgtccgagaaggagaggcaaatcaagaagcagactgccctcgttgagcttgtgaagcataagcctaaggcaactaaagagcagctgaaggcagtgatggatgattttgctgctttcgtcgagaagtgctgcaaggccgacgacaaggaaacctgtttcgctgaggagggaaagaaactcgtggccgccagccaggccgcgctgggccta

SEQ ID NO: 249351 - DNA, 2007 bp, Artificial Sequence
  Description of Artificial Sequence: Synthetic coding sequence
atgaaatgggtgtcgtttatctcgctcctctttctgtttagcagcgcatactcgggaagcctggataagagacacggtgagggaactttcaccagcgacgtgtcctcatatctggaaggacaggctgccaaggagttcatcgcctggctggtcaagggccggcatggtgaaggaacttttacctcagatgtctcctcttacctggaaggccaggccgcgaaggagtttatcgcgtggctcgtgaagggacgcgatgcccacaaatccgaggtggcccaccggtttaaggacctgggagaagaaaacttcaaggcgctcgtgctcatcgcattcgcacagtacctgcaacagtgcccattcgaggaccacgtgaagttggtgaacgaagtcaccgaatttgctaagacgtgcgtcgccgatgagtcagccgaaaactgcgacaagtcactgcataccctgttcggagacaagctgtgcactgtggcgactcttagggaaacgtacggagagatggcggactgctgtgccaagcaagaaccggagagaaacgagtgctttctgcaacacaaggatgacaaccctaaccttccgagactggtaagaccggaagtcgatgtgatgtgcaccgcgttccacgacaacgaggaaaccttcctgaagaagtacctctacgaaatcgcgcgcagacacccgtatttctacgcacctgaactgctgttcttcgcaaagcggtacaaagctgcatttaccgaatgctgccaggccgccgacaaagccgcatgcctgttgccgaagctggatgaactcagagacgaaggcaaggcgtcctccgctaagcagcgcctgaaatgcgcgtcacttcaaaagttcggcgagcgcgcctttaaagcgtgggcagtggcccgcctgtcacagagattcccgaaggcagaattcgcggaggtgagcaaactcgtgaccgacctgactaaggtgcatacggagtgctgccacggcgatcttctggagtgtgctgacgaccgcgcggatctcgcaaagtacatctgcgagaaccaggattcgatctcgagcaaactgaaggaatgctgtgagaagccgctgctggaaaagtctcactgcatcgctgaagtggagaacgacgaaatgccggcagacctgccatcccttgctgctgacttcgtggagtcaaaggacgtctgtaagaattatgcagaggcaaaggacgttttcctgggaatgtttctctacgaatacgcacggcggcatccggactacagcgtggtgctgctgttgcgcctggctaagacttacgaaacgacccttgagaagtgttgtgcggcagcggacccgcatgaatgctacgcgaaagtgttcgacgaattcaaaccgttggtggaagagccacaaaatctgatcaagcaaaactgtgagctttttgaacagctcggggagtacaagttccagaacgccctcctcgtcagatacactaagaaagtgccccaggtgtccactccaaccctggttgaggtgtccaggaaccttggaaaagtgggatcaaagtgctgtaaacaccctgaagcaaaacgcatgccgtgcgccgaagattacctgtccgtggtgcttaaccagctgtgcgtgctccatgagaaaacccccgtgtccgatagggtcaccaagtgctgcactgaatcgctcgtgaacaggcgcccttgcttcagcgcgctggaagtcgatgaaacctatgtgcctaaggaattcaacgctgaaacctttactttccacgcagacatctgtaccctgagcgaaaaggagagacaaatcaagaagcaaaccgctttggtggagctcgtgaagcacaagccgaaggccacgaaggaacaactgaaggccgtgatggacgacttcgccgccttcgtggagaaatgttgtaaagcggacgataaggagacttgcttcgccgaggaaggcaaaaaactcgtggcggcgtcccaagccgcgcttggtttg

SEQ ID NO: 249352 - DNA, 2007 bp, Artificial Sequence
  Description of Artificial Sequence: Synthetic coding sequence
atgaagtgggtgtcgttcatatctctcctttttcttttttcgtcagcctactcgggaagccttgataagcgccacggagagggtacctttactagcgatgtgtcctcctatctcgaaggtcaagcagcaaaggaattcattgcatggctggtcaagggacgccatggtgaaggtactttcacttcggacgtctcctcctaccttgaaggacaggccgcaaaggagttcatcgcctggcttgtcaaaggaagagacgcgcataagagcgaagtcgcacatcgctttaaggatctgggcgaagaaaactttaaggcacttgtgcttattgcatttgctcagtacctccagcagtgtccatttgaggaccacgtgaagctggtgaacgaggtgaccgaatttgcaaagacttgtgtggcagatgaatcagcagaaaattgtgacaagtcactccatactctgtttggagacaagctgtgcaccgtggctactctgcgggagacttacggagagatggcagattgctgcgcaaagcaggaacccgaacgcaacgaatgtttcctgcaacataaagacgataatccgaatctgccccggcttgtgcggcctgaagtcgatgtcatgtgcactgctttccacgataacgaggaaacctttttgaagaagtatctttacgagatagccagaaggcacccttacttttacgctcctgaattgctcttctttgccaagaggtacaaggcagcattcacggagtgctgtcaagcagcagataaagcagcttgtctgctccctaaacttgacgaactgcgtgacgaaggtaaagcctcctccgcaaagcaaaggcttaagtgcgcaagcctgcagaaatttggagagcgggcatttaaggcatgggcagtggcaagactttcgcaaagattccctaaggccgaatttgctgaagtgtcaaagctggtgaccgatctcaccaaggtccacaccgaatgttgccacggcgaccttctggaatgtgcagatgatcgggcagaccttgccaaatacatttgtgaaaatcaggatagcattagctccaagctcaaagaatgctgtgaaaagcctcttctggaaaagtcgcattgtatcgcagaagtggaaaatgatgagatgcctgcagatctgccttccttggcggcagattttgtggagagcaaggatgtgtgtaagaattacgcggaggcaaaggatgtgttcctgggtatgtttctctatgagtacgcaaggagacacccagattactccgtcgtcctgctgcttagactggctaagacttatgaaacgaccctggaaaaatgttgtgcagcagcagatccacatgagtgctacgccaaggtgtttgacgaattcaagccgctggtggaggaaccacagaatttgattaagcaaaactgcgaactgtttgaacagctgggagaatacaaattccaaaatgctcttcttgtgcggtatacgaagaaagtgccgcaagtgtcgactccgactctcgtcgaggtgagcaggaatcttggaaaggtggggagcaagtgctgtaagcaccccgaagcaaagagaatgccatgtgcggaggactatctctcggtggtgcttaaccagctgtgtgtcctgcatgagaaaaccccagtgtcagatcgggtcaccaagtgttgtactgagagccttgtgaatcgacgtccttgcttttcagcattggaggtcgatgagacttacgtgccaaaagaattcaacgcagaaacctttacgttccatgcagacatctgtactctgagcgagaaggaacgccaaatcaaaaagcaaaccgccctggtcgagctcgtgaaacacaagcctaaggcaactaaggagcagcttaaggccgtgatggatgattttgcagcattcgtggaaaagtgttgtaaggcagatgacaaggaaacttgttttgcagaggagggcaaaaagctggttgcagcaagccaggccgcactggggctg

SEQ ID NO: 249353 - DNA, 2007 bp, Artificial Sequence
  Description of Artificial Sequence: Synthetic coding sequence
atgaagtgggttagctttattagcctgctttttctgttttcatctgcttactccgggagtctagacaaacggcacggagaaggaacatttacaagtgacgtttcaagctatctcgagggacaggccgccaaggagttcatcgcatggcttgtgaagggacgtcacggagaaggtaccttcacttctgatgtgagctcctacctggagggccaggcggcaaaagagtttatcgcatggttggttaaagggagggacgcacataaatctgaagtggctcaccgctttaaggatttgggggaagagaatttcaaggcactggtgctgattgcattcgctcagtacctgcaacagtgcccttttgaggatcatgtgaaactcgtgaacgaagtcaccgaatttgccaagacgtgtgtggctgacgagagcgctgaaaattgtgataagagcttgcacaccctgttcggggataagctgtgcactgtggctacacttcgtgaaacctatggcgagatggcagattgctgtgcaaaacaagagcccgagcggaacgaatgttttctgcaacataaggatgataatcccaacttgcctcggttggtgagacctgaggtcgacgtgatgtgtacagcatttcacgacaacgaggagaccttcctgaaaaagtacttatacgaaatcgctagaagacatccatacttttatgcccccgagctgctcttttttgctaagaggtacaaggccgcttttaccgaatgctgccaggcagcagacaaagcggcctgcctgttgccaaagctcgatgagctaagagatgaaggaaaggcatcatccgctaagcagcgcctcaagtgcgcctcgctgcagaagttcggagagcgggcattcaaggcctgggcagttgcccgtttatcccagaggtttcccaaagctgagttcgccgaggtttccaaattggtaactgatttgaccaaggtccacacggagtgctgccatggggatctgttggaatgcgctgatgaccgcgctgacctggctaaatacatttgtgagaaccaagattctatttcttccaagttgaaagaatgttgcgaaaaacccctgctcgagaaaagtcattgcattgccgaggtggagaacgacgaaatgccagccgacctgccatccctcgcggcagatttcgtcgagtcaaaagatgtctgcaaaaactacgccgaagccaaggatgtgttcctcggaatgttcctgtacgaatacgcacgaagacaccccgactacagcgtagtgttgctactcagactggcaaagacctacgaaacaacacttgagaagtgctgtgcagcagcagacccccatgagtgctacgcgaaagttttcgacgagttcaaacccttggttgaggaaccacagaacctgatcaagcagaattgcgagctttttgaacagctgggtgaatacaaattccagaacgcgctgttggtaagatatacaaagaaggtacctcaagttagtactccaacactggtcgaggtgtctaggaacctcggaaaagtaggatccaagtgctgcaagcaccctgaagccaagcgcatgccttgcgctgaggactacctgagtgtagtgctcaatcagctgtgcgtgctgcatgagaagacccccgtgtcagacagggttacaaagtgctgcaccgagagtctggtgaatcgcagaccttgtttctcagcccttgaagttgatgaaacatatgtgccgaaagagttcaacgccgagacgtttacatttcatgcggatatttgcaccttgtccgagaaagaacggcagatcaaaaagcagaccgctctcgtggagctggtcaagcacaaacctaaggctacaaaagagcagctgaaggctgtgatggatgacttcgccgctttcgtggaaaaatgttgcaaagcggacgataaggaaacctgctttgcggaagaaggcaaaaagcttgttgctgccagccaggcggccctgggcctc

SEQ ID NO: 249354 - DNA, 2007 bp, Artificial Sequence
  Description of Artificial Sequence: Synthetic coding sequence
atgaaatgggtcagcttcatttccctgttgtttctgttcagctctgcgtactcggggtccctcgataagcggcacggagagggtacgttcacctccgatgtctcgagctaccttgaagggcaggccgctaaggaattcattgcatggcttgtgaagggccgtcacggtgaaggtacgtttacgtccgatgtgagctcgtacctcgagggacaggcagcgaaggaattcatcgcgtggctggtgaaggggcgggacgcgcataagtcggaagttgcacacaggttcaaggacctgggggaggaaaactttaaggcgcttgtgctcattgcgtttgcacagtatcttcagcaatgtccatttgaggatcacgtgaagttggtgaacgaggtgacggagtttgccaagacctgcgtggctgatgaatccgccgaaaactgcgataagtcactccacaccctcttcggagataagctctgtaccgtggcaaccctgagggaaacttacggcgaaatggccgactgttgtgcaaagcaagaacccgagagaaacgaatgcttcctccaacataaggacgataaccctaatctcccccggctggttcgcccggaggtcgatgtcatgtgtaccgcatttcatgacaacgaggagactttccttaagaagtacctgtacgaaattgcgcgcaggcatccttacttttacgcaccagagctgcttttcttcgcaaagcgctacaaggccgcttttactgagtgctgccaagccgcagataaagccgcgtgtctgctgcctaagctggacgaacttcgggatgaaggtaaggctagctcagcaaagcaaaggcttaagtgcgcatcgctgcaaaagtttggtgaacgcgcattcaaagcgtgggccgttgcacgcctgtcgcaacgattcccgaaagcagagtttgcagaagtctccaagctggtgactgatctgactaaagtccacactgaatgttgtcatggggacttgctggaatgtgcagatgatcgagcagacctcgccaagtacatttgcgagaatcaagattccatctcctcaaagttgaaggaatgttgtgagaaaccactgttggagaaatcacattgtatcgccgaggtcgagaacgatgaaatgcccgcagatctgccatccctggccgccgactttgtcgaatccaaggatgtgtgtaagaattacgcagaggcaaaggacgtgtttctgggcatgtttttgtacgagtacgcaaggcgtcacccagattatagtgtcgtcctgctgctcagattggctaaaacctacgaaaccactctggagaagtgctgtgcagcagccgacccacacgaatgttacgcgaaggtgttcgacgagtttaagccattggtggaagaaccccaaaacttgataaagcagaactgtgaactgtttgaacagctgggagagtacaaattccagaacgcacttctcgtcagatacaccaagaaagtcccacaagtgtccactcctacgctcgtcgaagtgtcgcgaaaccttgggaaagttggttcgaagtgctgcaagcaccccgaggcaaagagaatgccttgcgctgaagattaccttagcgttgtgctgaatcagctttgcgtgctccatgaaaagactcccgtgagcgacagagtgactaaatgctgtacggaatcgctggtgaaccgcaggccatgttttagcgcacttgaagtggacgagacttacgtcccgaaggagtttaacgcggaaacttttaccttccacgcagatatttgcacgctttcggaaaaggaaagacagatcaagaagcaaaccgcacttgtcgaacttgtgaagcacaagcccaaagccacgaaggaacaacttaaggcggtcatggacgattttgcagcttttgtggaaaaatgttgtaaagcagacgacaaggaaacctgttttgccgaagaggggaagaaacttgttgcagcaagccaggcagcgctgggactg

SEQ ID NO: 249355 - DNA, 2007 bp, Artificial Sequence
  Description of Artificial Sequence: Synthetic coding sequence
atgaaatgggtatcgtttatatcgttattatttttattttcgtcggcgtattcgggttcgttagataaacgacatggtgaaggtacgtttacgtcggatgtttcgtcgtatttagaaggtcaagcggcgaaagaatttatagcgtggctagtaaaaggtcgtcatggtgaaggtacgtttacgtcggatgtatcgtcgtatttagaaggtcaagcggcgaaagaatttatagcgtggttagtaaaaggtcgtgatgcgcataaatcggaagttgcgcatcgatttaaagatttaggtgaagaaaattttaaagcgctagttttaatagcgtttgcgcaatatttacaacaatgtccgtttgaagatcatgtaaaattagtaaatgaagtaacggaatttgcgaaaacgtgtgtagcggatgaatcggcggaaaattgtgataaatcgttacatacgctatttggtgataaattatgtacggttgcgacgctacgtgaaacgtatggtgaaatggcggattgttgtgcgaaacaagaaccggaacgtaatgaatgttttctacaacataaagatgataatccgaatctaccgcgtttagtacgaccggaagtagatgttatgtgtacggcgtttcatgataatgaagaaacgtttctaaaaaaatatttatatgaaatagcgcgtcgacatccgtatttttatgcgccggaattattattttttgcgaaacgatataaagcggcgtttacggaatgttgtcaagcggcggataaagcggcgtgtttattaccgaaactagatgaactacgtgatgaaggtaaagcgtcgtcggcgaaacaacgtttaaaatgtgcgtcgttacaaaaatttggtgaacgtgcgtttaaagcgtgggcggtagcgcgactatcgcaacgttttccgaaagcggaatttgcggaagtatcgaaactagttacggatttaacgaaagtacatacggaatgttgtcatggtgatctattagaatgtgcggatgatcgtgcggatctagcgaaatatatatgtgaaaatcaagattcgatatcgtcgaaattaaaagaatgttgtgaaaaaccgctattagaaaaatcgcattgtatagcggaagttgaaaatgatgaaatgccggcggatttaccgtcgttagcggcggattttgtagaatcgaaagatgtatgtaaaaattatgcggaagcgaaagatgtatttttaggtatgtttctatatgaatatgcgcgacgtcatccggattattcggtagtattactactacgtttagcgaaaacgtatgaaacgacgttagaaaaatgttgtgcggcggcggatccgcatgaatgttatgcgaaagtatttgatgaatttaaaccgctagtagaagaaccgcaaaatttaataaaacaaaattgtgaactatttgaacaactaggtgaatataaatttcaaaatgcgttactagtacgatatacgaaaaaagtaccgcaagtatcgacgccgacgctagtagaagtatcgcgtaatctaggtaaagttggttcgaaatgttgtaaacatccggaagcgaaacgaatgccgtgtgcggaagattatctatcggtagttttaaatcaattatgtgttttacatgaaaaaacgccggtatcggatcgagtaacgaaatgttgtacggaatcgctagtaaatcgtcgtccgtgtttttcggcgctagaagtagatgaaacgtatgttccgaaagaatttaatgcggaaacgtttacgtttcatgcggatatatgtacgctatcggaaaaagaacgtcaaataaaaaaacaaacggcgctagtagaactagtaaaacataaaccgaaagcgacgaaagaacaattaaaagcggtaatggatgattttgcggcgtttgtagaaaaatgttgtaaagcggatgataaagaaacgtgttttgcggaagaaggtaaaaaactagtagcggcgtcgcaagcggcgctaggttta

SEQ ID NO: 249356 - DNA, 2007 bp, Artificial Sequence
  Description of Artificial Sequence: Synthetic coding sequence
atgaaatgggtgtcttttatttcactcctattcctgttctcctccgcctactctggaagtttagataaaaggcatggagaagggacattcacttcagacgtgtccagttatctggaagggcaggcagccaaagagttcatcgcctggcttgtcaaggggcggcatggagaaggaacatttactagtgatgtatcgtcctacctggaagggcaggccgccaaagagttcattgcgtggctggtcaaaggaagagacgcacataaatcagaagtcgcccaccgattcaaagaccttggagaggaaaactttaaagctctcgttctcattgccttcgcacagtatctccagcagtgccccttcgaggatcacgtgaaactggtaaacgaagtaactgaattcgccaaaacttgcgtagctgatgagtcagctgagaattgtgataaaagtctccatactctcttcggggataagctctgcacagtagctactctgcgagaaacttacggagaaatggcggattgttgcgccaaacaggaacctgagagaaacgaatgcttcctgcagcacaaggatgataatcccaatctacctcgcctggtgagacccgaggtggacgtgatgtgtactgccttccacgataatgaagaaacatttttaaaaaaatatctatatgagatcgcccgacggcatccatacttctacgctcccgaacttcttttttttgccaaacggtacaaggctgccttcacagaatgctgccaggctgccgataaagcagcctgccttcttcctaagttagatgaactgagggacgaagggaaagcctcatcggcgaaacagcgcctaaaatgcgcctcactgcagaaatttggggaaagggccttcaaggcctgggctgtggctaggttatctcaaaggtttccaaaagccgaattcgctgaagtctccaagctagtgacagatctcacaaaagtgcacacggaatgctgccacggggacttgttggaatgtgctgatgatagggctgatctcgcaaaatatatatgcgaaaatcaggatagtatatctagtaaactaaaggagtgttgtgaaaagccattgcttgaaaaatcacattgcatcgcagaagtggaaaatgatgaaatgccagccgatctaccatctctggcggcggattttgtcgaaagtaaagatgtgtgtaagaattacgcagaagccaaagatgtattcttaggaatgtttctctacgaatacgccagacgacatcctgattactctgttgtgctactcctaaggctggcgaaaacatatgaaacaactcttgaaaagtgttgcgcggcagctgatccacacgaatgctatgccaaagtgtttgatgagttcaaaccccttgttgaagaacctcagaatcttattaaacagaattgcgaactttttgaacagctaggggaatataaattccagaatgcactcctggtgcggtatactaaaaaagtaccccaggtgagtacacctacactggtggaggtcagtagaaatctggggaaggtagggtccaaatgttgtaaacaccctgaagcgaagaggatgccatgcgccgaagattatttatctgtggtgctgaaccagttgtgtgtccttcatgaaaagactcctgtatcagacagagtaactaaatgctgcacagaatcccttgtaaaccgacgcccatgcttttcagccctcgaggtggatgaaacatatgtgcccaaagaattcaatgctgaaacatttacattccacgctgatatttgcacactatcagagaaggaaaggcagataaagaaacagactgctttggtggaactcgtgaaacataaacccaaagctacaaaagaacagctgaaagccgtaatggatgacttcgccgccttcgtggaaaaatgttgtaaagccgatgataaagaaacatgttttgccgaagaaggaaaaaagctcgtggcagcttctcaggccgcgctggggcta

SEQ ID NO: 249357 - DNA, 2007 bp, Artificial Sequence
  Description of Artificial Sequence: Synthetic coding sequence
atgaagtgggtgtcgttcatttcgctcttgtttctgttctcgtcagcttactctggatcacttgataagcggcacggggaagggacttttacctcggatgtgtcctcctaccttgagggacaagcagcgaaggagtttatcgcctggctcgtgaagggcagacatggggaaggcactttcacgagcgatgtgtcgtcctacctggaaggacaagcagccaaggagttcatcgcttggctggtgaagggtcgggatgcgcataagtccgaagtcgcgcaccggttcaaggaccttggcgaagaaaacttcaaggcactggtgctgatcgcatttgcacaatacctgcagcagtgtccttttgaggatcatgtcaagctcgtcaacgaggtcactgaatttgctaagacctgtgtcgcagacgaatcagccgagaactgtgacaaatccttgcacactttgtttggagacaaactgtgcacggtcgccacgcttcgcgaaacctacggtgagatggccgattgctgcgcaaagcaggagccagagcgcaatgagtgctttctgcagcataaagatgacaaccctaacctccctagactcgtgcggccagaagtcgatgtgatgtgtactgcatttcatgataacgaagaaacttttctgaagaaatacctctacgaaatagcacggcggcatccttacttttacgccccagagcttctgttttttgcaaagagatacaaggcagcttttacggagtgctgccaagcagcggataaggcggcatgtctcctgccaaagctggatgagctgagagatgaaggaaaggcttcgagcgcaaaacagagacttaagtgtgcgagcttgcagaaattcggagaacgagcatttaaggcctgggccgtggcgagactgtcgcagcgcttccccaaggccgaattcgcagaagtgtccaagctggtgaccgatcttaccaaagtgcatactgaatgttgccatggagacttgctggagtgcgcggatgatagagctgatctggcaaagtacatatgtgaaaatcaggatagcattagctccaagctgaaggagtgttgcgaaaagccactcctggaaaaatcacattgtattgccgaagtggaaaacgacgagatgcccgcagaccttccttcgctggcggcagatttcgtggaatccaaggatgtgtgcaagaattatgcggaggcaaaggacgtctttctcggtatgtttctgtacgaatacgcaaggagacacccggactactccgtcgtgcttctcctccgccttgcaaaaacttacgaaactactctcgagaagtgttgcgccgcagcagacccccatgagtgttacgcaaaagtgttcgatgagtttaagccacttgtggaagaaccccagaacttgataaagcagaattgtgaactttttgaacaactcggcgaatacaagtttcagaacgcgttgcttgtgcggtacactaaaaaggtgccacaagtctcgacgcctactttggtggaggtgagccgcaacctgggcaaggtcggttcaaagtgttgtaagcatcccgaggccaagagaatgccctgtgcagaagattacctgtcggtggttcttaaccaactttgtgtgctgcacgaaaagacgccggtgtcagatcgggtgaccaaatgctgcacggaatccctggtgaataggcggccatgtttttctgcactggaagttgacgagacttacgtcccaaaagaattcaatgcagaaacctttaccttccatgctgatatttgtactctctcggaaaaagagcgacagatcaaaaagcaaactgcacttgtggagcttgtcaagcataagccaaaggcaaccaaagaacagctcaaagcagtgatggacgattttgccgccttcgtggaaaagtgctgtaaggcagacgataaagaaacttgttttgccgaagagggaaaaaagttggtcgcagcaagccaagcagcacttggactt

SEQ ID NO: 249358 - DNA, 2007 bp, Artificial Sequence
  Description of Artificial Sequence: Synthetic coding sequence
atgaaatgggtcagtttcatctccctgctctttttgttcagcagcgcatactccggctcgctggacaagcgccatggtgaaggaactttcacctccgacgtgtcctcatatcttgaaggacaggccgcaaaggaattcattgcctggctggtgaaagggagacatggagaaggaacttttacttccgatgtgtcgtcgtacttggaaggccaagcagctaaggagttcatcgcatggctggtcaagggacgcgacgcccataagtcagaagtggctcatcggtttaaggacctcggagaagagaactttaaagccctggtgctgatcgccttcgcacaatatctgcagcaatgcccattcgaagatcacgtgaagctggtgaacgaagtgactgagtttgcaaaaacctgcgtggcagacgagtccgcggaaaactgtgacaagtcactgcataccctctttggagacaagctgtgcactgtcgcaaccctccgcgagacttacggagagatggcagactgttgcgccaaacaggagccagagagaaatgagtgcttcttgcaacataaggacgataatcccaacctcccgcgactcgtccggccggaagtggacgtgatgtgcacggccttccatgataatgaggaaactttcttgaagaaatacctctacgaaatcgcccgccggcacccttacttttacgcaccagagctgctgttcttcgccaagcggtacaaggctgcctttacggaatgctgccaggcagccgataaggctgcgtgcctgctcccgaagctggatgagttgagagatgaaggaaaagcgagctccgccaagcaaagattgaagtgcgccagcctgcaaaagtttggagaacgggcctttaaggcctgggcggtggcgagactctcgcagcggtttccgaaggccgagtttgctgaagtgagcaagttggtgactgacctgactaaggtgcacaccgagtgttgtcacggagacttgctcgaatgcgccgacgatcgggctgacctcgcaaagtatatctgcgaaaatcaagatagcatttcgtccaagctgaaggagtgctgcgaaaagccgcttcttgaaaaatcccattgcattgcggaagtggaaaacgatgaaatgccggctgacctgccatcgcttgcggcggacttcgtcgagtcaaaagatgtgtgcaagaattacgctgaggctaaggacgtctttctgggaatgtttctgtacgaatacgcgaggcgccatccggattactcagtcgttttgcttctcagactcgccaagacctacgaaaccactttggagaagtgttgcgccgccgccgaccctcacgaatgctacgcgaaggtgttcgacgagtttaagcctctggtggaggagccacagaacctgataaaacagaactgcgaacttttcgaacagctgggggaatacaagttccagaacgcgctcctcgtgcgctacactaagaaggtcccacaagtgagcactccaacgctggtcgaggtcagccgcaacctgggaaaggtggggtcaaagtgttgcaagcatccggaagccaagcggatgccttgcgcagaagattacctctccgtggtcctgaatcaactctgtgttctccacgaaaaaactccagtgtcggatcgggtcaccaaatgctgtaccgagtccctggtgaatcgcagaccgtgcttctccgctctggaagtggatgaaacctacgtcccgaaagaattcaacgcggaaacttttaccttccatgcggacatctgcaccctgtcggagaaggaacgtcagattaagaaacagactgcgctggtggagctggtgaagcacaagcctaaggcgactaaggagcagctgaaggccgtgatggacgacttcgcagcctttgtcgaaaagtgttgtaaggccgacgacaaggagacttgcttcgccgaagaaggcaaaaaactggtcgcggcttcgcaagccgccctcggtctg

SEQ ID NO: 249359 - DNA, 2007 bp, Artificial Sequence
  Description of Artificial Sequence: Synthetic coding sequence
atgaagtgggtgtcgtttatctcgctgctgtttctgttctcctccgcatactcaggaagccttgataagcgtcatggtgaaggaaccttcacttcggatgtttcatcctacctggaaggtcaagcagccaaagaattcattgcatggctggtcaaggggagacatggggaaggaacttttacttccgatgtttcctcttaccttgaaggacaagccgccaaagagtttatagcctggctcgttaagggaagagatgctcataagtccgaggtggcacacaggtttaaagacctgggcgaagagaatttcaaggcgcttgttctcattgcattcgcacagtatctccaacaatgtccctttgaggaccatgtcaagctggtgaacgaagttaccgaatttgcaaagacctgtgtcgcagacgaatcagccgagaactgcgataagagcctccatactctttttggagataaactgtgcactgtcgcaaccctgcgtgaaacttacggagaaatggctgactgctgcgcgaagcaggaaccagaaagaaatgaatgcttcctgcagcataaggatgacaaccctaacctgccacgtctggtgcgtcccgaggtggacgtgatgtgcactgcatttcatgataacgaagaaacttttctgaagaagtacctttacgaaattgcgcgcagacacccgtacttttatgctcccgagcttttgttttttgcaaagcgatataaggctgcattcacggaatgttgccaagccgccgataaggccgcatgccttctccccaaactcgatgaactgagagatgagggaaaggcatcctcggcaaaacaacggcttaagtgtgccagcctgcaaaagtttggggaaagagccttcaaggcatgggccgtggcccggctttcgcaacgctttccaaaggctgagtttgcagaagtgagcaagttggtcaccgatctgaccaaggtgcataccgaatgttgtcacggtgatttgcttgagtgtgcggatgatcgagcagatcttgcgaagtatatctgcgagaaccaagattccatcagctcaaagctgaaagagtgttgcgaaaaacccctcctcgagaaatcccattgtattgctgaggttgagaacgacgagatgccagccgatcttccatccctggcagcagacttcgtggagtccaaagacgtctgtaagaattacgccgaagctaaggatgtgtttctcggtatgttcctctacgaatacgcgcggagacatcctgattactccgtggtgctgctgctccggcttgcgaaaacgtacgagacgactctcgagaagtgttgcgccgctgctgatcctcacgaatgttacgcgaaggtgtttgacgaattcaaacccctcgtggaagaaccacagaatcttatcaagcagaattgtgagctctttgagcaacttggagaatacaagttccagaacgccctcctcgttagatacactaagaaggtcccacaagtctccactcccactcttgtggaagtgagcagaaacttgggcaaggtcggttcgaaatgttgtaagcatccagaagcaaagagaatgccatgtgcagaggactaccttagcgtcgtactgaatcaactttgtgtgctgcatgaaaagaccccagtgtccgacagagtcaccaagtgttgcaccgagagtctggtcaacagaaggccttgtttttcggcgctggaagtcgatgaaacctatgtgcctaaagagtttaacgctgaaactttcactttccacgccgatatttgcactctgtcagaaaaggagagacaaatcaagaagcagactgcccttgtggaactggtcaaacataagcctaaagccacgaaggagcagctcaaggccgtcatggatgactttgccgcatttgtcgaaaaatgctgtaaagcagatgataaggaaacctgctttgcagaagaagggaagaaactggtggcagccagccaggcagcacttggtctg

SEQ ID NO: 249360 - DNA, 2007 bp, Artificial Sequence
  Description of Artificial Sequence: Synthetic coding sequence
atgaagtgggtctctttcatcagcctcttattcctgttttccagcgcttactctgggagcctggataaaagacacggagagggtacattcactagcgatgtatcctcgtatttggaaggacaagctgccaaggaattcatagcctggctggttaagggcagacatggagagggtacattcacctccgatgtctcttcttatttagagggtcaggctgccaaagaatttattgcatggctggttaagggacgggacgcacacaagtctgaggtggcccacaggtttaaagaccttggcgaagaaaacttcaaggcactggtgctcatagccttcgctcaatacttgcagcagtgcccattcgaggaccacgtgaagctcgtgaacgaagttacagaattcgctaagacttgcgtggcagacgagagtgccgagaattgtgacaagtccctacacactctctttggagataagctgtgtaccgtagctacgctcagggagacctacggagagatggccgattgttgcgcaaagcaggaacccgagaggaacgaatgctttttgcagcacaaggacgacaatcccaatttgcccagactcgtccgccctgaagtcgatgtcatgtgcactgcatttcatgataatgaggaaacattcctgaaaaagtacctgtacgagattgcacgacggcacccttatttttatgcaccagagctgctcttttttgcaaagcggtataaggccgcatttacagagtgctgccaggcggctgataaggcggcctgtttgctccctaaactggacgagttgagagatgaggggaaggcttcgagcgccaagcagagattgaagtgcgcttccttacaaaagtttggtgagagggcgtttaaagcttgggcagtggctagacttagccaaaggtttcccaaggcggaattcgcagaggtctccaaactggtgactgaccttaccaaagttcacaccgaatgttgtcatggggatctgctcgaatgtgcagacgaccgcgccgatctggcgaagtatatttgtgagaatcaggatagtatcagctctaaactcaaagagtgctgtgaaaaaccactattggagaagtcacattgtattgcggaagtggaaaacgatgaaatgcccgccgatcttcctagcctagcagctgattttgtggagagtaaagacgtgtgtaaaaattacgcggaagccaaagatgtgtttctcggtatgtttctctatgagtatgctcgccgtcaccctgactatagtgtggtgctgcttcttagactcgcaaagacctacgaaaccacgttagaaaaatgttgcgcagccgccgatccccatgaatgttacgccaaggtgttcgatgaattcaaacccctggtggaggagcctcaaaaccttataaagcagaattgcgagctcttcgagcagctcggggagtacaagtttcagaacgcgttgctcgtgaggtacaccaaaaaggttccccaggtgagcacaccaactctggtggaagtctctcggaacctggggaaggtcggcagcaaatgttgcaagcacccagaggcaaagaggatgccgtgcgctgaagactacttatctgtggtccttaatcagttgtgtgtcctccacgaaaagacacctgtctccgatcgcgtaacgaagtgttgcactgagagtttagtcaacaggcggccctgtttctcagcactggaggtcgatgagacatatgtgcctaaggagtttaatgcagagactttcacctttcacgcagacatctgtacgcttagtgaaaaagagcgacaaatcaagaagcagactgcattagtggagctggttaagcacaagcctaaagcaaccaaagagcagctcaaggctgtgatggacgactttgccgcgttcgtcgaaaagtgctgcaaagcagatgacaaggaaacctgctttgccgaggaaggtaaaaagctagtcgccgcctcgcaggccgctctgggactc

SEQ ID NO: 249361 - DNA, 2007 bp, Artificial Sequence
  Description of Artificial Sequence: Synthetic coding sequence
atgaagtgggtgtctttcatctctctcctgtttttgttttcctccgcctattccggtagcttggataagaggcacggagagggcacttttacttccgacgtgagcagctacctggagggccaagctgccaaggagttcattgcctggctcgtcaagggtcggcacggcgaaggtacgttcacgtcagacgtctcgtcttacctggagggtcaggcagccaaggaattcatcgcttggttggtcaagggcagagatgctcataagtccgaggtggctcacagattcaaagatctgggggaggaaaacttcaaagctctcgtgctcatagccttcgcacagtacctgcagcagtgtccgtttgaggaccacgtgaaactcgtgaatgaggtgaccgaattcgcaaagacttgcgtcgccgacgagtccgcagagaactgcgacaagtcattgcacactctgttcggagataagttgtgcaccgtggccaccctgcgggaaacctacggagagatggccgactgctgtgccaagcaggaaccggagcgcaacgaatgctttctgcaacataaagacgataaccctaacttgcctcgcctggtccgtcccgaggtggatgtgatgtgtacggcgtttcacgacaacgaggaaactttcctgaagaaatacctctacgaaatcgctagacgccacccatatttctacgcgccagaactcctcttcttcgcaaagcgctacaaagcagcgttcaccgagtgttgccaggccgccgacaaggctgcatgccttctgccaaagctggacgaactgcgtgacgaagggaaagcaagcagcgcaaaacagcggctcaagtgcgcctccctgcagaagtttggcgaaagggctttcaaagcctgggccgtggccaggctgtcgcagagattcccgaaggcagaattcgcggaggtgagcaaattggtgactgacctgaccaaagtgcataccgagtgctgccacggcgatcttctggagtgtgccgatgatcgcgcagaccttgcgaagtacatctgcgaaaaccaggactctatctcctcgaagctcaaggagtgctgcgaaaaacctctcctggaaaaatcccactgcattgcagaagtggagaacgatgaaatgcctgcggacctgccgtcgctggcggcggattttgtcgaatcgaaggatgtgtgtaagaattatgcagaggcaaaggatgttttcctggggatgttcctgtacgaatacgctagaaggcacccggactactcggtagtccttttgctgagacttgccaagacctacgaaaccactctggagaaatgttgcgccgcggcggatccgcacgaatgctacgcgaaagtgttcgacgagttcaagccgctcgtcgaggaaccacagaatctgatcaagcagaattgtgaactgtttgaacaactgggcgagtacaaattccaaaatgcgctgctggtgcgctacacgaagaaggttccgcaagtgtcgactccgactctggtcgaggtcagccgcaatctgggaaaggtcggatcgaagtgttgcaaacacccggaagcgaagcgcatgccgtgcgccgaagattacctgtccgtcgtgttgaaccaactctgcgtgcttcatgaaaagacgccagtgtccgatcgcgtgaccaagtgctgcaccgagagcctcgttaaccgccggccctgcttttccgccctcgaagtggacgagacttacgtccccaaagagttcaacgcggaaactttcacctttcacgccgatatctgcaccttgtccgaaaaagaacggcaaatcaagaagcagacggcactggtggaattggtcaagcataagcctaaagcgactaaagaacagctgaaagcagtcatggacgacttcgccgcgttcgtagaaaagtgctgtaaggccgacgacaaggagacttgtttcgcagaagaagggaagaagctcgtggcggcctcgcaagcggctctgggcctg

SEQ ID NO: 249362 - DNA, 2007 bp, Artificial Sequence
  Description of Artificial Sequence: Synthetic coding sequence
atgaagtgggtgtcattcatctcactgttgtttctgttttcctccgcctacagcggaagcctggacaaacgacacggtgaaggcacgttcacctcggatgtgtctagctacctcgagggtcaagctgcaaaggagtttattgcctggctggtgaagggcagacatggcgagggtacttttacgtccgatgtgtccagctatctggaaggacaggccgcaaaagagtttatagcatggcttgtgaagggacgggatgcacataagtccgaggtggcacacagattcaaggacctcggtgaggaaaacttcaaagccctggtgctgattgcatttgcccaataccttcagcaatgtccctttgaagatcacgtcaagctggtgaatgaagtcacggaattcgcaaaaacttgtgtggcagacgagtcagcagaaaattgcgataagtcacttcatacgctgtttggagacaaactgtgtaccgttgccactcttcgagaaacttatggcgaaatggcagactgttgcgccaagcaagaaccagaacgtaacgaatgctttctgcaacataaggatgacaatcctaatctgcctaggctggtccgtcctgaagtcgatgtgatgtgcactgcattccatgataatgaagaaacctttctgaagaaatacctttacgaaattgcgagaaggcacccatacttctacgcacctgaactcctgttttttgccaagagatataaggcagcatttactgaatgctgccaggccgcagacaaggcagcttgtctgcttcccaagctcgatgagcttagagatgagggaaaggcatcctcggccaaacaacgcctcaagtgtgcaagtctccagaaattcggagaacgcgcattcaaggcctgggcagtggcgcgcctctcgcagaggttccccaaggctgaatttgccgaagtctcaaagttggtgactgacctgaccaaggtccacactgaatgttgtcacggtgacctgctggaatgcgccgacgatcgcgctgatctcgcaaagtacatttgtgaaaatcaagactcgatatcatccaaacttaaggagtgttgtgagaaaccactgcttgaaaagtcgcactgcatcgcagaggtggagaacgatgaaatgcccgcagaccttccctcgctggcggcggactttgtggaaagcaaggacgtctgtaagaattacgctgaagcgaaggatgtctttcttggaatgtttctttacgaatacgcacggcgccacccggactactcggtggtgctcctcctgaggcttgccaagacttacgaaaccactctggagaagtgctgcgccgctgcagatcctcatgagtgctacgcaaaggttttcgatgagtttaagccacttgtggaagagcctcaaaatctgatcaagcagaactgtgaactgttcgagcaactcggagaatacaagttccaaaatgcattgcttgtccgatatacgaaaaaggtgccacaagtgtccacgccgacgcttgtggaggtgtcacgcaaccttgggaaagtgggatcgaagtgttgtaagcacccggaggccaaaagaatgccgtgtgcggaagattacctgtccgtcgtgcttaatcaactctgcgtgctgcacgaaaaaactcccgtctcggatagagtgaccaagtgctgtaccgagagcctggtcaaccgcagaccctgtttctcggcattggaagtcgatgaaacttacgtgcctaaggaattcaatgcagaaacttttaccttccatgccgatatctgcaccctgtcagaaaaggagagacagattaagaagcaaactgcgcttgtggaactggtcaagcacaaacccaaggcaaccaaagaacaactgaaggccgtgatggatgactttgcagcctttgtggaaaaatgctgtaaggccgatgacaaggaaacgtgttttgccgaagagggcaagaaacttgtggcagcatcccaggctgcgctgggtctt

SEQ ID NO: 249363 - DNA, 2007 bp, Artificial Sequence
  Description of Artificial Sequence: Synthetic coding sequence
atgaagtgggtgagcttcatatcactcttgtttctgttcagctcggcctacagcggcagcctcgacaagagacacggggagggaaccttcacaagtgacgtgagctcgtacttagaaggccaggccgcgaaggagtttatcgcgtggctagttaagggtcgacacggcgagggtacatttacaagtgatgtatcgtcatatctggaggggcaggcggccaaagaatttattgcatggctggtcaagggccgcgatgcccacaagtcggaggtcgctcaccgattcaaggacttgggtgaggaaaattttaaggcgctcgtgttgattgcatttgctcaatacctccagcagtgcccctttgaagaccacgtcaagttagtcaatgaggtgaccgagttcgcaaagacctgcgtcgccgacgagagcgccgagaattgtgacaaaagtttgcatactctattcggagataagctctgtaccgtggctacacttagagaaacttatggtgagatggcagattgctgcgccaaacaggaacccgagcggaacgagtgcttcttacagcacaaagacgacaatccaaatctccctaggctggtgcgtccagaggtcgacgtcatgtgtacggcattccacgacaatgaagagaccttcctcaaaaagtatctgtatgagattgctcgtaggcacccctacttctatgcccctgaactcctcttttttgctaaacgatacaaagccgccttcactgaatgctgtcaagctgctgataaagccgcctgtttgctccctaagctggacgagttgcgagacgaagggaaggcctcatccgcgaaacagcgactcaagtgcgccagtctacagaaatttggagagcgggcgttcaaggcctgggcagtggcacggctgtcgcagcgatttcctaaagctgagtttgctgaggtgagtaagttggtcactgatttgactaaggttcatacagaatgctgtcacggtgacctgttggaatgcgcagacgatagggctgacttggctaaatacatatgtgagaatcaggattctatcagcagtaaactaaaagagtgttgtgagaagcctctcttggagaaatcccactgcatcgccgaagtcgagaacgatgaaatgcctgcagacctgcccagtctggctgccgatttcgttgagagcaaggacgtttgcaagaattatgcagaggcaaaagatgtctttttggggatgtttctatacgaatacgctaggagacacccagactatagcgtggttttgctgctgcgactggccaagacttatgagacgacccttgaaaaatgctgcgcagctgctgacccccacgagtgttacgcgaaggtctttgacgagttcaagcctctggtggaagagccccagaacctcataaagcagaattgcgagttgttcgagcaattgggcgagtacaaattccagaatgcattgttggtgcgctatactaaaaaggtgccacaggtttcaactccaactctggtggaggtcagtcgcaatctgggtaaagtgggatcaaagtgttgcaagcacccggaggcaaagcgaatgccatgcgctgaggactatctctcggttgtgctgaatcagctatgcgtactacacgaaaaaactcccgtgtcagaccgggtcacgaaatgttgcaccgaaagtttggttaatagaaggccgtgtttttctgccctcgaggtagatgaaacttatgtcccaaaagagtttaacgctgagacctttacctttcatgccgatatatgcacgctttccgagaaggagaggcaaattaaaaaacagactgctctggtagaactggtgaagcataaacctaaggcaaccaaagagcaactgaaggctgttatggacgatttcgccgccttcgtggagaagtgctgtaaggccgacgataaagaaacatgctttgcggaggaagggaagaagctggtggctgcttcacaagcggccctcggcctg

SEQ ID NO: 249364 - DNA, 2007 bp, Artificial Sequence
  Description of Artificial Sequence: Synthetic coding sequence
atgaaatgggtgtcgtttatcagcctgcttttcttgttctcaagcgcatactcaggatctctcgataagagacatggtgaaggaacgtttacttcagatgtgtcgagctatctggagggtcaggctgcaaaggagtttatagcctggctcgtcaaagggagacatggcgagggtactttcacgtctgacgtgtcgtcgtaccttgaaggacaggcggcaaaggaattcatagcttggcttgtgaagggtcgcgacgcacacaaatccgaggtggcacatagatttaaggatttgggagaagagaacttcaaggcattggtgctgattgccttcgcacagtaccttcagcaatgcccttttgaagatcatgtgaagctggtgaacgaagtgaccgaatttgccaagacctgtgtcgccgacgagtcagccgaaaattgcgataagtcccttcacaccctttttggagacaagctctgtaccgtggcgacgcttcgggaaacctacggcgagatggcagattgttgcgcgaaacaagaacccgaacgtaacgaatgttttttgcaacataaggatgataaccctaatctgccaaggctggtgcgccccgaagtggatgtgatgtgcaccgcatttcatgataacgaggaaacctttcttaagaagtacctgtacgaaatcgcaaggcggcatccatacttttatgcacctgaactgcttttcttcgcaaaacggtacaaagcagcctttactgagtgttgtcaggcagcagataaggcagcttgtctccttcccaaacttgacgagctccgggatgaaggaaaggcatcgtcggcaaagcaaagacttaagtgtgcttcactgcagaagtttggagaaagagctttcaaagcatgggccgtggcaaggctttcccaaagatttcctaaagcagaattcgcagaggtcagcaagctcgtcactgacttgactaaggtgcacactgaatgttgtcatggggacctccttgagtgtgcggatgacagagcagatcttgcaaagtacatttgcgaaaaccaagattccatctcatccaagttgaaggagtgctgtgagaagccactgctcgagaagtcccattgcattgcagaagtcgagaacgacgaaatgcctgccgacctgccctcactggcagcagacttcgtggaatccaaggatgtgtgtaagaattacgcggaagccaaggacgtctttcttggtatgtttctctacgagtatgccaggcgacatcctgactactcggtggttcttctgctgcggttggcaaagacctatgagacgacgctggagaagtgctgtgccgcagcagatcctcacgaatgctacgccaaggtctttgatgagttcaagccgctggttgaagaaccacaaaacctgattaaacaaaactgtgagctttttgaacagctcggcgaatacaaatttcaaaatgcacttctcgtgcgctacactaagaaagtgccccaggtgtcaaccccaacccttgtggaggtgtcacgaaatttggggaaggtgggatccaaatgttgcaaacacccagaggcgaagaggatgccatgtgctgaagattacctttcggtggttctcaaccaactgtgtgttcttcacgagaaaacgcccgtgagcgatagagtgaccaagtgctgcaccgaaagcctcgtcaatcggcgcccgtgtttctcagcactggaggtcgacgaaacctatgtgccgaaggagttcaacgcggaaacctttactttccatgcggacatttgtacgctttctgagaaagaacgacaaatcaagaagcagactgcacttgtggaacttgtgaaacacaagcctaaggcaactaaagagcaactgaaggcagtgatggatgactttgctgcattcgttgaaaagtgctgtaaagcggatgataaggagacttgtttcgcagaagaagggaagaagctggtcgcagcaagccaggctgccctcgggttg

SEQ ID NO: 249365 - DNA, 2007 bp, Artificial Sequence
  Description of Artificial Sequence: Synthetic coding sequence
atgaaatgggtcagctttatttccctgctgtttctgttctcaagcgcctattccggatcactcgataagagacatggcgaaggaacctttactagcgacgtgtcttcctatctggaaggtcaggcagccaaggaattcatagcctggctggtcaaaggccgacacggcgaaggcacattcacctccgacgtgagctcttacctggaggggcaggcggcaaaagagttcattgcatggctggtcaagggccgcgatgctcataagagcgaggtggcccatagatttaaggacctcggcgaagagaacttcaaagcattggtcttgatcgcttttgcccaatacctgcagcagtgtcccttcgaggaccacgtaaaactcgttaacgaggtgacggagttcgcaaaaacatgcgtcgccgatgaatcagcggagaattgcgacaagagcctccacacactgttcggtgataaactttgtactgttgcaaccctgagggagacttacggtgaaatggcggattgctgtgcaaaacaagaacccgagcgcaacgaatgtttcttgcagcacaaagatgataatcctaatttgcccagactcgtgagaccggaggtcgatgtcatgtgtactgcctttcacgacaatgaagagacctttctcaaaaagtatctctatgaaattgctagacgccacccgtacttttacgcgccagagctgctcttttttgccaagcggtacaaagctgctttcaccgagtgctgtcaggccgcagataaggctgcctgtctgttgcctaagcttgacgagcttagagacgaaggtaaggcctcaagcgctaagcagcggctgaagtgtgctagtctgcagaaatttggcgagcgggcattcaaggcatgggccgtagccagactgtcccagaggtttccaaaggccgagttcgcagaagtgagcaagcttgttacagacctcaccaaagttcacactgaatgctgccacggggacctgttggaatgcgccgatgacagagcagatctggctaagtacatctgcgagaatcaggacagcataagcagcaaactcaaagaatgttgtgaaaagccactccttgaaaagtctcactgtattgctgaggtcgagaacgatgaaatgccagccgacctccctagcctggcagctgatttcgtggagtccaaggacgtgtgcaaaaactacgccgaggccaaagatgtctttctgggaatgttcctctacgagtatgctagacggcaccccgactattctgtggttctgctgctcagactggcaaagacttatgaaacgacactcgagaaatgttgcgccgccgcagacccacatgaatgctacgctaaggtgttcgacgagttcaaacccttggtcgaggaacctcaaaacttgattaagcagaactgcgaactgtttgagcagctcggtgagtataagtttcagaatgccctgctggtccggtatacaaagaaggtcccccaggtatccaccccaacactcgttgaggtgtcaagaaatctgggaaaagttgggagcaagtgctgtaagcatcctgaggcaaagcggatgccttgcgccgaggactacctcagcgttgttctcaatcagctgtgtgtactgcatgaaaaaactccggtcagtgatcgggttaccaaatgttgcacagaatcactggtgaatagacgcccatgtttctctgctctggaagtagatgaaacttatgttcctaaagagtttaacgctgaaactttcacattccatgcagacatatgcaccctcagcgagaaggagcggcagataaaaaagcaaacagccctggtggaactcgtgaagcacaagcctaaggccaccaaggaacagttgaaggctgtgatggacgatttcgccgctttcgtagagaaatgttgtaaagctgacgacaaagaaacttgtttcgcagaggaaggcaagaaattggttgccgcttcacaggcggcactgggcctt

SEQ ID NO: 249366 - DNA, 2007 bp, Artificial Sequence
  Description of Artificial Sequence: Synthetic coding sequence
atgaagtgggtatccttcatctcactcctgttcctcttctccagcgcttacagcggctccctcgataaaagacatggtgagggcaccttcacctccgacgtgtccagctacctggaaggtcaagcggcaaaggagtttattgcatggctggtcaagggaaggcacggagagggaaccttcacctctgatgtatcatcctacctggagggtcaagcggcgaaggagttcatcgcttggcttgtgaaggggcgcgacgcgcacaaatccgaggtggcgcaccgctttaaggacctgggagaggagaacttcaaagctctggttctgatcgcattcgcccagtacctccagcagtgcccattcgaggatcacgttaagctcgtgaacgaagtgaccgaattcgcaaagacctgtgtggccgacgagagtgctgaaaactgcgacaagtcgctgcacacccttttcggcgataaactttgtactgtggcgactctccgcgaaacttacggagaaatggccgattgttgtgcgaaacaggagcccgagcggaacgagtgcttcctgcaacacaaggacgacaacccaaatctccctcgattggtccgccctgaagtcgacgtcatgtgcactgcgtttcacgacaacgaggagactttcctgaagaagtacctgtacgagatcgctcggcggcacccttacttctacgcaccagagctgcttttcttcgccaagagatataaggcggcattcaccgaatgctgtcaagctgcggacaaagccgcgtgcttgctccctaaactcgatgaactgagggacgaagggaaggcttcctccgcaaagcaaaggttgaagtgcgcgtcattgcagaaattcggagaacgcgcctttaaagcatgggccgtggcgagactgagccagcggttcccaaaggccgagttcgccgaagtttctaagctcgtcaccgatctgacgaaggtgcatacggaatgctgccatggcgatctcttggaatgtgctgatgaccgcgcggacctcgccaagtacatctgtgagaatcaggattcgatttcgagcaagttgaaagagtgttgcgaaaagccgttgctggaaaaaagccactgcatcgctgaagtggagaacgacgagatgcccgccgacttgccgagcctggccgcggacttcgtcgaatccaaagatgtgtgtaaaaactacgccgaagcaaaagacgtttttcttggcatgttcctgtacgaatacgctagacgccacccggattactcggtcgttctcctcctccgactcgccaagacttacgaaactactcttgaaaagtgctgcgccgccgcagatccgcacgaatgctatgccaaggtgttcgacgagtttaagccactcgtcgaggagccgcaaaatctgatcaaacaaaattgcgagctcttcgaacagctgggggaatacaagttccagaacgctctgctcgtcagatataccaagaaggtgccacaagtctccactccgaccctggtcgaagtgtcccggaacctcggaaaggtcggatcgaagtgctgtaaacacccggaggccaagaggatgccgtgcgccgaagattacctttccgtggtgctcaaccagctgtgcgtgcttcacgaaaaaaccccggtgagcgaccgggtgaccaagtgctgtacggaaagcctggtgaatcggcggccgtgcttttcagctctggaggtcgatgaaacctacgtgccgaaggaattcaacgcagagacgttcaccttccacgcagacatctgtactttgtcagagaaggagcgtcagataaagaagcaaactgctcttgtcgaactcgtcaagcataaaccgaaggccaccaaggaacagctcaaggcggtgatggacgacttcgcggccttcgttgagaaatgctgcaaggccgacgataaagaaacttgcttcgctgaagagggcaagaagctcgtggcggcgagccaagcagccctcggactc

SEQ ID NO: 249367 - DNA, 2007 bp, Artificial Sequence
  Description of Artificial Sequence: Synthetic coding sequence
atgaaatgggtgtccttcatttccctcctgttcctgtttagctcggcctactcgggcagcctagataagcggcacggagagggaaccttcacctcagatgtgtccagttatctggagggtcaggcagcaaaggagttcatcgcctggcttgtgaagggcaggcatggcgagggcacctttacctcggacgtctccagctacctcgagggtcaggccgccaaggagttcatcgcttggctggtgaagggtcgcgatgcacataagagcgaagttgcccaccgattcaaagaccttggcgaggagaacttcaaagcgctggtcctgattgcatttgcgcagtacttgcagcagtgtccattcgaggaccacgttaagttggttaacgaggtgaccgagtttgccaagacctgcgttgctgacgaatccgccgagaactgtgacaagagcctccacaccttgttcggtgacaagctctgcaccgtggcgaccctacgcgagacctacggtgagatggccgattgctgcgcgaagcaggaacccgaaaggaatgaatgcttcctgcagcacaaggatgacaacccgaatctccctcgtctggtcaggccagaggtggacgtgatgtgcactgcttttcacgacaacgaagagaccttcctcaagaaatacctgtacgagatcgcacgtcgccatccgtacttctacgctccggagcttctgttcttcgcgaagcgttacaaagccgcgttcactgagtgctgccaggctgctgataaggctgcttgcctccttcccaagctggatgagctgcgtgacgaggggaaagcgtcctccgctaagcaaaggctgaagtgtgcgtcgttgcagaaattcggagaacgtgccttcaaggcctgggccgtcgcccggctgtcccagcgcttccccaaggcggagttcgccgaagtttcgaagctcgtgacagatctaaccaaggtccataccgagtgctgccacggcgacctgctggagtgcgccgacgatcgcgccgacctggccaagtacatctgcgagaaccaggattccatcagctccaagctcaaagagtgctgcgaaaagccccttcttgaaaaaagccactgcatcgctgaggtggagaatgacgagatgcccgctgacctcccctcgttggccgccgattttgtcgaatccaaagatgtctgcaagaactacgccgaggccaaggatgttttcctcggaatgttcctctacgagtacgcccgacggcatccggattactccgtggtcctgttgttgcgtctcgccaagacctatgagaccaccctcgagaaatgctgcgcggctgccgatccacacgagtgctatgcgaaagttttcgacgagttcaagccgctcgtggaggagccacagaatctgatcaagcagaactgtgagctgttcgagcagttgggggagtacaagtttcagaacgccctcctcgtaagatatactaagaaggtcccacaggtctccacgcctacactcgtcgaggtttcccgcaatttaggtaaggtcggttccaagtgctgtaagcacccggaggccaagcgaatgccctgcgcggaggattacctaagcgtggtgctcaatcagttgtgcgttttgcacgaaaagacccccgtcagcgatcgcgtgaccaagtgttgcaccgagtccctcgtgaataggcgtccttgcttctccgcgcttgaagtagacgaaacatatgtccccaaggaattcaacgctgagactttcaccttccacgcagatatttgcaccctcagtgagaaggaacgccagattaaaaagcagacggccctggtggaactggtcaagcacaaaccaaaagcaaccaaagaacagctcaaggctgtgatggatgatttcgccgcctttgtggagaagtgctgcaaggctgacgacaaagagacctgcttcgccgaggagggcaagaagctggtcgctgcttctcaggccgccctgggcctg

SEQ ID NO: 249368 - DNA, 2007 bp, Artificial Sequence
  Description of Artificial Sequence: Synthetic coding sequence
atgaagtgggtatctttcatctcgctgctcttcctgtttagctcggcctactcgggatcgctcgacaagcgccatggcgaaggcaccttcacctcagacgtgtcgagctacttggagggtcaggcggctaaagaattcatcgcgtggctcgtcaagggcagacatggcgaaggaacctttacgtccgacgtgagcagctatttggaaggtcaggccgcgaaggagtttatcgcctggctcgtgaaaggaagggatgcacacaaatccgaagtggctcatcggttcaaggacctgggagaggagaacttcaaagcgctggtgctgatcgcgttcgctcagtacctgcagcagtgcccattcgaggatcatgtgaagctcgtgaatgaagtgactgagttcgccaagacttgcgtagcggacgaatccgcagaaaattgcgacaagagcttgcacactctgttcggagataagctctgcaccgtggcaaccctgagagaaacctacggcgaaatggccgattgctgtgcaaagcaagaaccggagaggaatgagtgtttcctgcagcacaaagacgacaatccgaacttgccgagattggtgcgcccggaagtcgacgtgatgtgtaccgcattccacgataacgaggaaaccttcctcaagaagtacctgtacgagattgccaggaggcacccatacttctacgcccccgagctgctgttcttcgcgaaacgctacaaggccgcgtttactgaatgttgtcaggctgcggataaggcggcttgcttgctcccaaaactggatgaactgcgggacgaagggaaggcctccagcgccaaacagcggctgaaatgcgcatcgctgcaaaagttcggcgaacgcgcattcaaggcatgggccgtggcacgcctcagtcagcggtttccgaaggcggaattcgcggaagtgagcaaactcgttaccgatctgaccaaggtccataccgaatgctgtcacggcgacctgttggagtgcgcagatgaccgggcggaccttgcgaaatacatctgcgagaatcaagactcgatttccagcaagctgaaggagtgctgcgaaaagccactgctcgagaagagccactgtatcgccgaagtcgaaaatgacgaaatgccagccgacttgccgtccctcgctgccgacttcgtggagtcaaaggatgtctgcaagaactatgcggaggcgaaggacgtctttctgggtatgtttctttacgaatacgcgcgcagacaccccgactactcagtggtcctgctgctgagactggcaaagacctacgagacgactctggaaaagtgttgcgccgccgccgatccacacgaatgttacgcaaaggtgttcgacgagttcaagcctctggtggaggagccccaaaatctgatcaagcaaaattgcgaactgttcgaacaacttggagaatacaaattccagaacgccctgctggtgcggtacaccaagaaagtcccacaggtgtcaaccccgaccctcgtggaagtcagccgcaacctgggaaaagtcggcagcaaatgctgcaagcatcctgaggctaagcggatgccttgcgcggaggactacctgagcgtggtgctgaaccaactttgtgtcctgcacgaaaagacgccagtgtccgatcgcgtgaccaaatgctgcaccgagagcctggtgaaccggcggccatgtttttcggccctggaagtggacgagacttacgtgccgaaagagttcaacgccgaaaccttcacgttccatgcagacatttgcactctgtctgagaaggagcggcagatcaagaaacagaccgcgctggtggaactcgtcaagcacaagcctaaggcaactaaggaacagctgaaagccgtgatggatgactttgcggccttcgtggaaaaatgctgtaaggctgacgacaaggaaacctgttttgccgaggaaggtaagaagctcgtggcagcctcacaggcggctctcggattg

SEQ ID NO: 249369 - DNA, 2007 bp, Artificial Sequence
  Description of Artificial Sequence: Synthetic coding sequence
atgaagtgggtttctttcatctcactcctgttcctgttctcctcggcctactccgggagcctggacaagagacacggcgaaggcactttcacgtccgacgttagctcctacctcgagggccaagccgccaaggagttcatagcgtggttggtgaaaggcagacatggagaaggcaccttcacctctgatgtctcgtcatacctcgagggacaagcggcgaaggagtttatcgcctggctggtgaagggacgcgacgcccacaaatcagaggtggcacataggttcaaggatctgggagaggagaatttcaaggccctcgtgctgatcgcgttcgcccagtacttgcagcagtgtccttttgaagatcatgtgaaactggtgaacgaagtgactgaatttgcaaagacctgcgtggcggatgagtccgcggagaactgcgacaaatcgcttcacaccctcttcggtgataagctctgtaccgtggccaccctccgagaaacttatggggagatggccgactgctgtgccaagcaggagccggaacggaacgaatgcttcctgcaacataaggacgataatccgaacctgccgagactggtccggccggaggtggacgtgatgtgcactgcattccatgacaacgaagagacttttctgaagaaatacttgtacgaaatcgcacgccggcacccgtacttttacgctccggaacttctgttcttcgccaagcgatacaaggcggccttcactgaatgctgtcaggctgccgacaaagccgcctgtctgctcccaaagctggacgagctgcgcgatgaaggaaaggctagctcagcaaagcagagattgaagtgcgcaagccttcagaagtttggggagagagcattcaaagcctgggctgtggctcgcctgtcccaaaggtttccaaaagctgagttcgccgaggtcagcaaacttgtgaccgacctgacgaaagtgcacaccgagtgctgtcacggcgatctgctggaatgcgctgatgatcgcgcagacttggccaaatacatttgtgagaatcaggactcgatctcctcgaaactcaaggagtgctgcgaaaagccgctccttgagaagtcgcactgcatcgccgaggtggagaacgacgaaatgccggccgaccttcctagcctggccgctgacttcgtcgaatctaaggacgtgtgcaagaattacgcggaggctaaggacgtttttctgggcatgttcctgtacgagtacgccaggcggcatcccgattacagcgtggtgctcctgttgaggctcgcaaaaacttatgaaactactttggaaaagtgctgtgccgccgccgatccgcacgaatgctatgcaaaagtctttgatgagtttaaaccgcttgtggaagagccccaaaacctcatcaagcagaattgcgaattgttcgagcagctgggagaatacaagttccaaaacgcgttgctcgtgcgctacactaagaaggtgcctcaggtttccactccaactctggtggaggtttcgcggaatctgggtaaggtgggatccaagtgctgcaagcacccagaagcgaaacgcatgccatgtgcggaagattaccttagcgtggttctcaaccagctgtgcgtcctgcatgaaaagaccccagtctcggacagagtgaccaagtgctgtacggaatccctggtgaaccgccggccgtgtttttctgccctcgaagtcgacgaaacctacgttccaaaggaattcaacgccgaaaccttcaccttccatgccgacatctgcaccctgagcgagaaggagcggcagattaagaaacagaccgcgttggtggagcttgtgaagcacaagccgaaagcaaccaaggaacagctgaaagcagtcatggacgattttgcagcttttgtggagaagtgttgcaaagccgatgacaaggaaacttgtttcgcggaggaaggaaagaaactcgtcgcggcgtcgcaagcggctctgggtctt

SEQ ID NO: 249370 - DNA, 2007 bp, Artificial Sequence
  Description of Artificial Sequence: Synthetic coding sequence
atgaaatgggtaagcttcatctctctgctgttcctgttctccagtgcatatagcggatccctggataaacgtcatggtgaaggtacctttacgagcgatgtatcttcctatctggagggacaagctgcaaaagagtttatcgcttggttggtgaaagggcggcatggcgaaggcacattcacatctgatgttagctcttatctcgaaggccaggcagccaaggaatttatcgcgtggcttgtgaagggtcgcgatgctcacaagagcgaggtcgcccatcggtttaaagatctgggagaggaaaactttaaggctttggtccttatagctttcgcacagtacctgcaacaatgtccgtttgaggatcacgttaaactggtgaacgaagtgactgagtttgctaagacttgtgttgccgatgaaagcgcagaaaactgcgataaatcactgcacaccctttttggggataaactatgcacagtggccactctgcgggagacttacggagagatggctgactgttgcgcaaaacaagaaccagagagaaacgaatgctttttgcagcataaagatgataacccaaacttgccgcgactcgtccgtcctgaggtcgacgtcatgtgcaccgcgttccacgacaacgaagagacttttctgaaaaagtacttgtatgagattgctagaaggcacccttatttttatgcgcccgaattgttattctttgcaaaaagatataaagccgcctttaccgagtgttgtcaggccgcagacaaggctgcatgcttactccctaagcttgatgaacttcgggacgagggcaaggcctcgagcgccaaacagcggctcaagtgcgctagcctgcaaaagttcggcgagcgagcctttaaggcctgggcagtggccagattaagccaaagatttccaaaggccgaatttgcagaagtgtcaaaactggtcaccgacctcacgaaagtgcacactgaatgctgtcacggtgacctgctggagtgcgccgacgacagggcagacctggctaaatacatctgtgaaaaccaggatagtatctcgtctaaattaaaagagtgctgcgaaaaacctctcctggaaaagtctcattgtattgccgaagttgaaaacgatgagatgcccgccgatctgccatctcttgcagctgattttgttgagagtaaggacgtatgtaaaaattatgcagaagccaaagacgtgttcttgggaatgtttctctacgaatacgctcggcggcacccagattatagtgtagtgctcttgcttagactcgcgaagacgtacgaaaccactctggagaaatgctgtgcagcggctgatccccacgagtgttacgccaaagtttttgatgagttcaagccactggtagaggagcctcagaacttgatcaaacagaattgcgaactcttcgaacaactcggcgaatacaagtttcagaatgcactgctggtccgatacaccaaaaaagttcctcaggtgtctactccaactctggtcgaagtgagtcgtaaccttgggaaggtgggcagtaagtgttgcaaacatcctgaggctaagaggatgccatgcgccgaagactacctgtccgtcgtcctgaatcagctttgtgtgctacacgaaaagacaccagtctccgatcgggttacaaagtgctgtacagaaagcctcgtcaacagaagaccgtgctttagcgccctggaggtcgacgaaacatacgtccctaaagagtttaacgcggagacgtttacatttcacgccgacatttgcactctgagtgagaaagagaggcagataaagaaacaaaccgcacttgtcgaactggtgaaacacaaacctaaggctacaaaagagcagctgaaggctgtgatggatgacttcgccgcttttgtagaaaaatgctgtaaggcagacgataaagagacctgcttcgctgaagagggaaaaaaactggttgcagcaagccaggccgccctaggcctg

SEQ ID NO: 249371 - DNA, 2007 bp, Artificial Sequence
  Description of Artificial Sequence: Synthetic coding sequence
atgaaatgggtttcattcattagcctgctgttcctgtttagcagcgcatactccgggtcgctcgataagcgccatggtgaaggtaccttcacaagcgatgtttcgtcatatttggagggacaagcagcaaaggagtttattgcttggctagtcaagggcagacatggcgaggggacgttcactagtgatgtgagttcctatctcgaaggacaggcggccaaggaattcatcgcttggttggtcaaggggcgagacgcgcacaaatccgaggtggctcatagatttaaggaccttggtgaggagaattttaaagcgctggtcttgattgcttttgcgcagtacttgcagcagtgccctttcgaggatcacgtgaagttagttaacgaagttacggagtttgcgaaaacttgcgtggccgacgaaagtgccgagaattgcgacaaatcccttcatactttgttcggcgataagctgtgcaccgttgcgaccctccgggagacatacggagagatggctgactgctgtgcgaagcaggaaccagagcgaaacgagtgctttcttcagcacaaggatgataatccgaatctcccacgactagtcaggcccgaggtcgacgtcatgtgtacagcttttcatgacaacgaggaaacattcctcaagaaatatttgtacgaaattgcccgccgtcatccttacttctatgcccctgagctgctgttcttcgcaaagcgatataaggctgcatttaccgaatgttgtcaagctgccgataaggccgcttgtctcctgcctaagctggatgagcttcgggatgagggtaaagcgtcatctgctaaacaacgtctgaagtgtgctagtctccagaagttcggtgagagggcattcaaggcctgggccgtggcgcgtttgagtcagcgcttcccaaaagctgagttcgcggaggtcagcaagttggttactgatcttacaaaggtccacacagagtgttgccacggcgatcttctcgagtgtgctgatgaccgcgcagacctcgcaaagtacatatgcgagaatcaggactctatcagcagcaaattgaaggaatgttgtgagaaacctcttctggagaagtcgcattgcattgcggaagtggaaaacgatgagatgcctgcagaccttccttccctggcggcggacttcgttgagagcaaagacgtctgtaagaattacgcagaagcgaaagacgtttttctgggcatgttcctgtatgagtacgcaaggcgtcacccagattactcggtggtcctactcctaagactcgcgaagacatatgaaacgacactcgaaaagtgttgtgccgctgcagatccacatgaatgttacgcaaaggtcttcgatgaatttaaaccactcgtggaggagccacagaacctcattaagcagaattgcgagcttttcgagcaacttggagagtacaagtttcagaacgcgctattggttagatacactaagaaggtgcctcaggtgtcaacccctacactggtcgaagtatcacgaaacctcggaaaagtaggttcgaagtgctgtaagcaccccgaggctaagcgtatgccctgcgctgaagattatcttagcgtcgtcctcaatcagctgtgtgtcctccatgagaaaacgcccgtctctgatcgtgtcacaaagtgctgtacggagtccttggtgaacagacgcccttgcttcagtgcgctggaggtggacgaaacttatgtaccgaaagaattcaacgccgaaaccttcacatttcacgccgatatatgcactctgagtgagaaagagcgacaaatcaagaagcagacagctctcgtagaacttgttaaacataaaccaaaggccacaaaggaacagcttaaggctgttatggacgacttcgccgcattcgtggaaaagtgttgcaaggccgatgataaggagacgtgtttcgccgaggagggaaagaaactcgtagcggcttcacaagccgccctcggtctt

SEQ ID NO: 249372 - DNA, 2007 bp, Artificial Sequence
  Description of Artificial Sequence: Synthetic coding sequence
atgaaatgggtgtcctttatctcgctgctttttctgttttcatcggcatacagcggatccctggataagcgacacggagagggtactttcaccagcgacgtcagttcttacctcgaaggccaagcagcaaaggaattcatcgcatggcttgttaagggtagacatggcgagggtacctttaccagcgatgtgtcgtcatacctggaagggcaggccgcgaaagagtttatcgcatggctggtcaagggacgtgacgctcataagtccgaagtcgcacataggtttaaagatcttggtgaagaaaactttaaggcgcttgttcttatcgcgtttgcacaatatctccagcaatgccctttcgaagatcatgtgaagttggtcaacgaagttaccgaatttgcgaaaacctgtgtggctgacgaatcagcagaaaactgcgacaagtcgctccacaccctgttcggggataagctgtgtactgtggcaactcttcgtgaaacctacggagagatggctgattgttgcgcaaaacaggaacccgagcggaatgagtgtttcctgcagcataaggacgataatcctaacctcccgcgcctcgtgcgcccggaagttgatgtcatgtgcactgcatttcatgacaatgaagagacgttcctcaaaaagtacctgtacgaaatagcaagacgccacccatacttctacgccccagaactgctgttctttgccaagcgctacaaggcagcgtttaccgaatgttgtcaggcagccgacaaggcagcttgtctcctgcctaagctggatgagctgcgggatgaagggaaagcaagctccgctaaacaacgcctgaagtgcgcatcgcttcaaaagtttggagaaagagcctttaaagcgtgggccgtggcgaggctgtcccagcgatttcctaaggcagaatttgcagaagtgagcaaactcgtgacggatctgaccaaggtgcacaccgaatgttgccatggtgacctgctggaatgtgcggatgatcgagctgatcttgcaaagtacatatgcgaaaaccaagacagtatttcgtcgaaattgaaagagtgttgcgaaaagcctctgctcgaaaagtcgcactgtattgcagaagtggagaatgatgaaatgcccgcagaccttccatcacttgccgcagactttgtggaatcgaaggacgtctgcaagaactacgcagaagccaaggatgtgtttctgggtatgttcttgtacgagtacgcccgtagacacccggactactccgtggtgctgcttctgagactcgcaaagacgtacgaaactactcttgagaaatgttgtgcggcagcagatcctcatgaatgctacgcaaaggtgtttgacgagtttaaacctctcgtcgaagaaccacagaacctcataaagcaaaattgtgagttgttcgagcaactgggagagtacaagttccaaaatgcactgcttgtcagatataccaagaaggtgccacaggtgagcactccaaccctcgtggaggtgtcgcgcaacttgggaaaggtgggctcaaagtgttgcaagcatccagaagcgaagcgcatgccttgtgccgaggattacctttctgtggtgctgaatcagctttgcgtcttgcacgaaaagacccctgtatctgatcgggtgactaaatgttgtaccgagtctcttgtgaacagacgaccatgcttttcggcattggaggtcgatgaaacttatgtgcccaaggaattcaacgcggaaacgttcacttttcatgcagatatatgtaccctctcggagaaagagaggcaaatcaagaagcaaactgctctggtggagctcgtgaagcataaaccgaaagctactaaggaacaacttaaggcagttatggacgacttcgccgcattcgtagagaagtgttgtaaagcggatgacaaggagacgtgtttcgcagaggaaggaaagaagctcgtcgctgcatcacaggcagcactcggtctt

SEQ ID NO: 249373 - DNA, 2007 bp, Artificial Sequence
  Description of Artificial Sequence: Synthetic coding sequence
atgaaatgggtaagctttatctctctgctgtttttgttcagttccgcttattctggctcactggacaagcggcacggcgaggggacgttcacttcagatgtgagtagctatctggagggtcaggcggccaaggagtttatagcgtggttggtgaagggccgccacggcgaaggaacctttaccagtgatgtgtcgtcctacctcgagggtcaggccgcgaaggaattcattgcgtggctggtcaaggggcgggacgcccacaagtcagaagttgcgcaccgctttaaagatctcggcgaggagaatttcaaggctctggtacttattgccttcgctcagtatttgcagcagtgtccattcgaggaccacgttaaactggtgaatgaggtgacagaattcgcaaagacatgcgttgccgacgaatcggctgagaactgcgacaaatcccttcatactctgttcggtgacaagctttgcacagttgccaccttacgagagacttacggcgagatggctgactgttgtgcgaagcaggagcccgaaagaaatgaatgttttctccagcacaaggacgataaccccaacctgcccagactggttcgtccggaggtcgacgtcatgtgtaccgcctttcatgataacgaggagacatttctcaaaaagtatctttacgagattgcacggcgtcacccctacttttatgctcccgaactgttgttctttgccaagaggtataaagctgccttcactgagtgttgccaggcggccgataaggccgcctgtctcctgccgaagcttgatgaactgcgcgacgagggaaaggctagttcagctaaacagaggctgaaatgcgcaagtttacaaaagttcggtgaaagagcttttaaggcttgggccgtggcgagattgtcccagcggtttcccaaggctgagttcgccgaggtttctaaactagtgaccgatctcaccaaagtccacactgagtgctgccatggcgacttattggagtgcgccgacgaccgagctgacttagccaaatatatttgcgaaaaccaggactcaatttcaagcaagctaaaagagtgctgtgaaaaaccgttactagaaaagtcccactgtatagcagaggtggagaatgacgaaatgcctgctgatctgccgtccctcgccgccgacttcgtggagagtaaggatgtttgcaagaactatgcggaagctaaggacgtgttcctgggcatgttcctgtatgagtacgcgcgccgacaccctgactacagcgttgttttactgctgaggctggccaagacctatgagaccactctcgagaaatgttgcgcagccgccgacccacacgagtgttatgccaaagtattcgatgagtttaaacctctagtggaggagccacagaatctcatcaaacagaattgcgagctgttcgagcagctcggagaatataagttccaaaacgcgctcctggtccgctataccaagaaagtgccccaggtttccacgccaaccctggtggaggttagccgcaaccttgggaaagtgggctccaaatgctgtaagcatcctgaggctaaacgtatgccatgtgccgaggactacctgagcgtagtcttaaaccaactctgtgtcctccatgagaaaactccagtgtccgacagagtcaccaagtgctgtacagagagcctggttaataggaggccctgcttttcagctctggaagtggacgaaacctacgtgccgaaagagttcaacgctgagaccttcacttttcatgccgacatatgtaccctcagcgagaaggagcggcagattaagaaacagacagctctggtggaattggtgaaacacaagcctaaggcaactaaggaacagttaaaggccgtcatggacgacttcgcagcattcgtggagaaatgctgtaaagctgatgataaagagacgtgcttcgctgaggaagggaaaaagctggtagcagcatcacaggctgctctgggactt

SEQ ID NO: 249374 - DNA, 2007 bp, Artificial Sequence
  Description of Artificial Sequence: Synthetic coding sequence
atgaagtgggtgtcattcatcagtctgttgtttctcttctcttcagcctattcaggttcacttgacaaaagacatggagaaggtacttttacgtccgacgtttctagttatcttgagggtcaggcggctaaggaatttattgcctggctggttaagggtaggcacggggagggtacattcacttcggacgtttcttcctatcttgagggccaagctgctaaagaattcatcgcttggctggtaaaaggaagggacgcgcataagagtgaagtcgcacataggtttaaagatctcggtgaagaaaacttcaaagctctcgtgcttattgccttcgcacaatacctgcagcagtgcccattcgaggatcatgttaaattggttaatgaagtgacagagtttgctaagacttgtgtggcagacgagtcggccgagaattgcgataagtcgctccatacactctttggtgataaactatgcactgtcgcgacgctcagagaaacatatggtgagatggcagactgctgcgctaaacaggaaccggagaggaatgagtgctttcttcaacataaggatgataatccaaatttgccacggctcgtcaggcctgaagtcgacgttatgtgcactgcctttcatgataatgaggagacctttttgaagaaatatctatatgaaattgcgcggcgacatccctacttctacgctcccgaactcctgttctttgcgaaaagatataaagcagcttttacggaatgctgtcaggctgcagataaggctgcttgccttcttccaaagctggatgagttaagggatgaaggcaaggcgtcttcggccaagcagcgcttgaaatgtgcttcactgcagaagttcggtgagagggcatttaaagcttgggctgtggcacgcttgtcccaacgtttccccaaggctgaatttgctgaggttagcaaattagttacggacttaactaaagtccacactgaatgctgccatggagatcttctcgaatgcgctgacgacagagccgacctggctaaatacatatgcgagaatcaggattctatcagcagcaaattgaaggaatgttgtgaaaagccacttctcgaaaaaagtcattgcatcgctgaagttgaaaacgacgaaatgccggcagatcttccttcgttggctgcagacttcgtagagtccaaggacgtttgtaagaattatgccgaagccaaggatgtatttttgggcatgtttctatatgaatatgcacgccgccatccagattactctgttgtcctcttgctgaggctggccaaaacatatgaaacgactctagagaagtgttgtgctgccgccgatccgcatgagtgctacgctaaagtctttgacgaatttaagccactcgtcgaggaaccacaaaaccttatcaagcaaaattgtgagctattcgaacagcttggggaatataagttccaaaatgcgttacttgttcgttataccaagaaggttcctcaagtttccactcccactcttgttgaagttagcagaaatctaggtaaggtagggtctaagtgttgtaagcaccctgaggcaaagcgtatgccctgcgctgaagattacctttcagtggtgctcaaccagttatgtgttctccatgaaaagacacctgtttccgaccgagttacaaaatgctgcactgagtctcttgttaacaggaggccttgcttcagcgcattagaggtggacgagacctacgtgccaaaagagtttaacgcagagacatttaccttccatgccgacatctgtactctgtccgaaaaagaaagacaaataaaaaaacaaacggctttggtcgaattggtgaaacataagccgaaggctaccaaggaacaattgaaggctgtgatggatgatttcgcggctttcgttgaaaagtgctgtaaagcggatgacaaagagacatgcttcgcggaagagggaaagaagttagtggcggcctcacaggcagcactcggactt

SEQ ID NO: 249375 - DNA, 2007 bp, Artificial Sequence
  Description of Artificial Sequence: Synthetic coding sequence
atgaagtgggtatcctttatcagcctgttgtttctgttcagctccgcatactctggtagtctggataagaggcacggagagggcacgttcactagcgacgtttcttcctatctggaagggcaagccgccaaggaatttatcgcttggcttgttaaaggtagacacggtgaaggcacgttcacgtcagacgtctcatcatatctggaagggcaggcagcaaaagagttcatcgcctggctggttaagggtcgcgatgcccacaaaagcgaggttgcacatcgattcaaagacctgggtgaagagaattttaaagcactggtgctgattgccttcgcacagtacctgcaacaatgtccgttcgaggaccatgttaagctcgtgaatgaagtcactgaatttgcgaagacttgtgttgccgatgaatccgctgagaattgcgacaagtctctgcacactctgttcggggataagttgtgcaccgtcgccacgctgcgcgaaacttatggggaaatggctgactgctgcgcgaagcaagaacctgagagaaacgaatgttttctgcagcataaggacgacaaccctaacctgccgcgactggtacgtccagaggtggatgtcatgtgtaccgccttccacgataatgaggaaacgtttctgaaaaaatacctctatgagattgctaggcgacacccatacttttacgcccccgagctgctgtttttcgctaaacgctacaaagcagcatttacggaatgctgccaggctgcagataaggctgcatgcttattgccaaaactagatgagctgcgggatgaaggcaaagctagctccgcaaagcagcgtctgaagtgtgccagcctgcagaaattcggcgagcgcgccttcaaggcatgggccgtggcacgcctgagccagcggtttcctaaggcggagttcgccgaagtttcgaagctggttaccgatctgaccaaggtccataccgaatgctgccacggcgatttgctggaatgtgccgacgaccgcgctgatctggccaaatatatctgcgaaaatcaggatagcatttcgtctaagctgaaagaatgttgcgaaaaaccgctgctggaaaaatcccactgtattgcagaagtggagaacgatgaaatgccggcggatctgccgtcactggcggccgattttgtcgagagcaaagatgtctgcaaaaactatgctgaggcgaaagacgtctttctcggtatgtttctgtacgaatacgcccgccgccatcctgactattctgtggtgctgctactgcggctggcgaagacctacgaaacaactttagagaaatgttgcgcggcggcagacccgcacgaatgttatgctaaagtgttcgatgagtttaaaccactagttgaggaaccgcaaaacctcatcaaacaaaattgcgaattgttcgaacagctgggcgaatataaatttcagaacgcattgctggtccgatacaccaaaaaggtcccacaggtgtccacccctactctggttgaagtcagccgcaatttaggtaaagtcggctccaaatgctgcaagcaccctgaggcaaagcgtatgccgtgtgcagaagactatctgagcgtggtgctgaaccagctgtgtgtgctgcatgagaaaacccctgtttccgatcgcgtgaccaaatgttgtactgagtcactggttaaccgacgcccttgcttttccgcgctggaagtggacgaaacctatgttcccaaggagttcaatgcagaaacgttcacctttcacgcggatatatgtacgctctccgagaaggaacgccaaattaagaaacagactgccttggtggagctggttaagcacaaacctaaggctactaaagaacaactgaaggcggtgatggacgatttcgcggcttttgtcgagaagtgctgcaaggcggatgataaagagacgtgttttgcggaagaggggaaaaaactcgtcgccgcctctcaagcggcactgggactg

SEQ ID NO: 249376 - DNA, 2007 bp, Artificial Sequence
  Description of Artificial Sequence: Synthetic coding sequence
atgaagtgggtttcctttatctcactgctgttcctgttctcctcggcatactcgggatcgctggacaaacgccatggtgagggaaccttcaccagcgatgtctcttcgtacctggaaggacaggccgccaaagagtttatcgcgtggctggtgaagggacgccacggcgaggggacctttacttcggacgtgagctcgtacctggaggggcaggctgccaaggagtttattgcatggctggtcaagggccgcgatgcccataagtcagaagtggcccacagattcaaggatctgggagaggagaactttaaagctctcgtcctgattgccttcgcccagtacctgcagcagtgcccattcgaggaccacgtgaagctggtgaatgaggtgactgaatttgccaagacctgtgtggccgacgaaagcgccgaaaattgcgacaagtcactccacacgctctttggagataagctctgcaccgtcgctactctgagagaaacgtacggagaaatggccgattgctgcgcaaagcaggaaccggaaaggaacgagtgtttcctgcaacataaggacgacaatccgaatcttcccaggctggtgcggcctgaggtggatgtcatgtgtacggctttccacgataacgaagaaactttcctcaagaaatacctgtatgaaatcgccaggcgacatccatacttttacgcgccagaattgctgttcttcgcgaagcggtacaaggctgcgttcaccgaatgctgccaagccgccgataaggccgcctgccttctgcctaagctggacgaactgcgcgatgaaggtaaagcgagcagcgcaaagcagagactcaagtgcgcttccctgcagaagtttggagaacgcgccttcaaggcctgggcggtcgcccggctgtcccagagattcccgaaggcggagtttgccgaagtctccaagctggtgaccgacctgactaaggtgcacacggaatgctgtcatggagatctcctggaatgcgcggacgatcgggcggatctggcaaaatacatatgcgagaaccaagattccatcagctcgaagctgaaggagtgttgtgaaaagccactgctcgaaaagagccattgcattgccgaggtggagaacgacgagatgccggcggatctgccatcgctcgcagcggattttgtggagtcgaaggacgtgtgtaagaactacgcggaggcaaaagatgtgttcctggggatgttcctctacgagtacgcgcgccggcatccagactactccgtcgtcctgctcctgagactggccaagacgtatgagactacgcttgaaaagtgctgcgcagcggccgacccacatgaatgttacgcgaaagtgttcgatgaattcaaaccgctcgttgaggagccacaaaacctcatcaagcaaaactgcgagctgttcgagcaactcggagagtataagttccaaaacgccctgctggtccggtacaccaagaaggtcccacaggtgtccactccaaccctggtcgaggtcagcagaaatctgggaaaggtgggaagcaagtgctgtaagcaccctgaagcaaaaagaatgccttgcgccgaagattatcttagcgtggtgctcaaccagctgtgcgtcctgcacgaaaagactccggtgtcggaccgcgtgaccaagtgctgtaccgagtcactggtgaatcggcggccatgcttctcggctttggaggtggacgaaacctacgtgccgaaggaattcaacgcggagactttcactttccatgccgatatttgcaccctgtccgaaaaggaaaggcagatcaaaaaacaaaccgcacttgtggaattggtcaaacacaagccgaaggctacgaaggaacagcttaaagctgtgatggatgacttcgccgctttcgtggaaaaatgctgtaaggcggacgacaaggagacttgctttgcggaagagggcaagaaactcgtggccgcatcacaagcggccctgggactg

SEQ ID NO: 249377 - DNA, 2007 bp, Artificial Sequence
  Description of Artificial Sequence: Synthetic coding sequence
atgaagtgggtcagctttatctctcttcttttcctgttctcctcagcatactcgggctcactcgataagagacacggtgaaggtacgtttacgtcggatgtgtcgtcgtaccttgagggacaagcggcgaaggagtttattgcatggcttgttaaaggtagacacggagaggggacttttaccagcgacgtgtcctcatacctggagggacaggccgccaaggaattcatcgcctggttggtgaagggaagagatgcccataaatcggaagtggcacatagattcaaggacttgggggaagagaatttcaaggcgctcgtgctgatagcatttgcacaataccttcagcaatgcccatttgaagatcatgtgaaacttgtgaatgaagtgacggagtttgctaagacctgtgttgcagacgaatccgcagaaaattgcgataaaagcctgcacacgctgtttggtgataaactctgtaccgtggccaccctgcgggaaacgtatggagaaatggcggattgttgcgcgaaacaagaacctgaacggaatgaatgtttccttcaacataaggatgataaccccaacctcccaagactcgtgaggccagaagttgatgtcatgtgcactgccttccacgataacgaggaaacttttcttaagaagtacctctacgaaattgcaagaaggcatccatacttttacgcaccggaactgctcttttttgccaagagatacaaggcagcatttactgaatgttgccaagcagcggataaggcagcctgtctgcttcccaagctggacgaactgcgcgacgagggcaaagcatcaagcgcaaagcaacgtcttaagtgtgcgtctcttcagaagttcggagaaagggcgtttaaagcatgggcggtggcacggctctcacagcggtttcctaaggcagaatttgctgaagtgtccaagctcgtcactgatttgaccaaggtgcacaccgagtgttgccacggcgacctcctggaatgtgcagatgacagggcagaccttgcgaagtacatttgcgagaaccaagattcgatttcatcgaagctgaaagaatgttgcgagaagccacttctggaaaagagccactgtattgccgaggtggaaaatgacgagatgccagcagatctcccttctctggcggccgatttcgtcgagtcgaaggacgtttgtaagaattacgcagaggctaaggacgtgttcctgggcatgtttctctatgaatacgctcgaaggcaccctgattacagcgtggtgttgcttcttaggctggcaaagacttatgaaactacgctggagaagtgctgcgcagccgccgaccctcacgagtgttacgcaaaagtgtttgacgaattcaagcctctcgtggaagaacctcagaaccttatcaaacaaaattgtgagttgttcgagcaactgggagaatacaagttccagaacgcactgctggtgcggtacaccaagaaggtccctcaggtgtcgacccccactctggtcgaagtctcgcggaacttgggaaaggtcggaagcaagtgttgtaaacatccagaggcgaagcgaatgccttgtgctgaggattacctgagtgttgttttgaatcagctgtgtgtgctgcacgaaaagacccccgtgtcagacagagtcaccaagtgctgtactgagagccttgttaaccggcgcccctgcttctcagcccttgaagtcgacgaaacttacgtgcccaaagagtttaacgcggaaacttttacgttccatgccgacatttgtaccctgagcgaaaaggaacgccaaatcaagaagcaaaccgcgcttgtggagctggtgaagcacaaacctaaggctactaaagagcagcttaaagcggtgatggacgacttcgcagcattcgtggaaaaatgctgcaaagctgatgataaggaaacttgcttcgcagaggaggggaaaaagttggtggctgccagccaggcagcgctcggcctc

SEQ ID NO: 249378 - DNA, 2007 bp, Artificial Sequence
  Description of Artificial Sequence: Synthetic coding sequence
atgaagtgggtatcgttcatttctttgctcttcctattctcgagcgcttattccgggtctctagacaagaggcacggagagggcacatttacctctgatgtgtcgtcatacctggagggtcaggctgccaaggagtttatcgcctggctcgtaaagggtcgacatggcgagggcacgttcacaagtgatgtctcttcctacctcgaaggccaagccgcgaaagagtttatcgcttggttggtcaaagggcgcgacgcccacaagtccgaggtagctcaccggtttaaggacctcggtgaggaaaattttaaggccctggtgctgatcgcgtttgcgcagtatctgcagcagtgcccctttgaagatcatgtaaagctagtcaatgaagtgactgagtttgccaaaacttgcgtcgccgatgaatcagcggagaactgtgacaagagcctgcatactttgttcggcgacaagctgtgtaccgtggcgacactccgagagacttacggtgaaatggccgactgttgtgccaagcaggagcccgagcggaacgaatgcttccttcagcacaaggacgataacccgaacctgccgaggctggttcggcccgaggttgacgtcatgtgtacagctttccatgataacgaagaaacctttctcaagaagtatctctacgagattgctcgtaggcacccttacttctatgctcccgaactgctctttttcgcaaagcgatacaaggccgccttcactgaatgttgccaggcggcagacaaggcagcgtgtcttctgcccaagttggacgaactacgcgacgagggtaaagcctcttctgcgaaacagagattgaagtgtgcttcactccagaaatttggtgagcgagctttcaaagcgtgggctgtagcacgcctatctcagcggttcccaaaagctgaattcgccgaagtctcgaagctcgtgacagatctaactaaggtgcacactgagtgctgccatggagacctcctagagtgcgctgatgatcgggctgatctggcaaagtatatctgcgagaaccaggacagtattagctcaaagcttaaagaatgctgtgaaaagcctcttttggagaaaagtcactgtatcgccgaggtggagaacgatgagatgcccgctgacctgccaagcctcgctgcggacttcgtagaaagcaaggatgtgtgcaaaaactacgctgaggctaaagacgtgtttctcggaatgttcctctatgaatacgcaagaaggcaccctgactattccgtcgtgctcctcttgaggttagcaaagacctatgagaccactttggaaaaatgctgcgccgccgcagatccccacgagtgctacgcaaaggtgtttgacgagttcaaacccctcgtcgaagagccacagaacctgatcaaacagaactgtgagctcttcgagcagttgggcgagtacaagttccagaacgctctccttgtgcgctataccaaaaaagtgccacaggtgagcacacctacactggttgaggtgtctagaaacctcggaaaggttggatccaaatgctgcaagcacccggaggccaaacggatgccatgcgccgaagactatctcagcgtcgtcctcaaccagctgtgcgtcctgcatgagaaaacacctgtgtccgatcgtgtgactaaatgttgcactgaatctctcgttaaccgccgcccctgcttcagcgctctggaggtcgatgaaacctatgtaccaaaagagttcaacgctgagacatttacgtttcatgctgatatttgtactttatctgagaaggaacggcagattaagaagcagacagccctcgtcgaattggttaaacacaagcctaaagctactaaggaacaattaaaagccgttatggacgactttgccgcgttcgtggaaaagtgttgtaaagcggatgacaaggagacatgcttcgctgaggaaggcaagaaactcgttgccgcctcccaggcagcccttggcctg

SEQ ID NO: 249379 - DNA, 2007 bp, Artificial Sequence
  Description of Artificial Sequence: Synthetic coding sequence
atgaagtgggtcagctttatctctctcctcttcctcttctcgtcagcttactccggatcactggacaagagacacggtgagggaaccttcacttccgacgtgagtagctacctcgagggtcaggccgccaaggaattcatcgcctggctggtgaaaggccgtcatggagaaggaaccttcacctccgatgtgtccagctatctcgaaggccaggccgctaaggagttcattgcgtggctggtgaagggacgggacgcacataagtccgaggtggctcatcggttcaaggacctcggagaggagaactttaaggcactggtgctgatcgctttcgctcaatacctgcaacaatgcccgtttgaagatcatgtgaagttggtgaatgaagtaactgagttcgctaaaacttgcgtcgcagacgagtcagccgaaaactgcgacaagtctcttcataccctcttcggcgacaaactgtgcactgtcgccaccctgagagaaacctacggggaaatggccgactgttgtgccaagcaggaaccggaacgcaatgagtgtttcctccagcacaaggatgataatccgaacctgccacgactggtgcgccctgaggtggacgtcatgtgcacggccttccatgacaacgaagaaaccttcctgaagaagtacttgtacgaaatcgcccgccgccacccttacttctacgccccggaactcctgtttttcgccaagcgttacaaggccgcgttcactgagtgttgtcaggccgcggacaaagccgcctgtctgctgcccaagctggatgaacttagagacgaaggaaaggcatcctcggccaaacagcggctgaagtgcgcgtccctccagaaattcggagagagagcttttaaggcctgggcagtggccaggctctcccaacgcttcccgaaagccgagtttgctgaagtcagcaagctggtgactgaccttaccaaggtgcacacggagtgttgtcacggagacttgcttgaatgcgcggatgaccgcgcagacctcgctaagtacatttgcgagaatcaagactcgatctcgagcaaattgaaggagtgttgcgagaaaccgcttctggaaaagtcccactgtattgccgaagtcgagaacgacgagatgcctgcagacctgccgagcctggctgcagacttcgtggaatccaaagacgtttgcaagaattacgcggaagccaaggatgtgtttctgggaatgtttttgtacgagtacgcaaggcggcatccagactactcggttgtgctgttgttgagactggccaagacctacgaaactacgctggagaagtgttgcgccgccgctgacccacacgaatgctacgcgaaagtgttcgacgagttcaagccgctggtggaggagccgcaaaacctcatcaagcaaaactgcgaacttttcgagcagctcggagaatacaagttccagaacgcactcctggtgcggtacactaaaaaggtgccacaggtttcgactcctaccctggtcgaggtgtcgaggaacctcgggaaggtgggcagcaagtgctgcaagcatccagaggcaaagaggatgccatgcgccgaagattacctctccgtcgtgctgaaccaactttgcgtcctccatgaaaagacgcctgtgagcgatagagtgactaagtgttgcactgaatcccttgtgaatcgcaggccgtgtttctcagccctcgaggtggacgagacttacgttcctaaggagtttaatgcggaaactttcacgttccatgccgatatctgcactctcagcgaaaaagaacgccaaatcaaaaagcaaaccgctctcgtggaactggtgaagcacaagccgaaggcgacgaaggagcagctcaaagccgtgatggatgactttgccgcgttcgtggagaagtgctgtaaggctgacgacaaggaaacctgctttgctgaagagggtaagaaactggtggccgcctcccaagccgcactcggattg

SEQ ID NO: 249380 - DNA, 2007 bp, Artificial Sequence
  Description of Artificial Sequence: Synthetic coding sequence
atgaagtgggttagctttataagccttctttttcttttctctagcgcttactcaggctctcttgataagaggcacggagaggggaccttcacaagcgacgtgagtagctaccttgagggacaggccgcaaaagaattcattgcctggctggtaaaagggagacatggggaggggaccttcaccagtgatgtatcatcctacctggaaggccaggcagctaaggaatttattgcctggctggtgaagggcagggatgcccataagagcgaagtggcccacagatttaaagatctcggagaggaaaacttcaaggccctggtgctgattgcctttgctcaatacctacagcagtgcccttttgaggatcacgtcaagctggttaacgaggtgactgagttcgccaaaacctgtgtggctgacgaaagtgctgaaaactgcgataaatcactgcatacactgttcggcgacaagctgtgtacagtggctactttgagggagacttacggcgagatggccgattgttgcgctaaacaggagccggagagaaacgaatgcttcctgcagcacaaagatgacaatccgaatttgccccggctggtgcgcccggaggtcgatgttatgtgcactgcttttcacgataatgaagagactttcctgaaaaagtacttgtacgagatcgcaagacggcacccatatttttacgctccagagctcctgttttttgctaagagatataaggctgctttcacagagtgctgtcaggcagctgataaagcagcgtgcctgttgcccaaactggatgagctccgtgacgagggtaaggcatcctcagccaagcagcggcttaaatgcgcctcacttcagaaattcggggagcgcgcctttaaggcctgggccgtcgcacggcttagccagcgtttccctaaggcggagttcgctgaggtgagcaaactagtaacagacctcacaaaagtgcacacagaatgttgtcacggcgatctgttggaatgtgccgatgatcgcgcagacctagctaagtacatttgtgaaaatcaggacagcatatcttccaaactgaaggagtgttgcgaaaagcccttgcttgagaagagccattgtatagctgaagtggaaaacgacgagatgcccgccgatttgcctagcctcgcagccgattttgttgagtcaaaggacgtgtgcaagaactatgcggaggccaaagacgtctttcttgggatgttcctgtacgagtacgcaagacgtcatccggattatagtgtggtactgttgctaaggctcgccaaaacatatgaaactaccctggagaaatgttgcgctgccgctgatccccacgagtgttacgccaaagtttttgacgagttcaagccgctggtggaggaaccgcaaaacctgatcaaacaaaactgcgaactatttgagcagctgggagagtacaagtttcagaacgcgctactggtgcgctacactaagaaagtgccacaggtctccacccccacgctggttgaggtgtctcgaaatctgggaaaagtaggcagcaaatgctgtaagcaccctgaagccaagcgcatgccatgcgccgaagactatctgagtgtagtgctgaaccagctttgcgtcctgcacgaaaaaaccccagtctccgatcgagtcaccaagtgttgtaccgagtccctggtcaatagacgtccctgctttagtgctctcgaagttgacgagacttacgtccccaaagagttcaatgcagagacatttacatttcatgccgatatctgcaccctaagcgaaaaggagaggcagattaagaaacagacagccctggttgagcttgtcaaacacaagcctaaagctaccaaggagcagttaaaggcggtgatggatgattttgccgcttttgtggagaaatgttgcaaggcggacgacaaggagacatgcttcgctgaagaaggtaaaaaattagtcgcagcctcacaagccgctttgggtctg

SEQ ID NO: 249381 - DNA, 2007 bp, Artificial Sequence
  Description of Artificial Sequence: Synthetic coding sequence
atgaagtgggtcagcttcatctccttgctgtttctctttagctccgcttactcgggatcgttggacaagcgccacggggagggcaccttcacttcggatgtgtcgtcgtacctcgaaggacaagccgccaaggaattcatcgcgtggctggtgaagggacgccacggcgaagggacgttcacgtccgacgtgtcatcgtacctggaaggacaagcggccaaagaattcatcgcctggctggtcaagggaagggatgctcacaagagcgaagttgcgcaccgattcaaggaccttggagaagaaaacttcaaggcactggtgctcatcgctttcgcacagtatctccaacaatgcccattcgaggaccatgtcaagctcgtcaatgaggtcactgaattcgccaagacgtgcgttgccgacgaatccgcagaaaattgcgacaagtccctccacaccctgttcggagataagctgtgcactgtcgcgaccctcagagaaacttacggagagatggcggattgctgcgcaaagcaggagcctgagagaaatgaatgcttcctgcagcacaaggacgacaaccccaatctgccacgcctggtccgcccggaagtggacgtcatgtgcactgcctttcatgataacgaggaaaccttcctgaaaaagtacctgtacgaaattgcccggaggcatccgtacttctacgcccctgagcttctcttcttcgcaaaacggtacaaagcggcttttaccgagtgctgccaggccgcagataaggctgcatgcctcctcccgaaactcgatgagctgcgcgacgaaggaaaagcctcctcagctaaacaacggctgaaatgcgcctcgctgcagaagtttggggagagagcgttcaaggcttgggcagtggcgcggctgtcccaacggtttcccaaggccgagttcgcggaggtgtctaagctggtgaccgacctgaccaaggtccacaccgaatgctgccacggtgatctcctggagtgcgccgatgacagagccgaccttgcaaagtatatctgcgagaaccaggactccatcagctccaagctcaaggagtgctgcgagaagcccctgttggagaagtcacactgcatcgctgaggtggagaacgacgaaatgccagctgatctgccatcgctggcggccgacttcgtggaatcgaaggatgtgtgcaagaactacgcagaagcgaaggacgtgttcctgggcatgtttttgtacgaatacgcgcgccggcacccggattactccgtcgtgctcctgcttcggctggccaagacttacgaaaccaccctggagaaatgttgcgcggcagcggacccacatgaatgttacgcaaaggtctttgacgagttcaagcctctggtggaggagccgcaaaatctgatcaaacagaactgcgaactttttgaacaactcggagaatacaagttccagaatgcgttgttggtgcggtacaccaagaaggttccgcaggtcagcaccccaactctggtggaagtgtcgagaaacctgggcaaggtcggtagcaagtgctgcaaacacccggaggcaaagagaatgccttgtgcagaggactacctcagcgtcgtgctgaaccaactctgtgtgctccatgaaaagactccggtttccgaccgggtgaccaaatgctgcaccgaatccttggtcaaccgcagaccgtgcttttcagcactggaagtggacgaaacgtacgttccgaaagagttcaatgccgaaactttcacgttccatgcggacatctgcaccctctccgagaaggagcgccagatcaagaagcagaccgctctggtggagctggttaagcacaaacccaaggctaccaaggaacagctcaaggccgtgatggatgatttcgccgcattcgtggagaagtgctgtaaagcagacgataaggaaacgtgtttcgcagaggaggggaagaagctggtggctgcctcacaggccgccctgggactg

SEQ ID NO: 249382 - DNA, 1146 bp, Artificial Sequence
  Description of Artificial Sequence: Synthetic coding sequence
atggcactgcagggtatctctgttgtcgaactctccggactggctccaggacccttttgtgccatggttcttgccgacttcggggccagagtggtacgggtggatagacccggaagccgatacgatgtaagtcgcttaggtcggggaaagcggtcactcgtgctagatctgaaacagcctcgcggagctgcagtgctgaggaggctgtgtaagcgcagcgacgttctgttggaacccttccgcagaggagtaatggaaaagcttcagctgggacccgaaatattacagagggagaaccctcgcctcatttatgcgcgactgtcagggtttggtcaatctggttcgttctgtagattggccggtcacgacataaattacctagcactgtcaggcgtcctttcaaaaatcgggagaagtggtgagaacccatacgctcccctcaacctccttgccgatttcgccggaggtggtttgatgtgcgctttgggcatcatcatggctttatttgatcggacccgtacagggaagggacaggtcattgatgccaatatggtggaaggcaccgcttatctttcatcattcctatggaagacccagaagctaagcttatgggaggcgcctaggggacagaacatgttagatgggggtgcccctttctacacaacttatcggacagcagatggggaattcatggctgttggggccattgaacctcagttctacgaactgctgataaaaggcctaggcttgaagtccgatgaacttcctaaccagatgagcatggatgactggcctgagatgaagaaaaaattcgcagatgtttttgccgagaagaccaaggctgaatggtgtcagatttttgatggaactgacgcctgtgtaacacccgtactcacgttcgaggaggttgtgcaccacgaccataataaggagagaggcagcttcataacttctgaagaacaggacgtgtctccacgcccagccccactgctgctgaacactcccgcaatacctagttttaaacgcgatccctttattggagagcatactgaggagattttagaagagttcgggttcagtcgcgaagaaatctatcagctcaactcggacaaaatcatcgagtcaaacaaagttaaggcatcactc

SEQ ID NO: 249383 - DNA, 1146 bp, Artificial Sequence
  Description of Artificial Sequence: Synthetic coding sequence
atggctttacaggggatctcagtggtggagctctcaggtctcgcccctggtcctttctgtgctatggtattggccgacttcggggcccgggtcgtgcgcgttgatcgccccgggtccagatatgatgtctctcggttgggacggggaaagcggtcactggtgctggatctgaagcaaccacgcggggctgctgtgttgcgacggctgtgtaagagaagtgatgttctcctggagccctttcgtcgcggagtgatggaaaagctacagctcggccccgagatcctccagcgcgaaaacccgcggttgatctacgctaggttgtccggttttggccaatctggatctttttgcagactcgctgggcacgacatcaactacctcgccctcagtggagtgctgagcaagatcgggaggagtggagaaaatccttacgcccccctgaatctcctcgcagacttcgccggtggcggtcttatgtgtgcattgggcatcattatggccctgtttgataggacaaggacaggcaaaggtcaggttatagacgccaacatggtggagggcaccgcctatctgagttcttttctctggaagacccagaaactgtctctgtgggaggcgccccgaggccagaacatgctggatggaggtgcccccttttatactacatacagaactgcggacggggaattcatggccgtgggcgccatcgagccccagttctatgagctgctgatcaagggtctgggattgaaatctgatgaactgccaaatcagatgagtatggacgattggcctgagatgaaaaagaagttcgccgacgtgttcgcagagaaaaccaaggctgaatggtgccagattttcgatggaacagacgcctgcgtcacaccagttctgacgttcgaagaagtggtacaccatgaccacaacaaggagcgtggttcctttatcacttcagaggagcaggacgtgtcaccccgccctgccccccttctgctgaatacacccgcaatcccatccttcaaaagggatccttttattggcgagcatactgaagagattctggaggagtttggcttcagtagggaagaaatctatcagctgaattctgacaagatcattgagtctaataaggtgaaagcttctctg

SEQ ID NO: 249384 - DNA, 1146 bp, Artificial Sequence
  Description of Artificial Sequence: Synthetic coding sequence
atggccctgcaaggaattagcgtggtggaactcagcgggctggctcctggaccattttgtgccatggtgttggcagattttggtgcaagagtggtccgcgtggaccggcctggatcccgctacgatgtttcacggctgggcagaggaaagagatccctcgtgcttgacttgaagcaaccacgcggtgcggcagtgcttagacggctctgcaaacggtcagacgtcctgctggaaccctttcgcagaggtgtgatggaaaaacttcaactgggacctgaaatcctgcagcgcgagaacccacgactgatctacgcccggctttccggctttggccaatcggggtccttttgtcgtctcgcgggccatgacatcaattatctcgctctttcaggcgtgcttagcaaaattggcagaagcggagagaacccttacgcgcctcttaatctgcttgcggattttgccggaggggggcttatgtgtgcattgggaatcattatggcactgtttgatcgcaccaggactggaaaggggcaggtcattgacgcaaacatggtggagggtaccgcatacctttcgtcatttctctggaaaacgcaaaaactctcactgtgggaggcacctaggggacagaatatgcttgatggtggcgcccctttttacactacgtacagaactgccgacggagaattcatggccgtgggtgcaatcgagcctcaattctacgagcttctgatcaagggactgggtctgaaatccgatgaactgccaaatcagatgtcgatggatgattggcctgagatgaaaaagaagtttgcagatgtctttgccgaaaagactaaggctgaatggtgccagatcttcgatggtactgatgcatgcgtcacccccgtcctcactttcgaagaagtcgtgcatcatgaccacaataaagagcgcggttcgttcattacttcggaggaacaggatgtctcgcctcgacctgcacctcttcttctcaatacccccgcgattccttccttcaaacgcgatccctttattggggagcacactgaagaaattcttgaggaatttggattctcgcgtgaggagatttatcagctgaactccgataagattattgagagcaacaaggtgaaagcgagcctc

SEQ ID NO: 249385 - DNA, 1146 bp, Artificial Sequence
  Description of Artificial Sequence: Synthetic coding sequence
atggccctccagggcataagtgtggtcgagttgtccggcctcgcaccaggccccttttgcgcaatggtgctggctgacttcggggcaagagtggtgcgggtagacaggccaggctcccggtatgatgtgtctagactaggcagagggaaacgcagcctcgtgctggatctcaagcagccccgcggagcagcggttttgagaaggctctgtaagagaagcgacgttctactcgagccttttcggcgcggggtgatggaaaaactacaattggggcccgagatcctgcaacgcgagaaccccagactgatctatgcccgcctgtcgggattcgggcagagcgggtccttctgccgtctggccggccatgacattaactacctcgctctgtccggcgtcctgagtaaaatcgggcgatccggggagaacccatacgcccccctgaacctgctagcagatttcgcaggtggcgggttaatgtgcgctctcggaattattatggccctattcgacaggacacgtacaggcaaaggccaggtgattgacgccaacatggtggaaggtaccgcctatctaagcagctttctttggaagacgcagaagctgtccttgtgggaggctccgaggggacagaatatgctggacggcggagcaccattctacacgacctatagaactgctgatggagagttcatggccgtcggagccatagagccccagttttacgaacttctgataaaaggcttaggactcaagagtgacgaactgccgaaccaaatgtccatggacgactggcctgagatgaaaaaaaagtttgcggatgtgtttgctgagaaaaccaaggctgagtggtgccaaatttttgatggcaccgatgcctgtgttaccccggttctaactttcgaagaggttgtgcatcacgaccacaataaggaaagaggttctttcattacgagtgaggaacaggatgtttctcctagaccggcccctttgctcctcaacacccctgccattccgtcatttaaacgggacccttttatcggtgaacacaccgaggaaatcttagaggagttcggtttttctcgagaggagatctaccagctgaattcagacaaaataattgagagtaataaggtcaaggcttcactg

SEQ ID NO: 249386 - DNA, 1146 bp, Artificial Sequence
  Description of Artificial Sequence: Synthetic coding sequence
atggcccttcaggggatctccgttgtcgagctgtccggacttgctcccgggccattctgcgccatggtcctcgccgattttggagctcgggttgtcagagtggatcgacccggaagtagatacgacgtctcccggttagggaggggcaaacgttccttggtgctggatttaaagcagccgcgcggcgcggccgtactgcggcgcctctgcaaaaggagtgatgtgttactggagccctttagaaggggagtgatggagaaattgcagctgggacctgagatcctccagagggagaaccccagacttatttatgcaagactgagcgggttcggccagtcaggcagcttttgcagattggccggccacgacattaactatttggccctaagcggagtgctctcgaaaatcgggcgctccggcgagaatccatacgctcctcttaatttgctcgcagacttcgcaggaggcggtcttatgtgcgccttaggaattatcatggccctgtttgacaggacacgcactggcaaaggccaggttatcgacgcgaacatggtggaaggcacggcttacttgtcctccttcctgtggaagactcagaagctctctctatgggaagctcctcgcggtcagaacatgctggacggaggcgcccccttttacaccacgtatcggaccgccgacggagagttcatggcagtcggcgcgattgaaccacaattctatgagcttcttattaagggactgggcctgaaatccgatgagctgcctaatcaaatgagcatggacgattggccagaaatgaagaagaaatttgctgatgttttcgcagagaaaaccaaggccgaatggtgccagatcttcgacggcacagacgcctgcgtaacaccagtgttaactttcgaagaagtggtgcatcacgatcataacaaggaacggggctcgttcatcaccagtgaggaacaagatgtgtcaccccgacccgcccccctcttactcaataccccggccattcccagcttcaagcgtgatcccttcattggagagcacaccgaggaaattttggaagagttcggcttttcacgagaggagatctaccaattaaattctgacaaaatcattgagtccaataaagtaaaggctagcctc

SEQ ID NO: 249387 - DNA, 1146 bp, Artificial Sequence
  Description of Artificial Sequence: Synthetic coding sequence
atggcccttcagggaatttcagttgtggagctcagcggcctcgcccctgggccgttctgcgctatggtcttggctgacttcggagctagggttgttcgcgtcgacagaccaggatccagatacgatgtgagcaggcttgggcggggtaaaaggagcctagttcttgacctgaagcagcctagaggcgcagccgttctgagacgcctttgcaaaagaagtgacgtcttgttggagcctttccgacgcggggtgatggagaaactgcagctcggccccgaaatcttgcaaagagagaaccctcgcctgatctatgcgaggctcagcggctttgggcaatccggttctttctgtcggctggcaggccatgatatcaactacctggcactctcaggggtgcttagcaaaatcggacggagcggagagaacccttatgctccattgaacctgttggcagacttcgctggggggggcttgatgtgcgccctgggaatcatcatggcactgttcgatcgcacaagaactggcaaaggccaggtcatagacgcaaacatggtggagggaacagcttacttgtctagcttcctgtggaagacccagaagctgtccttgtgggaggctccacggggccaaaacatgctggacggcggcgctcctttctacactacctaccgcactgcagacggggaattcatggctgtgggagcaattgagcctcaattctacgagttgttgatcaaaggtctcggcttgaagagtgatgagctgccaaaccaaatgagtatggacgattggcccgaaatgaagaagaagttcgcggatgtcttcgctgagaaaaccaaggccgaatggtgccaaattttcgacggcactgacgcttgtgtgacacccgtcctgactttcgaagaggtggtgcaccacgatcataacaaggaacgcggaagcttcattacttcagaggaacaagacgtctcccctcgccctgcacctctcctgctgaacactcctgcgataccttccttcaagcgcgaccctttcataggagaacacactgaggagattctggaggagttcggattttctagggaagaaatttatcaattgaacagtgacaagatcattgagtcaaacaaagtcaaagccagcctt

SEQ ID NO: 249388 - DNA, 1146 bp, Artificial Sequence
  Description of Artificial Sequence: Synthetic coding sequence
atggctctgcaaggcatttccgtggtggaattgtcggggctcgcgcctggaccgttttgtgcgatggttctggctgatttcggtgcccgagtggttagagtcgataggcctggatcgcgctacgatgtgtcaaggcttggtcgtggcaagcggtcgctggtgctggatttgaagcaacctcgcggcgcagccgtgctcaggcgcctctgtaagagaagcgatgtcctgctcgaaccctttagacgtggggtgatggaaaagttgcagcttggcccggaaatcctgcaacgtgagaaccccaggctgatttacgcccgactcagcggttttggtcagtcggggagcttttgtcgcctggccggacacgacataaactacctcgcactttccggcgtcctgtccaaaatcggacggagcggggaaaacccatatgcacctcttaacttgctggcagactttgctggcggaggactgatgtgcgcattggggatcattatggcactctttgataggactcggacgggtaagggacaggtgattgatgcgaacatggtggaaggaaccgcatatcttagctcctttctgtggaaaacccaaaaactttctctttgggaggcgccaagaggacagaacatgctggatggtggtgcaccattctatacgacttatcgtaccgcggatggagaattcatggcagtcggggctattgagccacaattctacgaacttcttatcaaaggtcttggtctgaagtcggacgaactgcccaatcagatgtcgatggatgactggccagagatgaagaagaaatttgcggatgtctttgcagaaaaaactaaggcggaatggtgccaaatctttgacggaactgacgcttgcgtgaccccagtccttacttttgaggaggtggtccaccatgatcataacaaagagagaggttcgttcataacgtccgaagaacaagacgtgtcccccagacctgcccctctcctcctgaataccccggccatcccctcatttaagagagatccgttcataggcgagcataccgaggagattctcgaagaatttggtttttcaagagaagagatctaccagcttaattctgacaagattattgaatcaaataaggtgaaggcatccctc

SEQ ID NO: 249389 - DNA, 1146 bp, Artificial Sequence
  Description of Artificial Sequence: Synthetic coding sequence
atggcactccaaggaatttcagtcgttgaattaagtggattagcaccaggacctttttgtgctatggtgttagctgattttggagctagagtagtaagagtcgatagaccaggttcacgatatgatgttagtagacttggtagaggtaaaagaagtttggttttagatttaaaacaacctagaggagctgcagttttaagaagattatgtaaaagatcagatgttttgttagaaccatttagaagaggagttatggaaaagttacaattaggtcctgaaatattacaaagagaaaatccaaggctcatttatgcacgattatctggatttggacaaagtgggtcattttgtagattagccggtcatgacattaattatttagctttatctggagttcttagtaaaattggtagatcaggtgaaaatccatatgcaccattaaatcttcttgcagattttgcaggaggaggattaatgtgcgcacttggaattattatggctctttttgatagaactagaactggtaaaggacaagtaatagatgcaaatatggttgaaggaacagcatatctttcatcttttctttggaagacccaaaaactttcgctttgggaagctcctagaggacaaaatatgcttgatggaggtgcacctttttatactacctatagaacagcagacggagaattcatggccgttggagctatagaaccacaattctatgaattattgatcaaaggattaggtttaaaatcagatgaattgcctaatcaaatgtcaatggacgactggccagaaatgaaaaaaaaatttgctgatgtatttgctgaaaagactaaggctgaatggtgtcaaatttttgatggtactgatgcatgtgtaactccagttttaacttttgaagaagttgttcatcatgaccataataaagaaagaggatcatttattacaagtgaagaacaagatgtatcacctaggcctgctcctttacttcttaataccccagctattccatcatttaaaagagatccatttattggagaacataccgaggaaattcttgaagaatttggattctctagagaagaaatatatcaattaaattctgacaaaattatcgaatcaaataaagtaaaagctagttta

SEQ ID NO: 249390 - DNA, 1146 bp, Artificial Sequence
  Description of Artificial Sequence: Synthetic coding sequence
atggctttacaaggcatcagcgttgtcgagctgtctgggctggctcctggtcccttctgcgccatggtcctagctgactttggggcaagagttgtacgggtcgaccgcccagggagtcggtacgacgtgtcccgtctcggcagaggtaagaggtccctcgtgctggacctgaagcaaccccgaggcgcagcggtgctccggcggctgtgtaaaagatctgatgtacttctagagccattccgtcggggagtcatggagaaactgcaactcggccccgagatcctgcagcgcgagaaccctcggttgatttacgcacgcctgtccggattcggacagagcggctctttttgtaggctggcaggtcacgacataaactacttggctttgtcgggcgtgctgtcaaaaatcggccggtccggggagaatccctatgctccactgaatctgctggcagactttgccggtggaggcctcatgtgcgccctgggcattattatggcactgtttgacagaacccgcactgggaaaggacaggtgatcgatgccaacatggtcgaaggaaccgcctatctatcgtctttcctgtggaagactcagaagttaagcctgtgggaagctcctcgcggtcagaacatgttggatgggggcgctccgttctacactacttaccggaccgctgacggcgagtttatggcagtgggtgcaatcgaacctcagttttacgaacttttaatcaagggcctaggcttgaaaagcgacgagctccccaatcagatgtcaatggacgattggcccgagatgaagaaaaaattcgctgacgtgttcgccgagaagaccaaagccgagtggtgtcagattttcgacgggacagacgcttgtgtcactcccgtgctcaccttcgaggaggtggtccaccatgatcacaataaggagagaggctcgtttattactagcgaggagcaggacgtttctcccagaccagcgcccctacttctaaataccccggccatacctagctttaagcgtgacccatttattggcgagcacaccgaggagatcctggaggagttcggcttcagccgtgaggagatctatcagttgaatagcgataagattattgaaagtaataaggtcaaggccagcctg

SEQ ID NO: 249391 - DNA, 1146 bp, Artificial Sequence
  Description of Artificial Sequence: Synthetic coding sequence
atggctctgcaaggcatctctgtcgtcgaactttctggactggctcccggacctttctgcgccatggtgcttgcagacttcggtgcccgcgtggtaagggtggataggccaggtagccgttacgacgtgagcagattgggtcgcggcaaaaggagccttgtgcttgatttgaagcagcctcgcggtgccgccgtactgaggcgtctttgcaagagaagtgacgtcctgcttgaacccttccgtcgcggagtcatggaaaaactgcagctgggtccagaaatccttcagcgtgaaaatccacgtctgatatacgccagactctccggattcggtcagtctggatcattctgccgtctggccggtcacgatatcaactatctggctctcagcggtgtgctctccaaaatcggcaggtccggagagaatccctacgcccctctcaacctgttggccgacttcgctggtggaggtcttatgtgtgccttgggtataattatggccctgttcgatcgcactaggaccggcaagggccaggtgattgatgccaacatggtcgagggtacagcataccttagctcattcctgtggaagacacaaaagctcagcctttgggaggctccacgtggccagaacatgcttgacggcggtgctcctttctacacaacttacaggaccgctgatggagagtttatggccgtgggtgccatcgaaccacagttctacgagctgctcatcaagggtttgggccttaagagcgacgaattgccaaaccagatgtccatggatgactggcctgaaatgaagaaaaaatttgctgatgtcttcgctgagaagacaaaagcagagtggtgtcaaatcttcgacggtacagacgcctgtgttaccccagtcctgacatttgaggaggtcgtacaccacgaccataacaaggagcgcggtagctttatcacctccgaggaacaagatgtcagccctagacctgccccactcctgttgaatactcccgctatcccatcttttaagagggatccattcattggcgagcacacagaagagatactggaagaatttggattctcacgcgaggagatatatcagcttaactccgacaaaattatcgagagcaacaaggttaaggcttccttg

SEQ ID NO: 249392 - DNA, 1146 bp, Artificial Sequence
  Description of Artificial Sequence: Synthetic coding sequence
atggccctccagggaatctctgtggtcgagctttccggactagctcctggcccattctgcgcaatggtcctagccgactttggcgctagagtggtgagagtcgatcggcctggatcccggtatgacgtgagccggctaggcagaggaaagaggtccctcgtgctggatctgaagcagcctagaggagctgcggtgctgcgtcgactttgtaagcgcagtgacgtgctgctggagcctttcaggcggggcgtaatggaaaaactacaactcggacccgagatcttacaaagagaaaatcctagactcatctatgctagactctcaggctttggacagtcaggaagtttttgtcggctggccggccacgacatcaactatttggcgcttagcggagtgctctccaaaatcgggcggagtggtgaaaacccctacgccccattgaacctgctcgccgactttgcagggggcgggctgatgtgtgccctgggtatcattatggctctcttcgacagaaccagaactggtaagggacaggttattgacgctaatatggtggagggaacagcctatctgagttcatttctttggaagactcaaaaacttagcttgtgggaggccccacgaggccaaaatatgctggatgggggcgcgcccttttatacaacgtataggactgcagatggagagttcatggcggtgggggctatcgagccacagttttacgagctgttaataaaaggcttaggcctaaaatccgatgagctcccaaaccagatgagtatggatgattggccagaaatgaagaagaaatttgcagatgtcttcgccgagaaaacgaaggcagagtggtgtcagatctttgacggcacagatgcgtgtgtgacccccgtgcttactttcgaggaggtggtgcatcatgaccacaacaaagagcgcgggagctttatcacttccgaagagcaggacgtttccccccggcccgcacccctgcttttaaacactcccgctataccctcttttaagagagacccgttcattggagagcacaccgaagagattctggaggaattcggattcagccgagaggagatctaccagctcaacagcgacaagataatcgagagtaataaggtgaaggcctcacta

SEQ ID NO: 249393 - DNA, 1146 bp, Artificial Sequence
  Description of Artificial Sequence: Synthetic coding sequence
atggcgcttcaaggaatctcggtcgtggagctcagcggactcgctccaggccctttctgcgcaatggttttggccgactttggagcccgcgtagtacgtgtcgaccgaccaggctcgagatacgatgtctcccgtcttggtagagggaagcgatcgctggtactggacctaaagcagccccggggagccgccgtgctgaggcgattgtgtaaacgaagtgacgtccttctggaacccttcaggcgaggagtgatggaaaaactacaattgggaccagaaattctccagagagagaatccaagactgatctatgccagactatctgggttcgggcagtccgggagcttttgcagactggcgggacatgatatcaactatctcgccctgtctggggtgctctctaaaatcggcaggagtggggaaaatccctatgctcccctgaacctattagctgacttcgctggcggtgggttaatgtgtgccttggggattatcatggccctgtttgacagaacgagaactgggaagggacaggtgatagatgcaaacatggtggaggggaccgcctacttatcctccttcctttggaaaacccaaaaactgtctctgtgggaagccccacggggccagaacatgctggatggcggtgccccattttatacaacgtatcgaaccgccgatggggagtttatggccgttggagctatcgaaccacagttctacgaactactgatcaaaggactggggctgaaaagcgacgagctcccgaaccagatgagtatggatgactggcccgagatgaagaaaaaattcgctgacgtatttgccgagaagacaaaggcggagtggtgtcagatcttcgatggcaccgacgcttgtgtgacaccagtcctgacttttgaagaggttgtgcaccacgaccacaacaaagagcgtggcagctttatcacatcagaagagcaagatgtaagccccagacctgctcctctgctgctgaacactccggcaattcctagtttcaaaagagatcccttcattggggaacatacagaagaaattctcgaagaatttggattcagtcgagaggagatttaccaattgaattcagacaagataatcgaatcaaataaagtgaaggcttcatta

SEQ ID NO: 249394 - DNA, 1146 bp, Artificial Sequence
  Description of Artificial Sequence: Synthetic coding sequence
atggcccttcagggaatcagtgtggtggagctgtccgggctggcgccgggccccttttgtgctatggtcctggcagacttcggggctcgagtcgtgcgcgtcgaccggcccgggagtagatacgatgttagccgcctcggccgcggtaagcgcagtttggtcctggacttgaagcagcctcgcggcgcggccgtcctgaggcgcctttgtaaaaggtccgatgtactcctggagcctttccggaggggtgtgatggaaaagctgcagctcggacccgagatcctccaacgggagaatccgcggctcatttacgcacgactgagtggattcggacagtcagggtctttctgcaggctggctggacacgacatcaactacctggccctgagcggagtcttgagcaaaatcggcagatcaggcgagaacccctatgcaccccttaatctcttggccgacttcgctggcggaggcttgatgtgtgctttggggattatcatggccttgttcgaccgcacccgcacagggaaagggcaagttatagacgcaaacatggtcgaagggacagcatatctgtccagtttcctgtggaagacacaaaagcttagtctttgggaagcaccccgcggtcaaaatatgttggacgggggtgcgcctttttacaccacatatcggacagccgacggagaattcatggccgtgggcgcaatcgagccacaattctacgaattgcttattaaggggctggggctgaagtcagatgagctgcctaatcagatgagcatggacgactggccggaaatgaaaaagaaatttgcggatgttttcgccgagaagacaaaggctgagtggtgtcagattttcgacggcaccgatgcctgcgttactcctgtcttgacttttgaagaagtggtgcaccacgaccacaacaaggaaagaggctcctttatcacgtccgaggagcaggatgtaagtccaaggcccgcacctctcctcttgaatacaccagccatacctagtttcaagcgcgatcctttcattggcgagcacaccgaagaaatactcgaagaattcggctttagtcgagaggagatctaccagctcaactccgataaaatcattgaaagtaataaggtcaaggcgtctttg

SEQ ID NO: 249395 - DNA, 1146 bp, Artificial Sequence
  Description of Artificial Sequence: Synthetic coding sequence
atggcattgcaggggatttctgtggtggagctttccggcctggccccagggccattctgtgctatggtccttgccgacttcggagcccgagtggtccgggtcgacaggccaggatcccggtatgatgtgagcaggcttggcagaggtaaaagaagcctggtcttggatctgaaacaaccaaggggggctgcagtacttaggagactgtgtaagagatctgacgtgcttctagagccgttcagaagaggcgtcatggagaagctccagttgggaccggagatactacaaagggagaacccccgactgatttatgccagactttctggcttcgggcagtcgggttccttttgccgtctggcgggccacgatattaattacctggccctctccggtgtattgtcaaagattggaaggagcggcgaaaacccttatgctccactaaacctcttagctgatttcgccggaggcggtttgatgtgtgctctgggaatcatcatggccctgttcgataggacccgcactggaaaaggccaggtgattgatgccaacatggtagagggtaccgcgtatctgtcaagtttcttatggaaaacccagaaactaagtctgtgggaagccccacgcggccagaatatgctggatggcggggctccattttatactacatataggacggctgatggggagtttatggctgttggagccattgagcctcagttttatgagttgctgattaagggactcggtctcaaaagcgacgagctacctaatcagatgagcatggacgactggcccgagatgaagaaaaagttcgcagacgtttttgctgagaagactaaagctgagtggtgtcagatctttgacggcaccgatgcttgcgtgacacctgtgctcacttttgaggaggtggtccaccacgatcacaacaaagagcgaggctcattcattacctccgaagaacaggacgtgtccccaagacctgcacccctgctgctgaacacgccggctataccatcatttaaacgagatccattcattggagaacacaccgaggaaattttggaggagtttggctttagccgagaggagatttaccaactgaattcggacaagattatagagagcaacaaggtgaaggcatccttg

SEQ ID NO: 249396 - DNA, 1146 bp, Artificial Sequence
  Description of Artificial Sequence: Synthetic coding sequence
atggcattgcaggggatcagcgtagttgagctctctgggctcgcgccggggccattctgcgcaatggtcttggctgacttcggagcccgagtcgtgagggtggacaggcctgggtcccgctatgatgtcagccggctgggcaggggcaaacgatccttggtcttggaccttaaacagcccaggggagccgctgtattgcgcagattatgcaaacgtagtgacgtgcttctggagccttttcgccgtggcgtgatggagaaactgcagctgggaccagagatacttcagagagaaaatcctcggcttatatacgctagattgagcggattcggtcagtccgggagcttctgccgactcgctggacacgatatcaattacttggctctttctggagttctcagtaagatcggccgttccggcgaaaatccctacgcccccctgaatctgctggcagattttgctgggggcggcctgatgtgtgcattgggaattatcatggcgctctttgaccgcactagaaccggaaagggccaagtcattgacgctaatatggtcgaaggaacagcatatctcagttccttcttgtggaagactcagaaactgtccttgtgggaagcaccccggggccagaacatgctggacgggggcgctccattctacaccacttatcggaccgccgacggtgagttcatggctgtcggggccattgagccccagttttatgagctcctgatcaaaggtctggggctgaaaagtgatgagctgcctaatcagatgtccatggacgactggcctgaaatgaagaaaaaattcgcagacgtcttcgcagaaaagacgaaagcagagtggtgccagatcttcgacggtaccgatgcctgtgtcaccccagtgctcactttcgaggaagtagtccatcacgatcataataaggaaagaggctccttcattacctcagaagaacaggatgtgtcaccccgacccgctcctctcttactgaacacaccggctattccctctttcaagagagacccattcatcggtgagcatactgaggagattctggaggaatttgggttcagtcgggaggagatctatcaacttaacagcgataagatcatagaaagcaataaggttaaagcctctctg

SEQ ID NO: 249397 - DNA, 1146 bp, Artificial Sequence
  Description of Artificial Sequence: Synthetic coding sequence
atggcccttcagggcatcagtgtggtggagctctcgggactggcccccgggcccttttgtgccatggttttagctgacttcggagcccgggtagtgagagtggatcgtcctgggtctcgctatgacgtcagcaggctgggacgaggcaagcgcagtctggtgctggacctgaagcagccccggggggccgccgtcctgcgtcgactttgtaaaagatccgacgtgctgctcgaaccattccgaagaggtgtgatggaaaaactgcaactaggcccagaaattctgcaaagggaaaatcccaggctcatttacgctcgcctgtcaggctttggacaaagcggcagtttttgtcgcctcgcaggacacgatatcaactacctggcgctgtctggcgttctttccaaaatcggccgtagtggcgagaacccatatgcacccctcaatctgttggccgactttgcgggaggaggcctcatgtgcgcgctgggaatcatcatggctctgtttgacagaaccagaacgggcaaaggccaagttattgacgccaatatggtggaaggaaccgcctacctgagcagcttcctgtggaaaacccagaaactgagtttgtgggaagcaccaaggggccagaacatgctggacggaggtgcacctttttataccacctacagaacggccgacggagaatttatggccgtcggcgccattgagccccagttttatgagcttctcataaaaggcctggggcttaaatccgatgaactacccaatcagatgagcatggacgactggcctgagatgaagaagaagttcgcagatgtttttgccgaaaagaccaaagccgaatggtgtcaaatcttcgacggaacggacgcatgcgtgactcccgtgctgacctttgaagaggtcgttcatcacgaccacaacaaggagcgagggagctttatcactagtgaggaacaggatgtctcgccgcgccccgctcccctccttcttaacacacctgcaatcccatccttcaagagagatcccttcataggagagcacactgaagagattctggaggagtttggtttctcgagagaggagatctaccagcttaactctgataaaattatcgagtccaataaggttaaggcctcactc

SEQ ID NO: 249398 - DNA, 1146 bp, Artificial Sequence
  Description of Artificial Sequence: Synthetic coding sequence
atggctctacagggaatttccgtcgtggagctttcagggctcgcccccggaccattttgcgctatggttctcgcagattttggagctagagtggtgcgcgttgatagaccagggtcaagatacgatgttagtcggttaggacgggggaaacgttcactggttctagatctgaaacagccccgaggagcagccgttctgagacggttatgtaaaagaagtgatgtgttacttgaaccttttcggcggggggtgatggaaaaattgcagcttgggcctgaaatactacagcgcgaaaatcctcgcctgatttacgctcggttgtcagggttcggacagagtggatccttctgcaggttagccgggcatgatataaactaccttgcgctctcaggggtgctcagtaaaataggacggtcaggggagaatccttatgctcctctcaatctactggctgattttgccgggggggggctcatgtgcgccctagggataatcatggccctcttcgaccggacacggacaggaaaaggacaggtgattgatgctaacatggttgaaggaactgcatatttatcttcatttctctggaaaactcagaaacttagtttatgggaagccccaagaggacagaacatgctcgacggaggggcacccttttacactacttatagaacagcagatggagagttcatggccgtgggagccatagaacctcaattttatgaactacttataaaagggctgggactaaaatccgatgagctgccaaatcagatgagtatggacgattggcctgaaatgaaaaagaaattcgccgatgtattcgccgaaaaaactaaagccgagtggtgccagatctttgacggaacagatgcttgtgtgacaccagttctcacattcgaagaagtggtgcaccatgatcacaataaagaaagggggtcattcattacatccgaggagcaggatgtgtcaccccggcctgctcccctactgttaaatacacctgccatcccctctttcaaaagggaccctttcatcggagaacacactgaagaaatccttgaagaatttgggttcagtcgtgaagaaatctatcagctcaactcggataagatcattgaatctaacaaagtgaaggcctctctc

SEQ ID NO: 249399 - DNA, 1146 bp, Artificial Sequence
  Description of Artificial Sequence: Synthetic coding sequence
atggcccttcaaggaattagcgtggtcgagctctcgggtctggccccaggacctttctgtgccatggtgctggctgattttggggcgcgcgtcgtgcgtgtggatcgtcccggctcgagatacgatgtgagccgcctcggcagagggaagcgttccctcgtgctggacctcaagcaaccccgcggagcggcggttcttaggcgcttgtgtaagcgctccgatgtgctgctcgagccattccgccgcggcgtgatggagaagctgcaactgggtccggagatactgcagcgggagaacccccggctgatttacgcaagactctccggctttggacagtcaggatcgttctgccgcctggcgggtcatgacatcaactacctggcattgtcaggagtcctgagcaaaattggtcgatcgggagaaaatccatacgcgccccttaaccttcttgcggattttgcaggcggtggtttgatgtgcgcccttggcattatcatggctctgtttgatcgcacccggactggtaagggccaggtgattgatgcaaatatggtggaaggaactgcatacctgtcctcatttctttggaaaactcaaaaactttcgctgtgggaggccccgagaggacaaaacatgctggacggcggcgcaccattctacacgacctacaggaccgcagacggagaattcatggccgtgggagcgatcgagccgcagttctacgaactgcttatcaaagggctgggactgaagtcggatgaacttcctaatcaaatgtctatggatgactggcctgaaatgaagaagaagttcgcagacgtgtttgcagaaaaaacgaaggcagaatggtgccagatttttgatggaactgacgcatgcgtaactcctgttcttacttttgaagaggtggtccaccatgatcataacaaagaacgtggatcctttatcacctcggaagaacaggatgtgtcacctcggcctgcgcctctgctgcttaacactcctgcaatcccatctttcaaacgtgatccgtttattggagaacacaccgaggaaatccttgaggaatttggttttagccgggaggagatctaccagctgaacagcgacaagatcatcgaatcaaacaaagtgaaggctagcctc

SEQ ID NO: 249400 - DNA, 1146 bp, Artificial Sequence
  Description of Artificial Sequence: Synthetic coding sequence
atggctctacagggtatctctgttgtcgagctttcaggcctcgccccaggaccgttttgcgctatggtgctggccgatttcggcgctagagtggttagagtggaccggcctggatcacgttacgatgtttcccggttaggtcgagggaaacggagtcttgttttggatttgaaacagccacggggggctgccgtgttacgacggctttgcaaacgcagcgatgtgttgttagagcccttcagaagaggggtgatggagaaactgcagctgggccctgagatactgcaacgcgagaatcctagactgatttacgctaggctctcagggtttggtcagtctgggagtttctgccgcctggccggtcacgatatcaactatctagccctcagcggggtgctgagcaagatcgggcgctctggagaaaacccatacgcacccctgaacctactcgcagattttgccggaggaggtttaatgtgcgctctgggcatcataatggctctatttgacaggacccggacggggaaaggacaagtcattgacgcaaatatggtcgaaggtactgcatatctcagctccttcctgtggaagacccagaagttatctctctgggaggcgcccaggggacagaatatgctggatggcggagcacccttttacacaacataccgcactgctgacggtgaattcatggctgtgggggcaattgaaccccagttctacgaactgctaataaagggactgggcctcaagtcagacgagctgcccaatcagatgtcaatggatgactggccggaaatgaagaagaagtttgctgacgtattcgccgagaaaaccaaagccgaatggtgtcagatattcgacggaacagatgcctgtgtgacaccagtcctcacgtttgaggaggttgttcatcacgatcacaataaggagaggggttcctttataacatccgaggaacaggatgtcagtccgcgccctgcccctctgctgctgaacacgcccgctatcccttcttttaagcgagacccgtttattggcgaacacacggaggagatcctggaggaattcgggttttcgcgggaagaaatctaccagctcaactcagacaaaatcatcgaatctaataaggtcaaggcttccctc

SEQ ID NO: 249401 - DNA, 1146 bp, Artificial Sequence
  Description of Artificial Sequence: Synthetic coding sequence
atggctcttcagggcatttctgtcgtcgagctgtccggcctggcgcctggccccttttgcgctatggttctggcagatttcggcgctcgggtcgtccgcgtcgatagacctgggtctcgatacgatgtcagccgcctgggacgcggtaaacggtctttagtactggatctgaagcagcctcgaggtgccgcggtgcttaggcggctttgcaagagaagtgacgtccttctggaaccttttaggagaggtgtgatggaaaaacttcagcttgggccagaaattctccaacgtgagaacccacgccttatctatgcacgactgtctggcttcggacaatctggttccttttgtcgattagcaggacatgatattaactacctggccttatcaggcgttctgtctaagatcggtaggtcgggtgaaaatccgtacgccccgctgaacctcttggccgatttcgctggtggcggactgatgtgcgccctgggaatcatcatggcgctattcgaccgcaccaggacaggcaaaggccaggtgattgatgccaatatggttgaagggacggcctatctatcctcctttctctggaagacgcagaaactgtccttgtgggaggcccctcggggccagaacatgctcgatgggggtgcacctttttacacgacctacagaactgccgacggggagttcatggctgtgggcgccatagagccgcaattttacgagctcctcatcaaaggactgggactcaagagtgatgaactacctaatcagatgtctatggatgattggcctgagatgaaaaaaaagttcgctgacgtcttcgccgaaaaaactaaagccgagtggtgtcagattttcgacgggactgatgcttgtgtaacccctgttctgaccttcgaagaggtggtccaccacgatcataataaggagcggggcagtttcattacttctgaggagcaggacgtgagccctcggccggcccctctgctgctgaatacccccgccatccccagcttcaagcgggatccatttattggcgaacacaccgaagagattctagaggagttcggcttctcacgggaagaaatctatcagcttaacagcgataagatcattgagagtaacaaagtgaaagcgtctctc

SEQ ID NO: 249402 - DNA, 1146 bp, Artificial Sequence
  Description of Artificial Sequence: Synthetic coding sequence
atggcacttcaagggatctctgttgtggaattgtccggactagctccaggaccgttttgtgccatggttcttgctgattttggagcacgcgtcgttcgagtcgataggccaggatcacggtatgatgtatcgagattaggtcgcggaaaacgatctctggtgttggatctaaagcagcctcggggggcagctgttctgcggcgtctttgcaagaggagtgatgttcttcttgagccattccgtagaggagtgatggaaaaattacaattaggaccggaaatcttgcaacgagaaaatccacgccttatctatgcaaggttgtcgggattcggacaaagcggcagcttttgccggttggcaggacacgatatcaattacctggctctatcaggagtactttccaaaatcggaagaagtggcgagaatccatacgcgccattgaatcttcttgcggattttgctggaggtggactgatgtgtgcgttgggaattatcatggcactcttcgaccgtacccgtactggaaaagggcaagttatcgatgctaacatggtggagggaactgcctatttatcttcgtttttgtggaagacgcaaaaactgtctctctgggaggctcctaggggacaaaacatgttagatggaggggcgcccttctacaccacgtatcgtacagcagacggagaatttatggctgttggtgccattgagcctcagttttacgagttgcttattaagggacttggactaaagtcagatgaactgcctaaccaaatgtcgatggatgattggccagagatgaaaaaaaaattcgcagatgttttcgctgaaaagactaaagcagaatggtgtcaaattttcgatgggacggacgcttgcgtaacaccagtcctaacattcgaggaagttgtgcaccacgatcacaacaaggaaaggggatcattcatcacatcagaagaacaagacgtttcgcctcgccccgctccattgctacttaacacacccgcaattccatcatttaaacgagatcctttcattggtgagcatacagaagagatacttgaagaattcggattttcccgtgaggaaatctaccagcttaatagcgataagattatcgaatcaaataaggtgaaagcttcactt

SEQ ID NO: 249403 - DNA, 1146 bp, Artificial Sequence
  Description of Artificial Sequence: Synthetic coding sequence
atggctctccagggaatatccgtcgtggagctgtcagggctggctcctggacctttctgtgcaatggtcctggccgactttggagctcgggtggtacgagtcgataggccgggttctaggtatgatgtgagtagattgggccgcgggaagcggtccctggtgctggacctcaaacaacctcgaggcgcagcagtgcttcggcggctgtgcaaacgttcagacgtgctattagagccctttcgacgcggagtgatggagaaacttcagctcggccccgagattctgcaacgggagaatccacggctgatctatgcccgattatcgggattcggccagtcgggtagcttttgccgactcgccggacacgatattaactatctggcactgtcgggagtgttgagtaagatagggagatctggggagaatccctacgcacccctgaatttgctcgccgattttgcaggcggtggacttatgtgtgctctgggaatcatcatggctctgtttgaccgaactcgaaccggcaagggacaggtgattgatgccaacatggtcgaagggaccgcgtacttgtcatcctttctttggaaaacacagaagctgagtctgtgggaggcaccccgcggacagaatatgttagacggaggggcaccgttttacacaacgtaccgcacggccgacggtgagttcatggcagttggagccattgagccacagttctacgaactgctgataaaggggctcggattgaagagtgatgagcttccaaatcagatgtccatggacgattggcccgagatgaaaaagaaattcgccgatgtctttgcagagaaaactaaagctgaatggtgccagatcttcgacggcacggacgcatgtgttacacccgtacttactttcgaggaagtggtgcaccacgaccacaataaggaacgcgggtcgtttatcacctccgaagagcaggatgtgagtccgcgaccggcaccacttttgctgaacacgcccgccattcccagcttcaagagagatccattcatcggcgaacacacagaagagatcctcgaagagttcggattctcaagagaggagatatatcagctcaatagcgacaaaatcatcgagtctaataaggtaaaggcctctttg

SEQ ID NO: 249404 - DNA, 1146 bp, Artificial Sequence
  Description of Artificial Sequence: Synthetic coding sequence
atggcactccagggcatcagcgtggtcgaattgtccggtctggccccagggccgttctgcgccatggtgctggccgactttggtgcccgcgtggtgcgggtcgataggccaggatcgcgatacgatgtgagccgtcttggaagaggaaagcgatccctcgtgctggatctgaagcagccaagaggtgctgctgtgctccggcggctgtgcaagcgctcggacgtcttgctggaacctttcaggaggggtgtgatggaaaagctgcaactgggaccagagatcctccagcgggagaacccgcggctgatctacgctcggctgtccggtttcggacagtcgggatccttttgcagattggctggacacgacatcaattacctcgccctgtcgggcgtgttgagcaagatcggccgctcaggcgaaaacccttatgctccccttaatcttttggcggattttgcgggtggtggactgatgtgcgccttgggcatcattatggcgctgttcgacagaaccaggaccggaaagggacaggtgatcgacgccaatatggtggaaggaaccgcttacctgtcgagcttcctgtggaaaactcaaaaactctctttgtgggaggctccgcgagggcagaacatgctggacggcggagcaccgttttacactacgtaccggactgcggacggggagtttatggccgtgggagccatcgagccgcagttctacgaacttttgattaagggactcggattgaagagtgacgaactcccaaaccagatgagcatggatgactggccagaaatgaagaagaaattcgcagacgtttttgccgagaaaaccaaggctgagtggtgtcagatctttgatggaactgacgcgtgcgtcacgccagttctgacttttgaagaagtggtccaccatgaccacaacaaagaacgggggtccttcatcacttccgaggagcaagatgtgagcccacgcccggctcccctcttgcttaacactcccgccatcccgtcgttcaagcgggacccctttattggggagcacactgaggaaattctggaggagttcggcttctccagagaagaaatctatcaactcaactcagacaaaatcatcgagtccaataaggtgaaagcctcgctg

SEQ ID NO: 249405 - DNA, 1146 bp, Artificial Sequence
  Description of Artificial Sequence: Synthetic coding sequence
atggccttgcagggaatctccgtggtcgaactgtccggcttggcgccagggccgttctgtgctatggtcctcgctgacttcggcgcgcgagtggtgcgcgtggatagaccgggaagccgctacgacgtctcaagactcggtagaggaaaacgatctctcgtgctggaccttaagcagcctcggggagcggcggtgctgagaaggctgtgcaagcggtccgacgtgctcctcgaaccgttccgcagaggtgtcatggaaaagttgcagctgggtccagaaatcttgcaacgtgagaacccgcggctgatttacgccaggctttcggggttcggccaatccggctcgttctgcaggcttgcaggacacgatatcaattacctcgcactgtcaggcgtgctttcgaagatcggccggtcaggagagaacccttacgctccactcaacttgctcgcagactttgccggaggcggactgatgtgtgccctgggaatcatcatggccctgtttgatcggacccgcactggtaaaggacaagtgatcgatgcgaatatggtcgaaggcaccgcttacctgtcctcgtttctgtggaaaacgcagaagctcagcctttgggaagccccccggggacagaacatgctggacggaggagcgccgttttacacgacctaccgcactgcagacggggaatttatggccgtgggagccatcgagccgcaattctatgaactgctgattaaaggactcggcctgaagagcgacgaactgcccaatcaaatgtcgatggacgattggcctgaaatgaagaagaagttcgcggatgtctttgcagaaaaaactaaggccgaatggtgccagatcttcgatgggactgatgcctgcgtgactccggtgctgaccttcgaggaggtggtccatcacgaccacaacaaggagcgggggtcattcatcaccagcgaggagcaggacgtgtcgccccgcccagctccactcctgctgaataccccggccatcccttcgttcaagcgcgacccgttcatcggagagcataccgaagagattctggaagagttcggattctcacgcgaggaaatctaccagctgaacagcgacaaaattatcgagtccaacaaggttaaggcatccctc

SEQ ID NO: 249406 - DNA, 1146 bp, Artificial Sequence
  Description of Artificial Sequence: Synthetic coding sequence
atggccttgcagggtatctcagttgtcgagctcagcggcctggcccccggcccgttttgcgccatggtgctggctgacttcggcgcccgggtggtgcgagtggacaggccggggtcgagatacgacgtgtcgcggttgggaagggggaaacgatcgcttgtgttggacctgaagcagccacggggtgcagccgtgctgcgccggctgtgcaagcgatccgacgtgctgctcgagccgttcaggcgcggagttatggaaaagctccagttgggcccagaaatactccaaagagagaatcctcgcctcatctacgccagactttccggatttgggcaaagcgggagcttctgcagattggcaggacacgacatcaattacttggcgctcagtggagtgctgagcaagattggaagatccggggaaaacccgtacgcccctcttaacctgctggccgatttcgccgggggcggtctgatgtgcgccctggggatcatcatggccctgttcgatcggactcgcaccggcaagggacaagtgatcgacgcaaacatggtggagggtaccgcgtacctgtcatcgttcctttggaaaactcaaaagctgtcactgtgggaggcgcctcgaggccagaacatgcttgacggaggcgccccgttctataccacctaccggactgctgacggggagtttatggcggtgggagccattgaaccacagttttacgagcttttgatcaaaggattggggctgaaatccgacgaactgccaaatcaaatgtccatggacgattggcccgagatgaagaaaaagttcgctgatgtgttcgcggaaaaaaccaaggccgaatggtgtcagattttcgatggaactgacgcttgcgtcactccggttctgacttttgaagaggtcgtccaccacgatcataacaaggaacggggttcattcatcacctccgaggaacaggatgtgtctccaaggccggccccgctgctgctgaacacgccagcgatcccgtccttcaagagagatccttttatcggtgaacatacggaggaaatcttggaggagttcggattctcgagggaagagatctaccaacttaatagcgacaagatcatcgaaagcaacaaggtcaaggcctcactg

SEQ ID NO: 249407 - DNA, 1146 bp, Artificial Sequence
  Description of Artificial Sequence: Synthetic coding sequence
atggcactacaagggatatcggttgtggagctctccggtcttgctccaggacctttttgtgcaatggtcttagctgattttggcgccagggtcgtgcgtgtggaccggcctggatccaggtacgacgtgtcgcgtctcggtaggggtaaacgctcgttagtgctcgatctaaaacagccgagaggggccgctgtgctacgtcgtctgtgcaaacggtctgatgtgctactggaaccctttagaaggggtgtcatggagaagttgcaactcggccctgaaatcctgcagcgcgagaatcctaggttgatctatgctaggttgtccgggttcggacagtcaggaagtttctgtcgtctggctgggcatgatatcaactaccttgccctcagcggtgtgttatccaaaattggccgctctggggaaaacccctatgcaccattgaacctgctggcagacttcgcgggcggaggcctcatgtgtgccttaggcattataatggccttgttcgacaggacccggacaggaaagggtcaggtcatcgatgccaacatggttgagggaactgcgtacctgagctctttcctctggaagacgcagaaactcagcttgtgggaggcaccaagggggcaaaacatgctcgacggaggggcaccattttacacaacataccgtactgccgatggcgagtttatggccgtgggcgccatcgagcctcagttctacgaactgcttattaaaggtctcggccttaagtctgacgagttgcctaaccagatgagcatggacgattggcccgagatgaagaagaagtttgcagatgtgttcgcggagaagacgaaggccgaatggtgccagattttcgacggcactgacgcatgcgtgacccctgttttgacattcgaagaggtggtccaccacgatcacaacaaggaaagaggcagctttatcacctccgaggaacaggatgtgtcccctcggccggctcctttgcttttaaatacacctgcaataccctcgttcaaacgggatccttttataggcgaacacacagaggagatcctggaggagttcggcttcagtcgggaggagatttaccagcttaattcagacaagattattgaaagcaataaagtgaaggccagtctt

SEQ ID NO: 249408 - DNA, 1146 bp, Artificial Sequence
  Description of Artificial Sequence: Synthetic coding sequence
atggcccttcaaggaatcagcgttgtggaacttagcggacttgcaccgggtccattttgcgcaatggtgctggctgattttggggcaagagtggttagagtcgaccggcccggttctaggtacgacgtctcacggcttggtagaggtaagcgatccctggtgcttgatcttaagcagcctcgtggggcagctgtgcttaggagactttgcaaacgcagcgacgtgctgctcgaaccattccgccgcggcgtcatggaaaaactgcaacttggcccagaaatacttcagcgcgagaatccgcggctgatttacgcccgcttgagcggtttcggccaatccggaagtttttgtaggctggcaggtcatgacatcaattatctggccctgtcgggggtgctttcaaagattggaagatcgggggagaacccatacgcgccccttaaccttctcgccgacttcgcgggaggcggactcatgtgtgcccttggaatcattatggcgctgtttgatagaactcggactggaaagggtcaagtcattgatgccaacatggtggagggcactgcctacctttcgtccttcctgtggaaaacccagaagctgtccctttgggaggccccacggggacagaatatgctggatggtggtgccccgttttacactacgtacagaactgcggatggcgagtttatggcagtgggagcaattgaaccacagttttacgaactcctgatcaaaggacttggtctgaagtcagatgaattgccaaaccagatgtctatggacgattggcctgaaatgaaaaagaaattcgcggatgtgttcgctgaaaagaccaaggcagaatggtgtcagatttttgacggtactgatgcgtgcgtcactcctgtcctgaccttcgaggaagtggtccatcacgatcacaacaaggaaagaggatcgttcataactagtgaagaacaggatgtgtccccccgaccagcaccactgcttttgaatacccccgcgattccttcttttaagcgagatccgtttattggagagcatacggaggagattctcgaagaatttggctttagcagagaagagatttaccaacttaactccgacaaaatcatcgagtctaacaaggtgaaggcctccctc

SEQ ID NO: 249409 - DNA, 1146 bp, Artificial Sequence
  Description of Artificial Sequence: Synthetic coding sequence
atggcccttcaaggtatttcagttgtagagctttcaggactagcaccagggcctttctgtgccatggtgctcgccgactttggtgctcgcgtcgtccgcgtcgacaggcccggcagcagatatgatgtgtcgcggctgggccgcggcaagcggagcctggtgctagatctaaaacaaccaaggggggccgcagtcctccggaggctttgcaagcgttcagatgtgctgttagaaccgttcagacggggtgtcatggagaaactgcaactcggccctgagatcctgcagcgggagaatcccagactaatttacgcacggctgagtggctttgggcagtccggatcattttgcagactggctggacatgacatcaactatcttgccctttcaggcgtgcttagcaagatcggccgatccggcgaaaatccgtacgccccactgaatctgttggctgactttgctggtggcggattgatgtgcgctctagggatcattatggcattatttgaccgcacacgtacagggaaggggcaagtcattgatgccaacatggttgaaggcaccgcttacttgagttcttttctgtggaaaacccagaaactctcattgtgggaagctcccagaggccagaacatgttggatgggggggcgccgttttacactacctatcggactgcggacggggagttcatggcagtgggcgccatagaaccgcaattctatgagttacttatcaaagggctaggcctgaagtcagacgagttgcccaaccagatgagcatggatgactggccggaaatgaagaagaaattcgctgacgtgttcgctgaaaagacgaaagccgagtggtgtcagatatttgacggcaccgatgcctgcgtgacaccagttctcacgttcgaggaggtggtccaccacgaccataataaggagaggggctcgttcattacctccgaggaacaggatgtctctcctcggcctgcccccctcttacttaatacccctgccattccttcctttaaaagagatccatttatcggtgagcacactgaggagattctcgaggagttcggcttcagtcgagaggagatttatcagttgaacagcgataaaatcatcgaatccaataaggtaaaggcttcgctg

SEQ ID NO: 249410 - DNA, 1146 bp, Artificial Sequence
  Description of Artificial Sequence: Synthetic coding sequence
atggccctccaaggaataagtgtagtcgagctctccggattagcacctggacctttttgcgccatggtgctagctgattttggagcaagggtggtgcgggtggatagaccagggagtaggtatgatgtgtctcggctcgggagggggaaaaggagtcttgttctggatctcaaacaacccagaggagctgccgtgctacgccgtctttgtaaaaggtcagatgtgctccttgaaccctttcggagaggagtaatggaaaaactgcagctcgggcccgagatcctgcagcgagaaaaccctaggcttatttatgctagactcagtgggtttgggcagtccgggagtttctgcaggctggccggacatgatataaattacctcgctctcagtggagtattgtctaaaataggaagatcaggagaaaacccatatgccccacttaaccttctcgctgacttcgccggaggagggcttatgtgcgctctaggaataatcatggctctttttgataggacaagaactggaaaggggcaggtcattgatgccaacatggtggaagggactgcctacctaagttccttcctgtggaaaacacagaaactatctctttgggaggctccacgcgggcagaatatgctggatgggggggccccattttatacaacatacaggacagcagatggggaatttatggccgtcggggctatcgaacctcagttctacgaactgctcataaaagggctaggactaaaatccgatgaacttcctaaccaaatgtctatggatgactggccagaaatgaaaaaaaaatttgctgatgtgttcgccgaaaaaacaaaggccgaatggtgccagattttcgatggaacagatgcttgcgtgacgcctgtgctgacttttgaagaagtggtccatcacgatcacaacaaagagagggggtcctttatcacaagtgaagaacaggatgtgtcgccaagaccagcccctttactccttaacacacccgctatccctagttttaaaagagatcccttcatcggggagcacacagaagaaatccttgaagaatttggattttctcgcgaggaaatataccagcttaattccgataaaattatcgaatcaaataaagtcaaagcctcttta

SEQ ID NO: 249411 - DNA, 1146 bp, Artificial Sequence
  Description of Artificial Sequence: Synthetic coding sequence
atggcgctccagggaatctcagtggtcgaactttctggcctggctccagggcctttctgtgccatggtactggcagatttcggggcgcgagttgtgcgcgtggacaggccaggcagtcgctatgacgtctctcgtttgggacgagggaaacgttcgctagtgctagacctcaagcagcccaggggcgctgccgtgctcaggaggttgtgcaaaaggtccgacgtcctgctggaaccctttcgacgcggcgtaatggagaaactgcagcttggacctgagatcctccaacgcgagaatcctcgcttgatttatgccaggttgtccggctttggacagtccggatccttctgtcggctcgcaggtcacgacattaattatctggccttgagcggagtgctctcaaaaatcggtaggagcggcgagaatccctatgccccacttaatctcctcgcagattttgctggcgggggattgatgtgcgcattgggaataattatggccctgttcgaccgaaccaggacaggcaaaggacaggtgatagacgcgaatatggtggaggggacggcttacttatcctccttcctgtggaaaacgcagaagctgtcactgtgggaggcgccaagaggacagaacatgcttgatggtggcgctccattttataccacctaccgcacagcagatggcgagtttatggctgtgggagctattgagccccagttctacgaactgctcattaagggcctcggtttaaagtccgacgagctgccaaatcagatgtcgatggacgactggccagaaatgaagaaaaagtttgccgatgttttcgccgagaaaaccaaggctgagtggtgtcagatcttcgatggcactgatgcctgcgtgacccctgtgctgaccttcgaggaagtagtgcatcatgatcataataaagagagggggtcatttataacgtctgaggagcaagacgtgtcacctcggccagctcccctgctgttgaacacgcctgccatcccgtcattcaaacgcgatcccttcatcggtgagcacaccgaagaaatactcgaggagtttggattttcccgagaagaaatatatcagcttaactcggataaaatcatcgaaagcaacaaggtaaaagcctcactg

SEQ ID NO: 249412 - DNA, 1146 bp, Artificial Sequence
  Description of Artificial Sequence: Synthetic coding sequence
atggcactccagggcattagcgttgtggaactcagcgggctggcaccgggacctttctgcgcaatggtgcttgcggattttggcgcgcgcgtggtacgagtggatcgccccgggagtcggtatgatgtcagcagactcgggcggggaaaacggtccctcgtcctggacttgaagcagccgaggggtgctgctgtcctcagacgactttgcaaacgcagcgacgttctcttggaaccgttcaggaggggggtcatggagaaattgcagctcggccctgagatcctccagagagaaaaccccaggctgatatatgcacggctttctggtttcggccagagcggttccttttgccggttggccgggcacgacattaactacctggcgctgagcggcgtcctgagcaaaataggccgcagtggtgaaaatccttatgcccctctgaacctcctggctgattttgctggaggaggtctgatgtgcgcccttgggattatcatggccctgttcgatcggacgagaaccggtaagggtcaggtgatcgatgcgaacatggtggaaggcaccgcctatctgtcatccttcctgtggaagacccaaaaactgtctctgtgggaggccccgcgggggcaaaacatgcttgacggcggagcccctttctacaccacctatcgcacagccgatggggaatttatggccgtgggagctatagagccccaattctatgaactgctgatcaaaggcctcgggcttaagagcgacgaactgccaaaccagatgtcaatggatgactggccagaaatgaagaaaaaatttgccgacgtcttcgccgaaaagacaaaggcagaatggtgtcagatttttgatggaactgatgcttgcgttacacccgtgctcacgttcgaagaagtcgtgcatcacgatcacaacaaagagcggggtagctttattaccagcgaggagcaggacgtgtccccgcgaccagcaccgctgcttctcaatacccccgccatcccctctttcaaacgagatcccttcatcggcgaacataccgaggagatacttgaagagttcgggttcagtagagaggaaatttatcaactgaatagtgacaagatcatcgaaagcaataaagttaaagcctccctc

SEQ ID NO: 249413 - DNA, 1146 bp, Artificial Sequence
  Description of Artificial Sequence: Synthetic coding sequence
atggctcttcagggaatttcagtggtcgagctgagcggtctggcaccaggccccttttgcgcgatggtgctcgccgattttggtgccagggtggtcagggttgaccgcccaggatcaagatacgacgtgagtaggcttggaagaggtaagagatctcttgttctggacctgaagcaacctcgcggtgcggccgtgctgcgcagactttgtaagagatctgatgtgctgttggagccattcaggaggggagttatggagaaacttcagctgggtccagaaatcttgcagagagaaaacccaaggttgatctacgctcgcctgagtggctttggccaaagcggttcattctgcagactggccggtcacgacattaactacctggccttgagcggcgtcctttcaaagatcggcaggtccggcgaaaacccttacgctccactgaatctcctggccgacttcgcgggaggcggactcatgtgtgccttgggcattattatggcgcttttcgataggaccagaaccggtaagggtcaagtgattgacgccaatatggttgagggaaccgcgtacctgagttctttcctgtggaagactcagaagctctctttgtgggaggctcccagaggacagaatatgctggatggcggcgcacctttctacaccacgtacagaacagccgacggcgaatttatggcagtcggcgccattgagccgcagttctatgagctgcttatcaagggcctgggactgaaatccgacgaactcccaaaccaaatgtccatggatgattggccagagatgaagaagaagttcgccgacgtatttgcggagaagaccaaggcagagtggtgccaaatcttcgatggaactgatgcctgcgtaactcctgtcttgacattcgaggaggtggtgcaccacgatcacaacaaggagcgcggctcatttatcacctctgaagaacaagacgtgagccctaggccagcgccccttctccttaatacccctgccattccgtcttttaagagggaccctttcatcggtgagcataccgaagagatactggaggaattcggcttctctagggaagaaatttatcagctcaactctgataagataattgagtccaataaagtgaaggcatctctc

SEQ ID NO: 249414 - DNA, 1146 bp, Artificial Sequence
  Description of Artificial Sequence: Synthetic coding sequence
atggccctgcagggaatctctgtagtggaactttcagggcttgcacctggaccgttctgcgcaatggttttggccgactttggtgccagagtagtcagggtggatagacctggttcacggtacgacgtatctcgtctgggccgcgggaaacgctccttggttctggaccttaaacagccacggggtgcagccgtcttgagaagactatgtaagcgtagtgatgtcctcctggagccatttcgaagaggagttatggagaagcttcaactcggcccagagatactgcagagagagaacccccgcctgatttacgcccgtctgtcaggcttcggtcagagcggatctttttgcaggctcgcaggacatgacatcaattacttggcactcagtggcgtcctatcaaagataggacgaagcggagagaacccctacgccccgcttaacctgctggcagattttgcggggggggggctgatgtgtgcattgggcattatcatggcactctttgacagaactcgcaccggaaagggtcaggtgatcgatgctaatatggtggagggaacggcttatttgagttccttcctttggaaaacccagaagctctcactttgggaggccccccgcgggcaaaatatgctggacgggggggccccattttacaccacatatcgcacagctgatggcgagttcatggccgtcggggccattgagcctcaattctacgaactcctcatcaagggactgggactgaagtcagacgagctccccaatcagatgtctatggacgattggcctgagatgaagaagaagtttgccgacgtgtttgcagaaaaaactaaggctgagtggtgtcagatcttcgacggcactgatgcatgcgtgactcccgtactgaccttcgaggaggttgttcaccacgatcataataaagagcggggcagtttcataacgtctgaagaacaggatgtgagccctaggcccgctcccctcctgctgaacacaccagccatcccgagtttcaagcgagaccccttcatcggcgagcacacagaggagatcctagaggagttcggattttctcgagaggaaatttaccagttgaactccgacaagatcatcgagtctaataaggttaaagctagctta

SEQ ID NO: 249415 - DNA, 1146 bp, Artificial Sequence
  Description of Artificial Sequence: Synthetic coding sequence
atggcactccagggcatctctgttgtggaactgtctggactggcccccggccccttctgtgctatggtacttgcggatttcggggcccgcgttgtacgggtggaccgaccagggagccgctacgatgtgtccaggctaggccggggtaaaaggtcgctggtgctcgacctgaagcagccgcgtggggcagccgttctcaggcgcctgtgtaaacgatccgacgtgcttctagagcccttcagacgaggcgtgatggagaagctgcagttgggccctgaaatcttgcagagagaaaatccgcgcctgatatacgccagactgtctggcttcggtcagagcgggagcttctgtaggctggccggacatgatatcaattatctggcgctctcaggtgtacttagtaagataggaagatcaggagagaatccttacgcaccacttaatctcctagcagatttcgctggagggggtctaatgtgcgcgcttggcatcattatggctctattcgaccgaactcggaccggcaaagggcaggtgatcgatgctaatatggtggaaggaaccgcgtacctctcctcgtttctctggaagacacagaagctgtctctgtgggaggcgcctcgcggccaaaacatgcttgacggcggcgccccattctatacaacgtatcggacagccgatggcgagttcatggctgtgggggccattgagcctcaattctatgagctcctgattaaaggactgggtctgaagagcgatgaattacccaatcagatgagcatggacgattggcctgaaatgaaaaagaagtttgccgacgtctttgccgagaagaccaaggcagaatggtgtcagatttttgatgggaccgacgcctgtgttacacccgtgctgacttttgaagaggttgtacaccacgaccacaacaaagaacggggcagttttatcacctctgaagagcaggatgtatcccctcggcccgccccattgctgttgaatacccctgcaatcccaagcttcaagcgcgatcctttcatcggggaacataccgaggagatccttgaagagttcgggttctcccgagaggaaatctatcagctcaacagcgataagatcattgaaagcaacaaagtcaaagccagtctg

SEQ ID NO: 249416 - DNA, 1146 bp, Artificial Sequence
  Description of Artificial Sequence: Synthetic coding sequence
atggccctccagggcattagcgtcgtggagctgagtgggctggcccccggacccttttgcgccatggtgttggcagattttggcgcccgagttgtacgagtggataggcctggttctagatacgacgttagccgtctgggcagggggaaacgtagccttgtcttagatttgaagcagccccgtggggccgctgttctccgaaggttgtgtaagcgctcagacgtattgttggagcccttcaggaggggggtcatggagaaactgcaactgggtccagagatcctgcaacgcgagaaccccagattaatctacgcccgcctctccgggtttggacagtctggtagtttctgtcggctggcagggcacgacatcaactacctggcgctatctggcgtgctctcaaaaataggccgctctggcgagaacccatatgctccactgaacttactggctgactttgcaggaggcgggctgatgtgcgccctgggaattattatggcactgttcgatagaactagaactgggaaagggcaggtgattgatgccaatatggtggaaggaaccgcctacctgagctccttcttatggaaaactcagaaactgtctttgtgggaggcacctcggggtcagaacatgctggacggtggggctcccttctacaccacctatagaactgctgacggagaattcatggcagtcggagctattgagccccaattctacgagctgttaatcaaggggctcgggctcaaatcagatgaactcccaaaccagatgagtatggatgactggcccgagatgaagaaaaaatttgcagatgtgttcgccgagaaaactaaagctgaatggtgccagatcttcgacggaacagatgcctgcgtgacgcctgtactgactttcgaagaagttgtgcaccacgaccacaacaaagagagggggagtttcattacctccgaggaacaggatgtgagcccgaggccagccccccttttgctaaatactccggccatcccctccttcaagcgcgacccttttatcggagagcacactgaggagattctcgaggagttcgggtttagtagggaagagatctaccagctgaacagcgacaaaataattgaaagtaataaggtcaaggcgagtctt

SEQ ID NO: 249417 - DNA, 1146 bp, Artificial Sequence
  Description of Artificial Sequence: Synthetic coding sequence
atggccctacagggaatatccgtggtagagctgtccggactcgcaccgggcccattctgcgcgatggtgcttgcagacttcggggctagagtcgtgagggtcgaccgacctggttcgcgatacgacgtgtcgcgactgggtagaggaaaacggtccctcgtattggatctgaaacaaccaagaggggccgcagttctccgaaggctctgtaagcgatcggacgtgcttttggagcccttcaggagaggcgtaatggagaaactgcaactaggaccagagatcttacaaagggagaatcctaggctcatctacgcccgcctgtcgggtttcggtcaaagcggatccttttgccgactcgcgggccatgacattaactatctggctctgtccggcgtgctttcaaagattggccggtcaggagaaaacccctacgctcctctgaatctgctggccgacttcgcaggaggcgggttgatgtgtgctcttgggattattatggcgctctttgatcgcacccgtactggcaaaggccaggtgatcgatgccaatatggttgaaggcactgcctatctgtcaagcttcctgtggaaaactcagaagctatcactgtgggaagctccaaggggccagaacatgctagacgggggagccccgttctatacaacctacagaacagccgatggcgagtttatggccgtcggcgcaattgaaccccaattttacgaactgttgatcaagggcctcgggctgaaaagcgatgagcttcccaatcaaatgtccatggatgactggcccgaaatgaaaaaaaagtttgctgatgtgtttgcggaaaaaacgaaagcggaatggtgtcagatcttcgacggaaccgacgcctgcgtgacacccgtacttacattcgaggaagttgtgcatcacgaccataataaagaaagaggctcttttataacttctgaggagcaggatgtcagccctaggcccgccccattgctgctaaacacgccagctattcccagctttaagagggacccctttatcggagaacatacagaggaaatcctcgaggaatttgggttttcccgagaggaaatttaccagctgaacagcgacaagatcatcgaaagcaacaaagtgaaagcttcactg

SEQ ID NO: 249418 - DNA, 1146 bp, Artificial Sequence
  Description of Artificial Sequence: Synthetic coding sequence
atggctcttcaggggatcagcgtggttgagctgtccgggctagcgccggggccgttctgtgcaatggtgttagcggattttggggccagggtggttagggtagaccgccctggaagcaggtacgacgtgtctcgactgggtcgcggcaagcgatcactggtgctggatctgaaacagcctcgcggggctgctgtgctccgtcgactttgcaaaaggtctgacgtactcctcgaaccattccggagaggcgtgatggaaaagctccaattgggccccgagattctgcagagggagaatcccaggcttatctatgcacgcctatctggcttcggccagtctggctcattctgcagactggcgggacatgacattaactatctcgcactgtctggggtactgagcaaaataggccgatctggcgagaacccgtacgcacctctgaatttgctcgctgacttcgcaggaggggggctgatgtgcgccctggggataataatggcactgtttgaccggacaagaacaggcaaaggccaagtgatcgacgccaatatggtggagggaacagcctatctatcaagcttcctttggaagacccagaagctgagtctctgggaagcgccgagaggccaaaacatgttggatggcggcgcccccttctatacgacatataggacagccgacggtgagttcatggcggtcggcgcaatcgagccccagttctatgagctgttgattaaaggtctgggcctgaagtcagatgaactccccaaccagatgagcatggacgattggcctgaaatgaagaagaaatttgcagatgtgtttgctgaaaaaaccaaagccgagtggtgccaaatcttcgatggcacagacgcatgcgtaacaccggtgcttactttcgaggaagtggtacaccatgaccacaacaaggagaggggcagttttatcactagcgaagagcaggacgtctcaccgcggccggcccctcttcttcttaatacccccgcaataccgagcttcaagagggacccctttatcggcgagcacaccgaggagattctggaagagtttggcttctcccgtgaagagatttaccagctcaattcagataaaatcattgagtccaataaggttaaggcttcactg

SEQ ID NO: 249419 - DNA, 1146 bp, Artificial Sequence
  Description of Artificial Sequence: Synthetic coding sequence
atggcgttgcaagggatttccgtcgtggaactcagcgggctggcgccggggccgttctgtgcgatggtgctcgcggactttggagcccgcgtggtgagagtggacagacctggatcgaggtacgatgtgtcccggctcggacgtgggaaaaggtcactggtgctcgatctgaagcaaccacgcggcgctgcggtgctgcgaaggctgtgcaaacggagcgacgtcctgcttgaacctttcagaaggggtgtgatggagaagttgcagctgggaccagagatcttgcagcgggagaacccacggctcatctatgcgaggctctcgggcttcgggcagtcaggatcgttctgccgattggcaggacatgacatcaactacctggctctctcgggagtgttgtccaaaattgggcgctccggggaaaacccgtacgccccactcaatctccttgctgatttcgcgggtggaggactgatgtgtgccctggggattatcatggcactgtttgatagaactcgcaccggaaaggggcaggtgatcgatgccaacatggtggaaggcaccgcgtacctgtcatcattcctctggaaaactcagaagctctcgctctgggaagcccctcgcggacaaaacatgcttgacgggggcgccccgttctacactacttacagaaccgccgacggcgaattcatggctgttggggccatcgaaccccaattctacgagctgctcatcaagggtcttggcctcaagagcgacgaactcccaaaccagatgagcatggacgactggccagagatgaagaagaagttcgccgatgtgttcgctgaaaagaccaaagccgagtggtgtcagatttttgacggcaccgacgcgtgcgtcaccccggtgctgacgttcgaagaagtggtccaccatgaccataacaaggaaagagggagcttcatcacctccgaagagcaggatgtcagcccaaggccggcccctctgctgctcaacactccggccatcccgtccttcaagcgggaccccttcatcggagagcatactgaagaaatcctcgaggaattcggattctctcgggaggaaatctaccagctgaactcggataagatcatcgaatcaaataaggttaaagcatcgctt

SEQ ID NO: 249420 - DNA, 1146 bp, Artificial Sequence
  Description of Artificial Sequence: Synthetic coding sequence
atggccctgcaagggatcagcgtcgtcgagctctcgggtcttgcgcctggcccattctgtgccatggtgctggcagattttggagcacgtgtggtgcgtgtggatcgccctggcagcaggtacgatgtcagccggcttggccgcgggaagcggagccttgtcctggatctcaagcagccacgcggtgctgcagtgctgcgccgactgtgtaagcgctcggatgtgttgctggagccatttaggcggggcgtgatggaaaagttgcagcttggtcctgagattctgcaacgagagaatcctcgcttgatttacgcaagacttagcggatttggacaaagcggatccttttgccggctggcaggtcatgacattaactatctcgcgctgtcgggagttctttcgaagattggacggtccggggaaaatccatacgcgcctcttaaccttctggccgattttgccgggggtggtcttatgtgtgcattgggaatcataatggctctgttcgatcggacccggactggaaaaggacaggtcatcgatgctaacatggtggaaggtactgcgtacttgtcgtcatttctctggaaaacccaaaagttgtcgctgtgggaagcaccacggggacagaacatgctggatggtggtgcgccattctacaccacctaccgaacggcagatggcgagttcatggcagtgggcgccattgagcctcagttttatgaactgctgattaaggggttgggtctgaaatccgacgaactgcctaaccaaatgtccatggatgattggcctgaaatgaagaagaagttcgcagatgtttttgccgaaaagaccaaggcagagtggtgtcaaatctttgatggcacggatgcctgcgtgacccctgtccttacgttcgaagaagtggtccatcatgaccacaataaggaaagaggctcattcataacttcggaagaacaggacgtcagccctagacctgcaccactgcttcttaataccccagctataccgtcgttcaagagagatccgtttatcggtgagcacactgaagaaattctggaagaatttggtttttcacgcgaagagatttaccaacttaattcagataagatcattgagagcaacaaggtgaaggcatcgctt

SEQ ID NO: 249421 - DNA, 1146 bp, Artificial Sequence
  Description of Artificial Sequence: Synthetic coding sequence
atggccttgcagggaatctccgttgtggaactgtcagggcttgcacccgggcctttttgcgctatggttctggccgacttcggcgcacgcgtggttcgggtcgaccgacccggaagccgctacgacgtgagccgactggggagagggaagcgcagcttagtgctggatctgaagcagccgcgaggtgctgccgttttgaggagactgtgcaagcgaagtgacgtcctactcgaacctttcaggcgaggtgtcatggagaaactgcagttgggcccagaaatcctgcagagagaaaaccctcgacttatctacgcaaggctaagcgggttcggccagagtggatcattctgcaggttggccgggcacgatattaactaccttgccctctctggcgtactgagtaaaattgggagatcaggagagaacccatatgctcctttgaacctcctggctgatttcgccgggggagggctcatgtgcgccctcgggattatcatggctctgtttgatcgaacccgtaccggaaaggggcaagtcatcgacgcaaacatggttgagggaacagcctacctctcttctttcttgtggaaaacccagaaactgtccctgtgggaagcaccacgagggcagaacatgctcgacggcggggcgcccttctataccacctacaggactgctgatggggagtttatggccgtgggagccatcgaacctcaattttatgaactgctaatcaaggggttggggctgaaatcagacgaactgcctaaccagatgtctatggacgactggcctgaaatgaagaagaagtttgctgacgtttttgccgagaaaactaaggccgagtggtgccagatttttgacggtacagatgcctgcgtaacgcccgtgctgacattcgaggaagtggtgcaccacgatcacaacaaagaacgaggttcttttataacatccgaagaacaagacgtgtcaccaaggccggcccccctccttttgaacactcctgccataccaagttttaagagagacccattcataggggaacatactgaagaaattttggaggagtttggattttcacgagaggagatatatcagctgaattcagataaaatcattgaaagcaataaggtaaaggcctccctg

SEQ ID NO: 249422 - DNA, 1146 bp, Artificial Sequence
  Description of Artificial Sequence: Synthetic coding sequence
atggccctgcagggaatctcggtggtcgaactctccggccttgccccaggaccgttttgcgcgatggtgctggcggattttggggccagagtcgtgcgggtagaccggcccggctccagatacgacgtgagccggctgggccgcggaaagcgatcattggtgctggaccttaaacaacctcggggcgcagcagtgctccgtaggctgtgcaaaaggtcggacgtgttgctcgagccgttccgcaggggagtgatggaaaagttgcagttggggccggaaatcctgcagagggagaatccccgccttatctacgcaagactctcaggatttgggcagtcaggatccttttgtaggctggctgggcatgacatcaactacctggctctgtcgggagtcctttccaagatcggacggtcgggcgaaaacccatacgcaccactgaacctccttgcggacttcgcaggcggtggactcatgtgcgcacttggcataatcatggccctctttgacagaacccgcaccgggaaaggacaggtcatagacgctaacatggtggaaggaaccgcttacctctccagcttcctgtggaaaacccagaaactgagcctgtgggaggctccgcgggggcagaacatgctcgatggcggagcaccgttctataccacctaccgcactgccgatggagagttcatggcggtgggagccatcgagcctcaattctatgagctgctgatcaagggccttgggctcaagtctgacgagctgccgaaccaaatgtcaatggacgattggcccgaaatgaagaagaagttcgccgatgtgtttgcagaaaagactaaggcggaatggtgccaaatcttcgacgggaccgatgcatgcgtcaccccggtgctgactttcgaagaagttgtgcatcacgatcataacaaagagagagggagcttcatcacttccgaagaacaggatgtgagcccgcggccggcaccccttctgctgaacacgccggccattccatcgttcaagcgggacccgttcatcggagagcacaccgaggagatcctggaagagttcggattctcccgcgaagaaatctaccagctgaatagcgacaagattatcgaatcgaataaagtgaaggcatcgttg

SEQ ID NO: 249423 - DNA, 1146 bp, Artificial Sequence
  Description of Artificial Sequence: Synthetic coding sequence
atggccttgcagggcatcagcgttgtggagctgtccgggctcgccccagggccgttctgtgccatggtcctagcggattttggtgcccgggtagtgcgcgtcgataggcccggtagcagatacgacgtgtctcggctcgggcgaggtaaaaggtctctggtccttgacctcaaacaaccacgcggcgcagctgtgctgcgcagactctgcaagaggtctgatgtgttgcttgagccttttcgcaggggcgtcatggaaaagctgcagctggggccggaaattctgcagcgggagaatccccggttgatctatgcgaggctgtctgggttcgggcaatccggtagcttctgtagactggcagggcatgacattaattatctggccttaagcggcgtgctgtccaaaattggccgttcgggcgagaatccttacgctcccctaaacctcctcgccgatttcgcgggggggggcctgatgtgcgctttagggatcatcatggccctctttgaccgcactaggaccggtaagggccaggtgattgacgccaacatggtcgaaggtacagcctatctgagttcgttcttatggaaaacgcagaaactgagtttgtgggaggcgccgcgggggcagaatatgctggacgggggggcccctttctacaccacatacaggacggcggatggggagttcatggccgtgggtgcgatagagccacaattctacgagctgctgattaagggcctcggcctgaaaagcgatgagctacctaatcagatgtcgatggacgattggcccgaaatgaaaaaaaaatttgctgatgtttttgcagagaaaaccaaggccgaatggtgccaaattttcgacggtacggatgcttgcgtaacaccagtgcttacttttgaggaggtggtgcaccacgaccacaataaggagcgcggcagtttcatcacttcagaggagcaggatgtctcaccaagacctgcacctctgttgcttaacactcccgccatcccctcttttaagcgcgaccctttcattggagagcacactgaagagattttagaggagttcggtttctctagggaagaaatctatcagttaaactccgataaaatcatagagtccaataaagtgaaggcatcactc

SEQ ID NO: 249424 - DNA, 1146 bp, Artificial Sequence
  Description of Artificial Sequence: Synthetic coding sequence
atggcgttgcagggaatatccgttgtcgaactgagtggcttagcccctggacctttttgcgccatggtgctggccgacttcggcgctagagtggtgcgggtggatagacctggatcccgatacgacgtttcgcgcctggggcgcggaaagagatctctagtgctggatctgaaacagcctcgaggcgcagctgttctgagaaggctgtgtaagaggagcgatgtgctgctcgaacctttccggcggggcgtaatggagaaactccagctgggccctgaaatcctgcaacgggaaaacccacgtctgatttatgctagactctcagggttcggccagtctggcagcttttgcagattagctgggcacgatatcaattaccttgcgttgtccggcgtgttgtctaagataggaaggtcaggggaaaatccctacgcccccttgaatttgctagccgacttcgcagggggcggtcttatgtgcgccctggggattattatggccctgttcgaccgaacacggaccgggaaagggcaggtgatagatgctaacatggttgagggcacagcctacctgagttcttttctgtggaaaacacagaaattgtctctctgggaagccccgagagggcagaacatgctggatggcggtgcccctttctatacaacgtacaggactgctgacggcgagttcatggcggtcggcgccatagagccccagttctatgaactcctgatcaaggggctgggcctaaagagtgatgagttaccgaatcaaatgtctatggacgactggcctgagatgaagaaaaaattcgctgacgtgttcgctgaaaagactaaggccgagtggtgccagattttcgatggcacggacgcctgcgtcacgccagtgctgactttcgaggaagtcgtgcaccatgaccataacaaggagcgcggttcattcatcacttccgaagaacaggatgtttccccaaggccggccccgcttctgcttaacactccagccattccctcatttaagcgggaccccttcatcggcgaacacactgaggagatcttagaagagttcggattcagtcgggaagagatctatcagctcaattcggacaagattatcgaatcaaacaaggtgaaagccagcctc

SEQ ID NO: 249425 - DNA, 1146 bp, Artificial Sequence
  Description of Artificial Sequence: Synthetic coding sequence
atggcattgcagggaatctcggtcgtcgaactcagcggactcgcccctggacccttctgtgctatggtgctggcagactttggtgcccgcgtggtgagagtcgacaggcctgggtcgcggtacgatgtgtcacgactgggccggggaaagaggtccctggtgctggatctcaagcagcctcgcggtgcagccgtcctgcgcagactttgtaagcgctcggatgtccttctggaaccctttagaaggggggtgatggagaagctccagcttggaccggaaattctgcagcgagaaaaccctcggctcatttacgctaggctttcggggtttggacagtctgggagcttttgtcgtcttgcaggccatgacattaactacctggcacttagcggagtgctctcaaagatcggaagatccggagaaaatccatacgcaccactcaatctcctggccgattttgccggcggtggacttatgtgtgcactggggatcattatggcactttttgacagaacgcggaccggaaagggacaggtgatcgatgcaaacatggtcgaaggtactgcctacctttcctcgtttttgtggaaaactcagaaactctccctgtgggaggcacctcggggtcaaaacatgcttgacggcggcgcccctttctacaccacctaccggaccgctgatggtgaattcatggcagtgggagccattgaaccccaattctacgaattgctgattaagggacttggactgaaatcggatgagctgcctaaccaaatgtcgatggatgattggccagagatgaagaaaaagtttgcagatgtgtttgcagagaaaactaaggctgaatggtgtcaaatcttcgacggtaccgacgcttgcgtgactcccgtgctcacttttgaagaggtggtccatcatgatcacaataaggaacgcggatcgttcattacgtcggaagaacaagatgtgtcacccagaccagcaccgctgcttctcaatacccctgcaatcccttccttcaagagagatccgtttattggcgagcacactgaagagatccttgaagaatttggcttttcccgcgaagagatttatcaacttaactccgataagattattgaatccaacaaagtgaaggcaagcctt

SEQ ID NO: 249426 - DNA, 1146 bp, Artificial Sequence
  Description of Artificial Sequence: Synthetic coding sequence
atggcgttgcaaggaatctccgtcgtggagctctccggactcgcacctggaccattctgcgctatggtcctggcggattttggcgcacgggtcgtcagggtggacaggcccggctccagatacgacgtgagcaggctgggacgtggtaagagatcacttgtgttggacctgaagcagcctcggggagccgcagtgttgcgtcgcctctgcaaaagatcagatgttttgctcgagcctttccggaggggcgttatggaaaagctgcagctgggtccagaaattcttcaacgggaaaatccacgtcttatctacgcgcggttgagcgggtttggacagtcgggttccttttgtcgactcgctggtcacgatatcaattaccttgcactttcgggagtgctttccaaaattggtaggtccggtgaaaacccctatgcaccgctgaacctcttggcagattttgccgggggaggactcatgtgcgcactgggaatcattatggcactgtttgaccggacccgaaccggcaaagggcaagtcattgatgccaacatggtcgagggaactgcatacctgtcatcgtttctgtggaaaacccagaaactttcactttgggaagcaccaagaggtcaaaacatgctggacggaggcgcgcctttttacactacctaccgtacggccgacggggagttcatggcggtgggagcaattgagccgcaattctatgaactgcttatcaagggattgggactcaagtccgacgagcttccaaaccaaatgtctatggatgactggccagagatgaagaaaaagttcgccgatgtgttcgctgaaaagaccaaggccgaatggtgccagatttttgatgggacggacgcatgtgtgactccagtgttgacgtttgaagaagtggtccatcatgatcataacaaggaacggggttcgtttatcacttccgaagaacaagatgtgtctccccgacccgcacctctccttctgaatacccctgcaatcccgagcttcaagcgcgatccattcatcggtgagcacaccgaggaaattctggaagaatttgggtttagcagagaggagatttaccagctcaatagcgataagataattgaaagcaacaaagtgaaagctagcctt

SEQ ID NO: 249427 - DNA, 1146 bp, Artificial Sequence
  Description of Artificial Sequence: Synthetic coding sequence
atggccctacaggggatttcagttgtcgagctgtctggcctcgcacctggtcctttttgtgccatggtgctggctgacttcggggcccgcgtggtcagagtggaccgtcctggctctcggtatgatgtgagcaggttgggtcgaggaaaacggagtttagtgctagatctgaaacaaccccggggcgcagctgtactacgcagactatgcaagcggtctgacgtcctgctcgagccttttcggcgcggagtgatggagaagctgcaactgggccctgaaatcctacagagggagaatccacggctcatttatgcaagactgtccgggttcggccaaagtggctcattttgccggctagcagggcatgatattaactacctggccttgtctggtgtcctgtctaagatcgggcggagtggcgagaacccttacgcccctctaaatctactggcagatttcgctgggggtgggctgatgtgcgctctgggcattattatggcactgttcgacagaacacgaacagggaagggtcaggtcatagacgctaatatggttgaagggaccgcctacctctcaagcttcctgtggaagacacagaaactgtccctgtgggaggcacccaggggccagaatatgttagatggcggagccccattttatacaacatatcggacagctgacggggagttcatggccgtgggcgccattgagccccagttctatgagctgctgatcaaaggactcggacttaagtccgatgaactgccaaatcagatgagcatggacgactggcctgagatgaagaagaagtttgctgatgttttcgccgaaaagacaaaggccgagtggtgtcagatctttgacgggactgatgcttgtgtgacccccgtgctgactttcgaggaggtcgtgcaccacgatcacaacaaggagcggggttcctttatcacctcagaggagcaggacgtgagccccaggccagctcccctgctgctgaacactcctgccatccctagtttcaagagagatcccttcataggtgaacacactgaggagatacttgaggagttcggcttctctagggaggagatatatcagctgaactctgacaaaattattgagagtaataaagtgaaagcaagtcta

SEQ ID NO: 249428 - DNA, 1146 bp, Artificial Sequence
  Description of Artificial Sequence: Synthetic coding sequence
atggcattgcagggcatatccgtggtggaattgtctggcctggcaccaggaccattttgcgcaatggtgcttgctgattttggagcccgggtggtgcgagtggatcgccccggatctagatacgacgttagcaggctgggcagaggaaaacgctctctggtgctcgatttgaaacaaccccgcggagcagcagtgctgcgccgactgtgcaagagatccgatgtcctcctcgagccctttcgcaggggcgttatggagaaactgcagctggggcccgagatcctgcagagagagaatccccgccttatatatgctcgtctgtccgggttcggccagagcggctccttctgcagactggctggccatgatatcaactaccttgctctctctggcgtgctgagcaaaattggaaggagtggagagaacccatatgcccccctgaacctgctggcagactttgccggaggggggttgatgtgtgctctcggaatcattatggctctttttgaccggactcgtactggaaaaggacaggttatcgacgctaatatggtcgaagggactgcatacctgtcatccttcctgtggaaaacacagaaactttcgctatgggaggcgccccgaggccagaatatgctggacgggggggccccgttttacactacataccgcacagcagacggagaatttatggccgtgggcgccatcgagcctcagttctatgagctgctcatcaagggcctggggttaaagtctgacgagctgccaaaccagatgtccatggacgattggccagagatgaagaagaagttcgctgacgtgtttgcagaaaaaacaaaggccgagtggtgccagatattcgatgggactgatgcctgtgtaacgccggtgctaaccttcgaggaagtggtgcatcatgaccataataaagagcgcgggtcttttattacaagcgaagagcaagacgtctctccaaggcccgcccccctcctgctgaatacaccagcaataccctcatttaaacgcgatcccttcatcggcgagcatacggaggagatcctcgaggagtttggatttagccgagaggagatctatcaactgaactctgataagatcatcgagtcaaataaagtgaaggcctcacta

SEQ ID NO: 249429 - DNA, 1146 bp, Artificial Sequence
  Description of Artificial Sequence: Synthetic coding sequence
atggcgctgcaaggtataagcgtggtggagctctcgggactggcgccgggacccttttgcgcgatggtgctggcggacttcggcgcccgggtggttcgcgttgatcgtccaggaagcagatacgacgtgtcacgcctcgggcgcggtaagcgctcgctggtgctggatctgaaacaaccgcggggagccgcggtcctcaggagattgtgtaagcgctcagacgtgcttctggaaccgttccgcagaggcgtcatggaaaaactgcaactgggcccggaaatcctgcagcgcgagaaccctagactgatctacgcccggctttccggattcggacaatcgggatccttctgcagactcgcaggtcacgacatcaactacctggcgctttccggagtgctctccaagatcggccggtccggggagaacccttacgcgcccctcaacctcctggctgacttcgcaggaggagggctgatgtgcgcgctcggaataatcatggcgctctttgatcggacccgaactggaaagggccaagtcatcgatgctaacatggtggaaggcactgcttacttgagttcattcctgtggaaaacccagaagctgagcctgtgggaagctccacgcggacagaacatgctggatggcggggcgccgttctacaccacctacagaaccgccgacggagagttcatggctgtgggcgccatcgagcctcagttttacgaattgctcatcaagggattgggactgaagtcggacgagctgcccaaccagatgtcaatggatgattggcctgagatgaaaaagaagttcgccgatgtgttcgctgaaaagactaaggccgaatggtgtcagatttttgatggaactgatgcatgcgttaccccggtgctcactttcgaagaggtcgtccaccatgaccacaacaaagagcggggatcgttcatcacctcggaagagcaggacgtctccccaaggcccgcaccgttgctcctgaatactccagcgatcccttcgttcaaaagagatccgtttatcggagaacatacggaggaaatcctcgaggagttcgggtttagcagagaggagatctaccagcttaactcagacaagattattgagtcaaataaggtgaaggcaagcctg

SEQ ID NO: 249430 - DNA, 1146 bp, Artificial Sequence
  Description of Artificial Sequence: Synthetic coding sequence
atggcacttcagggaatctcggtggtggagttgtccggcttggcgccgggacctttttgtgcaatggtgctggccgacttcggagctcgggtggtccgggtggacaggcccggatcccggtacgacgtgtcccggctggggcgcggcaaacgatcactggttttggaccttaagcagccgcggggggcagccgtgctccgccggctctgcaagcgctccgacgtgttgctggagccgtttaggagaggggtcatggagaagttgcagctgggaccggagatcttgcaaagagaaaatccgagattgatttatgcccgcctgagcggattcggccagagcgggtcgttctgcagacttgctggccacgatatcaactacctcgccctgtctggagtgctgagcaagatcggccgctcgggagagaatccttacgccccactcaatttgttggctgatttcgctggaggtggtctgatgtgcgccctcggcatcatcatggccctgtttgatcggactagaaccggtaaaggccaagtgatcgacgctaacatggtggaaggaaccgcatacctcagctcgttcctctggaaaacccaaaagttgtccctgtgggaggctccgagaggacagaacatgctggacggaggagccccgttctacaccacttaccggaccgcggacggcgaattcatggccgtcggggctatcgagccgcaattctacgaactgcttatcaaggggctgggactcaagtcagacgaactcccaaatcaaatgtcaatggacgattggccagaaatgaaaaagaagtttgcggacgtgttcgccgagaaaacgaaggctgaatggtgccagatctttgacggcaccgacgcatgcgtgaccccggtgctgacctttgaggaggtcgtccatcatgaccataacaaggaacgggggtcatttatcacttccgaggaacaggatgtgtcaccaagacccgcgccgcttctgctgaatactccggcgattccgagctttaagcgcgacccgttcatcggcgagcataccgaagaaattctggaggaattcggattctcgagggaggagatctatcaactgaattcagataagatcattgagagcaataaagtcaaggcgtctctg

SEQ ID NO: 249431 - DNA, 1146 bp, Artificial Sequence
  Description of Artificial Sequence: Synthetic coding sequence
atggccctccagggtatctctgtggtggagctatcagggttggcccctggccccttctgcgcaatggtcctggcggattttggggctagggtggtaagagtggaccgtcccggttctcggtacgatgtgtctagattgggtaggggaaaacgcagtctggtgttggatttgaagcagccacggggggccgctgtgttgcggcggctgtgtaagcggtccgacgttctgctggagccttttcgcagaggggttatggagaaactacagttaggtcctgagatcctacagcgggagaacccacgcctgatctacgccaggctgtccgggtttggtcagtccgggagcttttgtcggctggctgggcatgacataaattacctagcgctctctggcgttctatcaaagataggccgatctggggagaacccatatgctcctctgaatttgctggcagattttgccgggggaggattgatgtgcgcactcggtattataatggctttattcgaccgcacaaggactggcaaggggcaggttatcgatgccaatatggttgagggcacggcctatctatctagttttttatggaaaactcagaagctgtctctgtgggaggctccacgtggacagaacatgctggacgggggggcacctttctacactacctaccgaaccgccgatggtgaatttatggccgttggcgcaattgagccgcaattctacgagctgcttataaaagggctgggactgaaatcagacgaactccccaaccagatgtcaatggacgactggcctgaaatgaagaaaaagtttgctgacgtgttcgcagaaaaaaccaaggcggaatggtgtcagattttcgacggtacagacgcgtgtgtcacgcctgttttgacattcgaagaagtcgtgcaccatgaccataacaaagaacgcgggtctttcattacgagtgaggaacaggacgtttcaccccggcctgccccgttgctccttaacactccggcaataccctctttcaagcgggatccgttcattggagagcatactgaggagatcttggaagagttcggatttagtcgggaagaaatataccaacttaattctgataaaatcattgagtcaaacaaggtgaaggcatctctg

SEQ ID NO: 249432 - DNA, 1146 bp, Artificial Sequence
  Description of Artificial Sequence: Synthetic coding sequence
atggccctgcaggggatctcagtggtcgagctctccggtctggcccctggccctttttgcgcaatggtgctggctgattttggcgcaagagtcgtcagagtggaccggcccggctcacgctacgacgttagcaggctggggcggggaaaaagaagtttggtgctagacttaaaacagcctcggggagcggcagtgttgagacgcctgtgcaagcggagcgacgtcctcctcgagccgttcaggcggggcgtcatggaaaaactgcagcttggaccagaaatactccagcgtgaaaacccacgactcatctacgcgaggctcagcggatttgggcagtcggggagcttttgtaggttggccggtcacgatattaactatctggcactgtccggagtccttagtaagatcgggcggagtggggaaaacccctatgcccctctgaatctgttggccgatttcgccgggggtggcttaatgtgcgccctggggattatcatggccttgttcgaccggacccgcacgggtaaaggtcaagtgattgatgccaatatggtggagggcaccgcgtatctctcctcatttttgtggaaaacacagaagctgagtctctgggaggcaccgcgggggcaaaatatgctggatggaggagctccgttctacacgacctatcgcactgccgatggggagtttatggcggtgggcgctatcgagccccagttttatgagctgttgattaaggggctagggcttaagtctgatgaactgccgaatcaaatgtcaatggacgactggccagagatgaagaagaaatttgcagatgtgttcgcagaaaaaactaaggccgaatggtgccagatattcgatggaaccgatgcctgtgtcaccccagttctgactttcgaggaggtagtccatcacgaccacaataaggaacgtggatcttttatcacaagcgaggagcaagatgtgtcccctcggcccgccccattattgctgaacacgccagctatacctagttttaagagagacccctttatcggcgagcatacagaggagatcttggaggagtttggtttttcccgggaggagatttaccagctcaacagcgataagatcatcgaatcaaataaagtgaaggcctccctg

SEQ ID NO: 249433 - DNA, 1146 bp, Artificial Sequence
  Description of Artificial Sequence: Synthetic coding sequence
atggcactccaggggatttccgtcgtggaactttccgggttggcccccgggcccttttgtgccatggtgctcgcagacttcggggctagagtggttcgggtagataggcccggatctcggtacgatgtgagtaggctcggaagagggaaaaggagtctggtgctagatctgaaacagccccgaggagcagctgtcctacgccggctgtgtaaaagatcagatgtacttctagaacccttcagaaggggggtgatggaaaaattacagttaggacccgagatcttgcagagggaaaatccaagactgatctatgcgcgactatctggattcgggcagtccgggtctttctgtaggttagcaggacatgatatcaattatctcgctctgtctggagtcctgtccaagatcggacggtcaggagaaaatccttatgcccccttaaatcttctagcggactttgcaggaggagggctcatgtgtgcccttggaatcatcatggctctctttgacaggacaaggactggaaaggggcaggtcatcgatgccaatatggtcgaaggaactgcttacctctcttcatttctttggaagacacagaagctatccctctgggaggcaccccgcgggcagaatatgcttgatggaggggcgccattctatacaacatatagaacagccgatggagaatttatggcagtcggagccatagagccccagttttacgagctcctaataaaagggctcgggctaaagtcagatgaacttcccaatcagatgtctatggatgactggccagaaatgaaaaagaaatttgccgatgtttttgctgaaaaaacgaaagctgagtggtgccagatctttgatgggactgacgcttgtgtgactcccgttcttacattcgaggaggttgtgcatcacgatcataataaagaacgcgggtcttttatcacgtctgaggagcaagatgtgtccccccggcccgcccccctccttcttaatactccagctataccctccttcaaacgcgatcctttcataggggaacacacagaagagatactcgaagaatttggattctccagggaagagatctaccagctgaactctgataaaattatcgaatctaataaagtgaaagcatcgctg

SEQ ID NO: 249434 - DNA, 1146 bp, Artificial Sequence
  Description of Artificial Sequence: Synthetic coding sequence
atggccctgcaaggaatctcggtggtggagctctcgggactcgcaccgggaccgttctgcgcaatggtccttgctgattttggagcacgggtcgtgagagtggatcgacctggaagcaggtacgatgtgtcgagattgggacggggaaagcggtcactggtgctcgacctgaagcagccgcgcggcgctgctgtgctgcggagactgtgcaagagatccgacgtgcttcttgagccatttagacgtggggtgatggaaaaactgcagctgggtccagagatcttgcagagagagaacccacgcctgatctacgcgagactttccggctttggacagagcgggagcttctgtaggctggctggccacgatatcaactaccttgcgttgtcaggcgtcctgtcgaaaattggccggagcggagaaaacccttatgccccgctgaatttgctcgcagacttcgctggagggggcctgatgtgcgccctcggaatcattatggccctcttcgaccgcactcggaccggaaaggggcaggtcattgatgcgaacatggtggaaggcaccgcatacctctcttcgttcctctggaaaactcaaaagctctcgctctgggaagccccacgcgggcaaaacatgctggacggaggagccccattctacaccacctaccgaacggcggacggagagtttatggccgtgggagccatcgagccgcaattctacgagttgctgatcaaaggactcggtctgaagagcgacgaactgcctaaccagatgagcatggatgactggcctgaaatgaagaagaagttcgccgacgtgtttgctgagaaaaccaaggcggagtggtgtcagattttcgacggcaccgatgcgtgcgtgacccctgtcctgacgtttgaggaggtcgtgcaccatgatcacaataaggagcgcggctcatttatcacctcggaagagcaggatgtgtctccgcggccggcgcctctcctgctcaacacccctgcgatccctagcttcaagcgcgacccttttatcggggaacatactgaagagatcctggaagaatttgggttttcgcgggaagagatataccaactgaactcagacaaaatcatcgaaagcaacaaagtgaaggcgagcctg

SEQ ID NO: 249435 - DNA, 1146 bp, Artificial Sequence
  Description of Artificial Sequence: Synthetic coding sequence
atggccttgcaaggaatctcggtcgtggaactttcaggtttggcaccggggccattttgtgccatggtgctggctgattttggcgcacgcgtggtcagggttgaccggccaggatcgcggtacgatgtgtccaggcttggaaggggaaagaggtcccttgtgctcgatctgaaacagcctaggggcgcagcagtgctgcggaggctctgtaagcggagcgatgtgctgttggaaccattcagacggggcgtgatggaaaagttgcagttgggtccggagattttgcaacgagagaaccctagactcatctatgcgcggctgagcgggtttgggcagtcgggttccttttgccggctggccggtcacgacatcaattacctggcattgtcgggtgtgctgtcgaaaattggacgaagcggtgagaacccttacgcaccactgaatctgctggcagattttgcgggaggtggtttgatgtgcgctctgggtattatcatggcacttttcgaccggacgcgcaccggaaagggacaagtgatagacgcaaacatggtggaagggaccgcctacctctcgtcctttctctggaaaacccagaaactctccctgtgggaagcacctagaggtcaaaacatgcttgatggaggagcacccttctacactacttaccgtaccgccgacggagagtttatggcagtgggagcgatagaacctcaattctacgaactgctcatcaagggcctgggccttaagagcgatgaactgccgaaccagatgtcgatggacgattggcctgagatgaagaaaaagttcgcagatgttttcgcggagaaaaccaaggcagagtggtgtcaaatctttgatggtactgacgcgtgtgtcactccagtgcttacttttgaggaggtcgtccaccacgatcataacaaggagagaggcagcttcattacttccgaggagcaggacgtatcaccaagaccagcaccactgctgcttaatacccctgctattcccagctttaagagggaccctttcattggtgagcataccgaagaaatccttgaagagtttggtttttcgcgggaagagatttaccaacttaattcggataagattattgaatcgaataaagtgaaggcatccctc

SEQ ID NO: 249436 - DNA, 1146 bp, Artificial Sequence
  Description of Artificial Sequence: Synthetic coding sequence
atggccttgcaaggcatcagcgtggtggaactcagcgggctcgctcccggacccttctgcgcaatggtgctagcggattttggcgctcgtgtcgttcgggttgaccggccaggatcacggtacgacgtctctcggttgggccgggggaagagaagcctggtgctcgacctcaagcagcctaggggcgcagcagtgttgagacgcctgtgcaagaggtctgacgtgttactcgagccttttcggcggggggtgatggaaaagctgcagctcggaccggagatcctgcagcgcgaaaatccaaggctcatctacgctcgtctttcagggtttggccagtcaggctctttttgtcggctcgccggtcatgacatcaattatttagccctgtccggcgtactgtctaaaatcggccggtctggtgagaatccatatgcccccttaaaccttctggccgactttgcgggtggggggctcatgtgtgcactcggtatcattatggcgctgtttgataggacacggactgggaagggccaggttattgatgcaaacatggtggaaggcacagcctacttgtcttcttttttatggaaaacccaaaagctgtcactctgggaagccccaaggggacaaaacatgctcgatggcggagctcccttctataccacgtaccggactgccgatggagaatttatggctgtcggggccatcgaaccacagttctatgagttgctgatcaagggcctgggtctgaagtccgacgaactgcccaatcagatgtccatggacgactggccagaaatgaaaaagaagtttgctgatgtatttgccgagaagacgaaggctgagtggtgccaaatcttcgatgggactgatgcatgcgtgactccggttctgacattcgaagaagtcgttcaccacgatcacaacaaagaacggggttccttcatcacttctgaagaacaagatgttagcccacgcccagccccactcttattgaatacccctgctattccatcttttaagagagaccccttcatcggcgaacacaccgaggagatcctcgaagaattcgggttctctagagaggaaatctatcagctaaacagtgacaaaattatcgaaagcaataaggtaaaagccagtctg

SEQ ID NO: 249437 - DNA, 1146 bp, Artificial Sequence
  Description of Artificial Sequence: Synthetic coding sequence
atggccttgcaaggaatcagcgtcgtggaactgtccggactcgccccgggtccgttttgtgccatggtcctcgccgatttcggagctcgggtcgtgcgggtggacaggcccggctcacggtacgatgtgagcaggctcggacgaggcaagcggagcctcgtgctggacctcaaacagccacgcggagcggcagtgctcagaaggctgtgtaagcgctccgacgtgcttctggaaccgtttaggcgcggggtcatggagaagctgcaactcggacctgaaatcctgcagcgcgagaacccaagactgatctacgcgcgcctgtcgggattcggccagtcgggctcattctgccgactggcgggacatgacatcaactatctggccctgagcggtgtcttgtccaagatcggtcggtcaggcgaaaacccatacgccccacttaacctcctggcagacttcgccgggggaggactgatgtgcgctctggggatcatcatggcgcttttcgaccggaccaggacggggaagggacaggtcatcgatgcgaatatggtggaaggcactgcctacctgagctcattcctttggaaaactcaaaagttgtcactttgggaagcacctcgcggacaaaacatgctcgatggcggagccccgttctacactacctaccggactgccgatggagagttcatggcagtgggagccatcgaaccacaattctacgaattgctgatcaaggggctgggattgaagtccgacgaacttccaaaccaaatgtcgatggacgactggccggaaatgaagaaaaagtttgcagatgtgttcgccgaaaagactaaggcggaatggtgccagatatttgatggcacggatgcttgcgtgactccggtgttgacgttcgaggaggtagtccaccacgatcataacaaggaacggggatcattcatcacctcggaggaacaagacgtgtcacctcgtccggctcctctgctcctcaacaccccggccattccatcgtttaagcgcgacccctttatcggcgagcacaccgaggaaatcctcgaagagttcggattctcgagggaggagatctaccaactgaattccgacaagataatcgagagcaacaaggtcaaagcatccctt

SEQ ID NO: 249438 - DNA, 1146 bp, Artificial Sequence
  Description of Artificial Sequence: Synthetic coding sequence
atggcactccagggcatttctgttgtagaactctctggactcgcccctggacccttctgcgccatggttctagccgattttggcgctcgggtcgtgagggttgacaggccgggctctagatatgacgtgtccagacttggtcgtggtaagcgtagcttggttctcgacctgaaacagcctcgtggtgccgcagttctgcgccggctgtgtaagaggagcgatgtacttctcgaaccgtttcgccgaggtgtgatggaaaaactacagctcggcccggaaattctgcagagagagaatccacggttgatttacgcacgcctatcaggtttcggtcagagtgggtccttctgtaggcttgctggacacgacatcaattacctagcactttcgggggtgctgagcaagatcggaagatccggcgaaaacccatacgcccctctgaacctgcttgcagattttgcaggaggagggctgatgtgtgcactgggaatcattatggcactcttcgacagaaccagaaccgggaagggacaggtgattgacgctaatatggtcgaaggcaccgcatatctaagtagcttcttatggaagacacagaagctgtctctttgggaggccccacggggtcaaaacatgctcgacgggggagccccgttctacacgacttatcgaacggcagacggcgagttcatggccgtgggggctatagaaccccaattctacgagctattaatcaagggtttagggctgaaatctgacgaattgccgaaccagatgtcaatggacgattggcctgagatgaagaaaaagtttgctgacgtcttcgcggaaaagacgaaagctgagtggtgccagatcttcgacggaacggatgcatgtgtcaccccagtcctgacctttgaggaggtcgtgcaccatgatcataataaagagcgcggctcattcatcacctcagaggagcaagatgtgagcccccgcccagctcccctcttactgaataccccggcaattccatcctttaaacgggacccattcattggggagcatactgaggagatccttgaagagtttgggtttagcagggaggagatataccaactgaattctgacaaaatcatagagagcaataaagtaaaggcaagtctt

SEQ ID NO: 249439 - DNA, 1146 bp, Artificial Sequence
  Description of Artificial Sequence: Synthetic coding sequence
atggcccttcagggcatcagtgtggttgagctttctggactggctcccgggcctttctgtgctatggtgctagccgattttggggcacgggtggtgagggttgatcgtcctggcagcagatatgatgtgagcagactggggcggggcaagcggtcattggtcttggatctgaagcagccgaggggagcagccgtacttcgcagactctgtaaacgatccgacgtgttacttgagccatttcgcagaggtgtgatggagaagctccagctggggcccgaaattcttcagcgcgaaaacccgcggctgatctacgcaagactttcagggttcggacagtccggctcattttgtagactggctgggcacgatatcaattacttggctctgtcaggagtgctttccaaaataggccgcagtggcgagaatccctatgctcctctgaacctgctggccgactttgccggtggcgggctgatgtgcgccctcggaattatcatggccctctttgacaggacaaggaccgggaaaggccaggtgatcgatgcaaacatggtggaggggaccgcctacctgtcttcatttttatggaaaactcagaaactgtctctgtgggaagcaccccgtgggcaaaacatgctggatggtggggctcctttctacaccacctaccggacggcagatggcgaattcatggctgttggagctatcgagccacagttttatgagcttctaattaagggcctggggctgaagtctgatgaactgcctaatcagatgtctatggacgactggcccgagatgaagaaaaagttcgcggacgtctttgcagaaaaaaccaaagcagagtggtgtcagatttttgatggaactgacgcatgcgtgacacctgtgctgactttcgaagaggttgtgcaccacgatcacaataaggagaggggaagcttcatcacttccgaagagcaagatgtaagcccgcgtccagcgccgcttcttcttaacactcccgcaattccgtctttcaaaagggatcccttcatcggtgagcatacagaagaaattctggaggagtttggcttcagccgggaagaaatctaccagctcaattcagacaaaatcatcgagagtaacaaggtgaaagcttccctg

SEQ ID NO: 249440 - DNA, 1146 bp, Artificial Sequence
  Description of Artificial Sequence: Synthetic coding sequence
atggctctgcaaggtatctctgtggttgaactgagcggactcgcccccggccctttttgcgccatggtcctggccgattttggcgcccgagtggtgagggtggacaggccaggatcccgttatgacgtaagtaggctgggtagggggaaacgcagcctagtgcttgacttaaaacaaccccgtggcgccgccgtgctgcgaagactttgtaaacgctccgatgtgcttctcgaaccctttagaagaggtgtgatggagaagcttcagcttggccccgaaatcctgcagagggagaaccccagactcatctatgctaggctttctggcttcggccagagtggttccttctgtagattggccggacatgatatcaattacctcgctctgtctggagttttgagtaagattgggcgtagcggcgagaatccctacgctccactcaatctattggccgacttcgccgggggaggactgatgtgtgcgttgggcatcattatggcactcttcgacagaacacggaccggcaaaggacaggttattgatgcgaacatggtggaaggcacagcttatctgtctagtttcctctggaagacacagaagctgagcctgtgggaagcaccccggggccaaaatatgttagatggaggcgcccctttttacacgacttaccgaacggccgatggggaattcatggctgttggcgctattgagcctcagttttatgagctactgattaagggattgggacttaaatcggacgagctccccaatcagatgagcatggatgactggcctgaaatgaaaaagaaattcgcggatgtgtttgcagagaagacaaaggctgagtggtgtcaaatctttgacggcaccgatgcatgcgtgactccagtccttaccttcgaggaggttgttcaccacgatcacaacaaagagaggggttccttcatcacgtcggaggagcaagatgtgtccccaagaccagcgccgctgctgctcaatactcccgccataccgtcctttaagcgggatccctttataggggaacatacagaagaaatcctggaagagttcggcttctcaagggaggagatatatcagttgaacagcgacaagattatagagagcaacaaggttaaggctagcctg

SEQ ID NO: 249441 - DNA, 1146 bp, Artificial Sequence
  Description of Artificial Sequence: Synthetic coding sequence
atggcgcttcagggtatctccgtggttgaattgtctggcctggctcctggtcccttctgtgccatggttctcgcggactttggagcccgagtggtccgggtggatcgaccgggatctcgctatgacgtctcccgcttggggagggggaagaggtctctggtgctggacttaaaacagcccagaggagcggccgtgctgcgtaggctttgcaaacggagtgacgtcctgctggagcctttcaggagaggggtgatggaaaaactgcagctgggccccgaaattctccagcgcgaaaatccgcgcttgatctatgccaggctgtccggttttggccagtctggttctttctgcaggcttgctggtcacgatatcaactatctcgccttaagtggggtgctcagcaagatcggccggtccggcgagaatccctatgcacccttgaacctgctagcagatttcgctggagggggactcatgtgtgcgctgggcattattatggcactatttgatcgtacccgcactgggaaaggccaggtaattgacgccaatatggtagagggcacagcctatcttagcagctttctttggaagacacagaagctgtcactttgggaggccccccgagggcagaatatgctggacggaggggccccattctatacaacatacaggaccgccgatggagaatttatggctgtgggcgccatcgaaccacagttctacgagttgctgataaaggggcttggtctgaagtcggacgaattgccaaatcagatgtctatggacgactggccagagatgaagaaaaagttcgcagatgtatttgccgagaagaccaaagccgagtggtgccaaatctttgacggcactgacgcctgtgtcacccccgtgttgacctttgaagaggtggtgcatcatgaccacaacaaagagcggggctctttcattacttctgaagaacaagacgtgagtccaaggcccgccccactcttattgaatacccctgccattcccagctttaaacgggacccattcatcggcgaacacactgaagagatattggaagagtttgggttcagccgggaggaaatctatcaattgaactcagacaagattatcgagtcgaataaggtcaaggcctcgcta

SEQ ID NO: 249442 - DNA, 1146 bp, Artificial Sequence
  Description of Artificial Sequence: Synthetic coding sequence
atggctcttcaggggatatccgttgtcgagctgtctggccttgctccgggaccattttgtgctatggtgctggccgatttcggcgctagggtggtcagggtagaccggccaggttcccgctacgatgtcagtcgcctcgggcgaggcaaacggtctctcgtcctagacttgaagcaacctcgtggggcagcagtgcttagacgtttatgtaaacgtagcgatgtgttgctggagccattccgccggggtgttatggagaaactgcagctggggccggagatcctgcagcgagaaaatcccaggctaatctatgctcgccttagcggcttcggacagagcggatccttctgcagattagcgggtcatgacatcaactatctagctctgtcgggcgtcttatcaaagattggccgatcaggagagaatccatacgcacctcttaaccttctggccgacttcgccgggggcggcctcatgtgtgctctgggcatcattatggcattgttcgataggactcggacggggaagggccaagtcatcgacgcgaacatggtggaggggaccgcctatctgtcatcctttctgtggaaaacacaaaaattgtccctgtgggaggctccaaggggacagaacatgcttgatgggggggctcccttctacacaacttatcgtactgccgatggcgaatttatggcagtgggagccattgagccacaattctacgaactgctgataaagggcctcgggctgaagagcgatgagcttcccaatcaaatgtccatggacgactggccagagatgaagaagaagtttgccgatgtttttgccgagaagactaaggcagaatggtgccaaattttcgacggcaccgatgcgtgcgtcacccctgtactaacttttgaggaggtggttcatcatgatcataacaaggagcgagggtcctttatcacaagtgaggaacaagatgtcagcccccgcccagccccgcttctgctgaacacgcctgcaatccctagcttcaaacgggacccttttattggggagcataccgaggaaatacttgaggagttcggtttctctcgcgaggaaatctatcagctgaacagtgataagatcatcgaatccaacaaagtgaaggcatccctg

SEQ ID NO: 249443 - DNA, 1146 bp, Artificial Sequence
  Description of Artificial Sequence: Synthetic coding sequence
atggcactacaggggattagcgtggtcgaactttccgggctggcccctggccctttctgcgccatggtgttagctgatttcggtgctcgtgttgtccgggttgaccgaccaggatcacggtatgacgtctcaaggctagggcgcgggaaacggtctcttgtgctagacctgaaacagcctcggggagccgccgttctccggcgactctgtaaaaggtcagacgtgctgctggaaccatttcggaggggcgtcatggaaaaactgcaattgggccccgagatccttcagagggaaaaccccaggctgatctacgcgagactcagtggttttggccagagcggatctttttgtcgcctggctggccatgatattaactatttggctctgtccggcgtgctgtctaagattggacgttctggtgagaacccatatgcaccacttaatttgctggctgacttcgcgggtggaggacttatgtgcgctttgggcattattatggctctgtttgatcgaaccagaacaggaaagggccaagtaatcgacgctaatatggtcgaaggcaccgcctacctttcatcatttctgtggaaaactcagaagctcagcctttgggaagccccgcgcggccagaacatgcttgacggtggcgctcccttctataccacataccgcaccgccgacggtgaattcatggctgtgggcgccatcgaaccccaattttacgagctgcttatcaaaggactggggctaaaatctgacgagctgccgaatcagatgtcaatggatgattggcccgagatgaaaaagaaattcgcggatgtgttcgcagagaagacaaaggcggaatggtgtcagatcttcgatggaactgatgcatgtgtgaccccagttcttaccttcgaagaggtggtgcatcacgatcacaataaggagcgcggcagcttcattacctctgaagagcaggacgtaagcccgaggcctgcccctctgctgttaaataccccggcaattccgtcgtttaagagggatccatttattggcgagcacaccgaagagattctcgaggaatttggcttttcgagggaagagatttaccagttgaactctgataaaattatcgagagcaataaagttaaagcgtcactg

SEQ ID NO: 249444 - DNA, 1146 bp, Artificial Sequence
  Description of Artificial Sequence: Synthetic coding sequence
atggctctccagggcatctccgttgtggagcttagcggattggccccgggtccgttctgcgctatggtgctcgcagacttcggggctcgcgtggtgcgggtggacagaccgggaagcaggtacgacgtatctcggctggggcgcggcaaaagatcgctcgtgctcgaccttaagcagcccaggggagcggccgtccttagaaggctgtgtaagcggtcggatgtgcttctggagccgtttcggcgcggcgtgatggaaaagctgcaactgggcccggagattctgcagcgggaaaatccaagactgatttacgcccggttgtccgggttcggtcagtcgggatccttctgtaggttggctggccacgacatcaactacctggccctgtcgggagtgctctcaaagatcggaaggtcgggtgaaaacccgtacgccccgcttaacctgctggccgactttgcgggcgggggactgatgtgtgccctgggtattatcatggccctgttcgaccgcacccggactggaaagggacaggtgatcgacgcgaacatggtggaaggaactgcatacttgtcgagcttcctctggaaaacccagaaactgtccttgtgggaagccccacgcggccaaaacatgctggacggaggcgctccgttctacactacttacaggacggcagacggagaattcatggccgtcggcgcaatcgaaccgcagttctacgaactgctcatcaagggactcgggctgaagagcgatgaactgcccaatcaaatgagcatggacgactggcctgaaatgaaaaagaaattcgccgacgtgttcgcggaaaagaccaaggcggaatggtgccaaatctttgacggtaccgatgcctgcgtcactccggtgctgactttcgaagaagtggtccaccacgaccacaacaaggagcgcggctcctttatcacgtcggaggagcaagatgtctcgccacggcccgcgccattgctgctgaacaccccagcgatcccgtcctttaagcgcgacccgttcatcggcgaacacactgaggaaattctggaagagttcggattctcaagggaggagatttaccagcttaactcggataagatcatcgagtccaataaggtgaaggcctccctc

SEQ ID NO: 249445 - DNA, 1146 bp, Artificial Sequence
  Description of Artificial Sequence: Synthetic coding sequence
atggctctccaaggtattagcgttgtggagctgagcggcctggcccctgggcctttttgcgccatggttttggccgatttcggggcccgcgtggtacgagtggatagacctggctcaaggtatgacgtaagtagactcggacgaggcaagcggagcctggtgcttgacttgaaacaacctaggggagctgcagtgctccggagactgtgtaagagatccgatgtgctcctcgagcctttcagaagaggagtgatggagaaactccagctgggacccgaaatactgcagagagaaaacccgagactgatctacgccaggctgagcggattcgggcagagcggttctttctgtagacttgctgggcacgacataaattacctggcattgagtggtgtgctttctaagatcgggcggtctggagaaaacccatacgcccctctgaacctgctggccgatttcgctgggggcggtctcatgtgtgcccttgggattatcatggccctgttcgatcgcacaagaacaggtaaggggcaggtgatcgatgccaatatggtggagggaactgcataccttagtagtttcctctggaagacacagaaactgtctctctgggaggccccaaggggtcaaaacatgctcgatgggggtgcaccattttatacaacctaccggacggccgacggtgagttcatggcagtgggcgctattgagccccagttctacgagttgctgattaagggactcggtctgaaatctgacgaactgccgaatcagatgagtatggacgattggccagagatgaaaaagaagttcgcagacgtgttcgcagagaagaccaaggcggagtggtgccaaattttcgatggcactgatgcctgtgtgacacctgttctgacttttgaggaggtggtgcaccatgaccacaacaaggagagggggtcatttatcacatcagaagaacaggatgtgtcccctaggcccgccccactgcttttgaacacgcccgccatcccatcatttaagagggatccttttattggcgagcacactgaagaaattctcgaggagtttggcttctctcgcgaagagatatatcagctgaattcagataagatcattgaatctaacaaggtgaaagcttccctg

SEQ ID NO: 249446 - DNA, 1146 bp, Artificial Sequence
  Description of Artificial Sequence: Synthetic coding sequence
atggccctacagggtatctccgtggttgaattgtcggggttggctcccggcccgttctgcgctatggtgctggccgatttcggcgcccgggtggtaagagtggaccgccctggttctaggtatgacgtaagtagattgggacgaggcaagcgcagtctggtcctggatttgaaacagcccaggggtgccgcagtcctaaggcgattatgtaagcggagcgatgtactgctggagccctttcgacgaggagttatggagaagctgcagctcggtcctgagatcctgcagcgggaaaaccctaggttgatctatgcccgtttgtccggttttgggcagtccggctctttctgccgcctggccgggcacgacatcaactacctggccctgtctggggtgctgagtaagatcggccgttcgggtgaaaatccttacgcccccttaaacctgttggcagactttgccggcggcggactcatgtgcgcattaggaattataatggccctgttcgatcgcactcggacagggaagggacaggtgattgatgccaatatggtagagggcaccgcctacctgtcatcgttcctgtggaagactcagaagctgtccctatgggaggctcctcggggacagaacatgttagatggcggcgccccgttttacaccacctatagaaccgcagacggtgagtttatggcagttggggccatcgaaccacagttctatgagttgctcatcaaagggctcggattgaagtcagacgagttgccaaaccagatgagcatggatgattggccagaaatgaagaagaagtttgcagatgtattcgccgaaaagactaaagccgaatggtgccagatttttgatgggaccgatgcctgcgtaactcctgttctgaccttcgaagaagtcgtgcaccacgatcacaacaaagagcggggatcattcatcacatcggaagagcaggacgtgtcccccaggcctgcccccctgctcctgaatacaccagccattcctagttttaagagggatcccttcatcggcgagcacacagaagagattcttgaggagttcggcttctcacgagaagaaatataccagttaaactcggataagatcatcgaatctaacaaagtgaaagcgtcacta

SEQ ID NO: 249447 - DNA, 1146 bp, Artificial Sequence
  Description of Artificial Sequence: Synthetic coding sequence
atggcgctccagggcatctcagttgtggaactgtcaggactcgcaccaggaccattctgcgcaatggttcttgccgattttggggctagggtcgtccgggtggataggcctggatctcgatacgatgtttcacgtttgggacgaggcaaacgaagtttggttctagatctcaaacaaccacgaggagcagctgttcttaggcggctttgcaagcggtctgacgtacttttggagccgttcagacgtggagttatggagaaacttcaattgggcccagaaattctacaacgggaaaatcctagattaatctatgctcgactttccgggtttggacaatccggaagtttctgccgtttggcagggcatgatattaactacttagcattatccggagtgttgagtaaaattggtagatcaggagagaatccatatgctccgctcaaccttctcgcagattttgcaggaggtggactcatgtgcgctcttggaattataatggctttgttcgaccgtactagaacgggaaaaggtcaagttatcgacgcaaacatggtagaaggtactgcttacttgtcgtcgttcttgtggaagacacagaagttgagtctatgggaagcgccgagaggtcaaaatatgttggatggaggcgctccattttacaccacataccgcactgcagatggggaattcatggcagttggagccattgaaccacaattttatgaacttctgattaaaggacttggtctcaagtctgatgaattgccaaatcaaatgagtatggacgattggccggaaatgaaaaaaaagttcgctgatgtcttcgcggaaaaaacaaaggccgaatggtgccagatcttcgacggaactgatgcttgtgttacaccggtgcttacttttgaagaggttgttcatcatgatcataacaaggaacgtgggtcgtttattacctctgaagaacaagatgttagtccgcgacccgctcctctcctcctcaatactccagctatcccaagcttcaagagagatccgttcatcggagaacacacggaggaaatcctggaagagttcggcttcagccgggaagagatctaccagcttaattctgacaagattatcgaatcgaataaggtgaaagcatctcta

SEQ ID NO: 249448 - DNA, 1146 bp, Artificial Sequence
  Description of Artificial Sequence: Synthetic coding sequence
atggcgttgcagggaatctctgtagtggaactctctggcctggcacccggccccttctgtgctatggtgctggcagatttcggtgcaagggttgtacgggttgatagaccaggctcccgatacgacgtctcgcggttaggcaggggaaaacgctctctcgttctcgacctgaaacagccaaggggagcagctgtactgagacgcttgtgcaagcggtctgatgtgctcctggaacccttccgacggggggttatggagaaattacagctcggacctgagatcctgcaacgagagaatcctcgcctcatttacgcccgcctttccggattcggacagagtggctcattctgccgattggctggacacgacatcaactatcttgctctcagtggagtgctctccaagattgggcgcagcggcgagaacccttatgcccccctaaacctgctcgccgattttgctgggggggggctcatgtgcgctctcgggattatcatggcattgttcgacagaactaggacaggtaaggggcaggttattgatgcgaatatggttgagggaacggcctacctttcttccttcctctggaaaacacaaaaactgagcctctgggaggctcctcgcggccagaacatgctagatgggggggcaccgttctataccacatatcgcacggcggacggcgaattcatggccgtgggagccatcgagccccagttctacgagttattgatcaagggtttaggtctgaaatccgacgaactgcctaaccagatgagtatggatgattggcctgagatgaaaaaaaaatttgccgacgtctttgcggaaaaaacaaaagcagagtggtgtcaaatatttgatggcactgacgcttgtgtgacgccagtgctgacttttgaagaggtggtgcatcacgatcacaataaggagcgcggctctttcatcactagcgaagagcaggacgtgagtcccaggcccgccccattgctgctgaatactcccgccattccatcatttaaacgagaccctttcatcggagagcacacagaagagatcttggaagaattcggcttttctcgcgaagagatctaccagctgaattccgataaaattatagaaagcaacaaggtgaaggcctcactt

SEQ ID NO: 249449 - DNA, 1146 bp, Artificial Sequence
  Description of Artificial Sequence: Synthetic coding sequence
atggccctgcagggaatttcggtggtggaactgagcgggttagcgcctgggccattctgtgctatggtgctagctgacttcggcgcgagggtggtgcgcgtggacaggcccggatccaggtacgacgtttctcgcctgggacgggggaagcggagccttgtgcttgacctgaaacaaccccgcggagccgctgttctaaggaggctgtgtaagcgctcagacgtattactggagccgttcagacgcggcgtgatggaaaagcttcagcttggcccggaaatcctccagagggagaatcctcgcctgatttacgcacggctttcgggatttggccagtctggttccttctgccgcctcgccggacatgatattaactatctggctctttcgggagtcttgtctaagatcggtaggtcaggtgagaacccctacgcacctttaaacctgttggcggacttcgctggaggcggccttatgtgcgcgctgggtattataatggctctcttcgatcgcactagaacaggaaaaggacaggtcatcgatgccaacatggtggagggcaccgcctacttgtccagcttcctgtggaagacacagaagctcagcctttgggaagcccctcggggccagaacatgctcgatggcggtgcccccttctacacaacctaccggaccgctgacggtgagtttatggcggtgggtgctatcgagccccagttctatgagctgttgattaagggattaggactcaaatctgatgagctgcccaaccagatgtcaatggatgactggcctgaaatgaagaaaaagtttgcggatgtatttgcagaaaagacaaaggccgagtggtgtcaaatcttcgacgggaccgatgcatgtgtcacccccgttctgactttcgaggaggtggttcatcacgatcacaacaaagaaagagggtccttcatcaccagcgaggaacaggacgtctctccacgccctgcccccctgctgctgaatactccagcaatcccatctttcaagcgggatcccttcatcggggagcacacagaggagattctcgaagaattcggtttctcgcgcgaagaaatttaccagctcaactccgataaaatcatcgaatcaaacaaggttaaggcatcactg

SEQ ID NO: 249450 - DNA, 1146 bp, Artificial Sequence
  Description of Artificial Sequence: Synthetic coding sequence
atggcactgcagggaatttcggtggtggagctgagcggcctcgccccgggacctttctgtgccatggtgctggcggacttcggcgcccgcgtggtgcgggtcgacagaccgggatcgcgctacgacgtttctcggttgggaagaggaaaaagatcactggtccttgatctcaagcagccacggggtgccgcagtcctgagacgcctgtgtaaacgttctgatgtcctgctcgagccgttccggcgcggagtgatggaaaaactgcagctgggacccgaaatcctgcaacgcgaaaacccgcggctgatctacgctagactgtcgggcttcggccagtcggggtcgttctgcagactggcagggcacgatatcaattacctggccttgtctggcgtcctgtcaaagatcgggcggtcaggtgagaatccatacgcaccactcaacctgctcgccgacttcgctggtggggggcttatgtgcgcgctcggaattatcatggcactgtttgaccgcacgcgcactggtaaaggccaagttatcgatgcaaatatggtggagggaactgcctacctgtcgtccttcttgtggaaaacgcaaaagctctcgttgtgggaagctccaagaggccagaacatgctggacgggggcgctccgttctacacgacttaccgcaccgccgacggagaattcatggcagtgggggcgatcgagccacagttttatgaactcctgatcaagggactgggactgaagtccgatgagttgccgaatcaaatgtcgatggatgactggccagaaatgaagaagaagttcgccgacgtgttcgcggaaaagaccaaagcggagtggtgccagatcttcgatgggactgatgcctgtgtgacccctgtgctgactttcgaagaggttgtgcatcatgatcacaataaggaacgcgggagcttcatcaccagcgaagaacaggatgtctccccaaggccagcgccgctgctgttgaacactcccgcgatcccatccttcaagcgcgacccatttatcggagaacacactgaagagatcctcgaagagttcggatttagccgggaggagatctaccagttgaactcagacaagatcatcgaatcaaacaaagtgaaggcatcactg

SEQ ID NO: 249451 - DNA, 1146 bp, Artificial Sequence
  Description of Artificial Sequence: Synthetic coding sequence
atggcgttacaaggtatatcggtagttgaactatcgggtttagcgccgggtccgttttgtgcgatggttctagcggattttggtgcgcgtgtagtacgtgtagatcgaccgggttcgcgatatgatgtttcgcgattaggtcgtggtaaacgttcgctagttctagatctaaaacaaccgcgtggtgcggcggttttacgacgactatgtaaacgttcggatgttctattagaaccgtttcgtcgtggtgttatggaaaaactacaattaggtccggaaatattacaacgtgaaaatccgcgtctaatatatgcgcgtctatcgggttttggtcaatcgggttcgttttgtcgactagcgggtcatgatataaattatttagcgttatcgggtgttttatcgaaaataggtcgatcgggtgaaaatccgtatgcgccgttaaatctattagcggattttgcgggtggtggtctaatgtgtgcgttaggtataataatggcgttatttgatcgaacgcgtacgggtaaaggtcaagtaatagatgcgaatatggttgaaggtacggcgtatctatcgtcgtttctatggaaaacgcaaaaactatcgctatgggaagcgccgcgtggtcaaaatatgctagatggtggtgcgccgttttatacgacgtatcgtacggcggatggtgaatttatggcggttggtgcgatagaaccgcaattttatgaactactaataaaaggtttaggtttaaaatcggatgaattaccgaatcaaatgtcgatggatgattggccggaaatgaaaaaaaaatttgcggatgtatttgcggaaaaaacgaaagcggaatggtgtcaaatatttgatggtacggatgcgtgtgtaacgccggttctaacgtttgaagaagttgtacatcatgatcataataaagaacgtggttcgtttataacgtcggaagaacaagatgtttcgccgcgtccggcgccgttattactaaatacgccggcgataccgtcgtttaaacgtgatccgtttataggtgaacatacggaagaaatattagaagaatttggtttttcgcgagaagaaatatatcaactaaattcggataaaataatagaatcgaataaagttaaagcgtcgtta

SEQ ID NO: 249452 - DNA, 1146 bp, Artificial Sequence
  Description of Artificial Sequence: Synthetic coding sequence
atggcccttcagggtattagtgtggtcgaattgagtggcctcgcccctggccctttttgtgctatggtcctcgcagatttcggggcccgggtcgtgagagtggaccgccccggtagccggtatgacgtttcccggctcggcagagggaaacgaagtctcgtgctcgatctcaaacagccacgtggtgctgccgtgcttcgcagactttgcaagaggagcgatgtcctcctggagcccttccggcgcggcgtcatggaaaagctccagctgggtcctgagatactgcagcgcgagaatccgaggctgatctacgccagactgtccggatttgggcagagcggaagtttttgtcgactggccgggcacgatatcaattatctagccttaagcggggtcctgtctaagatagggcgctccggggagaacccatacgccccgttaaatctcctcgcggacttcgccggcggcggcctgatgtgcgcccttggtataattatggcccttttcgaccgaacaagaactggaaagggccaggttattgatgccaacatggtcgagggcaccgcatacctctctagctttctgtggaaaactcaaaaactctccctctgggaggcgccccgagggcagaacatgctcgacggaggcgccccattttacaccacatatcggacagccgacggggagttcatggcagtcggcgcaatcgaacctcaattctacgaattactaatcaagggcctcggcttgaaatccgacgaactgccaaaccaaatgagtatggacgattggccagaaatgaagaaaaagttcgccgacgtgttcgctgagaaaaccaaagccgaatggtgtcagattttcgatggcaccgatgcatgtgtgacccccgttttgacgtttgaagaggttgtccaccacgatcacaacaaggaacggggctcttttataacttccgaggagcaagatgtctccccacggcctgcgccattgctgctgaacaccccggcaatccctagcttcaagagggatccgttcattggcgaacacactgaagagattctggaggagtttggtttttctcgagaggagatataccagctcaactctgacaaaattatagaatcaaataaggtgaaggccagcctt

SEQ ID NO: 249453 - DNA, 1146 bp, Artificial Sequence
  Description of Artificial Sequence: Synthetic coding sequence
atggcgttgcagggaatttcagtggttgaactgtccggactggcacctggcccgttttgtgctatggtgctcgccgactttggggcccgcgtggtgcgggtggatcgccctggatcgcggtacgacgtgtcgaggctgggccggggcaaaagatccctcgttctcgatctcaagcagccccgcggagccgcagtgctccggcggctctgcaagcggtcagatgtcctgttggaaccgttccggaggggtgtgatggagaaactgcaactgggtcctgagattctccagcgcgaaaatccgcggctcatctacgcgcggctctccggattcggacagagcggatccttctgccggctggcgggacacgatatcaactacctggcactctcgggggtgctgagcaagatcggtcggtcgggagaaaacccctacgccccccttaatctgctggctgatttcgcaggaggaggactgatgtgcgcgctgggaatcatcatggcgctcttcgatcggactagaactggaaagggccaggtcatcgatgccaatatggtggagggcaccgcctacctgtcatcgttcctgtggaaaactcagaagttgtccctgtgggaagcacctcggggacagaacatgttggatggtggagcgccgttctacactacgtaccgaacggccgatggcgaattcatggcggtgggcgcaatcgagccccaattctacgaattgctgatcaaggggctgggtttgaagtcggacgagctgcccaatcaaatgtccatggatgactggcctgaaatgaagaaaaagtttgctgacgtgttcgctgaaaaaactaaagccgagtggtgccagatcttcgatggtactgacgcttgcgtcaccccggtgctgaccttcgaggaggtcgtccaccacgaccacaacaaggaaagaggctcttttatcacctccgaagagcaagatgtgtcccctagaccagcccctttgcttctgaacaccccggcaatcccgtcctttaaacgcgacccgttcatcggggagcatactgaagaaatcctggaggagtttgggttctcacgggaagagatttatcaactgaattcagacaagattatcgaatcgaataaggttaaggcgtccctg

SEQ ID NO: 249454 - DNA, 1146 bp, Artificial Sequence
  Description of Artificial Sequence: Synthetic coding sequence
atggcactgcagggtatcagtgtcgttgagctctccggtctcgcgcccgggccattttgcgcgatggttctggccgacttcggcgcaagagtcgtacgtgtagaccgtcccgggtctagatacgacgtctcgcgcctaggacgtggcaagagaagtctggtcctggatcttaaacagccaagaggagcggccgtcttgaggagattgtgtaagcgttctgatgtcctgctcgaaccatttaggcgaggagttatggaaaagctccagctaggtcctgaaattttgcaaagagaaaatcctcgcctcatttatgcgcgcctgtctggctttggtcaatcaggcagtttttgtcgactagcaggacatgatattaattatctggcactgtccggcgttctgtctaagatcggccgctcgggtgaaaatccttacgcgccattgaatctactggcggacttcgctggaggcgggcttatgtgcgcattgggcataatcatggccctattcgaccggacccgcactggtaagggccaggtgatcgacgccaacatggtggaaggcacagcttatctctcttctttcctttggaagacgcaaaaattgagtctctgggaggccccccgcggccaaaacatgctggatggaggggcgccgttttataccacgtatcgcacggcagacggtgagttcatggcggtaggtgctatcgaacctcagttttatgaattgctaatcaaaggcctgggcctgaagtcggatgagttgccaaatcagatgtcgatggacgactggcctgagatgaaaaagaagtttgcggacgtgtttgccgagaaaacgaaagctgagtggtgtcagatcttcgatggtactgacgcttgtgtcacccctgtgttgactttcgaggaagtggtgcaccacgatcacaacaaggagagggggtcgtttattacctctgaggaacaggatgtctcccctagacctgctcctctacttcttaacacccctgccataccttcttttaagagagaccctttcatcggtgagcacactgaggaaattctcgaggagtttgggttttcccgtgaggagatatatcaactgaatagcgacaagataatcgaaagcaataaagtcaaggctagcctg

SEQ ID NO: 249455 - DNA, 1146 bp, Artificial Sequence
  Description of Artificial Sequence: Synthetic coding sequence
atggccctacagggcatttctgtggtcgagctttctggtctggccccgggccctttctgtgccatggtccttgctgacttcggcgcgcgggtcgtacgggttgacaggccaggctcgcgatacgatgtgtcccgactcggccggggtaagcggagtctggtactagatctcaagcaaccccgtggggcggctgtgctgaggaggctgtgtaagcgctctgacgtcctcttggagccattcagacgtggcgttatggaaaagctgcagctgggaccggagatcctgcagcgcgaaaatccgcgattgatctacgcgcgattgtcgggttttggtcaaagtggatccttctgtcgtcttgctggccacgatattaactatctagctctcagtggtgtgttgtcaaaaatcggacgaagtggtgaaaacccttacgcgccgctcaacttactcgcagatttcgcaggtgggggtctaatgtgtgccctcggcataatcatggccctctttgatcgaacccgcacagggaagggccaagtaatcgacgccaacatggtcgagggcaccgcctacctatcatcattcttgtggaagacccaaaagctgtcgctttgggaggcaccgcgcggtcagaatatgctcgacggtggcgcccccttttacactacatacagaacagccgacggtgaattcatggcggtcggcgcgatcgagccgcagttctacgaactcctgattaaaggcctcggtttaaagtctgatgaactgcccaatcaaatgtctatggacgattggcccgaaatgaagaaaaaattcgcggatgtttttgcagagaaaacgaaagccgaatggtgtcagatctttgacggcacggatgcctgcgttactccggtgctgacttttgaagaggttgttcaccacgatcataataaggaaagagggagctttatcacgagtgaggagcaggacgtaagcccgcgaccggccccgctcttactaaatactcccgctattccatcgttcaagagggaccccttcataggcgaacatactgaggagatcttggaggagttcgggttctccagagaagagatctaccagcttaattccgataaaattattgagtccaataaggtaaaggcatcgctc

SEQ ID NO: 249456 - DNA, 1146 bp, Artificial Sequence
  Description of Artificial Sequence: Synthetic coding sequence
atggctctccagggcatctccgtggtcgagctgtccggcctggcccctggaccattttgcgccatggtccttgcagacttcggggcacgagtggttcgagtggaccgacctggcagtaggtacgatgtgagccgactcggaagaggtaagcgatcactggttcttgacctgaaacagccaagaggagccgcagtgctgcgcagactgtgtaaaagatctgatgtgttgcttgagccatttaggagaggggtgatggagaagttgcagcttgggccagagatattgcagagagaaaatccgaggctgatctacgctagactatcagggttcggacagtccggctccttctgtcgcttggccggacacgacatcaattaccttgctctgagcggagtcttgtcaaagatcggccgtagtggcgagaatccttacgcaccattaaacttgttagccgatttcgctggaggcggactgatgtgcgccctcggtattattatggcgttgttcgatagaacacgcaccggaaagggacaggtgattgatgctaatatggtggagggcacagcatacctgtcttctttcctttggaagactcagaaattgagtctatgggaggcgccccgcgggcagaacatgctggatggaggtgcgccattttacactacctacagaaccgccgacggggagtttatggccgtaggggccattgagccccagttctacgagttactcatcaaaggattgggtcttaagagtgacgagctgcccaatcagatgtccatggacgactggcctgaaatgaagaaaaaattcgctgatgtgttcgccgaaaaaactaaggctgaatggtgtcaaattttcgacggtaccgatgcttgcgtaaccccagttctcacctttgaagaggtggtgcatcatgaccacaacaaggagcgaggcagctttatcacgtctgaggagcaggatgtgagcccgaggcccgcgcctctgctgctcaatacacccgctataccaagctttaaacgagatccattcatcggggaacacaccgaagaaatcctggaagagttcggattttcccgcgaggagatctaccagctgaatagtgacaagattatcgagagcaataaggtgaaggcgagcttg

SEQ ID NO: 249457 - DNA, 1146 bp, Artificial Sequence
  Description of Artificial Sequence: Synthetic coding sequence
atggccttacaagggatctccgtggtggaactttccggattagcgccaggaccgttttgtgcaatggtgctggctgactttggggctagggttgtgagagttgaccggcccggatctcggtacgacgtctcccgcctaggccgcggcaagcggtcacttgtcctggatctcaagcagcctcgaggcgcagctgtgttacgtcggctttgtaagcggtccgatgtgcttttggaaccattccgccggggcgttatggaaaagctgcagctggggcctgagatactgcagcgagagaacccccgtcttatatatgctagattaagcggattcgggcagtccggatccttttgccgccttgccggacacgacattaactacctggccctgtccggcgttctctccaaaatcgggcgttctggagagaacccctacgctccactgaacctgctcgctgattttgccggcggggggcttatgtgcgcactagggattatcatggctttatttgatcggacgcgcactggaaagggccaggtcatcgacgccaatatggtggagggtaccgcttacctgagctctttcctgtggaagacacagaagctatccctctgggaggctccaagaggacagaatatgctcgatggaggagctcctttctacaccacgtaccggacagccgatggcgaatttatggccgtgggggctatcgagccccaattttacgaattactgatcaagggtctggggcttaagtcagacgaacttcctaatcagatgagtatggatgactggcccgaaatgaagaagaaatttgcagatgtctttgctgaaaagacaaaggccgaatggtgtcagatattcgacggtacagacgcctgcgtcacacccgtgctgacttttgaggaggtggtccaccatgatcacaacaaagaacggggctcatttattacttccgaagaacaggacgtgtccccacgccctgctccgttgttgctgaatacccccgccattcccagtttcaagagagacccattcatcggggagcatacggaagagatcttagaagaattcggcttcagcagagaagagatctaccagctgaattcagacaagatcatcgagagtaacaaggttaaagcaagcctg

SEQ ID NO: 249458 - DNA, 1146 bp, Artificial Sequence
  Description of Artificial Sequence: Synthetic coding sequence
atggcgttgcaaggaatctcagttgtggaattatctggtctcgccccaggtcctttctgcgcgatggtgttggcagacttcggagcccgagttgtcagggtcgaccgacccggaagtcgatacgatgtgtctcgattagggagaggaaaacggagtctggtcctggacttaaagcaaccccgaggggcagctgtgttgagaagactttgtaagcgctcagacgtcttgctggagccatttagaaggggagtgatggagaaactgcaactggggcccgagatactgcagcgcgagaatcctcggttgatctatgccaggttgtctggattcgggcagtccggatcattttgtcgtctcgcaggccatgatatcaattatctcgccctctccggggtcctgtccaagatcggccggtccggagagaacccctatgcaccattgaatctgctcgctgattttgctgggggcgggcttatgtgtgcactcggcataatcatggctctgttcgacagaacacgaacagggaaggggcaggtcatcgacgccaatatggtagaggggacggcctacctgagttccttcctgtggaaaacacagaaacttagtctgtgggaagccccgcgcggccagaacatgcttgatggtggcgcacccttctatactacttatagaacagctgatggagagttcatggcagtgggagctattgaaccccagttttacgagcttctaattaaaggtctcggacttaagagcgacgagctccctaaccaaatgagtatggatgactggccagaaatgaagaagaagttcgccgacgtgtttgcagaaaaaacgaaagccgaatggtgccagatcttcgatgggaccgacgcatgcgtaactccggtcctcactttcgaggaagtggtccatcacgatcacaataaggaacgaggctccttcataacttctgaagagcaagatgtgagtccacggcctgccccgttgttactgaacacgccagctatcccaagttttaaacgggatccctttatcggcgagcacacagaagaaattttggaagagttcggcttctcaagggaggagatttatcaactgaacagcgacaaaatcatagagtccaacaaggtgaaggcaagtctg

SEQ ID NO: 249459 - DNA, 1146 bp, Artificial Sequence
  Description of Artificial Sequence: Synthetic coding sequence
atggcactccagggtatttcagttgtagagcttagtggactggcccctggacccttttgcgcgatggtattggccgacttcggagcaagagtcgtgagagtggacagaccagggagcagatatgacgtctccaggcttggtaggggaaagaggagcctagtcctggacctcaaacagccccggggcgccgcggtgctgcgtaggctttgtaagaggtccgacgtgttgctcgagccatttagaagaggtgtaatggagaaactgcagttgggacccgagattctgcagcgtgaaaatccacggctgatttacgccagactcagcggattcggacaaagcggttccttttgccgtttggctggtcatgacattaactacctggcactgagcggagtgttgagcaaaattggccggtccggcgaaaatccgtacgctccattgaacctgctcgcggatttcgccgggggcgggttaatgtgcgctctgggcatcatcatggctctgtttgatagaaccaggaccggaaagggtcaggtgatagatgcaaacatggtggaaggaaccgcgtacctgtcttccttcctgtggaaaacccagaagctgagtctttgggaggcaccccgcgggcagaacatgttggatggcggcgctccattctacactacctacagaaccgctgatggagagtttatggcagtgggcgcaattgagccacaattctatgagcttctgatcaaaggactgggcctgaagagcgatgagttgcccaatcagatgagcatggatgactggccagagatgaaaaaaaagttcgcagatgttttcgccgaaaagacaaaagcggagtggtgccaaattttcgatggcaccgacgcgtgtgtcacccctgtgctgacgtttgaagaagtcgtgcaccacgaccacaataaagagaggggcagctttatcacatcagaggagcaggacgtatcccctcgccctgctccgcttcttttgaacacccctgctattccttcctttaaaagggatccatttattggcgagcatactgaagaaatcttggaggagttcggtttctctcgcgaagagatctatcagctaaacagcgataaaattatcgagagcaacaaagtcaaggccagcctg

SEQ ID NO: 249460 - DNA, 1146 bp, Artificial Sequence
  Description of Artificial Sequence: Synthetic coding sequence
atggccctccagggtataagcgtggttgagcttagtggtttggcaccaggtccattctgtgccatggtgctcgcagatttcggtgctagagttgtgcgcgtagaccgcccaggatctagatacgacgtttctcgtttgggcaggggtaagagaagcctggtgttggacctgaagcagccccgtggagccgccgttcttcgcagactgtgtaaaagatccgacgtcctgctggagccctttcgccgcggagtcatggagaaactccagttgggtcccgaaatcctgcaaagagagaacccccgcctgatttatgcaagattgtctggtttcggccagagtggttctttctgccgcttggcaggtcacgacataaactacttggctttgtcaggcgtccttagtaagatcggccgctccggcgaaaatccttatgctcctttgaatctgctggctgacttcgcaggcggaggattgatgtgcgcactgggtatcatcatggccctctttgaccgcacacgcaccggcaaaggccaggtaattgatgccaatatggtcgaaggcaccgcttacctgtcatcttttctctggaagacccagaagctctctctctgggaagcaccaaggggccagaacatgcttgatggcggtgcacccttttatacaacctatcgtacagccgatggtgaattcatggccgtcggtgctatcgagcctcagttttacgaactccttataaagggtcttggactgaagagtgatgagctgcccaaccagatgtctatggacgactggcctgagatgaaaaagaagttcgccgacgtctttgctgagaagaccaaagctgaatggtgccagattttcgatggtaccgacgcatgcgttacccccgtacttacctttgaagaagtggttcaccacgatcacaacaaggaacgcggcagtttcatcacatctgaggagcaggacgtgtctccccgccccgcaccactgctgctcaatacacctgccattccatcattcaagagggatccctttataggtgagcacactgaggagatacttgaagagtttggcttcagtagggaggaaatctatcagctgaactcagataagatcattgagagtaataaggtaaaagcatctctg

SEQ ID NO: 249461 - DNA, 1146 bp, Artificial Sequence
  Description of Artificial Sequence: Synthetic coding sequence
atggcactacagggcatttccgtagtcgagctttctggcttagcgcctgggcccttttgcgctatggtgctggcagactttggagcaagagtggtacgcgtggacagaccaggtagcagatacgatgtgagtaggctaggacgtggaaagagatccctagtgctggatttgaaacagccaagaggggcagctgtgctccggcggttatgtaagagaagcgacgtgcttcttgaaccctttcgcagaggtgtcatggagaagttgcagctgggaccagaaattcttcagcgggagaacccaaggttgatttacgccaggttaagcgggttcggccaatcaggaagtttttgcagattggctgggcatgacattaattacctggctctgtctggagtgctctcaaaaatcggccggtcaggagaaaacccttatgcacccctcaacctgttagctgatttcgccggcggcggactgatgtgcgccttgggcatcatcatggcattgtttgataggactagaaccggaaaagggcaggtgatcgatgcgaatatggtcgagggaacagcatatctcagctcttttctgtggaaaacacaaaaattatcgctgtgggaggccccaaggggacagaatatgcttgacggaggagcacctttctatacgacctacaggactgcagatggcgaattcatggctgtgggtgcaatcgaaccccagttctacgaactgctgattaaggggctgggactgaaaagcgacgagctccctaatcagatgtcaatggatgactggccagagatgaagaagaaattcgctgatgtcttcgccgagaagactaaagccgaatggtgccagatcttcgatggcactgatgcttgcgtcacaccggtcctcaccttcgaagaggtcgtccaccacgatcataataaggaaagagggtccttcatcacttcagaagaacaagacgtgtccccaagaccagctcctctgctgctgaacactcccgctatcccttcctttaaacgggacccatttataggggagcacactgaggaaatcctagaagaattcggattctcaagagaggagatctaccaattgaactcagacaaaatcattgaaagcaataaagtaaaggcaagcttg

SEQ ID NO: 249462 - DNA, 1146 bp, Artificial Sequence
  Description of Artificial Sequence: Synthetic coding sequence
atggcacttcaaggtatttccgtcgtggagctgagtggacttgcaccggggcctttttgtgcgatggtcctggcggactttggagctcgcgtggtgcgggtggatcggcctggatcaagatacgacgtctcgagactcggaagaggaaagcgaagcctcgtgttggatctcaagcagccaagaggcgcagcagtgctcaggaggttgtgtaagaggtctgatgtcctccttgagccattccgtagaggagtcatggaaaagttgcaactggggcctgagattctgcaaagagagaatcctaggcttatctatgcccggctgtccggtttcggacagtcaggtagcttctgccgacttgcaggacacgacattaactacctcgctctttcaggagtactttcgaaaatcggacgaagtggagagaacccttacgcgcctcttaacctgcttgcggacttcgcaggtggcggcctcatgtgcgcccttggtatcatcatggccctgtttgaccggaccagaactggtaagggacaagtcatcgatgcaaacatggtggaggggactgcatacctgtcctcatttctgtggaaaactcagaaactgtcgttgtgggaggcgccacgcgggcagaatatgctggatggtggtgcacccttctacacgacttaccgcactgcagatggggaattcatggctgtgggagcaatagaacctcagttttacgaactcctcattaaaggccttggtctgaagtcggacgaactcccaaaccaaatgagcatggatgattggccggaaatgaagaaaaagttcgcagatgtctttgccgaaaagaccaaggccgagtggtgtcagatctttgacggtaccgatgcctgtgtgactccggttctgacttttgaagaggtcgtgcatcatgatcataacaaagaacgtggtagcttcattacctccgaagagcaagacgtgtctccccgtccagcaccactcctccttaatacccccgccataccttcgtttaagcgtgatcctttcataggtgaacacactgaagaaatactcgaggagtttggtttttcacgcgaagaaatctaccaacttaacagcgacaagattatcgaatcaaataaggtgaaggcatcgctt

SEQ ID NO: 249463 - DNA, 1146 bp, Artificial Sequence
  Description of Artificial Sequence: Synthetic coding sequence
atggcgctgcagggtatatcagtggtggaactaagcggtttggcaccaggtccgttttgcgctatggtcctggctgactttggtgctcgggtggtgcgcgtggacaggccgggaagccgttacgacgttagccgcctaggccgcggaaagcgttccctggttctggacctgaagcagccacgaggtgccgcggttcttcgccgcctgtgcaaacgcagtgatgttttgctggagcctttccgccgtggcgttatggaaaagctgcaacttgggccggagatattacagagagagaatcctcgcctgatctatgcccggttatcgggttttggccaatctggctcattctgcagactcgccggccatgatatcaactatctggcgctctccggggtgttaagcaagattggtaggagcggcgaaaacccatatgccccgctgaatctgcttgcggatttcgcaggcggtggcctgatgtgcgctctggggattattatggccctgtttgatcgaacccgcacgggaaagggccaggttattgacgctaacatggtggaaggtaccgcatatctgagctctttcctgtggaagacacaaaaactgtccctttgggaagcacctcggggccagaacatgctcgatggaggtgcgccgttttacactacctataggacggcggacggtgaattcatggcggttggcgcgattgaacctcagttctatgaactgctcattaaagggctgggcctaaaaagcgacgagctgccgaaccagatgagcatggatgactggccggagatgaaaaagaaattcgccgatgtgtttgcggaaaagaccaaggcggagtggtgccagatcttcgacggtaccgacgcctgcgtgacaccggtgctcacctttgaggaagtcgtccatcacgatcacaacaaggagaggggatcgtttattacatctgaagaacaggatgtctccccgcgtccagcacccctcctgctgaacactccagcgattccttcttttaaaagggacccttttattggcgagcacactgaagaaattctggaagagtttgggtttagccgggaggagatctaccaactgaatagcgataagatcattgaatcaaacaaagtgaaagcaagcctg

SEQ ID NO: 249464 - DNA, 1146 bp, Artificial Sequence
  Description of Artificial Sequence: Synthetic coding sequence
atggcgctgcagggtatttcagtggtcgagctttccggcctcgcacctggaccattctgtgccatggtgctggcagactttggtgcgcgggtcgtcagggtggatcgcccgggatcgcgctacgatgtatcgaggctggggaggggaaagcgtagcctggtgctggatctgaagcaacctaggggcgcagccgtgctgcgcagactctgcaagcgatcggatgtcctccttgaacctttcagaaggggcgtgatggaaaaactgcagttgggaccagagattctgcaacgggaaaacccgcgtttgatttacgcaagactttctggattcggtcagtcgggctcgttttgtcgtctcgccggtcacgacattaactacctggcgctttcgggagtgctttcgaagataggtagatcgggggagaatccctatgcgccccttaacctgctggcggattttgccggaggcggacttatgtgcgccctgggcatcattatggcactctttgaccgtactaggaccggcaagggtcaagtgatagatgcgaatatggtggaaggtaccgcatacctttcatcgttcctttggaaaactcagaagttgtcactgtgggaggcgccacgcggtcagaatatgcttgatggaggggcacccttttacaccacttacagaaccgcagacggtgaattcatggcagtcggtgccatagaaccgcaattctacgagcttcttatcaaaggactgggactcaagtcggatgaacttcctaatcaaatgagcatggatgattggccagaaatgaagaagaagttcgccgatgtgtttgcggaaaagactaaagccgaatggtgccagattttcgacggtaccgacgcctgtgttactccagtgctgacctttgaagaagtggtgcatcatgatcataacaaggaacgcggatctttcattacttccgaggagcaggatgtcagcccccggccggcacctctccttctgaacaccccggctatcccatcctttaagcgtgacccatttatcggtgaacacaccgaggagattctggaggaattcgggttttcacgagaggagatataccagctgaacagcgataagattattgaaagcaacaaagtgaaagcatccctg

SEQ ID NO: 249465 - DNA, 1146 bp, Artificial Sequence
  Description of Artificial Sequence: Synthetic coding sequence
atggctctccaggggatctcagtcgtcgaattgtccggtcttgcaccaggccctttttgtgcaatggtgcttgcagattttggtgcaagagtcgtgagagtggatagaccaggatcgagatacgatgtgtcgaggcttggaagaggcaaacgttcccttgtgctggatctgaagcagcccagaggtgcggcagtgctgcgcagactctgcaagcgcagcgacgtgcttttggaaccatttcgccgcggcgtcatggaaaagctgcagctcggcccagagattctccaacgggagaaccccagactgatctacgcaaggctttccgggtttggacaaagtgggagcttttgccggctggccggccatgacattaactacctggcacttagcggagtcctgagcaagattgggagatcaggcgaaaacccgtacgcaccactgaacctccttgcggattttgccgggggagggctcatgtgtgcactcggaattatcatggcactgttcgacagaacccgcactggtaagggtcaagtcatcgatgcaaacatggtggagggaaccgcctacctctcctcattcctttggaaaacccagaagctgagcctttgggaagcaccgagaggccagaatatgcttgatggcggagcacctttctacactacctaccggactgcagacggtgagtttatggcagtcggagcaatagaacctcagttttatgaactcctcattaagggcttgggacttaaatcggatgaactgcctaaccaaatgtcaatggatgactggccggaaatgaagaagaagtttgccgacgtgttcgcggagaaaactaaagcagagtggtgtcagatttttgatgggacggatgcatgtgttacccctgtgcttacgtttgaggaggtcgtgcatcacgatcataacaaagaaagaggatcgtttatcacctccgaagaacaagatgtctcgcctaggccagcacctctgctgcttaatactccggcaataccatccttcaagcgtgaccctttcatcggagaacataccgaagaaattctggaagaattcggcttctcacgggaggagatataccaactcaactcggataagataatcgaaagtaataaggtgaaggcaagcctt

SEQ ID NO: 249466 - DNA, 1146 bp, Artificial Sequence
  Description of Artificial Sequence: Synthetic coding sequence
atggcactccagggaatcagcgttgttgagctgtcgggactagcccccggacctttctgcgctatggttctggctgattttggagctcgggtggtgagggtggatagacccgggtccaggtatgacgtgtcccggttggggcgcggcaagcgcagcttggtactcgatcttaaacagccacgaggagcagctgtccttcggaggctgtgtaagcgaagtgacgtgttgctggagccgtttagaaggggtgtcatggaaaaattgcagttgggaccagagatattgcagcgagaaaatccaaggctaatctacgcacgcctgagcggctttggtcagtctggttccttctgtcgcctcgccggccatgatattaattatctggcactatccggcgtgctttccaaaattggacgttctggtgagaatccctacgcgccactcaatttgctagccgactttgcaggggggggcctaatgtgcgcccttggcatcataatggccctatttgatcgtaccaggacaggtaagggccaggtcatcgacgccaacatggttgaaggaactgcctacctctcttccttcctatggaaaactcaaaagctgagtctctgggaggcaccacgcggccagaacatgcttgacggaggcgcccctttctatacaacctacagaaccgctgatggggaatttatggccgtgggggcgatcgagccccaattttacgagctcttaataaaggggttaggccttaagtccgatgaactgccaaaccagatgtctatggatgattggcccgagatgaaaaagaaattcgcagatgtctttgctgagaagacaaaggcagagtggtgccagatttttgatgggacggacgcctgtgtcacccctgttctcacctttgaagaggtggttcaccacgatcacaacaaggaaaggggttctttcatcacgagcgaagagcaggatgtgtcacccagacccgctccactcctgctgaatactcctgctatccccagcttcaaaagggacccattcattggggagcatacggaggagattcttgaagagtttggattctcccgggaggagatttaccaattgaatagcgataagatcatagagtctaacaaggtgaaagcatctctc

SEQ ID NO: 249467 - DNA, 1146 bp, Artificial Sequence
  Description of Artificial Sequence: Synthetic coding sequence
atggccctacagggcataagcgttgtggaactcagcggcttggctcccgggccattttgtgccatggtgttggcggattttggcgctcgagtggtgagggtggacaggcctggttctcggtatgatgtctcccgcctgggccgcgggaagaggagccttgttctggacctgaagcagccaaggggcgctgccgtattgagacggctgtgcaagcgcagtgatgttctgctggagccctttcgaagaggggtcatggagaaactacagctgggccccgagattttgcagagggagaacccccgcctcatctacgctcgactgtctggattcggccagagcgggtccttttgtaggctggctggccatgacataaattatctcgcacttagcggagttcttagtaagatcggcaggtctggcgagaatccatatgcccccctgaatctcctggctgattttgccggcggaggcctgatgtgcgcactgggaatcatcatggccctatttgacaggacaaggaccgggaaggggcaggtgatcgatgctaatatggttgagggaactgcctatctgagctctttcctctggaagacccagaaactgtccctttgggaagctccacgagggcagaacatgcttgatggcggcgcacccttttataccacttatcgtaccgctgacggcgagtttatggcagttggcgctatcgagccccagttctatgagctattgatcaagggattgggactcaaaagcgatgaactccctaaccagatgagcatggatgattggccagagatgaagaaaaagttcgcagatgtctttgccgagaagacaaaggcagagtggtgccagattttcgacggaaccgatgcttgtgtaactcccgtgctgacattcgaggaggtcgtccaccatgatcataataaagaacggggttctttcattacttcagaggagcaggatgtaagccctcggccggctcctctgttactgaatactcccgcaattccatctttcaagcgtgacccgtttattggcgaacacaccgaagaaatcctggaggaatttggtttcagccgggaggagatatatcagctgaactctgacaaaattattgagtcaaataaggtgaaagcaagcctc

SEQ ID NO: 249468 - DNA, 1146 bp, Artificial Sequence
  Description of Artificial Sequence: Synthetic coding sequence
atggcgttgcaaggcatttcagtggtagaactgagtggtctggcaccagggccgttttgtgccatggtcttagcggattttggggctcgcgttgtgcgtgtggatcgcccaggctctaggtatgacgtctcgcggttgggacgtgggaagcgcagtcttgtactggatctcaaacagcccaggggagcagcggtgctgcgccggttgtgtaaacgctcagacgtgcttctggaaccgttccggcgaggtgttatggaaaagctgcaactgggaccagagattcttcaaagagaaaatccaagattaatttacgcgcggttgagcggctttggtcagtcaggcagtttttgccgtcttgcaggtcatgatatcaattaccttgcgttgagcggcgtactttccaaaataggccgaagtggggagaatccgtatgcaccgcttaatttactggctgattttgccggagggggtttgatgtgcgctcttggcattatcatggcactattcgatcggacaaggactggcaagggacaggtcattgatgccaacatggtagaaggcactgcgtatctgagttcttttttatggaaaacgcaaaaattatcattatgggaagccccgcgtggtcaaaacatgcttgatggaggcgcgcctttttatacgacttatcggactgccgatggcgaatttatggcagtcggtgcgatcgagcctcagttttacgaattgttaattaaaggccttggacttaaatctgacgagctccctaatcagatgagcatggatgattggccggaaatgaagaaaaaatttgcagatgtgtttgcagaaaaaacgaaagcagagtggtgccagatttttgatggcacggatgcctgtgtaacgccggtgctgacgttcgaggaagtcgtacatcatgatcataataaagaacgtggtagttttatcacgagtgaagaacaagacgtatcaccccgaccggctccactactgcttaacacgcctgcgatcccgtcctttaaacgggatccgttcataggagagcatacggaagagattcttgaagaatttggcttttcacgtgaagaaatttaccaattaaattcagacaaaattattgagtcaaacaaagtaaaggcgagtctg

SEQ ID NO: 249469 - DNA, 1146 bp, Artificial Sequence
  Description of Artificial Sequence: Synthetic coding sequence
atggcgcttcagggtatttcagttgtggaattaagcggcctagcccctggtcctttttgtgccatggtacttgcggattttggagctcgagtggtgagagtagatcgacccggttctcgctacgacgtgtcacggttaggccggggcaaacgtagcttagtcttggatctgaagcagccaagaggcgcagctgtccttcgacggttatgtaaacgcagcgatgtactgctggaaccttttcgtaggggagtgatggaaaaacttcagcttggtcctgaaattttgcaaagagagaatccgcgcttaatttatgctaggttgtctggttttggacagtcaggcagcttttgcagacttgccggacatgacatcaattatctggcgttgtctggagttcttagtaaaatcggccggtctggcgaaaatccgtacgctccgttaaatctcctggccgatttcgcggggggtggattgatgtgtgcgctgggcatcattatggcgttgtttgaccgtacaagaacgggtaaaggccaggtgattgacgcgaatatggttgagggaacagcttatctgtcttcatttctttggaaaacgcaaaaattgtctctgtgggaagcgccgagaggccaaaatatgcttgatggtggggctcccttttacacgacatatcgtacagcggacggcgaatttatggcggtgggcgcgattgaaccgcagttttacgagcttcttattaaaggactgggccttaaatcagatgaactgccgaatcagatgtccatggacgattggcctgaaatgaagaagaaatttgcggatgtttttgccgaaaaaacaaaggcagaatggtgccaaatctttgacggaaccgatgcatgcgtcacgccggttcttacctttgaggaagtagtacaccacgaccataacaaggaacgcggttcttttatcacgtctgaagagcaggatgttagcccgcgtccggctccccttctattgaatacaccggccataccgtcattcaaacgcgaccccttcatcggggaacatacggaagaaattttggaagaatttggattttcaagggaagaaatctatcaattgaattcagacaaaatcattgaatcgaataaagtgaaagcaagctta

SEQ ID NO: 249470 - DNA, 1146 bp, Artificial Sequence; identical to SEQ ID NO: 249458
  Description of Artificial Sequence: Synthetic coding sequence

SEQ ID NO: 249471 - DNA, 1146 bp, Artificial Sequence
  Description of Artificial Sequence: Synthetic coding sequence
atggctctgcaggggatctctgttgttgaactgtccggactggcccctggtccattttgcgccatggttctcgctgattttggcgcccgagtggtgagagtcgatagaccagggagtaggtatgacgtgtctcgcctgggcagagggaagcgttccctcgtgctagatttgaagcagcctaggggcgctgccgtgctgaggcgactgtgcaagaggtctgacgtactgctggaacccttcagacgcggcgtcatggaaaagttgcagctcggccctgagattctccaacgggagaaccccagactaatatatgcccggctaagcggattcggccaatctggttccttctgccgactggccggtcatgatataaattatttagctctgtctggagttctgtccaaaatcggcagatctggcgagaacccttatgccccactcaacctgctggctgactttgctggcggcgggttaatgtgcgcattaggcatcatcatggctctgtttgatcgtaccaggactggcaaaggtcaggtgattgacgccaacatggtcgaggggaccgcctacctatctagctttctgtggaagacacagaaactatccctctgggaagctccaaggggtcaaaacatgctggacggtggggctcctttttacaccacataccggaccgccgacggagaattcatggcagtgggcgccatcgaacctcagttttatgaattactaataaagggcttaggtctgaagtccgatgagctacccaatcaaatgtccatggatgactggcccgagatgaagaagaaattcgctgatgtgtttgctgaaaagacaaaagccgagtggtgccaaatctttgatggtaccgatgcctgcgtgactcctgtccttaccttcgaagaggtagtgcaccatgatcacaacaaggagaggggctcctttataacttcagaagaacaagacgtgtctcccaggccagcccctctgctgctgaacactccagccatccccagcttcaaacgtgacccattcatcggggagcacactgaagagattctagaggagttcggctttagtagagaggagatataccaactgaactcagataagataattgaatccaacaaggtgaaggcctccctg

SEQ ID NO: 249472 - DNA, 1146 bp, Artificial Sequence
  Description of Artificial Sequence: Synthetic coding sequence
atggcgcttcaaggaatatccgtcgtcgagctttcaggactggcacctggtcctttttgtgcaatggtccttgcggatttcggggcaagagtggtgcgggtcgatcggcctggctccagatacgatgtgtcgcgtctcgggcgtggcaaaagatccttggtgctggacctgaagcaaccgcggggggcagcggtgcttagacgcctgtgtaaacggtcagatgtccttctggagccatttcggcggggtgtgatggaaaagctccaactgggacctgaaattctgcagagagaaaacccacgcctgatctacgcgcgcctttccggtttcggacaaagcggtagcttctgtcgactggcaggccacgatatcaattaccttgcactgtcaggagtgcttagcaaaattggccgatcgggagagaacccctacgcccctcttaaccttctggcagattttgccggtggaggactgatgtgcgccctcggcatcattatggctctttttgatagaaccaggacggggaagggccaagtgattgacgcaaatatggtggaaggcaccgcatacctttcttcctttctctggaaaacccagaaactcagcctgtgggaagcaccacgcggacagaacatgcttgatggaggtgccccattttacaccacttaccggactgcagacggagaattcatggctgtgggcgccattgagccccaattctacgaactgttgatcaagggactgggtcttaagagcgatgaactgcccaaccaaatgtccatggatgattggcctgaaatgaagaagaaatttgcagatgtctttgcagaaaagactaaagccgagtggtgtcagatttttgatggtacggatgcatgcgtgactcctgtcctgaccttcgaggaggtggtccaccacgaccataacaaggaacgggggagcttcattacctccgaagaacaagacgtctccccccgacccgccccccttctgctgaacactcctgccataccatcgtttaaacgtgatccgtttataggtgaacataccgaagaaattctggaagaatttggcttctccagggaagagatttatcagttgaactcggataagattatagaatcaaacaaggtgaaggccagcttg

SEQ ID NO: 249473 - DNA, 1146 bp, Artificial Sequence
  Description of Artificial Sequence: Synthetic coding sequence
atggccctgcagggaatctcagtcgtggagttgtccggtctcgcccccggtccattttgcgccatggtactggctgatttcggtgctcgcgtggtcagggtagatagacctggaagccgctatgacgtatctcgattgggcaggggtaagcggagcctcgtgctggacctcaagcaaccgcgaggtgctgcggtgctcagacggttgtgcaaaaggagcgatgtgttgcttgagccatttcggcgcggtgtgatggagaagctccagcttggcccagaaatcctgcagagggaaaatccgaggctgatttatgctcgactgagtggatttggccagtctgggtctttctgtcggttggcaggtcatgacattaattatctcgcactgtctggagtactcagtaaaatagggcggtctggagagaacccttatgcacccctgaatcttctggcggatttcgccggaggagggttgatgtgtgccttgggaatcataatggccctgtttgacaggacccggacaggaaagggccaagtcatagatgctaacatggtcgagggcaccgcctacctctcctcttttttgtggaaaacccagaaactctcactgtgggaagccccacgcggccaaaacatgctcgatgggggagcaccgttttataccacttacaggactgccgatggagaattcatggcagtgggtgcaatcgagccacaattttatgaattgctcatcaaaggcctcggcctgaagtcagatgagctgccgaatcagatgagcatggacgattggccagagatgaagaaaaagttcgctgacgttttcgctgagaagactaaggccgaatggtgtcagatattcgacggcaccgacgcttgcgttacccccgtgctcacattcgaggaggtagtgcaccatgaccataacaaggaaagaggctcctttatcacctccgaggagcaagatgtcagccctcgccctgcaccgcttctgcttaacactcctgcaatccccagctttaaaagggacccctttatcggtgagcacactgaggagattctggaggagtttggattcagccgcgaagagatctaccagctgaactcagacaagattattgaaagcaataaggtgaaagcaagcctc

SEQ ID NO: 249474 - DNA, 1146 bp, Artificial Sequence
  Description of Artificial Sequence: Synthetic coding sequence
atggccttgcaggggatatctgtggtggagctctccggtctggcgcccgggccgttctgcgcgatggtcctggctgactttggggctagggtggtgcgggtcgataggccgggctctcggtatgacgtttctcgactgggcagggggaagcgatccttggtgctagacctgaagcaaccccggggggcagctgtactgcgcagactgtgcaagcgcagcgatgtgctgcttgagccattccggcgtggggtcatggaaaagctgcagctgggacccgaaatactccagagggagaacccccgattgatctacgctagattgagcggattcggacagagcgggtctttctgccgcttggccggacacgacatcaattatctggctctctcaggcgtcctgtccaagattgggagatccggtgagaacccttacgctcccttgaatctgttagccgatttcgccggcggcgggctgatgtgcgctttgggtatcatcatggctctgttcgacagaacacgcaccgggaaggggcaggttattgacgctaatatggtggagggaacagcctacctcagttcctttttgtggaaaacccagaagcttagtctgtgggaagccccccgaggccagaatatgctggatggcggggcacccttttacaccacctaccgcaccgccgatggagagtttatggccgtcggagcaatagaaccccagttttatgagttgctcattaaggggctgggactgaagtccgacgagctgcctaatcaaatgtctatggatgactggccagaaatgaaaaaaaagttcgctgacgtctttgctgaaaagacaaaggccgagtggtgccagattttcgatggcacagacgcgtgtgttacgcccgtcctgacgttcgaggaagtagtgcaccatgaccataataaggagcgcggttcctttataacgagcgaggagcaggacgtgagcccaagaccggcaccactcctgctgaataccccagccatcccgtcatttaagcgcgatccatttataggagaacatactgaagagattctcgaggagtttggcttttcacgagaagagatataccagctgaatagtgacaagatcattgaatccaacaaagtcaaagcctcgctg

SEQ ID NO: 249475 - DNA, 1146 bp, Artificial Sequence
  Description of Artificial Sequence: Synthetic coding sequence
atggctttgcaaggtatcagcgtcgtggaactttcgggactggctccgggacccttctgtgctatggtacttgcggacttcggcgcgagggtggtgcgcgtcgaccgtcccggttcccggtacgatgtgagcagactgggacgaggaaagagaagcttggttttggacttgaaacagccgcgtggtgctgctgtgttacgacggttgtgtaaacgttcagacgtcctgctggagcccttccgccggggcgtcatggaaaagctccagctgggtccggaaatcctgcagcgcgagaacccgcgtctgatctatgcccgactgtcaggattcggccaatccggatctttctgccgcttggccgggcatgatataaactacctggcgctttcgggtgtgctgagcaaaatcggtcgctccggagaaaacccctacgcgccgctaaatctgctggccgatttcgccggtggcgggctgatgtgcgctttagggatcattatggcgctattcgatcgcacccggacgggaaagggccaagtcatcgatgcaaacatggtggagggcacggcctatctgagctccttcctctggaagacacaaaagctctctctatgggaggctccacgcggtcagaatatgcttgacggaggcgccccgttctatactacgtatcgaacggcggatggcgagttcatggccgtgggcgccattgaaccgcaattttacgagctgctgataaagggtttgggattgaagtccgatgagttgcccaaccagatgagcatggatgattggcccgagatgaagaagaagtttgcagatgtgttcgcagagaagactaaggcagagtggtgccagatcttcgatggcactgatgcctgcgtgacgccggtgttgacctttgaggaagtagttcaccacgatcacaacaaagagcgaggatccttcattaccagtgaggagcaggatgtgtccccacgccctgcacctctgctgctgaacacaccagctattccctcgttcaaacgtgatccatttatcggagagcacacggaagagatactggaagagtttgggttctcgcgtgaggagatctaccagctgaactcggacaagataatcgaatcgaacaaggttaaggcttcgctg

SEQ ID NO: 249476 - DNA, 1146 bp, Artificial Sequence
  Description of Artificial Sequence: Synthetic coding sequence
atggccctgcagggtatcagcgtggtggaactgtcaggtttagccccaggccccttctgtgcaatggttctagccgacttcggggcccgcgttgtgcgtgtagaccggcccgggagccgctacgatgtatcccgactagggcgcggaaaaaggagccttgtgcttgacctcaagcagccccggggcgcagctgtgttaagacgcctctgcaagaggtctgatgtgctgttagagccattccgccggggggtgatggagaaactgcagcttggcccagaaattctgcaacgagagaacccacgcctcatatacgctcggctgtcaggctttgggcagtccggttcattctgccggttagctgggcatgacatcaattacctggcactctccggcgtgctctctaagattggacgcagcggagagaacccgtatgcaccccttaatctattggcagacttcgctgggggcggcctcatgtgtgcactggggatcatcatggcactcttcgatagaacgcgcacaggcaagggccaggtcattgacgcaaatatggtcgaaggcaccgcctacttaagttccttcctttggaaaacacagaagctttctctgtgggaagccccccgtggccagaatatgttagacggaggtgcaccgttctataccacctaccggactgctgatggggaatttatggccgtgggggctatcgaacctcagttttatgagttactgattaaagggttgggactgaagagcgacgagttgcccaatcagatgtctatggacgattggcccgaaatgaaaaagaagttcgctgacgtgtttgctgaaaaaactaaagccgagtggtgtcaaatcttcgatgggaccgacgcctgtgtgacgcctgtgctgaccttcgaggaagtcgtgcaccatgaccataataaggagaggggatcctttatcacgtcagaagagcaggacgtctcaccacgccccgcaccccttcttcttaatacgccagctatcccctcattcaaaagggatccctttatcggagagcataccgaggaaatactcgaagagtttggtttttcgcgtgaggaaatctaccagctgaatagtgacaaaattattgagtctaataaagtgaaggcttcacta

SEQ ID NO: 249477 - DNA, 1146 bp, Artificial Sequence
  Description of Artificial Sequence: Synthetic coding sequence
atggccttgcaaggaatctccgtggtggagctgtcgggtctggcgccgggacctttctgtgcgatggtcctggcagacttcggagccagagtggtcagggtcgatcgcccgggcagcagatacgacgtcagccgcttgggtagaggcaagagatcccttgtgcttgatctgaagcagccacgcggggcggcagtgctgcggcggctgtgcaagaggtccgatgttctgctggagcctttccgccggggagtcatggagaaactgcagttgggaccggagatccttcagagagaaaatccgcggttgatctacgcacggctctcagggttcggtcagtcgggcagcttctgtcggctcgctggccatgatatcaactacctggccctgtccggcgtgctctcgaaaatcggccgctcaggcgagaatccgtacgcgccacttaacctgctggcggattttgcgggaggcggactgatgtgcgccctgggcatcatcatggccctgtttgatcggacccggactggaaagggacaggtgatcgacgcgaatatggttgaaggaaccgcctacctgtcgtcctttctctggaaaactcagaagctctcactctgggaggcaccccgcggacaaaacatgcttgatggaggagcgcctttctacactacttaccgcaccgccgacggcgaattcatggccgtgggggctatcgagccacaattctatgagttgcttatcaagggactcgggcttaaatccgacgagctgccaaatcagatgtcaatggacgattggccggagatgaagaaaaagttcgctgatgtgttcgccgagaaaactaaggccgaatggtgtcagatcttcgacgggactgatgcgtgtgtcaccccagtgttgacgtttgaagaggtggtgcatcacgaccacaacaaggaaagaggtagcttcattaccagcgaagaacaggacgtctcgccgcgcccggcgcctctgctgctgaataccccagcgatcccatcattcaagcgggatccctttatcggagaacacaccgaggagatcctcgaggaattcggattctcccgggaggaaatctaccaactgaacagcgacaagattatcgaatccaacaaggtgaaggccagcctg

SEQ ID NO: 249478 - DNA, 1146 bp, Artificial Sequence
  Description of Artificial Sequence: Synthetic coding sequence
atggctttgcaaggcatttctgttgtcgaactctctggcttagctccaggcccattctgcgcaatggtactcgccgatttcggtgctcgtgttgtcagagtggatagacctggttccaggtatgatgtgagtaggttgggaagaggaaaaagatccttagttttggacttaaagcaaccacgaggagctgctgttttgcggagattatgtaagagatctgatgtccttctagagccctttagaaggggtgttatggagaagttgcaacttggccctgaaatcttgcagagggaaaacccacgtttaatttatgccaggctttctggttttggtcagtctggttccttctgtaggcttgctggtcacgacattaattacctggccttatcgggcgttttgtcaaagattggtagatcgggtgagaacccatacgcacctcttaatctcctcgctgacttcgccggagggggacttatgtgtgctcttggcatcatcatggctttgttcgataggactcggacaggaaagggacaggttatcgacgccaacatggtagagggtactgcttacctatcgtcttttctatggaaaacccagaagctgtctctatgggaggctcctaggggtcagaatatgttagacgggggggcgcctttctatacaacctaccgaactgctgatggtgaattcatggcggtcggcgctatagagcctcagttctacgaattgctcataaaaggacttggccttaaatccgatgagcttccgaatcaaatgagtatggatgattggccggaaatgaagaagaaatttgcagatgttttcgctgaaaagacgaaggcagaatggtgccagatattcgatgggacggatgcttgtgtgacgcctgttcttactttcgaggaggtggttcatcacgatcacaataaggagagaggatcctttatcacctctgaggaacaagacgtatctccacggccggcacctttgttgttaaacaccccagctatccctagctttaaacgtgatcctttcattggagaacatactgaggagatcctggaagaatttggtttctcaagagaagaaatctaccagctaaattctgataaaattatagaatctaataaggtcaaggctagcttg

SEQ ID NO: 249479 - DNA, 1146 bp, Artificial Sequence
  Description of Artificial Sequence: Synthetic coding sequence
atggcccttcagggtatttcagtagtcgaactgtccggactggcacctggtccattttgcgcaatggtgctcgcggactttggagcgcgggtggtgagagtcgaccgcccaggatcgagatacgatgtgtcgagacttgggagaggaaagagaagcctggtccttgatctgaagcaaccgcgcggcgcagcagtgcttagaaggctgtgtaagcgctcagatgtcctcctggaaccatttagaaggggagttatggagaaactccagttggggccagaaatcctccagagggagaacccgcgactcatatatgcacggctctctggttttggacagagcggatccttttgtcggcttgcagggcatgacatcaactacctggcgctgtcgggtgtcctttcgaagatcggacgctccggcgaaaacccatacgcgcctcttaaccttctcgctgattttgcagggggaggacttatgtgtgcactggggattatcatggcactgtttgatcgcacccgaaccggaaaagggcaggtgatcgatgccaatatggtggagggaactgcatacctcagcagctttctctggaaaactcagaagctgagcctttgggaagctccccgggggcagaacatgcttgatggtggcgcgccattctacaccacttaccgtaccgccgatggagaattcatggcagtgggtgcaattgaacctcaattctacgagctgctcataaaaggtctgggactcaaatcagacgaattgccaaatcaaatgtccatggacgactggcctgaaatgaaaaagaagttcgccgatgtgtttgcagagaaaactaaagcagaatggtgccagatctttgatggcacggatgcatgtgtgactcctgtgctcacttttgaagaagtggtccatcacgatcataacaaagaacgcggttcgttcataacctccgaggaacaggacgtgagccctagacccgcccccttgctgctgaacactcccgccattccttcctttaaacgagatccttttatcggtgaacacaccgaggaaatactggaagaatttgggttctcgagggaagagatctaccagctcaactccgacaaaatcattgaatcaaacaaagtgaaagcctcgctt

SEQ ID NO: 249480 - DNA, 1146 bp, Artificial Sequence
  Description of Artificial Sequence: Synthetic coding sequence
atggctttgcaaggcatctctgttgtggagctttcgggcctggctccgggtcccttctgcgcgatggtcctagccgatttcggtgcgcgcgttgtacgcgtcgaccggccaggcagccgctacgacgtgtcacgcttgggcagaggcaaacggtcgctagtgctggacctgaagcaaccgcgcggagcagctgtattgcgcagactctgcaagcgctccgatgtgctgctcgaaccgtttcgtcgaggtgtcatggagaagttgcaacttggccctgagattctgcagcgcgagaatccgcgtctgatttatgctcgcctatcggggtttggtcaatccggatccttttgtcgattagccggtcacgatattaattatctggccctttccggggtgctatcgaaaatcggacgaagcggagaaaacccgtacgcgccgttgaatctgctcgccgacttcgcgggtggtggactgatgtgcgcgctgggcatcatcatggcactgttcgaccggacgaggacaggtaaaggccaggtgatcgatgcgaacatggtggagggcacggcatatctgtcctccttcctgtggaagacccaaaagctaagtctgtgggaggccccgcgaggacagaacatgttggacggcggtgcccccttctacactacttataggacagcggatggtgagtttatggccgtcggcgccattgaaccacaattctacgagttgctaattaaaggcctcggtctcaagtcggatgagctgccaaaccagatgagcatggatgactggcccgagatgaagaagaagttcgccgacgttttcgccgagaagaccaaggccgagtggtgccaaatatttgatggcacagacgcctgcgttacaccagtactgacatttgaggaagtggtgcaccatgaccacaataaggagagaggttctttcatcacttccgaggagcaggatgtgtccccccgccctgctcctcttctgttgaacacccccgcaatcccctcgtttaaacgggacccatttataggggagcacaccgaagagatactcgaggagttcggcttctcgcgtgaggagatctatcaactgaattctgacaaaatcatagagagtaataaggtgaaggcctcctta

SEQ ID NO: 249481 - DNA, 1146 bp, Artificial Sequence
  Description of Artificial Sequence: Synthetic coding sequence
atggcgttgcagggtatttccgtagttgagctgtccggtctggctcccggaccgttttgcgcgatggtgctcgccgacttcggtgcccgggtggtgcgcgtggaccggcctggcagtcgctacgacgtttcccgtctcggacgtggtaagaggtcccttgtgttggacttaaaacaaccgagaggcgctgctgtgctgcgccggctctgcaagcgctccgatgtcctgttggaaccgttccggcggggggtgatggagaagctccagctaggccccgagatcctgcagcgcgagaaccccagacttatctacgctcgcttgtcgggcttcggtcagtccggtagcttctgccgtctcgccggtcacgacattaactatctcgcgcttagcggcgtgctgtcgaagatcggtaggtcgggtgagaatccctacgcccctctcaatttgttggcggacttcgcgggtggaggcttaatgtgcgccctcggcatcattatggcactgttcgatcgtacacgcaccggtaagggtcaggtcattgatgccaacatggtggagggaaccgcctacctgtcttctttcctctggaagacccagaagcttagcctatgggaggccccgcgcggccagaatatgcttgacggtggtgctcccttctacactacctaccgcaccgccgacggagagttcatggcggtaggcgccattgagccgcaattctacgaactgctaataaagggcctcggcctgaagtcggatgagctccccaaccagatgagtatggacgattggcctgagatgaagaagaagttcgccgatgtgttcgctgagaagacgaaggccgagtggtgccaaatcttcgacggtaccgacgcatgcgtcactcccgtgttgacattcgaagaggtggtccatcatgatcacaacaaggagaggggctccttcattacctcagaagagcaagacgtcagtccgaggccagctccccttctgctgaacactcctgcaatcccttcctttaaacgcgacccgttcattggtgagcatactgaagagatcctggaggagttcggctttagcagggaagaaatataccagctgaacagtgataagattatcgagtccaacaaggtgaaggcctcgctg

SEQ ID NO: 249482 - DNA, 1146 bp, Artificial Sequence
  Description of Artificial Sequence: Synthetic coding sequence
atggctctgcagggaatcagtgtagtggaattatccgggctggcgccaggtcccttctgcgcaatggtgctggcggatttcggcgcgagggttgtgcgggtcgatcgaccggggtctcgctacgacgtgtcgagactgggcagaggcaaacgctccctggtgctggatttgaagcagccaaggggggctgccgtcctgaggagactgtgtaagcgctccgacgtcctcctcgagccctttagacgcggagtcatggaaaagttacagctcgggcctgaaatactccagcgggagaatccgagactgatttacgctaggttatccgggttcggccagtcaggtagtttttgccgcctggccggccacgacatcaactacctcgctctgtccggcgtgctatcaaaaatcggaagatccggtgagaacccctacgcccccctgaacctcctggccgattttgctggaggagggctaatgtgtgccctgggtatcattatggctctgttcgacagaacccgcacagggaaaggccaggtgatcgatgccaatatggtggagggaacagcctacctgagttcttttctgtggaagacccagaaactgtctctgtgggaggctcccaggggccagaatatgcttgacggcggagcgccgttctacaccacttacagaacagcagacggggagtttatggccgtcggagccatagaaccccagttctacgagctgctgatcaaggggctcggacttaagtcagatgagctacctaatcagatgagcatggatgactggcccgaaatgaagaagaaattcgcagatgtcttcgctgaaaagaccaaagccgagtggtgccagatattcgatggcacggatgcttgtgttaccccagtactgacgtttgaggaagtggtccaccacgatcacaataaagaacgggggagctttatcacttcagaggaacaggacgtctccccaagacccgcccccctcctgcttaataccccagccattccctcttttaaacgcgatcccttcatcggcgagcacacagaagagatactggaagagttcggattctcaagagaggagatttatcaactgaatagtgacaaaataatcgagagcaacaaagtcaaagccagcctc

SEQ ID NO: 249483 - DNA, 1146 bp, Artificial Sequence
  Description of Artificial Sequence: Synthetic coding sequence
atggccctccaggggatcagtgttgtcgagctgtccggtctggccccaggcccgttctgtgcaatggtattggccgatttcggagcaagagtcgtgcgtgttgatcggcctggaagccgctacgacgtgagccgcctcggcagagggaagcgttccctcgttttggacctcaaacagcctagaggcgccgctgtcctgcggcggctgtgcaaacggtcagacgtcttgctcgagccttttcggcgaggggtgatggagaagctccagctgggccccgagattctgcagcgagaaaaccctagactcatatacgccaggctgagcgggttcggccaatctgggtcattttgtaggctggcgggacatgatattaactatcttgcactctccggcgtgttgagcaagatcgggcggagcggcgagaatccttatgccccactcaacctgttggctgattttgctggcggaggcttgatgtgcgccctcgggatcatcatggctctgttcgaccggacaaggaccggcaaaggccaggtcatagacgcgaacatggtcgaaggcaccgcgtatctgtcatccttcctgtggaaaacccaaaaactgagcctgtgggaggccccaagagggcagaacatgctggatggcggagctcccttctacaccacttaccggacagcagacggtgagttcatggctgtgggcgccatcgaaccgcaattctatgaattgctgatcaagggcctgggcctgaaatcagatgaattgcctaaccagatgagtatggacgattggcctgagatgaagaagaagtttgccgatgtcttcgccgagaagaccaaagctgagtggtgtcagatcttcgacggaactgacgcttgtgtaacccctgtactgacttttgaagaagtcgtgcatcatgatcataataaagaaagaggttccttcattaccagtgaggagcaggatgtgtccccccgacctgcaccactcctcctgaatacccccgcaatcccatcattcaagagagatccatttatcggcgagcatactgaggaaattctggaagagttcggattttctagagaggagatataccaactcaattcagataaaatcatcgaatccaataaggtgaaggcctcattg

SEQ ID NO: 249484 - DNA, 1146 bp, Artificial Sequence
  Description of Artificial Sequence: Synthetic coding sequence
atggctctccaggggatcagcgtggttgagttgagcggtttggcccctggaccattctgcgccatggtactggcagatttcggagccagggtcgtgcgggtcgatagacctggatctcgctacgatgtgtccaggctggggcgcgggaagaggtcgctggtgctggatctcaagcaaccaagaggagccgcggtgctcagacggctttgcaagcgctccgatgtcctgctggaaccgtttaggcgcggcgtcatggaaaagctccaactgggcccggaaatcctgcaacgcgaaaatccccggctgatttacgcccggctctccggattcggacagtcaggaagtttctgcagattggcgggacatgacattaactacctcgctctttcgggagtcctcagtaagatcggtcgaagtggggagaacccttacgctcctctgaatctgctggccgactttgcgggaggaggcctcatgtgcgcactcggcattatcatggcactgtttgacaggaccaggaccggcaaagggcaagtgatcgacgctaacatggtggagggcaccgcatatttgtcctcctttctgtggaaaactcagaagctctccctgtgggaggcaccgcgcgggcagaacatgttggacggaggagcgccgttctacactacgtaccgcactgcggacggcgagtttatggccgtgggcgccatcgaaccgcagttctacgagctcttgattaagggtttgggacttaaatcggacgaactgccgaaccaaatgagcatggatgattggccagagatgaagaagaagttcgcagacgtctttgctgaaaagaccaaagcggaatggtgtcagatcttcgatggcacggacgcctgtgttaccccagtgctgactttcgaggaagtggttcatcacgaccataacaaggaacgggggagcttcattacttcggaggaacaggacgtgtcgccgcggcccgccccactgctgttgaacactcccgcgatcccttcgttcaagcgcgacccattcatcggagagcatactgaagaaatcctggaggaattcggattcagccgggaagagatctaccagcttaatagcgacaaaatcatcgaatcgaataaagtgaaagcaagcctg

SEQ ID NO: 249485 - DNA, 1146 bp, Artificial Sequence
  Description of Artificial Sequence: Synthetic coding sequence
atggccctacagggaatctcagtggtcgaactgtctggtctggcccctggaccattctgcgctatggtgctcgcggactttggcgcacgcgtggtacgggtggatcgccctgggtctagatacgacgtgtcaaggctgggaaggggcaaaaggagtctggtgctggacttgaaacaaccgcggggcgctgcggtcctccgtcgtctgtgcaagagatccgacgttttgctggagccattccgtagaggagttatggaaaagctccagttaggaccagaaatcctgcagagggagaacccgaggctcatctatgctcgcctatccggattcggacaatcaggtagtttctgccgactggctgggcacgatattaactatctggccctgagcggcgtattgagtaaaatcgggcggtcaggcgaaaacccatatgccccactgaatttgctggctgacttcgctggcggcggcctgatgtgtgcgctcggaataattatggccctgtttgacaggacacgtacaggtaaaggacaggtgatcgacgctaatatggtcgaagggactgcgtatctgtcttctttcctatggaaaacacagaaactgagtctctgggaggcccctaggggccagaacatgttggacggcggcgcccctttctacaccacctatagaacagcagacggagagttcatggcagtgggcgctatcgagccccagttttacgagcttctaatcaaagggctgggcctgaagagcgacgagttaccaaaccaaatgagtatggacgactggccggaaatgaaaaagaagttcgcagatgtgtttgctgaaaagaccaaggcggagtggtgtcaaattttcgacggcaccgatgcatgcgttacccccgtgctcaccttcgaagaagtggtgcatcacgaccacaacaaggagcgcggcagctttatcacctcagaggagcaggacgtttctcctcggcctgctcctcttctgttgaatactcccgctatccctagtttcaagagagacccgttcattggcgagcacactgaggaaattcttgaggagttcggtttcagtagggaggagatctaccagcttaactcagataagatcatcgagtccaataaagttaaggccagttta

SEQ ID NO: 249486 - DNA, 1146 bp, Artificial Sequence
  Description of Artificial Sequence: Synthetic coding sequence
atggcccttcagggaataagtgttgttgaactttctggactggcgcccggcccattttgtgcaatggtgctggcagactttggggccagagtagtgcgagtcgataggcccggatctcgctatgatgtcagtcgtctgggcaggggaaaaagatccctggtactggacctgaagcagccccggggagcggcggtcctccgcaggctgtgcaagcggtctgatgtcctgctagaacctttccgacggggtgttatggagaaattgcagctagggccagaaatcctccaacgagagaatccccgcctgatttacgctaggcttagtggattcggacagagcggttctttctgtcgtctcgccggacatgatatcaattatttagctctgtctggcgtgctgagcaagatcggacgatctggggagaatccttatgctccgttgaacctgttggcggatttcgccggcggcgggctgatgtgtgcactagggattattatggcactgttcgacaggacacgcactggaaagggccaggtgatcgatgcaaacatggtagagggtacagcctacctctcaagctttctatggaaaacccagaagctttccctttgggaggctccacgagggcaaaatatgctcgatggcggggctccattctatactacataccggacagctgacggtgaatttatggccgtgggcgccatcgagcctcaattctatgaactactgatcaagggactcgggctgaaaagcgatgaactgcctaatcagatgtccatggacgattggcctgaaatgaaaaaaaagttcgccgacgtgtttgccgagaaaacaaaggccgaatggtgtcagatttttgatgggactgatgcctgcgtcacgcctgtccttacctttgaagaagtggtgcatcacgatcacaacaaggaaagaggttctttcatcacctccgaggagcaggacgtctccccccgaccagcaccacttctgttaaatacccccgctatccctagttttaaacgagatccattcatcggggaacatacagaggagatcttggaggaatttgggttttctagggaggagatttaccaacttaactccgataagattattgaatcgaacaaggtaaaggcgtctctg

SEQ ID NO: 249487 - DNA, 1146 bp, Artificial Sequence
  Description of Artificial Sequence: Synthetic coding sequence
atggcgctgcagggcatctccgtcgtcgaattgtcggggctggctcccggcccgttctgcgcaatggtgctcgctgattttggcgccagagtggtgcgcgtggaccgcccgggttcccgctacgacgtgtcgaggcttggacgaggtaagcggtccctcgtcttggacctcaaacagcccagaggagctgcggtgctgcgccggctctgcaagcggtccgatgtgctcctcgaaccgttccgccgcggagtcatggagaaactgcaactgggccctgaaatccttcaacgggaaaatccacgcttgatctacgcaaggctctccggatttggtcagtcgggtagcttttgtcgacttgccggacacgacatcaattacctcgcacttagcggagtgctgagcaagatcggaagatcgggagagaatccatacgcccctctgaacttgctggccgatttcgctggcggtggactgatgtgcgcgctcggaatcatcatggcgctgtttgaccggactaggactggaaagggccaggtcattgacgccaacatggtggaaggcactgcctacttgtcgtcctttctgtggaaaacgcaaaagctgtccttgtgggaagccccgaggggacaaaacatgttggacggcggagcaccattttacaccacctaccggactgccgacggggaattcatggcagtcggcgcaatcgagccacagttctacgagcttctcattaagggactgggcctcaagtcagacgaactcccgaatcaaatgtcgatggatgattggccggagatgaagaagaagttcgcagacgtgttcgccgagaaaaccaaggctgagtggtgtcagatcttcgacggaacggacgcctgcgtcactccggtgctgactttcgaagaagtggtgcatcacgaccacaacaaggagcggggatcattcatcacctccgaagaacaggatgtgtcaccgcgccctgccccactcctgctgaacaccccagcgataccgtcattcaagagggatccctttatcggagagcatacggaggaaatcctcgaggagttcggtttcagcagagaggagatttaccaacttaattccgacaagattatcgagtcgaataaggtcaaggcctcgctc

SEQ ID NO: 249488 - DNA, 1146 bp, Artificial Sequence
  Description of Artificial Sequence: Synthetic coding sequence
atggcactacagggaatttccgtagtggaactcagtgggctcgcgcctgggccattttgcgcgatggtgctggccgatttcggggccagggtggtaagggttgatcgccccggatctcggtatgatgtctctcgactggggagaggaaaaaggtcccttgttttggatcttaaacagcccaggggggccgctgttctgcggagactatgcaagcggagtgatgttctcctagaacccttcaggcgaggagtgatggaaaaactccagctcggacccgaaattctccagcgcgagaacccccggcttatatatgctcgactttccggatttggacagtccgggtccttctgccggttagccgggcatgacatcaactacctcgccctgagtggagtgctgagtaaaatcggaaggtctggggaaaacccttatgcccctctgaatctattggctgatttcgctggaggagggttaatgtgcgctctggggatcataatggccctttttgatagaactcggacagggaaagggcaggtaatcgatgccaatatggttgaggggactgcttacctttcaagttttctctggaaaactcagaaactttccttatgggaggctccgcgaggacagaatatgctcgacgggggggctcccttttatactacatatcgaacagctgacggggaattcatggccgtgggggctatcgagcctcagttttatgaactcctcataaaaggactgggacttaaatcagatgagttgccgaatcagatgtccatggatgattggccagaaatgaaaaaaaaatttgccgatgtttttgccgagaagacaaaagctgaatggtgtcagatctttgatggaactgacgcctgcgtaactcccgtacttacttttgaggaagtggtgcatcatgatcataacaaagaaagggggtcatttatcacatccgaagaacaggacgtctccccaaggcctgccccccttcttctaaacactcctgccataccttcatttaaacgagatccattcattggagaacatactgaagaaatcctcgaagagttcggattctcaagagaggaaatataccagctaaattccgacaaaattatagaatcgaacaaggttaaagcctctctt

SEQ ID NO: 249489 - DNA, 1146 bp, Artificial Sequence
  Description of Artificial Sequence: Synthetic coding sequence
atggcccttcagggaattagtgttgtggaactgtccggtcttgcccccggaccattctgcgccatggtgttagccgatttcggggctcgcgtggtgagagtggatcgacctgggagcagatatgatgtgagcagattggggcggggcaagcgaagcctggttcttgatctcaaacaaccgcgaggtgctgccgttctcagaagactctgcaaacggagtgatgttctcctggagccgttccgaaggggagtgatggaaaagctgcagttgggccctgaaatactacagcgcgagaaccccagactgatatatgcacgtctgtcaggctttggccagagcggtagcttctgtaggctagcagggcacgacatcaactaccttgcgctgagcggtgtcctatccaagattggtcggagtggcgaaaatccctatgccccactgaacctattagctgattttgccggcggcggcctgatgtgcgcgctgggaattattatggctttgttcgatcgaacccgtaccggaaaaggacaggtaattgacgctaatatggtggagggaaccgcatatctaagttcctttctttggaaaacacagaagctcagcctttgggaggcccctagaggccagaatatgttggacgggggcgctccattctatacgacctataggaccgcagacggcgagttcatggcggtgggcgccatcgaaccccagttttatgaactgctgattaaagggctcggattgaagtccgacgagctgcctaatcagatgagcatggatgattggcctgagatgaagaaaaaatttgctgacgttttcgctgagaaaactaaggcagaatggtgccaaatctttgatggtacagacgcatgtgtgacccctgtcctgacttttgaggaggtggtccatcacgaccacaataaagagagaggcagtttcataaccagcgaggagcaggacgtaagcccgcgacccgctcctctgttgctaaatacccccgccatcccttctttcaaacgggatcccttcatcggggagcatacagaggaaatccttgaggaatttggtttcagtcgtgaggagatataccagctcaactcagacaagatcatcgagtccaataaagttaaggcgtccctc

SEQ ID NO: 249490 - DNA, 1146 bp, Artificial Sequence
  Description of Artificial Sequence: Synthetic coding sequence
atggcgctgcagggcattagcgtggtagaactttctggtcttgcccccggtccgttttgcgccatggtgctcgctgactttggagctagagtggtcagggtggatcgcccaggctccagatatgacgtgtctagactcggaaggggcaagcgctctctggtcctggatcttaagcaacctaggggtgctgctgttctgagacgcctctgcaaaaggtccgacgttctcctcgagccttttcgcaggggcgtgatggaaaagctgcaacttggcccggaaatcttgcagagagaaaaccctagactgatatatgccaggttgtccggattcggacagtccggctccttctgccgcctcgccggccacgacatcaattacctggccctcagtggtgtactttcaaaaatcggtaggtctggtgagaatccctatgccccactgaacctgcttgcggacttcgccggaggaggattgatgtgtgccctcggcataattatggctttgttcgatagaacaaggactggaaaaggccaggtcatagacgctaacatggtcgagggtaccgcttacctgtcatcctttctctggaagacacagaaactctctctttgggaagccccaagaggacagaacatgttggacggtggagctcccttctataccacataccgcacggcggacggcgagttcatggccgtgggtgcaattgaacctcaattctacgagcttctgattaagggccttggactcaaatccgatgaactcccgaaccaaatgtccatggatgactggcctgagatgaagaagaagttcgccgatgtgtttgccgaaaaaactaaagcagaatggtgccagatttttgacggaacggatgcatgtgtgactcccgtcctcacgtttgaggaagtcgttcaccatgaccacaacaaggagcgcggaagcttcatcacttctgaggagcaggacgtgagtccccgcccggctcctctgctcctcaatacccccgccatcccttccttcaaaagggatccctttatcggagagcatacagaagaaatactggaagagtttggttttagcagagaggaaatctatcaactcaatagcgataaaatcatcgagtcaaacaaggtgaaagctagcctc

SEQ ID NO: 249491 - DNA, 1146 bp, Artificial Sequence
  Description of Artificial Sequence: Synthetic coding sequence
atggccctgcagggtatatccgtagtcgagctctccgggctggcaccgggccctttttgtgccatggtactcgcagacttcggcgcaagggtcgtgcgagtcgaccggccgggcagccggtatgatgtgtcacgcctggggagaggaaagagatccctggtcctcgacttaaagcagccccggggcgccgccgtcctccgcaggctttgcaagcgcagtgacgtgttactggaacctttcaggcgaggagtgatggaaaaactgcagttaggccccgagatcttgcaaagagaaaaccccaggctgatttatgcccggcttagtggttttggtcagagtggaagcttttgtagactggccgggcacgacattaattacctcgccctctcgggcgtgcttagcaaaattggcaggtctggagaaaacccatatgcccccctaaatctcctcgctgactttgctggcggagggctgatgtgcgccctcggaatcatcatggccttgttcgaccgcacccggaccggcaaagggcaggtcattgacgccaatatggtagagggaaccgcttacctgtcgtctttcctgtggaaaactcaaaagctctccctgtgggaggctccacgcggacagaacatgctggacgggggggcgccattttatacaacatacaggaccgcagacggcgaatttatggctgtgggtgctattgaaccccagttctatgaacttctgatcaagggtctgggcctgaaaagcgacgaactccccaaccagatgagcatggacgattggccagagatgaaaaaaaaattcgccgacgtattcgccgaaaaaacaaaggcagagtggtgccagatttttgacgggaccgatgcgtgcgtaacacccgtgctcacatttgaggaagtggtgcaccacgaccataataaggagagagggtctttcattacctcagaggagcaggatgtgtcccctcgcccagcacctctgttacttaatactcccgccattccgtcgttcaagagggaccctttcatcggtgagcacactgaggagattctagaggaatttggattctcccgcgaggaaatctaccagctcaactctgacaaaatcatcgagtctaacaaagtcaaagcaagtttg

SEQ ID NO: 249492 - DNA, 1146 bp, Artificial Sequence
  Description of Artificial Sequence: Synthetic coding sequence
atggccctccagggtatatctgtcgtcgagctttctggtctcgcacctggacccttttgtgccatggttcttgctgatttcggtgcaagggtcgtacgcgtggatcgccccgggtccagatacgatgtctcacggctgggccgcggaaaacggtcactcgttttggacctgaagcagccccgaggtgccgccgttctccgccgcctgtgtaaacggtccgatgtgctgctggagccatttcgacggggggtaatggagaaacttcagcttggacctgaaatcctccagagagaaaacccaaggctgatatacgcacggttgtccggattcggacaatcaggatccttttgccgactggcaggacacgacatcaactatttggcactcagtggcgtgctgtccaagattgggcgctcaggcgagaacccctatgcacccttgaatctgctggctgatttcgctggcggaggactgatgtgcgctctgggtatcatcatggctttgtttgatagaaccagaactgggaagggccaagtgattgacgccaatatggtagaaggcaccgcctacctctcctctttcttgtggaaaacccaaaagctttccctgtgggaggcccctcgcggacagaacatgctcgacgggggagcccccttttacactacatacaggaccgcagacggggaattcatggctgtcggggcgatcgaacctcagttctacgaactgcttattaaaggactgggcttgaaaagtgacgagctgcccaaccagatgagtatggatgactggccagaaatgaagaagaagttcgcagacgtcttcgctgagaaaaccaaggccgagtggtgtcagatcttcgatggcactgatgcgtgcgttaccccagtgctgactttcgaggaagtggtgcaccacgaccacaacaaggagcgaggctcatttatcacatcagaagagcaggatgtgagtcctaggcccgccccacttcttctgaacacaccggccattccctcctttaagcgcgacccatttatcggcgagcatactgaggaaatactcgaggagtttggcttctcacgagaggagatttaccagctcaactccgataaaatcattgaaagtaataaagttaaagcgtccctg

SEQ ID NO: 249493 - DNA, 1146 bp, Artificial Sequence
  Description of Artificial Sequence: Synthetic coding sequence
atggcccttcaaggtatcagcgtcgtggagctgtcgggactcgcgcccggacctttctgcgctatggtgctggcagacttcggagccagagtggtccgggtggatagacctggatctcgctacgacgtttcgcgcctgggaaggggtaagaggtcgttggtgctggaccttaagcagccgagaggagccgccgtgctccgacggctgtgcaagcgctcggacgtgctgctggaacctttccggcggggagtgatggagaagctgcaactgggtcccgaaatcctgcaacgcgaaaacccgcggctgatttacgcccgcttgtcaggattcgggcaaagcggatcattctgtagactcgccgggcatgatatcaactacctggcactgtccggggtcctctccaagatcggtaggtccggagagaacccgtacgcccccctcaatctcctggcggacttcgctggcggcggcctgatgtgtgcgctgggcattatcatggccttgtttgatcggacccgcactggtaagggccaggtcatcgacgcgaacatggtcgagggcactgcctatctgtcatcctttctttggaaaacgcagaaactgtcactctgggaagctccgcgtggccagaatatgctcgatggaggcgccccgttttacaccacctaccgcactgcagacggagaatttatggcagtgggagcaatcgaacctcagttctacgagctccttattaaggggctggggttgaagagcgacgagctcccaaaccagatgtcgatggacgattggccggaaatgaaaaagaaatttgcggatgtgttcgcggaaaaaaccaaggctgagtggtgccagatcttcgatggaaccgacgcgtgcgtgactccggtgcttaccttcgaggaagtggtccaccatgaccacaacaaggagcggggcagcttcatcacttcggaggagcaagatgtgtcgccacgcccggctccattgctgctcaacaccccagccatcccgtccttcaagcgcgacccattcatcggagaacacacggaggaaattctcgaagagtttggattctcaagagaagaaatctaccagctgaatagtgacaagatcatcgaatccaataaggtcaaagcaagcctg

SEQ ID NO: 249494 - DNA, 1146 bp, Artificial Sequence
  Description of Artificial Sequence: Synthetic coding sequence
atggcgctacaaggtatatcggtagttgaactatcgggtttagcgccgggtccgttttgtgcgatggtattagcggattttggtgcgcgagttgttcgtgtagatcgtccgggttcgcgttatgatgtatcgcgtttaggtcgtggtaaacgttcgttagtattagatttaaaacaaccgcgaggtgcggcggttttacgacgtctatgtaaacgatcggatgttttactagaaccgtttcgtcgtggtgttatggaaaaattacaactaggtccggaaatactacaacgtgaaaatccgcgactaatatatgcgcgtctatcgggttttggtcaatcgggttcgttttgtcgactagcgggtcatgatataaattatttagcgttatcgggtgtactatcgaaaataggtcgttcgggtgaaaatccgtatgcgccgttaaatttactagcggattttgcgggtggtggtctaatgtgtgcgttaggtataataatggcgttatttgatcgaacgcgaacgggtaaaggtcaagtaatagatgcgaatatggtagaaggtacggcgtatctatcgtcgtttctatggaaaacgcaaaaattatcgttatgggaagcgccgcgtggtcaaaatatgttagatggtggtgcgccgttttatacgacgtatcgtacggcggatggtgaatttatggcggtaggtgcgatagaaccgcaattttatgaattactaataaaaggtttaggtttaaaatcggatgaattaccgaatcaaatgtcgatggatgattggccggaaatgaaaaaaaaatttgcggatgtatttgcggaaaaaacgaaagcggaatggtgtcaaatatttgatggtacggatgcgtgtgttacgccggtactaacgtttgaagaagtagttcatcatgatcataataaagaacgaggttcgtttataacgtcggaagaacaagatgtttcgccgcgtccggcgccgttactattaaatacgccggcgataccgtcgtttaaacgagatccgtttataggtgaacatacggaagaaatattagaagaatttggtttttcgcgtgaagaaatatatcaattaaattcggataaaataatagaatcgaataaagtaaaagcgtcgtta

SEQ ID NO: 249495 - DNA, 1146 bp, Artificial Sequence
  Description of Artificial Sequence: Synthetic coding sequence
atggcactccagggcatatccgtggtagagcttagtgggctggcccctggacctttttgtgccatggtcctcgccgattttggagctagggttgtaagggtggatcgtcctggttcaaggtacgacgtgtcccggttaggaagaggaaaacggtccctggtccttgatttgaagcaacccaggggggccgcagtgctcaggaggctttgtaaacgtagcgacgttcttcttgaaccatttcggcggggagtcatggagaaactacagctcgggcccgagatcctgcagcgcgagaacccccgactcatttatgcaagactgtccggattcggccagtcggggagtttttgtcgtttagctgggcacgatataaactatttggcgctatccggcgtgctatcgaagattggacgcagcggagagaatccctatgctcccctcaatttgctggctgacttcgccggaggtggcttgatgtgcgccctgggtatcattatggccttgtttgaccgcacgcgcacaggaaaaggacaggtcatcgacgcaaacatggtggaggggacagcctatctgagcagcttcttatggaaaacccagaaactctctctttgggaagccccccgcgggcagaacatgctggatgggggcgcaccgttctacaccacataccgcaccgcggatggggagtttatggcagtgggagccatcgagcctcagttttatgagctattgatcaagggccttggcttgaagagcgatgaacttcccaaccagatgtccatggatgactggcctgagatgaagaagaaattcgctgacgtgttcgccgagaaaaccaaagctgagtggtgccagattttcgatggcacagatgcctgcgtaacacctgttctgacttttgaagaggtggtccaccatgaccacaacaaggaaaggggctcttttattactagcgaggaacaggacgttagccctcgcccagcaccgttgttactgaatacgcctgcgatcccctccttcaaacgggacccctttatcggagaacatacagaggagatcctcgaggagtttgggttctcacgggaggagatctatcagctgaacagcgacaaaattatcgaaagcaataaggtgaaggcttccttg

SEQ ID NO: 249496 - DNA, 1146 bp, Artificial Sequence
  Description of Artificial Sequence: Synthetic coding sequence
atggctcttcaggggatcagcgtggtggaactcagtgggcttgcccccggacccttttgcgccatggtcttagcagattttggagccagagtggtacgagtcgaccgtcctgggagcaggtacgatgtgagcaggctgggccgggggaagaggagcctcgtcctggatcttaagcaaccccggggagccgccgtattgcgccggctttgtaaaagatctgacgtgttgcttgagccttttaggaggggagtaatggaaaaactgcaactcggccctgagattctccagcgcgagaacccccggttaatctacgccaggctgtctggattcggccaatctggcagcttctgccgtctggccggccacgacatcaactatctggccctgtccggagtgctgtcgaaaatcggcagaagtggagagaacccgtatgcgccattgaatcttctggctgacttcgccgggggcggattaatgtgcgctctggggattataatggctctcttcgataggacgcgaactggtaaagggcaggtgattgacgccaatatggtcgaaggaactgcctacctctcttcattcctttggaagacacagaaactatccctgtgggaggccccccgagggcaaaacatgctggatggcggcgcaccattttacacgacataccgtaccgccgacggtgagtttatggcagttggcgccattgagccacaattctacgaactccttataaaaggacttggcctgaaatctgacgagctgccaaaccagatgagcatggacgactggccagaaatgaagaagaagttcgctgacgtcttcgccgaaaagacaaaggcagagtggtgtcagatatttgatggaactgacgcttgtgtaactcccgtcttgacgttcgaagaggttgtgcatcatgaccataataaagaacgaggctcttttatcacgagcgaggaacaggacgtgagcccaagaccagctccactgttactcaatactccggcgatccccagctttaaacgcgatcccttcattggagaacacactgaggagatcctggaagagttcgggttctccagggaagagatctaccagctgaactctgataagatcatagaaagcaacaaagtcaaggcttctctg

SEQ ID NO: 249497 - DNA, 1146 bp, Artificial Sequence
  Description of Artificial Sequence: Synthetic coding sequence
atggctttacagggcatctccgtggttgagctgtccggtctggcccccggtcccttttgtgcgatggtgttagccgacttcggcgcaagagtagttcgggtggatcgcccaggatcacgctatgacgttagccgtctggggcgaggaaaaaggtcactagttctggatctgaaacagccaaggggggcagccgtgttacggcggctctgtaagcgaagtgacgtcctcctggagccctttcgcaggggtgtgatggaaaaactccagctagggccagaaatcctccagagagaaaaccctcgcctgatctatgccagactgtctggatttgggcagagcggatcattttgtcggctggcggggcatgatatcaactatctggcactgtctggcgtattaagcaagatcggccgtagcggagagaatccgtatgcccctttaaacctactcgccgacttcgccggagggggcctcatgtgcgccttgggcattatcatggccctgttcgaccgcaccagaaccggcaagggccaggtcatcgacgccaatatggtggaaggcacagcttaccttagtagttttctttggaaaactcagaagctctcactttgggaagcccccagaggccagaacatgctggacggcggcgctcctttttataccacgtatcgtaccgccgacggcgagtttatggcagtgggcgccattgagccacagttttatgaattgctaatcaaggggctgggtctgaagtcagatgagctgccgaaccaaatgagtatggatgactggcctgagatgaaaaagaaatttgcagatgtgttcgcggagaaaactaaagccgagtggtgccaaatctttgatggtacggatgcatgcgtgacccccgtactgacttttgaggaggtcgtgcatcatgatcataataaagagcgcggttcgttcatcacgagcgaggagcaggatgtgtcaccgcgtcctgcaccactcctgctgaatacccctgctatccccagctttaagcgagacccttttataggtgagcacaccgaggaaatccttgaagagtttggtttctctcgggaggaaatttatcagctcaattccgataaaattattgagtctaataaagttaaagcttctctg

SEQ ID NO: 249498 - DNA, 1146 bp, Artificial Sequence
  Description of Artificial Sequence: Synthetic coding sequence
atggcactccagggtatctcggtggtcgaactgtcaggccttgcgccgggacccttctgcgcaatggtgctcgcggacttcggagcacgcgtggtgagagtggaccgccctggctcgcgctacgacgtttcccgactgggcagggggaaacgcagccttgtgctggacctgaagcagccgagaggcgctgcagttctgagacggctgtgcaagcggtcagacgtgcttctcgagcccttccgccgcggagttatggaaaaactgcaactgggtcccgagatcctgcaacgggaaaacccgcggctcatctacgcgcgactgtcgggattcggacagtccggatcgttctgccgattggctggacatgacatcaattacttggccctgtccggcgtgctgtcaaagatcggaagatccggtgaaaatccgtacgcgccactcaatctcctcgccgactttgcgggaggcggactcatgtgtgccctgggaatcatcatggcgctttttgacagaacgcgcacgggcaagggacaggtgatcgacgcaaacatggtggaaggcaccgcatacctgtcatccttcctgtggaaaacccaaaaacttagcctctgggaagcgccgcgcggtcagaacatgcttgacggaggtgctcccttttacaccacttacagaactgccgacggagaatttatggctgtgggggctattgagccgcagttctacgaactgctcattaagggactcggtctgaagtcagatgagctccctaaccagatgagcatggatgactggcccgaaatgaagaaaaagttcgcggacgtgtttgcggagaaaaccaaggccgaatggtgccaaattttcgacgggactgacgcgtgtgtcacgccggtgctgacctttgaggaggtggtgcatcacgatcacaataaggaacggggctcgttcatcacgtcagaagagcaagacgtgtcccctcgcccggctccactgcttttgaacaccccagccatcccatccttcaaaagggaccctttcatcggcgaacacacggaagagatcctcgaggaattcggattctctagggaggagatttatcagcttaattcggataagatcatcgagagcaacaaggtgaaggcctccttg

SEQ ID NO: 249499 - DNA, 1146 bp, Artificial Sequence
  Description of Artificial Sequence: Synthetic coding sequence
atggctttgcaaggaatttccgtcgtggaactgtcgggccttgcacctggaccattttgtgctatggtgctggcagacttcggagccagggttgttcgagtggatagaccggggtctagatatgacgtgagccgcctgggacggggtaaacgcagcttagtgctcgacctgaaacagccgcgaggggcagccgtactccgcagactctgcaagagaagcgatgtgttactagagcctttccgcaggggcgttatggagaagcttcagctcggacccgagatactccagcgtgaaaatcctcgcctgatctacgcccggctttcaggattcggccagtctggctccttttgtcgtcttgccggccatgacataaattatctggccttatctggagtgttgtctaaaatcggtcgaagcggagaaaacccttatgcgccactgaacttacttgccgattttgcaggcggcgggctgatgtgtgcactgggcataatcatggcgctctttgaccggacccggaccggaaaaggacaggttatcgatgccaatatggtggagggcaccgcttacctgtcctctttcctgtggaaaacacagaagttaagtttgtgggaagcccctcgcggccagaatatgttggacggcggtgcccctttctacacaacatatagaacagccgatggggagtttatggctgtcggagccatagagccccagttctatgagcttcttatcaaggggctgggccttaagagcgacgagctgcctaatcagatgagcatggacgactggccggaaatgaagaagaagttcgcggatgtgtttgccgagaaaacaaaagctgaatggtgccaaattttcgacgggaccgacgcatgtgtgaccccagttctgacttttgaggaggtcgtgcatcacgaccacaacaaagaacgaggaagcttcattaccagcgaagagcaggatgtgagcccacggcctgcaccgctgcttctaaatacacctgccatcccatcgtttaaacgggaccccttcattggcgaacacaccgaagagatcctagaagaatttgggttcagcagggaggagatataccaactgaattccgataagattatcgagtcaaataaggtgaaagccagcctg

SEQ ID NO: 249500 - DNA, 1146 bp, Artificial Sequence; identical to SEQ ID NO: 249466
  Description of Artificial Sequence: Synthetic coding sequence

SEQ ID NO: 249501 - DNA, 1146 bp, Artificial Sequence
  Description of Artificial Sequence: Synthetic coding sequence
atggcactgcaggggattagcgtcgtagagctctccgggctcgcacctggtcccttctgtgcaatggtgctcgcagacttcggcgctcgggtggtgcgggtcgaccgccccggttcaagatacgacgtcagccgcctcggtcgcggaaagcggtcacttgtgttggatctgaagcagccaagaggggcggctgtgctgcgaagattgtgtaagcggtcggatgtccttctggagccttttcgtcgaggagtcatggaaaaacttcagttgggacccgaaattctgcaaagggaaaacccgaggctcatctatgcacgcctttccggtttcggacagtcagggtcattttgtagacttgccggacatgacatcaactacctcgccctctccggcgtcttgtcgaaaatcggccgaagcggcgagaatccttacgcaccgctcaacctgctcgccgatttcgcaggcggaggacttatgtgtgcattggggatcataatggcactgtttgacaggacgcgcaccggcaagggacaagtgattgatgccaacatggtggaaggcactgcgtacttgagcagctttctctggaaaactcaaaaactctcattgtgggaagccccaagaggacaaaacatgctggatggcggagcacccttttacactacctacagaactgccgacggtgaattcatggctgtgggcgcaatcgagcctcagttttacgaactgctcataaagggtctggggctgaagtcggacgaactgcctaatcagatgtcaatggacgattggccggaaatgaagaagaagttcgcagacgtgtttgcggagaaaaccaaggctgaatggtgtcaaatcttcgatggaaccgacgcatgcgtgactcctgtccttactttcgaagaagtcgtgcaccacgatcataacaaggaacgcggttcgtttatcacctcggaggaacaggacgtgagcccacgtcctgctcctcttcttctcaacactcctgcaatacccagcttcaaacgtgacccatttatcggagaacacaccgaggagattcttgaagagttcggattttcccgggaggagatctaccagctgaatagcgataagattattgaaagcaacaaagtcaaggcatcactg

SEQ ID NO: 249502 - DNA, 1146 bp, Artificial Sequence
  Description of Artificial Sequence: Synthetic coding sequence
atggcacttcaggggatatccgtcgttgagctgtcaggacttgctccagggccattttgtgcaatggtccttgctgattttggcgcgagggtcgtccgcgtcgatcgacccggttcacggtacgacgtgtctcgcctcggccggggaaaacgaagccttgttctggatttgaaacagccccgcggtgcggctgtgctgaggagattgtgcaaaagaagtgacgtcctcctggagcctttcaggagaggagtaatggagaagcttcagctgggacctgagatccttcagcgggagaaccccaggttgatatacgcacgcctctccggttttggtcagagcggctcattctgccggctcgctggccatgacattaactatttggctctgagtggggtgctgagcaaaattgggcggtccggagagaacccttacgcacctcttaacctgctggcagatttcgctggcgggggtctgatgtgcgcactgggaatcataatggcactgttcgacaggacgaggaccggcaaaggccaagtgatcgatgccaatatggtggagggcaccgcgtacctcagtagttttctgtggaagacccagaaattgagtctgtgggaggccccaaggggccagaatatgttggacggtggagcccctttctacactacttatcgcaccgctgacggggagtttatggcagttggggccattgagccacagttctatgagctgctgatcaaggggttgggactgaaaagtgatgagctccccaaccagatgtccatggacgactggccagagatgaagaaaaagtttgcagatgtgttcgctgaaaagacgaaagctgagtggtgtcagatttttgacggcaccgacgcctgtgtgactcctgtgctgactttcgaagaggttgtgcatcacgatcacaataaggagagaggatctttcattacatcagaggaacaggatgtaagtcctaggccggctccgttgttgctgaacaccccagcgatcccttctttcaagcgcgacccgttcatcggcgaacacacagaggagattctggaggaattcggattctccagggaggagatctatcagcttaattctgacaagataatcgagtcaaacaaggtgaaggccagtctg

SEQ ID NO: 249503 - DNA, 1146 bp, Artificial Sequence
  Description of Artificial Sequence: Synthetic coding sequence
atggcgctacagggaataagtgtcgtggagctctcggggctagcccccggccccttctgcgctatggtgctggcagactttggcgccagagtggtgagggtggacagaccaggaagcaggtacgacgtctcccgcttagggcgcggaaaacgctctctggtgctagatctaaagcagccccgaggagcggcggtgcttaggcgcttgtgtaaacgctccgatgtgctgcttgaaccattccgcagaggtgtgatggagaagctgcagctaggaccagagatcctgcaacgggagaacccacgactcatctacgccaggctgtctggttttgggcaatcggggtccttctgccggttggccgggcacgacatcaattacctcgccctgtccggggtgctgtctaagattggcaggagcggcgagaacccatatgcaccgcttaatttgctggccgattttgctggcggggggttaatgtgcgctttggggattatcatggccctgttcgaccggacccgaactggtaaaggccaagtaattgatgcgaacatggtcgaaggcacagcttacttgtcatcatttttgtggaagactcagaagttgagtctgtgggaggcgcccaggggccagaatatgctggacggcggcgctcccttttacacaacctatcggacggcagatggcgagtttatggcagtgggagctattgaaccgcagttttacgagctcctgatcaaggggcttggcctgaagagcgatgagttgcccaatcagatgtccatggacgattggcctgaaatgaaaaaaaaatttgctgatgtgttcgccgagaaaaccaaggcagagtggtgtcagatctttgatggaactgacgcatgtgtcacaccagtcctgacctttgaagaggtggttcaccacgaccataataaggaaagggggtcgttcatcaccagcgaagaacaagacgtgagcccccggcctgcccctctcttactgaacacccccgcgatcccatccttcaagagagacccattcattggcgagcataccgaggaaatcctcgaagaattcggcttcagccgcgaggaaatttaccagctgaattcagataaaataatcgagagcaataaggtcaaggcttccctg

SEQ ID NO: 249504 - DNA, 1146 bp, Artificial Sequence
  Description of Artificial Sequence: Synthetic coding sequence
atggcgctgcagggaatttcagttgtggagctcagtggacttgcccctggacctttctgtgcaatggttctcgctgatttcggagcgcgggtagttcgtgtggacagaccggggtccaggtatgatgtgagcaggttgggcagggggaaaagatcactggtgctggaccttaagcagccgcgcggcgctgctgtgcttagaagactgtgtaagagatcagacgtattgctggagccattccggagaggcgtgatggaaaagctccagctcggccctgagatactccaacgggagaatccccgccttatttacgcccggttgagtggatttggccagagcggcagcttttgtcgccttgcaggacatgatattaattacctagctttgagcggagtgttgagcaagataggaagaagtggagagaatccttatgccccactgaatctgcttgcagattttgctggcggcggcctgatgtgcgcgctggggattattatggcacttttcgataggacacggacaggtaagggccaagtgatagacgccaatatggtggaagggactgcatacttgagctccttcttatggaaaacccagaaattgtcactgtgggaggcccccagaggtcaaaacatgctggacgggggcgctcccttctacacaacctatcgtactgcagacggggagttcatggccgtcggcgctatagagcctcaattctatgagctgctaatcaagggtctgggccttaaatccgacgagctccctaaccagatgagcatggacgattggccagaaatgaagaagaagttcgccgatgtcttcgcagagaagaccaaggccgagtggtgtcagatatttgacggaactgatgcatgtgtcacacccgtattgacatttgaggaggttgtgcaccatgatcacaataaagagagaggcagtttcatcaccagcgaagagcaagatgtttctccgaggccagcacccctgctgctgaatacccctgcaatccctagttttaagagggacccattcatcggagaacacaccgaggaaattttggaagagttcggattctctcgggaagaaatctatcagttgaacagcgataaaatcatagagagcaataaagtgaaggcctcgctt

SEQ ID NO: 249505 - DNA, 1146 bp, Artificial Sequence
  Description of Artificial Sequence: Synthetic coding sequence
atggccctgcagggtatttctgtggtggaactttcaggacttgctccaggcccattttgcgcaatggttttggcagattttggggcccgcgtagtccgggtggatcggcctggatcgagatacgacgtgagccgcctcggaagaggcaagcgctccttggtgctggacctgaagcagcccagaggcgcagcagtgcttagacgtctgtgtaagagatcggatgtgttgttggagcctttcaggaggggggtcatggaaaaactgcagctgggaccagagatccttcaaagagaaaaccccagactgatctatgccagactctcgggattcggacaatcaggatccttttgtagactggcgggacatgacataaactacctggcacttagcggcgtgttgagcaagatcgggcgctcaggtgagaatccttacgcacccctgaaccttctggcagacttcgcaggtggggggttgatgtgtgcgcttggtatcataatggcactgttcgataggactaggaccggaaagggtcaagtgattgacgcaaatatggtggagggtaccgcctacctgtcatcgtttctctggaaaacgcaaaagttgtcactttgggaggcaccgcgaggtcagaacatgcttgatggaggagcacctttctacaccacttaccggaccgccgatggagagttcatggcagtgggcgcaattgagcctcagttttacgaactgttgatcaagggtcttggcctcaagtcggatgaacttcctaaccagatgtcaatggatgactggccagagatgaagaaaaagttcgcggacgtttttgctgagaaaactaaggccgagtggtgtcagattttcgatggaaccgatgcgtgtgtgacgcctgtccttacctttgaagaagtcgtccatcatgatcacaacaaggaaagaggatcgttcattacttcggaagaacaggatgtctcacctcggcctgcacctcttctgctgaatactccggcgattccctccttcaagcgtgatcccttcattggagaacacacggaagaaatcctggaagagttcgggttttcacgagaagaaatctatcagctgaactcggacaaaatcatcgagtcgaataaggtgaaggcatcactc

SEQ ID NO: 249506 - DNA, 1146 bp, Artificial Sequence
  Description of Artificial Sequence: Synthetic coding sequence
atggcccttcaaggaataagcgtggtagaactgtctgggctagccccggggcctttctgcgccatggtattagccgatttcggagctagagtcgtgagggtggaccgcccaggttccagatacgacgtttctagattggggcggggaaaaagaagcctcgtgctcgatttgaagcaaccaagaggggctgctgttttgcggagactgtgtaagcgatctgacgtcctccttgagccatttcgcagaggtgttatggagaagctacagctggggccagaaattctgcaacgcgaaaatcctcgacttatttacgctaggctttctgggtttggacagagtgggtcattttgtaggctcgcaggacatgacattaactatctggccctgagcggcgtgctcagtaaaatcggaagaagcggagaaaacccctacgcgcctcttaatcttcttgcagatttcgctggaggtgggttgatgtgcgcactgggcataatcatggcacttttcgatcggacaagaacaggaaagggacaggtgatcgacgcgaatatggtggagggcaccgcatacctgtcatcatttctgtggaagactcagaaactctcactgtgggaggctcctagaggtcagaacatgttggatggaggagccccattttacaccacctacagaaccgccgacggtgagtttatggcagtaggggcaattgagcctcagttttatgagctgttgatcaagggcctgggcttaaagagcgatgagctgcctaaccagatgtctatggatgattggcccgagatgaagaagaaatttgcagacgtgttcgctgaaaaaacaaaggcggagtggtgccagattttcgatggaaccgacgcatgcgttacccccgtgctgacatttgaagaagtggtccaccacgatcacaacaaagaaaggggatcatttatcacctctgaggagcaggatgtgtcacctaggccggcccctctgctgcttaacacacctgcaataccttcctttaagagagatccatttatcggggaacataccgaagagatcttggaagagtttgggttctcaagagaggagatataccagctgaatagtgacaaaatcatcgaatcaaacaaggtgaaggctagccta

SEQ ID NO: 249507 - DNA, 1146 bp, Artificial Sequence
  Description of Artificial Sequence: Synthetic coding sequence
atggctcttcaaggcatctccgtggtggagctgagcggcctcgcgcccggcccgttctgtgccatggtgctggcggacttcggcgctagggtggtgcgggtggacaggccgggatcacgctacgatgtgtcgagactgggacgggggaagcgaagcctcgtgctggacctgaagcaaccacggggagccgcagtgcttcgccggctttgtaagagatctgatgtcctgcttgagccattccgccggggcgtcatggaaaaactgcagctgggcccggaaattctgcagcgagagaatccgcgcctgatctacgcacgcctgtcgggtttcggccaatcggggagcttctgcagacttgccggccacgacatcaattacctggctctgtccggggtgctgagcaaaatcggacggagcggggagaacccgtacgcccccctgaatctcctggctgattttgccggtggcggactgatgtgtgccctggggatcattatggcgctgttcgaccgcaccagaactggaaagggacaagtcatcgatgcgaacatggtggaaggaaccgcctaccttagctcattcctgtggaaaactcagaaactcagcctgtgggaagcgccgcgggggcagaacatgcttgatggcggggcccctttttacaccacctaccgcaccgcggatggagagttcatggctgtgggtgctatcgaaccccagttctacgaactgctcatcaagggacttggcctgaagtcggacgagctgccgaaccagatgtcaatggatgattggcctgagatgaagaagaagttcgccgacgtgtttgccgagaaaaccaaggcggagtggtgccagatattcgatgggaccgacgcatgcgtgaccccagtcttgaccttcgaagaggtagtccaccatgaccataacaaagagcggggctccttcattacctcggaagagcaggacgtctcgccgaggccggcgccgctgctcttgaacaccccggccatccctagcttcaagcgcgaccccttcatcggtgaacacactgaagaaatcctggaagaatttggattctcccgcgaagaaatctaccaactgaattcagacaaaatcatcgaatcgaacaaggtgaaggcctcgctc

SEQ ID NO: 249508 - DNA, 1146 bp, Artificial Sequence
  Description of Artificial Sequence: Synthetic coding sequence
atggcactgcagggaatctcagtggtcgaactgtccggtctggctccgggaccattctgtgccatggtgttagcagacttcggggcgagagtggtccgcgtggatcggcccggctcacgctatgacgtcagcagacttggccgcggtaaacgcagtctggtgctggatcttaaacagcctagaggcgccgccgtgctgagaaggctgtgcaagagatccgatgttctgttggaacctttccgtaggggagtaatggaaaagctacagctgggacctgagatcttgcaaagggaaaatccaaggctgatatatgcacggctctcaggcttcgggcagagcggctctttctgcaggctggctgggcatgatattaactacttagctctgtcaggggttttaagtaagattggccgttctggagagaacccttacgcgcccctgaatctgcttgcggacttcgcagggggagggctgatgtgtgctctcggtatcattatggcgctgttcgatcggactcggactgggaaaggacaggtcattgacgcaaacatggtcgagggaacggcctacctgtcttccttcctttggaagacacagaaacttagcctctgggaggcaccacggggacagaacatgttggacgggggggctccattctacactacttatcgcactgctgacggcgagtttatggctgtaggtgcaatcgagccgcagttttacgagctgctgatcaagggcctgggcctcaagtccgatgaattgcctaaccaaatgagcatggatgattggcccgagatgaaaaagaagtttgctgatgtgtttgcagagaagacaaaagccgagtggtgccaaatcttcgacgggaccgatgcctgtgtaacacctgtgctcacatttgaggaagtggtgcaccacgaccataataaggaacgcgggagctttataacctccgaagagcaggatgtgagtccgaggccagctcccctgcttttaaatacccccgctatcccgtccttcaaacgtgacccctttattggggagcacacagaggagatactggaagagttcggtttttccagggaggaaatctaccagctgaacagtgacaagatcattgagtctaacaaagtgaaggccagcctc

SEQ ID NO: 249509 - DNA, 1146 bp, Artificial Sequence
  Description of Artificial Sequence: Synthetic coding sequence
atggcacttcaaggcatttccgttgtggagctctctggcttggcgccgggcccgttctgtgccatggtgctggcggacttcggtgcccgtgtcgttcgcgttgatcggcccggttcgcggtatgacgtatcgcgtctgggccgcgggaagcgctctctcgtgctagatctaaagcaaccccgtggagctgctgtcttgcgccgcctctgcaagcgctccgacgtacttctggagcccttccgccgcggcgtcatggaaaagttacaactcggtccagagatcctccaacgtgagaaccctcgccttatttatgcaagactgtccggcttcggccagtcaggaagcttctgtcgcctggctggtcatgacatcaactaccttgccctctccggtgtcctcagcaagatcggtcgttctggggagaatccctacgcccccctgaacctgctcgccgattttgccggcggtggcttgatgtgcgcgcttggtattattatggccctgtttgacaggacccgaaccggcaaaggtcaggttattgatgccaacatggttgagggtaccgcctatttgagtagctttctctggaagacccaaaagctcagcctttgggaagctccccgcggccaaaacatgcttgacggaggcgctcccttctacacaacgtatcggacggctgatggagagttcatggctgtcggcgctatagagccccaattctatgagttattgatcaagggtctaggacttaagagcgatgaacttccaaaccaaatgtcgatggacgattggcccgaaatgaaaaaaaagttcgctgatgttttcgccgagaagactaaggccgagtggtgtcaaatcttcgatggcaccgatgcttgtgtcacccctgttttgactttcgaggaagtagtgcaccacgaccacaacaaggaacgcggctcattcattacatccgaggagcaggatgtctcccccagacccgcgcctctactattgaacacgccagccataccgtccttcaaaagagatccctttatcggcgagcacacggaggagatcctggaagagttcggtttcagtcgagaggagatctaccagctcaacagtgacaagatcatcgagagtaacaaagtcaaggctagcctg

SEQ ID NO: 249510 - DNA, 1146 bp, Artificial Sequence
  Description of Artificial Sequence: Synthetic coding sequence
atggccctgcagggaatttccgtggtggaactttccggactcgccccaggaccgttctgtgcgatggtgctggccgacttcggcgcgcgcgtggtcagagtggatagaccgggttcacgctacgacgtgtccaggctgggacgcggaaagcggtccttggtgctggatctgaaacaaccacggggagcggccgtgctgcgccgcctgtgcaagcgctccgacgttttgctggagccgttccgaagaggtgtgatggaaaaactgcaactgggcccagagatattgcagcgggagaaccctcgcttgatctatgccagactgagcggttttggtcagtcaggctccttctgcaggctggctggccacgacattaactacctggcgctctccggggtgctgtccaaaatcggacggagcggggagaacccctacgctccactgaacctcctggcagatttcgcaggaggaggactgatgtgcgcactcggtattatcatggcactttttgatagaacccgcacgggcaagggacaggtcatcgatgcgaacatggtggaggggactgcataccttagctcgttcctgtggaaaacgcagaagctcagcctttgggaagccccgcgcggtcagaatatgcttgatggtggggccccgttttacactacctaccgcactgccgatggtgagtttatggccgtcggcgcgatcgagccgcagttctacgaactgcttatcaaggggctcgggctgaaatcggacgaactcccaaatcagatgtccatggacgactggccggaaatgaaaaagaaattcgccgacgtgttcgcggaaaaaaccaaggccgaatggtgccagatcttcgacggcactgatgcgtgcgtcacgccggtcctgacctttgaggaggtcgtccaccatgaccataacaaggaaagggggtcgttcatcacttcggaggagcaggacgtgtcgccacgacctgctccgctgctgctcaacactccggccatcccgtccttcaagcgggacccattcattggagaacacaccgaagaaatcttggaggagttcggattttcccgcgaggagatctaccaactgaatagcgacaagatcatagaatccaacaaagtgaaagctagcctc

SEQ ID NO: 249511 - DNA, 1146 bp, Artificial Sequence
  Description of Artificial Sequence: Synthetic coding sequence
atggcacttcaaggaatttcagttgtagaactttcaggacttgctccaggaccattctgtgctatggttttagcagactttggagcacgagttgtacgtgttgataggccaggatcaagatatgatgtatcaagactcggaagaggaaaaagatcgcttgttttagacttaaaacaaccaagaggtgctgcagttcttagacgattatgtaagagatcagatgtgttattagaaccatttcgtagaggtgttatggaaaaacttcaattaggaccagaaattctacagagagaaaatccaagactaatatatgcaagactttcagggtttggtcaatctggatcattttgtagacttgcaggtcatgatattaattatcttgcactttcaggagttctttcaaaaattggaagatctggagaaaatccatatgcaccattaaatcttttggctgattttgctggaggtggattaatgtgtgctcttggaattatcatggccctttttgatagaacacgtacaggaaaaggtcaagttatagatgctaatatggttgaaggaacagcttatctttcgtccttcttatggaagacacaaaaactttctctttgggaagctcctagaggtcaaaacatgcttgacggtggagcaccattttatactacttaccgaactgctgatggagaattcatggctgttggagctattgaaccacaattctacgaattactaattaaaggattaggattaaagtcagatgagcttccaaatcaaatgagtatggatgattggccagaaatgaagaaaaaatttgctgatgttttcgcagaaaaaacaaaagctgaatggtgtcaaatattcgatggtactgatgcatgtgtgacacctgttttaacttttgaagaagttgtacatcatgatcataataaagaaagaggatcatttataactagtgaagaacaagatgtctcaccaagaccagctcctttattattgaacactccagcaattccatcatttaaaagagatccatttattggagaacatacggaagaaattttagaagagttcggattcagtcgagaagaaatttatcaattaaatagtgataaaataattgaatccaacaaagttaaagcatcattg

SEQ ID NO: 249512 - DNA, 1146 bp, Artificial Sequence
  Description of Artificial Sequence: Synthetic coding sequence
atggccctccagggcatctcagttgtggagctgagtggcctggccccgggacccttttgcgctatggtcctggctgatttcggggctcgcgtcgtgagggtggatcgcccaggttctcgttacgatgtatcacgactcggacgggggaagcgcagtcttgtgctggatctcaagcaacctaggggcgccgccgtcctgcgcaggctctgcaagaggagcgacgtcctcctggaacctttcagacgcggcgttatggagaaactccagctcggccctgagatcctccaaagggagaacccccgcctgatttacgccagattatccggctttggtcagtctgggagtttctgtagactagcgggccacgacattaactacctggctctgtcaggagtgctgtctaagattggccggtctggtgagaacccctatgccccactcaatctactcgccgatttcgccggcggtggcttaatgtgcgctctcggtatcatcatggccctgtttgatcgtacccgaacgggcaagggccaggtgatagacgccaacatggtggaggggactgcatatctaagcagcttcctgtggaagacacaaaaattgtctctgtgggaagcccccagagggcagaacatgctcgatggaggcgctccattctatacgacttaccgcaccgccgacggagagttcatggctgtgggtgcaattgaaccccaattttatgaattgctgataaagggtctgggattgaaaagcgacgaactgccaaaccaaatgagcatggacgactggcccgagatgaagaaaaagttcgcggatgtgttcgctgaaaaaactaaggccgaatggtgtcagatctttgatggcaccgacgcgtgtgtgacccctgtgctcacatttgaggaggttgtacatcacgatcacaacaaagagcgcggctctttcatcaccagcgaggaacaggacgtgtctcctcgtcccgcccccctgctccttaacactcctgctatcccttccttcaagagagacccattcatcggcgagcataccgaggaaatcttggaggagtttggcttctcccgcgaggagatctatcagcttaatagtgataaaatcatcgaatctaacaaagtgaaggcaagtcta

SEQ ID NO: 249513 - DNA, 1146 bp, Artificial Sequence
  Description of Artificial Sequence: Synthetic coding sequence
atggcgttgcaaggtattagcgttgttgagctgagcggtctggccccgggcccattctgtgctatggtactagcggactttggcgcgcgcgtggttagagtggaccggccgggctctcgctatgacgtgagccgcctgggtcgcggtaagagaagcctggtcctcgatcttaaacagccaaggggagccgctgtccttcgccggctgtgcaaacgctctgacgtgttgcttgaacctttccgaaggggtgtcatggagaaattgcaactcggacctgaaattttgcaacgcgaaaatcctcgcctgatttatgcgcgcctctccggttttggtcaaagcggcagcttctgtcgcctggcgggccacgatataaactacctggcactgtccggcgttctcagcaaaatcggccgctctggggaaaatccttacgctcctttgaatctgctggccgacttcgcaggaggcggtttgatgtgtgctctgggcatcatcatggcgctgttcgaccggacgcgcacgggtaaaggtcaggtgatagatgccaatatggtagaaggtaccgcttacctgtcttcatttctttggaagactcagaagctgtcgctgtgggaagcgcctcgtggtcagaacatgctggatggcggtgccccgttttatactacttaccgtaccgcggacggtgagttcatggcggtcggggccatcgagccccagttctacgagctgttgatcaagggcctcgggcttaagtccgatgagctaccgaatcaaatgagcatggacgactggccagagatgaagaaaaaatttgctgacgtatttgccgagaaaacgaaagccgagtggtgccagatcttcgatgggactgatgcgtgcgtgacgccggttctgaccttcgaagaggttgtgcaccatgaccataacaaggagcgcggttccttcataaccagtgaagaacaagacgtcagccctcggccggcgccgctgctgcttaacaccccagcaattcccagcttcaaacgcgacccatttatcggagagcacaccgaggaaatcctggaagagtttggcttcagcagagaggaaatttatcaactgaacagcgataaaatcatcgagtcaaataaggtgaaggccagcctg

SEQ ID NO: 249514 - DNA, 1146 bp, Artificial Sequence
  Description of Artificial Sequence: Synthetic coding sequence
atggcgttgcagggaatctccgtcgtggagctgtctgggctggcgcctggacctttctgcgcgatggtgctggccgactttggagcccgagtggtgagggtggacaggccgggatcgcgctacgatgtgtcgagactgggaaggggtaaacgcagcctcgtgctggatctgaagcaaccgcgcggagcggctgtgctccgtagactctgtaagcggtcggacgtgctgcttgaaccattccggcgcggagtgatggaaaaactgcagttgggaccggaaattctccaacgcgaaaacccgcggctgatctacgcccgcttgtcaggtttcggacagtccgggtccttctgccgcctcgccggccatgacatcaactacctggcactgagcggcgtcctctccaagatcggacggtcgggagaaaatccctacgcgcctttgaatttgctggcggatttcgcgggcggggggctcatgtgtgcacttgggattatcatggcacttttcgaccgcacgcggaccggcaagggacaggtcatcgacgcaaacatggtggaaggaaccgcatacttgtcatcgtttctgtggaaaactcagaagttgagcctctgggaggccccgagaggtcagaacatgcttgacggcggcgccccgttctacactacttatcgcaccgctgacggcgagtttatggctgttggagccatcgagccacaattctacgaactgctgatcaagggtttgggccttaaaagcgatgagctccccaaccaaatgtctatggatgactggccagagatgaagaagaagttcgcggacgtctttgccgagaaaaccaaagccgaatggtgccagatttttgacggaactgatgcctgcgtcaccccagtcctcacgttcgaggaagtggtgcatcacgaccacaataaggaaaggggctcattcataacctccgaagaacaagacgtctccccacgtccggctccgctgctcctgaataccccagcgatcccgtcgttcaagcgagatccctttataggtgagcacactgaagaaatactggaggagttcggattctcgcgcgaggaaatctaccagttgaactccgataagatcatcgagtcaaacaaggtgaaggctagcctg

SEQ ID NO: 249515 - DNA, 1146 bp, Artificial Sequence
  Description of Artificial Sequence: Synthetic coding sequence
atggccctgcagggtatcagtgttgttgaactctctgggttagctccgggtcctttctgcgcaatggtacttgcagacttcggcgcaagggtggtgcgggtggatcgacctgggagtagatacgacgtgtcccgcctgggccggggcaagcggtctctggtgctcgatctcaagcagccgagaggagccgccgtgctgagaaggctatgcaaaaggtccgacgttctgctggagccattccggaggggcgttatggagaaactacagctcgggccagagattctgcaaagagagaacccccgcctgatttatgctagactgagcggatttggccagagcggatccttttgcaggctggctggtcacgatatcaactatcttgcactctcaggcgtgctgtcaaaaattggccgctccggcgaaaacccatacgcaccactgaatctgcttgccgattttgccggggggggactaatgtgtgctctcgggatcattatggccctcttcgataggaccagaactggtaagggtcaggtaatagacgccaacatggtggagggcacggcctacctgagttccttcctgtggaaaacccagaaactgagcctgtgggaagcacccagagggcagaatatgcttgatggtggagcacccttttacacaacctaccgcacagccgacggggaattcatggccgtgggtgcgattgagccgcaattctacgagctcctgattaaaggcttgggtctgaaaagcgatgaattgcccaatcagatgagcatggacgattggcccgaaatgaaaaagaagttcgcagatgttttcgccgaaaagactaaagcagagtggtgtcagatcttcgatggaactgacgcttgtgtgactcccgtattaaccttcgaggaagtagtccaccacgatcacaataaagaacgaggcagctttatcaccagcgaggagcaggatgtcagcccccggcctgcgccccttctgttaaatactcctgccatacctagcttcaagcgcgatccgttcattggagagcacaccgaggagatcttagaagagttcggatttagtcgtgaggaaatctaccagctgaacagcgacaagataattgagtctaacaaggtgaaagctagtctg

SEQ ID NO: 249516 - DNA, 1146 bp, Artificial Sequence
  Description of Artificial Sequence: Synthetic coding sequence
atggcccttcaaggtatttcagtggtcgagctctccggtctggcaccaggtcctttttgcgccatggtgctggcagatttcggcgccagagtggtgcgtgtggacagaccaggctcacgctacgatgtctcaaggctgggacgagggaagagatcactggtgctggatctcaagcaacctagaggtgccgcagtgcttagacgtctgtgtaagcggtccgacgtgctgcttgaacctttccgcagaggagtgatggaaaagctgcagttgggtccagagattttgcagcgtgagaatcctcgactgatatatgcacgactttcaggtttcggccaatccggttcattctgtcggctggccggtcatgatatcaactaccttgcactgtccggggtgctttccaagattggacgctccggagaaaatccatacgcaccactgaacctgctggcggatttcgccggtggcggactcatgtgcgcactgggcatcattatggcgcttttcgaccgcactcggactggaaagggacaggtcatcgatgcaaacatggtcgaaggaacggcatatctctcctcgtttctgtggaaaacccagaagctgagtctgtgggaagcacctcgaggtcagaacatgctggatggtggcgcacctttttacactacttaccgtactgcagacggtgagtttatggcggtgggtgctatagaaccccagttctacgaactgcttatcaaggggctcggcctgaaatccgatgaactcccaaaccaaatgtcaatggatgattggcctgagatgaagaaaaagttcgccgatgtctttgcggaaaaaacgaaagccgaatggtgtcagattttcgatggaaccgatgcgtgtgtcaccccagtcctgacttttgaagaagttgtccatcacgaccataacaaggagaggggttcgttcataacctcggaagaacaagacgtgtcgccaaggcctgcccctcttctcctgaatactccagctattccgtcgtttaaacgcgacccttttatcggagagcacaccgaagaaattctggaagagtttggattcagccgggaagagatttaccaactcaattccgataagatcattgaatcaaataaggtcaaggcaagcctg

SEQ ID NO: 249517 - DNA, 1146 bp, Artificial Sequence
  Description of Artificial Sequence: Synthetic coding sequence
atggcacttcagggcatatccgtggtcgaactgtccggcctggcaccaggacctttctgcgccatggtccttgcagatttcggagcaagggttgtcagagtggatcgcccaggatcaagatacgacgtaagcaggttgggaagaggtaaacggtcacttgtgctcgatcttaagcaaccgaggggtgcagccgtcctgcggcgcctttgtaagagaagcgatgtgcttcttgaaccatttcgaaggggcgtgatggaaaaacttcaacttgggcccgaaattcttcaacgtgagaatccaagactcatctacgcgagactttcagggtttggacagagcggttccttttgcaggctcgcaggccatgacattaactacttggcactttcaggcgtgctgtccaagatcggacgatcaggagaaaatccttacgcacctcttaacctgctcgcagattttgcaggaggaggactcatgtgtgccctcggaatcattatggccctgtttgatagaaccagaaccggcaagggacaggttatagatgccaacatggtggagggcaccgcctaccttagttcgtttctgtggaaaactcaaaaactttccctctgggaagctcctcgtggacagaacatgcttgacgggggcgcacccttctatacgacgtaccgtaccgcagatggggagtttatggccgtcggggcgattgagcctcagttttacgagttgctcataaaaggcttgggtcttaagtcagacgaactgccgaatcaaatgtcgatggatgattggccagaaatgaagaagaagttcgcggatgtctttgcagagaaaactaaagcagaatggtgtcagattttcgacggtactgacgcatgtgtaaccccagtgctgacctttgaggaagtggtgcaccatgatcataacaaggaacgaggatcctttatcaccagcgaggaacaggacgtgtcgcctagaccggcacctttgctgcttaatacccccgcaatcccgtcatttaagcgcgatccttttatcggagaacacactgaagagattctggaggaattcggattctcgcgcgaagagatttaccaactgaactcggacaaaatcattgagtcgaacaaggtcaaagcctctttg

SEQ ID NO: 249518 - DNA, 1146 bp, Artificial Sequence
  Description of Artificial Sequence: Synthetic coding sequence
atggctctccagggaatttccgtggttgaactttccggcctggctcccgggcctttctgtgctatggtgttagcggacttcggggcccgtgtggtccgcgtggatcgaccaggatcaagatacgacgtgtcccggctcggtcgcgggaaacgctcgctcgtcctagacctgaagcagccgaggggtgctgccgtcctccggcgactctgcaaacgctcagacgtgcttttggagccgttccgacggggagtgatggagaaactgcagcttggtcccgagatcctccaacgagaaaacccgcgcttgatttacgcacggctctccggattcggacagtcaggctctttctgtagactggcgggacacgacattaactatttagccctcagcggtgtgttatccaaaataggccggagcggcgagaatccatacgcacctctgaaccttcttgcggatttcgctgggggcggtctgatgtgcgcactaggaatcatcatggctctcttcgacaggactcgaaccggaaagggtcaggtgatcgatgcgaacatggtcgagggcacagcctatcttagtagcttcctgtggaagactcagaaactgagtttgtgggaagcccccagaggacagaacatgttggacggcggagcccctttctataccacctacaggacagcggacggagagtttatggcagtcggggcaatagagccgcagttctatgagctgctgattaaaggtctgggacttaaatctgacgagctgcccaaccagatgagcatggacgattggccagagatgaagaaaaagtttgccgacgtgttcgcagaaaaaactaaggctgaatggtgccagatattcgacggcacagacgcatgcgtgacgcccgtgctgacattcgaagaagttgtccaccatgaccacaacaaggagcgaggaagttttattacctcagaggagcaggacgtctcccctcgccccgcccctcttctgcttaatacccctgccatcccaagttttaaaagagacccctttatcggagagcacactgaggagattctggaggaatttggcttttcccgcgaggaaatataccaactgaacagcgataagatcatcgaatccaataaggtgaaggctagtcta

SEQ ID NO: 249519 - DNA, 1146 bp, Artificial Sequence
  Description of Artificial Sequence: Synthetic coding sequence
atggcgttgcaggggattagcgtcgtcgagctttctggactggcacctggtccattttgcgcgatggtgttagctgactttggtgctagggtagttcgcgttgaccgtcctggctcccgctatgacgtttcaaggcttggtaggggaaagcgtagtctcgttcttgatcttaaacaaccaaggggagcagcagtgttgcgacgcctgtgtaagcgctccgatgttcttttggagccattccgtcggggagtgatggaaaaacttcagctgggacctgagattcttcaacgagagaatcccaggcttatttatgccagactttccggatttgggcagagtggatctttctgtaggttagcaggccatgacataaactatctggctctttcaggggtcctgtccaagatcggtaggtccggtgaaaatccatatgctccacttaatcttctcgcagacttcgctgggggaggtcttatgtgtgcacttggcattatcatggctttatttgatcgaactagaaccggtaagggtcaagttattgacgcaaatatggttgagggaacggcttatctctcaagtttcttatggaagacccagaaattatccctatgggaagcgccaagggggcaaaatatgctcgatggtggggctccgttctataccacatatagaaccgctgatggggaatttatggcagtcggggctatagaaccacagttctatgagctcctgatcaagggactaggtcttaaatctgatgaattgcccaatcaaatgtcaatggatgattggccagagatgaaaaaaaaatttgccgatgtgtttgcagagaaaaccaaagctgagtggtgtcagatattcgatggtacggatgcttgtgtcacccccgtcctgacgttcgaggaagtagtccatcatgatcataataaggaacgtggttcatttattacctcagaggaacaagatgtgtcccccagacctgcccccctcctgcttaatacacccgcaattccctccttcaagcgagatccctttatcggagaacatacagaagagattctcgaagaatttggattcagcagagaagagatctatcagctcaactctgacaagatcattgagtccaataaggttaaggcttcactg

SEQ ID NO: 249520 - DNA, 1146 bp, Artificial Sequence
  Description of Artificial Sequence: Synthetic coding sequence
atggcattgcaaggaatatcagtggtggagctcagtggcctcgcccctggacctttttgcgccatggttcttgctgacttcggagctagggtggttcgagtcgatcgtcctggatctcgctatgacgtcagtagactgggtcggggcaagcggagcctggtgctggacctgaaacagcctcgcggggctgctgtccttaggcgcttgtgcaaaagaagcgatgtgctgcttgaacccttccgccgcggcgtgatggaaaaactgcagctggggcctgagattttgcagagagagaacccccggctcatctacgctagactcagcgggtttggccaatccggctccttttgccggttggccggccacgatatcaactacctcgcacttagcggagttttgtctaagattggaagaagtggcgagaacccttacgcccctttgaacctgctggctgatttcgctggcggaggattgatgtgcgctctgggcatcatcatggctcttttcgatagaaccagaaccggaaaaggtcaggtcatagacgctaacatggtcgaagggaccgcctacctctcatcttttctgtggaagacacaaaaactttcgctctgggaagcccctagaggccagaacatgctcgatggcggagcccccttctatactacctatagaactgcggacggggagttcatggcagtgggagccatcgaacctcagttctatgagctgctgataaaaggcctcggcctcaagtccgacgagttacctaaccagatgagtatggacgattggcccgagatgaagaaaaaatttgcagatgtgttcgcagaaaaaacaaaagcagagtggtgtcaaattttcgacggaacagatgcctgcgtcacccctgtgttgactttcgaagaagttgtccatcatgatcacaacaaggagcgaggctctttcatcacctccgaagaacaggatgtgtcacctaggccagctcccctgttgttaaacactccggctatcccaagcttcaagcgggatcccttcatcggagaacacacagaagaaatcctggaggagttcggctttagccgcgaagagatttaccaactgaacagcgacaagattatcgagagcaacaaggtgaaggcaagtctt

SEQ ID NO: 249521 - DNA, 1335 bp, Artificial Sequence
  Description of Artificial Sequence: Synthetic coding sequence
atggctgtcgcaattgctgctgcgcgcgtgtggcggctgaatcgggggctatcccaggcggccctgttgctcctcaggcagcccggtgcacgcgggcttgcaagatcgcatccaccccgccagcagcaacagtttagcagccttgatgataagccgcagtttcctggggccagcgccgaattcattgacaaactggagttcattcagcctaacgttatctctggtattcctatctaccgcgtgatggaccgtcaaggccagatcattaatccaagtgaggacccccaccttcctaaggagaaggtgctgaagctgtataaatccatgactttgttgaacacaatggatcggatcctctatgaaagccagcgccagggacgaatcagcttttacatgaccaactacggcgaggaagggacacatgtgggaagcgccgccgccctggacaatacagacctggtgttcggacagtatagagaggccggagtgctcatgtatagagactatccgttagagctttttatggcccagtgttacggaaatatttccgacctgggtaagggtcggcaaatgcctgtgcactacgggtgtaaagaaaggcatttcgtgacaattagcagcccactcgcaacccagattccgcaagccgtgggcgccgcatatgcagctaagagggccaacgcaaacagagtagtcatctgctatttcggtgaaggcgccgcgtcagaaggcgacgcacacgccggattcaacttcgctgccacactcgagtgtccaattattttcttctgtaggaataacggctacgctataagtactcccacctctgaacagtatcgcggcgatgggattgcggcaaggggccctggttatgggataatgtcaattcgtgtagacggaaatgacgtctttgccgtgtacaatgcaaccaaggaggccaggagacgagcagtggccgagaaccagcccttcctgattgaagccatgacatataggattggccaccattcaacaagcgatgactcatctgcctatagatctgtggacgaggtaaattattgggataagcaggaccatccaataagtagactccgccactatctcttatcacagggatggtgggacgaagagcaggagaaggcctggcgcaagcagtctaggcggaaggtgatggaagcgttcgaacaggccgagcgcaagcccaaacccaatccgaatctcttgtttagtgatgtatatcaggagatgcctgcacagctccggaagcagcaggaaagcttggccagacacttgcagacctacggcgagcactatcccctagatcacttcgataaa

SEQ ID NO: 249522 - DNA, 1335 bp, Artificial Sequence
  Description of Artificial Sequence: Synthetic coding sequence
atggcagtggctatcgctgcagcccgggtgtggcgcctgaaccgcggactgagccaagctgcactgctgctgctgcggcagcccggagcgcgggggctggcaagatcccacccaccccgccagcaacaacagttttcgtccctcgatgataagccgcagttcccgggggcgtcggccgagttcattgacaagttggagttcatccagccgaacgtgatctcaggaatcccaatatacagggtgatggacagacagggtcagatcatcaacccttcagaagatccgcacctgccaaaagagaaggtgctgaaattgtacaagtccatgactctgctcaatacgatggatcggatcctgtacgagagtcagcggcagggccgaatctcgttctacatgaccaactacggagaggaggggactcacgtgggctccgcggcagctctcgacaatacggacctcgtgttcggtcagtatcgggaagcgggagtgctgatgtaccgcgactacccactggaactcttcatggcccagtgctacggaaacatctccgacctcggcaaaggacggcagatgcctgtgcattacggatgtaaggaacggcactttgtgaccatttccagcccattggccacccagatcccgcaagcagtcggcgcagcctacgccgccaaacgcgcaaatgctaatcgcgtggtgatctgttacttcggagagggagctgcgtcagaaggagatgctcatgccgggttcaatttcgctgcgactttggaatgccctattatctttttctgccggaataacggatacgctatcagcactccgacgagtgagcaatacagaggtgatggcatcgcggcacgggggcctggatacggtatcatgtcgatcagagtggacggcaatgacgtgttcgcggtgtacaacgccaccaaggaagcgcggcgcagagctgtggccgaaaatcaaccgttcctgatcgaagcaatgacctatagaatcggacaccatagcacttccgatgatagctcagcctacagatctgttgacgaagtgaactactgggacaagcaggaccacccaatctcgcgcctgcgccactacctcctgagccagggatggtgggatgaggagcaagaaaaggcgtggcgcaagcagagcagacgaaaggtgatggaggcgtttgaacaggcggagcggaaaccgaagccaaaccctaacctccttttcagcgacgtgtaccaagaaatgcccgcgcagctgagaaaacaacaagagtcactcgctagacacctgcaaacctacggagaacactacccgctggaccacttcgacaag

SEQ ID NO: 249523 - DNA, 1335 bp, Artificial Sequence
  Description of Artificial Sequence: Synthetic coding sequence
atggccgtcgctatcgcagcggcgcgtgtgtggcggttgaacaggggtctgtcacaggcagccctcctcctgctgagacagcccggagctcgcggtctggcccggtcgcatccgccacggcagcagcagcagttcagctcactggacgataagccacaattcccgggtgcttctgcagaattcatcgataaacttgagttcatccagccgaatgtcattagcggaatccccatctaccgtgtcatggatcgccaggggcagatcattaatccaagcgaggaccctcatcttcctaaggagaaggtgctcaagctctataagtcaatgacccttctgaacaccatggacaggattttgtacgagtcgcaacgccagggaaggatctcattttacatgacgaactatggcgaagaaggaacccacgttgggtcggcagctgccttggacaacaccgatctggtgttcggccagtaccgcgaggcgggggtcctcatgtaccgcgactaccctctggagctcttcatggcgcaatgttacggtaatatctccgacctgggaaagggacgccaaatgccagtccattacggatgcaaagaacggcactttgtgactatctcctcaccgctcgccacccagatccctcaggccgttggcgccgcatacgcggccaagcgtgctaacgcgaatagggtcgtgatatgctacttcggagagggcgcagcgtccgaaggggacgctcacgccggattcaatttcgcagcaacgctggaatgcccaatcattttcttctgcaggaacaatggatatgccatcagcacgccgacttccgaacagtaccgcggggacggaatcgccgctcgcggcccgggatatggcataatgtcgatccgggtggatggtaacgacgtctttgcggtgtacaacgctactaaggaagcgagacgacgtgccgtggccgagaatcaaccctttctgatcgaggccatgacctaccggatcggccatcactcgacgagcgacgattcgtcagcctacagatccgtggacgaggtgaactactgggacaagcaggatcaccctatctcacggctgcggcattaccttctctcgcaaggatggtgggatgaggaacaggagaaagcctggcgcaaacagtcgcggcggaaagtgatggaggcctttgaacaagccgagcggaagccaaaaccaaacccgaacctgttgttttccgatgtgtaccaggaaatgccagcgcaactccggaaacagcaggaatcactcgccagacacctgcaaacctatggggaacattacccgctcgaccacttcgacaag

SEQ ID NO: 249524 - DNA, 1335 bp, Artificial Sequence
  Description of Artificial Sequence: Synthetic coding sequence
atggcagtggcaattgcggccgcccgagtctggcggctgaatagagggctctcccaggcagccctcctgcttctacggcagccaggggcgaggggactggccaggtctcatcctcctcggcagcaacagcagttttccagtttagacgataagccccaatttccaggcgcgagcgcagagttcattgataagctagagttcatccagcccaacgtgatctccgggattcccatttacagagtaatggatcgccaggggcagatcattaacccatcggaggacccccacctcccgaaggagaaagtgctgaagctgtataagtcaatgacgttgctgaacactatggatcgtatcctgtacgagtcacagaggcaaggccgcataagcttttacatgaccaattatggggaagaaggcacacacgtgggatccgccgctgctctggataacactgacctcgtcttcggacagtaccgggaagcaggagtgctgatgtaccgggattacccccttgaactgttcatggcacagtgttatggaaacatttcagacctcggaaagggcaggcagatgccagttcactatgggtgtaaagagagacattttgtgaccatcagtagccctctggcaacccagatcccccaagcagtgggggccgcctatgctgccaagagggccaatgctaatagagtggtaatttgctatttcggagaaggtgcagcgtcagagggcgacgctcatgccggctttaattttgcagccacgttagagtgtcccattatttttttctgccgcaataatgggtatgccatcagtactcccactagcgaacagtatcggggcgatggcattgcagctcgcggaccggggtatgggatcatgtccatcagggtcgatggcaatgatgtattcgcagtctataatgcaaccaaggaagctcggcgccgcgccgtggcagagaaccagccctttctgattgaagctatgacctaccggattggtcatcattccacatcagacgatagctccgcttaccggtcggtcgatgaagtcaattattgggacaaacaggaccaccctattagccgcctccgccactacctgctatcccaaggttggtgggacgaggagcaggagaaagcctggcggaagcaaagcaggaggaaggtcatggaggcttttgaacaagcagagcgcaaaccgaagccaaacccgaacctcctgttctccgatgtctatcaggagatgccggcacagttgaggaagcaacaggagtcactggcccggcacctccagacatacggtgagcattacccacttgatcatttcgacaag

SEQ ID NO: 249525 - DNA, 1335 bp, Artificial Sequence
  Description of Artificial Sequence: Synthetic coding sequence
atggccgttgcgatcgctgctgctagagtgtggagactcaacagagggctctctcaagcggccctgctgctgctgcggcagccaggtgcccgcggactggcccgctctcatcccccccggcagcagcagcagttttcctctctcgacgacaaacctcagtttcctggcgctagtgctgagtttatcgacaaattagaattcatacagcctaatgtaatctctggcatccctatctacagggtcatggaccgtcagggccaaatcattaatcccagcgaggacccccatctgccaaaagagaaggtgttaaagctgtataagagcatgaccctgctcaacactatggatcggatactgtacgagagccagcggcagggacggatttctttttacatgaccaactacggcgaggaagggacccacgtggggagcgccgcagctctggacaacactgatctggtctttggccagtacagagaggccggcgtgctgatgtacagggactatccgctggagctgtttatggcacaatgttacggaaatatatctgatctagggaagggccgccagatgcccgttcattacgggtgcaaggagagacattttgttacaataagcagcccactggccacccaaatcccacaggccgtgggagccgcttatgcagccaagcgtgcaaacgccaatcgcgtggttatatgctatttcggggagggagcagctagcgaaggagacgcacacgcaggattcaactttgccgctaccttggaatgtcccatcatcttcttttgccgaaacaacgggtacgccatttccacccctacctctgagcagtacaggggtgacggaattgcggcccgcggtccaggctatgggattatgtccatcagagttgacggtaacgacgtctttgccgtctacaacgccactaaggaagctcgccggcgagcagtggctgaaaaccagcccttcctgatcgaagctatgacttacagaatcggccaccacagcacaagcgatgacagtagtgcctaccgaagcgtggatgaggtaaattattgggacaaacaggaccaccctatttcgaggctgcgccactatttgctgtctcaggggtggtgggatgaagagcaggaaaaggcctggagaaagcaatcccgccggaaggtcatggaggccttcgaacaggccgagagaaagcccaaacctaatcccaatctgctgttctcagacgtgtaccaagaaatgcctgctcagctgaggaaacagcaggaaagcctggcccgccacctgcagacgtatggcgaacactaccccctggatcattttgataag

SEQ ID NO: 249526 - DNA, 1335 bp, Artificial Sequence
  Description of Artificial Sequence: Synthetic coding sequence
atggcagtggctatcgccgctgctagagtctggagactgaataggggtttgagtcaggccgccctcctcctactgcggcagcctggcgcacgaggtctggctcgatctcaccctcccaggcagcagcaacagttttctagcctcgacgacaaacctcagttccctggtgcatccgccgagtttatagacaagctggagtttatccaacccaatgtgatatctgggattccaatctatcgagtgatggatcggcagggccagatcatcaaccccagtgaagatccccacttgcccaaagagaaggtcctcaagctttacaaaagtatgacacttctgaacaccatggataggatcctgtacgaaagccagcgtcagggccgaattagtttctacatgaccaactatggcgaggagggcactcatgtgggcagtgccgcagcgctggataacacggacctcgtttttggtcaatatcgagaggctggagtgctcatgtaccgggattatccgctggagttattcatggcgcaatgctatggcaatatcagtgatctgggaaaaggacggcagatgcctgttcactacggttgcaaggagcggcatttcgtgacaatttccagcccactcgccactcagatcccccaggcagtgggcgccgcatacgccgccaaacgggctaacgctaaccgggtcgtgatttgttactttggcgaaggcgcagcttctgagggggacgcccacgccggcttcaacttcgcagccactcttgaatgccccattatctttttttgtaggaacaacggttatgccatcagtacacctacttccgagcagtaccggggtgacggcatcgctgcacggggacctggttacggaattatgagtatccgagtggacggaaatgatgtgttcgcagtgtacaatgcaacaaaagaagccaggaggagggcagttgctgaaaaccagccttttcttattgaagcaatgacataccgtatagggcatcattcgacctcagacgactcatctgcatacagatcagtagacgaagttaactactgggataaacaagatcaccccataagtagactgcggcattacttgctatcgcagggatggtgggacgaagaacaggagaaagcatggcggaagcagtcaaggcgcaaggtaatggaggcgttcgagcaggccgaacgaaaacccaagccaaatcccaatttgctcttctctgatgtatatcaagaaatgcctgcccagctgagaaaacagcaggagtccctcgcacgccacttgcagacatacggagaacactatccactggatcatttcgataaa

SEQ ID NO: 249527 - DNA, 1335 bp, Artificial Sequence
  Description of Artificial Sequence: Synthetic coding sequence
atggccgtcgcgatcgcggctgcccgggtgtggagactaaaccgcgggctcagccaggccgcattgctgctgctgcggcagcctggtgctaggggcttagcccgctctcatccgccaaggcaacagcaacagtttagcagcctggatgataaaccccagttcccaggggcctcggcggagtttatcgataagttagagttcatccaaccgaacgttattagcggcattcctatatacagagtcatggataggcaagggcagatcatcaacccttcggaagaccctcatcttcctaaagagaaagtgctaaagctgtataaaagcatgacactgctcaatactatggataggattctctacgagtcccaacgtcagggccgaatcagtttctatatgacgaactatggggaggagggtacccacgtggggtctgcagccgccctcgacaacactgatctggtgttcgggcagtatcgtgaggccggggtgctgatgtatagagactaccccctagagctatttatggcccagtgttatggtaatattagcgatctgggtaaggggagacaaatgccagtgcactatggctgtaaggagcgtcacttcgtgacaatttccagcccccttgctacccaaataccccaggctgtgggtgctgcttatgcagcgaagcgcgctaacgctaatagagtcgttatatgctatttcggggaaggtgctgcctctgaaggcgatgctcatgccgggtttaatttcgccgccacactcgaatgcccaatcattttcttctgccggaacaatgggtacgcaataagcacgccgaccagcgagcagtataggggggacggaatagctgcacggggacctggctacggcatcatgtccatcagagtggacggtaatgacgtgtttgcggtatataacgccactaaggaagcaaggcggagggcggtcgcagaaaatcagcccttccttatcgaggctatgacatacaggattggccatcactccacctccgacgactcctccgcctaccgatcagtggatgaggttaactactgggataaacaagaccatccgatctcccgactccggcactatctcctgtcccagggatggtgggacgaggagcaggagaaggcttggcgaaagcagagcaggcgaaaagtgatggaggccttcgaacaggccgagcggaaacccaagcctaatcccaacctgctgtttagcgatgtataccaggagatgcccgcccagttgagaaagcagcaggaaagtctggctagacacttacaaacctacggagagcattaccctctggaccacttcgacaag

SEQ ID NO: 249528 - DNA, 1335 bp, Artificial Sequence
  Description of Artificial Sequence: Synthetic coding sequence
atggcggtggcaatcgccgctgctagagtgtggagactaaatcgaggtctttcgcaggcagccctcctgctcctgcggcagccaggcgcaagaggcctagctcgctcccacccgcccaggcagcaacagcagttctcatccctggacgataagcctcaattccccggggcatcggcggaattcatcgataagttggaattcatccagccaaatgtcatctccggcattcccatctatagggtaatggacagacagggacagatcattaatccatccgaagatccacacctgcctaaggaaaaggtactcaagttgtataagagcatgactctgctgaacaccatggatcggatcctgtacgaaagtcagagacagggacggataagcttctatatgactaattacggtgaggagggaacccatgttgggagcgcggccgcactcgacaataccgacctggtctttggccagtatcgcgaggctggggtgctcatgtatcgggactaccctctggaactgttcatggctcagtgctacggaaatatctctgatctgggaaaggggagacagatgccagtccactacggctgtaaggaacgtcacttcgtgaccatctcctcacccctggccactcaaatcccacaggccgtgggagcagcatatgctgctaagcgcgctaatgctaaccgcgtggtaatttgttattttggcgagggagctgcctcagagggcgacgctcatgccggcttcaacttcgcagctacactggaatgccccatcatcttcttctgcaggaataatggatatgctatttccactcctaccagcgagcaatatcgcggtgatggaatagccgcacggggcccagggtacggaattatgagtattagagtggacggcaacgatgttttcgccgtgtacaacgctaccaaagaggctagacgccgcgcagtggccgagaaccaaccattcttgatcgaagccatgacataccggatcggccatcattctacctcagacgattcctcagcttacagatctgttgacgaagtcaattattgggataaacaggatcatccgatctcacgcctgcggcattaccttctcagccaaggatggtgggatgaggaacaggaaaaggcatggaggaaacaatcaaggcggaaggtgatggaggcattcgaacaggcagagcggaaacccaagcctaatcctaatctgctctttagcgacgtgtatcaggaaatgcccgctcagctgcgtaagcagcaggaaagtctggcccgccatctgcagacgtatggtgagcattaccctctggaccatttcgataaa

SEQ ID NO: 249529 - DNA, 1335 bp, Artificial Sequence
  Description of Artificial Sequence: Synthetic coding sequence
atggcagttgcaattgccgcagcaagagtgtggcggttgaacaggggactatctcaggctgcacttctccttttgcggcagcccggagctcgtggcctggcgcggtcccatcctcctcgccaacagcagcagttctcctcactggacgacaaaccccaatttcccggagcctccgctgaatttatcgacaagctggaatttattcagccgaacgtgataagcgggatcccaatctaccgggtaatggatagacaggggcagatcatcaacccttctgaggacccacacctgccaaaggaaaaagtgttgaaactgtataaatccatgacactgctaaacacaatggacaggatcctctacgagagccagcggcagggaagaatctctttttatatgaccaattatggtgaagaaggcactcatgtcggcagtgcagccgcgctagacaacactgacctggttttcggacaataccgggaggcgggtgtgttgatgtaccgggactaccctcttgagctgttcatggctcaatgctacgggaatatcagcgatttgggaaagggcaggcagatgcctgttcactatggatgtaaggagaggcattttgttaccatctcttcccctctggcgacccagatcccccaagctgtgggggccgcatatgctgcaaaaagggccaatgccaacagggtggtgatttgttacttcggtgagggagccgcatcagagggagacgcccacgccggctttaactttgccgccacactggagtgccccattatatttttttgtcggaataatggctatgcaatcagtacgcccacaagcgaacagtaccggggagacggtatcgctgcacgggggccaggctacggaattatgtctatccgcgtggatgggaatgatgtcttcgctgtgtacaacgccaccaaggaagcaagacgccgggcagtggctgagaaccagcctttcctcatcgaggccatgacatatcggatcgggcaccacagtacctcggatgattccagcgcctaccgcagcgtggacgaggtgaattactgggacaaacaggatcacccaataagccgcctacgacactatctactatcccagggctggtgggatgaggagcaggaaaaggcttggcggaagcagagcaggaggaaagtgatggaagcctttgaacaagctgagaggaagccaaagcccaatcccaatcttctttttagcgacgtctaccaggaaatgcccgcccagttgcggaagcagcaagagagtctggcgcggcatctgcaaacctatggtgaacattatccacttgaccactttgacaag

SEQ ID NO: 249530 - DNA, 1335 bp, Artificial Sequence
  Description of Artificial Sequence: Synthetic coding sequence
atggcagttgctatagcggcagcacgagtttggcgcctgaatcgtggactctcccaggccgcgctcctgctccttagacagcctggagcacgcggtctggcacggtcccatccgccaaggcaacaacagcagtttagctcgttggacgacaaaccccaattccctggagcgtccgctgaattcattgacaagctggagtttatccaacctaacgtcatttcgggaattcctatctacagagtcatggaccgtcaaggacaaatcattaacccctcggaggacccccatctgcccaaggaaaaagtactgaaactttacaaaagcatgaccctcttgaacactatggacaggatattgtacgaatcccaacgccaggggagaatcagcttctatatgactaactacggggaagaaggcacccatgtgggatccgcagcagctcttgacaacactgatctcgtgtttggtcagtacagggaagcaggagtcttgatgtaccgtgattaccctcttgaattgttcatggcgcaatgttacggcaacatttccgatctgggcaagggcagacagatgccagttcattatggttgtaaagagcgtcactttgtgactatcagctctccccttgctactcaaattccacaagccgtgggagcagcctacgcagccaaacgcgcaaatgcaaaccgagtcgtgatctgttactttggagaaggtgcagcctccgaaggagatgcacatgccggatttaactttgctgctactcttgaatgcccaatcatctttttctgtcgaaataacggctacgcaatatccaccccaacttcggagcaatatagaggagatggtattgcagcgcgcgggcctggatacggtattatgtccatccgtgtggatggtaatgacgtgtttgcagtgtacaacgcaaccaaggaagccagacggagagcagtcgcggagaaccagccatttctcattgaagccatgacgtaccgcattgggcatcactctacttccgacgattccagcgcataccggagcgtggacgaagtgaactactgggataagcaggatcaccctatctcgcgcctgagacattacctgctctcgcaaggatggtgggatgaagaacaagaaaaagcatggagaaaacaatcaaggcgcaaggtcatggaagccttcgaacaggcagagagaaagcctaagccaaatcctaacctgcttttcagcgatgtgtaccaggaaatgcctgcccagttgagaaaacagcaggaatccctggctagacatctgcagacctacggggaacactaccctctggatcattttgacaag

SEQ ID NO: 249531 - DNA, 1335 bp, Artificial Sequence
  Description of Artificial Sequence: Synthetic coding sequence
atggcagtggccattgccgcggcccgtgtctggcgcctgaacaggggactgtcccaagcagccctgctcctgctgcgccaacccggagcgagaggactcgcgcggagccacccgccacgacagcaacagcagttctcgagcctggatgataaaccacaattcccgggagcatctgcggagttcatcgacaagctggagtttatccaaccaaatgtgatctcgggaatcccgatctatcgagtaatggaccggcaaggacaaatcattaacccatccgaggaccctcacttgcctaaagaaaaggtgctcaaattgtacaagtctatgactctgctgaacactatggaccgcatcctctatgaaagccagcggcaaggtcgcatcagcttctatatgaccaattacggggaggaaggaacgcatgtgggttcagcggcggccctggacaatactgacctcgtctttggccagtacagagaggccggtgtcctcatgtacagagactaccctcttgaactcttcatggcccaatgttacggtaacatatcggatcttggcaagggccgccagatgccggtgcattacgggtgcaaagaacggcacttcgtgactattagctccccgcttgcaacccagatccctcaggccgtgggagcggcatacgccgcgaagcgggcgaatgcaaatcgggtggtgatctgctacttcggagaaggagcggcgtccgagggtgacgctcacgcgggattcaacttcgccgctaccctggaatgccccataatcttcttctgcaggaataacggttacgccatcagcaccccgacgtcagaacagtaccgcggcgacgggatcgcagcccggggaccaggctacggcatcatgtccatccgcgtggacgggaacgatgtttttgctgtgtacaacgctactaaggaggctagacgccgggctgtcgctgagaatcagccgtttttgatcgaggcaatgacgtaccgcatcggacaccactcgacctcagacgatagctccgcgtaccggtcggtagatgaagttaactactgggacaagcaggatcatcccatctccagactgcgacactacttgctcagtcaggggtggtgggacgaggaacaagaaaaggcttggcgcaagcagtcgagaagaaaggtgatggaggcctttgaacaggctgaacggaaacccaagccaaacccgaatctgctgttcagcgacgtctaccaagagatgccggcccagctccgcaaacagcaggagtctctggcacgtcatttgcagacttacggcgaacactacccgcttgatcatttcgataag

SEQ ID NO: 249532 - DNA, 1335 bp, Artificial Sequence
  Description of Artificial Sequence: Synthetic coding sequence
atggcagtggctatcgcagccgctcgcgtgtggcgcttgaaccggggcctgtcccaggcggccctgctgctgctcagacagccgggtgccagagggctggcgcgctcccatccgcctcgccagcagcaacagttctcctcactcgacgacaagccacagttcccgggggcgagcgcagaattcattgataaactcgaattcatccaaccgaacgtgatctccggcattccgatttacagggtgatggaccggcagggacagatcatcaacccgtccgaagatccacacctcccgaaggaaaaggtcctcaagctgtacaaatccatgaccctcctgaatactatggaccgcatcctgtacgaatcccagaggcagggaagaatctcattttacatgaccaactacggagaggaaggaacccacgtcggtagcgcagcggctctcgacaacaccgatctggtattcgggcaataccgcgaagccggagtcctgatgtacagggactaccctctggagctgtttatggcccagtgctacggcaacattagtgacttgggaaagggtcggcaaatgcccgtgcactacggatgtaaggaacgccacttcgtcaccatctcatcgccgcttgccactcagatccctcaagctgtgggcgctgcctacgccgcaaagagagccaacgcaaatcgagtggtgatctgctacttcggcgagggagctgcttcggaaggagacgcccacgcaggattcaactttgccgccaccctggagtgtcctatcatcttcttttgcagaaacaacggatacgcgatctcgactccgacctccgaacaatatcgcggagacggaatcgcggcccggggtccaggatatggaatcatgtctatccgggtggacggaaatgacgtgttcgccgtgtacaacgccaccaaggaggcgcgacgccgcgccgtcgccgagaatcagcctttcctgatcgaggccatgacctaccgcatcggacaccattccacctcagacgactcctcggcgtatcgctccgtggacgaagtgaattactgggataaacaggaccaccctatttcccggctgagacactacctgcttagccagggatggtgggacgaagaacaggaaaaagcctggcggaagcagtcacgccggaaagtcatggaggcatttgaacaggccgagcgcaaaccgaagccgaacccgaacctgctcttttcggatgtgtaccaagagatgcccgcacagctccggaagcagcaagagagcctggcccgccatctgcagacttatggggagcactacccgctggatcatttcgacaag

SEQ ID NO: 249533 - DNA, 1335 bp, Artificial Sequence
  Description of Artificial Sequence: Synthetic coding sequence
atggctgttgcgattgccgctgcccgcgtatggcgattgaaccgcggattgagtcaagctgctctcctcctgctcaggcagcccggagcaaggggcctagccaggagtcacccaccacgtcaacagcagcagtttagctcactcgacgacaagccccagtttccgggcgcttctgccgaatttatcgataaacttgagttcattcagcccaatgtgatatccgggataccaatatacagggtaatggaccggcagggccagataataaacccaagtgaagacccacatttacctaaggagaaggtacttaaattgtacaaatccatgactttgctcaataccatggacaggattctgtacgagtcccagaggcagggccgaatctccttctacatgactaattatggggaagaaggaacccatgtgggatctgcggctgctctagacaacaccgacctggtattcggacaatacagagaagccggagtgctcatgtatcgcgactatccgcttgaactcttcatggctcagtgctacggcaacatttccgacctcggtaaagggaggcagatgcctgttcattacgggtgcaaagagagacactttgtcactattagctcaccactggccacgcagattccccaggccgtgggggcagcgtacgcagcaaagcgtgctaacgctaatagggttgtcatttgctactttggcgagggagcagctagcgagggggatgcacatgccggttttaattttgccgccactctggagtgtccaatcatttttttctgccgaaataacggctatgcaatctctacccctacctcagagcagtatagaggtgatggaatcgctgctagaggacccggctacggcatcatgtcaatccgagtcgacggcaacgatgtattcgccgtgtacaacgcgacaaaggaggctagaaggagagccgtggccgagaatcagccatttttgattgaggcaatgacgtacaggatcgggcaccactctacctctgacgactcaagcgcttacagatccgtcgatgaagtcaattattgggacaagcaggatcatcccatctccagactgaggcattacctcctgagccaagggtggtgggacgaggagcaggaaaaagcttggaggaagcagtcgaggcgtaaagttatggaggcctttgaacaggccgagcggaaaccaaaaccaaatcccaacctgctgttctccgacgtctatcaggagatgccagcacagctgcgaaagcagcaggagtctctagctcgtcatctccagacatacggtgagcactaccctctggaccacttcgacaag

SEQ ID NO: 249534 - DNA, 1335 bp, Artificial Sequence
  Description of Artificial Sequence: Synthetic coding sequence
atggctgtggccatcgccgctgctcgcgtctggcggctgaacaggggcctctcacaggcggcactgctgctcctgcgccagcccggagccagaggactggctcggagccatccacctcgccaacaacagcaattcagctccctggacgacaagccacagttccctggcgcctcggctgagttcatcgataaactggagtttattcaaccaaacgtcatcagcggtatcccgatctacagggttatggaccggcaaggtcagatcatcaatccatcggaggacccccacctccccaaagaaaaagtgctgaaactgtataagagcatgacgctgctcaacaccatggaccggatcctgtacgagtcccaaagacagggaaggatctcattttacatgaccaattacggagaggagggaactcacgtgggatcagcggcggccctcgacaatactgatcttgttttcggccagtacagagaggcgggcgtcctgatgtacagagactatccgctggaattgttcatggctcagtgctacggaaacatctccgatctcggcaagggtcgccagatgccggtgcactacggttgtaaggagcgacacttcgtgaccatctcaagcccgctcgcgactcagatcccgcaggccgtgggagctgcgtacgccgctaagcgggcaaatgcgaacagagtcgtcatctgctacttcggagagggagcagcttcggagggagacgcccacgcggggttcaacttcgccgcgaccctggaatgcccgattatcttcttttgtcgcaacaacggatacgccatctcaaccccaactagcgagcaatacaggggagacggaatcgccgcccgcggcccgggctacggcatcatgtccattcgggtcgatggaaatgatgtgttcgctgtgtacaacgcaactaaagaggcacgcaggcgcgcagtggctgagaaccagccttttttgatcgaagccatgacttacaggatcggtcaccactccacttcggatgacagcagcgcgtaccgttcggtggacgaagtgaattactgggacaagcaggaccaccctatctcacggttgcgccactacctgctgagccaaggatggtgggacgaagaacaagaaaaagcctggcgcaaacagtcgcggcgcaaagtcatggaggcttttgagcaggcggaaaggaaaccgaagcccaacccaaacctgctcttctcagacgtgtaccaggagatgcccgcgcaactgcgtaagcagcaagagtccctcgcccgccatctgcaaacgtacggcgaacattaccccctggatcacttcgacaaa

SEQ ID NO: 249535 - DNA, 1335 bp, Artificial Sequence
  Description of Artificial Sequence: Synthetic coding sequence
atggcagtcgccatagctgcggcaagagtatggcgactaaaccgtggactcagtcaggctgcccttctcttgcttagacagccaggggccaggggcctggccagatcacatcctcccaggcagcaacagcagttttcatccctagatgataagcctcagtttccgggggcatctgctgagtttatagataaacttgagttcatccagcctaatgtcatttcaggaattcccatttaccgagtgatggaccgccagggccagattattaacccaagtgaagacccacacctcccaaaggagaaagtcctgaagctgtacaagtccatgacactcctcaacacaatggatcgtatcctgtacgagtcgcagcggcagggtcgcattagtttctatatgaccaactatggggaggagggcacccacgtgggttcagcagccgctctggacaacactgatctggtttttggccaataccgggaagcaggcgtgttgatgtaccgggattacccactagagctctttatggctcaatgctacggaaatataagtgatcttggcaaagggcggcaaatgccagtgcactatggatgtaaagaacgccacttcgtgacaattagcagcccactggctactcaaattcctcaggccgttggcgccgcttatgctgcaaagcgggccaacgcgaatagagtagtgatttgttattttggcgagggagcagcttctgagggtgatgctcatgcaggcttcaacttcgctgccactttggagtgcccgataatattcttttgtaggaacaatggatatgcaatctcaactccaacctcagagcagtaccgcggcgatggtattgcggcccgcggacccgggtacgggattatgtccataagggtcgacggcaacgatgttttcgcagtgtataatgctaccaaagaggcccggaggagagcagtggctgagaatcagcccttcctgattgaggctatgacctatcgcatcggccaccattctacttctgacgactccagcgcctaccgcagcgtggacgaggtgaactactgggacaagcaggaccatcctatctctaggcttaggcattatctgcttagccaggggtggtgggacgaagagcaagagaaggcctggcgtaagcagtcaaggagaaaggtgatggaagctttcgagcaggctgagaggaaaccaaagccaaatcctaacctcctgttctccgacgtgtaccaggagatgccggcccagctgaggaagcagcaggagagtctcgccaggcacttgcagacctacggagagcactatcccctcgatcacttcgataag

SEQ ID NO: 249536 - DNA, 1335 bp, Artificial Sequence
  Description of Artificial Sequence: Synthetic coding sequence
atggcagtggcaattgcagcagccagagtctggagactgaatagaggcctgtcacaggccgcgcttcttctgctcagacagcccggtgcacggggtttggcaagaagccatccacctcgacagcaacagcaattttcgtcgcttgacgataagccacaatttcctggagcatcggcagaattcattgacaagctggagtttatacagcccaatgtgatttcgggaattccaatttaccgtgtgatggatcggcaagggcagattatcaacccttccgaggaccctcaccttcctaaagaaaaagtgctgaaactgtacaagtccatgaccctgcttaatactatggaccgtatcctttacgaatcgcaacggcagggtcggatttcattttacatgaccaattacggagaagaaggaacccatgtgggttctgcagcagctctcgacaataccgatcttgtgttcggtcagtacagagaagcaggggtgcttatgtaccgcgactatccacttgaactctttatggcacaatgctacggtaacatttcggaccttggtaaggggcgtcaaatgccggtccattatgggtgcaaggagaggcattttgtgaccatctcaagcccactggcaactcaaattccacaggcagtcggggcagcatacgcagcaaagagagctaacgctaaccgggtggtcatatgttacttcggtgagggtgcagcctcagaaggtgacgcacacgcgggtttcaattttgcagcaactctggagtgccccatcatcttcttttgtcggaacaatgggtacgcaatttcaactcccacttcggaacaataccgaggcgacggcattgcggcccgcggaccgggctacggcattatgtccatcagagtggatggaaatgatgtttttgccgtgtataacgccactaaggaagcacggagacgggccgtcgccgagaatcaaccttttctgattgaggcaatgacttacagaataggacatcattccactagcgacgattcctcagcatatcggagcgtggatgaagtcaattactgggataaacaggatcatcctattagtcgcctccgccactacctgctttcccaaggatggtgggacgaagaacaagagaaggcatggcgcaagcaatcccgtagaaaagtcatggaggcgttcgaacaagcagagagaaagcctaagcctaatccaaatctcctgttttcagatgtgtaccaagaaatgcctgcccaacttcgtaagcagcaggaatccctggcacgtcatttgcaaacctacggagagcactaccctctcgaccactttgacaag

SEQ ID NO: 249537 - DNA, 1335 bp, Artificial Sequence
  Description of Artificial Sequence: Synthetic coding sequence
atggccgtggccatagcagccgcccgagtgtggcggctgaaccggggactgtcgcaggcagccctgcttctgcttcggcaaccgggagcccgaggtttggccaggtcgcacccccctcggcagcagcaacagttttccagtctggacgataagccccaattcccgggcgcttcagcggagttcatcgataagctggaattcatccaaccaaacgtcatctcggggattccaatctaccgcgtgatggaccggcaaggacagattatcaatccttcagaagatcctcacctcccaaaagagaaggtgttgaagctctataagtcgatgaccctgctgaatactatggaccggatcctttacgaatcacagagacagggacggatcagcttctacatgaccaattacggagaagaaggcactcacgtgggatcagcggccgccctggacaatactgacctggtctttggacagtacagagaggccggcgtgctgatgtacagggactaccctctggagctctttatggcgcagtgctacggaaacatttcagaccttggaaagggacgccaaatgccagtgcactacggatgtaaggaacggcatttcgtgaccatctcaagcccgctcgcgactcagatcccgcaagctgtaggagcagcctatgcggcaaagcgagcaaacgcgaaccgcgtggtgatctgctacttcggagagggagcggcttcggagggggacgctcatgccggcttcaacttcgcggcaacccttgaatgtcctattatcttcttctgccgcaacaacggctacgcgatctcgacccctacctcggaacagtatagaggagacgggatcgctgcgcgggggccaggctacggtatcatgtccattcgcgtggacggcaacgatgtttttgcagtgtacaacgccaccaaggaggcccggcggcgagcggtggcggaaaaccaaccgttcctgatcgaggctatgacttacaggatcggacaccactccacctcggacgattcctccgcctacagatcggtggatgaagtgaactactgggataaacaggaccatcctatcagccggctcaggcactacctgctttcgcagggatggtgggacgaagagcaggaaaaagcatggagaaagcagagccggcggaaggttatggaggcattcgagcaggcagaacgcaagccgaagcccaatccgaacctgctcttcagcgacgtgtaccaggaaatgccggcccagctccgcaagcagcaagaatccctggcccggcacttgcagacttacggagaacactatcctctcgaccactttgataag

SEQ ID NO: 249538 - DNA, 1335 bp, Artificial Sequence
  Description of Artificial Sequence: Synthetic coding sequence
atggctgtcgccatcgcagcagctcgcgtttggagactcaacagaggcttatcccaggcagccctcttgctcctgcgccagcccggagccagagggctcgcccggtcccacccccctcgccaacagcagcagttcagttccctcgatgataaacctcagtttccaggggcatccgctgaattcatcgataagctggagttcatccagccaaacgtgataagtgggatccctatatatcgggtcatggatcgacaaggccaaatcattaaccccagtgaggatccacacttgccaaaggaaaaggtcttgaagttgtacaagtcaatgactctcctgaacactatggacaggattctctatgagtctcagcggcagggccgtatctctttttacatgaccaactatggagaggagggtacacacgtgggcagcgctgccgcccttgacaataccgacttggttttcgggcaataccgggaagccggcgtgttaatgtacagagattaccctctggagctgttcatggcccagtgttatggcaacatcagtgacttgggcaagggacgccaaatgcctgtacattatggctgtaaagaaagacactttgtcactataagtagtccactcgccacgcagattccacaggccgttggagccgcttacgccgccaaacgcgctaacgccaaccgcgttgttatttgctacttcggggagggcgccgcaagtgagggggacgcccatgccggattcaacttcgctgccacactcgagtgcccaatcattttcttctgtagaaacaacggatacgctatttccacccctacgtccgagcaatatcgaggagacggcatcgcagcgcgtggaccgggctacggaatcatgtctataagagtggacggaaatgacgtttttgctgtttataacgcgacaaaggaggccaggaggcgcgccgtcgctgaaaatcagccatttctgatcgaagccatgacttaccggatcggacaccactccactagtgatgacagtagcgcttaccgcagtgtggatgaagtcaactattgggataaacaggatcatccaatatcgcgacttagacattatttactatcccaagggtggtgggatgaggaacaggagaaggcctggaggaaacagtcacgcagaaaagttatggaagctttcgagcaagcagagcggaaacctaaacctaatccaaacctgctgttctccgatgtgtatcaagaaatgccagctcaattaaggaagcagcaggaaagcctggccaggcacctgcagacctacggggagcattaccccctggaccacttcgataaa

SEQ ID NO: 249539 - DNA, 1335 bp, Artificial Sequence
  Description of Artificial Sequence: Synthetic coding sequence
atggctgtagctattgccgccgccagggtgtggcgactgaacagaggattgagccaagcagcgctgctgctcctgagacagcctggagcgcgcgggctcgctaggtctcacccccccagacaacagcagcagttctcctccctggacgacaaacctcagtttcccggcgccagcgctgaatttatcgataagctggaattcatccaacctaatgtgatttcggggattcctatctatagggttatggaccggcaaggtcagatcattaatcctagcgaggatccccatttgccaaaagagaaggtccttaagctgtacaagagcatgactcttttgaatacaatggatagaattctgtacgagagtcaacggcagggcagaatcagcttctatatgactaattacggagaggagggcacacacgtgggttcagcggccgccctcgataatacagacctggtgtttggtcagtacagagaggccggtgtgttgatgtaccgggattatcctctcgaactgttcatggctcagtgctatggtaatatttcagacctgggaaagggacgacaaatgcccgtgcactacgggtgcaaagagcggcactttgtgaccattagctctccactcgccacccagatccctcaggccgtcggggcggcatacgccgcaaagagagcgaatgctaacagagtggtcatttgctacttcggtgagggagcggccagcgagggagacgctcacgcggggttcaacttcgccgccactctcgagtgtcctattatcttcttttgtcgcaataatgggtatgctataagcacacccacctcagagcaataccggggcgatggcattgccgctcggggccctggttacggaataatgtccatcagggtggatgggaacgatgttttcgccgtttacaatgcgacaaaggaagctcgaaggagagcagtggcggaaaaccaaccctttctcattgaagcaatgacctaccggattggtcatcactcaacaagcgatgacagctctgcctatcgttctgtggatgaagtgaattactgggacaagcaagatcaccctatctctaggctgcgtcactatcttctatcacagggttggtgggatgaagaacaggaaaaggcatggcggaagcagtccaggagaaaggtcatggaggctttcgagcaggctgaaagaaagccgaaacccaatcccaatttgctgtttagcgatgtgtatcaggaaatgccagcccagcttcggaagcagcaggaatctctcgcccggcatttgcagacttatggcgagcactacccgctggatcattttgacaag

SEQ ID NO: 249540 - DNA, 1335 bp, Artificial Sequence
  Description of Artificial Sequence: Synthetic coding sequence
atggcagtagctatcgccgcagcccgggtgtggaggctgaatcgaggactatcacaagcagctctgctcctgctcagacagcccggagcgagaggtcttgcccgctcccaccctccccggcagcagcaacagttcagctctctcgatgataaaccacagtttcccggagcatccgctgaattcatagacaaactcgaattcatccagccaaacgtcatctctggcattcctatctatcgcgtgatggatcggcagggacagatcataaatccctcagaggatcctcacctcccaaaagagaaggttctgaagctgtacaaatctatgacactgttgaacactatggatcgaatcctatatgaaagccaaagacagggccggatctccttctacatgacaaactacggggaggaaggaacacatgtaggctctgcggccgccctcgacaataccgacctcgtattcggtcagtaccgcgaagccggggtactaatgtatcgggattaccccttagaactgttcatggcccagtgttacggcaacatttccgatctgggaaaaggtcggcagatgcctgtgcactatggttgcaaggaacggcattttgtcacgatttcctctcccctggcgacccaaatcccacaagcagtgggtgctgcctatgctgcaaagagagctaatgccaacagagtcgtaatctgctacttcggcgagggcgctgcttccgaaggcgacgcacatgccggttttaactttgctgcaaccctggaatgtccgatcatattcttctgccgtaataacggttacgctatctcaacccccacttctgaacagtaccgcggcgacggtattgcagcacggggcccaggttacgggatcatgtcaatccgggtggacggaaacgacgtgtttgccgtgtacaacgccaccaaagaagcgagacgcagggccgtggccgagaatcagcctttccttatcgaggctatgacctatagaatcggccatcacagcaccagtgatgatagttctgcatataggagcgtcgacgaagtcaattactgggataagcaggatcacccgatcagtcggttgaggcactacctactcagtcaggggtggtgggacgaggagcaagagaaggcgtggcgaaagcagtcaagacggaaggtgatggaggcatttgagcaggcagaacgcaagcccaaacccaaccccaatctgctgttttctgatgtttatcaggaaatgcccgcacagcttcggaaacagcaggagtccttagcgcgtcacctgcagacatacggagaacactacccccttgatcatttcgacaaa

SEQ ID NO: 249541 - DNA, 1335 bp, Artificial Sequence
  Description of Artificial Sequence: Synthetic coding sequence
atggccgtggccatcgcggcagcacgggtgtggcgcctgaacagaggtttgtcacaggccgcgctgctgctcctgagacaaccgggagccagaggacttgctcgctcccatcctccacgtcagcaacagcagttctcgagcctcgatgacaagccacagttcccgggagcgtcagccgaattcattgacaagctcgagttcatccagccgaacgtgatctccggcatccccatctatcgagtaatggataggcagggacaaatcatcaatccatcggaagatccccacctgcccaaggaaaaagtgctcaaactctacaagtcgatgacccttttgaacacgatggaccggatcctgtacgaatcccagaggcaaggaagaatctcgttctacatgaccaattatggagaggagggaacgcacgtcggaagtgcggcggcgttggacaatactgaccttgtgttcggccagtatcgggaggcgggggtcctgatgtatcgcgattaccccctggagctctttatggctcaatgttacggcaatatcagcgaccttggaaagggcagacagatgccagtgcactacggctgcaaagagcggcatttcgtgactatttcgagtccgttggcgactcaaattccacaggccgtcggggcggcttacgcggctaaacgggccaacgccaaccgtgtcgtgatctgctactttggtgagggggcagcgtccgagggtgacgcacacgccggcttcaacttcgctgcaaccctcgaatgcccgatcatctttttctgccgcaacaacggatatgctatttcaaccccaactagcgaacaataccggggagatggcatcgccgcacgcggcccaggatacggtatcatgtctatccgcgtcgatggaaacgacgtgtttgccgtgtacaacgccactaaggaagcacgcaggcgcgctgtagccgagaatcagccctttctgatagaagctatgacctaccgcattggccatcactccacgtccgatgactcgtcggcataccgctcggtggacgaagtgaactactgggataagcaggatcacccgatcagccggctccggcattacctgctgtcgcaagggtggtgggacgaagaacaggaaaaagcctggcgcaagcagagcagacgcaaggttatggaagcgttcgagcaggcggagcgaaagcctaagccgaacccgaatctgttgttcagcgacgtctaccaagagatgcctgcccagcttagaaaacaacaggaatccctggccagacatctgcaaacctacggcgagcactaccctctggaccacttcgacaag

SEQ ID NO: 249542 - DNA, 1335 bp, Artificial Sequence
  Description of Artificial Sequence: Synthetic coding sequence
atggcggtcgccatagccgcagctagagtatggcgattaaacagaggcctctctcaggccgcattgctgttactacgacagcccggggctcgtggcctggcccggtcgcatccacctcgacagcagcagcagtttagtagcctagacgataagccccagttccctggagcctccgctgagttcatcgataaactcgaattcatccaaccaaatgtcataagtgggatccccatttacagggtcatggacaggcagggccaaattatcaatccctccgaggacccccatctacctaaagagaaagttctgaaactctataagtccatgacacttctgaacaccatggaccgaatcttgtacgagagccaaagacaggggcgcatcagcttctatatgacaaattatggagaggagggcacccatgtgggttctgcagctgccctcgataacaccgacctggtttttggacagtatagggaagctggggtcctaatgtatagagactacccactggagttgtttatggcacagtgctacggtaatatctctgacctgggcaagggaaggcagatgccggtgcattacggatgtaaagagaggcacttcgtgaccatttcttcccccctcgcgacgcagattccacaagccgtgggggcagcatatgccgcaaagcgtgctaacgctaaccgagtggtaatctgctactttggagagggggccgcctccgaaggcgacgcacacgcaggctttaacttcgccgccaccctggaatgcccaatcatctttttctgtcgcaacaacgggtacgccatcagcactccgacatccgagcagtataggggagatggcattgcagcgcgagggccgggatatggcatcatgtctatcagggtggacggtaacgacgtgttcgcagtttataacgctacgaaagaagcccgacgccgagctgtggccgaaaaccaacccttccttatcgaagccatgacatacaggataggacaccactctacctcggacgacagtagcgcttatagatcggtcgatgaagttaattactgggataaacaggaccacccaatttcacgattacgacattacctgttgagccaggggtggtgggatgaggaacaggagaaagcttggcgaaaacaaagcaggaggaaggtgatggaggccttcgagcaggcggagcgtaaacctaaacccaaccccaaccttttgtttagtgatgtataccaggagatgccagcccagctgagaaagcaacaggaaagcctggctagacatctgcaaacttacggtgagcactacccgctggaccacttcgacaaa

SEQ ID NO: 249543 - DNA, 1335 bp, Artificial Sequence; identical to SEQ ID NO: 249538
  Description of Artificial Sequence: Synthetic coding sequence

SEQ ID NO: 249544 - DNA, 1335 bp, Artificial Sequence
  Description of Artificial Sequence: Synthetic coding sequence
atggcagtggccatcgcagcggccagagtttggaggctgaatcgagggctgtcccaggcggccctgcttctactgaggcagccaggcgcaagaggactcgcaaggtctcacccccccagacagcagcagcagtttagctcgctagacgacaaaccacagttccccggggcttccgccgaatttatcgacaagttagaattcattcagcctaatgtgatctccggcatcccgatatatagggtgatggataggcaagggcagatcattaaccctagcgaggacccccatctccctaaggaaaaggtgcttaaattatacaagtctatgaccctactgaacacaatggaccggatcctatacgaatctcagagacagggacgcatctctttttatatgactaactatggtgaggagggtacccacgttggcagtgccgcagctttagataacaccgatctggtgtttggccagtaccgggaggccggggtgctgatgtatcgcgactatcctttagagctcttcatggcgcagtgctacggaaatatttccgatcttgggaaaggccggcagatgcccgttcactatggctgcaaggaaagacatttcgtcactattagttctcctcttgccacacaaattcctcaagctgttggtgctgcatacgccgctaagcgggccaatgccaaccgggtagtgatctgctactttggggagggagcagcatccgaaggtgatgctcacgccggcttcaatttcgcagccacacttgaatgcccaataatcttcttttgcaggaataacggttatgcgatttctaccccaacttccgaacaatatcgtggagacgggatagccgctcgagggcccggctacggcataatgtccataagagtcgacggtaacgatgtgtttgcggtgtataatgctactaaggaagctaggaggcgggccgtggccgaaaatcagccgtttctgatagaagcgatgacttacagaattggacaccactctacttccgatgacagctccgcatataggtctgtggacgaagtcaactattgggataagcaggatcatccgatatcacggctgagacattacctgctttcgcagggatggtgggatgaggagcaggaaaaggcgtggcggaaacagtccaggcggaaggttatggaggccttcgagcaggctgaacggaagcctaaacctaatcctaacctcctgttttctgacgtataccaggagatgcctgcgcagctgcggaaacaacaggagtctctggcacgacacctccagacgtatggggaacattatcctctggatcatttcgataaa

SEQ ID NO: 249545 - DNA, 1335 bp, Artificial Sequence
  Description of Artificial Sequence: Synthetic coding sequence
atggcagtggctattgcagcagccagagtctggcgtctcaatcggggactctcccaggcggcacttctccttctgcgtcaaccaggtgcgcgaggccttgcacgttcgcacccacctaggcaacaacaacagttttcctcgctggacgataaaccccaattccctggcgcatccgctgagttcattgataagctggagttcatccaacctaacgtcattagcggtatccctatttacagagtcatggatcgtcaaggacagattatcaacccgagcgaggatcctcaccttccaaaggaaaaggtactcaagctctacaagtcgatgacgctgttgaataccatggataggatcctttacgagagccaacgccagggacggatctcgttctacatgaccaactacggggaagaaggtactcatgtcggatcggcagccgcccttgataataccgacctcgtgtttggccagtacagagaggcaggcgtgctgatgtacagggactacccacttgaactgttcatggcacagtgctatggaaatatcagcgatcttggaaaaggtcgccagatgccagtccactacggatgtaaagaaaggcattttgtgaccatcagctccccactggcaactcagataccccaggccgtgggagcagcatatgcagctaagagagcaaacgctaatagagtggtgatctgttactttggagaaggagcagcatccgagggtgatgcacatgccggattcaatttcgccgcaacccttgaatgtcctattatcttcttctgcaggaataatggttacgccatttcaacccctacgtccgagcaataccgaggtgacggaattgcagcacgaggccctggctacggaattatgagcatccgcgtggatggcaacgacgtgtttgcagtctacaatgccactaaagaagcgcggcggagagcagtggcagaaaatcaaccttttcttatagaggcaatgacttaccgaataggtcaccattcaacctcggacgatagctcagcgtacagatcggtggacgaagtgaactactgggataagcaagaccatcccatctcaaggctgcgccattacctcctgagccagggatggtgggatgaagaacaagagaaggcgtggcgtaagcaatcgcgacgaaaggtaatggaagcctttgaacaggctgagagaaagcccaagccaaacccaaatcttctgttttccgacgtgtatcaggaaatgccagctcaattgcggaagcaacaagaaagccttgcacgccatctccagacttacggggagcattaccctctggatcactttgataag

SEQ ID NO: 249546 - DNA, 1335 bp, Artificial Sequence
  Description of Artificial Sequence: Synthetic coding sequence
atggccgtggcaatcgcagcagcgcgggtgtggagacttaaccgcggcctttcacaagcagctcttcttctgttgagacaacccggcgcaaggggtcttgcaaggagccatccaccaagacaacagcaacaattctcatcgctggatgataagcctcagttccctggagcgtcagcagagtttattgacaagctcgagtttatccaaccaaacgtgataagcggaattccaatttaccgggtgatggatcgccagggacaaatcatcaacccatcagaggatccacaccttccaaaggaaaaggtgctgaagctgtacaagtccatgactctgcttaataccatggacagaatcctctacgaatcgcagagacagggaaggattagcttttacatgactaactacggagaagaaggaacccatgtaggaagcgctgcagcactggataataccgatttggtgttcgggcaatacagggaggctggggtgctcatgtacagggactatcctctggaactgtttatggcacagtgttatggcaacatcagcgacctggggaagggacggcaaatgccggtgcattatggatgtaaagaaagacatttcgtcaccatcagcagccccctggcaactcaaattccacaggccgtcggagccgcctacgccgcaaagagagctaacgccaacagagtggtcatctgctacttcggagaaggggccgcaagcgagggagatgcccatgcaggatttaacttcgctgcaacccttgaatgtccaatcattttcttttgccgaaacaatgggtacgctatttccacccctacttctgaacagtaccgcggcgatggtatagcagcaaggggccctggatacggaattatgtccattagagtggacggaaacgatgtctttgccgtgtacaatgcaaccaaggaagcgcgcagacgggcagtggccgaaaaccaaccttttctgatcgaggccatgacttaccggattggtcatcattcaacttcggacgactcgtcggcatacaggtcggtcgacgaagtgaactactgggataagcaggatcatccaatttcaagactgcgacattacctgctgtcccagggctggtgggatgaagagcaagaaaaggcatggcggaaacaaagccgacgtaaggtcatggaggcatttgaacaggccgagagaaagcccaagcccaacccaaatcttctttttagcgatgtctatcaagaaatgcccgcacaacttagaaaacagcaggaatcgctcgcaagacatctgcagacctacggtgagcactacccgctggatcatttcgacaag

SEQ ID NO: 249547 - DNA, 1335 bp, Artificial Sequence
  Description of Artificial Sequence: Synthetic coding sequence
atggctgtggcaattgctgctgctagagtttggagattaaatagaggtttatcacaagctgctcttttattgttgagacaaccaggagcaagaggacttgcaagatctcatccaccacgacaacaacaacaattctcatctcttgatgacaaaccacaatttcctggagcttcagctgaattcattgacaaattagaattcatacaacctaatgttattagtggaattccaatttatagagttatggatagacaaggtcaaattattaatccaagtgaagatccacatttaccaaaagaaaaggttttaaagctttataaatcaatgacattattaaatacaatggatcgtattttatatgaaagtcaaagacaagggagaatatcattttatatgactaattatggagaagaaggtacacatgttggatcagcagcagcacttgataatacagatttagtttttggacaatatagagaagctggagttcttatgtatcgtgattatccattagaactattcatggctcaatgttatggaaatattagtgatttaggaaagggaagacaaatgccagttcattatggatgtaaagaaagacatttcgtaacaatatcatctccacttgctacacaaatacctcaagcagttggagcagcatatgctgcaaaaagagctaatgcaaacagagttgttatttgttattttggagaaggagccgcttctgaaggagatgcacatgcaggttttaattttgccgcaactttagaatgtccaattatttttttttgtagaaataatggatatgcaataagtacaccaacaagtgaacaatatagaggggacggtattgctgcaagaggtccaggatatggaattatgtctattagagttgatggaaatgatgtattcgctgtttataatgcaactaaagaagcaagaagaagagcagttgcagaaaatcaaccatttcttattgaagctatgacctatagaattggacatcatagtactagtgatgattctagtgcttatcgatctgttgatgaagtaaactattgggataaacaagatcatccaattagtcgattaagacattatcttttgtcacaaggttggtgggatgaagaacaagaaaaggcatggagaaaacaatcacgtagaaaagttatggaagctttcgaacaagcagaacgaaaacctaaaccaaatccaaatttactctttagtgatgtatatcaagaaatgccagctcaattaagaaaacaacaagaatcacttgctagacatcttcaaacatatggagaacattatccattagatcattttgacaag

SEQ ID NO: 249548 - DNA, 1335 bp, Artificial Sequence
  Description of Artificial Sequence: Synthetic coding sequence
atggccgtggctatcgcagcagccagagtctggaggctgaataggggactctcgcaggccgctctgctgctgctccggcaacctggcgcccgcggtttggcacgatcccacccgccacgccagcaacagcaattcagctcactcgacgacaaaccacagtttcctggcgcctccgccgagtttattgataagctggaatttatccaacctaacgtgatcagcggaatccctatctatagggtcatggatcgccagggacagataatcaacccgtctgaggacccccatctgccaaaggagaaagtgttgaaactgtacaagtcgatgacgctcctcaataccatggaccggattctgtacgagtcacagcgccaggggaggatctccttctacatgactaattacggagaagaggggacccatgttggctccgcagctgctctggataacactgacctggtgttcggacagtaccgggaggccggagtcctcatgtaccgcgattatccacttgaactgttcatggcccagtgctacggcaatatctccgaccttggaaagggccgccaaatgcccgtgcactacggatgtaaggagagacacttcgtcaccatctcctcacctcttgccacccaaatcccgcaggctgtcggcgctgcctacgctgccaagcgggctaatgccaaccgcgtggtcatctgctacttcggtgagggtgcggcctctgaaggagacgcacacgcgggattcaattttgcagcaaccctcgaatgcccgatcatcttcttctgccgtaacaacgggtacgctatttcgaccccgacttctgagcagtacagaggagatggaatcgccgccagagggccaggctacggcatcatgtccattagagtggatgggaacgacgtattcgccgtgtacaatgcgactaaagaagcgcggcgacgcgcggtggcagaaaaccagccgttccttatcgaggctatgacctacagaataggacaccacagcaccagcgacgactcgtcagcgtacaggtctgttgacgaagtcaactactgggacaagcaggaccatccgatctctcggctgcgccactacctgctctcacagggatggtgggacgaggagcaagaaaaggcctggcggaaacagtcgaggcgcaaggtcatggaggccttcgaacaggccgagcgcaagccgaagccaaatccaaacctgctgttcagcgatgtgtatcaagagatgccggcccagctgagaaaacaacaagagtcgctcgcgcggcacctccagacgtacggagagcattacccccttgaccacttcgataag

SEQ ID NO: 249549 - DNA, 1335 bp, Artificial Sequence
  Description of Artificial Sequence: Synthetic coding sequence
atggcagtggcaattgccgccgctagggtctggagactgaacaggggcttgtcacaggccgcccttctgctcctgcggcagccaggtgcacgggggctggcacgctcccatccgcctagacaacaacaacaattctcgtccctcgatgataagccacaatttccgggagcatcggcggagtttatcgataagttggaattcatccagcccaatgttatttcgggaattccaatataccgtgtgatggacaggcaggggcaaatcattaatccttcggaggacccgcatctgcctaaggaaaaggtgcttaaactttacaagtccatgactctcctgaatacgatggatagaattttgtacgagtctcaaagacaaggaaggatatcgttttacatgactaactacggagaggaaggaacccacgtgggaagcgccgcagcactggacaacaccgatcttgtgtttggacagtacagagaggcaggagtgctgatgtaccgagactatcccctggaactcttcatggcgcagtgctacggaaacatctccgatcttgggaagggccgccaaatgccagtgcactacggctgtaaggagcgacattttgtcactatctcatcaccgctggcaacccaaattcctcaagcggttggcgcagcttacgctgcaaaacgcgcgaacgctaacagggtggtgatttgttacttcggagagggggcggcctccgaaggagatgcccatgcaggtttcaatttcgcagccactcttgagtgcccaatcatctttttctgccgcaataacggttacgcaatttccacccccacctcggagcaataccgtggtgacggaattgcagccaggggacctgggtacggaattatgtcaattcgggtggatggtaacgatgttttcgcagtgtacaacgccaccaaggaagcaagacggcgggcagtggcagaaaatcaaccatttctgatcgaggcaatgacttatcgaatcggacatcatagcacgagcgatgattcctccgcgtacagaagcgttgatgaagtgaactactgggacaagcaagatcacccgatctcaagactgagacattacttgctgagccagggttggtgggacgaggaacaggagaaggcttggcgtaagcaatcccgacgtaaggtgatggaagcattcgagcaggccgagcgaaaacctaagcctaatccaaacctgctgttttcggatgtctaccaggaaatgcctgcccagcttagaaagcagcaagaatcacttgcgagacacttgcagacctacggagaacattatccccttgaccatttcgacaaa

SEQ ID NO: 249550 - DNA, 1335 bp, Artificial Sequence
  Description of Artificial Sequence: Synthetic coding sequence
atggccgtggcaatcgcggccgcaagggtgtggagactgaataggggtctgagccaggctgccctgctgctgttgagacagccaggagcacgcggcctggcccggtcacaccccccaagacaacaacaacagttctcgtcgcttgacgataaaccgcagttcccaggagccagcgcggaattcatcgacaaattggagttcatccagccgaacgtgatctcgggaatccctatctaccgcgttatggacaggcaaggccagatcatcaatccgtcggaggacccgcatttgccgaaggagaaagtgctcaaattgtacaagagcatgaccctcctcaacactatggaccggattctctatgaaagccaacggcaaggacgtatctccttctacatgaccaattacggagaggaagggacgcacgtggggtcggctgcggccctcgataataccgacctcgtctttggccagtaccgcgaggctggagtgctcatgtaccgcgattaccctctggagctgttcatggcgcaatgttacgggaacatctctgatcttggtaagggacgacaaatgccagtgcactacggatgcaaggaaagacacttcgtcacgatttcctcccccctggccacccagatccctcaggcggtgggggcggcctacgcggctaagcgggcaaacgcaaatagagtggtcatttgctactttggagagggagccgcctctgaaggggacgcgcatgccggctttaatttcgctgctactctcgagtgccctatcattttcttctgccgcaacaacggatacgctatctcaactccgaccagcgaacaataccgcggcgacggaatcgccgcacggggaccaggatacggtattatgtcgatcagggttgatggtaatgacgtgttcgcagtgtacaacgccaccaaggaggctcgccgccgcgccgtggcggagaaccagccgtttctgatcgaagcaatgacctaccggatcggccatcacagcacttcagatgactcatccgcctatagatccgtggacgaggtcaactactgggataagcaggatcaccccatctcgcgactgcggcattacctgctgtcccagggctggtgggacgaagagcaggaaaaagcctggcggaagcagtcccgccggaaggtcatggaagcattcgaacaggcggaaagaaaaccaaagccgaacccgaacctgctgttctcggacgtctaccaggaaatgcctgcccaactccgcaagcagcaagaatcacttgcccggcacctgcagacttatggagaacactacccgctggaccattttgataag

SEQ ID NO: 249551 - DNA, 1335 bp, Artificial Sequence
  Description of Artificial Sequence: Synthetic coding sequence
atggctgtcgcgattgctgctgcccgagtgtggcgcctcaaccgcgggttgtcccaggctgcgttgctgctgctccgccagcccggagcccggggtcttgctcgtagccatcctcctcgccagcagcagcagttcagtagtctggacgataagcctcaattccccggcgccagtgccgagttcatagataagctggagtttatccagcccaacgtcatcagcggcatccctatttaccgtgtcatggaccgccaaggtcagattattaacccttctgaggacccgcacctccctaaggagaaggttctgaagctctacaagtccatgaccctgcttaacactatggaccgcattctctacgagagtcaacgtcaggggcgcatctcgttctacatgaccaattacggcgaggaaggaactcacgtcgggtctgccgctgctcttgataacacggacctagtcttcggtcagtaccgggaagccggcgtgctgatgtaccgcgactaccctttggagctctttatggctcaatgctacggcaacatttctgacttgggaaagggccgtcagatgcccgtccattacggctgtaaagagcgccatttcgttactatttcttcgcctctggcgacccaaattcctcaggctgttggtgcggcctacgctgctaagcgcgctaacgctaatcgcgttgttatctgctacttcggcgaaggcgcagcttctgaaggtgatgctcacgcaggcttcaatttcgccgcaaccttggaatgccccatcatttttttctgtcggaataatggttacgccatctcgacaccgacgtctgagcagtaccgtggcgacggtatcgccgcccgcggcccgggctatggcatcatgtccatccgtgtcgacggcaacgacgttttcgctgtctacaacgcaactaaggaggctcgccgtcgcgccgtcgccgagaatcagccctttctcatcgaggctatgacctaccgcattggccaccactctacctccgacgatagttcggcttacaggagcgtcgacgaggtgaattattgggataagcaggaccacccgatcagccgactccgccactaccttttgtcgcagggatggtgggacgaagagcaggagaaggcctggcgcaagcaaagtaggcggaaagtgatggaggcctttgagcaggccgaacgtaagcctaagccaaatccgaacttgcttttctctgatgtttaccaggagatgcccgcgcagttgcgcaagcagcaggaaagcctcgcccggcacttgcagacttacggcgagcactacccgctcgatcacttcgacaag

SEQ ID NO: 249552 - DNA, 1335 bp, Artificial Sequence
  Description of Artificial Sequence: Synthetic coding sequence
atggctgtcgctatcgcagccgctcgggtgtggaggctcaacagaggcttaagccaagccgccttgcttctgctccgccagcctggtgctaggggcctcgctagaagccacccaccacgccagcaacaacaattctcctctctggatgataagcctcagtttccaggggccagtgctgaatttatcgataagctggagttcattcagccaaacgtgatctctggcatccccatctaccgggtgatggatagacagggccaaatcatcaacccatcagaggatcctcatctgcccaaggagaaggtactgaaactgtataagagtatgaccctgctgaacactatggaccgaatactgtatgaatctcaaagacaagggcggatctctttttacatgacgaactacggggaggaaggaacacacgtgggcagcgctgcagctttggataacaccgatctcgtcttcggccagtatagagaagcaggagtattaatgtacagggattatcccctggagctgttcatggctcagtgctatgggaacatcagcgatttaggtaagggtagacagatgccagtgcattatggatgtaaggaaaggcattttgtcactatctcgtctccgctggctacacagatcccacaggctgtaggtgctgcgtatgctgcaaagcgcgcaaacgcaaacagggttgtcatctgctattttggagagggtgctgcttccgaaggcgacgcccatgccgggtttaatttcgctgcaactttggagtgcccaattatttttttttgtagaaacaatggctacgccatttctacccccacttctgagcagtatcgaggggatggcattgccgccagggggccaggctacggaataatgagcatacgcgtcgatggtaacgacgtgttcgcggtctacaacgcgaccaaggaggcgcggcgtagagccgtggctgagaaccagccttttctgatcgaagctatgacatacagaatcggtcaccatagcactagcgatgattccagcgcctatagatccgtggacgaggtgaattattgggataagcaggatcaccccattagcaggctgcgccattatttgctcagccaaggttggtgggatgaagagcaggaaaaggcctggaggaaacagtctaggcggaaggtgatggaagccttcgaacaagcagaacgcaaacctaagcccaacccaaaccttctatttagcgatgtctaccaggagatgccagctcagcttcggaaacagcaggaaagtctcgccaggcacctccaaacttatggtgaacattaccccctggaccattttgataag

SEQ ID NO: 249553 - DNA, 1335 bp, Artificial Sequence
  Description of Artificial Sequence: Synthetic coding sequence
atggccgtggccatcgctgcagcgcgggtgtggaggctgaaccgaggcctgtcccaggctgcattgctgttgctgagacagccaggtgccagggggctcgccaggtcccatccaccccgccaacaacagcagttcagttcactggacgataaaccccagttccccggcgcctcagcagaattcattgataagcttgagtttattcaaccaaatgtgatctccgggatccccatatatcgagtaatggatagacagggccagataatcaaccccagcgaagacccccatctgcccaaggagaaagtgctcaagctgtacaagtctatgaccctgctgaacacaatggatcgaatcctgtacgagtctcagagacaggggcggattagtttctacatgactaattacggagaggagggcacgcacgtaggctctgccgcggctctggataatactgacctcgtgttcggccagtatcgagaggccggggtcctgatgtaccgagattacccactggaactgtttatggcacagtgctatggcaacatttctgatctgggaaagggtcggcagatgcctgtgcactacggctgtaaggagcgccattttgtgaccatcagcagtcccctggccactcagattcctcaggcagtcggggcggcttacgctgcgaagagggcgaatgctaatagagtggtcatctgttatttcggcgaaggagccgcaagcgagggggacgcccacgccggcttcaatttcgccgctacattggaatgcccaattatctttttttgcagaaataacggttatgcgatatctactccaaccagcgaacagtatagaggcgacggcatagctgcacgcggtcctggctacgggatcatgtccatcagggtggacgggaatgacgtgtttgccgtgtacaatgctacaaaagaagcgcggagacgggccgtggcggagaaccaaccattcctgatcgaggccatgacttacaggataggacaccattctacctctgacgacagcagtgcttataggagtgtcgatgaagtcaactactgggacaagcaagatcatccaatttctcgcctgcgccattacctgctcagtcagggttggtgggacgaggaacaagagaaggcctggagaaaacagagccgccgaaaggtgatggaggcttttgagcaggccgaacggaagccgaagccaaatcccaacctcctgttctccgatgtatatcaggagatgcccgcccagttgaggaagcaacaggagagcctggctcggcatcttcaaacctatggggagcattatcccctggaccacttcgacaaa

SEQ ID NO: 249554 - DNA, 1335 bp, Artificial Sequence
  Description of Artificial Sequence: Synthetic coding sequence
atggcggtggctatagctgccgccagagtttggaggcttaaccgcggattgagtcaggcagcactcttgctgttacgacagccaggcgctaggggcctggccagaagccaccctcctaggcagcaacaacagttttccagccttgatgacaagccacagttccctggagcctcggctgagttcattgacaaattggaatttatacagcctaatgtcatctctgggatcccaatctatcgagtgatggaccgtcagggacaaatcatcaacccaagcgaggacccacacttaccaaaggagaaggtgctgaagctctataagtcaatgaccttgctgaatacaatggaccgcatcctctacgagtctcagaggcagggccggatctcattctatatgacaaactatggagaggaaggaacccatgtggggagcgcagcagctttggacaacaccgacctggtattcggtcagtacagggaggccggagtccttatgtatcgagattatccccttgaattgtttatggcccagtgctacggaaacatctctgacctcggcaaaggcagacaaatgccagtccactacggctgtaaagagaggcactttgtgacaatttccagccctctggcgactcagattccacaggctgttggcgcggcttatgcagcaaagcgagcgaacgctaacagagttgtcatttgctatttcggagaaggagctgcatcagaaggcgacgcacacgccggattcaatttcgctgctaccctcgaatgccccatcatttttttctgtaggaataacggctatgccatctccactccaacaagcgagcagtaccgtggagatgggatcgctgcacgcggccctggctatggcatcatgtcaattagagtggatggtaacgacgtgtttgcagtttacaatgcaaccaaagaggcccgccgaagggctgtcgctgaaaaccaaccattcctgatagaagctatgacttatagaattgggcatcactccaccagtgatgacagcagcgcttacagaagcgttgatgaggtgaactattgggacaagcaagatcatccaatcagccggctgaggcattacttgctcagccaaggctggtgggatgaggaacaagaaaaagcatggcgaaaacagagtcgaagaaaggtcatggaggcattcgaacaggctgaacgtaagccaaaaccaaacccaaatctgctgtttagcgacgtgtatcaggaaatgcccgcacagcttaggaaacagcaggagtccctcgcccgccatcttcaaacctacggagagcattaccctcttgatcatttcgataag

SEQ ID NO: 249555 - DNA, 1335 bp, Artificial Sequence
  Description of Artificial Sequence: Synthetic coding sequence
atggccgtggcaatcgccgccgctcgcgtctggagattgaatagaggactgagccaagcagcactcctgctgctgcggcagccgggtgcaaggggactggcacgaagccacccgccacgccagcaacaacaattctcgtcactggacgacaagccgcagttcccaggggctagcgcggagttcatcgacaagctggaattcatccagccaaatgtcatctcgggaataccgatctaccgggtgatggaccggcagggacagattatcaacccgtcagaggacccccacctgccaaaggagaaggttctgaaactgtacaagtccatgactctgctgaacaccatggatcggatcctttacgagtcgcaaagacagggccgcatatccttctacatgactaactatggagaagaaggaactcatgtcgggtcggctgcggcgctcgataatacggacctcgtttttggacagtaccgggaagcgggcgtgctgatgtacagagactacccactggaactgttcatggcccagtgctacggcaacatcagcgatctcggaaaaggccggcagatgccagtccattacggatgcaaggaacgacatttcgtcactatttcgtcacccctcgccacgcagatcccgcaagcggtgggggcagcctacgcggccaagagagcaaatgcaaaccgcgttgtcatttgctacttcggcgaaggggcggcctctgagggagacgcccacgctgggtttaacttcgcagcaactctggaatgtcccatcatcttcttttgcagaaacaatgggtacgctatctcgaccccgacctcagagcaataccggggagacggaatcgccgcgcgcgggcccggatacggtatcatgtccatcagggtggacggcaatgatgtgtttgctgtctacaatgccactaaagaagcccggcgcagggcggttgcggaaaaccagcctttcttgatcgaggcgatgacttacaggatcggacaccacagcacctcagacgatagctcagcctatcgttccgtggacgaggtcaactattgggacaaacaggaccacccgatctcgcggttgcgacactaccttctctcacagggatggtgggacgaagaacaggaaaaggcatggcgcaagcaatcgagacggaaggtcatggaggctttcgagcaggcggaaaggaagccgaagccgaaccccaacctcttgttctcagatgtctaccaggagatgccagcccagctgcggaaacagcaagagtcccttgcgcgccatctccaaacttacggggagcactatcctttggatcatttcgataaa

SEQ ID NO: 249556 - DNA, 1335 bp, Artificial Sequence
  Description of Artificial Sequence: Synthetic coding sequence
atggcggttgcgatagcggcggcgcgagtatggcgtttaaatcgtggtctatcgcaagcggcgttactactactacgacaaccgggtgcgcgtggtttagcgcgatcgcatccgccgcgtcaacaacaacaattttcgtcgttagatgataaaccgcaatttccgggtgcgtcggcggaatttatagataaattagaatttatacaaccgaatgtaatatcgggtataccgatatatcgagtaatggatcgacaaggtcaaataataaatccgtcggaagatccgcatttaccgaaagaaaaagtattaaaactatataaatcgatgacgctactaaatacgatggatcgtatactatatgaatcgcaacgtcaaggtcgtatatcgttttatatgacgaattatggtgaagaaggtacgcatgtaggttcggcggcggcgttagataatacggatctagtttttggtcaatatcgagaagcgggtgttttaatgtatcgtgattatccgctagaattatttatggcgcaatgttatggtaatatatcggatctaggtaaaggtcgacaaatgccggttcattatggttgtaaagaacgacattttgttacgatatcgtcgccgctagcgacgcaaataccgcaagcggtaggtgcggcgtatgcggcgaaacgtgcgaatgcgaatcgagttgtaatatgttattttggtgaaggtgcggcgtcggaaggtgatgcgcatgcgggttttaattttgcggcgacgctagaatgtccgataatatttttttgtcgaaataatggttatgcgatatcgacgccgacgtcggaacaatatcgtggtgatggtatagcggcgcgtggtccgggttatggtataatgtcgatacgtgttgatggtaatgatgtttttgcggtttataatgcgacgaaagaagcgcgtcgtcgagcggttgcggaaaatcaaccgtttttaatagaagcgatgacgtatcgaataggtcatcattcgacgtcggatgattcgtcggcgtatcgttcggttgatgaagtaaattattgggataaacaagatcatccgatatcgcgtttacgtcattatttattatcgcaaggttggtgggatgaagaacaagaaaaagcgtggcgtaaacaatcgcgacgaaaagtaatggaagcgtttgaacaagcggaacgaaaaccgaaaccgaatccgaatttattattttcggatgtatatcaagaaatgccggcgcaattacgaaaacaacaagaatcgctagcgcgacatctacaaacgtatggtgaacattatccgctagatcattttgataaa

SEQ ID NO: 249557 - DNA, 1335 bp, Artificial Sequence
  Description of Artificial Sequence: Synthetic coding sequence
atggcggtggccatcgcggccgcaagagtctggaggctgaaccggggcctgagccaagccgcactcctgctgttgcgccagcccggtgctcgaggacttgcgcggtcgcaccctccccgtcagcaacaacaattttcctcccttgacgataagccacagtttcctggggcatccgccgagttcatcgataaactggaattcatccaaccaaatgtgatttcgggtatccctatttaccgggtaatggacagacagggccaaatcattaaccctagcgaggatccgcatttgccaaaggagaaggtcctcaagctgtacaaatccatgactctcctcaacactatggatcgcatcctgtacgagagccaaaggcagggacgtattagcttctacatgactaattacggcgaagaaggaactcatgttggtagcgcagcagcccttgataatacggaccttgtctttggacagtatagagaagcaggcgtgttgatgtaccgggactaccctctggaactctttatggctcaatgttacgggaacatctctgatcttggaaaaggacggcaaatgccagtgcactacggttgtaaggaacgtcattttgtcaccattagctccccactcgcaacccaaatacctcaagccgtgggagcagcgtacgcagcgaaacgggcaaatgcaaatcgagtggtgatctgttatttcggagaaggagccgcttcggaaggagacgcacatgcaggatttaactttgcggccaccctggaatgccctatcatattcttctgccggaacaacggttatgcgatatcgacccccacgtctgaacaataccggggtgacggaattgccgcacggggaccaggctacggtataatgtccattcgtgtggatggcaacgacgtctttgcagtgtacaatgcaacgaaggaagctcgtcgccgggcagtggccgagaaccaaccatttcttattgaggccatgacctacagaattggccatcattccacttcagatgatagctcagcataccgtagcgtggacgaggtgaattactgggataagcaagatcacccaatctcgcggcttaggcactacctgctgtcgcagggttggtgggacgaagaacaagaaaaggcatggcggaagcaatctcgaagaaaagtcatggaagcatttgagcaggctgaacgaaaacccaagcctaacccaaaccttctttttagcgacgtgtaccaagaaatgcctgcacaacttcgcaaacaacaggaaagcctcgccagacacttgcagacctatggggagcattatccacttgatcatttcgataag

SEQ ID NO: 249558 - DNA, 1335 bp, Artificial Sequence
  Description of Artificial Sequence: Synthetic coding sequence
atggcggttgccatagcggccgcaagggtctggagactgaacagaggtctgagccaagcggccctgctcctgctgaggcagccgggagccagagggcttgcccgatcgcacccacctaggcagcagcaacaattcagctccttggacgataagccccaattcccgggtgcaagtgcggaattcatagacaaactggagttcatccaacccaatgtcatctcggggattccgatctaccgagtgatggatcggcagggccagattatcaacccctcggaagatccccaccttccgaaggaaaaagtgttgaagctgtacaagtcgatgaccttgcttaacacgatggacagaatcctgtatgagtcgcagcggcaaggcagaatctcattttacatgacgaattacggagaagagggaacccacgtgggatccgccgcagcacttgataacactgacctcgtgttcggacaataccgggaagctggagtgctgatgtaccgcgactacccgttggagctgttcatggctcagtgctacgggaatatctcagatctggggaagggccgccagatgccagtgcattacggttgtaaggagagacacttcgttacgatctcgtccccgctggccactcagatcccacaggcggtgggagccgcctatgcggcgaaacgcgccaatgctaaccgggtcgtcatttgctattttggcgaaggagccgcatcggagggagacgcacatgccggattcaatttcgctgccaccctggagtgcccgatcatcttcttctgccggaacaacgggtacgcgatcagtactcctacctcggaacaataccgcggagacggaatcgccgcccggggcccaggttacggcatcatgtcaattcgggtggacggcaatgacgtgttcgccgtgtataacgccactaaggaagcaaggaggcgggcagtggccgaaaaccagcccttcctcatcgaagccatgacttaccggatcggacatcattcaacctcagatgatagctccgcctaccgctcggtcgatgaagtcaactattgggacaagcaggaccacccaatttcacgcctccgacactacctgctcagccagggctggtgggacgaggagcaagagaaggcctggcgcaagcagtccaggcgcaaggtgatggaggcatttgaacaggcagaacgcaaaccgaagccaaacccaaatctcctcttttcagacgtgtaccaggaaatgcccgcgcagcttcgcaaacagcaggaatcactcgcacggcacctccaaacttacggggagcactacccactggaccatttcgacaag

SEQ ID NO: 249559 - DNA, 1335 bp, Artificial Sequence
  Description of Artificial Sequence: Synthetic coding sequence
atggctgtggcaattgctgcagcacgtgtctggcgtttgaatcgggggttatcgcaagctgccttgttgctccttcgacagcctggagctagaggccttgccagatcccacccgccacgacaacaacaacaattttcgtccctggatgataaacctcaattcccaggagcttctgccgagttcatcgacaagcttgagttcattcaaccaaatgtaatctctggcataccaatttatcgagttatggatcgtcaaggacaaattattaatccatctgaagacccacatcttcctaaagagaaggttttgaagctttataaatctatgaccctgttgaacaccatggatagaatactctacgaatcccagaggcagggtagaatcagtttctatatgacgaactatggagaggaaggtacgcacgtgggaagtgcagctgcgttggataacacggatctagtctttggccaatatagggaggcgggtgttcttatgtatcgagattatccacttgaactcttcatggcacaatgctatggaaacatctctgatctcggaaaaggaagacaaatgcccgtgcactatggttgcaaagagcgtcatttcgtgactatctcatcgcccttagcaactcagattccacaagctgtaggtgctgcctatgctgcaaagagggcaaatgcaaatagagtggttatctgttattttggagagggcgccgcaagtgagggagatgcccacgcgggcttcaatttcgccgccacactggaatgtcctattatttttttctgtcgtaacaatggttatgctatttcaacgccaacctctgaacaatatagaggcgacggtatagccgcccgcggaccaggttatggaatcatgagcattcgcgtcgatggaaatgatgtttttgctgtttacaatgcaactaaagaagctcgaagacgggctgttgcagaaaatcagccattcctgatcgaagcgatgacatacagaatagggcatcacagtacttctgacgacagttctgcataccgctccgtagatgaggttaactactgggacaaacaggatcatccaatatccagactccgtcactacttgctcagtcaaggatggtgggacgaagagcaagagaaagcgtggaggaaacaatcgcgacgtaaagttatggaagctttcgagcaggctgaacgaaaaccaaagccaaaccctaacctattattctctgatgtttaccaggagatgcctgcacaattgcgaaagcaacaagaaagcttggcacgccaccttcagacgtatggagaacactatccattggatcactttgataag

SEQ ID NO: 249560 - DNA, 1335 bp, Artificial Sequence
  Description of Artificial Sequence: Synthetic coding sequence
atggcggtggcaatcgcagccgcaagagtttggcgtctgaacagagggctgagccaagccgcacttctgctgctgaggcagccaggagcacggggtctggcccggtcgcatcccccgcgacagcaacaacagttttcctcactggacgacaagccacaattcccgggtgcctccgcagagttcatagataagctcgagtttatccaaccaaacgtcatttcgggcattcccatttacagagtgatggatcgacaaggacagatcattaacccttccgaagatccacatctgccgaaagaaaaggtgctgaaactttacaagtcgatgaccctgcttaacactatggatcgaattctctacgaatcgcagagacaagggcggatttcgttctatatgaccaattacggtgaagagggcacccacgttggttcagccgcagccctggacaacaccgatcttgtctttggacaatacagagaagcaggagtccttatgtacagagactaccctttggagctgtttatggcacagtgttacggaaacatttcagatctgggaaaaggtcgacagatgccggtgcactacggatgcaaagagcggcattttgtgacgatctcgtcccctctcgccactcagatcccacaggcagtcggggcagcatacgctgccaagcgcgctaacgcgaatcgagtggtcatttgttactttggcgaaggtgcagccagcgaaggggatgcacatgcaggtttcaactttgcggccacccttgagtgccctatcatcttcttttgccgcaacaacggatacgccatttcgactcctacctcggaacaataccggggagatggaatcgcagcgagaggcccagggtacggaattatgtcgattagagtggatggaaacgacgtgtttgccgtctacaatgcgacgaaagaagcccgcagaagagcagtggctgaaaaccaacccttcctgattgaggcgatgacctaccgcatcggacaccattcaacctcggacgacagctcagcttacagaagcgttgatgaagtgaactactgggacaaacaagatcacccaatttcgaggcttagacattacctcctttcacaaggctggtgggatgaagaacaggaaaaggcgtggagaaagcagtcaagacgaaaagtgatggaggcgtttgaacaagcagaaagaaaacccaaacctaatcccaacctgcttttttcagatgtctaccaggaaatgcctgcccaactcagaaagcagcaggagagcttggcaaggcatcttcagacttacggcgagcactacccactggaccactttgacaaa

SEQ ID NO: 249561 - DNA, 1335 bp, Artificial Sequence
  Description of Artificial Sequence: Synthetic coding sequence
atggccgtggctattgccgcagctagggtttggcgacttaacaggggactttctcaggcggcactcctcctccttaggcagcccggggcgcgaggactcgcccgatcccaccctccacgacagcaacaacaattctcatccctagatgataaaccccagtttcccggggcctctgctgaatttatcgataagctggaattcatccaaccaaatgtgatctcaggaatccctatctatcgggtaatggatcgtcaggggcagataatcaaccctagtgaagacccccacctgcccaaggaaaaggtgctgaagctatataagtcaatgactctactgaacactatggacaggatcctgtatgaaagccagcgacaagggcgtatctcattttatatgacaaattacggggaagaaggcacccatgttggctcagccgcagcactcgataacacagacctcgtgttcgggcaatacagagaggcaggggtgcttatgtaccgcgattaccccctggagctcttcatggcccagtgttatggcaacatcagtgacctcggaaaagggaggcagatgccagtgcactatggatgtaaggagaggcactttgtgacgatctcatcccccttggccacccagataccacaggcagtgggtgctgcctatgcagctaagcgggcgaacgctaaccgagtggttatctgttattttggcgaaggagctgcctctgagggagatgctcacgccggtttcaacttcgctgccacactcgagtgtcccataatcttcttttgtagaaataacggttatgctatttccacacccactagcgagcagtatagaggggatggcatcgcagcaagaggacccggatacggaataatgagtattagggtggacggcaacgacgtgtttgctgtttacaacgccaccaaagaagcacgaaggagggcggtagctgagaaccaaccctttctgattgaggcgatgacctatcgtatcggccaccattctacaagcgacgacagctccgcctaccgaagtgtggacgaggttaactattgggataagcaggaccaccccatcagtaggctgcgacactatctcttgtcccagggctggtgggatgaagagcaagaaaaagcctggaggaaacagtccagaaggaaagtgatggaggcatttgaacaggccgagagaaaacccaagcccaatccaaacttactgttcagcgatgtctaccaggagatgcccgctcaactgaggaagcagcaagaatctcttgccagacacttgcagacctacggcgaacactaccctctagatcatttcgataaa

SEQ ID NO: 249562 - DNA, 1335 bp, Artificial Sequence
  Description of Artificial Sequence: Synthetic coding sequence
atggcagtggcgattgccgccgcacgggtgtggagactgaatcgaggcttgagccaagctgcgttgctgctgctgcgccagcctggcgcccggggtttggcccgttcccatccccccagacagcaacagcagttttcaagtttggacgacaagccacagttcccgggggcttccgccgaatttatagacaagctggaatttatacagccgaacgtgatatctggcattcccatctaccgtgttatggatcgccagggtcagattattaacccatctgaagacccccacctgccgaaagaaaaagttctgaagctgtataagagcatgacgctgttgaatactatggaccgcattctttatgaatcgcaacgtcagggaaggatttccttctacatgactaattacggtgaagagggaacccatgtcgggagcgcagcggcactggacaatacggatctggtgtttggccaatatcgggaggctggcgtccttatgtaccgcgactatccgctagagcttttcatggcccagtgctatggaaacatttcagacctcggcaagggccgccagatgcccgttcattatggttgcaaggagagacactttgtcacgatctccagtccactggccacgcagatcccccaggccgtcggcgccgcttacgcagcgaagcgggccaatgccaacagggttgtgatatgctattttggtgagggcgcagcatcagagggcgacgctcatgctggatttaactttgctgctacattggagtgtcccattatcttcttctgccggaataacgggtacgccataagcacgccgacatccgaacagtacaggggcgacggaatagcagcacgcgggcctgggtatggcattatgtcaatccgagttgatggaaacgacgtattcgccgtgtataatgcaacaaaggaagctcgccgtagagccgtcgctgagaaccagccattcctaatagaggcgatgacttaccgaatcggacatcatagtacgtcagacgactcctcggcctaccgaagcgtggatgaggtgaactactgggacaaacaggaccaccctattagcagacttcgccactatctccttagccagggttggtgggatgaggaacaggaaaaagcctggcggaaacagtcacggcgtaaagttatggaggcctttgagcaggcggagaggaagcctaagcctaacccaaacctcctattcagtgacgtatatcaggagatgcctgcccagcttcggaagcagcaagagagcctggccaggcacctgcagacgtacggggaacattatcctctggatcatttcgacaaa

SEQ ID NO: 249563 - DNA, 1335 bp, Artificial Sequence
  Description of Artificial Sequence: Synthetic coding sequence
atggcggtcgcaatcgctgcggcccgggtgtggaggctcaaccgcggcctctcgcaggctgcgctgttgctgctgcgccagccaggagcaaggggactggcgcggagccatccaccgcggcagcaacaacagttttcgagcctcgacgataagcctcaattcccgggcgccagcgccgagttcatcgacaagctggaattcatccagccaaacgtcatctcggggatccctatctacagggtcatggaccggcaaggacagatcatcaacccgtcggaggacccgcacctgccgaaggagaaggtccttaagctgtacaagtccatgactttgcttaacactatggacaggatcctctacgagtcacaaagacagggccgcatctcgttttacatgaccaactacggagaagaaggaactcacgtgggatccgcggcagcgctcgacaataccgatctcgtgtttggacaataccgcgaagctggcgtgctcatgtaccgcgattatcctctcgaattgttcatggcacagtgctacgggaacatctccgatcttggtaaggggagacagatgcctgtgcactacggatgtaaggaacggcactttgtgacgatctcatccccgttggccacgcaaatccctcaggctgtcggcgccgcttacgccgctaagcgggcaaacgccaaccgagtggttatctgctacttcggagagggagcggcaagcgagggagatgcacacgcgggctttaacttcgcggctaccctcgagtgccctatcatcttcttctgccgcaacaatggctacgccatctcaactccgaccagcgaacagtaccgcggagacggtatcgctgcaagaggcccgggctatgggatcatgagcatcagagtggacggaaacgatgtgttcgccgtatacaacgcaacgaaggaggcccgacggagggcagtggcagagaaccagccgttcctgatcgaggccatgacttaccgcatcggccaccattcaacttccgacgacagctcagcctaccggtccgtggacgaggtgaattactgggacaaacaagaccatccaatcagccgcctgcgccattacctgctgtcccaggggtggtgggatgaggaacaggaaaaggcctggcgcaagcaatcgcgccggaaagtgatggaagcatttgaacaagcagagcggaaaccgaagcccaacccgaatctcctgttttctgatgtttaccaagagatgccggctcagctgcgcaagcagcaagaatcgctcgcgcgccatctgcagacttacggcgagcactaccctctggaccacttcgacaag

SEQ ID NO: 249564 - DNA, 1335 bp, Artificial Sequence
  Description of Artificial Sequence: Synthetic coding sequence
atggcagtggcaatcgccgccgctagggtttggaggctgaatcggggactaagtcaggcagccctgctgcttcttaggcagccaggggcacgaggtctagcacgcagccacccgcctcgccagcagcagcaattctcaagcctcgatgacaagccccagtttcctggagcctctgccgaattcatcgataagctcgaattcatacagccaaatgtcataagtggtatcccgatctaccgcgtaatggacagacagggacagatcatcaacccttccgaagatccccatcttcccaaagaaaaagtactgaaactctacaagagcatgacgctgctgaacactatggaccgaattctctatgagtcacagcgccaggggagaatcagcttctacatgactaattacggggaagagggtacgcacgttggatccgcagcagcactagacaacactgacttggttttcggtcagtaccgcgaggcgggggtactaatgtaccgagactatccattagagcttttcatggcccagtgttatgggaacatctccgaccttggtaaggggcgccagatgccggtgcactacggatgtaaagaacgtcacttcgttaccatctcaagcccactggcaacccagatcccacaagcagtgggcgctgcttacgctgccaaaagagctaacgccaaccgggtggtcatatgttacttcggcgagggcgcggcctctgagggtgacgcgcacgcaggcttcaattttgcggctactctcgagtgtcctatcatcttcttctgcaggaacaacggctacgctatttccaccccaacgtccgaacagtatagaggggacggcatagccgcaaggggtccgggttatggcattatgagtattcgtgtcgacggaaatgatgttttcgctgtttacaatgccactaaagaggcccgtcgcagagcagtggcggagaatcagccatttttgatcgaggctatgacttatcgcatcggacaccactccaccagtgacgacagttctgcttatcggagtgtcgatgaggtgaattactgggataaacaggaccaccccatttcacggctgagacattatctcttgtctcaggggtggtgggacgaggagcaggagaaagcctggcgtaaacagtctaggcggaaggtaatggaggcgtttgagcaagccgagagaaaacccaagccaaatcccaacttactgttttcagatgtttatcaggagatgcccgcacaactgcggaagcagcaggaaagtctcgcccgtcacctgcaaacttacggcgaacactaccctctggaccatttcgacaag

SEQ ID NO: 249565 - DNA, 1335 bp, Artificial Sequence
  Description of Artificial Sequence: Synthetic coding sequence
atggccgtcgccatcgccgctgcccgggtgtggaggctgaacaggggtctgtcccaggcagccctcctcttgcttagacagcctggcgcacgcggcctcgctcgctctcacccccctcgtcagcagcagcagttctcttccctggacgataaaccacagtttcctggggcaagcgccgagtttatcgataagctggaatttatccagccgaatgtgatctctgggatccccatatatagagtcatggatagacagggccagataatcaacccgtctgaggatccacacctgccgaaagagaaagtgctcaagctgtacaaaagcatgacactcctaaacaccatggatagaattttgtatgaaagtcagagacaaggtcgtattagcttttatatgacgaactacggcgaagaaggcacacacgtaggctcagccgctgcattggacaatacagatcttgttttcggccagtacagggaggcaggggtcctaatgtatagggattacccgctggagttattcatggcacagtgctacggcaacatttctgacctggggaaaggccggcagatgcctgtgcattacgggtgcaaggagagacacttcgtgaccatcagtagtccgctggccactcaaatcccccaggccgtgggtgccgcatacgcggccaagagggctaatgctaacagggtggtaatctgttatttcggggagggggcagcaagcgagggtgacgcacacgctggattcaattttgcggctaccctggagtgcccaataatcttcttctgcaggaataatggatacgccatatccacacccacctcagagcagtaccgcggagatggcatcgctgcaagaggccccggctacggaataatgagtatccgcgtggatggaaacgatgtcttcgccgtgtataacgccacaaaagaggcaaggcgacgcgccgtggctgagaaccagcccttccttattgaggctatgacatatagaattggccaccattctacctccgatgattctagcgcttatcggtctgtagatgaggtgaactattgggacaaacaagaccaccctatatcacgactgcgacattacctgctcagccagggatggtgggacgaagagcaggaaaaggcctggagaaagcagtcgcgcagaaaggtaatggaagctttcgagcaggcggagagaaaacctaagcctaatccaaacttgctgtttagcgacgtctatcaggaaatgcctgcccagttaaggaagcagcaggagtcacttgcccggcacctgcagacctacggcgaacattaccccttggaccacttcgacaaa

SEQ ID NO: 249566 - DNA, 1335 bp, Artificial Sequence
  Description of Artificial Sequence: Synthetic coding sequence
atggcagtggcgatcgccgccgcgcgggtgtggaggctgaacagaggactgagccaagccgcccttctgctcctgagacagccgggagcgagaggactggcaagatcccatccgccgagacagcaacagcagttttcctcgctggatgataagcctcagtttcctggggcctccgccgaattcatcgataaactggagttcatccaaccgaatgtcattagcggaatcccaatctaccgggtgatggaccggcagggacagattatcaatccatccgaggacccgcatcttcctaaagaaaaagttctgaagctctataagtctatgaccttgctgaacaccatggaccgcattctctacgaatcgcagcggcagggaagaattagcttctacatgactaactacggggaagaaggaacccacgtcgggtccgccgccgcgctggataatacggatctggtgtttggacaataccgggaggccggagtcctgatgtatcgcgattacccgctggagctctttatggcgcagtgctacggaaacatctcagacctgggaaaaggtagacagatgccggtgcactacggatgcaaagagcgccacttcgttaccatctcttcccctctggcaacccaaatccctcaagccgtcggagctgcctacgcagccaagcgggcgaacgccaacagagtggttatctgctacttcggcgaaggagcggctagcgagggagatgcgcacgccggtttcaacttcgctgctaccctcgagtgtcccatcattttcttctgtaggaacaacggatacgctatctccaccccgacctcagaacagtaccggggtgacggtatcgccgcacgggggccgggatacgggatcatgtccatccgcgtggacggcaacgacgtctttgctgtgtacaacgcaacgaaggaagcgagacgccgggcggtggctgagaatcagcccttccttatcgaagctatgacttatcgcatcggccatcactcaacctcagacgatagctcagcttaccgctcggttgacgaggtgaactactgggacaagcaggatcacccgatctcacggcttcgccactacctcctgtcacagggctggtgggacgaggagcaggaaaaggcatggcggaagcagagccgccgcaaggtgatggaggcattcgaacaggcggaacggaagccgaaaccaaatccgaatctcctgttctcggatgtgtaccaggaaatgcccgcccaactgaggaaacagcaggagtccctggctcgccacctccagacctacggggaacattacccgttggatcacttcgacaaa

SEQ ID NO: 249567 - DNA, 1335 bp, Artificial Sequence
  Description of Artificial Sequence: Synthetic coding sequence
atggctgtggccatagccgctgcccgtgtgtggagacttaaccgaggactgtcccaggccgcgttgctgctcctgcggcagcctggcgccaggggcctggctagatcacacccacctcgccaacagcagcaatttagctctttagacgacaaaccgcaattccccggagcgtctgcagaatttattgataagctggagttcattcagcctaatgtgatcagcggaattccgatctatcgcgtaatggaccggcagggtcagatcatcaacccctctgaagacccccacttacccaaagaaaaagtcctcaagttgtacaaatctatgaccctcctcaataccatggacagaatcctctatgagagccagagacaaggacggatatccttctatatgacaaactatggcgaagaaggtacgcacgtgggctctgctgctgcactggataacaccgacctggtcttcggccagtaccgtgaagccggcgtgttaatgtatcgggattatccgctggagctcttcatggcccagtgctatggcaatatcagcgacttaggaaagggaaggcagatgcccgtacactatgggtgcaaggaaagacatttcgtgacaatttccagccccttggctacccaaatcccccaagctgtgggcgcggcgtacgccgcaaagcgcgctaacgcaaacagagttgtcatctgttacttcggagagggtgcggcaagcgagggagatgcacacgctggttttaactttgcggctacgcttgaatgtccaataatcttcttctgccggaacaatggctacgccatttcaacacctactagtgagcagtacaggggagacgggatcgccgccagaggcccaggttatggcataatgagcattagagtcgacgggaacgacgtgttcgccgtctacaacgcgacgaaagaggcccgccgtcgcgctgtggccgagaaccagcccttcttaattgaggctatgacttaccggatcggccaccactcaacctccgatgactcttctgcctataggagcgtggacgaggtgaactactgggacaagcaggatcatccgatctcaagattgcgtcactatctgctgagtcagggctggtgggatgaggagcaggagaaagcatggcggaaacagtcgaggcggaaagtgatggaggccttcgaacaggcagagcgcaagccaaagccaaatccaaacctgctattcagcgatgtgtaccaggagatgcccgcccagctgcggaaacagcaggagtcactggcccgacatttgcagacctacggtgaacactacccgctggatcatttcgacaag

SEQ ID NO: 249568 - DNA, 1335 bp, Artificial Sequence
  Description of Artificial Sequence: Synthetic coding sequence
atggccgtggccatcgctgccgccagggtgtggagactgaacagaggcctgtctcaggctgctcttctgcttctgagacagccgggagccagaggcttggcacgctcccatccgccacgccaacagcaacaattctcctctcttgacgacaagccccagttcccaggcgcatccgcggagttcattgataagctcgagttcatccagcccaacgtgatctccggaattcctatttacagagtgatggaccgccagggccagatcatcaatcccagcgaggacccgcacctgccgaaagaaaaggttctgaagttgtacaaaagtatgacacttctcaacaccatggaccgcatcttgtacgagagccaacgccaaggtagaatatccttctatatgaccaattatggcgaggaaggaacccatgtgggtagcgccgcagctctggataataccgacttggtcttcggtcagtatcgcgaggctggcgttttgatgtacagagactaccctttggaactgtttatggcgcagtgttacggtaacattagcgatcttggtaagggtagacagatgccggtccactacggatgtaaggaaaggcacttcgtaacaatttctagcccacttgccactcaaatacctcaagccgttggcgccgcctatgcagccaagcgcgcaaacgcaaaccgcgttgtcatatgctacttcggtgagggagctgcttccgaaggcgacgcgcacgccggtttcaacttcgctgccaccctggaatgccccataatcttcttctgtagaaacaacggttacgcgatctccactcctacctctgaacaatacagaggtgatggcatcgcggccaggggaccaggttacggaatcatgtctatcagggtcgacggaaatgatgtcttcgcggtgtacaacgccaccaaggaggctcgcagacgcgcagtagcggaaaaccaacctttccttatagaggctatgacatataggatcggccaccattctacctccgatgacagtagtgcctacaggtctgtggacgaggtgaactactgggacaaacaagaccatcctattagtagattgaggcattacctcctgagccagggatggtgggacgaggagcaagagaaagcttggagaaaacaatctcgcagaaaggtcatggaagctttcgagcaagctgaaaggaaaccaaagcctaatcctaatctgttgttctcagacgtgtaccaagagatgccggcccagctgcgcaaacagcaggagagcttggcgaggcacctgcagacatatggcgagcactacccactcgatcactttgataag

SEQ ID NO: 249569 - DNA, 1335 bp, Artificial Sequence
  Description of Artificial Sequence: Synthetic coding sequence
atggcggtcgctattgccgctgctcgcgtgtggaggctcaaccgcgggctcagtcaagctgccctcttgttgcttcgtcagccgggcgcgagaggattggctagaagccatcctccacgacagcagcaacaattctctagtttggatgataaacctcagtttcccggagcgtctgctgaattcatcgataagctggagttcatccagccaaatgtgattagtggcattcctatatatcgggtaatggaccgacagggtcagatcatcaacccgtccgaggatccccatttacctaaggaaaaggttctgaaactgtataaatcaatgactctcctcaacacaatggaccggatactttatgagtcccagcgccaaggtcgtatatcgttctatatgacaaactacggggaagagggtactcatgttggttctgccgctgcactcgacaacaccgatttggtattcgggcaatacagggaggctggcgtgctcatgtatcgtgactatccattagaactgtttatggcccagtgctatggcaacatctccgaccttggaaaggggcggcagatgccagtgcactatggctgcaaggagagacacttcgtcaccatctcgagcccccttgcgacccagatccctcaagcagttggagctgcatatgcggccaagcgagccaacgcaaacagagttgtaatctgttactttggcgaaggcgcagcctcagagggcgacgctcacgccggatttaactttgcggcaacactagagtgccctattatattcttctgccgtaacaacggatacgctatttccacaccaacgtccgaacaataccgcggggatggcatcgctgctcgtggccccggctacggcattatgagcatcagagtcgatggcaatgatgtttttgccgtgtataacgccactaaagaggctcgtcgccgtgctgttgctgagaatcagccttttctcattgaagctatgacgtaccgaattggccatcactccacaagtgatgattctagcgcgtaccgatcagttgacgaggttaactattgggataagcaggaccaccccatctcccgcttacggcactatctccttagtcagggctggtgggatgaggagcaagaaaaggcatggcggaagcagagccgaagaaaggtcatggaggcattcgagcaggcggaacgcaaaccgaagccaaatcctaatctccttttcagcgatgtttaccaggaaatgcccgcccaacttaggaagcagcaggaaagtttggctcggcacctccagacttacggagagcattatccattagaccattttgacaag

SEQ ID NO: 249570 - DNA, 1335 bp, Artificial Sequence
  Description of Artificial Sequence: Synthetic coding sequence
atggcagttgccatcgcggctgcacgagtgtggcgacttaatcgcgggctgtcccaggcggcgctgctgctgcttaggcaaccgggtgcacgtgggttggcacggagccatcccccaagacaacagcaacaattttcatcgctggatgataagcctcaatttcccggagcgtccgccgagtttattgacaagctcgagttcatccagccaaacgtcataagcggaattccgatctaccgagtcatggaccggcaaggacagataatcaacccttcagaagatccacaccttccgaaggaaaaggtgcttaagctgtacaagtcgatgactctgcttaatactatggatcggattctttacgagtcccagagacagggacggatttcgttctacatgaccaactatggtgaagagggtactcatgtgggatcggccgcagctttggataacacggatctggtctttggccaataccgagaggccggagtgcttatgtatcgtgactaccctttggaacttttcatggcccaatgctatggcaacatttcggacctgggaaagggtaggcagatgcccgttcactacggatgtaaagaaaggcatttcgttaccatttcgagccctctggcaacccagataccacaagcagtgggagcagcctacgcagcaaagagagcaaatgccaatagagtggtgatctgttactttggcgaaggagccgcctcagagggagacgcacatgcaggtttcaatttcgccgccactctggagtgtccaataatctttttctgccggaacaacggttacgccattagcactcctacttcagagcaatatcggggagatggaatcgcagcacgtggcccagggtacggaattatgtcgatacgcgtggacggtaacgacgtctttgccgtgtacaacgctactaaggaagcacggagaagagccgtagcggagaaccaaccattcctgatcgaagcaatgacttacaggattggtcaccattctaccagcgatgactcgtccgcgtacaggtcggtggatgaagtgaattactgggataagcaggatcaccccatatcgaggctcagacattacctgctttcgcagggctggtgggatgaagaacaagaaaaggcgtggaggaagcagagccggcggaaagtcatggaagcgttcgagcaagccgaacgaaagccaaaacctaatcctaatcttctcttttccgacgtgtaccaagaaatgcctgcccagcttagaaaacagcaagaaagcctcgcaagacacctgcaaacctacggagaacattacccgctcgatcattttgataaa

SEQ ID NO: 249571 - DNA, 1335 bp, Artificial Sequence
  Description of Artificial Sequence: Synthetic coding sequence
atggccgtggctattgcagcagcaagggtgtggcgcctaaatcgtggtctgtcacaggcagcattactgttgttaaggcagcctggggcccgggggctggcccgcagtcatcctccacgccagcagcaacagttctcaagtctggacgataagccacagtttcccggagcttctgccgaatttatcgataaactcgagtttatccagcccaatgtgatttcagggattccgatctatagagtgatggatcggcagggacagataattaacccaagtgaggacccccacctccccaaggaaaaggtgctgaagctatacaagagcatgacactgctgaacactatggaccgaatattgtacgagtcccagagacagggtcggatttccttttatatgacaaactatggggaggagggcactcatgtgggctctgcagccgctttggataacactgacttggttttcgggcagtaccgcgaggccggcgtcttaatgtacagggactatcccttggaactgtttatggctcaatgctatgggaacattagcgacttgggcaaaggccgccagatgccggtgcattacggatgtaaagaacgtcattttgtgacgatttcttctcccttggctactcaaatcccccaggcagtaggagccgcttatgctgcaaaacgggcaaatgccaatcgcgttgtaatctgctacttcggggaaggcgcggcatctgagggcgatgctcacgcaggcttcaactttgctgctactctggagtgcccaataatattcttctgccggaataatggctacgcaattagcacacctacttccgagcagtataggggcgacggaatagccgccagagggccaggttatggcatcatgtctatccgcgtggatggtaacgatgtgtttgcggtgtacaacgctacaaaagaagcaaggaggcgagcggtggcagagaaccagcctttcctgattgaggccatgacctatcggatcggccaccatagcactagtgacgattcttcagcctaccgtagcgtggacgaggtaaactattgggataagcaggatcaccctatttcccggctacggcattacctactttcacagggttggtgggacgaagagcaggaaaaggcatggaggaaacagtccaggagaaaggtgatggaggcttttgaacaggctgagcggaaacctaaacctaacccgaatctcctgttttctgatgtctatcaggaaatgcctgctcagctgcgcaaacagcaagagtccctggctaggcacttacagacctacggagagcattacccactggaccactttgataaa

SEQ ID NO: 249572 - DNA, 1335 bp, Artificial Sequence
  Description of Artificial Sequence: Synthetic coding sequence
atggccgtcgccatagctgctgcaagagtgtggaggcttaaccgcggcctgtcacaagccgcgctcctccttttacggcagcccggcgcgcgcggcctggctcggtctcatccaccaaggcagcagcagcagttctcttcactagacgacaaaccccagttcccgggcgccagcgccgaatttatcgataaactggaatttatccagccgaacgtgattagcggaatacctatctatcgggtaatggacagacagggacagataatcaaccctagcgaggacccacatcttcccaaggaaaaggtgctcaagctctataaatcaatgacactgttgaatactatggatcggatattgtacgagtcacagcgccagggacggatcagcttttatatgaccaattacggagaagagggcacacatgtggggagcgctgcagcccttgacaatactgacctggtgtttggacaatatagagaggccggagtgctcatgtatagagattaccccctggagctgtttatggcgcaatgctacggcaatatctcagatctcggtaagggaaggcagatgcccgttcactacggctgcaaagagagacattttgtcacgatcagctccccactggctacacagattcctcaggcagtgggcgccgcctatgctgccaaaagggccaacgcgaaccgagtagtgatctgttactttggggaaggagcagcctctgagggagacgcgcatgctggtttcaatttcgcggcaaccctggagtgccccatcatctttttctgtcggaataacgggtacgcaatcagcacccccacatccgagcagtataggggagacgggatagctgccagaggaccaggttatggtataatgtccattcgcgtggacggcaacgacgtattcgctgtgtacaacgccacaaaagaagcgagacgccgagcagtcgccgaaaaccagccgtttctgatcgaagctatgacatatagaatcgggcaccatagcacttcagatgatagctccgcctataggtccgtggacgaggttaactattgggataagcaagatcatccaatctcacgccttagacattatctccttagccaaggatggtgggacgaggaacaagaaaaagcttggagaaaacaaagcaggcgtaaggtaatggaggcgttcgaacaggccgagcgaaagcctaaacctaatcccaatctgttgttctcagacgtgtatcaggaaatgcccgcacagcttagaaagcagcaggagtccctggcccggcacctgcaaacctacggcgagcattacccactggaccactttgacaaa

SEQ ID NO: 249573 - DNA, 1335 bp, Artificial Sequence
  Description of Artificial Sequence: Synthetic coding sequence
atggccgtggcgatcgctgccgcccgagtgtggaggttaaaccgcgggttgagccaggctgctctgctccttctccgccagcccggtgctcggggattggcacgatctcatcctccgcggcagcagcaacaattctcttctctggatgacaagccgcaattcccaggcgcttctgcagagttcatagacaagctggagttcattcagccgaacgtcatttccggcatccctatttatcgggtgatggacagacaggggcagattataaacccctccgaagatcctcatctgcctaaggagaaagtcctgaagctgtataaatctatgactttgttaaatacgatggacagaatcctatatgaatcccagagacagggccggatatctttctacatgacaaattatggcgaggaaggcacacatgtggggtctgcagctgctctggacaatactgatctcgtcttcggtcagtacagagaggcaggtgtcctgatgtatagagactatcctctcgaattatttatggctcagtgctacggcaatatctccgacttgggtaaaggccgtcagatgcctgtccactatggatgcaaggaaagacatttcgtgactattagttcccctctggcaactcagatccctcaagccgtgggggccgcgtatgctgcaaaacgcgcaaatgccaatagggtcgttatatgctattttggcgagggagcagcctctgagggcgacgcccacgccggctttaatttcgcggccacccttgagtgtcccattattttcttctgcaggaacaacgggtatgcaatatctacgcctaccagtgaacagtaccgcggggacggcattgccgctcggggcccgggctacggcattatgagcatacgggtggacggaaacgacgttttcgcagtctataacgccaccaaggaggcccgaaggcgcgcagtggccgagaaccagcccttcctgattgaggcaatgacatatagaatcggccatcacagcacctcggacgatagcagtgcctatagatctgtggacgaagtcaattattgggacaaacaagatcaccctatctcacgactgcgtcactacctcctgtcgcagggctggtgggatgaggaacaggaaaaagcctggcggaagcaatccaggcgcaaggtcatggaagctttcgaacaggcggaaagaaaacccaagcctaatcccaatctgctttttagtgatgtgtaccaggagatgcccgcgcagctccgaaagcagcaggagtcactcgctcgacaccttcagacctacggcgagcactacccactggaccactttgacaag

SEQ ID NO: 249574 - DNA, 1335 bp, Artificial Sequence
  Description of Artificial Sequence: Synthetic coding sequence
atggccgtggcaatcgccgcagcaagggtgtggcgcctgaatagggggctttcgcaagcggcacttcttcttctcaggcagcccggagcccgtgggcttgcaagaagccatcctccgcggcaacaacagcagttttcatcgcttgacgataagccacaattcccaggtgcatccgcagagttcatcgataagctcgagtttattcagcctaacgtgatttcgggtatcccaatttaccgcgtcatggacaggcagggtcaaatcataaatccttcagaagatccacatttgcctaaggaaaaagtgctgaaactttacaaatccatgaccttgcttaacactatggaccgcattctctacgaatcacagcgacaaggccgtatttcgttttacatgacgaattacggagaggagggaactcacgtcggcagcgccgcagccctggacaacactgaccttgtgtttggacaataccgagaggcaggagtcctcatgtacagagattaccctctcgaactgtttatggcccaatgctacggtaacatctccgatcttgggaagggtcgccagatgcctgttcattacgggtgtaaagaacggcatttcgtgaccatttcctccccccttgcaactcaaatccctcaggccgtcggtgcggcgtacgcggcaaagagggccaatgccaatcgggtggtcatttgctactttggtgagggcgccgcgtcagaaggagacgcccatgcaggtttcaactttgccgcaaccttggaatgtccaatcattttcttctgtaggaacaatggatacgcaatatcaacgccgactagcgagcaataccgcggagatggcattgcagccagaggtcccggatacgggattatgagcatcagagttgatggcaacgatgtttttgcggtgtataacgcaactaaggaagcacgcaggcgtgcggttgccgaaaaccaaccatttcttatcgaagcaatgacctatagaatcggacatcattcgactagcgatgatagctccgcctaccggagcgtcgatgaagtgaattactgggacaagcaggatcatccaatttcacgccttagacattacctgctctcccaaggatggtgggatgaggagcaggaaaaggcctggcgcaagcaatcgagacggaaagtgatggaagcgttcgaacaggccgaacgtaagcccaagcccaaccctaacctgctgttttccgacgtgtatcaggaaatgcctgcacagctgaggaagcagcaggagtcacttgcccggcatcttcaaacttacggtgaacattaccctctggaccattttgataaa

SEQ ID NO: 249575 - DNA, 1335 bp, Artificial Sequence
  Description of Artificial Sequence: Synthetic coding sequence
atggctgtggcaatcgcggcagcccgggtgtggcgcttgaaccggggactgtcccaagccgcgctgctgctgctgaggcagccaggagcccggggcctcgcaagaagccaccctccccggcagcagcaacaattctcctccttggatgacaagccgcagttcccaggagcgagcgctgaattcattgacaaattggagttcatccagccaaatgtgatctcgggcatcccaatctaccgggtgatggaccggcagggtcagatcatcaacccttcggaagatccacatctgccgaaagagaaggtgctgaagctctacaaatctatgaccctgctgaacactatggaccgtatcctctacgagtcccagcggcaggggcggatctcattctacatgaccaattacggagaggagggaacgcatgtgggatccgcggctgctctggacaacaccgacctggttttcgggcaatacagggaagctggagtgctgatgtaccgagactacccgctggaactgttcatggcccaatgctacggtaacatttcggacttgggaaagggaaggcagatgcctgtgcattacggctgcaaggaacgccacttcgtcactatcagttcaccgctcgccacccaaatcccacaagccgtgggagcagcgtatgcagccaaacgcgcgaatgcaaaccgcgtggtgatctgttactttggagagggtgcagcatcggagggggacgcgcacgcaggattcaatttcgcagctacccttgagtgcccgatcatcttcttctgcagaaacaatggttacgctattagcaccccgacctcagaacaatacaggggagacggcatcgctgctaggggcccgggctacggaatcatgagcatccgggtcgacggcaacgatgtgtttgcagtgtacaacgctactaaggaggctcggaggagagcagtcgccgagaaccagccgttcctgatcgaggcgatgacgtacagaattggacaccattcaacctccgacgactcgtctgcataccgatccgtggacgaagtcaactactgggataagcaggatcatccaatcagccgactccgccactacctgctgtcccaggggtggtgggacgaagagcaagagaaggcttggagaaaacagtcgcggagaaaggtgatggaggcattcgagcaagccgagagaaaacccaagccaaacccgaatctgcttttcagcgacgtctaccaggaaatgccggcccaactgcggaagcagcaagaatcactggcgaggcatcttcagacctacggagaacactatccgctggatcacttcgataag

SEQ ID NO: 249576 - DNA, 1335 bp, Artificial Sequence
  Description of Artificial Sequence: Synthetic coding sequence
atggcagttgcgattgcggcagcaagagtctggaggcttaaccgcggcctctcccaggccgcacttttgttgctgcgtcagccaggagcacggggacttgcacggtcgcatcctcctcggcaacagcagcaattttcctcgcttgatgataagcctcagtttccaggagcgtcggccgagttcattgataaacttgagtttatacaacccaacgtgatttcgggcatcccaatctacagagtgatggataggcaaggtcagatcatcaatccatcggaggacccccatctgcctaaggagaaagtcctgaaattgtacaagtcgatgaccctgctgaataccatggataggattctctatgaatcacaacggcaaggtcgcatatccttctacatgactaactatggcgaagaaggaactcatgtgggttcggctgcggcacttgataacactgacttggtgtttggccagtaccgggaagcgggagtgctcatgtacagggattatccccttgagctgtttatggcccagtgctacggcaacatttcggacctcggtaaggggagacaaatgcctgtgcattacggatgtaaggaacgtcacttcgtgacgatctcctcccctctcgccacccagatccctcaagcagtgggagcagcatatgcggcgaagcgagctaacgccaacagagttgtaatctgttacttcggagagggtgcagcatctgagggagatgcccatgccgggtttaactttgcagccaccctggaatgcccgatcattttcttttgtcgaaacaacggatacgcaattagcacccctacttcggaacagtaccgtggcgacgggatcgctgcccggggtccaggctacggaataatgtccatacgtgtggatggaaacgatgtgtttgctgtgtacaacgcaaccaaagaggcacgacgaagagccgtcgcagaaaaccagcctttcttgattgaagcaatgacttaccgtattgggcatcattcaacctccgacgactccagcgcataccgcagcgtggacgaagtgaactactgggacaagcaggatcaccccattagccggctgagacattacctcctgtcgcaaggatggtgggatgaagaacaagagaaagcctggagaaagcaaagcaggcgcaaggtcatggaggctttcgagcaagcagaacgtaagccaaagcctaacccaaacctcctcttctcggatgtttaccaagaaatgccagcccagcttcgtaagcagcaagaatcgcttgcccgtcacctgcaaacttacggggagcactacccactggatcatttcgataag

SEQ ID NO: 249577 - DNA, 1335 bp, Artificial Sequence
  Description of Artificial Sequence: Synthetic coding sequence
atggctgtggcaattgccgcagctcgcgtgtggcggctcaaccgcgggttgtcgcaggccgctctgctgctgttgcgccagcctggcgctagaggactagcgagaagccatcccccgcgccagcagcaacagttttcctccctggatgataagccgcagtttcccggagcctctgcagagtttattgataaactggagtttattcaaccgaacgttatatctggaatcccgatctaccgtgtgatggatcgccaaggccagatcatcaatcccagtgaagacccccacttaccaaaggagaaggtcctaaaactgtacaagtctatgactttgcttaacaccatggatcggatcttgtatgagtcacagcgacagggaaggatttcattctacatgaccaattacggggaagagggcacacatgtggggagcgcagcagcactggataatacggacctggtgttcggtcagtacagggaggccggtgtgctgatgtaccgggactaccccctggagttgttcatggcccagtgctatggcaacatcagtgacctggggaaaggccgacagatgccagttcattatggctgcaaggaacgacatttcgtgactatctcgagtccccttgccacacagattccgcaggcagtgggggcggcctatgcggctaagcgcgctaatgccaatcgagtggtaatctgttactttggcgagggagcagccagtgaaggagacgcccatgcgggattcaactttgccgccacccttgaatgcccaataatctttttctgccggaataacgggtacgctatctcaacccctacatccgagcagtacagaggcgacggtatagcagctaggggccccggttacggaatcatgtcaattcgggtggacggcaatgatgtattcgccgtgtataatgcgacaaaagaagctagacggcgggccgttgccgaaaatcagccttttctcatcgaagccatgacctatcgcattggtcaccactctacgtcagacgatagtagcgcataccgatctgtggacgaggtgaactattgggataaacaggaccaccccataagtcgcctccgccactacctgctttcacagggctggtgggacgaagaacaagaaaaggcatggcgaaagcagtccaggcggaaggtgatggaggcgtttgagcaggccgaacggaagcctaagcccaaccccaatctcctgtttagcgacgtttaccaggagatgcccgcccaactgaggaaacagcaggagagccttgcccgccatctgcagacatacggcgaacactacccacttgatcatttcgataag

SEQ ID NO: 249578 - DNA, 1335 bp, Artificial Sequence
  Description of Artificial Sequence: Synthetic coding sequence
atggcagtggcaatcgcggcagcccgggtgtggcgtctcaaccgaggcctttcacaggcagcactgcttcttcttcgacagccaggggcacgagggctcgcacggtcacacccacccagacagcaacaacagtttagctctttggatgataagccacaattcccaggagcaagcgcagagttcatcgacaagttggaattcatccaacctaacgtgatttcaggaattcctatttaccgcgtcatggaccgccaaggccagattatcaacccttccgaggatccgcatctgccaaaagaaaaggtcttgaagctctacaaatcgatgacgctcctgaataccatggataggatcctttacgaaagccaaaggcagggtcgaatttcgttttacatgaccaattacggtgaggaagggacgcacgtcggtagtgcggcagccctcgacaataccgaccttgtgttcggacaatatcgggaggccggagtgctgatgtacagagattacccactggaattgttcatggctcagtgttacgggaacatatcggatctgggtaaggggagacaaatgccagttcactatggatgtaaggaacggcattttgtgactatatcctccccactcgcaacgcagatcccacaagcagtgggtgccgcttatgcagcaaaacgggctaacgctaatagggtggtgatctgctactttggagagggagcagcgtctgaaggggatgcgcatgcaggattcaattttgctgccactcttgaatgcccgattatcttcttttgtagaaataacgggtacgccattagcaccccgacttcggaacaataccgcggtgacggtatagcggcacgcggtccagggtacggaattatgtccatacgagttgacggaaacgacgtgtttgccgtgtacaacgcgactaaagaagcacggagaagagccgttgccgagaaccagccttttcttattgaagcaatgacttaccgcattggacaccactcgacctcggatgactcctctgcctacaggtccgtagatgaagtgaattactgggacaaacaagatcatcctatttcaagactgcggcattacctgcttagccaaggctggtgggatgaagagcaagagaaggcctggagaaagcagtccagacgcaaggtgatggaagcgtttgaacaggcagagcgcaaacccaagcctaaccctaacctccttttttcggatgtttaccaagaaatgccggcccagcttaggaagcaacaagagagcctggcaaggcatcttcagacttacggagagcactaccctttggatcacttcgataag

SEQ ID NO: 249579 - DNA, 1335 bp, Artificial Sequence
  Description of Artificial Sequence: Synthetic coding sequence
atggccgtggctatcgcggcggcgcgggtctggcgcctgaatcggggcctgtcgcaggccgccctcctgctgctcagacaacccggcgcacgcggcctcgcgcgctcccaccctccgcgccagcaacaacagttctcaagcctcgacgataagccacaattccctggagcctcagccgagtttatcgacaaactggagtttatccagccgaacgtgatctcagggatcccgatctaccgggtgatggatcggcaggggcagattatcaacccgtccgaggacccgcatctgcctaaggagaaagtgctcaaactctacaagtcgatgactctcctgaatactatggatcggatcctgtacgagagccagagacaggggcgcatctccttttacatgaccaactacggtgaagagggcactcatgttggctcggccgctgcactcgacaacacggatctggtgttcggacagtaccgggaagcgggggtgctgatgtacagggactaccctctcgaactgttcatggcccaatgctacggtaatatcagcgacctcggaaagggtcggcaaatgccggtgcattacggatgcaaagaacgccacttcgtgactatctcctcgccactggctactcagattccacaagcggtcggagccgcgtatgcggcgaaacgcgctaatgcgaaccgcgttgtgatttgctacttcggcgaaggtgccgcgagtgaaggagacgcccacgcagggtttaacttcgccgccacgctggagtgtccaattatcttcttttgccgcaacaacggctacgccatctccactcccaccagcgaacaataccggggtgacgggatcgcggcccgcggcccgggctatggaatcatgagcatccgggtggacggaaatgacgtctttgccgtctacaacgctactaaggaggccaggcgccgggcagtggcagaaaaccagcctttccttattgaagcaatgacctaccggattggacaccactccaccagcgacgatagctccgcgtacagaagcgtcgacgaagtgaactactgggataagcaagaccacccaatctcccggctcaggcattacctcctcagccagggctggtgggacgaagagcaggagaaggcctggcgcaagcagtcgcggcgcaaagtgatggaagcgtttgagcaggcagaaagaaagcccaagccaaatccaaaccttctcttctcggacgtgtaccaggagatgcctgcccagttgcggaagcagcaggaaagcctggctcgccatctgcagacttacggagagcattacccactggatcactttgacaaa

SEQ ID NO: 249580 - DNA, 1335 bp, Artificial Sequence
  Description of Artificial Sequence: Synthetic coding sequence
atggctgttgctatcgctgccgcacgcgtatggcggctgaatagaggcttgagtcaggcggcgcttcttctcctgcgacagccgggggctcgcggactggcgagaagtcacccaccaaggcagcaacagcaattctctagtctcgatgacaaacctcagttccctggcgcaagcgcagaatttatagacaagctcgaatttatacagccaaatgtcatctcagggatacctatctatcgggtgatggaccgccagggtcaaataatcaatcccagtgaagatccacacctgcctaaagaaaaggtccttaaactgtacaagtctatgacactccttaacactatggacaggatactgtacgagtcccagaggcagggaagaattagtttttatatgaccaactacggagaggagggaactcacgtgggtagtgcggctgctctcgacaacacggatctggtatttggccagtatcgggaggccggcgtcctcatgtaccgagactatcccctggaacttttcatggctcagtgctacggtaacataagcgatctggggaagggcaggcagatgcccgtgcactacggctgtaaagagcggcatttcgtcacaatcagctctcctctggccacccagattccacaggcagtaggtgccgcttacgccgccaagagggcaaatgcaaatagagtggtcatttgctatttcggagagggggccgcctctgagggagacgcccacgccggttttaacttcgcagcaacgctcgagtgtcccatcatcttcttttgcagaaataatgggtacgccatttcaactccaacgagcgagcagtacaggggggacggcatcgctgcccgcgggcccggttacggaattatgagcatcagagtggacggcaacgacgtattcgcggtatataacgccactaaagaagctagacggcgcgctgtcgctgaaaaccaaccattcctgatcgaggcaatgacatataggattgggcaccactctacttctgacgactcatctgcttatcgcagcgtggacgaagtgaattactgggataagcaggatcacccaatctctcggctgcggcattacctgctcagtcagggctggtgggacgaagagcaggaaaaagcttggcgcaaacagagtagaagaaaagttatggaggcctttgaacaggcagagagaaagcccaaaccaaatcctaaccttctgttctccgacgtctaccaggaaatgcctgcccagctgaggaagcagcaggaaagtctggctagacatctgcagacttacggggagcattacccgctggaccacttcgataag

SEQ ID NO: 249581 - DNA, 1335 bp, Artificial Sequence
  Description of Artificial Sequence: Synthetic coding sequence
atggccgttgccatcgctgccgctcgtgtctggcgtctgaatcgcggcttaagtcaggctgcactgctgctgctgcgacaacccggcgctcgcggactcgcacggtcacacccgccccggcagcagcagcagtttagtagtttagatgacaagccacagttcccaggagcttccgctgaatttatcgataaactggagttcattcagccgaacgtcatttccggaattccaatctacagagttatggaccggcagggacagataatcaatccctccgaagacccccatttaccgaaagagaaagtactaaagctgtacaagtcaatgaccctcctgaatacaatggatagaattctctatgagagccagcgccagggtaggattagcttctacatgacaaattatggtgaagagggtacacacgtgggctctgctgccgcgctcgacaacaccgacctagtttttggacagtacagggaagccggagtgctcatgtaccgagactatcccctggagctattcatggctcagtgctacggaaatatttcagacttgggtaaggggcgccagatgcctgtacactatggatgtaaggagaggcacttcgttacgatcagttcccctctggcaactcagattcctcaggcagtgggcgcagcatacgccgccaagagggctaatgcaaatagggtagttatttgttacttcggcgaaggagccgcctctgaaggagatgcccacgcgggcttcaatttcgccgccactctcgagtgccccatcattttcttctgccgcaataatgggtacgcaattagcaccccaaccagcgagcagtatcgcggcgatggaatcgctgcacgcggcccaggatatggcataatgtcaatacgtgtggatggcaatgacgtgtttgcagtttacaacgccaccaaggaggcacggagacgggcagtagccgaaaaccagccctttctgatagaagcaatgacctatcggattggccatcatagtacgagtgatgactcaagtgcttataggtccgttgacgaggtaaattattgggacaagcaggaccacccaatctccagactgcggcattatctgctgtctcagggatggtgggacgaggagcaggagaaagcctggcgcaagcagtccaggagaaaggtgatggaagcgttcgaacaggcagagagaaagccaaagcccaaccccaatttactgttctctgatgtctatcaggagatgcctgcacagctcagaaaacagcaggaaagcctcgctagacacctgcagacttatggggaacattatccattagatcatttcgacaag

SEQ ID NO: 249582 - DNA, 1335 bp, Artificial Sequence
  Description of Artificial Sequence: Synthetic coding sequence
atggctgtcgcaatcgctgccgcgagggtttggagactaaatagagggctgtctcaagcagctttgttgcttttgcgtcagccaggggccaggggattagctcgatcgcacccacctcgccagcaacagcagttttcttctcttgatgataaacctcaattccccggggcttccgctgagtttatagataaacttgagtttatccaacctaacgtgattagtggaatacctatttatcgtgttatggatagacaaggacagatcattaacccttcagaagatcctcaccttccaaaggagaaggtactgaagttgtataagtccatgacacttcttaacactatggatcgtatcttgtacgaatcccaacgacaaggacggatttctttctacatgaccaattatggagaagaaggtacccatgtcggatctgcagctgctcttgacaataccgaccttgtctttggacagtatcgagaagctggtgttttgatgtacagagattatccattggagttattcatggcacaatgctacggcaacatcagtgatttggggaaaggtagacaaatgcctgttcattatggttgtaaggaaagacactttgttactatatcttcaccactggcaactcagatcccgcaggcggtaggggccgcatatgctgctaagcgtgcaaatgctaatagggtcgtgatttgctatttcggtgaaggtgcggcttctgaaggtgatgctcatgctggtttcaacttcgcagctactttggagtgcccgataatattcttttgcagaaataatggttatgcgatatctactccaacttcagaacaatatcggggcgatggaattgctgccagaggacctggatacggaataatgagcattagagtggatggtaatgacgtattcgcagtttataatgcgaccaaagaggctcgaagaagagctgtcgctgagaaccagccttttctcattgaagctatgacatataggattggccaccactcaacgtcggatgactcctctgcatatcggagcgttgatgaggttaactactgggataagcaggaccaccccatcagtaggttacgacactatttgctctctcagggttggtgggacgaggagcaggagaaggcctggcggaagcaatctagaaggaaggtcatggaggcgttcgagcaagctgaacggaagcccaagcccaacccaaacttgctcttcagtgatgtgtatcaggagatgcctgcccaattgaggaaacaacaggaatccttagctaggcatttgcaaacttatggtgagcattacccgctggatcactttgataaa

SEQ ID NO: 249583 - DNA, 1335 bp, Artificial Sequence
  Description of Artificial Sequence: Synthetic coding sequence
atggccgtggccattgccgccgctagagtgtggcggttgaaccgggggctctcgcaggctgctctcctgctgctcaggcaacctggtgcacgcggactcgcacgctcccatcctccaagacaacagcagcagtttagctccctggacgataaaccgcagtttccgggagccagcgcagagtttatcgacaaactcgagttcatccaaccgaatgtcatcagcggcattccgatttaccgtgtcatggatagacagggacaaatcattaacccttcagaggatccacatctgccgaaagaaaaagtgctgaaactgtacaagagcatgactctcttgaataccatggatcggatcctttacgaatcacagagacagggacgcatctcgttctacatgactaactacggagaagagggaacccacgtcgggtcagcagccgcacttgacaataccgaccttgtgttcggtcagtaccgggaagcgggcgtcctcatgtaccgcgattacccgctggagctctttatggcccagtgctacggcaacatctcggatcttggaaaaggacggcagatgccggtgcactacggctgcaaggaaagacacttcgtgactatcagctcgccgctggccacccagatcccacaggccgtgggagctgcctatgccgcaaagcgggcgaacgccaatcgggtcgtcatttgctatttcggagaaggcgccgcgtccgaaggcgacgcgcatgctggcttcaacttcgccgctactctggagtgcccgatcatctttttctgccgcaataacggatatgccattagcaccccaaccagcgaacagtatagaggcgacggaatcgcggcacgcgggccgggctacggaatcatgtcaatccgcgtggatggaaacgacgtgttcgccgtgtataacgcgactaaagaggccaggagacgcgccgtcgccgaaaaccagccgttcctgatcgaagcgatgacttaccgaattggtcatcacagcacctcggacgactcttccgcgtacagatcagtggacgaagtcaactactgggacaagcaggatcatccgatctccaggctgagacattaccttttgtcccaaggatggtgggacgaggagcaagagaaggcgtggcgcaagcagtcacggagaaaggtgatggaagcgtttgaacaagccgagcggaagcctaagcctaatccgaatcttctgttcagcgatgtctaccaggagatgccggcacagcttcgcaagcaacaagagtcgctcgctcggcacctgcaaacgtacggagagcactacccgctggatcatttcgataag

SEQ ID NO: 249584 - DNA, 1335 bp, Artificial Sequence
  Description of Artificial Sequence: Synthetic coding sequence
atggcagtggccattgctgcagcacgggtctggaggctcaaccgaggactctctcaggcagccctcctactcctgcgccagcctggagcccgcgggctcgcccgatcccatcctcctcggcagcagcagcagtttagttcattagatgataaacctcagttccccggggccagtgccgagttcattgacaagttagaattcatacagcctaatgtgatatctgggatccccatttaccgggtcatggataggcaggggcagataattaatccatccgaggatccacacttacctaaggaaaaagttcttaaactgtacaagtccatgacattattaaacacaatggatcggattctttatgaatcccagcggcagggacgaatatccttctatatgacaaattatggggaagaggggacgcacgttggatccgccgccgctcttgataatactgatctcgttttcggacagtacagggaagccggagtcttgatgtaccgggattatccattagagctcttcatggctcagtgttacggaaatatctctgatcttgggaaagggagacagatgccagtgcattacgggtgcaaggaaaggcacttcgtgactatctcaagtcccctcgctactcagatcccacaggccgttggagccgcatatgccgccaaaagggcaaacgccaatcgggttgtgatctgctatttcggggagggagccgcatcggaaggagacgcacatgccggattcaactttgctgctacactcgagtgtccaataatcttcttttgtaggaacaatgggtatgctatctcaactcccacatcagaacaatatcgcggggacggaatagctgcaagaggaccaggatatggaataatgtccattcgagttgatggaaacgatgtattcgctgtttacaacgcgactaaggaggcaagaaggcgggccgttgctgagaaccaacccttcctgatagaggcaatgacatatcggatagggcaccatagtacttctgatgattcatcagcctatcggtccgtggatgaagtcaactactgggataaacaggatcaccccatatcccgacttagacactatctcctttcccagggatggtgggatgaagaacaggaaaaagcctggcggaagcagagtcgaagaaaagttatggaggcctttgagcaggctgaaaggaaacctaagcccaacccaaacttactatttagtgatgtctatcaggaaatgcctgcacagctaaggaaacagcaggaatcactcgcacgacatttacagacatatggagaacattatcctcttgatcactttgataag

SEQ ID NO: 249585 - DNA, 1335 bp, Artificial Sequence
  Description of Artificial Sequence: Synthetic coding sequence
atggccgttgcgatcgccgctgctcgcgtttggaggctgaaccgggggctcagtcaggctgcgcttttacttctacgtcagccgggagctcgagggttagctcgcagtcatccaccacgtcagcagcagcagttttcctcgctcgacgataagccacagtttcccggggcttctgccgagttcatcgataagttggagttcattcaaccaaatgtgatttccgggatcccaatatatagggtcatggaccggcagggccagattataaaccccagcgaagatcctcacctgcctaaggagaaggtgctaaagctctacaaatcgatgacactccttaacacaatggatcgtatcttgtacgaatcccagcgccaggggcgtattagcttctacatgactaattatggggaagaaggaacccatgtggggtcagccgctgcgctcgataatacagacctggtgttcggacagtatcgggaggcaggagtcttgatgtatagagattacccactggagctgttcatggctcagtgctatggaaatatctctgatttggggaaagggcggcagatgccagttcactacgggtgcaaggagcgccatttcgtcacaatttcttcccccctcgccacacagatcccccaggcggtgggggccgcctacgcagctaagagggctaacgctaatcgcgtggtaatatgttattttggtgagggtgctgcatcagaaggggatgcacacgcgggattcaacttcgccgccaccctcgagtgtcctatcatattcttctgtcgcaataatgggtatgctatttccacccctacttccgaacagtatcggggcgacggcatcgccgctcgagggccaggatacgggattatgtctataagggtggacgggaatgacgtattcgcggtctataacgcgacaaaggaggcgagacgaagggctgtcgctgagaatcagccatttctgatagaagcaatgacatatcgcatcggccaccactccacctctgacgactcatctgcctaccgttctgtcgatgaagtaaattattgggataagcaggaccacccaataagtcggctgcggcactacctactgtcgcagggctggtgggacgaggagcaggaaaaagcgtggcggaaacagtctcgacgtaaagtgatggaggccttcgagcaagccgaacgaaagccaaaacctaaccccaatcttctgttttctgacgtgtaccaggagatgccagcgcagctgcgtaagcagcaggaatctctggcacgtcacctccagacctacggcgaacactaccctctagaccacttcgataaa

SEQ ID NO: 249586 - DNA, 1335 bp, Artificial Sequence
  Description of Artificial Sequence: Synthetic coding sequence
atggctgtcgcaatcgcagccgccagagtatggagactgaatcgtggtctcagccaagccgcattgttgcttttgaggcagcccggagcccgcggcctggcccgcagtcaccctccacgccagcagcagcagttttctagcctggatgacaagccccagttccccggcgcatccgcagaattcatcgacaaactggagtttattcaacccaacgtcatctctggtattccaatatatcgcgtcatggaccgtcagggacaaataattaatccatccgaggacccacatcttcccaaggagaaggttcttaaactctacaagagtatgactctgctcaatacaatggacaggatcctctacgaatctcagcgccaaggccgcatttctttttacatgaccaactacggtgaggagggcactcacgtgggctcagctgcagcactggacaacactgacttggttttcggacagtaccgcgaggccggcgtgttgatgtatcgcgactatccattggaactgttcatggcccagtgctacggaaacatctccgacctgggaaagggcaggcagatgcctgtgcactatggatgcaaggagaggcatttcgtcaccattagctcaccccttgcaacacagatacctcaagccgttggcgctgcttatgctgctaagagggctaacgcaaacagggtggtgatctgttatttcggcgaaggcgctgcctctgagggagacgctcacgccggtttcaactttgcagctacactggaatgccctatcatctttttctgccgtaataacggctacgccatctctactccaacatccgagcaatatcgcggagacggtattgccgctcgcggtcctggatacggcataatgtctattagggtggacggtaatgacgtgttcgccgtctacaatgccacaaaggaggcacgtcgtagggccgtggctgaaaatcagccattccttatcgaggcaatgacataccgtatcggtcaccactctacctctgatgactcctctgcttatcgctcagtggacgaggtcaattactgggacaagcaggaccatccaatttcaagactgagacattatctcctgtcccaaggatggtgggacgaggagcaggaaaaagcctggagaaagcaatcaaggagaaaggtgatggaggctttcgagcaggccgagaggaagcctaagcccaatccaaacttgttgttttctgatgtataccaggagatgcccgctcagttgagaaagcaacaagagagcttggcccgtcacctgcaaacctacggagaacattaccccttggatcacttcgataag

SEQ ID NO: 249587 - DNA, 1335 bp, Artificial Sequence
  Description of Artificial Sequence: Synthetic coding sequence
atggcagtcgccatcgcagccgcaagggtgtggcgcctcaatcgcggcttgagccaggccgcactgcttctgcttaggcagccgggagctagagggctggcgaggagccacccgcctcgccagcaacagcaattttcttcgctggacgacaagccacaattccctggggcatcagcagaattcatagacaagctcgagttcatccagccgaacgtgatttcgggcatccccatttatcgagtgatggacaggcaaggtcaaatcatcaatccgtcggaagatccacatctgcctaaggagaaggtgctcaaactttacaagtcaatgacccttctgaatactatggacagaatcctgtacgagtcccagagacaaggaaggatttctttttacatgacgaactacggagaagaaggaacccacgtcggaagcgcagccgctctggataatactgacctggtgttcggccagtaccgggaagcaggcgtcctcatgtaccgcgactaccctctcgaactgtttatggcacagtgctacggaaacatctccgacctgggcaagggtcgccagatgccggtgcactacgggtgcaaagagcggcatttcgtgaccatcagctcaccgctggcgacccagataccacaggccgtgggtgccgcgtacgcagcgaagagggcgaatgccaatcgggtggtgatctgttacttcggagaaggagctgcctctgaaggagacgcccacgccggattcaatttcgccgcgacgcttgagtgtccgatcatcttcttttgccgaaacaacgggtacgcgattagcaccccaacttcagagcagtaccggggtgacggaatcgcggcccgcggcccggggtacggaattatgtcaatccgggtggacgggaacgatgtctttgccgtctacaacgccactaaagaggcccggcgtcgggctgtcgcggaaaaccagccattcctcattgaggcaatgacctacagaatcgggcaccattcaacttcagatgattcctcggcctatcggtccgttgacgaagtcaactactgggataaacaagatcatcctatctcgcgcctccgccattacctcctgagccagggttggtgggacgaagaacaggagaaggcttggagaaagcagtcacgacggaaggtgatggaagccttcgagcaggcggagcggaagccgaaaccgaaccccaacttgctgttctcggatgtctaccaggaaatgcccgctcaactgcgcaaacagcaggaatcgcttgccagacaccttcaaacctacggagagcactatcccctggaccatttcgataaa

SEQ ID NO: 249588 - DNA, 1335 bp, Artificial Sequence
  Description of Artificial Sequence: Synthetic coding sequence
atggctgttgccattgcggcagctcgagtctggcggttgaaccgaggactaagtcaggccgccctattattactccggcaaccaggagctagggggcttgcccggtctcatccacccaggcaacagcaacaattttcttccctggacgacaagccacagtttcccggagcttctgcagaattcatagataagttggaattcatacagccgaacgtgatttcaggcattccaatttatcgagtaatggatagacagggccagattatcaacccatccgaggatccccacttgccgaaggagaaagtactgaagctgtacaagagtatgaccctacttaacaccatggaccgcattctgtatgaaagccagagacagggacgcatttccttctacatgaccaattatggcgaagagggcacgcatgtgggatctgccgcagctctcgacaatacagatttggtttttggacagtatagggaggcaggcgtgttgatgtacagagactaccctctggagctgtttatggcccagtgctacgggaatatcagcgatctgggcaagggccgtcagatgcccgtgcattacgggtgcaaagagagacactttgtaaccatttcttctccccttgcaactcagattcctcaggcagtgggggccgcctatgccgcaaagcgggctaatgcaaacagagtcgtgatctgttactttggggaaggggctgccagcgagggcgacgcacacgccggctttaattttgctgccacactggaatgccccatcatcttcttttgcagaaacaatgggtacgccataagtactcctacctccgagcagtaccggggtgacggtatcgctgcaaggggtccaggatacgggattatgagcatcagggttgacggtaatgacgtctttgccgtgtataatgccacaaaagaagcccggaggagagccgttgctgaaaaccagccttttttgattgaggcaatgacgtacaggatcgggcaccattctaccagtgatgacagtagtgcatacaggagcgtggatgaagtgaattactgggataagcaggatcacccaatttctaggctgcggcattatctattatctcagggttggtgggacgaggagcaggaaaaggcgtggcggaagcagtcccgtcgcaaggtaatggaggccttcgagcaggccgaacgaaagccaaagcccaatccaaatctgctcttctccgatgtctatcaagagatgccagctcagctgagaaaacaacaggagtctctagctcggcatctgcaaacctacggagagcactatcctttggaccacttcgataag

SEQ ID NO: 249589 - DNA, 1335 bp, Artificial Sequence
  Description of Artificial Sequence: Synthetic coding sequence
atggcagtggccattgccgctgcgagagtgtggaggctgaataggggcttgtcccaagcggcccttctgctgctccgccagccgggtgctaggggacttgctagatcgcaccccccgcgacaacaacaacagttctcgtcccttgatgacaagccgcaattcccgggagcctcagccgaattcatcgacaagctcgaattcatccagccaaacgtgatcagcgggatcccgatttacagagttatggaccggcaaggacaaatcatcaacccgtcggaagatccgcatttgcctaaggagaaagtcctgaagctctacaaatcaatgactctgctgaacactatggacagaatcctgtacgaatcccagcgccaaggacgcatcagcttttacatgaccaactatggcgaggaaggaactcatgtggggtccgccgctgccctggacaacaccgacctcgtgttcggccagtaccgggaggcaggagtgctcatgtacagagattatccgctggagctcttcatggcccagtgctacgggaatatctcagacctgggtaaagggcggcaaatgcctgtgcactacggttgcaaggagaggcacttcgtgactatctcgtcccctctcgctacccagatcccacaagcggtgggtgccgcttacgccgcaaagagagccaacgccaacagagtcgtcatctgttacttcggagaaggagcggctagcgaaggcgatgcacacgccggattcaacttcgcggcaactctcgaatgccctatcatcttcttctgccggaataacggatacgccatttccacgccgacttcggaacagtaccggggtgatggaatcgcagctcggggacccggctacggaatcatgtctatccgggtggatggaaacgatgtgttcgccgtgtacaatgcaaccaaggaggcccggcgccgcgccgtggccgagaaccaaccattcctcatagaagccatgacgtatcggatcggccaccactcgacctctgatgattcgtcggcataccgcagcgtcgacgaagtcaattactgggacaagcaagaccatccgatttctcggctgagacattacctgctgagccaaggatggtgggatgaagaacaagagaaagcctggcggaagcaaagccgccgcaaagtgatggaagccttcgagcaggccgagcgcaagcctaagccaaaccccaatctcttgttctcagatgtgtaccaggaaatgcccgcacagctgagaaagcagcaggagtccttggcgcggcacctccaaacttatggcgagcactaccctttggaccattttgacaag

SEQ ID NO: 249590 - DNA, 1335 bp, Artificial Sequence
  Description of Artificial Sequence: Synthetic coding sequence
atggcggtagccatcgctgcagctcgcgtatggagactgaatagagggctctcacaggccgcactcttgctacttcggcagcccggagccagaggactagctaggtctcatccgcctagacagcagcagcagttcagttcgttagatgacaagcctcagttccctggggcctccgctgagttcatcgataagttggaatttatccagcccaacgtgatcagtgggatcccgatttacagagttatggatcggcaagggcagattatcaaccccagtgaggaccctcatctccccaaagaaaaagtgcttaaactctataaatctatgacactacttaacactatggataggattctatatgaatctcaacggcaggggagaatctcattctacatgacaaattacggggaagagggaacacacgtagggtcagcagccgccctcgataacacagatttagtctttgggcagtatagggaagccggagtgctgatgtatcgtgattatcctctagagctattcatggcacagtgttatgggaacatctctgatctcgggaaaggacgccagatgcccgttcactatggatgtaaagaacggcattttgttacaatatcctctccactggccacacagatcccccaggcagttggggccgcatatgcagccaaacgcgctaatgccaatagggttgtcatctgttatttcggggaaggagccgccagtgaaggggatgcccatgccgggtttaacttcgctgccactttagaatgccctatcatttttttttgtcggaataatgggtacgccatatcaactccaacgagtgaacaatatcgaggggatgggattgctgcccgcgggcccgggtacggaatcatgtctatcagagtggatggaaatgatgtattcgccgtatataatgctacaaaagaagcccggaggcgggcagtggcagaaaatcagccctttcttatcgaggccatgacttatagaatagggcaccattctacatcagacgattcatccgcttatcggtcagtggatgaagtgaattattgggataaacaggatcaccctatatctcggctccggcactatctcctatctcagggatggtgggatgaagaacaggaaaaagcctggcgaaagcaatctcggaggaaggtaatggaagcttttgagcaggccgaaaggaaacccaaaccaaatcccaatctcctcttctccgatgtataccaggaaatgccagctcagctccggaaacagcaggagtccttggctcggcatcttcagacatacggagagcactatcctttagatcattttgataaa

SEQ ID NO: 249591 - DNA, 1335 bp, Artificial Sequence
  Description of Artificial Sequence: Synthetic coding sequence
atggcggtggcaatagccgcagccagagtgtggagactgaatcggggactgtcacaggcagcacttctgttgctgaggcaacccggggcgcggggacttgcacggagtcatccgccccgccagcagcaacaattctcgtcgcttgatgataagccacagtttccaggggcatccgctgagtttatagataagctcgagtttattcagccaaacgttatttcagggattccgatttatcgagtcatggacagacaaggtcagatcataaaccccagcgaagatcctcatcttcctaaggagaaagtgctcaaactgtacaagtccatgactctccttaataccatggaccggattctttacgaatcacaaagacaaggacggatttccttttacatgaccaactacggcgaggaaggtactcacgtgggatcggcagcagcgctggataataccgatcttgtgtttggacaataccgagaagcaggcgtgttgatgtatagagattaccctctcgagctgttcatggctcagtgctacggtaatatctccgacctggggaagggcagacagatgcctgtccattacggttgtaaggaacgccattttgtcaccatttcgtcccctcttgcaacccagattcctcaggctgtgggagcggcctacgcagcaaagagagccaatgccaaccgcgttgtgatctgttactttggcgagggtgcagcatcggaaggagacgcccatgcagggtttaacttcgctgcaaccttggaatgtcccataatcttcttttgccgtaataacggatacgcgattagcacccccactagcgaacaatatcgtggagacgggatcgcagcaaggggaccgggatacggtatcatgagcattagagtggatggtaatgatgtctttgcagtctacaacgcaactaaggaagcacgcagacgtgcagtggccgaaaaccaaccatttcttatcgaagcaatgacctacaggattgggcaccacagcacttcggacgattcctctgcataccgcagcgttgacgaggtgaactattgggataaacaggaccatccgatttccaggctgcggcattatcttctgagccaggggtggtgggatgaagaacaagaaaaagcctggcgcaagcaatcgcgccggaaagtgatggaagcatttgagcaggcagaacgtaagcctaagcccaaccctaatctcctcttttcagatgtgtaccaggaaatgccagcacagctgcgaaagcagcaagaatcccttgcccgccatctgcagacctacggcgagcattacccactggatcactttgataaa

SEQ ID NO: 249592 - DNA, 1335 bp, Artificial Sequence
  Description of Artificial Sequence: Synthetic coding sequence
atggctgttgcaattgcagccgcgagagtatggcgcttaaaccgcgggctgtctcaagcggccttgcttctgttaaggcagcccggcgccaggggactggctcggagtcaccccccacgccagcagcagcaattcagctctctggacgataaaccccaatttccaggcgcatccgcggaattcattgataagcttgagtttatacagcccaacgtaatctcaggaatcccgatttaccgggtcatggaccgccagggtcagatcattaacccctctgaggatcctcacttgcccaaggaaaaggtcctgaagctgtataaaagcatgacactgctcaatacgatggaccgcattctttatgagagccagcgccaggggcgaatcagcttttacatgaccaactatggagaggaggggacccacgtgggctcagcggccgcactggacaacacagatcttgtgtttgggcagtacagagaggcgggagtactgatgtacagagactatccgctagaactattcatggcccagtgctacggcaatatctcggacttgggtaagggccggcagatgcctgtgcattacggctgtaaagagagacattttgtgacaatttccagcccgctggcaacacagattcctcaggctgtcggcgccgcgtacgctgccaagcgagccaacgctaatcgggtggtgatctgctacttcggggaaggggctgccagcgagggggacgcccatgccggcttcaacttcgccgcgacgttggagtgtcctattattttcttctgtaggaacaatggatacgccatcagtactcccacatccgaacagtaccggggggacggcatcgcagccagaggaccaggctatggcattatgtccattcgtgtcgacggtaatgacgtgttcgctgtgtataatgctacaaaagaggctagacggcgggcggtggctgagaaccaaccattcctgatcgaggccatgacctataggattggccaccactccacctccgacgatagcagtgcctacaggtcggtcgatgaagtgaactactgggacaagcaggaccatcccattagccggctcaggcattacctattgagccaaggatggtgggacgaagagcaggagaaggcgtggcggaaacaaagtagaaggaaggtgatggaagcctttgaacaggcagagcggaagccgaagccgaacccaaaccttttattttcggacgtgtaccaagaaatgcctgctcagcttaggaaacagcaagaatccttagcaagacacttgcagacttacggagaacactatcccctggaccattttgacaag

SEQ ID NO: 249593 - DNA, 1335 bp, Artificial Sequence
  Description of Artificial Sequence: Synthetic coding sequence
atggcagtggcaattgcggcagcgcgcgtttggcggttgaacagaggtctttcgcaggcagcactgcttctgcttcgtcaaccaggggcaagggggctcgcacgatctcaccccccacgtcaacagcaacaattctcgagcctggatgataagccgcagttccctggggcctcggcggaattcatcgataaactggagtttatccaacctaatgtgatttccggaattcctatctacagagtgatggaccgccaaggacaaatcattaaccctagcgaagatccccacctgccgaaggaaaaggtcctgaagctctacaagtccatgactctgttgaacacgatggatagaattctgtacgaatcacagcggcagggacggatttcattttacatgactaactacggcgaagaaggtactcatgtgggaagcgcagcagccctcgataacactgatctcgtgttcggacagtatcgggaagcaggagtgctgatgtaccgcgactacccccttgaactgtttatggcacaatgttatggcaatatctctgaccttggaaaggggcggcaaatgcctgtgcactacggctgtaaagaaagacattttgtcaccatctcctcccccctcgcgacccagatcccccaagcggtcggcgcggcatacgcagcgaagcgcgcaaatgccaaccgcgtggtgatttgttactttggtgaaggagctgcgtcagaaggagacgcacatgcgggttttaacttcgcagcaactcttgaatgcccaatcattttcttctgtagaaacaacggatacgcgatctctacccctacttcggaacagtaccgcggtgacgggattgcagccagaggccctgggtacggtattatgagcatcagggtggacggcaacgatgttttcgcagtgtacaatgccaccaaggaagcccgaaggagagcggtcgcggagaaccagccgtttcttatagaggccatgacctacagaattggacatcattccacgtcggatgactcctccgcctaccgtagcgtggacgaagtaaactactgggacaaacaagaccatccaatcagcaggcttaggcactacctgctcagccagggatggtgggacgaggagcaggaaaaggcctggaggaaacagtcgcgtcgtaaggtgatggaagcgtttgaacaggcagaaaggaaacctaagccaaaccctaacctcttgtttagcgatgtgtaccaagaaatgcctgcacaactgcggaagcaacaggaatcgctggccagacacctccagacctatggagaacattaccctctggatcattttgacaaa

SEQ ID NO: 249594 - DNA, 1335 bp, Artificial Sequence
  Description of Artificial Sequence: Synthetic coding sequence
atggctgtcgctattgccgcggcgagagtgtggcggcttaataggggcctgtcacaagcagcactcttgcttctgcgtcaacccggcgcccgcggcttggctcgctctcatccccccagacagcagcagcaattttcctccttggatgataaacctcagttccccggcgcaagcgccgaatttatcgacaaactcgagtttattcagccaaacgtaatcagcggcattccgatttatcgagtgatggaccggcagggtcagatcattaatccaagcgaagatccacatctccccaaagagaaagtgctgaagctctataagagcatgaccctgctcaatacaatggataggatactctacgagagccagcgacagggtaggattagcttttacatgacgaattacggggaggaggggacccacgttgggagcgcagccgcattggacaatacagatctggtcttcggacagtaccgcgaggcaggcgtcctgatgtatcgtgactaccctctagagctctttatggcacagtgctatggcaacatctctgacttgggtaaaggtagacaaatgcctgtccactacggctgcaaggaacggcactttgtcaccatttccagtccactcgccacccaaatcccccaggccgtgggcgctgcctacgctgcaaagcgtgccaacgccaatcgggtggtcatatgttactttggcgaaggcgccgcgtccgagggggacgctcatgccggcttcaactttgctgctactctggagtgccctataattttcttttgtcggaataatggttatgcgatatccaccccaacgagcgaacagtatcgaggtgacggaattgccgcacggggtcccggctatggaattatgtcaattcgtgtcgatggtaatgatgtgttcgcagtttataacgcgaccaaagaggcccgacgccgcgcggtggcagaaaatcagccttttttaatagaggccatgacatatcggattggacaccattctacctcagacgattcgagcgcctatcggtccgtggatgaagtcaattattgggacaagcaggaccacccaatctctaggctgaggcactatctacttagccagggctggtgggatgaagaacaggagaaggcctggaggaagcagagcagacgcaaagtcatggaagcctttgaacaggcagagcgcaagcctaagccaaaccctaatttactgttttcagatgtgtaccaagaaatgccagcacagctcaggaagcagcaggagtctctggcccgtcatctgcagacctatggagagcactatcccctcgaccacttcgacaaa

SEQ ID NO: 249595 - DNA, 1335 bp, Artificial Sequence
  Description of Artificial Sequence: Synthetic coding sequence
atggccgttgcaatagccgccgctcgtgtgtggagactcaatcgcggcctatctcaggctgcactgctgttgttgagacagcccggcgcccgaggtctagcacgttcacacccacctagacaacagcagcagttctccagtctcgatgataaaccccagtttcccggcgcctctgcggagttcatagacaaactggagtttatccaacctaacgtgatctccggaatccccatctacagggtgatggaccggcagggacaaatcatcaatcctagcgaagacccccacttgccaaaggaaaaggtcctcaagctgtataagtcaatgactctcttgaatacgatggatagaatcctatatgagtctcaaagacagggcaggatttccttttacatgacgaattatggtgaagagggaacccacgttggctctgcagcagccctggacaatacggatttagtgttcggacagtatagggaggccggtgtgcttatgtatagggattaccccctcgagttgttcatggctcagtgttatggcaacatctccgacttgggcaaggggcgccagatgccagtgcactatggctgtaaggagaggcactttgtcactatatcatcaccattagcaactcaaataccccaggctgtcggagctgcttatgccgctaagagagctaacgcaaacagagtggtaatatgctattttggggagggcgccgcaagcgaaggggacgctcatgccgggtttaacttcgccgcaacactcgaatgccccataatatttttttgtcgtaataatgggtatgccataagtaccccaactagcgaacagtacaggggcgatgggatcgctgcaagaggacccggatacgggatcatgtcaatcagagtggacggaaatgatgtgtttgctgtgtataatgcgacaaaagaggccaggcgtagagcagtcgctgaaaaccagccattcctgattgaggccatgacctatcgaattggacaccactcaacatcagatgactcgtctgcataccgcagcgtggacgaggtgaactactgggacaaacaggatcaccccatcagcagattacggcactacctactgagccagggatggtgggacgaagaacaggaaaaggcttggcggaaacagagccgccggaaagtcatggaggcgttcgagcaggccgagagaaaacccaagcctaaccctaaccttctttttagtgacgtgtaccaagaaatgcctgcacaactgagaaagcaacaggagtctctggcacgccatcttcagacatatggcgagcactatcctttagaccattttgacaag

SEQ ID NO: 249596 - DNA, 1335 bp, Artificial Sequence
  Description of Artificial Sequence: Synthetic coding sequence
atggctgtagcaattgcagcagctcgcgtctggcgattgaaccgtggactttcacaggccgcgctgttattgttacggcaacccggcgctcgcggtttagccagaagtcatcctccgagacagcagcagcaattttcttctctggatgataaaccgcagtttccgggcgcgtccgcagaatttattgacaagctcgaatttatccaaccgaacgtaattagcggcattccaatataccgcgttatggacagacaaggacagatcattaacccttcagaagatccacatctgccgaaagaaaaagtgctgaaattatataaatctatgaccctattgaatacgatggatcgtattctgtatgagagccagcgacagggacgcatttcgttttatatgacaaattatggagaagaaggaacacatgtaggttccgcggctgctcttgacaatacagacttggtattcggacagtacagggaagcaggagtcttaatgtatagagactatcctttggagctatttatggcccagtgctacggaaacatctccgatcttggcaaaggcagacaaatgccagttcattacggctgcaaagaaagacattttgttactatctcttcaccgttagcaacacaaattccgcaagccgttggagccgcttatgctgcaaaacgggcgaacgcaaatagggtggtgatctgctattttggcgagggcgcagcgagcgaaggagatgcacacgcgggattcaattttgccgcaacccttgaatgcccgatcattttcttttgtcgcaataatggatacgcaataagtacacctacatcagaacaatatcgtggtgacggcattgcagcgcgtggccctggttatggaataatgtccatacgggtggatggtaatgatgtctttgcagtttacaatgcaacgaaagaagcacgccgtcgtgccgtggcagaaaatcaacccttcctcatcgaggcgatgacctacagaattggccaccactcgacatccgatgatagctctgcttacaggagcgttgacgaagtaaattattgggataaacaggatcatccaatttcacgcctgcgccactaccttctcagtcaaggttggtgggatgaggaacaggaaaaagcctggcgtaaacagagccgtcgcaaagtaatggaggcattcgagcaagctgaacggaaaccgaagccgaatcctaaccttcttttttctgacgtttatcaggaaatgccggcacaattgagaaaacagcaagaatcacttgcaagacatcttcaaacgtatggcgaacattacccgttagatcattttgacaaa

SEQ ID NO: 249597 - DNA, 1335 bp, Artificial Sequence
  Description of Artificial Sequence: Synthetic coding sequence
atggctgtggccatcgcagctgcccgagtctggcgtctgaatcgcggcctatcacaggccgccctcttgctgctgcggcagccaggcgccagaggccttgcaaggagccaccccccacgtcagcagcaacagttcagttcccttgacgacaagcctcagttccctggtgcctcagctgagtttatcgacaagctagaatttatacagcctaacgttatttcaggcatccctatctatcgcgtgatggacaggcagggacagattattaacccctccgaggacccgcatctgcccaaggagaaagtactgaagctttataaaagtatgaccctgctgaatactatggatcgcatactgtatgaatcccagagacaggggaggatttcgttctatatgacgaactacggagaggagggtacccacgtgggtagtgccgctgccctggacaatacagatttagtgttcgggcagtaccgagaagctggagtgctcatgtatcgggattatccactcgaattgtttatggcccagtgctacggaaacatttccgatcttgggaagggcaggcagatgcccgttcactatggctgtaaagagcggcactttgttaccattagcagtcctctcgcaactcagattccccaagccgttggcgcagcatacgcggcaaagcgggccaatgccaacagagtggtcatatgctactttggcgagggcgctgcgagcgagggcgacgcacacgctggctttaatttcgctgcgacgctggagtgccctatcatctttttctgtaggaacaacggctatgctatatcaactccgactagtgaacagtacagaggggacgggatcgccgcgcgtggtcccggttacgggattatgagcatacgggtagacggtaatgatgtttttgccgtgtataatgctaccaaggaagctagacgtcgcgctgtcgcggaaaaccaaccattcttgatcgaggctatgacctaccggatcggacatcattctaccagcgacgactcctcagcctaccgcagcgttgacgaagtcaattactgggacaaacaagatcacccaatcagcaggctgagacactatctgctgtcacagggctggtgggatgaggaacaggagaaagcttggcgaaagcagagccggagaaaggtcatggaggcgttcgagcaggcagaaaggaaacctaagcccaatccgaaccttcttttctccgacgtttaccaggagatgcctgcacagttgcgaaagcagcaggaatcgctggcacgccacctgcagacttatggggagcattaccccctcgatcattttgataaa

SEQ ID NO: 249598 - DNA, 1335 bp, Artificial Sequence
  Description of Artificial Sequence: Synthetic coding sequence
atggcagtggccattgccgcagcgagagtctggcgtctgaaccgaggtttgagccaggccgcgctgctgcttctcagacaacctggtgcgaggggccttgccaggtcacatccacctcgacaacagcaacagttctcctcccttgatgacaagccacagtttcctggggcatcagcagaattcatcgataagctggagtttatccagccaaatgttatttccggcatacccatttaccgggtgatggacagacaaggtcaaatcattaacccttcagaagatccgcatttgcctaaagaaaaggtgcttaaactttacaagagcatgactctgctcaacacgatggacagaattctttatgagtcccagcgtcagggacgcatatcattttacatgacgaattacggtgaggaaggcacccacgtgggctcagcggcagcactcgacaacactgatctcgtgttcggacaatacagagaggcaggtgtgctgatgtaccgagactacccacttgagctgtttatggcacaatgctatggcaatatcagcgatctgggaaaaggaaggcagatgcctgtccactacggatgtaaggaacgccactttgtgaccatttcttcccccctcgcaacccaaatcccccaagcggtcggggcagcatacgctgccaagagggcaaacgctaatagagtggtcatctgttactttggagagggagcagcgtcggaaggggatgcacatgccgggtttaactttgcagccaccctcgaatgcccaatcattttcttttgtaggaacaacgggtacgctatctcgactcccacctcggaacagtaccggggagatggaatcgcggcccgtggtccggggtacggtattatgtccattagggtcgatggaaatgatgtgttcgcggtctacaacgcaactaaagaagcgagacggagagccgttgccgagaaccaaccttttcttatcgaggcaatgacgtacagaatcggtcatcacagcacttcggacgattcatcggcatacagatcggttgacgaagtcaactactgggacaaacaagaccatcctatctccagactcagacactaccttttgtcacaggggtggtgggatgaggaacaagaaaaggcatggagaaagcaaagccggcggaaggtgatggaagcattcgaacaagcggagagaaagcctaaacccaatccaaatttgctcttttccgatgtctaccaggagatgcccgcgcaactgcgaaagcagcaagaatccctggcgcgacatcttcagacctacggtgaacattaccctctggatcatttcgacaaa

SEQ ID NO: 249599 - DNA, 1335 bp, Artificial Sequence
  Description of Artificial Sequence: Synthetic coding sequence
atggccgtcgccattgcggccgcccgcgtctggcgcttgaaccggggtttgagccaggccgccttgctgctgctccggcaaccaggggcacgtggcctggctagaagccacccgccccgtcagcagcaacagttcagctctctcgatgacaagccacagtttcccggggcatcggccgagttcatagataagctagagtttatacagcccaatgtgataagtggaatacccatctatcgagtgatggatcgacagggacagattattaatccatcagaagacccccacctcccaaaggaaaaggtccttaagctatacaagtctatgacgcttctgaacacgatggatcgcattctgtatgagtcccagaggcagggacggatcagcttttatatgactaattacggagaagagggaacccacgtgggcagcgcggccgccttggataacacggacctggtgttcggtcagtaccgcgaggccggtgtgctaatgtaccgagactaccctttggagctgttcatggcccagtgctatggcaacatatccgacctgggcaagggtcgacaaatgccggtgcactacggctgcaaagagaggcatttcgtcacaattagttccccactggccacccagatcccacaggcagtgggcgctgcgtacgccgcgaagcgggcgaacgccaaccgagtcgttatctgctacttcggagagggagcggcatccgaaggcgacgcccacgccggatttaacttcgcggcaaccctagaatgccccatcatcttcttttgtcgtaataacggctatgccattagtaccccgacgtccgaacagtatcgcggcgatggcatcgctgcaaggggtccaggctacggcattatgtcgattcgtgttgatggtaacgacgtattcgctgtctacaacgcgactaaggaggcacgacgccgagcagtcgccgagaatcagccgtttctaattgaagccatgacataccgtatcggacatcattcaacgtcggatgattcgtcggcctatagatccgtcgatgaggtaaactattgggataagcaggatcatcctatctcacgcttgcgccattacctgctgagtcagggttggtgggatgaggagcaggaaaaagcctggaggaagcagagtcgacgcaaagtgatggaggccttcgagcaggctgagagaaaacccaagcctaaccccaatctgctgttctctgatgtgtaccaagagatgcctgcccagttgcgaaagcagcaagagtcccttgcccgccacctgcagacctacggagaacactacccgcttgatcacttcgacaag

SEQ ID NO: 249600 - DNA, 1335 bp, Artificial Sequence
  Description of Artificial Sequence: Synthetic coding sequence
atggccgtggcaatcgctgcagcccgcgtgtggcggctcaaccgcggcctctcgcaagccgccctgctgctgctgcgacagccaggagcacgcgggttggccagatcgcatccgccccgccaacaacaacaattctcaagcctggatgacaaaccccagttcccaggagcgtccgcggagtttatcgacaagctggagtttattcagccgaacgtcatctccggcatcccgatctaccgtgtcatggaccggcagggacaaatcattaacccatcagaggacccacatctccccaaggaaaaggtgctcaagctgtacaagtcaatgaccctgctgaataccatggatcggatcctctacgaaagccaacggcagggtcggatctccttctacatgacgaattatggggaagagggcactcacgttggctcagcagcggcactggataacactgacctggtttttggacagtatagagaggccggagtgttgatgtaccgggactaccctctggaacttttcatggcacagtgctacggaaatatctccgacctcggaaaaggacggcagatgcccgtccactacggctgcaaggaacgccatttcgtcactatcagctcccctctcgcaactcagatcccacaggccgtcggagcagcgtacgcggccaagcgcgccaatgcgaaccgggtcgtgatctgttacttcggagaaggtgcagccagcgagggcgatgcgcatgccggcttcaacttcgccgctaccctggaatgtccgatcattttcttttgccggaacaacggatacgcgatttccaccccaacgtcggaacagtatcgcggggacgggatcgccgcccggggaccaggatacggaattatgtcaatccgggtggacggaaatgatgtgtttgctgtttacaacgcgaccaaggaggctagacgcagagcggttgcggaaaaccaaccttttctcatcgaggcgatgacgtaccgcattggacatcactcaacctccgatgactcgagcgcttaccggtcagtggatgaagtgaactactgggacaaacaggatcatccgatctcacggctccggcattacctgctgtcacagggatggtgggatgaagagcaggagaaagcctggcggaagcaatctcgccgaaaagtcatggaagcctttgaacaggcggaacgcaagccgaagccgaacccaaatctgctgttttcggacgtctatcaggagatgcccgcccaactgcggaagcagcaagaatcgcttgcgaggcacctccaaacttacggagagcactatccgctggaccacttcgacaag

SEQ ID NO: 249601 - DNA, 1335 bp, Artificial Sequence
  Description of Artificial Sequence: Synthetic coding sequence
atggcagtcgcaatagccgcagcacgagtgtggcgccttaatcggggattgtcacaagcagcacttcttctgctcagacaaccaggagctagaggtctggcaagatcccaccctccacgccagcagcaacaatttagttccttggatgataagccccagtttccaggtgctagcgccgaattcatcgacaaattggagtttatacaaccaaacgtgatatcggggattcctatctacagagtgatggacaggcaaggtcagatcatcaatccgtcagaggaccctcatcttcccaaggaaaaggtgctgaagctgtacaagtcgatgacccttctgaacacgatggacagaatcctgtacgaatcccagcggcagggtcggatttcattctacatgactaactacggggaagaggggactcacgttggatcagccgcagccctcgacaacacggatctggtttttggacagtacagagaagcaggtgtgcttatgtacagagattaccccctggaacttttcatggcacagtgttacggcaatatcagcgaccttgggaagggacggcaaatgcccgtgcattacggatgtaaggaaagacactttgtgactatttcgagcccgctcgccacgcagattccgcaagcagtgggtgcggcatacgcagcaaagagggctaacgccaacagggtggtgatttgttactttggtgaaggagcagcaagcgagggggacgcgcatgcaggcttcaattttgcagcgaccctggaatgccccatcatattcttctgccggaacaacggctacgcaatatcgactccgacctcggagcagtatcggggtgatggaatcgccgcaagaggccccggttacggaattatgtcgattagagtggacggcaacgatgtatttgcagtgtacaatgccaccaaagaggcaagacgaagggcagtggcagaaaatcagccttttttgattgaagccatgacttacagaatcggccatcacagcaccagcgatgattcgtcagcgtacagaagcgtcgatgaggtcaattactgggataaacaagaccatccaatatcaaggcttagacattatctcctgtcacaggggtggtgggacgaagagcaggaaaaggcatggcgcaagcaaagcagaaggaaggtcatggaagcattcgaacaggccgaaagaaagccaaagcctaaccctaacctgcttttcagcgacgtctaccaagaaatgcccgctcagctgcgcaaacaacaagagagccttgcaagacatctgcaaacctacggagaacattaccctctggatcattttgataag

SEQ ID NO: 249602 - DNA, 1335 bp, Artificial Sequence
  Description of Artificial Sequence: Synthetic coding sequence
atggccgtagccattgccgccgctagggtgtggcggttgaatcgcgggctgagccaggctgccctgctgttgttgcgacagccaggcgcacggggcctggcgcgaagccatccaccaaggcagcagcagcagttctctagccttgacgataaaccacagtttcccggcgcaagtgcagagtttatcgacaagctggagtttattcagccgaatgtgattagcggaatccccatatatcgggtgatggatcgccagggtcagatcatcaaccccagtgaggacccgcacctgccaaaggagaaagtactgaagctctataagagcatgaccctgctgaacactatggatagaatcctctatgagagccagaggcaagggaggatttccttctatatgaccaattacggggaggaagggacacatgtaggctccgccgctgcactcgacaatacggacctggtctttggacaatatcgggaagccggggtcctgatgtaccgagattacccgctggaactgtttatggcccaatgttacgggaatatctccgacctgggaaagggcagacagatgcccgtgcattatggttgcaaggaaagacatttcgtcaccatcagtagcccgctcgccacacagatacctcaggcggtaggggctgcatacgctgccaaaagagctaatgcaaatcgcgtggtaatttgttactttggagaaggggcagcctcagagggagacgctcacgcaggctttaattttgcagcaacactggaatgtcctatcatcttcttctgtcgaaacaacgggtacgcaatctccacacctacatccgagcagtaccggggcgacggcattgctgcacgggggccaggctacgggatcatgagtattcgggtggatggcaatgatgtgtttgccgtgtacaatgcaacaaaggaggccagaagacgagctgtcgccgagaaccaacctttcctgatcgaggccatgacataccggattggacatcacagcacaagtgacgacagttctgcctacagatccgtggacgaggtcaattattgggataaacaggatcacccgatctcccggctgagacactatctgctgtcccaggggtggtgggacgaggaacaggaaaaagcatggagaaagcaatcccggcgaaaggtcatggaggccttcgaacaggcggagcgcaaacccaagcccaatcctaacctgctgttctctgacgtgtaccaggagatgcctgctcagctgagaaagcaacaggaatccctcgctagacacctgcagacttacggcgaacactacccactggaccatttcgacaaa

SEQ ID NO: 249603 - DNA, 1335 bp, Artificial Sequence
  Description of Artificial Sequence: Synthetic coding sequence
atggcagtggctattgccgctgcgagagtgtggagactgaacagaggactgtctcaggcggcgttgttgctcctgcgtcagccgggtgcacgtggactcgcacgatcccaccctccacggcagcaacaacagttttcgtccctcgacgataaaccgcaattccctggggcctcggctgagttcatagataagctggaattcatccaacccaatgtcatttcgggcatacctatatacagggtcatggataggcagggacaaatcatcaatccctccgaggatccacatctgccaaaggaaaaggtgcttaagctgtacaaaagcatgacgctcctgaataccatggataggattctgtacgagtcccaaagacagggcagaatctccttttacatgaccaattacggagaggagggaacccatgtgggctcggctgctgcactggacaacactgatctggtctttggacagtacagggaagcgggagtgcttatgtaccgggactatccccttgaactcttcatggcccagtgttacggcaacatatcagacctggggaagggacggcaaatgccggtccactacggatgtaaggaaaggcactttgtgacgatttccagcccactggcaactcagatccctcaagccgtcggggcggcatatgcagcgaagcgtgcaaacgcgaatagggtggtgatctgctactttggcgagggagcagcaagcgaaggcgacgcacatgcagggtttaacttcgccgcgactctggaatgtccaataatcttcttctgtcgtaataacggctacgcgatttcaactccaactagcgaacaataccgtggagatggaattgcagcaaggggacctggctacgggattatgtccattagagtggacggtaatgatgtctttgcggtttacaatgcaaccaaggaagcacgccgtagagcagtggcagaaaaccaaccttttcttattgaggcaatgacgtaccggattggacatcactcaacttcggatgattccagcgcataccggtcggtggacgaagtgaactactgggacaagcaggaccatcctatctcgcgcctgcgccattaccttctgtcgcagggctggtgggacgaagaacaggagaaagcatggcgaaagcaatcgagacgaaaggtgatggaggcctttgaacaagcggagcggaagcccaaaccgaacccaaacctccttttcagcgatgtgtaccaggaaatgccagcacaactgcgtaagcaacaggaatccctcgcgcggcatcttcagacttacggagagcattatccactggatcactttgataaa

SEQ ID NO: 249604 - DNA, 1335 bp, Artificial Sequence
  Description of Artificial Sequence: Synthetic coding sequence
atggccgtggctatagccgctgcacgtgtgtggcggttaaacaggggactgtctcaggctgccctgctgctactgaggcaacccggggcccgtgggctagcccggtctcaccccccaagacaacaacagcagttctcttcccttgacgacaagccccaattccccggtgcatcagctgagttcatcgataaacttgagttcatccaaccaaacgtcattagtggtattccaatttaccgtgtcatggatcgtcagggccagatcatcaatcctagtgaggacccccacctgcctaaggagaaagttctcaagctctataaatctatgactcttctgaacacaatggacagaatactgtacgagtctcagcggcagggtaggatcagcttctatatgacaaactacggtgaggaggggacccatgtcgggtccgctgctgccctggacaacactgatctagtgttcgggcagtaccgggaagccggtgttctgatgtatagagactaccctctggaactgtttatggcccaatgctacggaaacatatcagatctgggtaagggccgtcagatgcccgttcactatggttgtaaagagaggcacttcgttaccatctctagtccactagcaacacagatcccacaggctgttggcgcagcctatgctgctaaacgcgcaaacgccaaccgcgtggtcatctgttattttggggagggagccgcctccgagggcgacgctcacgcaggctttaatttcgcagctaccttggagtgtccaattatcttcttctgtcgaaataacggttacgcaatatctacccctactagtgaacaatacaggggcgacggtatcgccgccagaggcccaggatacgggataatgagcatcagagtggatggaaacgacgtcttcgccgtctataatgccaccaaggaggctagacgccgcgccgtcgctgagaaccagccattcctaatcgaagcaatgacttatagaataggccaccacagcacttctgacgattctagcgcctaccgcagtgttgacgaggtgaattattgggataagcaggaccatccaatatctaggctgcgtcactacctgttaagtcagggatggtgggatgaggagcaggaaaaggcatggcggaaacagtctaggcgtaaggttatggaagcatttgagcaggccgaacgcaaaccaaaacctaaccctaaccttctgttctccgatgtttaccaagaaatgcctgcccaacttagaaaacagcaggagagcctcgctcggcacctgcagacctacggagagcattaccctctggaccacttcgataag

SEQ ID NO: 249605 - DNA, 1335 bp, Artificial Sequence
  Description of Artificial Sequence: Synthetic coding sequence
atggcagtggcaatagcagcagcaagagtgtggcgtttgaatcgggggctttctcaggcagcacttcttcttcttaggcaacctggtgcacgtggactggcaaggtcccaccctccccgacaacaacaacaattttcatcgctcgacgacaagcctcagtttccaggtgcatccgcggagttcattgataaactcgaattcattcagcccaacgtcatctccggcatccccatctaccgcgtcatggatagacagggacagattatcaacccatccgaagatccacatctgccgaaggagaaggtgcttaagctgtacaagtccatgaccctgctgaacactatggatcggattctttacgaaagccaaaggcaagggcgtatttcgttctacatgactaactacggagaagagggtactcacgtgggctccgcagcagcactggacaataccgacctggttttcggacaatacagagaagccggtgtgcttatgtacagagactaccccctggaactgtttatggctcagtgctacggaaacatctccgacctgggaaagggtaggcaaatgccagtgcactacgggtgtaaggagaggcactttgtgaccatatcgagcccactcgcaactcagattcctcaggcagtgggagccgcatacgcagcaaagcgcgcaaacgcgaatagagtggtcatttgttacttcggagagggcgcagcatcggagggagatgcacatgcaggttttaactttgcggcgactctcgaatgtccaatcattttcttttgcagaaataacggttacgcaatcagcactcctaccagcgagcaataccgtggtgatggtatagctgcacgcggtccgggatatggaatcatgtcgatcagagtggatggtaacgacgtgttcgcagtgtacaatgcgactaaagaagcccgtagacgcgcagtggccgagaaccagcctttcttgatcgaagcgatgacctacagaatcggacaccactccacctcagatgactcctcagcctaccggtcagttgacgaggtgaattactgggataagcaagatcatcccatatcccgacttaggcactaccttctgtcccaaggatggtgggacgaggagcaggagaaggcctggagaaaacagtcacggagaaaggtgatggaagcgttcgaacaagcagaaagaaaacctaagccaaacccgaacctgcttttttcagacgtgtaccaagaaatgcccgcccagcttaggaagcaacaagaatcgttggcaagacatctgcagacctacggggagcattaccctcttgaccatttcgacaaa

SEQ ID NO: 249606 - DNA, 1335 bp, Artificial Sequence
  Description of Artificial Sequence: Synthetic coding sequence
atggccgtggccattgctgccgcgcgcgtctggcgtctcaataggggcttaagccaggccgcacttctgctgctgcgccagcctggagctcgtggcctggcccgcagccacccacctcgtcagcagcagcaattttcttcgctagacgacaagcctcagttccccggcgcaagcgccgagttcatcgataagctggagttcattcagcctaatgtgatcagcggcattcctatttatcgtgtgatggatcgccaaggccagatcatcaacccttctgaggacccgcatcttcctaaggaaaaggtgctcaagctatacaagagcatgactctgctgaataccatggatcgcattctgtacgaatcccagcggcagggcagaattagcttctacatgacgaactacggcgaggaaggcacacacgtgggttccgctgcggcactggataacaccgatttagtgttcggtcaatatcgcgaagcgggagtcctgatgtaccgtgactacccgctggagcttttcatggcacagtgctacggaaacatcagcgacctgggcaaaggtcgtcaaatgcctgtgcattacgggtgcaaagaacgccattttgtgactataagctctccgcttgccactcagattccgcaggcagtcggagccgcatatgctgcgaagcgggcaaatgcgaaccgcgtggtgatttgttacttcggcgagggagcggcctcagagggggacgcccacgccggcttcaacttcgccgccacactcgaatgcccgattattttcttttgcagaaataacgggtatgcgatttcaaccccgacttctgagcagtatcgtggcgacggaattgcggctcgaggtccaggttatggcataatgtccatccgggtggacggcaatgacgttttcgcagtttataatgcaaccaaggaagcccggcgcagggcggttgccgagaatcaaccttttctgatcgaggctatgacctatcgaattggtcaccatagcaccagcgacgattcttccgcctaccgctcggtcgacgaagtaaactactgggataaacaggatcacccaatcagccgcctgcgccattacctgctgagccaaggttggtgggatgaagagcaggaaaaggcctggcgtaaacagtcacgtagaaaggttatggaggccttcgagcaggcagaacgcaagccaaagccgaacccgaacctgctcttcagtgatgtttaccaagaaatgccagcacagctgcgcaagcagcaggagagtcttgcgcgtcacctgcagacctacggtgagcattatccactggaccacttcgacaag

SEQ ID NO: 249607 - DNA, 1335 bp, Artificial Sequence
  Description of Artificial Sequence: Synthetic coding sequence
atggccgtggcaatcgctgcagctcgagtgtggaggttgaaccgcggactatcacaggcagccttactgttactccggcagcccggcgcaaggggcctagctcgctcccatcccccacgtcagcagcaacagttctcgtccctggacgacaagccgcagttcccaggggcctccgctgagtttattgacaagctggaatttatacaacccaatgttatctcaggcatccccatctatcgtgtcatggaccggcaggggcagattatcaatccatccgaagatccacatctgcctaaggaaaaggttcttaaactttacaagtctatgactctgctaaacactatggacaggatcctctacgagtcccagcgtcagggtcgcatttctttttatatgaccaattatggagaggaagggacgcatgtggggagtgccgccgcacttgataataccgatttggttttcgggcaatacagagaggcgggggtactgatgtaccgcgactatccactagaattattcatggcacaatgctacggaaacatcagtgatctcggcaaggggaggcagatgcctgtccattatgggtgtaaggaaaggcactttgtgaccatttctagccctctggctactcagatccctcaggccgtaggcgccgcatacgccgccaaaagggccaacgccaatagagtggtcatatgttacttcggcgaaggcgccgctagcgaaggggacgcccatgctggatttaatttcgcggcgacgctcgaatgccccattattttcttttgtcgtaacaacggctacgcgatctccacaccgacgtccgagcagtatcggggagacggaatcgcagctagaggtccgggttacggtataatgagcataagggttgacggcaacgatgtttttgccgtgtataatgctaccaaagaagcccgccggcgggcagtggctgaaaaccagcccttcttgattgaggccatgacctatcgcatcggacatcactctaccagcgacgactcaagcgcatacaggagcgtagacgaggtgaactattgggacaagcaggaccaccccatcagtcgactccgccattacctgttaagtcagggctggtgggacgaagaacaggagaaggcgtggcgcaagcaaagccggagaaaagtgatggaggcttttgagcaggcggagcgcaaaccaaagcctaatccaaacctactcttctctgacgtataccaggagatgcctgctcaacttcgaaagcaacaagagtctctcgcacgacacttgcagacttacggggaacactacccgctcgatcactttgacaag

SEQ ID NO: 249608 - DNA, 870 bp, Artificial Sequence
  Description of Artificial Sequence: Synthetic coding sequence
atgatcgaaactgacagcggggtggacgatgatatggcctgccataagatcccggtcgaggccgacttcctctacgcatactcgaccgcaccaggttactatagctggcgtaatagcaaggatggatcatggtttatccaatcactctgtgccatgctcaagcagtacgcggataagctggagtttatgcatatcctgacccgtgtgaacaggaaggtggcaactgaatttgagtcattctcctttgatgcaaccttccatgcaaaaaagcaaattccctgtatcgtctccatgttgactaaggaactgtacttctaccatgacgaggtggacggtggaagccctatggaaaataccgaaaatagcgtggatagcaagtcgatcaagaacttggagcccaagataatccatggttcggaatcgatggactccgggatctcgttggataactcctacaagatggattatccagaaatggggctctgtattatcattaacaacaagaatttccacaaatccactgggatgaccagccggtcgggcactgatgtggatgcggccaatctgagagaaacctttagaaaccttaagtacgaagtgcgcaacaagaatgatcttactagggaagaaattgttgaactcatgcgggatgtgagcaaggaagatcactccaagagatcctccttcgtgtgtgtgcttctgtcgcatggagaagaaggaatcatttttggtactaatggtcctgttgaccttaagaaaatcactaatttctttagaggtgatcgctgcaggtcccttactggtaaaccaaaacttttcattatccaggcgtgtcgcgggaccgagctggattgtggaattgaaaccgat

SEQ ID NO: 249609 - DNA, 870 bp, Artificial Sequence
  Description of Artificial Sequence: Synthetic coding sequence
atgatcgagactgactccggagtggacgacgatatggcatgccacaagatcccggtggaagcagatttcctttacgcttacagcacggcaccggggtactactcgtggcggaattcgaaagacgggagctggttcatacagagcctgtgcgccatgctcaagcaatacgcagacaaattggagttcatgcatatcctgactcgcgtgaacaggaaggtggcgacggagttcgagtcattcagtttcgatgccactttccacgccaaaaagcagatcccctgtattgtgtcaatgctcactaaggaactgtacttttatcacgacgaagtggatggaggatctcctatggagaacaccgaaaattctgtggactcgaagtcaatcaagaatctggagccgaagatcatccacggatcggaatccatggactcaggcatcagcctggataactcctacaaaatggactacccggagatgggactctgcattatcatcaataacaagaactttcacaagtcgaccgggatgactagcaggtcgggcactgacgtcgatgcagctaatttgagagaaactttcagaaatcttaagtacgaagtgcgcaataagaacgaccttacccgagaggaaatcgtggaactgatgcgagatgtctccaaggaagatcactctaaacgcagctcctttgtgtgcgttcttctgtcccatggagaggaaggcattatctttggcactaatggaccagtcgatctcaagaagatcaccaatttcttcaggggcgaccggtgtcggagcctgacgggaaagccgaaactgttcatcatccaggcatgccggggaaccgaactggactgcgggattgaaactgac

SEQ ID NO: 249610 - DNA, 870 bp, Artificial Sequence
  Description of Artificial Sequence: Synthetic coding sequence
atgatagagacagactccggggtggatgatgatatggcctgccacaagataccagtggaagctgatttcctgtacgcctacagtactgctcctggatattacagttggagaaattcgaaggatgggtcttggtttatccagtccttgtgcgcaatgttaaaacaatatgcagacaaactggagtttatgcacatccttactcgcgtgaataggaaggtggccacagagtttgagagctttagctttgatgcaacattccatgccaagaaacaaatcccatgtatcgtgtcaatgctcacgaaagagttgtacttttatcacgatgaagtggacggcggcagcccaatggagaatacagagaattccgtagactctaagagcataaaaaacttggagcctaaaataatccacgggtcagagtcaatggacagtggcattagcctggataatagttacaaaatggactaccctgaaatgggcctatgtatcatcattaataacaaaaatttccacaaatccacgggcatgaccagcagatccggaacagacgttgacgccgccaacctgagggagacctttaggaacctgaagtatgaagtgcgcaacaaaaatgacctcacccgggaggagatcgtggagctgatgcgtgacgtttctaaagaagatcacagcaagcgcagtagttttgtttgtgtactattatcgcacggggaggaaggcattatttttggcactaacggccctgtggatctgaaaaaaataaccaacttcttccgtggggacaggtgccgatctctgacaggcaaacccaagttgttcattattcaggcttgtcgcggcacggagttagattgtggtattgagactgac

SEQ ID NO: 249611 - DNA, 870 bp, Artificial Sequence
  Description of Artificial Sequence: Synthetic coding sequence
atgatagagaccgattcaggtgtcgacgacgacatggcttgccacaaaattcctgtcgaggcggattttctgtatgcatactctactgctcctggttattactcttggaggaattccaaagacggcagttggtttatccagtctctgtgcgctatgctgaagcagtacgccgacaagctggagttcatgcacattctgacaagagtaaaccgcaaagtggctaccgaatttgagtccttctcttttgatgcaacattccacgcgaaaaaacagatcccttgcatcgtgtccatgctgacgaaggaactgtacttctaccatgacgaggtggacggcggttctcccatggagaatacagagaacagcgtggactctaagtccatcaaaaacctcgaacccaaaattattcatggttctgaatctatggattctggaatttctcttgacaacagctataaaatggactacccagagatgggtctctgcattataatcaacaacaagaactttcacaagtctactggaatgacctctcgctccggcaccgacgtggatgccgccaacttgcgcgagacatttaggaacttgaaatacgaggtaaggaataaaaacgacctgaccagggaagaaatcgtggaacttatgagagacgtgagtaaggaggatcattccaagaggtcatccttcgtctgcgttctcctctcacacggagaagaaggcataatttttggcacaaacggacccgtggatttgaagaagatcactaactttttcaggggcgataggtgtcgctcactgacgggaaagcctaagttgttcattatacaagcatgtaggggtacagaactggattgtggaatcgagaccgac

SEQ ID NO: 249612 - DNA, 870 bp, Artificial Sequence
  Description of Artificial Sequence: Synthetic coding sequence
atgatcgaaacggacagcggtgtcgacgacgacatggcttgtcataagatcccggtggaagccgacttcctgtatgcgtatagcaccgcccctggatactactcctggcggaattcgaaggacggctcctggttcatccaatccctctgtgcgatgcttaaacagtacgctgacaaactggagttcatgcacattctgactcgcgtaaacaggaaggtggctactgagttcgaatcgtttagtttcgatgcaacctttcacgccaagaagcagatcccatgcatcgtgtccatgctgactaaggaactgtacttttaccatgatgaggtggatggaggatcaccgatggagaacaccgaaaattcggtcgactcgaaatcaataaagaacctggaacccaaaatcatacatggctcggaatcaatggattctggtatctcactcgacaactcatacaagatggattacccggagatgggactctgcatcatcatcaacaacaaaaacttccacaagtccactggtatgacctctaggtccgggaccgatgtggacgcagcaaatttgagggaaacgttccgtaatctcaaatacgaagtgaggaataagaacgacctgactcgcgaggagatcgtcgagctgatgcgggacgtgtctaaggaggatcacagcaaacggtcgtcgttcgtttgcgtgctcctgtctcacggagaagaagggattatctttggaaccaacgggccagtcgacttgaagaagatcaccaacttcttccgcggagatcggtgccgcagcctgactggtaagcctaaacttttcatcattcaggcctgccgaggcactgagttggattgcggcatagaaaccgac

SEQ ID NO: 249613 - DNA, 870 bp, Artificial Sequence
  Description of Artificial Sequence: Synthetic coding sequence
atgatcgaaactgacagcggagtcgatgatgatatggcttgccacaaaatccctgtcgaagcggacttcttgtacgcctactccaccgcacccggatactactcctggagaaatagcaaagatggttcctggtttatccagtcgctctgcgctatgctgaaacagtacgccgataagctggagtttatgcacatcctgacccgcgtcaaccgcaaagtggctaccgagtttgagtcgttctccttcgatgcaactttccatgcgaaaaagcaaatcccgtgcatcgtgtcaatgttgaccaaagaactgtacttttaccacgacgaagtcgacggaggctccccgatggagaatactgagaactcggtcgattcaaagtcgattaagaatctcgagccgaaaatcatccacggatcggagagcatggactcaggaattagcctcgataactcgtacaagatggattatcctgagatgggtctgtgtatcatcatcaacaataagaatttccataagtcaactggtatgacttccagatcgggaaccgatgtggacgcagccaacctcagagagactttcaggaacctcaagtacgaagtgcgcaacaagaatgaccttactcgggaggaaatcgtcgagttgatgcgcgatgtgtccaaggaggaccactcgaagcggtcctcgtttgtgtgtgtgctgctgtcacacggtgaagaaggaatcatctttggaactaatggaccggtcgatctcaagaaaatcactaacttcttcagaggtgatcgatgcagatcgcttaccggaaagccgaagctgttcatcatccaggcatgcagaggcacggaactggactgcggcattgaaaccgac

SEQ ID NO: 249614 - DNA, 870 bp, Artificial Sequence
  Description of Artificial Sequence: Synthetic coding sequence
atgatcgaaacagactctggagtggacgatgacatggcttgtcacaagatccccgtcgaggcggatttcctttatgcctatagtactgcacccggctactattcctggcgtaattctaaggacggcagctggtttatccagtcgctatgcgctatgctgaagcagtacgcagacaagctggaatttatgcatatcttgactagagtgaaccggaaggtggctacggagtttgagtcattttcttttgatgcgacttttcacgcaaagaagcagataccttgcatagtgtccatgctgacaaaagaactctatttttatcacgacgaagtcgacggtggatctccaatggagaacaccgaaaattcagtggattcaaagtcaatcaagaacctcgagcctaaaattatccatggatcggaatccatggactccggaatttcactggataattcttacaaaatggactatccagaaatgggactttgcatcattatcaacaataagaattttcacaaatctaccgggatgacgagcagaagcgggacagacgtcgatgccgcaaacctgagggagacttttcggaatttaaaatacgaagtccggaacaagaatgatctcacccgcgaggaaatcgtggagctaatgagggatgtgagtaaggaggaccacagcaagaggagctctttcgtttgtgtgctgctgtcccacggcgaagaaggaataatatttggaacgaatggacccgtggatcttaagaagatcaccaatttctttcgtggagaccggtgtcgctcccttacaggcaagccgaagctcttcatcatccaggcatgcagaggcaccgagctcgattgcggcatagagactgat

SEQ ID NO: 249615 - DNA, 870 bp, Artificial Sequence; identical to SEQ ID NO: 249610
  Description of Artificial Sequence: Synthetic coding sequence

SEQ ID NO: 249616 - DNA, 870 bp, Artificial Sequence
  Description of Artificial Sequence: Synthetic coding sequence
atgatcgaaaccgacagcggagtggatgatgacatggcttgccacaaaatcccggtggaagcagatttcctttatgcatatagtaccgcgccgggctactacagctggcggaattcgaaggatggatcgtggttcatccaatcgctgtgcgccatgctcaagcagtacgcggacaaactcgagttcatgcacatccttacccgagtcaaccgcaaggtcgcaaccgagttcgaatcgttctcgttcgacgccactttccatgctaaaaagcagatcccatgtatcgtgagcatgctgactaaagagctctacttctatcatgacgaagttgacggaggctcaccgatggaaaacaccgaaaattcagtggattccaagtccattaagaacctggaacccaagataatccacggttccgaaagcatggactcaggcatctccctggacaattcctacaagatggactaccctgagatggggctgtgcatcatcattaacaacaagaatttccacaaatcaaccggcatgacttcacgctccggaaccgacgtggacgccgcaaatctgagagagacttttcgcaacctcaagtacgaagtccgtaacaagaacgatctcacccgcgaggaaatcgtggaactgatgcgcgacgtctccaaggaggatcattcgaaacggtcgtcttttgtctgcgtgctgctttcacacggagaggaaggcataatctttgggaccaacggaccagtcgatctgaagaaaatcactaacttctttcggggcgatcgctgtagatcattgactggaaagccgaagctcttcataatccaagcgtgcaggggaaccgagctggattgcggcattgaaaccgac

SEQ ID NO: 249617 - DNA, 870 bp, Artificial Sequence
  Description of Artificial Sequence: Synthetic coding sequence
atgatcgaaaccgattccggagtcgatgacgatatggcgtgtcacaagattcctgtggaagcggacttcctttacgcatacagcacggcaccaggatactacagctggcggaatagcaaggatggttcgtggtttattcaatcactttgtgctatgctcaaacagtacgcagataaactggaattcatgcatatcttgaccagggtgaaccggaaggtggccactgaatttgaatccttttcgttcgatgcaactttccacgctaagaagcagattccatgtattgtgtccatgcttactaaggaactctacttctaccatgacgaagtcgatggaggatcacccatggaaaacaccgagaacagcgtggattcaaagtcgattaagaatcttgagccgaaaatcatccacggctcggagagcatggattctggtatttcactggataattcatacaaaatggattacccagagatggggctgtgtattatcatcaataacaaaaactttcacaaaagcactggcatgacttcccggagcgggacggatgtcgatgcagcaaaccttagagaaaccttcaggaatcttaagtacgaagtgaggaacaagaatgatctgactcgagaagagattgtcgaactgatgagagatgtgtcgaaggaggaccactcaaaacggtcgtcatttgtgtgtgtgcttcttagccacggagaagaggggatcatttttggaactaatgggcctgtcgatctcaagaagataactaactttttccgcggagatagatgccgttcactgaccggcaagccaaaacttttcattatacaggcatgcaggggtactgaacttgactgcggcatagaaaccgac

SEQ ID NO: 249618 - DNA, 870 bp, Artificial Sequence
  Description of Artificial Sequence: Synthetic coding sequence
atgattgaaacggactctggtgttgatgacgatatggcttgtcacaaaataccagtcgaggccgacttcctgtatgcctattcaacagctccgggatattattcatggagaaactcgaaagacggatcgtggttcattcaatctctgtgtgctatgttaaaacagtacgctgataagctagagttcatgcatatcttgacacgtgtaaaccgtaaagtggctacagagttcgaaagtttctccttcgacgcaacatttcatgctaaaaaacaaattccgtgtatagtctccatgctaacaaaagaactctatttctaccatgatgaagttgatggaggatcccctatggaaaatactgagaattcggtggacagtaagtctattaaaaatttggaacccaagattattcatggaagtgaatcaatggattcaggtatctcacttgataattcttataaaatggattatcctgaaatgggactttgtatcattataaacaacaagaattttcacaaatctacaggaatgacttctagatccggcactgatgtagatgctgctaatttgcgtgaaacatttagaaatcttaagtacgaagtgagaaacaaaaatgatttgacccgagaagagatagtagaacttatgcgagatgtgagtaaggaagatcacagtaagcgttcatcttttgtttgcgtacttctgtcgcatggagaggaaggaatcatctttggaactaacgggccagtcgatctaaagaagattacaaattttttccgcggagatcgatgccgatctcttaccggaaaacccaaactcttcataattcaagcatgtcggggtactgaacttgactgtggaatagaaaccgac

SEQ ID NO: 249619 - DNA, 870 bp, Artificial Sequence
  Description of Artificial Sequence: Synthetic coding sequence
atgatcgagaccgacagcggagtcgatgatgacatggcctgtcataagatcccagtggaggccgacttcctgtatgcctactcaactgcgccaggatattattcatggcgtaattccaaggacggatcctggttcatccagtctctgtgtgccatgcttaagcagtatgctgataagctggaattcatgcacatcttaacaagagttaataggaaagtagcaacggagtttgaatctttctcatttgacgcgacatttcatgcaaagaaacagatcccttgtatcgtctccatgctgacaaaggagttgtatttttaccatgacgaggtagatggaggttccccaatggaaaacacagaaaatagcgtggattccaagtctataaaaaacctggagcccaaaatcatccacggatccgaatctatggacagcggaatttctctcgataactcttacaaaatggactatccagagatgggcctgtgcataatcataaataataagaacttccataagagtaccggaatgacaagtcgaagcggtacagacgttgatgcggccaacctgcgggagacttttcgtaatcttaagtacgaagtgcggaacaagaacgaccttactcgggaagagatcgtcgagctcatgcgcgatgtctccaaagaggaccactcgaaaagatcatcgttcgtgtgtgtgttactctctcatggggaggaaggtataatcttcgggactaacggccctgtggacctgaaaaaaatcaccaacttttttcggggggacagatgtaggtctctgacaggcaaaccgaaactgtttataattcaggcatgccggggcacggagttggattgtggcattgaaaccgat

SEQ ID NO: 249620 - DNA, 870 bp, Artificial Sequence
  Description of Artificial Sequence: Synthetic coding sequence
atgattgaaacggatagcggggtagatgacgacatggcctgccacaagatcccagtggaggccgatttcctctacgcctattctactgcgccgggctactattcctggcgtaattccaaggacggtagttggtttatccagtcgttgtgtgcaatgctcaagcagtacgccgacaaactggaattcatgcatattctcacacgcgtgaacaggaaggtggctactgagtttgagtccttctcctttgacgctactttccatgccaagaagcagatcccttgtatagtatccatgcttaccaaggagctatacttctaccatgatgaggtcgatggaggatcaccgatggaaaacacggaaaattctgtggactccaagtccattaaaaacctcgaaccgaagataatacacgggagcgaatctatggacagtgggattagcttggataatagttacaaaatggactaccccgagatggggctgtgtatcatcatcaacaacaaaaactttcataagagcaccggcatgacaagccgctcaggtaccgacgtcgatgccgccaatctgcgggagactttccggaatcttaaatacgaggtgagaaacaaaaacgacctgacacgggaggaaattgtggaactcatgcgggacgtgtccaaagaggaccactcaaagcggtcctcctttgtatgcgtgctgctctctcacggcgaggaaggtatcattttcgggaccaatggaccggtcgatctgaaaaagattacgaacttcttccgcggcgaccgttgtagatcccttacaggcaagccaaaactgtttatcattcaggcttgcagaggcacagagctagactgcggcatcgagaccgac

SEQ ID NO: 249621 - DNA, 870 bp, Artificial Sequence
  Description of Artificial Sequence: Synthetic coding sequence
atgatcgaaactgacagtggggtggatgacgacatggcatgtcataaaatacccgtcgaggctgattttctgtatgcatatagcactgctcccggctattactcttggcgaaatagcaaggacggaagctggttcatccaatcgttatgcgcgatgctcaagcagtatgcggataagctggaattcatgcacatcctgacacgcgtcaatcggaaagtggcaaccgaatttgagagcttcagtttcgacgccacattccatgccaaaaaacagatcccctgcatcgtttctatgctgaccaaagaactgtatttttatcacgatgaggtcgatggtggctcacccatggagaacactgaaaattcagtggattccaagtccatcaagaacttggagcccaaaatcatccatggttctgagtccatggactctggcatcagtctggacaactcctacaaaatggactaccctgagatgggcctctgcatcatcatcaacaacaaaaattttcacaaatctaccggaatgacatcgcggtccggcactgacgtagatgccgccaacctacgcgagacttttcgcaacctgaagtacgaagtgcggaataaaaacgatttgacccgagaggagattgtagagctgatgcgcgacgtgagcaaggaggatcactccaagagaagtagctttgtctgtgtgctgctgagccacggcgaagaaggaataatttttggcacgaacggccccgtggatctcaagaaaataacgaacttctttaggggtgatagatgcagatccctaaccggcaaacccaagctgttcattattcaggcatgtcggggtaccgaactggactgcgggatcgagacggat

SEQ ID NO: 249622 - DNA, 870 bp, Artificial Sequence
  Description of Artificial Sequence: Synthetic coding sequence
atgatagagaccgatagtggcgtggatgacgatatggcctgccataagatacctgtggaggcagacttcttgtacgcatattctacagcaccaggttattattcttggcgaaatagcaaggacggctcctggtttattcagtcactgtgcgccatgctgaagcagtatgcagataagctggagtttatgcacatcttgacaagagtgaacaggaaagtggccactgagttcgagagtttctcctttgacgcgaccttccacgctaagaaacagattccctgtattgtgtcaatgctgactaaggaactgtacttctatcacgatgaagtggacggaggcagcccgatggagaacaccgagaattctgtggactccaagagcataaaaaacctggagccgaagatcatccacggttcagagtctatggactccggcatttccctggacaattcctacaaaatggactatccagaaatggggctatgtatcataatcaataacaagaactttcacaagtcaaccggcatgacttctaggagtggcacagacgtggatgcagctaacctacgagaaacattcaggaatttgaagtacgaagtgaggaataaaaatgacctcacacgtgaagaaatcgtggaactgatgagagatgtatctaaagaggatcactcgaaacgttctagctttgtttgcgtgctgctatcccacggggaagaaggaattatctttggaaccaatggtccagtggacctgaagaaaatcactaactttttccgtggtgaccgatgccgcagcctgaccggcaagcccaaactattcattatccaggcatgcaggggaaccgaactggactgtgggatagagaccgac

SEQ ID NO: 249623 - DNA, 870 bp, Artificial Sequence
  Description of Artificial Sequence: Synthetic coding sequence
atgatcgagaccgatagcggtgtggatgatgacatggcttgtcacaagatacccgtggaagcagactttctttacgcctattctaccgcacctggctactactcttggcgcaactctaaggacggatcgtggttcattcaaagtctttgtgccatgctcaagcagtacgcagacaagcttgagtttatgcacattttgacacgagtcaatagaaaggtagccacagagttcgaatccttcagcttcgacgcaactttccacgcgaaaaaacagattccatgtatcgtgagcatgttaaccaaagaattatatttctatcatgatgaagtcgacgggggatcgccaatggaaaatacagaaaacagcgtagatagtaagtcaataaagaatctggagccaaagattatccatggttccgagagtatggatagcggcatcagcttggataactcctataagatggattatcctgaaatgggcctctgtatcattattaataataaaaatttccacaaatctaccggcatgacctccaggagtggcacagacgtagacgctgccaatttgcgggagaccttcagaaaccttaagtatgaggtcaggaacaaaaacgatctgactagagaggagattgtcgagctgatgcgggacgtgtctaaggaggatcatagcaagcgatcatcctttgtttgcgtcctgttgtctcatggagaagagggcatcattttcggcacgaacggacctgtcgatctgaagaaaataaccaatttctttaggggggacagatgcaggagcctgaccgggaagccgaagcttttcatcatccaggcttgcaggggaactgaactcgactgcggcatagaaacggat

SEQ ID NO: 249624 - DNA, 870 bp, Artificial Sequence
  Description of Artificial Sequence: Synthetic coding sequence
atgatcgagaccgatagtggagtagatgacgacatggcatgccacaagattcccgtggaagccgatttcctctatgcctacagcacagccccagggtactattcatggcggaatagcaaagacggatcctggtttattcagagtctctgcgctatgcttaagcagtatgccgacaaactggaattcatgcacatcctcactagggtgaaccgaaaggtagcaactgaatttgaaagcttctctttcgacgcaaccttccacgcaaaaaagcaaattccatgcatagtgtccatgctgacgaaagagctttacttttatcatgacgaggtggatggaggatcacccatggaaaatacagagaattccgtagacagtaagagcatcaagaacctggaacccaaaattatccatggaagcgagtcaatggattctggcatttcactggataatagctataaaatggattatccagagatgggactgtgtattatcattaacaacaaaaactttcacaagtcgacgggtatgactagtcgatccggaacggatgtggacgccgcaaatctgcgcgagacttttcgcaatctcaaatacgaggtgcgtaacaagaatgatctaactcgggaggaaatcgtggagttgatgagagacgtatccaaggaggaccattccaagaggtcttcctttgtctgcgtcctactgtcgcatggcgaggagggaataatcttcggtacaaacggccctgtcgatctgaaaaagatcactaatttcttccggggggatagatgcaggagcctcacggggaagccaaaattgttcattatacaggcctgccggggaacggagctggattgcggcatagaaacggat

SEQ ID NO: 249625 - DNA, 870 bp, Artificial Sequence
  Description of Artificial Sequence: Synthetic coding sequence
atgattgaaacggatagtggtgtcgatgatgatatggcttgccataagatcccggttgaggctgacttcttgtatgcatatagtaccgcacctggttattactcgtggcgtaatagcaaggatggtagttggtttatccagagcctttgtgcaatgttaaaacaatatgcggacaagcttgagtttatgcatattttaacacgagttaaccgtaaggtcgcaactgagttcgaatcttttagcttcgatgctacgtttcatgctaagaaacaaataccatgcatagttagcatgctaacaaaagaattgtacttctaccatgatgaagttgacggtggttccccaatggagaacacagagaattccgtcgactctaagtcgatcaaaaacttagaacccaagatcatccacggaagtgaaagtatggacagtggtatctctttagacaactcctacaagatggattacccagagatgggcttgtgcatcatcatcaataataaaaatttccacaagtcaactggcatgacttctagatccgggactgatgttgatgcagcaaatttacgcgagacttttagaaacttaaaatatgaggttaggaataaaaatgatctcacaagggaggaaattgttgagctaatgagggatgtgtccaaagaggatcactcaaagaggagttcttttgtttgtgttctgcttagtcatggtgaggaagggatcatctttggtacgaacggcccggtagatctgaaaaagataacaaatttttttaggggagacagatgccgatctttgactgggaagcctaagttgttcatcatacaagcgtgtaggggtacagagttggattgtggcattgagacggat

SEQ ID NO: 249626 - DNA, 870 bp, Artificial Sequence
  Description of Artificial Sequence: Synthetic coding sequence
atgatagagaccgatagtggtgtggatgatgatatggcctgccataaaattcccgtggaggcagatttcctatacgcctactccaccgcgcctgggtattactcctggcggaattccaaggatggcagctggttcattcagtccttatgtgccatgctgaaacaatacgctgacaaactggaatttatgcacattctgactcgggttaacaggaaggtggcaaccgagttcgagtctttctcctttgatgctacatttcatgcaaaaaaacagattccttgcatcgtgagcatgctgactaaagaactgtatttctaccacgacgaggtggatggcggcagtcctatggaaaatacagaaaactcggtggattcaaaatctataaagaatctggaaccaaaaattatccacggttcagagagcatggacagtggaatttcactggacaatagctacaagatggattaccctgaaatgggactgtgtattattatcaacaacaagaactttcataagtccacagggatgactagccggtccggcacggacgtcgacgcggccaacctgcgcgaaacttttcgcaatctgaagtatgaagtcagaaataagaatgacctgacccgcgaggaaattgttgagctgatgagagatgtcagcaaagaggaccattcaaaacggagttcattcgtgtgtgtgctcctgtcccatggagaggaaggtatcatcttcggcaccaatggacctgttgacctcaaaaaaataaccaatttttttcggggggaccggtgcaggtcccttacaggtaaaccaaaactgttcatcatacaagcctgtcgtggcacagagctggattgcggcatagaaaccgat

SEQ ID NO: 249627 - DNA, 870 bp, Artificial Sequence
  Description of Artificial Sequence: Synthetic coding sequence
atgatcgagaccgatagcggcgtggatgacgatatggcttgccacaaaatccctgttgaggccgatttcctgtatgcctacagcacggcacccggctactactcgtggagaaactccaaggacggatcctggttcatccagtccctttgcgcgatgctcaaacagtacgccgacaagctcgaattcatgcacatcctaacccgtgtaaacagaaaagtggcgacggaatttgaatcattctcatttgacgccacctttcatgctaagaaacagatcccctgtatcgtgtcgatgctgactaaggagctctacttctaccatgatgaagtggacggaggttctccaatggaaaacactgagaactccgtggactcaaaatcaatcaagaacctggagcctaagatcatccacggcagtgaatctatggactctggcatcagtctggacaatagctacaaaatggattatccagaaatgggactgtgcattatcattaataataagaacttccacaaatctacaggaatgaccagccgcagtggtaccgacgttgatgctgccaatttgagggagaccttcagaaacctgaagtacgaggtccggaataagaacgatctgactcgtgaagagatagtggagctgatgcgggacgtgagcaaggaagaccatagcaagaggagttcatttgtatgcgtccttttgtcgcacggtgaagagggaataatcttcggcacgaatgggcccgtcgatctgaagaagatcacgaattttttccggggcgataggtgtaggtccttgaccggtaagcccaagctgttcattattcaggcctgccggggaacagaactcgattgtggtatcgaaacagat

SEQ ID NO: 249628 - DNA, 870 bp, Artificial Sequence
  Description of Artificial Sequence: Synthetic coding sequence
atgatcgaaactgattcaggtgttgacgatgatatggcatgccataagatccctgtcgaggcagactttttatatgcatattctacagccccaggctattacagttggagaaattctaaagatggatcgtggtttattcagtccctttgtgcaatgctgaaacaatacgcagataaactagaatttatgcatatcctcacgcgagtgaaccgcaaagtagctacggaatttgagtcgttttctttcgacgcaacattccatgccaagaagcaaattccatgtattgtctccatgttgacaaaagaactgtacttctatcacgatgaagtagatggcggatctccgatggagaacacggaaaattctgtagattctaagtctattaagaacctggaaccgaaaattatacacggaagcgaatctatggatagtgggataagtcttgacaacagctacaagatggattaccccgaaatgggtctatgcatcataattaataataagaatttccacaaatcgactggcatgacgtcacgttccggaacagacgtcgacgctgctaacttgcgcgaaacgtttcgtaatcttaaatatgaagttcgaaataaaaatgacttgacgcgcgaagaaatagtagaactgatgagggacgtgtctaaagaagaccattcaaagcgctcgtcatttgtgtgcgtgctccttagccatggagaggaaggcatcatatttggaaccaatggaccggtcgatcttaaaaagattacgaacttttttcggggcgatagatgccgttcattgacaggcaaaccgaagttgttcattattcaagcttgcagaggtacggaactggattgtggcattgaaaccgat

SEQ ID NO: 249629 - DNA, 870 bp, Artificial Sequence
  Description of Artificial Sequence: Synthetic coding sequence
atgattgaaactgacagtggtgtcgacgacgacatggcctgtcataagatccccgttgaggccgacttcctttacgcctactccactgctcccggatattactcctggcgaaactcaaaggatggaagttggttcatccaatcgctctgcgccatgttaaagcagtacgcagacaagcttgagttcatgcacatcctcaccagggtgaataggaaagtggccaccgagttcgagagtttcagtttcgacgcaacattccacgcaaagaaacaaataccgtgcatcgtgtccatgctcactaaggaactgtacttttatcatgacgaggtggatggcggttcaccaatggaaaacactgaaaactccgtggactccaaatccatcaaaaatctagagcccaagataatacacgggtccgaatctatggattctggaatcagcctggataacagctataaaatggattatcctgagatgggcttgtgcattatcatcaataataagaattttcataagtctaccggcatgacaagcagaagtggcaccgatgtggacgcagctaatctgagggaaacattcagaaaccttaagtacgaagttaggaataagaacgacctgacacgcgaggagattgtggaactgatgagagacgtaagcaaggaagaccattccaagaggagctcatttgtgtgcgtccttttgagtcatggcgaggaggggattattttcggaacgaatggacctgtggatcttaagaagatcactaacttttttcgaggcgatcgctgccgatctcttacagggaagcctaaactgtttatcatccaagcctgtaggggaaccgagctcgattgcggtatcgaaaccgac

SEQ ID NO: 249630 - DNA, 870 bp, Artificial Sequence
  Description of Artificial Sequence: Synthetic coding sequence
atgatcgagactgactctggagtcgatgacgacatggcatgccacaaaataccggtggaagccgacttcctgtacgcctactccaccgcgccgggttactactcatggcggaactcaaaggacggatcatggtttatccagagcctctgcgcaatgctcaagcagtacgctgataaactcgaattcatgcacattctcactcgggttaataggaaagtggccactgaattcgagagcttcagctttgacgcgacctttcacgcaaagaagcaaatcccctgcatcgtgtcaatgcttaccaaggagctgtacttttaccatgatgaagtggatgggggttcgcctatggagaacaccgagaatagcgtggacagcaaatcaatcaagaatcttgaacctaagatcatccacggcagcgaatcgatggactccgggatctcgcttgacaactcctacaagatggactatcctgaaatgggactgtgtatcattatcaacaacaagaacttccataagagcaccggaatgacttccagatccggaaccgacgtggacgctgcgaatcttagagaaaccttccggaacctgaagtacgaagtgcggaacaaaaatgaccttactcgggaagaaatcgtcgagctgatgcgggacgtgtccaaggaggaccattccaagcgctcttcatttgtgtgcgtgctcctctcacatggagaggagggaattatcttcggcaccaatggacctgtcgatctgaagaagatcaccaacttcttccgcggagacaggtgtcgcagcctgaccgggaaaccgaagctgttcattattcaagcctgtcgcggaaccgaattggactgcggaatcgaaaccgac

SEQ ID NO: 249631 - DNA, 870 bp, Artificial Sequence
  Description of Artificial Sequence: Synthetic coding sequence
atgattgagaccgatagtggggtggatgacgacatggcctgccataaaattcccgtcgaggccgacttcctctacgcctactccaccgctcccgggtactattcctggcgcaattctaaggatggtagctggttcattcaatctctatgtgctatgctgaaacagtatgctgataaactcgagtttatgcacatcttaactagagtcaacaggaaagtggccaccgaattcgaaagcttttcgttcgatgcgacattccacgccaagaagcagataccatgcatagttagcatgctgacaaaggaattgtacttttatcatgacgaggtggatgggggatctcctatggaaaatacggaaaattcagtggactctaaatcaattaaaaatctggagcctaaaataatacacggatctgaatccatggattcaggaatctccctggataattcctacaaaatggactatccggagatggggttgtgcatcatcattaataataagaacttccacaagtcaacagggatgacctcccgcagcggcacagacgtcgacgccgccaatttgcgcgagactttcaggaacctcaaatacgaggtgcgaaacaaaaatgacctaactcgggaggaaatcgtcgaattaatgcgtgatgtatcgaaggaggatcattcgaagcgcagcagtttcgtatgtgttctattgtcccacggtgaggaaggcataatattcgggaccaatggcccagtggacttaaagaagatcaccaacttcttccgcggtgatcgttgcagatctttaactggcaagccaaagttgttcatcatacaagcgtgccggggcactgaacttgactgcggcatagaaaccgac

SEQ ID NO: 249632 - DNA, 870 bp, Artificial Sequence
  Description of Artificial Sequence: Synthetic coding sequence
atgattgaaaccgacagcggagtggatgacgacatggcctgccataagatcccggtcgaagccgattttttgtatgcctacagtacagcgccaggctattacagttggagaaactccaaggatggctcctggttcattcagagtctgtgcgcaatgttgaagcagtacgcggataagttggagttcatgcatatcttgacccgggtgaaccgaaaggttgccaccgagtttgaaagcttcagtttcgacgcgaccttccacgccaagaaacagataccatgcatcgtttcgatgctcacgaaggagctttacttctaccacgacgaggtcgacggtggcagtcctatggagaacactgagaactcggtggactccaaatcgataaaaaatcttgagcccaagatcatccatggatcggagtcgatggatagcggcatatccctggataatagctacaaaatggactatccggagatgggcctatgcataatcatcaacaacaaaaattttcacaagagcaccggaatgacctctagaagtgggacggatgtcgacgcagcaaaccttcgggaaacttttcgcaatctaaaatacgaggtgcgaaacaagaatgatctgacccgtgaggagattgtcgaattgatgcgtgatgtttcgaaggaggatcactcgaagcgaagctcatttgtttgcgtccttctgtcccacggcgaggaaggcatcattttcggcaccaatggacctgttgacctcaagaagatcaccaatttcttccgcggcgaccggtgccgctcgttgactggaaagccaaagctattcataatccaagcctgccggggtaccgaacttgactgcggcattgagaccgat

SEQ ID NO: 249633 - DNA, 870 bp, Artificial Sequence
  Description of Artificial Sequence: Synthetic coding sequence
atgattgagactgattcgggtgtggacgacgacatggcctgtcataagatcccagtcgaagctgattttctctacgcttactcgacggctcccggatactattcatggaggaatagcaaggacggaagctggttcatccaatctctctgcgcgatgctgaaacagtacgccgataagctggaattcatgcatattctcactcgggtgaaccgcaaagtcgccaccgaattcgagagcttcagcttcgacgcgaccttccacgctaagaaacagatcccgtgcatagtctccatgctcaccaaggaactgtacttctaccatgacgaagtcgatggcggctcgcctatggagaacactgagaattcggtggactcgaagtctatcaagaatctggagcctaaaatcatccacggctcggagagcatggactccggaatctccctggacaactcctacaagatggactacccggaaatgggtctgtgtatcattatcaacaataagaatttccacaagtcgactggtatgacttcacggtcaggaacggatgtcgacgcagccaatctgcgggaaacttttagaaatttgaagtacgaggtgcgcaacaagaacgatctgactagagaggaaatcgtggaactgatgagggacgtgtcgaaagaggaccactccaaacgctcgtcattcgtgtgcgtccttctctcccacggagaagagggaatcattttcggcactaacggtccggtggatctcaagaagatcactaatttcttccgcggagatcggtgccgctcactgaccggaaagccgaagctcttcatcatccaggcctgccggggaactgaactggactgcggaattgaaacggac

SEQ ID NO: 249634 - DNA, 870 bp, Artificial Sequence
  Description of Artificial Sequence: Synthetic coding sequence
atgatcgagacggactcgggcgtggacgacgatatggcctgtcacaaaataccagtcgaggctgatttcctgtacgcatactcgaccgcgccgggttactacagctggaggaattccaaagacggatcgtggttcatccagagcctgtgcgccatgctgaagcaatacgcggacaagctggagtttatgcacatcctcaccagggtgaacagaaaagtggcaactgaattcgaatccttctcattcgatgccacgttccacgcgaaaaagcagatcccttgtatcgtgtccatgctcacgaaggaactgtacttctaccatgatgaagtggacggaggctccccgatggagaacacggaaaactccgtggattccaagtccattaagaatttggaaccaaagatcatccacggaagcgagtcgatggactcaggaatctcgttggataactcctacaagatggactatccggaaatggggctgtgtatcattatcaataacaagaattttcataagtccaccgggatgacctcacgtagcggaactgatgtagatgcggctaacctgagggaaacctttcggaacctgaagtacgaagtcagaaacaaaaacgacctgacccgcgaagagatcgttgaactgatgcgagatgtttcgaaggaggaccattcgaagcgaagcagctttgtctgcgttcttctctcacacggtgaggaaggaatcatcttcggaactaacggtccggtggaccttaagaaaatcaccaacttcttccgcggtgaccggtgcagatcactgactggcaagcctaaactgttcatcattcaagcctgtcgcggcaccgaactcgactgcggtatcgagactgac

SEQ ID NO: 249635 - DNA, 870 bp, Artificial Sequence
  Description of Artificial Sequence: Synthetic coding sequence
atgattgaaacggattccggtgtggatgatgacatggcatgccacaaaattccggtcgaagcagacttcctgtacgcttactccaccgctcccggatactactcgtggcgcaattcgaaggatggttcatggttcattcaatcgctctgtgcaatgctgaaacagtacgcagataagctcgagtttatgcatatcttgactcgcgtcaaccgcaaggtggcaaccgaatttgaatccttttcgtttgacgccacttttcatgccaagaagcaaataccttgcattgtcagtatgctgaccaaggagctttacttttaccacgatgaggtggacgggggttccccaatggaaaacactgaaaattcggtggattccaagtcaattaagaatcttgagccaaaaatcatacacggctccgaatctatggacagcggtatatccctggataacagctacaagatggattaccctgaaatgggactgtgtattatcatcaacaataagaattttcataagagtacgggcatgacttctcggtctgggaccgacgtggatgcagccaatcttcgagaaactttccgaaatcttaagtacgaagtgagaaacaagaacgacctgacgcgcgaagagatcgtagaactcatgcgtgacgtgtcaaaggaagatcattcgaagcgctcatccttcgtctgtgtgcttctgtcgcatggagaggaaggaattatcttcggaaccaatggcccagtggatctgaaaaagatcaccaacttctttagaggcgatcggtgtagatcgctgaccggcaagcctaaactcttcattatccaggcttgtaggggtactgagctggattgtggaattgaaaccgac

SEQ ID NO: 249636 - DNA, 870 bp, Artificial Sequence
  Description of Artificial Sequence: Synthetic coding sequence
atgattgaaaccgattccggggtggacgacgatatggcctgtcacaaaataccggtggaagctgactttctgtatgcctacagcacagcccctggctactattcatggcgcaatagtaaagatgggtcatggtttattcagagcctttgcgccatgttaaaacagtatgctgataaactggagttcatgcacattctcacccgtgtgaacagaaaagttgctaccgagtttgagagcttttcttttgatgcgactttccacgcaaagaagcagatcccatgtattgtatctatgctgacgaaagagctgtacttttaccacgacgaggttgacgggggctctcccatggagaacacggaaaactccgtggattcaaaatccatcaagaatctcgaacccaagattattcacggcagtgagagtatggactcaggaatcagcctcgacaattcctacaaaatggattatccagagatggggttgtgcatcattataaacaacaaaaactttcataagtccaccgggatgacaagccgatctggcaccgatgtggatgcagcaaacctgagggaaacttttaggaacttaaaatatgaggtccggaacaaaaacgatctgactagggaggagattgtggaactaatgagggatgtgagcaaagaggatcattcaaagcgcagttcctttgtctgtgtcctgctcagccacggggaggagggcatcatcttcggtacgaacggtcccgtggatctgaagaaaattaccaattttttcagaggtgataggtgcaggagtctgaccgggaagcccaaattgtttatcatacaggcatgccgcggaacggaactcgactgtggcattgaaaccgat

SEQ ID NO: 249637 - DNA, 870 bp, Artificial Sequence
  Description of Artificial Sequence: Synthetic coding sequence
atgatcgaaacggattcgggagtggacgacgacatggcgtgtcataagattccggtggaggcagattttctgtatgcctactcgaccgctccaggttactacagttggcggaatagcaaggatggtagctggtttatacagagcctgtgcgccatgcttaaacagtacgcagacaagctggagtttatgcatatcctcactagagtgaacaggaaggtcgccactgagttcgaatcattttccttcgacgccacctttcacgcaaagaaacagatcccgtgtattgtatcgatgcttacgaaagaactttacttctatcacgatgaggtggacggaggaagccctatggaaaacaccgagaatagcgtggactcaaagtcaattaagaacctggaaccaaagatcattcatggttcagaatccatggactcgggtatttcgttggataactcttacaaaatggactaccccgagatgggcctgtgcattatcattaacaataagaacttccataagtcaaccggaatgacctctaggagcggaaccgatgtcgatgccgcaaacctgagggaaacttttagaaacctcaagtacgaggtcagaaacaagaatgacttgaccagggaagagatcgtggaactgatgagagacgtgagcaaggaagatcactccaagcggtcctcatttgtgtgtgttcttctgtcccatggagaagagggaataatctttgggaccaacgggcctgtcgatcttaagaaaatcaccaacttcttccgaggtgatagatgcaggtccctcacgggaaaaccaaagctctttatcattcaagcgtgtagaggaaccgaactcgattgtggaatcgaaactgac

SEQ ID NO: 249638 - DNA, 870 bp, Artificial Sequence
  Description of Artificial Sequence: Synthetic coding sequence
atgattgagaccgactctggtgtggatgacgatatggcctgtcacaaaataccggtcgaggcggacttcctgtacgcctacagtactgcaccaggctactactcctggaggaattccaaagatggctcttggttcatccaatcactgtgcgcgatgctgaaacagtacgccgacaagctggaattcatgcacatcctgactcgggtaaaccgcaaggtagctacagaattcgagtccttcagtttcgacgccacatttcacgcaaaaaagcagatcccgtgcatcgtctcgatgctgacaaaagagctctacttctatcacgacgaggtcgacggaggctccccaatggagaacacagagaatagcgttgacagcaagagcataaagaatctggagccaaagatcatccatggctccgagtccatggacagcggcataagcctggacaactcgtacaagatggattaccccgagatgggcctttgtatcattataaacaacaaaaacttccacaaaagtacaggaatgacctctaggtcagggactgacgttgacgccgctaacctccgtgagacattccggaatctaaagtacgaggtccggaacaagaacgacctgactcgcgaagaaattgtggagctgatgcgggacgtctccaaagaggatcactccaaacgctcctccttcgtctgtgtgctgctcagccatggcgaagagggcatcatatttggcacaaatggcccagtcgacctgaaaaaaatcaccaatttttttcggggtgacaggtgtcgttcactcacaggtaagcctaagctgttcatcatccaagcctgccgaggtaccgagctggattgtggaatcgagacagac

SEQ ID NO: 249639 - DNA, 870 bp, Artificial Sequence
  Description of Artificial Sequence: Synthetic coding sequence
atgattgaaactgattccggagtggacgatgacatggcatgtcataagattcccgtcgaagcagattttctgtatgcgtactccactgcacctggatattactcctggcggaactccaaggacggttcctggtttatccagagcctttgtgcaatgctgaagcaatacgccgacaaacttgaattcatgcatatcctgacgagagtcaatagaaaggttgcaaccgaatttgaatcctttagctttgatgccacttttcatgcgaagaagcagataccttgtatcgtgtccatgttgaccaaggaactgtatttctatcatgatgaggtcgatgggggttcgcctatggagaacaccgaaaactccgtggattcaaaatcgattaagaatctcgagcctaagatcattcacggttcggagagcatggatagcggaatttcacttgacaactcatacaagatggattaccccgaaatgggactttgtattatcattaacaacaagaatttccataagagcactggaatgacttcacggagcggaactgatgtggatgccgcaaatctgcgggaaaccttcaggaatctgaagtacgaagtgagaaacaagaacgacctgacccgagaggaaattgtcgagctcatgcgagatgtatcgaaggaagatcattcgaaaagatccagcttcgtgtgtgtgctgctctcgcatggggaagaaggcatcatctttggtacgaacggaccagtcgaccttaagaaaatcaccaatttctttagaggtgacaggtgtagaagcctgacgggcaagcctaaactctttatcattcaggcttgtagggggactgagctcgactgcgggattgaaaccgac

SEQ ID NO: 249640 - DNA, 870 bp, Artificial Sequence
  Description of Artificial Sequence: Synthetic coding sequence
atgattgaaacagacagcggcgttgacgatgatatggcctgtcacaagattccagtagaggccgactttctctatgcttattccaccgctcccggttactattcctggcgcaacagcaaggatggtagttggttcattcagtccctgtgcgcgatgctgaaacagtatgcagacaaactcgagtttatgcacatcttgaccagagtgaatcgaaaggtggcaaccgagttcgagtcattctcctttgacgctacgtttcatgcaaaaaaacagataccttgtatcgtaagtatgttgactaaagagctctatttctaccacgacgaggttgatggcggcagtcccatggagaacactgagaacagtgtagattcaaagagtatcaaaaatttggaacctaaaatcatacacgggtcggagagcatggattctggtatttccctggataatagctataaaatggactatccagaaatgggcctttgcattataatcaacaataaaaactttcataaaagtacaggcatgaccagcaggtcagggaccgacgtggatgccgctaatctgcgggagacgtttcgaaatctgaagtatgaagtacggaacaagaatgatctgacgagggaagagattgtcgaactgatgagggacgttagcaaagaagatcattccaagaggagtagcttcgtatgcgtgttattgagtcacggtgaggaaggcatcatctttggtacgaacggacccgtcgatctgaagaagatcaccaacttctttcggggggataggtgccgatctcttaccggaaaaccgaagctgtttatcatccaggcgtgccgcgggacagagctggattgcgggatcgagaccgac

SEQ ID NO: 249641 - DNA, 870 bp, Artificial Sequence
  Description of Artificial Sequence: Synthetic coding sequence
atgatcgagactgattcaggagtggacgacgatatggcgtgtcacaaaatcccagtggaagcagattttctctatgcctatagtaccgcgcctggatactactcatggcgcaattctaaggatggcagctggttcatccagtccctctgcgccatgttaaaacagtacgctgataagctcgagtttatgcatattctcacccgagtgaataggaaggtcgccacagagtttgaaagctttagttttgacgctacttttcacgcaaagaagcagatcccctgcatagtgagcatgctgaccaaggagttatatttttaccatgacgaggtagatgggggctcccccatggagaatacagagaacagtgttgatagcaaatccatcaaaaacctggagcccaagattatacacgggtccgagagcatggacagcggaatctccctggacaactcgtataaaatggactatccagaaatgggattgtgtattatcattaacaacaagaatttccacaagtccactggtatgacctcccgctccggaaccgatgtcgacgctgccaacctgcgtgagacctttagaaatttaaaatacgaagtcaggaataaaaacgatctgacaagggaggagatcgtcgagctgatgcgagatgtttcaaaggaggaccactcgaagcggagcagtttcgtgtgcgtcctcctctcccatggtgaagaggggataatattcggcactaatggccccgtggacttaaagaagatcaccaattttttcaggggcgacaggtgcagatcccttactggaaaaccgaagctgttcataatccaggcctgtcgcggcacagaacttgactgcggcatcgaaaccgac

SEQ ID NO: 249642 - DNA, 870 bp, Artificial Sequence
  Description of Artificial Sequence: Synthetic coding sequence
atgatcgagactgacagcggagtggacgacgacatggcttgtcacaaaatcccggtggaggcagacttcctctacgcgtactcaaccgccccgggctactactcgtggagaaactcgaaggacggttcttggttcatccagtcattgtgcgccatgctcaagcagtacgctgacaagctcgagtttatgcacatcctgaccagagtcaaccgcaaagtggcaactgagttcgaatcgttctccttcgatgccaccttccacgcgaagaagcaaattccatgtatcgtgagcatgctgaccaaggaactgtacttctaccacgacgaagtcgacggaggatcccctatggagaacaccgagaacagcgtggattcaaagtccattaagaatttggaaccaaagattatccatggatccgagtccatggattcgggaatctcgctggataattcgtacaaaatggactaccctgagatggggctctgcatcatcatcaacaataagaatttccataagtcgaccggaatgacttcccggagcggcaccgacgtggacgcggcgaacctgagagaaaccttcagaaatctcaaatacgaggtgcgcaacaagaacgacctgactcgggaggagatcgtggagctcatgagagacgtgtcgaaagaagatcattcgaagcggtcgtccttcgtgtgcgtccttctgtcgcacggagaagaaggaattatctttggcaccaatggcccggtggacctcaagaagatcaccaacttcttccggggagacaggtgcaggtcactgaccggaaagccaaaactgtttatcatccaagcgtgccgtggcaccgaactggattgcggaattgaaaccgat

SEQ ID NO: 249643 - DNA, 870 bp, Artificial Sequence
  Description of Artificial Sequence: Synthetic coding sequence
atgattgagaccgactctggcgtcgatgacgacatggcctgccataagattcctgttgaagccgacttcctgtatgcgtattcaacggccccaggttattattcttggcgtaattcaaaagacggatcttggttcattcaatccttgtgtgccatgcttaagcagtatgctgataaactggagtttatgcacattttgactagagtgaaccgcaaagtggccacggagttcgaaagtttcagcttcgatgctacatttcatgctaaaaaacaaatcccatgtatcgtaagcatgcttaccaaggaactgtacttctaccatgacgaagttgatgggggaagccccatggaaaacactgagaatagcgttgattcaaaatccatcaagaacctagagcccaaaatcattcatgggtctgaaagcatggacagcggcatcagcttggataacagttacaagatggattatcctgaaatggggctgtgcatcatcataaacaataagaattttcacaaaagcacagggatgaccagtcgaagcggcactgatgttgatgctgccaatctgcgagagactttccggaatctgaagtacgaggtgaggaacaagaatgatcttaccagagaggagatagtcgaattgatgcgggatgtctccaaagaggaccactctaagaggtcatctttcgtgtgcgtgctgctgtcccacggagaggaaggaattatctttggcactaacggccccgtggacttgaaaaagattaccaatttcttcagaggagacagatgccggtcactgacgggcaagcccaagctgtttattattcaggcatgcagagggaccgaattggactgcggaatcgagacggat

SEQ ID NO: 249644 - DNA, 870 bp, Artificial Sequence
  Description of Artificial Sequence: Synthetic coding sequence
atgatagagacggactccggggtggatgacgatatggcttgtcataagattccagtcgaggcagatttcctgtacgcatacagcacggcgccaggctactacagctggaggaactccaaagacggttcgtggtttattcaatccctttgcgcaatgcttaagcagtacgctgataaactggaattcatgcatattcttaccagggtgaaccgcaaggtcgcaactgagttcgaatccttcagctttgatgccacgtttcacgccaaaaagcaaataccttgcattgtgtccatgctcactaaggagctctacttctaccatgatgaagtggacggtggatcgccaatggaaaatactgagaacagcgtggactctaaatcgattaagaatctcgagcctaagattattcacggctccgaatcaatggattccggcatctccctggacaactcatacaagatggattaccccgagatgggtctgtgtatcatcatcaacaacaagaatttccacaagtccactggtatgaccagccggtcgggaactgatgtggatgctgccaaccttagagaaaccttcagaaacctgaaatacgaagtgagaaacaagaatgatctcactagagaggaaattgtggaattgatgagagatgtgtccaaagaagatcattcgaagagatcgtcgtttgtgtgtgtccttctctcacatggtgaagaaggcattatctttggcactaacggcccagtggatctcaagaagattaccaactttttccgcggcgatagatgtcggagccttaccggaaaaccaaaactgtttatcatccaagcatgcaggggaactgaactcgactgtggaatcgaaacggat

SEQ ID NO: 249645 - DNA, 870 bp, Artificial Sequence
  Description of Artificial Sequence: Synthetic coding sequence
atgattgagaccgattcaggtgtggatgatgacatggcttgccataagatacctgtggaggcggatttcctgtatgcgtattccacggcgccaggttactattcttggcgcaattctaaagacggatcttggttcattcagtctctgtgcgccatgctcaaacagtatgcggacaagctcgaattcatgcatatcctgacacgagtaaatcgcaaggtagctactgagtttgagagcttctctttcgacgcgacatttcatgctaaaaagcaaattccgtgtatcgtgtccatgctgactaaggagctgtatttctatcacgacgaagtcgacggcggctcccctatggagaatactgaaaatagcgtcgattctaagagtatcaagaacctggagccaaagatcatacatggatcagagtcaatggattccgggatatcactggacaactcctacaagatggactatcctgagatgggcctttgcatcatcataaataacaaaaatttccataaatctaccgggatgacctctagatcagggacggacgtggacgccgccaatctgcgggaaacgtttcgcaatctgaaatacgaggtcaggaataaaaacgatttgacccgagaggagatagtagagctcatgagggatgtgagcaaagaggatcacagcaaacgctcatcttttgtgtgcgtgttgttatctcacggagaggaaggaataatcttcggcacaaacgggcctgtcgaccttaaaaagataaccaatttctttaggggagatcgatgccggtctctgactgggaaacctaagctcttcatcattcaagcctgcaggggtaccgaactggattgtggcattgagaccgat

SEQ ID NO: 249646 - DNA, 870 bp, Artificial Sequence
  Description of Artificial Sequence: Synthetic coding sequence
atgatcgaaactgactcgggagttgacgacgacatggcgtgccataagatcccggtcgaagcagattttctgtacgcctactcgaccgctccaggctactactcgtggcgcaacagcaaggatggctcatggtttatccagtcgctttgcgcaatgttgaagcagtacgccgataagctggaattcatgcatatcctcactcgggtcaatagaaaggtggctacggagttcgaatcattctcattcgacgctaccttccatgccaagaagcagataccgtgcatcgtctcgatgctgactaaagaactgtatttctaccacgacgaggtggatgggggctcccccatggagaacactgagaattcagtggattccaagtcaattaagaatttggagcctaaaatcatccatggttcggagtccatggatagcgggatctcgctggacaactcgtacaaaatggattacccggagatgggactctgcatcatcatcaacaacaagaatttccacaagtccactgggatgacttccagaagcggaacggatgtggacgctgcaaacctgagagaaaccttccgcaatctcaagtacgaagtgaggaacaagaacgacctgactcgcgaggagatcgtggaactgatgagagacgttagcaaggaggaccactcgaagcggtcatcgttcgtgtgtgtgttgctgtcccacggcgaggaaggaatcatctttggaaccaatggtcctgtcgatcttaagaaaatcaccaacttttttcggggggatcggtgccgctcgcttacgggaaagcccaaactgtttatcatccaggcttgccgcggaacggagctggattgtggaatcgaaactgat

SEQ ID NO: 249647 - DNA, 870 bp, Artificial Sequence
  Description of Artificial Sequence: Synthetic coding sequence
atgatcgagacggacagtggagttgatgatgatatggcctgtcataagattcctgtggaagcggacttcctatatgcttattccactgctccgggctattacagctggaggaatagcaaagacggatcctggttcattcagtcactgtgcgccatgctcaagcagtacgcagataaattggaatttatgcacatactcacaagggtcaacaggaaggtcgccaccgagttcgagagcttctctttcgatgccaccttccatgctaaaaagcaaatcccctgcatcgtgagcatgctgactaaggagctgtacttttaccacgacgaggtggatggtggatctccaatggagaacaccgagaacagtgtggactccaagagtatcaaaaacttggaaccgaagataattcatggtagcgagagcatggacagcggcatcagcttagacaacagctacaagatggattatcctgagatgggtctgtgcatcatcatcaacaacaagaacttccacaaaagtacaggaatgacttcccgctctggcaccgatgttgatgctgcgaatcttagagagacgtttaggaatctgaaatatgaggttcgcaacaagaatgacttaacccgagaagagatcgtggaactgatgcgcgatgttagtaaggaagaccactcaaagcgatccagcttcgtttgcgtactactctcccatggcgaagagggcattatattcgggactaacggcccggtagatctgaagaaaataacaaacttcttcagaggggaccggtgcaggtccttgacggggaagccgaaactgttcattatacaagcttgtagaggcaccgagttagactgtgggatcgagacggat

SEQ ID NO: 249648 - DNA, 870 bp, Artificial Sequence
  Description of Artificial Sequence: Synthetic coding sequence
atgatcgaaactgattctggagtggatgatgatatggcctgtcataagattcctgtagaagccgatttcctttacgcttactcaacagcccctgggtattatagttggcgcaattcgaaagacggatcttggttcatacagtccctctgtgctatgttgaagcagtatgctgataaactggaatttatgcatattctaactagggtgaaccgaaaagtggctactgaatttgagtcattctccttcgatgcaactttccacgcaaaaaagcagattccctgcatcgtttcaatgttaactaaggagctctacttctatcatgatgaggtggatggaggatcccccatggaaaatacagaaaattcagtcgactctaaatcaataaaaaacctggaaccaaaaattatacacgggagtgagtccatggattccggaatatcattggataattcttataaaatggattatcccgaaatgggactgtgtataatcattaacaataaaaactttcacaaaagtacaggaatgacatctagaagtgggacagatgttgatgcagccaatctcagagaaacattcaggaacttgaaatatgaagtgaggaataagaatgaccttacacgggaagaaatcgtcgagcttatgagagatgtcagtaaagaggatcactctaaaagatcatctttcgtgtgtgtgcttctctcccatggggaggaaggaattattttcggaacaaacggaccagtcgatctgaagaaaataactaattttttccggggggatcggtgccgaagtttaacaggaaaaccaaaactatttattatccaggcctgccgggggacagaactcgattgtggaatcgaaactgat

SEQ ID NO: 249649 - DNA, 870 bp, Artificial Sequence
  Description of Artificial Sequence: Synthetic coding sequence
atgatcgaaaccgattcgggagtcgatgacgacatggcatgtcacaaaatccctgtggaagccgatttcctctacgcatacagcaccgcacccgggtactatagctggagaaattctaaggacggttcctggttcatccaatcattatgtgctatgcttaagcagtacgcagacaagctggaatttatgcacatcctcacaagggtaaacaggaaggtggccaccgaatttgagtcctttagctttgacgccacgtttcatgccaagaagcagataccatgcattgtgagtatgcttactaaagagttatacttctatcatgacgaggtggatggtggaagtccaatggaaaataccgaaaattctgtagattccaagtcgatcaagaacctggaaccaaagatcatccatggctctgaatcgatggattccggaattagcctggacaatagttataagatggactacccagagatgggcttatgtatcatcatcaacaataagaacttccataagagcaccggaatgacttctagaagtggcactgacgttgacgccgccaacctcagggagacctttcgaaacctgaagtacgaagtcagaaataagaacgacctcactagggaagaaattgtagaactcatgagggacgttagtaaggaggaccattccaagcgcagctcctttgtctgcgtgttgctatctcacggggaggagggtatcatatttgggacgaatggacccgtcgatttgaaaaagattacaaacttctttcggggcgacaggtgcaggtctctaactggtaagccgaaactgtttatcattcaggcttgccgcggaactgaactcgactgtgggatcgagactgat

SEQ ID NO: 249650 - DNA, 870 bp, Artificial Sequence
  Description of Artificial Sequence: Synthetic coding sequence
atgatcgaaactgacagcggggtggatgacgacatggcttgtcacaagatccctgttgaggcagactttctgtacgcctatagtacggcacccggctattacagttggagaaacagcaaagatggctcctggttcattcagtcgctgtgcgccatgctgaagcagtatgccgataaactggagttcatgcacatactcacccgcgttaatcggaaggtagccacagaatttgaatccttttctttcgatgccactttccacgccaagaagcagatcccgtgcattgttagtatgttaacaaaggaactgtacttttatcacgatgaagttgatggtggcagtcccatggagaatacggagaactccgtggatagcaagtccattaagaatttggagccaaaaattattcacggatctgaatcaatggatagtggtataagcctagacaactcttacaagatggattatcctgagatgggattgtgcatcatcattaacaacaaaaatttccataagtcaaccggtatgacctctcggagcgggacagatgtagacgccgcaaacctgcgcgaaacttttagaaacctgaaatacgaagtgagaaacaaaaatgacctcactcgtgaggagatcgtggaactgatgcgagacgtgtccaaagaggaccatagcaagagatcgagtttcgtgtgtgtcctccttagtcatggggaagaaggtataatattcggcacgaacggacccgtagacctgaaaaagatcaccaattttttcaggggcgataggtgtaggtctctgaccggaaaacccaagctatttataatccaggcctgccgcggaacagaactcgattgcggcatcgaaacagac

SEQ ID NO: 249651 - DNA, 870 bp, Artificial Sequence
  Description of Artificial Sequence: Synthetic coding sequence
atgatcgaaaccgattcgggtgtcgatgatgacatggcgtgccataagataccagtggaagcagattttctgtacgcctactcaactgcaccgggatattactcatggcgcaatagcaaggacggaagctggtttatccagtccctctgtgcaatgctcaagcaatacgcagacaagctcgaattcatgcatatactcactagagtgaatagaaaagtggccacggagtttgagagcttttcttttgatgcaacgtttcatgcgaaaaaacagattccgtgcatcgtctctatgctcacgaaagaactttacttttaccatgatgaggtggatggaggtagccctatggagaacaccgaaaatagcgtcgactcgaagagcatcaagaacctggaacccaagattattcatggctcagaatcgatggactcaggtatcagcctggataactcctacaaaatggactaccctgagatgggtctgtgtattatcattaacaacaagaatttccataagagcaccggaatgacttccagaagcggtaccgacgtggatgctgccaacctgcgcgaaacttttcgaaacctgaagtacgaggtcagaaacaagaacgatctcactcgcgaagaaattgtggagcttatgcgcgacgtttcaaaggaagatcatagcaagcggtcatcgtttgtgtgtgtgcttctctcgcacggtgaggaaggtatcattttcggcacgaacggtccagtggatcttaagaagataaccaacttcttcaggggagatagatgccgatcacttaccggaaaacccaagctgttcatcatacaagcctgtcgaggaaccgaactggattgtggaatcgagactgac

SEQ ID NO: 249652 - DNA, 870 bp, Artificial Sequence
  Description of Artificial Sequence: Synthetic coding sequence
atgatcgagactgacagcggggtggatgatgacatggcttgtcataagattccggtggaagcggatttcctttacgcctatagcactgccccggggtactacagctggcgtaacagcaaagatggttcatggtttatccagtcactttgtgctatgctcaaacagtacgcagacaaacttgagttcatgcacattcttacccgggtcaacaggaaggtggcaactgagtttgagtcgtttagctttgacgccactttccacgcaaaaaagcaaatcccttgcatagtgtccatgctgaccaaggaactctacttttaccacgacgaagtggatggaggctccccaatggagaacacggaaaattccgtggattcaaaaagcattaagaacctggaaccaaagattatccacggatcagaatcgatggactccggaatctccctcgataactcctacaagatggattaccctgagatgggtctgtgcatcatcataaacaacaaaaactttcataaatctactggaatgacttctcgctcgggtaccgatgtggacgcagcaaatcttagggaaacgttccggaatctgaagtacgaagtgagaaacaagaatgacctgacgagggaagaaattgtggagctgatgcgtgatgtgagcaaggaagatcactctaagagatcctcgtttgtttgtgtcctgttgtcgcatggcgaagaaggcattatcttcggtaccaatggccctgttgatctgaagaaaatcaccaacttctttagaggggaccggtgtagatcccttaccggaaagccaaagctgttcatcatacaagcatgcagaggcactgaactggattgtggtattgaaaccgat

SEQ ID NO: 249653 - DNA, 870 bp, Artificial Sequence
  Description of Artificial Sequence: Synthetic coding sequence
atgattgaaaccgattcgggggtggatgatgatatggcatgtcataagattcctgtggaagcagattttctttacgcatactccacggcaccagggtactactcatggcggaattcaaaggatggttcctggtttattcaatcgctgtgtgcaatgcttaaacaatacgcagacaaacttgagtttatgcatattctcacccgtgtgaaccgcaaggtggcgactgagttcgagagcttctcgtttgatgcaacttttcatgcaaagaaacaaatcccatgtatcgtgtccatgcttactaaggaattgtacttctaccatgatgaagtcgatggtggatcacccatggagaataccgaaaattccgtggacagcaagtccatcaagaatttggagcccaagattattcatggctcagaatcgatggactcgggtatttctcttgacaacagctacaaaatggattaccctgaaatgggactttgcatcatcattaacaataagaactttcacaaatcaaccgggatgacttctcgttcgggtactgacgtcgatgcagccaaccttcgggaaaccttcagaaacctcaagtacgaagtgaggaataagaatgacctgacccgagaggaaattgttgaactgatgcgggacgtgtcaaaggaagatcatagcaagcggagcagctttgtgtgcgtgctgctgtcgcacggtgaggaagggattatctttggtaccaacgggccagtggatctgaaaaagataacgaactttttccgtggggatcgttgtagatcccttacgggtaaacctaaactcttcattatccaagcgtgtcgcggaaccgagctggattgcggaattgagactgat

SEQ ID NO: 249654 - DNA, 870 bp, Artificial Sequence
  Description of Artificial Sequence: Synthetic coding sequence
atgatcgaaaccgactccggggtggacgatgacatggcttgccataagatccctgtagaggcagatttcctgtacgcgtatagcaccgcgccagggtactactcatggagaaattcgaaggacggatcatggttcattcaatccctttgcgcgatgctgaagcaatacgcagataagctggagttcatgcatatcctgactcgggtgaaccggaaggtggctaccgaatttgaatcgtttagctttgatgcgacctttcatgcaaagaagcaaattccttgcatcgtgtcgatgctgaccaaagagctttacttttaccacgatgaggttgatggaggttccccaatggagaatactgagaattccgtggattcgaagtcgattaagaacctcgagcccaagattattcacggttcagaaagcatggattctggaattagcctggataactcttacaagatggattacccagaaatgggcctttgtattatcattaacaacaagaattttcataaatccactggaatgaccagcagatcgggcactgatgtcgatgctgcaaaccttcgcgaaacttttcggaatcttaagtacgaagtgagaaacaaaaacgatctgactagagaagagatagtggagcttatgcgcgacgtctccaaggaggatcatagcaagcggtcgtcttttgtgtgtgtcctgttgtcacatggtgaggaagggatcattttcggtactaacggtcctgtcgatctgaagaaaatcaccaatttcttcaggggtgatagatgccgttccctgactggtaaacctaaacttttcataattcaggcatgtcgagggaccgaactcgactgcggaatagagactgac

SEQ ID NO: 249655 - DNA, 870 bp, Artificial Sequence
  Description of Artificial Sequence: Synthetic coding sequence
atgatcgagacggactctggcgtagacgacgacatggcctgtcataagattcccgtggaggctgattttctgtatgcttattcgaccgccccaggatattactcgtggcgcaacagcaaggatggttcgtggttcattcagtctctgtgtgcgatgctcaaacagtacgctgataaattggagttcatgcacatcttaaccagggtcaatcggaaagtcgctaccgagttcgagagcttctccttcgatgctacctttcacgccaagaagcaaatcccgtgcatcgtgagcatgcttaccaaggagctgtatttctaccacgacgaggtggatggaggcagcccaatggagaacactgagaattcggtcgacagcaaatccatcaagaacctggagcctaagattattcacggttcggagtcgatggacagcgggatctccctggacaatagctacaagatggactatcccgaaatgggtctttgcatcatcattaacaacaagaacttccacaagtcgactggcatgacctcccgttcgggcaccgacgtcgacgccgctaacctccgcgagaccttcaggaacttgaagtatgaggtcagaaataagaacgatctcacccgcgaggagatcgttgagcttatgcgtgacgtgtctaaagaggatcacagtaaacgcagttcgttcgtctgcgtgcttctcagtcatggcgaggaaggcatcatctttggcaccaacggtcctgtggatctgaagaagatcaccaatttctttaggggcgacaggtgccgctcactgacgggtaagcccaagttgttcatcatccaggcgtgtcggggtacggagctcgactgtggcatcgagacagat

SEQ ID NO: 249656 - DNA, 870 bp, Artificial Sequence
  Description of Artificial Sequence: Synthetic coding sequence
atgatcgagaccgattctggtgtggatgacgatatggcgtgccacaaaatcccagtggaagctgacttcctgtatgcatacagcaccgctcccgggtattatagctggaggaactctaaagacggctcctggttcatccagtcgctgtgtgccatgttgaagcaatatgcagataaactggaatttatgcacatcctgacgcgggtgaatcgcaaggtggcgaccgaattcgagtcatttagcttcgacgcgaccttccatgcgaaaaagcagattccttgcattgtttcaatgcttacgaaagaactgtatttttaccacgatgaggtcgatggcggttccccgatggagaacaccgaaaattccgtggattctaaaagcatcaagaatctggaaccgaaaatcattcatggcagcgagtctatggatagcggaatctcactcgataactcttacaagatggactatccggagatgggtctgtgcattataatcaacaacaaaaattttcataaaagcaccggtatgacctctcgaagcgggaccgacgtcgatgctgccaacctgcgcgagactttccgcaatctaaaatacgaggttaggaataaaaacgaccttacccgcgaagagatagtggagctgatgcgagacgttagcaaggaggaccacagcaagcgcagctctttcgtctgcgtcctgcttagccacggagaggaaggcatcattttcggcaccaatggaccagtcgacctgaagaaaattactaatttttttcgtggtgaccgctgcagatccctgacgggcaaaccaaagctttttataattcaagcttgtcgtggcaccgagttggattgtggtatcgagacagac

SEQ ID NO: 249657 - DNA, 870 bp, Artificial Sequence
  Description of Artificial Sequence: Synthetic coding sequence
atgatcgaaactgactcgggggtggacgacgacatggcctgtcacaaaattcccgtggaagcagactttctgtacgcatactccactgcccctggttactactcatggagaaactcgaaggatggatcctggtttatccaatcattgtgtgcaatgctcaagcaatacgcagacaaactcgaattcatgcatatccttacccgcgtgaatagaaaggtggctacggaattcgaatcattctcgtttgatgcaaccttccatgccaagaaacaaattccatgtatagtttcaatgctgaccaaggaactctatttctaccatgatgaagtggacggaggttcgcctatggagaataccgagaactccgtggattcaaaatcgatcaaaaacctcgaaccaaagattatacatgggtcggagtcgatggatagcgggatctcactggataattcgtacaaaatggattacccggagatgggactttgtattatcatcaacaacaagaactttcacaagtcaaccgggatgacttcgaggagcggcaccgatgtggatgcagcaaatcttcgggaaactttccgcaatctcaagtacgaagtcagaaacaagaatgatcttacgcgggaggagattgtcgagcttatgagggatgtctccaaggaagatcatagcaaaagaagctcatttgtgtgcgtgcttctttcccacggcgaagaaggtatcattttcggcactaacggaccagtggacttgaagaagattaccaacttttttcgcggcgatcgttgtagaagcctcactggaaaacctaaacttttcatcattcaagcatgtcgcggtactgaattggactgtggcatagaaactgac

SEQ ID NO: 249658 - DNA, 870 bp, Artificial Sequence
  Description of Artificial Sequence: Synthetic coding sequence
atgatcgaaaccgactcgggtgtggacgacgacatggcctgtcataagatcccagtagaagcggatttcctctacgcgtactcaactgctccagggtactactcatggcggaactcgaaggatggatcgtggtttattcaatccctgtgtgccatgctgaagcagtacgcagataagctggagtttatgcacatcctcacgcgggtgaatagaaaggtggcaactgaattcgagagcttctctttcgacgctaccttccatgctaagaaacagattccctgcatcgtgtcaatgctgaccaaggagctgtacttctaccacgacgaagtcgatgggggatccccaatggagaacaccgagaactcggtcgactcgaagtcgatcaaaaaccttgagccgaaaatcattcacggttcagagtcaatggactccgggatcagcctggacaattcgtacaagatggattaccctgaaatgggcctgtgcatcatcatcaacaataagaacttccataagtcgaccggcatgacttcacgctcgggtactgacgtggatgcagcaaatctccgtgaaaccttccgcaatctgaagtacgaggtccggaataagaatgatctcacgcgcgaggaaatcgtggaactgatgcgggacgtctcgaaagaggatcactcaaagcggtcctctttcgtgtgcgttttgttgagccacggcgaagagggaattatcttcggcaccaacggcccggtggacctgaagaaaatcaccaatttcttccggggtgaccgatgcaggtccttgaccggaaaaccgaagctcttcattatccaggcgtgtcgggggactgagctcgactgtggaatcgaaactgat

SEQ ID NO: 249659 - DNA, 870 bp, Artificial Sequence
  Description of Artificial Sequence: Synthetic coding sequence
atgatcgagactgactctggggtggacgacgacatggcctgccacaagattcccgttgaggccgacttcctgtatgcgtacagcactgctccgggatactatagttggcgaaactctaaggacggaagctggttcatccagagcctttgcgcaatgcttaaacagtacgccgacaagttggagtttatgcacatccttactcgggtcaatcgaaaggtagctacggaatttgagtctttttccttcgatgcaacgtttcatgctaagaagcagatcccatgcattgtgagcatgctgaccaaagagctgtacttctatcacgacgaggtggatggaggtagcccaatggaaaacacggaaaatagcgtggatagcaagtctattaagaatctggagcctaagatcatccacgggtctgagagtatggacagtgggatctccctggacaattcttataaaatggattacccagagatgggtctgtgcatcataattaacaataagaacttccacaaatctactgggatgacgtctcgctctggcactgacgttgatgctgctaacctgagagagactttcaggaatctgaaatacgaggtgagaaataagaacgacttgaccagggaagaaatagttgagcttatgcgggacgttagcaaggaagatcactctaaaagatccagcttcgtctgtgtacttctttcccacggcgaggaagggatcattttcggaacaaatggccccgtagacctgaagaaaatcaccaatttctttagaggtgatcgctgtcgaagtttgactgggaagcctaagctcttcataattcaggcctgtagaggaacagaactggattgtgggatagagacagat

SEQ ID NO: 249660 - DNA, 870 bp, Artificial Sequence
  Description of Artificial Sequence: Synthetic coding sequence
atgatcgaaactgatagtggggtggatgatgatatggcatgccataaaatacctgtggaagcagatttcttgtacgcatattctacagcccctgggtactattcttggaggaattccaaagatgggagttggttcatccagtccttatgtgccatgctcaagcagtacgccgataaactcgaattcatgcacatccttacaagggtcaacaggaaggtcgccactgaatttgaatcattctctttcgatgccacttttcatgccaaaaagcagataccatgtatagtttctatgctcacaaaagaactctatttctatcatgatgaggtagacgggggatcacccatggaaaatacagagaactcggtcgattctaaaagtatcaaaaatctggaaccaaagataattcacggatcagaatcaatggacagtgggatctcccttgataatagttataaaatggattatcctgaaatggggctctgtataataatcaataataagaatttccacaaatccacagggatgacttctagatctggaacagatgttgatgcagcaaaccttagggaaacatttcgaaaccttaaatatgaggtgcggaacaagaatgatctgactagagaagagatagtggaattaatgcgcgatgtttccaaagaagatcatagtaaaaggtcctcgtttgtttgtgttcttttgtcacacggagaagaagggataatattcgggactaatggaccagtagacttaaaaaagataacaaacttctttcgaggggatagatgtcgaagtctgacaggaaaaccaaagctgttcataatccaggcttgtagagggactgagctggattgcgggattgaaacagat

SEQ ID NO: 249661 - DNA, 870 bp, Artificial Sequence
  Description of Artificial Sequence: Synthetic coding sequence
atgattgaaaccgattccggtgttgacgatgatatggcgtgtcacaagatccctgttgaggccgacttcctttacgcatatagcactgccccagggtactattcgtggagaaattccaaggacggatcctggttcatacaatcgctgtgtgccatgcttaagcaatacgccgataagctggagttcatgcacattctcaccagggtgaatcgtaaggtggctaccgaatttgagagctttagctttgacgcaacctttcatgctaagaagcaaattccttgtatcgtgagcatgctgaccaaagagctctacttctaccatgatgaagtggacggtggtagccccatggagaataccgaaaacagcgtcgattccaaatccatcaaaaacctcgaaccaaagattattcacggttcggagagcatggatagcggaattagtcttgataattcatacaaaatggattacccagagatgggactgtgcatcattatcaataacaaaaactttcataagtcaaccggaatgacttcccggtcaggtactgatgtggatgcagcaaatctccgggagacttttagaaatcttaagtacgaagtgaggaacaagaacgacttgactagagaagaaattgtcgaacttatgagagacgtgtcgaaagaggatcattctaagagatcgagctttgtgtgcgtccttcttagccatggtgaggaggggattatctttggaaccaatggcccagtcgatctcaagaagattaccaatttcttccgtggagacagatgtcggtcactcactggtaaacctaagctcttcattatccaggcgtgtcgaggaactgaacttgattgtggcatcgagactgat

SEQ ID NO: 249662 - DNA, 870 bp, Artificial Sequence
  Description of Artificial Sequence: Synthetic coding sequence
atgatagaaactgactctggagtggacgatgacatggcatgccacaaaattcccgtggaggccgactttctatatgcttattcaacagctcctggttactattcgtggaggaacagcaaggatggctcctggttcatccagagtctttgtgctatgttgaagcaatacgctgataagctggagtttatgcatatcttgaccagggtgaaccggaaggttgccactgaatttgagagcttcagctttgacgctacatttcacgccaagaagcagataccttgcatcgtgtccatgctcacaaaggaattgtacttctatcacgacgaggtcgatggaggaagcccaatggagaatacagagaacagcgtagattcgaaaagtatcaaaaatctagagccgaagatcatacatggcagcgaatctatggattcaggcatttctctggataattcttataagatggactaccccgagatgggcctatgtataattattaacaacaagaatttccacaagagtactggaatgacttccaggtctgggacagatgtcgacgctgctaatttgagggagacgtttcgtaatctcaagtatgaggtccgcaataagaacgacctaaccagagaagaaatcgtcgagctcatgcgtgatgtgtccaaggaggaccactccaagcgctccagcttcgtatgcgtgcttctgtcccatggggaggaaggcattatcttcgggactaacggacctgtcgatctgaaaaagattacaaactttttcaggggagacagatgtagatcccttacaggaaagccgaagctctttattattcaagcttgtcgaggaacagagctagactgtggtatagaaacggac

SEQ ID NO: 249663 - DNA, 870 bp, Artificial Sequence
  Description of Artificial Sequence: Synthetic coding sequence
atgatcgagactgattcgggagtggacgacgatatggcttgccataagatcccggtcgaagcagacttcctctacgcctacagtaccgcccccggatactacagctggcgtaacagcaaggatggttcgtggtttattcagagcctctgcgcgatgctgaagcagtacgccgataagttggagtttatgcatattctcacccgggtcaatcggaaagtggcgaccgaattcgaatcgtttagcttcgatgctaccttccacgccaaaaaacaaattccctgcatcgtgtcgatgctcaccaaagagctctacttctaccacgatgaggtggacggcgggtcgcctatggagaatactgagaacagcgtcgactcgaaaagcatcaaaaacctggaaccgaagatcatccatggaagcgaatctatggactctggtatctcgcttgacaactcctacaaaatggattatccagaaatgggactgtgcatcatcattaacaacaagaattttcataagtcgacgggaatgactagccgctcgggtaccgacgtggacgcagcgaacctgcgggaaacttttagaaatttgaagtacgaggtgcgcaacaagaatgatctcacccgtgaagaaatcgtggagctcatgagagacgtgtccaaggaggaccactcaaagcgctcctccttcgtctgcgttctgttgtcgcacggagaggaaggcatcatattcggaaccaacggcccggtcgaccttaagaagattaccaacttcttccggggggataggtgcagaagtctcactgggaagcctaagctgttcatcatccaagcctgtcgcggcactgagctcgactgtggaatcgaaacggac

SEQ ID NO: 249664 - DNA, 870 bp, Artificial Sequence
  Description of Artificial Sequence: Synthetic coding sequence
atgatcgaaaccgactcgggggtcgacgatgacatggcatgccacaaaatacccgtggaggctgacttcctctacgcctactcaaccgcacctggttactactcctggcggaactccaaggatggctcctggtttattcaatcactctgtgcaatgcttaagcagtatgcagacaagctcgaattcatgcatatactgactcgagtgaatcggaaagtcgcaacggaatttgaatccttctcgtttgatgcaactttccatgcaaagaagcagataccctgtattgtgtcgatgctcaccaaggaactgtacttttaccatgacgaggtcgacggaggttcgccaatggagaatacggagaactcggtggattctaaatccatcaagaatctcgaaccaaagattatccatggatccgagtcgatggattccggcatatcccttgataactcgtacaagatggattaccctgaaatgggcctgtgtatcatcattaacaacaaaaactttcataagagcaccggcatgacctcgcgatcaggcactgatgttgatgcagcaaatctgagagaaacctttcggaatctcaaatatgaagtgagaaacaaaaacgatctgactcgtgaggagatcgtggaacttatgagagatgtgtcgaaagaggaccatagcaaacggtcgtcattcgtgtgtgtcttgctttcgcacggagaggagggcatcatatttggtactaatggaccggtggatttgaaaaagatcaccaactttttcagaggagataggtgtcgaagcctgactgggaaacctaagctcttcatcatccaagcatgccgtggaactgaacttgactgcggaatagaaaccgat

SEQ ID NO: 249665 - DNA, 870 bp, Artificial Sequence
  Description of Artificial Sequence: Synthetic coding sequence
atgattgaaactgattccggcgtggatgatgacatggcctgtcataagatacctgtggaagcggattttctgtacgcttacagcaccgcacccggatactactcatggcggaactcaaaggacggatcatggttcattcaatcgctctgtgcaatgcttaaacaatacgcagataaacttgaattcatgcatatcctgactcgcgtcaaccggaaggtggccaccgaattcgaatcgttttcattcgacgccacctttcatgccaagaagcagatcccttgtatcgtctcaatgcttaccaaggagctgtatttctatcacgacgaagtggacgggggttcgccaatggaaaataccgaaaactcagttgatagcaagagcataaagaaccttgaacctaagattatacatggatctgaatcaatggactcgggtatttcgctcgataattcctacaagatggattatcctgagatgggactgtgcatcatcatcaataacaaaaactttcataagtcgaccggcatgactagccgttccgggaccgacgtggacgcagcgaacctgcgagaaacctttcgtaatttgaagtacgaagtgcgtaacaaaaacgatttgaccagggaggaaattgtggaactgatgagggatgtctcgaaggaggatcactcgaagagatcctcgtttgtgtgtgtcctcctgtcccatggagaagagggaattatcttcggaacgaatggaccagtggatctgaagaagataaccaacttttttcggggagatagatgtaggagccttactggtaagccaaagctcttcatcattcaggcatgtcgtggaaccgaacttgactgtggaatcgaaactgac

SEQ ID NO: 249666 - DNA, 870 bp, Artificial Sequence
  Description of Artificial Sequence: Synthetic coding sequence
atgatcgagaccgactccggagtggatgatgatatggcctgtcacaagattccagtggaagccgactttctgtacgcttattcaacagccccaggctattactcctggcggaattcaaaggatggcagctggttcattcagagcctgtgcgccatgctgaaacaatacgccgacaagctagagttcatgcacatcctgacaagggtcaatcggaaggttgccaccgagttcgaatctttttcatttgacgcaaccttccatgctaagaagcaaataccctgtattgtgtccatgctgacaaaggagctttacttctatcatgacgaggttgatggtggcagtccaatggaaaataccgagaattctgtggatagtaagagcatcaaaaacttggagccaaagattatccatggctcagagagcatggacagcggcatctctctggataactcttataagatggattatccagaaatggggctatgcattatcatcaacaacaagaacttccacaagagtaccggaatgacttccagatctgggaccgatgtggatgccgcaaatctaagggaaacctttcgcaacctgaagtacgaagttcgcaataagaacgatctgacaagggaggagatcgtggagttaatgagagacgtgtccaaggaagaccactccaagcgcagctctttcgtgtgcgtgctgctgagtcacggcgaagagggtattatatttggaaccaacggcccagttgatctgaagaagataaccaacttttttaggggcgaccgctgcaggagcctgactggcaaacctaagctgttcataatacaggcctgtagaggcactgaattagattgtggcatcgaaaccgac

SEQ ID NO: 249667 - DNA, 870 bp, Artificial Sequence
  Description of Artificial Sequence: Synthetic coding sequence
atgatcgaaaccgattcgggcgtggatgacgacatggcatgtcacaagatcccggtcgaagctgacttcctgtacgcctactcgaccgccccagggtactactcttggaggaactcgaaggatggatcgtggttcattcagagcctgtgcgccatgttgaagcagtatgccgataaactcgaattcatgcacatcctgacccgcgtgaataggaaggtggccaccgagttcgaatccttctccttcgacgctacgtttcacgccaaaaagcaaattccgtgcattgtgtccatgctgaccaaggaattgtacttttaccacgacgaggtcgacggaggaagcccgatggagaataccgaaaactcagtggacagcaaatccatcaagaacctcgagccgaagatcattcatggctccgagtcaatggattcagggatctccctggataactcctacaagatggactaccctgaaatgggactttgcatcatcatcaacaataagaattttcacaagagcactggcatgacctcgagatcaggaaccgacgtggacgcggccaatctcagggagactttcagaaacctgaagtatgaagtgcgcaacaaaaatgatctgacgcgcgaagaaattgtggagcttatgcgcgatgtctcgaaagaggaccactccaagcgcagctccttcgtctgcgtgctgctgagccacggcgaagaggggatcattttcggaactaacggcccggtggacctcaagaagatcaccaacttcttccggggtgaccgctgccgttcactgactgggaagccgaaacttttcatcatccaggcgtgccgcggaacggaacttgattgcggcattgaaaccgac

SEQ ID NO: 249668 - DNA, 870 bp, Artificial Sequence
  Description of Artificial Sequence: Synthetic coding sequence
atgattgaaactgactcaggcgtggatgatgatatggcctgtcataagattccggtggaagcagattttctttacgcgtactcaacggcccctggatactactcttggagaaattccaaggacggatcttggtttattcaatccctctgtgcaatgctcaagcagtacgcagacaaacttgaattcatgcacatccttactagggtgaatagaaaggtagcaacggaattcgagtcattttcgtttgatgcaaccttccatgctaagaaacagattccctgcattgttagcatgttgactaaggaattgtacttctatcatgacgaggtggatggcggcagcccaatggagaacaccgagaactcggtggacagcaaatcgattaagaatttggagcctaagattatccacgggtctgagagcatggatagtggaattagcctggataactcgtataagatggattaccctgaaatgggactgtgtattatcatcaataacaaaaactttcataagtcaactggaatgacctctcgctcgggcactgacgtcgatgcggccaacctgagagaaacctttcgaaatctcaagtacgaagtgcgaaacaagaatgacctcactcgcgaggaaatcgtggagttgatgcgcgacgttagcaaagaggatcactccaaacggtcatcctttgtgtgcgtgctgctgtcacatggagaagaagggatcatttttgggactaacggtccagtcgacctgaagaagattactaacttctttagaggggacaggtgtcgtagccttaccggaaagcccaaacttttcattatccaagcatgtagagggaccgaacttgattgcggaattgaaactgat

SEQ ID NO: 249669 - DNA, 870 bp, Artificial Sequence
  Description of Artificial Sequence: Synthetic coding sequence
atgatcgagaccgattcaggagttgacgacgacatggcatgtcataaaattcccgtggaagctgactttctgtatgcttatagtacggcccctggatactactcatggcggaacagcaaggatgggtcatggttcatccagagcttgtgtgcaatgctgaagcagtatgcagataaactggaatttatgcacattcttacccgggttaatagaaaggtagctacagagttcgagagtttcagcttcgatgcaacttttcacgccaagaaacagattccctgtatcgtttcgatgttgactaaggagctttatttttaccacgacgaggtcgatgggggctctcctatggagaacaccgagaacagcgtcgactctaaatctattaaaaatcttgaacctaagatcattcacggcagcgagagtatggacagcgggatttcccttgacaattcttataagatggactaccccgagatgggcctgtgcataattattaacaacaagaattttcacaagagtacgggtatgactagccgctccggcaccgacgtagatgcagccaatttgcgagaaacctttcggaacttaaagtatgaggtccgaaacaagaacgatctgaccagggaagaaatcgttgagctgatgcgcgatgttagcaaagaggatcacagtaagcgtagcagctttgtgtgtgtgctcctcagtcacggcgaagaaggaattatattcggaacaaacgggcctgtcgacttaaagaagatcacgaattttttcagaggcgatcgttgcagaagcctgacaggaaagcccaaacttttcatcatacaggcttgtagaggaaccgagctggactgtggaatcgaaacagac

SEQ ID NO: 249670 - DNA, 870 bp, Artificial Sequence
  Description of Artificial Sequence: Synthetic coding sequence
atgatcgaaaccgattctggcgtagatgacgacatggcctgccataagatccctgttgaagcagattttttgtacgcgtattccacagccccagggtattattcctggagaaacagcaaagacggatcttggtttattcagtctctctgtgctatgctgaagcagtacgccgacaaactggaatttatgcacattctcaccagagttaaccgaaaggtggccaccgagtttgaaagtttttcgttcgacgccactttccacgcgaaaaagcagattccttgcattgtgagcatgctgacgaaagaattgtatttctatcacgacgaggtggatggcggctctcctatggagaacacggaaaactctgtcgattcgaagtcaataaagaatctggaaccaaagataatccatgggtccgaatccatggacagcggcatttctctcgacaactcttacaaaatggactaccccgagatgggcctttgtatcatcatcaacaacaaaaattttcataagtctacgggcatgacctcgcggagtggtacagacgttgacgcagccaatttgcgcgagacctttcggaatcttaagtacgaggtaagaaataaaaatgacttgaccagggaagaaattgtggaattgatgagggacgtctctaaggaggaccatagcaagcggtcatccttcgtgtgtgttctgctctcacacggagaggagggcatcattttcggaacaaacggaccagtggatctaaaaaaaataacaaacttcttccgaggggatcgatgcagatccttaacaggtaagcctaagctgtttatcatacaggcttgtaggggaacagagctcgactgtggaattgaaactgac

SEQ ID NO: 249671 - DNA, 870 bp, Artificial Sequence
  Description of Artificial Sequence: Synthetic coding sequence
atgatcgaaacggactctggggtcgacgatgatatggcctgtcataagatccccgtcgaggctgactttctgtatgcctactccacggctccgggatactactcttggcgcaattcaaaggacgggtcctggtttattcagtcgctctgtgccatgttaaagcagtacgctgacaagctggaattcatgcatatactgacccgggtgaaccgcaaggtcgcgacagagtttgagagcttcagttttgacgctactttccatgcaaagaagcaaattccatgtatcgtgtctatgttgactaaggagctttacttctaccacgacgaggtggacggcgggagtccaatggagaataccgagaattccgtggattccaaaagcattaagaatctcgaacctaaaatcatccacggaagcgagagcatggacagtggcatctcacttgataacagctataaaatggattacccagagatgggtctctgtattatcattaataacaaaaatttccacaagagcactgggatgacaagcagaagtggaacagatgtggatgcagctaatttgagagagacctttaggaaccttaagtatgaggtacgcaataaaaatgatctgactagggaagagatcgtggaactcatgcgagatgttagcaaggaggaccactcgaagcgctcttcttttgtgtgtgtgctgctgagccacggggaggaaggaattatctttgggacgaacggcccagtggacttgaagaagatcacgaatttctttcgtggcgatagatgtagatccttgacaggtaagcctaaactgttcataatccaagcgtgtcgaggaactgagttggactgtggaatcgaaactgac

SEQ ID NO: 249672 - DNA, 870 bp, Artificial Sequence
  Description of Artificial Sequence: Synthetic coding sequence
atgatcgagacagattcaggggtggatgatgatatggcttgccacaagataccagtcgaggcagactttctttacgcctactcaaccgcaccaggatactattcttggcggaactccaaggatgggtcctggtttatacagtctctctgcgcaatgctcaaacaatacgcagacaagctggagtttatgcacatcctcactagggtgaatagaaaggttgcgaccgagtttgagagtttctcattcgacgcaaccttccacgctaaaaagcagatcccatgtatcgtgtccatgctcactaaggagctgtatttctaccacgatgaagtggacgggggatcccccatggaaaacacagaaaattctgtcgactctaaaagtataaaaaacctcgagcccaaaattatccatgggagtgagtccatggatagcggtatatctctcgataactcttacaaaatggattatcccgaaatgggattgtgtatcattataaacaataaaaatttccataagtctacaggcatgacttcaagaagtggaaccgatgtggacgcagccaacctgcgggaaacatttcggaatttaaagtatgaggtaaggaacaagaacgatctgaccagagaggagatagtggaactcatgagggatgtgagcaaggaggaccacagcaagcgaagttcatttgtatgtgttctactgagccatggtgaggaggggataattttcgggaccaacggtccggtggatttaaaaaagataaccaactttttccggggggatcggtgccgatccctgaccggaaaaccaaagctgtttatcattcaagcatgccgaggtactgagctcgactgtggtatcgagactgat

SEQ ID NO: 249673 - DNA, 870 bp, Artificial Sequence
  Description of Artificial Sequence: Synthetic coding sequence
atgattgagacagatagtggggtggacgatgacatggcctgtcataagatccctgtggaggcagatttcctgtacgcctatagcacggccccagggtattactcctggcggaattccaaggatgggtcttggttcatacagagcctgtgtgcgatgctcaagcagtacgctgacaaactggagttcatgcatatcctgacacgggtcaataggaaagtcgcaacagagttcgaatcttttagcttcgacgccacctttcacgctaaaaaacagataccttgtatcgtttctatgctgactaaggagctgtatttctatcatgacgaagtggatggggggtctcccatggagaatactgaaaattccgttgactccaagagcattaaaaacctggagccaaaaatcatccatggctcagagtccatggattcagggatatcactggacaactcttacaaaatggactacccagagatgggactgtgcataattataaataataagaacttccataaatcgaccggaatgacgtccaggtccggcacagacgtcgacgccgctaatctcagagaaacctttaggaacttgaagtacgaggtacgaaacaaaaatgatctgacaagagaggaaatagtggagttgatgagggacgtgtctaaggaagaccactccaaaagatcctcattcgtctgtgttctgctgagtcatggagaggagggcattatatttggtacaaacgggccagtagaccttaagaagatcactaactttttccggggtgacaggtgccgctcattaaccggcaaacccaagctctttataatccaggcttgccggggaacagaactggactgcggaatagaaaccgac

SEQ ID NO: 249674 - DNA, 870 bp, Artificial Sequence
  Description of Artificial Sequence: Synthetic coding sequence
atgatagaaactgattcaggagtggacgatgacatggcctgccataaaattcccgtggaagcagactttttatatgcttattctacagcacctggatattattcttggcgcaactccaaagacgggtcatggttcatccagagcttgtgcgcgatgctcaaacagtacgccgataaactcgagtttatgcatattctcaccagagttaatcggaaagtggccaccgagtttgagtcgttctccttcgacgccacatttcacgctaagaaacaaattccttgtatagtgtcaatgttgacaaaggaattatatttttatcacgacgaggtcgacggaggatcacctatggagaatacagaaaatagcgtggactctaaatcaattaagaacctggagcctaaaataatccatgggtcggaatccatggacagcggcatatccctggataattcgtacaagatggactaccccgagatgggactgtgcatcatcattaacaataaaaactttcataagtctacaggcatgacttcccgatcgggcactgacgtcgacgccgcgaatttacgggagacatttagaaacctgaagtacgaggtcaggaacaaaaacgacctcacacgtgaggaaatcgtggagctgatgcgtgacgtttctaaggaagatcatagtaagaggagttcttttgtatgcgtgctgttgtcgcacggcgaagaggggatcattttcgggacaaacggtcctgtggaccttaagaaaataactaacttctttagaggagataggtgtagaagtctgaccggcaaacccaaactgttcattattcaggcgtgtagaggaacggagctggattgcggaatcgagaccgat

SEQ ID NO: 249675 - DNA, 870 bp, Artificial Sequence
  Description of Artificial Sequence: Synthetic coding sequence
atgatagaaacggattcaggcgttgacgacgatatggcatgccacaaaatcccagtcgaggccgactttctgtacgcatactccacagcacctggatactattcctggagaaattcaaaggatggcagctggttcatacagtccctctgcgcaatgttgaagcaatacgccgacaaattggaattcatgcatattctgacaagggtgaatcggaaagttgccacagagtttgagtcattctccttcgacgcaacatttcatgctaaaaaacagatcccctgcattgtctccatgctgacaaaagaactgtacttctatcacgatgaggtggacgggggctcccccatggagaatactgagaacagcgtagattctaaaagtatcaaaaacctggaacctaaaataattcacggtagcgaaagtatggactccggaatctccctggacaactcctataaaatggattatccggaaatgggcctgtgcattattattaacaacaaaaatttccacaaaagcacaggaatgacctcaaggtcagggactgatgtggacgccgctaatctgagagagactttcagaaacctgaaatatgaggttaggaataagaatgatctgacaagggaggagatagtggaactgatgagagacgtatccaaggaggatcattcaaagagatcctcctttgtctgtgtgctgctcagccacggagaggagggtatcattttcggaaccaacggacctgtggacctcaagaaaattacaaattttttccgaggtgacaggtgtcggtcccttaccgggaagcctaaactgttcatcattcaggcctgccgaggaacagagctggattgcgggatcgagacagac

SEQ ID NO: 249676 - DNA, 870 bp, Artificial Sequence
  Description of Artificial Sequence: Synthetic coding sequence
atgatcgagactgacagcggagtagacgatgacatggcatgtcacaaaataccagtcgaggccgatttcctatatgcctacagtaccgccccgggatactactcctggaggaactccaaggacggctcctggttcattcagtcactctgtgctatgctgaaacagtatgcggacaagttagaatttatgcacatattgacaagagtcaatcgcaaggttgctaccgaatttgagagcttcagtttcgatgccacctttcacgcaaagaagcagatcccgtgtatagtttccatgctaaccaaggagctctatttttatcatgatgaggtcgacggcgggagcccaatggagaataccgagaatagcgtggacagtaaaagcataaaaaatctcgagccaaaaatcatacatggaagcgaatctatggacagcgggatatctctcgacaatagctacaagatggactatcctgaaatgggactgtgcatcattattaataataagaatttccataagagcacgggtatgacaagcagaagcgggacggacgtggatgccgccaacctcagggagacctttagaaatctgaagtatgaagtcaggaataagaatgatctgaccagggaggaaattgtcgaattgatgagagatgtgtctaaagaggaccacagtaaaaggtccagttttgtttgcgtgctgttgtcccacggagaagaggggattatcttcggtacaaacggccccgtggatctgaagaagatcacaaactttttccgcggggacagatgtcggtctctaacagggaagccaaagctattcataatacaagcatgtcgagggactgagctggattgtggaattgaaacggat

SEQ ID NO: 249677 - DNA, 870 bp, Artificial Sequence
  Description of Artificial Sequence: Synthetic coding sequence
atgatcgagactgattccggcgtggacgatgacatggcctgccataagattcccgtggaggccgacttcctttacgcctatagcacggctccaggctactactcgtggcgcaattcgaaggatggcagctggttcatccaatcgctgtgcgcgatgcttaagcagtacgcagataagctggagtttatgcatatcctgactcgcgtgaaccgcaaggtggccactgaattcgaatcgttctcattcgacgccaccttccacgccaagaagcaaattccttgtatcgtgagcatgctgactaaggagctctacttctaccacgatgaagtggacgggggatcaccgatggaaaatacggagaattcggtggacagcaagtcaatcaagaatctggagcctaaaatcatccatggatccgaaagcatggacagcggcatctcccttgataattcctataagatggattaccctgaaatgggcctttgtatcatcatcaacaataagaatttccacaagtccaccgggatgacctcaagatcggggactgatgttgatgcagcgaacctgcgcgaaaccttccggaacctcaaatacgaggtcagaaataagaacgatctcacccgcgaagagatcgtggaactgatgcgcgatgtgtcgaaagaggaccattctaagcggtcatctttcgtttgcgtgctcctgtcccacggcgaagagggaatcattttcggaaccaacggtccggtggaccttaagaaaatcaccaatttcttccggggcgaccggtgccgctccctgaccggaaagccaaaactgttcatcatccaggcatgtaggggcactgagctcgattgcggaatcgaaaccgat

SEQ ID NO: 249678 - DNA, 870 bp, Artificial Sequence
  Description of Artificial Sequence: Synthetic coding sequence
atgattgaaaccgactccggtgtcgacgacgatatggcttgccataagattcctgtggaagctgacttcctctacgcctatagcacggcgccgggatattactcttggaggaactcgaaggatggaagctggtttattcagtccctgtgtgccatgctgaagcagtacgctgataagttggaattcatgcatattctgacgagagtgaacaggaaggttgccaccgaattcgaatctttcagcttcgacgcgactttccacgccaagaagcaaattccatgcatcgtgtcgatgctgaccaaggagctgtacttctaccacgacgaggtcgacggaggatcaccgatggagaacaccgaaaactccgtggacagtaagagtatcaagaacctcgaaccgaagatcatccacggttccgaaagcatggactcgggcatctccctggataattcgtacaaaatggactacccagaaatggggctttgcataatcatcaataacaagaatttccataagagcactggaatgacgtcccggagcggcaccgatgtggacgcagcaaacttgagggaaacctttcggaatctgaagtacgaagtgcgaaacaagaacgatctcactcgcgaagagatcgttgagttgatgcgcgatgtctccaaggaggaccattccaaacgttcgtcatttgtgtgcgtgcttctgtcacacggcgaagaaggaatcatattcggaacgaacggacctgtggatctgaagaaaatcaccaatttcttccgaggggatcgctgcagatccctcactggaaagcccaaactgtttatcatccaggcgtgtcgcggaacggaattggactgcgggatcgagactgac

SEQ ID NO: 249679 - DNA, 870 bp, Artificial Sequence
  Description of Artificial Sequence: Synthetic coding sequence
atgattgagaccgattccggagtggacgacgatatggcttgccacaaaatcccagttgaagcagacttcctgtacgcttactcaacagctccaggctactacagctggagaaacagcaaggatggaagttggttcatccaatcactgtgcgccatgctgaaacaatatgcagataagttagagtttatgcatatcctgacccgtgtcaacagaaaggtcgctaccgagttcgaaagctttagctttgatgcaacatttcacgccaagaagcagatcccatgcatagttagtatgctgaccaaagaactgtatttttaccacgacgaagtcgatggcggctcccctatggagaacaccgagaactccgttgactccaagtcaatcaaaaacctggagccaaaaattatccatggcagcgagagtatggacagtggaataagccttgacaacagttataaaatggattatcctgagatgggcttgtgcattatcatcaacaacaaaaacttccacaagtctactggaatgaccagccgcagcggaaccgacgtggacgcggcaaacctgcgggagaccttccgaaacctcaagtacgaggtgcgtaataagaacgatcttacgagagaagagatagtcgagctcatgcgcgatgtgagcaaagaagaccatagtaaacgctcttcgtttgtttgcgtgctgctgtcacatggagaggagggaatcatctttggcacgaacggacccgtggatctgaaaaaaattacaaatttcttccggggggatcgatgcagatcattgacggggaagccgaaactgtttataatccaggcttgcaggggtactgaactggattgcggcatagagacagat

SEQ ID NO: 249680 - DNA, 870 bp, Artificial Sequence
  Description of Artificial Sequence: Synthetic coding sequence
atgatagagactgattcgggggtggacgatgacatggcctgtcataagatcccggtggaagcagactttctctacgcctactcgaccgcgccgggatactacagttggagaaacagtaaagatgggtcatggttcatccagtcactgtgcgcgatgctcaagcagtacgccgacaaactggagtttatgcatatcttgacccgcgtgaaccgcaaagtagcaacggaattcgagtccttctcattcgacgctacgttccacgccaagaagcaaatcccatgcatcgtatctatgctgactaaagaactgtacttttatcacgacgaggtcgatggcggttcccctatggaaaacacggaaaattccgtggattcgaaaagcattaagaacttggagcctaagatcattcacggatccgagagcatggacagcggtatctcactggacaatagctacaagatggactacccggaaatggggctctgcatcatcatcaacaacaagaacttccataagtctaccggtatgactagccgcagcggaaccgatgtcgacgctgcgaacctgcgggaaactttcagaaatcttaagtacgaggtgcgcaataagaatgacctgactcgcgaggaaatcgtcgagcttatgcgagatgtgtccaaggaggatcactcgaaaagatcatcctttgtctgcgtgctgctttcgcacggtgaagagggcatcattttcggaaccaacggacccgtggatctcaagaagatcaccaacttcttccgtggagatcggtgtagatctctcactggcaagccaaagttgttcattatccaagcctgccggggaaccgaactggactgcggcatcgaaaccgac

SEQ ID NO: 249681 - DNA, 870 bp, Artificial Sequence
  Description of Artificial Sequence: Synthetic coding sequence
atgattgaaaccgattcaggcgtggacgacgacatggcttgtcacaagattcccgttgaggcggattttctctacgcatactctactgcacctgggtactactcgtggagaaactcaaaagatgggtcgtggtttatccaatcactttgcgcgatgcttaaacagtacgcagacaaattggagttcatgcatattcttactagagtgaatcgtaaggtcgctactgaatttgaatccttttcgttcgacgccacctttcatgcgaagaagcagatcccgtgtattgtgagcatgctgaccaaggagctgtacttttaccatgatgaggttgatggaggatcgcctatggaaaatacggagaattccgtagacagcaaatccataaagaatcttgaaccaaagataattcatggctcggaaagcatggatagtggaatctcgctcgataactcgtacaaaatggactaccctgaaatgggtctttgcatcataatcaacaacaaaaactttcataagtcgaccggtatgactagccgttcgggtactgacgtcgacgcagcgaatctgcgggaaacttttaggaatctgaagtatgaagtgagaaacaaaaacgacttgaccagggaggaaattgtggaactgatgcgcgatgtgtcaaaggaggatcactccaaaaggtcatccttcgtctgcgtgctcctttcacacggagaagaagggatcatttttggaaccaacggccccgtagatcttaagaagataaccaacttcttcagaggggaccgctgtaggtccctgactggaaaaccaaagctctttatcattcaagcatgtcgaggcaccgaattggattgtgggatcgagactgat

SEQ ID NO: 249682 - DNA, 870 bp, Artificial Sequence
  Description of Artificial Sequence: Synthetic coding sequence
atgattgagacagactccggggtcgacgatgacatggcttgtcacaagatcccagtggaagccgactttttgtacgcctattctaccgctcccgggtactattcgtggaggaattctaaagatggcagctggttcatacagagcctttgtgccatgttgaagcaatacgctgataaactcgagttcatgcacatcctgactagggtcaaccgaaaggtggcgacggagttcgagagtttcagtttcgatgccacttttcatgccaaaaaacagatcccctgtattgtatcaatgttgactaaagaactgtatttctatcatgatgaagttgatggagggagtcctatggaaaacactgaaaattctgttgactcgaaatctattaaaaacttggagccaaaaataatccacgggtccgaaagcatggattccggtatctcactcgataactcttacaaaatggattacccggagatgggtctgtgcattattatcaataacaagaacttccacaagtcaactggaatgacatccaggagcggcactgacgtggatgccgctaacctccgcgagacatttcgcaaccttaagtatgaagttcgaaataagaatgatttaaccagagaggagatagtagagcttatgcgggacgtatctaaggaagaccattccaaacggtcgtctttcgtctgtgtattactgtctcatggagaagaggggataattttcggcacgaatggaccggtcgatttaaagaaaattactaatttcttcaggggcgaccgatgtagatccctgacgggcaagcccaagctttttatcatccaagcttgccgagggaccgagttggattgtggcattgaaaccgat

SEQ ID NO: 249683 - DNA, 870 bp, Artificial Sequence
  Description of Artificial Sequence: Synthetic coding sequence
atgatagaaaccgattcaggcgtcgacgatgatatggcctgtcataaaatccccgtggaagccgacttcctctacgcgtactccaccgcccccggctactattcctggcggaatagcaaggatggctcttggttcatccagtcattatgtgcgatgctcaaacaatatgcagacaagctagaatttatgcatattctgacaagggtcaaccggaaggtcgccactgagtttgaatcctttagttttgacgctaccttccacgccaaaaaacagattccatgcatcgtaagcatgcttactaaggagctgtacttctaccacgacgaggttgacggagggtcccctatggagaacacggagaacagtgtggactcaaagtccattaaaaacctcgaaccgaagataatccacggcagcgagtccatggactctgggatctcactcgataacagctacaagatggattaccctgaaatggggctatgtatcatcataaacaataaaaacttccacaagagcaccggaatgaccagccgatcggggaccgacgttgatgcagctaaccttcgagagacatttagaaatttgaaatacgaggtacgcaacaaaaatgatttaactcgtgaagaaatcgtggagctcatgcgtgatgtgtctaaagaggaccactcaaaaaggtcttctttcgtgtgcgtgctgctgtcgcatggcgaggagggtattatatttgggactaatgggcctgtggatcttaagaaaatcaccaatttcttcaggggagacagatgcaggtctttgacagggaaaccaaaactattcataatccaggcctgcagggggacggagctggattgtggaatcgagacagac

SEQ ID NO: 249684 - DNA, 870 bp, Artificial Sequence
  Description of Artificial Sequence: Synthetic coding sequence
atgatcgaaaccgactcaggagtggacgacgacatggcttgccacaaaatcccagtcgaggccgatttcttgtacgcctactcaaccgctccgggctactactcctggcggaactccaaggacgggtcctggttcatccagagcctctgtgccatgctgaagcaatatgctgataagctggagtttatgcatatcctcactcgggtcaatagaaaagtggcaactgagtttgagtctttctcattcgatgccacgttccatgctaagaagcagatcccatgcattgtgtcgatgctgaccaaagaactgtacttctaccacgatgaggtggacggcggatcaccgatggaaaatactgaaaactccgtggactcaaagagcatcaagaatctggagccaaagatcatccacggtagcgaatcgatggattccggcatttcgctggacaactcgtacaaaatggactacccggaaatggggctctgtattatcatcaataacaagaattttcataagtcaactggaatgacgagccgctcgggaaccgatgtcgacgccgccaatctgcgcgaaaccttccgcaacctcaagtacgaggtgagaaacaagaatgatttgacgagagaagaaattgttgaactcatgagagacgtgtcaaaggaggatcactcgaagagatcgtcgtttgtgtgcgtgctgctgtcccacggtgaagagggaatcatcttcggaaccaacggcccggtcgacttgaaaaagatcaccaacttcttccggggcgacaggtgccggtcgctgactggaaagcctaaacttttcataatccaggcttgcagaggaacggagttggattgtggaatcgagactgac

SEQ ID NO: 249685 - DNA, 870 bp, Artificial Sequence
  Description of Artificial Sequence: Synthetic coding sequence
atgatagaaacggattcgggtgtagatgatgatatggcgtgtcataaaataccggtagaagcggattttttatatgcgtattcgacggcgccgggttattattcgtggcgtaattcgaaagatggttcgtggtttatacaatcgttatgtgcgatgttaaaacaatatgcggataaactagaatttatgcatatactaacgcgagttaatcgtaaagtagcgacggaatttgaatcgttttcgtttgatgcgacgtttcatgcgaaaaaacaaataccgtgtatagtatcgatgctaacgaaagaactatatttttatcatgatgaagttgatggtggttcgccgatggaaaatacggaaaattcggttgattcgaaatcgataaaaaatctagaaccgaaaataatacatggttcggaatcgatggattcgggtatatcgttagataattcgtataaaatggattatccggaaatgggtttatgtataataataaataataaaaattttcataaatcgacgggtatgacgtcgcgatcgggtacggatgtagatgcggcgaatttacgtgaaacgtttcgaaatttaaaatatgaagtacgaaataaaaatgatttaacgcgtgaagaaatagtagaactaatgcgagatgtatcgaaagaagatcattcgaaacgttcgtcgtttgtttgtgttctactatcgcatggtgaagaaggtataatatttggtacgaatggtccggtagatttaaaaaaaataacgaatttttttcgtggtgatcgttgtcgttcgttaacgggtaaaccgaaattatttataatacaagcgtgtcgtggtacggaactagattgtggtatagaaacggat

SEQ ID NO: 249686 - DNA, 870 bp, Artificial Sequence
  Description of Artificial Sequence: Synthetic coding sequence
atgatcgagacggacagcggggttgacgacgatatggcctgtcacaaaattcctgttgaagctgatttcctttacgcctattccactgctcctggttactactcctggaggaattcaaaggatggaagctggttcattcagtcactgtgcgccatgttgaaacagtacgcagataagctcgaattcatgcacatactgaccagggtgaaccggaaggtggctactgagtttgaaagtttcagttttgacgccacctttcatgctaagaagcagattccttgcatcgtgagtatgttgaccaaagaactgtatttctaccacgacgaggttgacggcggcagccccatggagaatacagagaattccgtcgatagtaagagtattaaaaatctcgagcccaagatcattcacggctcagaaagcatggacagcggcatctccctggataattcctataaaatggactatcctgagatgggactgtgcattattatcaataataagaatttccataagagcacaggaatgacttcaagatctggcactgatgtcgacgcagcgaacctccgagagacgtttagaaacctcaagtatgaggtcaggaataaaaacgacctcacccgggaggagattgtcgagttgatgcgcgacgtgagcaaagaggaccatagcaaacggtcatccttcgtgtgcgtgctcctgtcccatggtgaagaagggatcatatttggcaccaatggaccggtagacctgaagaagataaccaacttcttcagaggggatcggtgtaggtccttgaccggcaaacccaagcttttcattatacaagcctgccgcggaacagagctcgattgcggcatcgagacagac

SEQ ID NO: 249687 - DNA, 870 bp, Artificial Sequence
  Description of Artificial Sequence: Synthetic coding sequence
atgattgaaaccgactccggggtggacgatgatatggcgtgtcacaaaattcctgtggaggcagactttctgtacgcgtactctaccgcacctggctactactcctggagaaattccaaggatggatcatggttcattcagtccctgtgcgccatgcttaagcaatacgcggataaactcgagttcatgcatattcttactcgagtgaacagaaaggtggccactgaattcgaatctttctcttttgacgcaacctttcacgcaaagaagcagattccttgcattgtgtctatgctcactaaggaactttacttttaccatgatgaagtggacggaggatccccaatggaaaataccgaaaattcggtggattccaagtccattaagaatctggaaccaaagatcatccatggttccgaatcaatggattcgggcatttcgttggataactcctataagatggattaccccgagatggggctgtgcattatcattaacaataagaactttcataagtcgactggcatgacctcacgctcaggtaccgatgtcgatgcagcaaacctgcgggagactttccggaatcttaagtacgaggtccgaaacaaaaacgatttgactagagaggaaatcgtggaactcatgagggacgtcagcaaggaggatcatagcaaacgaagctcctttgtgtgtgtcctgcttagccatggtgaggaaggaattatcttcggaactaacggaccagtcgacctcaagaagataactaatttctttcggggtgatcggtgtagatcattgaccggcaagccaaaacttttcattatccaagcatgcagaggtaccgaactcgattgtgggattgagactgat

SEQ ID NO: 249688 - DNA, 870 bp, Artificial Sequence
  Description of Artificial Sequence: Synthetic coding sequence
atgatcgaaactgatagcggagtggatgacgacatggcgtgccataagatcccagtcgaagcggactttttgtacgcctactccaccgcccctggctactattcctggcgcaacagcaaggatggatcatggttcatccagtcactttgtgcgatgttgaagcagtacgccgacaaactggaattcatgcatatcctgacccgcgtgaacaggaaagtcgccactgagttcgaatcgttcagcttcgatgctacctttcatgcaaaaaagcagatcccttgcatcgtatcaatgctgaccaaagaactgtacttttaccacgacgaggtggacgggggatcgccaatggagaacactgaaaattcggtggactcaaagtcaatcaagaatctcgagccgaagatcatacatggttcggagtcaatggactctggtatctcgctggataatagctacaagatggattaccccgagatgggcctgtgtatcattatcaacaataagaattttcataaaagcaccggcatgacttcgcgctcgggaaccgacgtggatgcagccaacctgagagagactttccggaatctcaagtacgaggtgcgcaacaagaacgatctgacccgcgaagaaatcgtggaactgatgcgcgacgtctccaaggaggatcactctaagcgctcgtcattcgtgtgtgtgttgttgtcccacggagaagaaggaatcatcttcggcactaatggcccggtggatcttaagaagattaccaacttcttccgcggggatcggtgccggagcctgaccggtaaaccaaagctcttcatcatccaggcctgcagaggaaccgagctcgactgcggaatcgaaactgac

SEQ ID NO: 249689 - DNA, 870 bp, Artificial Sequence
  Description of Artificial Sequence: Synthetic coding sequence
atgattgagacagactccggagtggacgacgatatggcatgtcataagatcccagtcgaggcagatttcttatatgcatacagtaccgccccgggatactattcgtggcgcaactcaaaggacgggtcttggtttattcagagcctgtgcgccatgctgaagcagtatgccgataaattggagttcatgcacatcctcacaagagtgaataggaaagttgccacagagtttgaaagtttctcattcgatgccaccttccacgccaagaagcagattccctgtatcgtttccatgttgactaaggaactgtatttctaccacgacgaggtggacggcggtagtcccatggagaacaccgagaactctgtagattcaaagtccatcaagaatctcgagccaaaaatcattcatggttcagagtcgatggactctggtatcagccttgacaactcatataaaatggactaccccgagatgggcctgtgtataattatcaacaacaaaaatttccacaaaagtaccggcatgacatctcgctccggtactgacgtggacgccgcaaaccttcgggaaacattcagaaacctgaagtacgaggtgaggaataagaatgatctgacgcgagaggagatcgtggaactcatgagagacgtctctaaagaggatcacagtaagaggtcttcttttgtgtgtgtgttgctgagtcatggcgaagaggggataattttcggtacgaatggacccgtagacttgaaaaagatcaccaacttctttaggggcgacaggtgcaggtcgctgaccggaaaacctaagctctttatcatccaggcgtgtaggggcactgaactggattgtggcattgagaccgac

SEQ ID NO: 249690 - DNA, 870 bp, Artificial Sequence
  Description of Artificial Sequence: Synthetic coding sequence
atgatcgaaacggattcaggagtcgacgacgacatggcatgtcacaagatcccggtggaagcggacttcctgtacgcctatagcacggccccggggtactactcctggcggaattccaaggacggatcgtggtttatccaatcgctctgtgcgatgctcaagcagtacgccgataagctcgaattcatgcacatcctgactcgggtgaacagaaaggtggcaactgaatttgagtccttcagcttcgacgctactttccacgccaagaagcagatcccgtgcattgtgtcaatgctcaccaaagagctgtacttctaccacgacgaagtggatggcggaagtccaatggaaaacaccgaaaattccgttgactcgaaaagcatcaagaacttggaacctaaaattatccacggaagcgagagcatggatagtgggatctcgctcgacaactcatacaaaatggactaccccgaaatggggctgtgcatcatcattaacaataagaattttcataagtcgaccggcatgacctcgcgatccggcactgacgtggacgcggccaacctgcgggaaaccttccgcaacctgaaatacgaggtgaggaataagaacgacctcactcgcgaggagattgtggagctgatgcgggatgtgtccaaggaggaccattcaaagcgctccagcttcgtctgcgtcttgctgtctcatggagaggaaggtatcatattcggaaccaatggaccagtcgatcttaaaaagatcaccaactttttccgcggagatagatgcagatcgctgactggcaaacctaagctgttcatcatccaggcttgcaggggaaccgaacttgattgcggtatcgagactgat

SEQ ID NO: 249691 - DNA, 870 bp, Artificial Sequence
  Description of Artificial Sequence: Synthetic coding sequence
atgatcgagaccgattctggcgtcgacgacgatatggcctgccataagattcctgtagaggccgatttcttgtatgcttatagcaccgcacccggctactactcttggcgtaactcaaaggatggctcctggttcatccagtctttgtgcgcaatgctcaagcagtacgcagacaagctcgagtttatgcacattttgactagggtaaaccgtaaagtggcaacagagtttgagagcttcagtttcgacgctacattccatgcaaagaaacagattccttgtatcgtctctatgttgactaaagagctctatttttatcacgacgaagtcgacggcggtagtcccatggagaacactgaaaattccgtcgactccaagtctatcaaaaacttggagcctaagattatccacggtagcgaatccatggatagcggtatctctcttgacaactcctacaagatggactacccagagatgggtctgtgcatcatcataaacaataagaattttcacaaatctaccggcatgacttctcgcagcggtactgatgttgatgctgctaaccttcgcgagactttcaggaacctgaaatacgaagtgcgcaataagaatgatttgactcgtgaagagatcgtcgagcttatgagggatgtttccaaggaagaccactccaagagatctagtttcgtgtgcgtattgttgtctcacggtgaggaaggtatcatttttggaaccaacggaccagtggacctcaagaagatcaccaatttttttcgcggagataggtgtaggagtctgaccggcaagcctaagctgttcatcatccaggcatgccgcggaactgaacttgactgcggcatcgagacagac

SEQ ID NO: 249692 - DNA, 870 bp, Artificial Sequence
  Description of Artificial Sequence: Synthetic coding sequence
atgattgaaactgattcaggagttgacgatgatatggcttgtcataaaattcctgttgaggcagattttctttatgcatattcaacagctcctggatattatagttggagaaattcaaaagatggatcatggtttattcaatcattgtgtgctatgcttaaacaatacgctgataaacttgaatttatgcacatacttacaagagttaatcgtaaagttgctacagaatttgaatctttttcatttgatgcaacatttcatgctaaaaaacaaattccatgtattgttagtatgttaacaaaagaattatacttttatcatgatgaagtagatggaggtagtccaatggaaaatactgaaaattcagtcgatagtaaaagtattaaaaatcttgaaccaaaaattatccatggatcagaatcaatggattcaggaatttctttagataatagttataaaatggattatccagaaatggggctttgtattattataaataataaaaattttcataaatctactggtatgacttctagatcaggaacagatgttgatgccgcaaatttaagagaaacatttagaaatttaaaatatgaagttagaaacaagaacgatttgacaagagaagaaattgtggaattaatgcgtgatgtttctaaagaagaccacagtaaaagaagttcatttgtatgtgtacttcttagtcatggagaagaaggtattatttttggaactaatggtccagttgatttaaagaaaattacaaatttcttcagaggagatagatgcagatcattgactggaaaaccaaaattatttattattcaagcttgtagagggacagaacttgattgcggtatagaaactgac

SEQ ID NO: 249693 - DNA, 870 bp, Artificial Sequence
  Description of Artificial Sequence: Synthetic coding sequence
atgatcgaaacagattcaggtgtggacgacgacatggcctgtcacaagatcccagtggaggcagattttctgtacgcatatagcacagcccccggctattatagttggaggaatagtaaagacggctcatggtttatccagagcctttgcgccatgctgaagcagtacgctgacaagttagaatttatgcatatattgacccgggtgaatcgcaaggtggctaccgagttcgagtccttctcctttgacgctaccttccacgccaaaaagcaaatcccttgcatagtgagtatgctcactaaagaactgtatttctatcacgacgaggtggatggaggatcaccgatggagaacacagagaattctgtcgactctaagagcattaaaaatctcgagcccaaaatcatccacggctctgaaagcatggacagtggaatatccctcgacaattcatacaagatggactaccctgagatgggtctctgcattatcattaataataagaacttccacaagagcacaggcatgactagtaggtctggcactgatgtcgacgcggccaaccttcgcgagactttcaggaatctcaagtacgaggtgaggaacaagaatgatctaactcgtgaagagatcgtggaactgatgcgggatgtttctaaggaggaccattcgaagcggagttctttcgtgtgtgtgctgttaagccacggcgaggaggggatcatctttggcaccaatggcccagtggatctgaagaagatcaccaacttttttaggggagatcggtgtcgcagcctgacaggcaaaccgaaactcttcataatacaagcttgccgcgggacagagcttgattgtggaatcgagacagac

SEQ ID NO: 249694 - DNA, 870 bp, Artificial Sequence
  Description of Artificial Sequence: Synthetic coding sequence
atgatcgagactgattctggcgtggatgacgacatggcctgccacaaaatccccgtggaggcagatttcctgtatgcatactcgactgctccaggatactactcctggcgtaactcgaaggatggatcctggtttatccaatcgctgtgtgcaatgctcaagcagtacgcagacaaactcgaattcatgcacatcctcactcgcgtgaatcggaaggtcgccaccgaattcgaatctttctccttcgatgctactttccacgccaagaagcagattccgtgcatcgtgagtatgctcaccaaagagctgtacttttaccatgatgaggtggatggcggatccccaatggaaaacaccgagaattccgtggactccaagtcgatcaagaatctggagccgaagataatccacggaagcgaatcgatggactccggaatttcgctggacaacagctacaaaatggactaccctgagatgggactttgcattatcatcaataacaagaacttccacaaatcaacggggatgacctctcgctcgggaaccgatgtggacgctgcgaatctcagggaaactttcagaaacctgaagtatgaggtccggaataagaacgacctcacccgtgaagaaatagtggaactgatgcgggacgtgtccaaggaggatcattcaaaacggtcatcgtttgtttgcgtccttctgtcccatggcgaggagggtatcatttttgggaccaatggtccagtcgacctgaagaagatcaccaacttctttcgaggcgacaggtgtcgcagccttactggcaagccgaaattgttcatcatccaggcatgccgcggtaccgaactggattgcggtatcgaaactgat

SEQ ID NO: 249695 - DNA, 855 bp, Artificial Sequence
  Description of Artificial Sequence: Synthetic coding sequence
atgatcgagaccgacagtggggtcgatgacgatatggcttgccacaaaatccctgtggaagccgactttctttacgcttatagtaccgccccaggatattatagctggcgcaacagtaaggacggatcatggttcatacaaagtctttgcgccatgttgaaacagtatgctgacaagctggaattcatgcacatcctcactcgggtgaaccggaaagtggcaaccgaattcgaaagtttttcttttgatgcgacttttcacgctaagaagcagatcccctgcatcgtgagcatgttgactaaagagctgtacttctatcacggatccccaatggaaaataccgaaaactccgtggccagtaagtccattaagaacctggaacctaagatcattcatggctcggagtctatggcctccggtattagcctggacaactcgtataaaatggattaccccgagatggggctctgcattatcatcaataacaaaaatttccataagtccacgggcatgaccagccgcagtggcaccgacgtcgatgccgctaacctgagggagacatttcgcaacctcaagtatgaggtaaggaataagaacgatctgacgcgggaggagatcgtggaattaatgagagatgtttcaaaagaggatcatagtaaacgatctagtttcgtgtgcgtactgctcagccacggcgaggagggaatcattttcggcaccaatgggcctgtggatctgaaaaaaatcaccaattttttccgaggtgaccgttgtcggtccctcaccggcaaaccgaaactcttcatcattcaagcttgccgcggcacagagttggattgtggaatcgagaccgat

SEQ ID NO: 249696 - DNA, 855 bp, Artificial Sequence
  Description of Artificial Sequence: Synthetic coding sequence
atgattgagaccgattccggtgttgatgacgacatggcctgccataagatccccgtcgaagcagatttcctttacgcctatagcaccgcccccggttactactcctggcggaactcaaaggacggaagttggttcattcagtcactgtgcgcaatgttgaagcaatacgccgataaactcgagttcatgcacattttaactcgtgttaaccggaaggtcgcaaccgaattcgagagtttctccttcgacgccaccttccacgcaaaaaaacagattccttgcatcgtttcgatgctgaccaaggagctgtacttctaccatggatcccccatggaaaacactgaaaattccgtggcatctaaaagcattaaaaatctcgagcctaagatcatacatggaagtgagtccatggcaagtggcatctccctcgacaacagctataaaatggattacccggaaatggggctgtgcattatcattaataacaagaattttcacaaatcaacaggcatgaccagcaggtctggaactgacgttgacgctgccaatcttcgtgaaacattccggaatctcaaatacgaagtcagaaataaaaacgacttaactagagaggaaatcgtcgagctgatgcgtgacgtgtccaaggaggatcacagtaaacgttcctctttcgtgtgtgtgttattgtcacacggagaggagggtattatttttggcaccaacgggccagtggacttgaagaaaattacgaatttcttcaggggtgaccggtgtcggtctctgactggcaaacctaaattgttcatcatacaagcatgcagaggcaccgagctagattgtggcatcgaaactgac

SEQ ID NO: 249697 - DNA, 855 bp, Artificial Sequence
  Description of Artificial Sequence: Synthetic coding sequence
atgatagaaacggattcgggtgtagatgatgatatggcgtgtcataaaataccggtagaagcggattttttatatgcgtattcgacggcgccgggttattattcgtggcgtaattcgaaagatggttcgtggtttatacaatcgctatgtgcgatgttaaaacaatatgcggataaattagaatttatgcatatattaacgcgtgttaatcgaaaagtagcgacggaatttgaatcgttttcgtttgatgcgacgtttcatgcgaaaaaacaaataccgtgtatagtttcgatgctaacgaaagaactatatttttatcatggttcgccgatggaaaatacggaaaattcggtagcgtcgaaatcgataaaaaatttagaaccgaaaataatacatggttcggaatcgatggcgtcgggtatatcgttagataattcgtataaaatggattatccggaaatgggtctatgtataataataaataataaaaattttcataaatcgacgggtatgacgtcgcgatcgggtacggatgtagatgcggcgaatctacgagaaacgtttcgaaatttaaaatatgaagttcgtaataaaaatgatctaacgcgagaagaaatagttgaactaatgcgtgatgtatcgaaagaagatcattcgaaacgatcgtcgtttgtttgtgtactactatcgcatggtgaagaaggtataatatttggtacgaatggtccggttgatttaaaaaaaataacgaatttttttcgtggtgatcgttgtcgttcgttaacgggtaaaccgaaattatttataatacaagcgtgtcgaggtacggaattagattgtggtatagaaacggat

SEQ ID NO: 249698 - DNA, 855 bp, Artificial Sequence
  Description of Artificial Sequence: Synthetic coding sequence
atgattgagacggatagcggggtggatgatgatatggcttgccataagattcccgtggaagcagattttctctacgcatacagcactgctcccggatactactcatggcgaaacagcaaagacggatcgtggttcattcagtccctttgcgccatgctgaaacaatacgcagataagctggaattcatgcatattctgacccgcgtgaaccggaaggtggcaaccgagttcgagagcttctcgtttgacgccacgtttcatgcaaaaaagcaaatcccatgtattgtgtccatgctcaccaaggaactgtacttttaccacggttcccctatggagaatactgagaatagcgtcgccagtaagtccattaagaatctggaacctaagataatccatggctcggaatcaatggcatccggaatttcacttgataattcgtacaaaatggattaccctgaaatgggactgtgtataatcatcaataacaagaactttcataaatcgaccggcatgacctcccggagcggtaccgatgtggatgcagcaaacttgcgcgaaacctttcggaatctcaagtacgaagtgaggaataagaacgatctcactcgggaggagatcgtggaactcatgagggatgtctcaaaggaggaccattccaagcggtcgagctttgtttgcgtgcttctgtcacacggggaggaaggaattatcttcggcactaacggacctgtcgatctgaagaaaatcactaatttctttcggggagatcgttgtagatcgctcaccggaaagccaaaattgtttatcatccaggcatgtcgcggaaccgagcttgattgtggtatcgaaaccgat

SEQ ID NO: 249699 - DNA, 855 bp, Artificial Sequence
  Description of Artificial Sequence: Synthetic coding sequence
atgattgagactgactcaggagtcgacgatgacatggcttgccataagattccagtggaagcagacttcttgtacgcgtactctaccgcgcctggatactactcatggcggaattcgaaggacgggtcttggttcatccagagcctgtgtgctatgctcaaacaatacgccgacaagctggaattcatgcatatcttgactagagtcaaccgcaaggtggccaccgaatttgagtcgttctcattcgatgcgaccttccacgccaagaagcaaatcccttgcatcgtgtcaatgttgaccaaggaactctacttctaccacgggtcgccaatggagaatactgaaaattcggttgcctcgaagagcatcaagaatctggagccgaaaatcatccatggatcagaaagcatggcgtcaggcatttcactggataactcatacaaaatggactatccggaaatgggactgtgcatcatcatcaacaacaaaaacttccacaagtccacggggatgactagccgatccggaactgacgtggacgccgctaatctccgcgaaacgttcaggaatctcaaatacgaggtccgtaacaagaacgacctgaccagggaagaaatcgtggaactgatgcgggatgtctcgaaggaagatcactccaagaggtcgtcttttgtatgcgttctgctgtcccacggtgaagaggggatcatttttggcaccaacggaccggtggatttgaagaagatcactaacttttttcgaggtgaccggtgccggtcccttaccggcaaaccgaagctgtttatcatccaggcgtgccggggtaccgagctggattgcggaatcgaaaccgat

SEQ ID NO: 249700 - DNA, 855 bp, Artificial Sequence
  Description of Artificial Sequence: Synthetic coding sequence
atgatcgaaaccgactcaggcgttgatgatgacatggcctgtcacaaaatccctgtggaggcagacttcctctacgcctacagcactgcgccgggatactactcgtggcggaattcaaaagacgggagctggttcatccagtccctgtgtgcaatgctcaagcaatacgccgataaactggagttcatgcacatcctgaccagagtcaaccgtaaggtggctaccgaatttgagagcttctccttcgatgccaccttccacgccaagaaacagatcccttgcatcgtctcgatgctgactaaagagctctacttctaccacggatccccaatggaaaataccgaaaattcagtggccagcaaatccatcaaaaacctggagcccaagatcattcacggatcagagtccatggcatcaggcatctcgctggacaactcgtacaaaatggactaccctgaaatgggcctgtgtatcatcataaacaataagaacttccataagtctacgggaatgacgtcgaggtccggaactgatgtggatgcggctaacctcagggaaacctttcggaatctgaagtatgaagtgcgcaacaaaaacgacctgacccgcgaggaaatcgtggagctgatgcgcgacgtgtctaaggaggaccattccaagcgatcgtcgtttgtctgcgtcctcctctcacacggagaagaagggatcatcttcgggactaatgggccagtcgatttgaagaagattactaacttttttcgcggggaccgctgccgctcccttacgggaaagccgaaattgttcataatccaagcctgtagaggcacggagcttgattgtggtattgaaaccgac

SEQ ID NO: 249701 - DNA, 855 bp, Artificial Sequence
  Description of Artificial Sequence: Synthetic coding sequence
atgattgagactgacagtggcgtggacgacgatatggcttgtcataagattccggtagaagccgactttctgtacgcctatagcacagcccccggctattacagttggagaaattccaaggacggatcatggttcatccagtctctgtgtgccatgttgaaacaatatgccgacaagctcgaattcatgcatatcctcactagggtgaaccgtaaggtggcaacagaatttgagtcatttagctttgacgccacgttccacgctaaaaagcaaataccctgtatcgttagtatgctgacaaaagaactctacttctaccacggctccccaatggagaatacagagaattcagtggcgtctaagagtataaagaatctggaaccgaagatcattcatggatccgagtccatggcgtccggcatcagtctggataacagttataaaatggactacccagaaatgggactgtgcatcatcataaataacaagaacttccacaaatccaccggtatgacttcacgcagcggcacggacgtggacgcagccaatttgcgagagacgtttaggaacttaaaatacgaggttagaaataaaaacgatctgacaagagaggagattgtggaactaatgcgagacgtctccaaagaggaccacagcaaaagaagttcctttgtttgtgtgctactctctcacggggaggaaggcataatcttcggcacaaacgggcctgtggatctgaaaaaaatcacaaacttttttcgtggggaccgatgccggtccctcacaggcaaaccaaagctattcataatccaggcttgccggggcaccgagctagactgtggcatcgagacggat

SEQ ID NO: 249702 - DNA, 855 bp, Artificial Sequence
  Description of Artificial Sequence: Synthetic coding sequence
atgatcgaaactgacagcggtgttgatgacgacatggcatgtcacaaaatccctgtcgaagctgactttctgtacgcttacagcacagctccaggatactactcatggaggaactctaaggacggcagttggtttatccagtcattgtgtgcgatgctcaaacagtacgctgacaagctggaatttatgcatatccttactagagttaacaggaaggttgccaccgagttcgagtctttcagtttcgacgctacctttcacgctaaaaaacaaatcccctgtatagtctctatgctcacgaaagaactttacttttaccacggtagtccgatggagaacacagagaattccgttgcctctaagagtatcaagaatctggaaccaaagatcatacacggctccgaatccatggcctccggtatttccttggacaatagctacaagatggactaccccgagatgggtctctgcataatcataaataacaagaatttccacaagtcaacaggaatgactagccgctcaggaacagatgtggacgctgcgaatctgagagagacttttcgcaacttgaagtatgaagttaggaacaagaacgatcttacccgcgaagaaattgtcgagctgatgagagacgtgtcaaaagaagatcactctaagagatcaagttttgtgtgtgtgcttttgtcccacggagaggagggcattatcttcggtaccaacggccctgttgatttgaagaaaatcactaacttctttcgcggagatcgctgcaggagtctgacgggaaagccaaagctctttatcatccaggcctgtaggggtaccgagctggattgtggtatcgagacagat

SEQ ID NO: 249703 - DNA, 855 bp, Artificial Sequence
  Description of Artificial Sequence: Synthetic coding sequence
atgatcgagacagattcaggcgttgatgacgatatggcttgtcacaagattcctgtggaggcggacttcctatacgcttactcaaccgccccaggatattacagctggaggaactcgaaggatgggtcgtggttcattcagagcctgtgtgctatgcttaagcaatatgctgataagctcgagttcatgcatatactcacaagggtgaatcgaaaggtagccaccgagtttgagagcttcagcttcgacgctactttccacgcgaagaaacagataccttgcatcgtttcaatgctgacaaaagagctgtatttctatcatgggtcacctatggagaataccgaaaattctgtcgcttccaaatccataaaaaatttagagcccaagatcatacacggctccgagagtatggcctcaggaatatctctggataactcatacaaaatggactatccagagatgggactgtgtattatcataaacaataaaaattttcacaagagtacaggcatgacttcgcggtctgggaccgatgtcgacgccgctaacctgcgggaaacgtttaggaacttgaaatacgaagtcagaaacaagaacgatcttacgcgggaagagatcgtcgagctaatgagggatgtctcgaaggaggaccactccaagcgctcttcctttgtctgtgttctgctgagccacggagaggagggaattattttcggtacgaacggaccggtcgatttaaagaaaattactaatttcttccggggagatcgctgtcgctcgttaaccggaaagcccaaactattcattatccaggcatgcagaggtaccgagctggactgtggcatcgagaccgat

SEQ ID NO: 249704 - DNA, 855 bp, Artificial Sequence
  Description of Artificial Sequence: Synthetic coding sequence
atgatcgaaaccgactcgggagtggatgatgatatggcctgccataagatacccgtggaagcagatttcttgtacgcatactcaactgcgcccggatattacagctggagaaacagcaaggacggatcgtggtttatccaatctctctgcgctatgttgaaacagtacgcagacaagctcgagttcatgcacattcttacgagagtcaatagaaaagtcgctactgaattcgagtccttttcgttcgatgcaaccttccatgcaaagaagcagattccttgtattgtgtccatgcttaccaaggaactttacttctaccatggatccccgatggagaacactgaaaattcggtggcgagcaagtccattaagaatctggagcctaagataatccacggtagcgagagcatggcatcaggaatttcgctggataattcgtacaagatggactacccagaaatgggtctttgtatcatcattaacaacaagaactttcataaatcaaccggaatgaccagccggtctggaacggacgttgatgccgctaacctgcgggaaaccttcagaaacctgaaatacgaggtgcggaacaagaacgacctgactcgagaggaaatcgtcgagctgatgagggatgtgtcgaaggaagatcactcgaagagatcctcgtttgtgtgtgtcctgcttagccatggagaggagggcatcatttttggaaccaacggaccagtcgatctgaagaagattactaacttttttcgtggtgacagatgtcgctcgctgaccggaaagccgaaacttttcattatccaagcatgccgcgggactgaactggactgtggcatagaaactgac

SEQ ID NO: 249705 - DNA, 855 bp, Artificial Sequence
  Description of Artificial Sequence: Synthetic coding sequence
atgatagagacagactctggcgttgatgacgacatggcgtgtcacaagatccccgtggaggccgacttcctatacgcctattctactgctcctggctactacagttggcggaattcaaaggacggatcatggtttatccagtctctgtgtgccatgctcaagcaatatgcagataaactggaatttatgcacatccttacacgcgtgaataggaaggtcgcaactgaatttgagagcttttctttcgatgctacatttcatgcgaaaaagcagattccctgcattgtgtccatgcttaccaaagaactttacttctatcacgggagtcccatggagaatactgagaatagcgtggcatccaaatcaattaagaatctggaaccaaagattattcatgggtccgagtctatggcatcgggtatcagtctggataatagttacaagatggactacccagaaatggggctgtgtataattattaacaacaagaacttccacaagagtactggaatgactagccggtccgggaccgatgtagacgctgctaatctgcgcgagaccttccgcaaccttaaatacgaagtacggaataaaaacgacctgacgcgggaggaaatcgtagagctaatgcgggacgtctcgaaagaggaccactctaagaggagcagttttgtatgtgtgcttctgagccacggggaagagggcataatctttgggaccaatggccccgtggatctcaaaaagattacaaacttctttcgcggcgatcgatgtcgcagcctcacgggaaagcctaagctgttcatcattcaggcctgtagaggaacagaattggattgcgggatagaaaccgat

SEQ ID NO: 249706 - DNA, 855 bp, Artificial Sequence
  Description of Artificial Sequence: Synthetic coding sequence
atgatcgagactgactcaggtgtggacgacgacatggcatgccataagataccagtggaggccgatttcttgtacgcatattctacagctcccggatattattcttggcgcaactccaaggatggctcatggttcatccaaagtctgtgtgccatgctcaagcagtatgccgataagctggaattcatgcatatcctgacaagagtgaacagaaaggtggccacagagttcgaatccttttcctttgacgctacctttcatgccaagaaacagatcccttgcatcgtctccatgctgaccaaagagctttatttttaccacggttcccctatggaaaacaccgaaaacagtgtggcttctaaaagcatcaagaacctggagcccaagatcatccacggctctgagagcatggcctccggcatatctttggataactcatacaaaatggactatcccgaaatgggtctctgcattatcatcaataacaagaacttccataaaagtactggaatgacctctagatccggtaccgatgttgatgcagctaacctgcgcgagacatttaggaacctgaagtatgaggtgcgtaataagaacgacctcacacgtgaagaaattgtcgagctgatgcgcgatgtctccaaggaagatcattctaaaaggtcctcctttgtttgcgtccttctgtcccacggtgaggagggtataatcttcggcaccaatggtccagtggacctgaagaagattaccaacttcttccgtggagatcgctgccgctcccttacaggtaaacctaagctgttcatcatccaggcctgtcgtggaacagagctggactgcggtatcgaaaccgat

SEQ ID NO: 249707 - DNA, 855 bp, Artificial Sequence
  Description of Artificial Sequence: Synthetic coding sequence
atgatagaaacagactccggtgttgacgacgatatggcctgccacaaaattcccgtagaggccgatttcctctatgcgtactccacagctccgggctattactcctggcgcaattcaaaggacgggtcttggttcattcagtccctatgtgcaatgctcaagcaatacgctgataaacttgagttcatgcatatattaacccgggtgaaccgcaaagtagcaacagaattcgagtccttttcatttgacgctactttccacgccaaaaaacagatcccttgcatagtcagtatgctgacaaaagaactctatttctatcacgggtctcctatggaaaatactgagaattccgtcgcttcaaagtctattaagaaccttgagcctaagattattcacggatctgaaagtatggctagcggcatcagccttgataactcatataaaatggactatccagagatggggctgtgtataattattaacaataaaaactttcacaagtcaaccggaatgaccagccggtccggcaccgacgtcgacgccgccaatcttagggagacatttcgcaacttgaaatatgaggttagaaacaagaacgatttgacccgcgaagagatcgtggagctgatgcgggatgtgtcaaaggaggaccattccaagcggagtagcttcgtatgtgtgcttctatcccacggagaagagggcatcattttcggtaccaacgggccagtagacctaaagaagatcaccaatttcttccggggagatcggtgcagaagtttgaccgggaagccaaaactgttcatcattcaggcgtgccgcggaaccgaactcgattgtggcatagagactgat

SEQ ID NO: 249708 - DNA, 855 bp, Artificial Sequence
  Description of Artificial Sequence: Synthetic coding sequence
atgatcgagactgactccggcgtggatgatgatatggcctgccataagatcccggtcgaagcagattttctttacgcctactcgaccgcccccggctactactcctggcggaatagtaaggacggcagctggtttatccaaagcctgtgcgcaatgctcaagcagtacgcggacaaactcgaattcatgcatatcctgactcgtgtgaaccgaaaagtggcaaccgagtttgagtcctttagctttgatgcgacctttcacgcgaaaaagcaaatcccctgtattgtctcgatgctgactaaggagctgtacttttaccatggttcacctatggaaaataccgaaaattcagtggcttcgaagagcataaagaatcttgaacccaagataattcatggttcggagtcgatggcctcggggatctcgctcgataactcctacaagatggactaccctgaaatgggattgtgtattatcatcaacaataagaactttcataagagcactggaatgacgagccgctccggtactgatgtcgacgccgcaaacctgagagaaacctttcgcaacctgaagtacgaggtccgaaataagaacgatctcaccagggaagagattgtggagttgatgcgggacgtcagcaaggaggatcattccaagagaagctcctttgtatgtgtcctgctttctcacggagaagaaggtataatctttggaaccaatggaccagtggatctgaagaagattacgaacttctttagaggtgaccggtgccggtcactcaccggcaagcccaaactgttcattatccaggcttgccgcggaaccgaactcgattgtggaattgaaaccgat

SEQ ID NO: 249709 - DNA, 855 bp, Artificial Sequence
  Description of Artificial Sequence: Synthetic coding sequence
atgattgaaacagattctggtgttgatgatgatatggcatgtcataaaattccagttgaagctgatttcttatatgcatactcaacagccccaggttattattcatggagaaattcaaaagacggttcttggtttattcaaagtttatgtgctatgcttaagcaatatgcagataaacttgaatttatgcatatattaactcgtgttaatcgaaaagtcgctactgaatttgagtcattttctttcgatgcaacattccatgctaaaaaacaaattccatgtatagtatcaatgcttacaaaagaattgtatttctatcatggatcgccaatggaaaatacagaaaattcagtggcaagtaaaagtataaaaaaccttgaaccaaaaattattcatggaagtgaatctatggcttcaggtattagtcttgataactcatataaaatggattatccagaaatgggtttatgtattataattaacaataagaattttcataaatcaactggtatgactagtagatcaggaactgatgttgatgctgcaaatctaagagagactttcagaaatttaaaatatgaagttagaaacaaaaacgatttaacaagagaagaaattgttgaattaatgagagacgtttcaaaagaagatcattcaaaacgttcatcatttgtttgtgtccttttatctcatggtgaagaaggaattatttttggaacgaatggaccagttgatcttaaaaaaattactaatttctttagaggagatagatgtagaagtttaacaggaaaaccaaaactcttcataattcaagcatgtagaggaacagaattagactgtggaattgaaacagat

SEQ ID NO: 249710 - DNA, 855 bp, Artificial Sequence
  Description of Artificial Sequence: Synthetic coding sequence
atgattgaaaccgatagcggcgtggatgacgatatggcctgccataagattcctgtggaagccgattttctctacgcctactcgacggcgcccggatactactcgtggagaaattccaaggacggctcctggtttatccaatcactttgcgcaatgttgaaacaatacgcagataagctcgaattcatgcacattttgacccgggtgaataggaaggtggcaaccgaattcgaatctttttcttttgatgcaactttccatgccaagaagcagatcccatgtatcgtctccatgctcacgaaagagctctacttctaccacggatcgcccatggaaaacaccgagaatagtgtggcgtcgaaatccatcaagaaccttgaaccaaagattattcatggaagcgagtccatggcgtcgggcatttctctcgataactcatacaaaatggattaccctgagatgggactgtgtatcatcataaacaacaaaaacttccataagagcaccggaatgacttcgcgctccgggacggacgtcgatgccgcaaatcttcgagaaacttttcgcaaccttaagtacgaagtcaggaacaaaaacgatctcactagggaagagattgtggaactcatgagagacgtctcgaaggaagatcattcgaaacgttcatcgtttgtctgcgtgcttctgtcacatggtgaagagggtataatctttggcactaacggaccggtcgatctgaagaagattactaacttttttcgtggggatcggtgtcgcagccttactggtaaaccaaagctcttcatcatacaggcatgtcgtggtactgaactggattgtggtattgagactgac

SEQ ID NO: 249711 - DNA, 855 bp, Artificial Sequence
  Description of Artificial Sequence: Synthetic coding sequence
atgatcgagaccgatagcggtgtggacgacgacatggcatgccataagatccctgttgaggcagatttcttgtatgcctattccaccgctcccggctactactcatggcgaaatagtaaggacggatcttggttcatccagtccctgtgtgccatgttaaagcagtacgccgataaactcgaattcatgcatatcctcactagggtgaatcgtaaagtggcaactgagtttgaatccttttctttcgatgctacatttcacgctaagaaacagatcccgtgcatcgtttccatgctgacaaaggaactttacttctaccacgggtcacccatggaaaatactgagaattctgtggctagtaaatctatcaagaacttagaaccaaagatcatacacggctccgagtcaatggcctccggcatcagtctcgataatagctataaaatggactatcccgagatgggactgtgcataattatcaacaataagaactttcataaatccacaggcatgacatctcgatccggaacagacgtggatgcggctaatctgcgagaaaccttcagaaaccttaagtacgaggtgagaaacaaaaacgacctgactcgcgaggaaattgtcgaacttatgagggatgtcagcaaggaggaccatagtaagcgctcttcgttcgtatgcgtcctattgagtcatggcgaggagggaattattttcgggaccaacggcccggttgacctgaagaagattaccaacttctttaggggagacagatgtcggtctttgaccggtaaaccaaagctattcattattcaagcctgcagagggactgagctcgactgcggcattgagactgat

SEQ ID NO: 249712 - DNA, 855 bp, Artificial Sequence
  Description of Artificial Sequence: Synthetic coding sequence
atgatcgaaaccgacagcggcgttgacgatgacatggcctgccacaaaatcccggtggaggcagacttcctgtacgcgtactctacggccccggggtactactcatggagaaactccaaggatgggtcatggttcatccaatctctgtgcgccatgctcaaacagtacgcggataagctggagttcatgcatatcctgactagggtgaaccggaaggtcgccaccgagttcgagtcattctcatttgatgcaacttttcacgccaaaaaacaaatcccgtgcattgtctcgatgctcacgaaggagttgtacttctaccacggatcaccgatggaaaatactgaaaattccgtggcgagcaaaagcatcaagaatctggagccaaagatcattcatgggtccgagtccatggcgtcgggaatatcgttggacaattcatacaagatggattatcccgaaatgggcctgtgcatcatcatcaataacaaaaactttcacaagtcaacggggatgacctcgcgcagcgggactgacgtggatgccgcaaacctgcgcgaaacttttaggaacctgaagtacgaagtccggaataagaacgacctcactcgggaggaaatcgtggaactgatgagggacgtgtcaaaggaggaccactctaaacggtcatccttcgtctgcgtcctcctgtcccatggggaagaaggcatcatcttcggaactaacgggcccgtggatcttaagaagattactaacttcttccgcggcgatcgctgtcggtcgttgacgggcaagccgaaactgttcattatccaggcttgtcgcggaactgagctggactgcggaatcgaaactgac

SEQ ID NO: 249713 - DNA, 855 bp, Artificial Sequence
  Description of Artificial Sequence: Synthetic coding sequence
atgattgaaaccgattcgggagtcgatgatgatatggcgtgtcataagattcctgtcgaagcggatttcctgtacgcatactcaaccgcgccaggctactactcttggagaaattcaaaggatggatcctggtttatccaaagtctgtgcgcaatgttgaagcagtacgcagataaactggagtttatgcacatccttactcgagtcaatcgaaaagtcgcgaccgaatttgaatcgttctcctttgatgcaacttttcatgctaagaagcagatcccatgtatagtgtcgatgcttaccaaggaactttacttttaccatgggtcaccgatggaaaatactgaaaactcggtggcctccaagtcgataaagaaccttgaaccaaagattatccacggatcagaatctatggcatcgggaattagccttgataattcgtacaagatggactaccctgagatgggactctgcatcattatcaacaacaagaattttcacaaaagcacgggaatgacctcaaggtcgggtaccgacgttgatgcggcaaatcttagagaaacttttcggaacctgaaatacgaagtgcggaacaagaacgatctcacccgcgaagaaattgtggagcttatgcgcgatgtctccaaggaagatcattctaaacggagcagctttgtgtgtgtgctgctttcgcacggtgaagaagggattatctttggcactaacggtccagtggatctgaagaaaatcactaacttttttcgaggtgacagatgccgtagcctgactgggaagcctaaactctttatcatacaagcatgcagaggtaccgaacttgactgtggaattgagactgat

SEQ ID NO: 249714 - DNA, 855 bp, Artificial Sequence
  Description of Artificial Sequence: Synthetic coding sequence
atgatcgagaccgattccggcgttgacgatgacatggcctgccacaagatccccgtggaggctgacttcctttatgcttactctaccgcacccggctactattcttggaggaactccaaggacggctcatggttcatccagagcctttgtgctatgttgaagcagtatgccgacaaactcgagttcatgcacatcctgaccagagtgaatcggaaggtcgctaccgagttcgagtctttttcttttgatgccaccttccacgcaaagaagcagatcccatgcatcgtgagtatgcttaccaaagaactgtatttttatcacggcagtcctatggaaaacactgagaactctgtcgccagcaagagcattaagaacctggaacccaagatcattcatgggtcagagagcatggcctctgggatctcccttgacaactcttataagatggattaccccgagatggggctgtgtatcattattaacaataaaaacttccacaagagcacaggcatgactagccggagtgggaccgatgtggacgctgcgaatttgcgagaaactttcaggaaccttaagtacgaggtgcgaaacaagaatgatttgactcgcgaggagatcgtagagttgatgcgggacgtttcaaaagaggaccactccaaacgctccagtttcgtatgtgtcctcttgagccacggagaggaaggcatcatattcgggactaatggccctgtcgacctgaaaaagatcactaacttctttagaggcgaccgctgtagatccctgactgggaaacccaagctgttcatcattcaggcatgtcggggaacagagctcgactgtggcattgagacagat

SEQ ID NO: 249715 - DNA, 855 bp, Artificial Sequence
  Description of Artificial Sequence: Synthetic coding sequence
atgatcgagactgacagcggtgtcgacgacgacatggcgtgccacaagatcccggtcgaggcagatttcctgtacgcgtactccacggcgccagggtactactcctggcgcaattccaaggacggttcctggtttatccagtcgctgtgcgctatgctgaagcagtacgctgataaactcgagttcatgcacatcctcactcgggtcaatcggaaggtcgccaccgagttcgagtcgttcagcttcgatgcaacctttcacgcaaagaaacaaatcccgtgcatcgtcagcatgttgacgaaagaattgtatttctaccacggatcgccaatggaaaatactgaaaattctgtggccagcaagtccatcaaaaacctggaaccaaagatcatacatggatcagagtcgatggcctccggaatttcactggacaacagctacaaaatggattacccggagatgggactgtgcattatcatcaacaacaagaactttcataagtccactgggatgacctcgaggagcggaacggacgtcgatgctgctaacctgcgcgaaaccttccggaacttgaagtatgaagtgcggaacaaaaacgacctcaccagagaggaaatcgtggagctgatgagggacgtcagcaaagaagatcactccaagcggtcctccttcgtgtgtgtgctgttgagccacggagaggaaggcatcatcttcggcaccaatggaccagtggatctgaagaagattaccaactttttcagaggcgaccgctgcagatcgctcactggcaagccaaagctctttatcatccaagcgtgtcgcggcactgaactggactgcggaatcgaaaccgac

SEQ ID NO: 249716 - DNA, 855 bp, Artificial Sequence
  Description of Artificial Sequence: Synthetic coding sequence
atgatagaaaccgattcgggggtggatgacgatatggcatgtcataagattccagtggaagctgactttctttatgcatacagcactgcacctggatactactcctggcggaacagcaaggatggatcctggtttatccaatccctgtgcgcaatgcttaaacagtacgcggataagctggaattcatgcatattctgacgagagtcaataggaaggtcgcaaccgagtttgaatccttttcattcgacgccacgttccatgcaaaaaagcaaatcccctgtattgtgtcaatgcttactaaggaactgtacttttaccacggatcgccaatggagaacaccgaaaattcggtggccagcaaatccattaagaacttggaaccaaagataattcatggcagcgagtccatggcatcggggattagcctggataattcgtacaaaatggactacccagagatgggtctttgtatcataatcaataacaagaatttccacaagagcaccggaatgacgtctcggtccggcaccgacgtagacgctgcaaatctcagagaaacctttcggaacctcaaatacgaagtgagaaacaaaaatgatttgacccgggaggaaatcgtggaacttatgcgggatgtgtcgaaagaagatcactccaagaggtcatcattcgtgtgtgttctgctttcgcatggagaggaaggtatcattttcggtaccaacggtccagtcgatctgaagaagatcaccaactttttccggggtgatcgttgccggtcgcttaccggcaaacccaagctgtttatcatccaggcctgtcgaggtaccgaattggactgtggcatcgagactgat

SEQ ID NO: 249717 - DNA, 855 bp, Artificial Sequence
  Description of Artificial Sequence: Synthetic coding sequence
atgatagaaactgactccggagttgatgacgatatggcttgtcataagatacctgtggaagctgatttcctttatgcctattctacagctcctgggtactattcctggcggaacagtaaggatgggagttggtttatccagtccctgtgtgccatgctgaaacagtatgcagataagctcgaattcatgcacatcctaacacgcgttaacaggaaagtagctactgagttcgaaagtttctccttcgatgctacttttcacgccaaaaaacagatcccatgtatcgtctcaatgttaactaaagaactgtatttctatcacgggtctccaatggagaacacagaaaattccgttgctagtaaaagtatcaagaatctagaacctaaaataatccacggatcggaatctatggcttcagggatctccctcgataactcttacaaaatggattacccagaaatgggattgtgcatcatcatcaacaataaaaacttccacaaatctacaggaatgacaagtcggagtgggactgacgtcgatgcagcaaatcttcgggagacattccgaaatttgaagtatgaagtgcgcaacaaaaacgatctcacacgcgaggaaatagtcgaactaatgagagacgtctctaaagaggatcactctaaaaggtcttcttttgtgtgcgtgctactatcacacggggaagaggggataatctttgggactaacgggcccgtagacctaaaaaaaatcactaatttctttagaggggatagatgtcggtccctaacagggaaaccaaaattatttataatacaggcctgtagggggacagaactagactgtggaatcgaaactgac

SEQ ID NO: 249718 - DNA, 855 bp, Artificial Sequence
  Description of Artificial Sequence: Synthetic coding sequence
atgatcgaaacggactccggtgtggatgacgacatggcctgtcataagattccagttgaggccgactttctgtacgcctactctaccgccccgggttactattcatggcggaattccaaggacggatcttggttcatccagagcctctgcgccatgctgaagcagtatgctgataagctcgaattcatgcacatattgactagggtgaacagaaaagtggcaacagaattcgagagctttagtttcgacgccacatttcatgctaaaaagcagatcccctgcattgtgtccatgctgacaaaggaactctatttttatcatggttcacccatggaaaacacggaaaatagcgtagcgagcaaatctattaagaaccttgagcctaagatcatccatggctcagagagtatggccagcggaataagcttggataactcctataagatggattatccagaaatgggcctgtgtataatcattaataataaaaacttccacaagagtactggaatgacctcacgctctgggacggatgtggatgccgccaatcttcgggagactttccggaaccttaaatacgaggtgcgaaacaaaaatgacctgactcgcgaggagattgtcgaactgatgcgcgacgtttccaaagaggaccactccaagcggtccagtttcgtgtgcgtgcttcttagtcatggggaagagggtatcatattcggaaccaatgggccggtggatctcaaaaaaatcaccaacttcttccgaggcgacaggtgtcgcagtcttactgggaagcctaaactttttatcattcaggcgtgcaggggcacagaactcgactgtggcattgaaactgat

SEQ ID NO: 249719 - DNA, 855 bp, Artificial Sequence
  Description of Artificial Sequence: Synthetic coding sequence
atgatcgagacagactctggggtcgatgatgatatggcttgtcacaaaattcctgtagaagccgacttcctttatgcttatagtaccgcccctggctattatagttggcgcaacagcaaagacggcagctggtttatccagtcactgtgcgccatgctgaagcagtatgctgataaacttgaatttatgcacattcttactagggttaatagaaaggtagcaacggaattcgagtcattttccttcgatgctacattccatgccaagaagcagattccgtgtattgtctctatgctgaccaaggaactgtatttctatcatggatcccctatggaaaacacagagaacagcgtagcttccaagagtatcaaaaacctggaaccaaagatcatccacggcagcgagagcatggcctccggcatttcactggacaatagctacaaaatggactacccagagatgggactctgtataatcatcaacaacaagaacttccataagagcacaggcatgacttctagatccggaacagacgtggatgccgctaacctgcgcgaaacctttagaaacctgaaatacgaagtgaggaacaagaacgatctcacccgcgaggagattgtggagctgatgcgggacgttagtaaagaagaccatagcaaacgatcctccttcgtttgcgtcctgctcagtcacggcgaagagggcatcattttcgggacaaacggcccagtggatttgaagaagattaccaatttctttcggggggataggtgtagatcccttaccggtaagcccaaactgtttataatccaggcctgtcgcggcactgagctggactgcggtattgaaacagat

SEQ ID NO: 249720 - DNA, 855 bp, Artificial Sequence
  Description of Artificial Sequence: Synthetic coding sequence
atgatcgaaaccgactccggtgtggacgacgatatggcctgtcataagatacctgtggaagcagactttctttacgcgtactcgactgcacccgggtactactcgtggcgaaattcaaaggacgggtcatggtttattcaaagcctgtgtgccatgcttaagcaatacgctgataaactggagtttatgcatattctgacgcgagtgaacaggaaggtggccactgagtttgaatccttttcgttcgatgctacttttcatgcgaaaaagcaaattccatgtatcgtctctatgcttaccaaagaactgtacttctaccatggatccccaatggagaacactgaaaattcggtggcatcgaagtccatcaaaaaccttgagcctaagataattcatggttccgagtccatggcatcgggtatctcactggataattcatacaagatggattaccccgaaatgggtctgtgcatcataatcaacaacaagaatttccacaagtcaactggaatgacttcacgatccggaaccgacgtggacgccgcaaaccttagagagacttttagaaacttgaagtatgaagtcagaaataagaatgatcttacccgggaagagatagtcgagctgatgagggacgtctcaaaggaggaccactccaagcgcagttccttcgtgtgtgttcttttgtcccacggagaagaaggtatcatttttggaactaacggacccgtggatctcaagaagataactaacttcttccggggtgatcggtgtcgttcacttaccggaaagcctaagctgttcatcattcaggcctgtcgtggaaccgagctggactgtggcattgagactgac

SEQ ID NO: 249721 - DNA, 855 bp, Artificial Sequence
  Description of Artificial Sequence: Synthetic coding sequence
atgatcgagactgattcgggggtcgatgacgacatggcttgccacaagatccctgtggaagcagactttctctacgcgtactccaccgcgcctggatactactcatggcggaacagcaaggacgggtcgtggttcattcaatccctttgtgcgatgcttaaacaatacgcagacaaacttgagtttatgcatatcctgacccgagtgaatagaaaggtggccactgaatttgaatccttctcctttgatgccacgttccacgcaaagaagcagattccatgtattgtctcaatgctgaccaaggaactttacttttaccatgggtcgcccatggagaacactgagaactctgtcgcctcaaagtcgatcaagaaccttgagccaaagattattcacggaagcgagagcatggcttcaggaatatctctcgataattcctataagatggattaccctgagatgggcctttgcatcatcattaacaacaagaattttcacaagtcaactggtatgacttcgagatccggtaccgatgtcgatgcagcaaacctgagggaaacgtttaggaatctgaagtacgaagtccgcaataagaatgacctgacgcgagaggaaattgtggaactcatgagagacgtgtcgaaggaagatcattcaaagagatcctcgtttgtgtgcgttctcttgtctcacggagaagaaggaattatcttcgggactaatggtcccgtggatctgaagaagattaccaatttcttccggggggatcgctgtagaagccttaccggaaagcccaaactgtttatcatacaggcttgtcgcggcaccgaactggattgtggtatcgagacggat

SEQ ID NO: 249722 - DNA, 855 bp, Artificial Sequence
  Description of Artificial Sequence: Synthetic coding sequence
atgattgaaactgactcaggtgtcgatgatgacatggcctgtcataaaatcccggtggaggccgatttcctctacgcctactctacggccccaggctactactcgtggcgaaatagcaaagatggaagttggttcattcaaagtttatgtgccatgctcaaacagtatgctgataaactagagttcatgcatatcctgacaagggtcaatcggaaagtggctacagaattcgagtcgttcagctttgatgccactttccacgccaaaaaacagattccatgtatcgtgtcgatgttaaccaaggaactgtatttttatcatggttcaccgatggagaatactgaaaatagcgttgctagcaagagcattaagaacctcgagccaaagattatccacggctccgaatcgatggccagcgggatctcactggacaacagctataaaatggattaccctgagatgggactgtgcatcataatcaacaataaaaatttccataagagcaccggcatgaccagccgctctggaaccgatgtggacgcggccaacctgagagagaccttcaggaatctgaaatatgaggtcagaaacaagaatgatctgacaagagaggaaatcgtggaacttatgagggatgtgtctaaggaggaccacagcaagagatcttcattcgtgtgtgtgctgctgtcccacggagaggaggggatcatattcggcaccaacggaccggtagacttaaaaaagattacgaatttctttagaggagatcgatgtaggtcccttaccgggaagccgaagctcttcattatccaggcctgccgcgggacggaactggattgcggtatcgaaactgat

SEQ ID NO: 249723 - DNA, 855 bp, Artificial Sequence
  Description of Artificial Sequence: Synthetic coding sequence
atgatagagaccgactcaggagtcgatgacgacatggcctgtcacaaaattccggtcgaggctgactttctctacgcttactctactgcaccaggatactattcttggcggaattcgaaggatggcagctggtttatacaatctctgtgcgcaatgttgaaacagtacgctgacaaacttgagtttatgcatatcctaacacgggtcaacaggaaagtggccactgagttcgaaagttttagtttcgatgccacattccatgccaagaagcagattccttgcatcgtgagcatgctcacaaaggagctgtacttttatcacggaagccctatggaaaataccgagaactcagttgcatcaaaatccattaaaaacttggagccgaagatcattcatgggtccgaatcaatggcaagtggtattagtttagacaattcatataagatggattatcccgaaatgggactctgtataataataaataacaagaactttcataaatccaccggtatgaccagtcgatctgggaccgacgttgacgccgcaaatctgcgggaaacatttcggaatctcaagtatgaggtgcgcaacaagaacgacctaactcgcgaagaaattgttgagctgatgcgggacgttagcaaggaggaccactctaagaggagctcatttgtttgtgttcttctgagtcacggcgaggagggcatcattttcggcaccaatggacctgtagacctgaaaaaaatcactaactttttccggggggatcgctgccgaagcctaactgggaagcctaagctgtttataatccaggcgtgtcgcggtaccgagcttgactgtggcatcgagactgat

SEQ ID NO: 249724 - DNA, 855 bp, Artificial Sequence
  Description of Artificial Sequence: Synthetic coding sequence
atgatcgaaaccgatagcggagtggacgacgacatggcatgtcataagatccctgtggaagctgactttctgtatgcgtactccaccgcaccaggttattatagctggcgcaattctaaagatggctcctggttcatccagagcctgtgtgctatgctgaaacagtacgctgataagctggaatttatgcatattttgacacgagtgaatagaaaggtggcgactgaatttgaatccttctcttttgacgcaaccttccacgccaaaaaacaaatcccctgcatcgtgtcaatgttgacaaaagagctgtatttctaccacggcagccctatggaaaacactgaaaatagtgttgcttctaagtccattaaaaaccttgagcctaagattattcacgggtctgagtcaatggcatccgggattagtctggataactcctacaagatggattatcccgagatggggctctgtattatcattaacaataagaatttccacaaatctaccgggatgacatcaagaagtggaaccgacgtggatgctgcaaacttgcgtgaaacctttcgcaacttgaagtacgaggtgcgcaacaaaaacgacctaactagagaggagatcgtcgagttaatgcgggatgtgagcaaggaagatcattcaaagcgcagttccttcgtgtgcgtgctccttagccatggagaagagggaatcattttcggtaccaatggaccagtggacttgaaaaagataacaaacttctttcgtggcgaccgttgcagatctttgacgggaaagcccaagctgtttattatccaagcttgtcgcggaacagagcttgactgcggcattgagaccgat

SEQ ID NO: 249725 - DNA, 855 bp, Artificial Sequence
  Description of Artificial Sequence: Synthetic coding sequence
atgattgagactgatagcggagttgacgatgacatggcctgtcataagattccggtcgaggcggacttcctgtacgcttactcaactgcacccggctattattcttggcgcaattcgaaagatgggtcatggttcattcagagtctatgtgctatgcttaagcagtatgcagacaaactggaatttatgcacattttgaccagagtaaatcgcaaggtggccactgaattcgaatcgttcagtttcgatgcgacctttcacgcaaagaaacagattccctgcatcgtgagcatgttgaccaaggagctctacttttatcatggcagtcccatggaaaacaccgagaattcagtcgcctcaaagtctattaaaaaccttgaacctaaaattatacatgggtccgagagtatggcaagtgggattagtttagataattcgtacaaaatggattacccagaaatgggcctgtgcatcatcattaataataagaacttccacaagtccaccggtatgacctctcgatccggaacggacgtggatgctgctaatctgcgcgagacctttcggaacctgaaatacgaagttcggaataagaatgacctgacgcgagaggaaatcgtggaactcatgagggatgtaagtaaagaagaccatagtaagcggagttcttttgtgtgtgtgctgctgtctcatggcgaggagggaattattttcggaacaaacggcccagtagatctcaaaaagatcaccaatttctttcgcggagataggtgccggtctctgaccgggaagccaaagttattcatcattcaggcgtgcaggggtaccgaactcgattgcggcatcgagactgat

SEQ ID NO: 249726 - DNA, 855 bp, Artificial Sequence
  Description of Artificial Sequence: Synthetic coding sequence
atgattgaaaccgactcaggagtggacgatgacatggcctgtcacaaaatccccgtcgaggcagactttctgtatgcatactcaaccgccccgggctactatagctggaggaatagcaaagacggtagctggtttattcagagcctttgcgccatgttgaaacagtacgctgacaaactggaattcatgcacatccttacaagggtgaaccggaaggtggctacagaatttgagtctttttcattcgacgctacattccacgccaaaaaacagatcccttgcattgtaagcatgttgacgaaggagctatacttttaccacggtagtcccatggagaacaccgagaatagtgttgcatccaagtccattaagaatcttgagcctaagattattcatggctctgagagtatggccagcggcataagcctggataatagctataagatggattatccggagatggggctgtgcatcataatcaacaacaaaaattttcataaatctaccggaatgacctcacggtcagggaccgatgttgatgctgccaacctgcgagaaacatttagaaatctgaaatatgaggtacggaataaaaacgatctgacaagagaagaaattgtcgagctgatgcgagatgtttctaaggaagaccattcgaaaagatcatccttcgtgtgtgtgctcctttcccatggagaagagggcatcatatttggaaccaacggacccgtggacttgaagaagatcactaattttttccgtggtgataggtgcagatccctgaccgggaagccaaaactgtttataattcaggcttgccgggggacagaacttgattgcggcattgaaacggat

SEQ ID NO: 249727 - DNA, 855 bp, Artificial Sequence
  Description of Artificial Sequence: Synthetic coding sequence
atgatcgaaacagattcgggtgtggatgatgacatggcctgtcataagattcctgttgaagcagactttctctatgcttactccacagcccccgggtactattcctggcggaacagcaaagacggcagttggttcatccaatctctgtgtgccatgctaaagcagtacgccgacaaattagagtttatgcacatactgacccgggttaatcggaaggtggccacagagttcgaaagcttcagttttgatgccaccttccacgccaaaaaacagattccatgcatcgtctcaatgctaacaaaggagctgtacttctatcacgggagccctatggagaatacagaaaattctgtggcaagtaaaagtattaaaaatctggaacccaagattatacatggatccgaaagcatggcatccggaatcagcttagataattcttataagatggactacccagaaatggggctctgcattataattaataacaaaaattttcacaaatcaacagggatgaccagtaggtctggcaccgatgtcgatgccgctaatctcagagaaaccttcaggaacttgaagtatgaggtgcgcaataaaaatgatctaaccagagaggagattgtggagcttatgagagatgtgagcaaggaggatcatagcaaaagatcctcatttgtctgcgtcttactgtcccacggagaagaaggcatcatttttggaaccaacggtcctgtagacctcaaaaagataaccaacttctttaggggcgataggtgccgatccctcacggggaagcccaaactttttattattcaagcctgcaggggcacagagctcgactgcgggattgagactgac

SEQ ID NO: 249728 - DNA, 855 bp, Artificial Sequence
  Description of Artificial Sequence: Synthetic coding sequence
atgatcgagactgactcgggggtggatgacgacatggcttgccacaagatcccagtggaagccgatttcctgtacgcctactccacggccccgggatactattcctggcgcaactccaaggacggaagctggtttatccagtctctctgtgcgatgctgaagcaatacgccgataaacttgagttcatgcatattctgacccgcgtcaatcgaaaagtggcaaccgaattcgagagcttttccttcgacgcgacgttccacgcgaaaaagcagatcccgtgcattgtgagcatgcttacgaaggaactgtacttttaccatggcagcccaatggagaatactgagaactccgtggcatcgaagtcgatcaagaatctggaaccgaagatcatccacggatcagagtctatggccagcggtatctcgttggataactcatacaaaatggattaccctgaaatgggtttgtgtatcatcatcaacaacaagaacttccataaatcgactggtatgacgtcccggtcagggactgatgtggacgcggccaatctgagggaaaccttccggaacctgaagtacgaagtgcgcaataagaacgatttgactcgggaagaaattgtcgagctgatgagggacgtctccaaagaggaccattctaaacgcagctcgttcgtgtgcgtgctcctgagtcatggagaagaaggcatcatttttggaaccaacggcccagtggatctgaagaagattaccaacttcttccgcggtgaccgctgccggagtctgactggaaagcccaagttgtttatcatccaggcttgtaggggtaccgaactggattgcggcattgagactgat

SEQ ID NO: 249729 - DNA, 855 bp, Artificial Sequence
  Description of Artificial Sequence: Synthetic coding sequence
atgattgaaactgattcaggggtggacgatgatatggcgtgtcataagatccccgtggaggctgattttctctatgcctactcaaccgccccggggtactatagctggcgcaattctaaagatggatcctggttcatccagtccctgtgcgccatgctgaaacagtacgcggataagctagagtttatgcacatcctcaccagggtaaacaggaaggtggccaccgaattcgagagcttctcgttcgatgccaccttccacgcaaaaaaacagatcccatgtatcgtgagcatgctgacaaaagagctgtatttttatcatggcagtccaatggagaacaccgaaaattcagttgcgagcaagtccatcaaaaatctagagccgaagatcattcatggcagcgaaagcatggcaagtggaatcagcctggacaattcttataagatggattaccctgagatggggctatgcatcatcataaataacaagaattttcataagagtacgggtatgaccagtcgatccggcacagacgtcgacgcggcaaatttacgagaaacatttaggaatctaaaatatgaggtccggaataagaacgatttgaccagggaggaaatcgtagagctgatgcgggacgtgagtaaagaagaccactccaagagatcctccttcgtgtgcgtgctcctgagccatggtgaggaaggcattattttcgggactaacggtcccgtagatttgaagaagatcaccaacttcttcaggggagatagatgtagatcgctgaccggaaagcccaaactgtttatcattcaggcctgtcgagggacggagctggactgtgggattgagacagat

SEQ ID NO: 249730 - DNA, 855 bp, Artificial Sequence
  Description of Artificial Sequence: Synthetic coding sequence
atgatcgagaccgactcaggtgtggacgacgatatggcttgccacaaaatccccgtggaggcagattttctgtacgcctacagtacagcacctggttattactcttggaggaatagtaaggatggcagttggtttatacagtccctttgcgccatgttgaaacagtacgctgacaaactggaattcatgcacatcctcactcgagtcaatcgaaaggttgccaccgaatttgagtccttctctttcgacgccacgttccacgctaagaaacagatcccgtgcattgtgtctatgttaaccaaagagctttacttttatcatggctcccctatggagaacacagagaatagcgtggcgtctaaatcaatcaagaatctcgagcccaaaattatccacgggagtgagagcatggcctccgggatttcacttgataatagctataagatggactaccctgaaatgggcctgtgcatcattatcaataacaagaacttccataaatctactgggatgaccagtcgctccgggaccgacgtcgacgcagcaaacctgagggaaacgtttagaaatcttaagtatgaggtacgaaataagaacgaccttactcgcgaggagatcgtggagctcatgagggacgtgagcaaggaggaccatagtaaaagaagttctttcgtatgcgtgcttctgtcccatggggaagaaggcattatctttgggacaaacggacccgtggatctcaaaaagataacaaacttcttcagaggagacaggtgccggagcctgacaggtaagccaaaattgttcatcattcaggcctgtcgggggaccgaacttgactgcggaattgaaaccgat

SEQ ID NO: 249731 - DNA, 855 bp, Artificial Sequence
  Description of Artificial Sequence: Synthetic coding sequence
atgatcgagaccgattctggcgttgacgatgatatggcttgccacaaaatcccagtggaggcggactttctgtacgcctattccactgcgccaggttactatagctggcgcaattccaaggatggatcatggtttatccagtccctgtgcgccatgctcaaacagtacgccgacaagctggagtttatgcacattttgaccagagtcaacaggaaagtggctaccgaatttgaaagcttttcctttgacgccaccttccacgccaaaaagcagatcccctgtatcgtctccatgctaaccaaagaactttatttttaccacggttctccaatggaaaacaccgagaattctgttgcctctaaatctattaagaaccttgaacccaaaatcatacatggctcggaaagcatggcatctgggatcagcctcgataattcctacaaaatggattaccccgaaatgggcttgtgtatcatcatcaataacaaaaatttccacaaaagcacagggatgacttctcggtcaggtactgacgtggacgctgccaatctccgcgagacgttcagaaacctcaagtacgaagtgaggaataagaatgacctgacaagggaagaaatagtggaactgatgcgggatgtgagcaaggaagatcattccaaacggtctagcttcgtttgcgtgctcttgtcacatggggaggaaggcattatctttggaaccaatgggccggtggacctgaagaaaattactaacttttttcgcggtgaccgatgtaggagcctcaccggcaagccaaaactcttcattattcaggcctgccggggcaccgagctggattgcgggatcgaaactgat

SEQ ID NO: 249732 - DNA, 855 bp, Artificial Sequence
  Description of Artificial Sequence: Synthetic coding sequence
atgatcgagaccgattcgggagtcgacgacgacatggcgtgccacaaaataccggtcgaagcagactttctgtacgcctactccactgcgccaggttactattcttggcgcaattccaaggacggttcttggtttattcagtccctgtgcgccatgctgaaacagtatgccgacaagctggagttcatgcatattctgacccgtgttaacagaaaggtcgcaactgagtttgagtcattttcctttgacgccaccttccacgcgaaaaagcagatcccctgtatcgtgtcaatgcttacgaaggaactgtacttctaccacgggtctccgatggaaaacactgagaactccgtggcgagcaaaagcattaagaatcttgaacccaaaattattcacggctctgaatccatggcgtcaggaatttcattggataattcttacaagatggactatcccgaaatgggcctgtgtattataatcaataataaaaacttccacaagagtacggggatgacttcaaggtcaggcacagacgtggacgcggctaacctgcgcgagacgtttagaaatcttaagtatgaggtgcgcaacaaaaatgacctgacgcgcgaggaaatcgtggagctgatgagagatgtgagtaaagaggatcatagcaagcgtagtagcttcgtgtgcgtcctgctgtctcatggcgaagagggaataatcttcgggacaaatgggcccgttgacctgaagaagataaccaattttttccggggggaccgttgccggagcttgaccggaaagccgaagctgtttatcatacaggcatgccgtggaactgaacttgattgtggaatcgagaccgac

SEQ ID NO: 249733 - DNA, 855 bp, Artificial Sequence
  Description of Artificial Sequence: Synthetic coding sequence
atgatcgaaaccgattccggagttgatgacgatatggcatgtcacaagattcccgtggaagcagactttctttacgcctactccactgcaccgggttactacagctggcgcaattcgaaagatggttcgtggtttatccaatcactgtgcgcaatgcttaaacaatacgccgataagctcgaattcatgcacatcctgaccagagtgaaccgaaaagtggcaaccgaattcgaatcgttttcctttgatgcaacttttcatgccaaaaagcaaatcccatgtatcgtgtccatgcttaccaaagaactgtacttctatcatggctctcctatggagaatacggaaaattcagtggcatccaaatccattaagaatcttgagccaaagattatacatgggtcagagagcatggcgtccggaataagcctggacaatagctacaaaatggactaccctgaaatgggactgtgcatcataatcaacaacaagaacttccataagtcaaccggtatgacgtcgaggtccgggaccgatgtcgacgcagcgaatctgagagagactttccgaaacctcaagtacgaagtcagaaacaaaaatgacctgactcgggaggagatagtggagctcatgagagacgtgtcaaaagaagatcactccaagagatcgtcattcgtctgcgtgttgttgtcgcatggtgaagaaggcatcatttttggtactaacgggccagtggaccttaagaagattacgaacttttttcgtggggaccgctgtcggtccctgactggtaaacccaaacttttcatcatccaggcgtgtagaggaaccgagctggattgtgggattgaaactgac

SEQ ID NO: 249734 - DNA, 855 bp, Artificial Sequence
  Description of Artificial Sequence: Synthetic coding sequence
atgattgagactgattctggcgtcgacgacgacatggcatgtcataaaattccggttgaagccgactttctgtatgcgtatagcacggcccccggctactattcctggcgaaacagtaaggacgggtcatggttcattcagtcactttgtgctatgcttaaacagtacgccgataaactggagtttatgcatatcctgacccgtgttaacagaaaggtggccaccgaatttgagagcttctcttttgacgccacctttcacgcaaaaaaacagataccatgcattgtgtcaatgctaacgaaagaactttacttttaccatggcagccctatggagaacactgagaattccgtggcttccaagagtattaagaacctggaacctaagatcatccatggttccgaatctatggcctcaggcatttcccttgataattcttataaaatggattaccccgagatgggcctgtgtataatcatcaacaataaaaactttcacaaatccaccggcatgacgagccgaagtggaacagatgtggacgcggccaacctccgtgaaaccttcagaaacttgaagtatgaagtaaggaataaaaatgatctcacaagggaggagattgtcgagcttatgagagacgtaagcaaggaggatcatagtaagaggtccagtttcgtgtgcgtgttgctatctcacggggaagaaggcatcatctttgggaccaacggtccggtggacctgaagaaaatcacgaattttttcagaggggataggtgcagatctctgactggaaaacctaaactgtttattattcaggcatgccgcggcaccgaactcgattgtggcatcgagaccgat

SEQ ID NO: 249735 - DNA, 855 bp, Artificial Sequence
  Description of Artificial Sequence: Synthetic coding sequence
atgatcgagactgatagcggggtggatgacgatatggcgtgccataagatccctgtggaagccgattttctgtacgcatactcgactgcacctggttactacagctggcgcaactcgaaggatgggtcatggtttatccaatcattgtgtgcaatgcttaagcagtacgccgacaagctcgaattcatgcatatcctcaccagggtgaacagaaaggtggcgaccgaattcgagagcttctcgttcgacgctacctttcatgcaaagaagcaaataccttgtattgtgagcatgctgaccaaggaactctacttttaccatggttcaccgatggagaacaccgaaaactccgtcgcatccaaaagcattaagaatttggaacccaagattatacatggcagcgaaagcatggcatccggtatttcccttgacaactcctataagatggactacccagagatgggtctgtgtatcatcattaacaacaagaacttccataagtcaaccgggatgacctcgcgttcagggactgatgtcgatgctgcaaaccttcgcgagacttttagaaaccttaagtacgaggtgagaaataagaatgatcttacccgggaagagattgtggaacttatgagagatgtgtctaaagaagatcactccaagcgtagcagctttgtgtgcgtgctgctgtcacatggagaggaaggaatcatttttggcactaacggccccgtcgatctcaagaagattaccaatttctttcgaggtgataggtgccgctccctgactgggaagcccaaactgtttatcattcaggcatgtagaggcactgaactggattgcggaattgaaactgat

SEQ ID NO: 249736 - DNA, 855 bp, Artificial Sequence
  Description of Artificial Sequence: Synthetic coding sequence
atgattgagaccgacagtggcgtcgacgatgacatggcctgccataagatacctgttgaagccgactttctctacgcctactccactgccccaggctattacagttggcggaatagtaaggacggttcttggtttatccagtccctctgcgctatgttaaaacaatatgctgacaaattagagtttatgcatatactgacacgggtgaatcggaaggtcgctaccgaattcgagtccttctcattcgacgccacttttcacgccaaaaagcagatcccttgcatcgttagcatgcttacgaaagagctctacttttatcatggcagtccaatggagaacactgaaaatagtgttgcaagtaaatccatcaagaatctggagcctaagatcatacacgggagcgagagcatggcgtccgggatatccctggacaactcctataagatggactacccagaaatgggactgtgtatcatcatcaataataaaaacttccacaaaagcactggaatgacctcacggtctggcaccgacgttgacgccgcaaacctgagggagacctttcgaaaccttaaatatgaggttcgaaacaaaaacgatttaacccgggaagaaattgtggagctgatgcgggacgtgagtaaagaagatcacagtaaaaggagcagctttgtttgcgtgctgctctcgcacggcgaggaaggaatcatctttggtacaaacggacctgtggacctcaagaagataactaatttctttagaggggacagatgccgcagcctgacaggcaaacctaagctctttatcatccaggcttgccgggggactgaactggattgtgggatagaaacagat

SEQ ID NO: 249737 - DNA, 855 bp, Artificial Sequence
  Description of Artificial Sequence: Synthetic coding sequence
atgatcgaaactgactcaggtgtggatgatgatatggcgtgtcacaagatcccagtagaggcggacttcctgtacgcctactccactgcacctggatactattcatggagaaatagcaaggacggctcatggtttatacagtcgttgtgcgcgatgctgaaacagtacgcagacaagctggagttcatgcatattctgacccgggtgaatcgcaaggtggcaactgaattcgaatcttttagcttcgacgccaccttccacgccaagaagcaaatcccttgcatagtgtcaatgctgaccaaagaactgtacttttaccacggctcgccgatggagaacacggaaaattcagtcgcctcgaaatccattaagaatttggaacctaagatcattcatggttccgaaagcatggccagcgggatcagcctcgacaattcctacaagatggattacccggaaatgggactgtgcatcattatcaacaataagaacttccacaagtcgactggaatgacctcacggtccggcaccgacgttgacgctgctaacctccgggaaactttccggaacctcaagtacgaggtgcggaacaaaaacgacctgacccgagaagagattgtggagctcatgagagatgtctcgaaagaagatcattcgaagaggtcgtcatttgtgtgtgtccttttgtcccatggtgaagagggtatcatcttcggaacgaacggcccggtggatctcaagaagatcactaatttctttcgcggagatcgctgcaggagcctgaccggaaaaccgaagctcttcataatccaagcatgccgcggaaccgagcttgactgcgggatcgaaacggac

SEQ ID NO: 249738 - DNA, 855 bp, Artificial Sequence
  Description of Artificial Sequence: Synthetic coding sequence
atgatcgaaaccgactccggagtagacgacgatatggcctgccacaagataccggtcgaagcggattttctgtacgcctactcgactgcacccggttattacagctggcgcaacagtaaggacggctcctggttcatccagtctctttgcgccatgttgaaacaatacgctgacaagctggaattcatgcacatcctgaccagagtgaaccggaaggttgcgaccgagttcgaatcgttctcatttgacgccaccttccacgcgaaaaagcaaattccttgtatcgtgagtatgcttacgaaggaattgtatttctaccacggatccccaatggaaaataccgagaattcagtggcctcgaaatcaatcaaaaacctcgagccgaaaatcatccatggatccgagagtatggcaagcggaatctcgctcgacaactcgtacaaaatggattacccggagatggggctctgcatcattatcaacaataagaactttcataagtccaccgggatgacttcgcggagcgggactgatgtcgacgcagctaacctgcgtgaaaccttcagaaacctgaaatacgaggtgagaaacaagaacgacctcactcgcgaagagatcgtggagcttatgcgcgatgtgtccaaggaagatcactcaaagagatcctccttcgtgtgtgtgcttctcagccatggtgaagagggaattatcttcggaacgaatggaccggtcgacctgaaaaagatcactaatttctttcgcggcgatcggtgccggtcactcaccggtaagccaaagctgttcatcatccaggcgtgccgcggaactgaactggattgtggtatcgagactgac

SEQ ID NO: 249739 - DNA, 855 bp, Artificial Sequence
  Description of Artificial Sequence: Synthetic coding sequence
atgatcgaaaccgacagcggggtggacgacgatatggcctgccacaagatccctgtggaggctgacttcctctacgcttattcaactgctcctggttattatagctggcggaactctaaggatggctcctggtttattcagtccctctgcgctatgctaaaacaatacgccgataagttggagttcatgcacatcctcacaagagtgaatcgtaaggtggctaccgaattcgagtctttctcgtttgacgccacatttcatgccaaaaagcagatcccatgtatagtatccatgttgaccaaggaattatacttttaccacggctctcctatggagaatacagagaatagtgtggcctccaaaagcatcaaaaatctggagccgaaaataattcatggcagtgagagcatggcttcaggtatttccctggataactcttataagatggattatcctgagatgggattatgcattattattaataacaaaaattttcataagtcaaccgggatgaccagcaggagcggcacagacgtcgatgcagctaacctgagagagacctttcggaacttgaagtatgaggtgaggaacaagaacgaccttacaagggaagagattgtcgaactaatgagggatgttagcaaggaggaccattctaaacggagttcttttgtgtgtgtcctgttgtcgcacggtgaagagggcataatcttcggaaccaacgggcccgtggacctgaagaagatcactaacttttttagaggcgacagatgcagaagcttgacaggaaagccaaaactgtttatcatccaagcttgtaggggcaccgagctggactgcggcattgagacggac

SEQ ID NO: 249740 - DNA, 855 bp, Artificial Sequence
  Description of Artificial Sequence: Synthetic coding sequence
atgattgaaacagattcaggggttgacgatgatatggcttgtcataaaatccccgttgaggcagatttcctttatgcttactctacagctcctggttactattcctggagaaacagtaaagatgggagttggtttatccagtcattatgcgccatgcttaaacagtacgccgataagttggagtttatgcacatattaaccagagtcaatcgtaaagtagccacagaattcgaaagcttctcgttcgacgccacctttcatgccaagaaacagattccatgtattgtgtctatgcttaccaaagaactatatttttatcacggctcgcctatggaaaatacagaaaacagcgtcgcatctaaatcaattaagaatcttgagccaaagattatacatgggtcagagtcaatggcttccggtatcagtctggacaattcctataaaatggattatcctgaaatggggctctgtatcatcatcaacaataagaactttcataagtctacaggtatgacgagtaggtcagggaccgatgttgatgctgcaaacctcagggaaacttttaggaatcttaagtatgaagtccgcaacaagaacgaccttactcgcgaagaaattgttgaactaatgagagacgttagcaaggaggatcattccaagcgtagtagcttcgtttgtgttctcttgagccatggtgaagaaggcattattttcggtaccaacggtccagttgatttgaagaagattaccaattttttcagaggcgacaggtgccgctcccttactggcaagcccaagttattcatcattcaggcttgcagaggcacagaattagattgcggtatcgagactgat

SEQ ID NO: 249741 - DNA, 855 bp, Artificial Sequence
  Description of Artificial Sequence: Synthetic coding sequence
atgatcgagaccgattctggagtcgacgatgacatggcctgtcacaaaatacctgtcgaagccgattttctgtacgcctattccacagcccccggttattacagctggcgaaattccaaggatggcagctggttcatccagtctctgtgcgcaatgctgaagcagtacgctgataaactggaatttatgcatattctgacccgcgttaaccggaaggtggcgacagaattcgagagcttttcttttgacgcgacctttcatgcaaaaaagcagatcccgtgcatcgttagcatgttgacaaaggagctatatttctaccacggcagcccaatggaaaataccgaaaatagtgtagcgtctaaaagcatcaaaaacctggaaccgaagattattcacggtagcgagagcatggcatcgggtatcagcctggacaatagctataagatggattacccagagatggggctgtgtattatcatcaacaataagaacttccataagtccaccggcatgaccagcagatcaggcaccgacgtcgacgcagcaaacctgagagagaccttcaggaacttaaaatatgaagtgcgcaataagaatgaccttacacgggaggagattgtggaattgatgcgcgacgttagcaaagaggatcacagcaaacgtagcagcttcgtgtgcgtattgctaagccatggggaagagggcatcatattcggtaccaacggtccagtcgacctcaaaaagataactaacttcttccgaggtgatcgctgtcgttctctgaccggtaaaccaaagttgtttataattcaagcgtgtcgtggcaccgagctggattgtggcattgaaactgac

SEQ ID NO: 249742 - DNA, 855 bp, Artificial Sequence
  Description of Artificial Sequence: Synthetic coding sequence
atgattgaaactgactcaggagtggatgatgacatggcctgccataagatcccagtcgaggcagactttctgtacgcctactccactgcgcccggatactacagttggcgcaattcgaaggacggctcctggttcattcagagcctctgcgcaatgttgaagcaatacgcagacaaactggagttcatgcacattctgactcgggtgaatcgcaaggtggctactgaattcgagtcgttctccttcgatgcaacctttcatgccaagaagcagatcccgtgcatcgtgtccatgctcaccaaggagctgtacttctaccatgggagcccgatggagaacactgaaaactctgtcgcctccaagtcaatcaagaatcttgagcccaaaatcattcacggttcagagtctatggcctcaggaatctcactggacaactcttacaaaatggattacccggaaatggggttgtgcatcatcatcaataacaaaaacttccacaagtcgaccgggatgacctccagaagcggaactgacgtggatgccgcgaatcttcgcgaaacctttagaaacttgaagtacgaagtgaggaacaaaaacgatctgacccgggaagaaattgtggaactgatgcgcgatgtgagcaaagaggatcattcaaagagatcctcctttgtgtgtgtgctgctgtcccatggagaggaaggaatcatcttcggaaccaacggtccggtggatctgaagaagatcacgaactttttccgcggagatcgctgtcgctcgcttacgggaaagccgaagctctttatcattcaagcatgcagggggactgaattggattgcggcatcgaaactgac

SEQ ID NO: 249743 - DNA, 855 bp, Artificial Sequence; identical to SEQ ID NO: 249734
  Description of Artificial Sequence: Synthetic coding sequence

SEQ ID NO: 249744 - DNA, 855 bp, Artificial Sequence
  Description of Artificial Sequence: Synthetic coding sequence
atgatcgagacggatagcggggttgatgacgatatggcctgtcacaagatcccggtcgaggcggatttcttgtacgcctactccaccgcgcccggatactacagctggcgtaattcgaaagatggttcctggttcattcagtcgctatgcgcaatgctgaagcagtatgccgacaagcttgagttcatgcacatcctgactcgcgtcaaccggaaagttgcaacggaattcgagtcgttcagcttcgacgcaacattccatgccaagaagcagataccctgcatcgtcagcatgcttaccaaggagctttatttctatcacgggtcgccgatggaaaatactgaaaacagcgttgcttcgaagagcatcaaaaatctggagccgaagattatccacggttccgagtccatggccagcggaatctccttggataacagctacaagatggattatcctgaaatgggcctctgcatcatcatcaacaacaagaactttcataagtcaaccggaatgacctctcgctcaggcacggacgttgacgcagctaacttgcgagagacattccgcaacctgaagtatgaagttcggaacaagaatgaccttacccgcgaagagatcgtcgagctaatgcgtgacgtgagcaaggaggatcactcaaagaggtcctcgttcgtgtgcgtactgctatctcacggagaggagggcattatattcgggaccaacggtccagtggacttgaaaaagattaccaactttttccgtggagaccgctgtcgctctcttactggaaagcctaagctgtttatcatccaggcctgcagaggtaccgagctcgactgtggcattgaaacagac

SEQ ID NO: 249745 - DNA, 855 bp, Artificial Sequence
  Description of Artificial Sequence: Synthetic coding sequence
atgattgaaactgattccggagttgatgatgacatggcatgtcacaagatccctgtggaggcagatttcctgtacgcatacagcaccgcgccgggctactactcatggcgcaatagcaaggatggtagctggtttattcagagcctctgtgcaatgcttaagcagtacgcagacaagctggaattcatgcatattctgacccgggtgaaccgcaaagtcgcaactgaatttgagtcgtttagctttgacgcgaccttccatgcaaagaagcaaattccttgcattgtgtccatgctgactaaggaattgtacttctaccacggctcccctatggaaaataccgaaaattccgttgcctcgaagtccattaagaaccttgaacctaagatcattcatggatcggaatcaatggcatcgggtatttcgctcgacaattcgtacaagatggactacccagaaatgggtctttgtatcattatcaacaacaagaatttccacaagtcgactgggatgacctcccgttcaggtaccgatgtcgacgcagcgaacctgcgcgaaacctttagaaacctgaaatatgaagtgcgcaacaagaatgaccttacccgcgaggaaattgtggagttgatgcgagatgtgtccaaggaagatcattcaaagcggtcgtcgtttgtgtgtgttcttctgtctcatggagaggaaggcatcatattcggcaccaacgggccagtcgatctgaagaagattaccaactttttcagaggcgatagatgtaggtcgctgactggaaagcccaaacttttcatcatccaggcatgcaggggaactgagctcgattgtggaattgaaaccgac

SEQ ID NO: 249746 - DNA, 855 bp, Artificial Sequence
  Description of Artificial Sequence: Synthetic coding sequence
atgatcgagaccgacagtggagtcgatgacgacatggcttgccacaagataccagtggaggccgattttctatatgcctattccaccgcaccgggctattacagctggagaaatagcaaggatggtagctggttcatccagtcattgtgcgcgatgcttaagcagtatgccgataagctggaatttatgcacattctcacccgtgtgaaccgcaaggttgcgacggagtttgaaagtttcagtttcgatgcaacctttcatgctaagaaacagatcccatgtattgtaagtatgttgacgaaggaactgtatttctaccatggaagccccatggaaaatacagagaacagcgtggcctccaagtcaattaagaatttggagccaaagattatccatggcagcgagagcatggctagcggcattagcctggacaattcctacaagatggactaccccgagatgggcctgtgtatcatcattaacaataagaattttcataagtcaaccggtatgacatccaggagcggtactgatgtcgatgccgcaaacctgcgtgagacattcaggaacctcaagtacgaggtgcgcaataaaaacgacctcaccagggaagaaatagtcgagcttatgcgtgatgtgtccaaggaggaccattccaaacggagcagctttgtctgcgtcttgttgagtcatggagaggagggtatcatttttggaacaaatggcccagttgatctgaagaagattaccaatttctttcgaggcgatcgttgtagatcgttgaccggaaagcccaagttgtttatcatccaggcttgtcgcggcactgagctcgactgcggaatagagaccgac

SEQ ID NO: 249747 - DNA, 855 bp, Artificial Sequence
  Description of Artificial Sequence: Synthetic coding sequence
atgattgagactgattcgggagtggatgacgacatggcatgccacaaaatccccgttgaagcagattttctttacgcttactcaaccgcacccggttactactcgtggcgtaacagcaaggatggatcgtggtttattcagagcctgtgcgcaatgcttaaacagtatgccgacaagctcgagttcatgcacatcttgactcgggtgaacagaaaggtcgctaccgaatttgagtcgtttagcttcgacgcgacctttcatgcaaagaagcaaatcccttgtatcgtgtcaatgcttaccaaggaactttacttctaccatgggtcacctatggaaaatactgaaaattccgtcgcgtccaaatcgattaagaacctggaaccaaagatcattcatggcagcgagtcaatggcgtcaggaatttccctggataattcgtataagatggattaccctgagatgggactgtgtatcatcattaacaataagaattttcacaagagcactggcatgacgtccagatccggaaccgacgtggatgcagcaaacctccgcgaaacctttcgcaatctgaaatacgaggtccgcaataagaacgacctgactagagaagaaattgtggaactgatgagagacgtctccaaagaagatcatagcaaacgctcctcgtttgtgtgtgtcctgcttagccatggtgaagaaggtatcatttttggaactaacggacccgtggatttgaagaagattaccaacttttttcgaggagatcgttgccgtagccttactggaaagccgaaactgttcataattcaagcctgtaggggtaccgaactggattgtggtatcgaaaccgat

SEQ ID NO: 249748 - DNA, 855 bp, Artificial Sequence
  Description of Artificial Sequence: Synthetic coding sequence
atgattgaaacggattctggcgttgacgatgatatggcctgccataaaataccagtggaggcggatttcctttacgcctacagcaccgcccccgggtattactcctggcgcaactccaaggacggctcttggtttattcagtctctctgcgccatgctcaagcagtatgccgacaaacttgagttcatgcacatcctgacgagagtgaataggaaagttgcaactgagttcgagtctttctcgtttgacgcgacatttcacgcaaagaaacagatcccttgcatcgtttctatgctgacgaaggaactctacttctaccacgggtctcctatggaaaacaccgagaatagcgtggcgtccaagtccattaagaatctggagcctaaaatcatccacggaagcgaatctatggcgagcggcatctccctcgacaatagctacaagatggattatccagaaatgggtttgtgcattattattaataacaaaaacttccacaagtcgacgggtatgactagccgctccggaaccgatgtggacgctgccaacctacgggagactttccgcaaccttaagtatgaggtccgtaataagaatgatctgactagggaggagatcgtagagctgatgcgggacgtgtccaaggaagaccactcaaaacggagtagcttcgtgtgcgtgctcctcagccacggtgaggaggggatcatcttcgggacaaatggccccgtggacctgaagaagattacaaatttttttcgcggcgataggtgcagaagcctcaccggtaaacccaagctattcattatacaggcctgcaggggcaccgagctggactgtggtatcgagaccgac

SEQ ID NO: 249749 - DNA, 855 bp, Artificial Sequence
  Description of Artificial Sequence: Synthetic coding sequence
atgatcgaaactgattctggagttgatgatgacatggcttgccacaaaatacctgtggaagctgattttttatacgcttatagtacagcgccaggatactattcatggcgcaattccaaagatgggtcttggttcatccagtcactttgtgcaatgttaaaacagtatgccgataaactagaattcatgcacatactcactcgcgtgaataggaaggtggccactgaatttgaatctttctcttttgacgccacttttcacgctaaaaaacagataccctgtatagtgtccatgttaactaaagaactctatttctatcatggaagtcctatggagaacactgagaactcggtggcctcaaaatcgataaaaaacctagaacccaaaatcattcatgggtctgaatctatggcttctggaatcagtcttgataattcatacaaaatggactaccccgagatggggctctgcatcatcattaataataagaacttccacaagtctacagggatgacaagtcggtccgggactgatgtagacgcagcaaacctgagagaaacttttaggaatctgaagtatgaagtccgcaataaaaatgaccttactcgggaagaaattgttgagctcatgcgcgatgtgtcgaaggaagaccacagtaagaggtcttctttcgtgtgcgtcctcctctcccacggagaggaaggaattatcttcggaactaatgggcctgtggatctgaaaaaaattacaaatttctttaggggggatcgctgccgatccctgactgggaaaccaaagctgttcattatccaggcttgccgcggaacagaactggattgtggaattgaaactgat

SEQ ID NO: 249750 - DNA, 855 bp, Artificial Sequence
  Description of Artificial Sequence: Synthetic coding sequence
atgattgagactgacagcggagttgacgatgatatggcatgccacaagattcctgtggaagcagatttcctgtacgcatattctactgcaccgggctactacagctggagaaacagtaaagatggatcttggttcatccaaagcctgtgtgccatgctgaagcagtacgccgacaaacttgagtttatgcatatacttactagagtcaatcggaaagtcgctaccgaattcgaatcattttcatttgatgcgaccttccacgccaagaaacaaatcccttgcatagtctcaatgctcactaaagaactgtacttctatcatggcagccccatggagaacaccgaaaattccgtggcatcaaagtcgataaagaatctggaaccaaagattatccacggatccgaatcgatggcaagtgggatttccttggataacagctacaagatggattatcctgagatgggcctttgtatcattatcaataacaagaacttccataagtccactggcatgacgtcacgttcgggaacggatgtggacgccgcgaatctcagagaaacgtttcgtaaccttaagtatgaggtgcgcaacaagaacgatctgactagagaagaaatcgtggaactgatgcgggacgtgagcaaggaggatcattccaagcgctcctcgtttgtgtgtgtacttctctcacatggcgaagaaggaattatctttggaacgaacgggccggtggacctgaaaaagattaccaactttttccggggggatcggtgtcggtcgcttactggaaagcctaaactgtttatcatccaggcgtgtcgaggtaccgagctggactgcggtattgaaactgac

SEQ ID NO: 249751 - DNA, 855 bp, Artificial Sequence
  Description of Artificial Sequence: Synthetic coding sequence
atgatcgaaaccgattcaggagtggatgatgacatggcctgccacaagatcccggtggaagcagacttcctgtatgcgtacagcactgcaccgggatactactcttggaggaactcgaaagatggatcatggttcatccagtcattgtgcgccatgcttaagcagtacgcggacaaactggaattcatgcatattctgacgagagtgaacagaaaggtggcgactgaatttgagtccttctcgttcgatgcgactttccacgccaagaaacagatcccctgtatcgttagtatgctcactaaggagctctacttctaccacggctcccctatggaaaacaccgagaactctgtggcgagcaagagtatcaagaatctcgaaccgaaaatcatccatggctcagagtccatggcttccggaataagcctggacaactcgtacaaaatggactaccccgagatgggtttgtgtatcatcattaacaacaagaacttccacaagtctactggaatgacttcccggtcgggcaccgatgtggatgcagccaacctgagagagactttccgcaatctgaaatacgaagtccgcaacaagaacgatcttacccgcgaggaaatcgtggaactgatgcgcgacgtgagcaaggaagatcactcgaagcgctcatcgttcgtgtgcgtcctgctgtcccatggagaagaaggaattatcttcggcaccaacgggccggtggatctgaaaaagattaccaactttttcagaggagatcgctgccggtccctgaccgggaaaccaaagctgttcatcatccaggcctgccgcggaaccgagctggactgcggaattgagactgac

SEQ ID NO: 249752 - DNA, 855 bp, Artificial Sequence
  Description of Artificial Sequence: Synthetic coding sequence
atgatagaaacagactcaggagttgatgacgatatggcttgtcacaagattccagtcgaggctgactttttgtatgcttacagcactgccccaggctattacagttggcgtaactccaaggacggatcttggttcatacagagtctgtgcgctatgctgaagcagtacgccgataaactggagttcatgcacatattaacacgcgttaataggaaggtagcaaccgagtttgagtccttctcatttgacgccacctttcacgccaagaagcagattccctgtattgtgtccatgctgactaaggagctttacttctatcacggaagccccatggagaacacagagaattccgtggcatccaagtctattaagaatttggaacccaagataatacacggtagcgaatcaatggcctccgggatctccctggataactcttacaagatggactatcctgagatgggcctgtgcataatcatcaataacaagaatttccacaaaagtaccggaatgacatctcgatcaggtaccgacgtagatgccgccaacctgcgggagacctttcggaacttaaaatacgaggtgcggaacaagaacgacttgaccagggaggagatcgtcgaactgatgagagacgtctccaaagaggatcattccaaacgcagtagctttgtgtgcgtgctgctgtcccatggagaggagggcataattttcggcactaacggcccggtcgacctgaaaaagataaccaatttcttccggggtgaccgctgtcgctcactgacagggaaacctaaactgttcattatccaagcctgccgaggcacagagctagattgcggaatagagacagac

SEQ ID NO: 249753 - DNA, 855 bp, Artificial Sequence
  Description of Artificial Sequence: Synthetic coding sequence
atgatagaaaccgacagcggagtcgacgacgacatggcctgccacaagattcctgtggaagccgacttcctgtacgcatattccacggccccgggatactactcatggcgcaactcaaaagacggatcgtggttcatccagtcgctctgcgcgatgctgaagcagtacgccgataagttggagtttatgcatatcctcactcgcgtgaacagaaaggtggcgaccgagtttgagtcattcagcttcgatgcaaccttccacgcaaagaagcagatcccctgcattgtctcgatgttgaccaaagaactgtacttctaccatggctcgccgatggaaaataccgaaaattcagtcgcatccaagagcatcaaaaatctggaacccaagatcatccacggatcagagtccatggcatcgggaatctccctggacaattcatacaagatggactacccggagatgggcctttgcatcatcatcaacaacaaaaactttcacaaatctactggcatgacttcgagatccggaaccgacgtcgacgccgctaacttgcgggaaactttccgcaatctcaagtacgaggtgcgtaacaagaacgacctgaccagagaggagatcgtggaactcatgagggatgtgtcgaaggaggatcattccaagcggtcctcgttcgtgtgcgtgctgctctcgcatggcgaggaaggcatcatcttcggcaccaacggtccggtggacctgaagaagatcactaacttcttcaggggggatcgctgccgctcccttaccggaaagccaaaactgttcatcattcaagcctgtcgcggaacggaacttgactgtgggatcgaaaccgac

SEQ ID NO: 249754 - DNA, 855 bp, Artificial Sequence
  Description of Artificial Sequence: Synthetic coding sequence
atgattgagaccgactctggggtggatgacgatatggcctgtcacaaaatccctgtcgaggccgatttcctgtacgcatactccacagctccgggctactatagctggcggaattcgaaagatgggagctggttcatacagagcctttgtgccatgctgaagcagtacgcggataagctggagttcatgcacatattgacacgggtgaatcgcaaagtggctactgaattcgaatccttctctttcgatgcaacgtttcatgcgaaaaagcagatcccctgtatcgtgtccatgttgacaaaggagctctatttctaccatgggtctccgatggagaacacagaaaactccgtcgcttcgaaaagcatcaaaaacctggaacccaaaatcatccacggttctgaaagtatggccagcgggatctccttggataactcatacaagatggattatcctgaaatgggcctctgtatcattatcaacaacaagaatttccataagagcacaggcatgaccagtcggtcaggaaccgacgtggacgccgccaacctgcgggagaccttcagaaacctgaaatacgaggtgcgcaataagaatgatctgaccagagaagaaatcgttgagctgatgcgagacgtgtctaaagaggatcacagcaagcggtccagctttgtgtgtgtcctactatctcatggcgaagaaggtatcatattcggaactaacggccccgtggacctcaaaaaaattaccaatttcttccgcggcgatcgttgccgatctctgaccggcaagccaaagctcttcataattcaggcctgcaggggcacagagctcgattgtggtatcgagacagat

SEQ ID NO: 249755 - DNA, 855 bp, Artificial Sequence
  Description of Artificial Sequence: Synthetic coding sequence
atgatcgaaacggacagcggggtggatgacgacatggcctgccacaaaattcccgtagaagccgattttctgtacgcatattcgactgcccctggctactactcctggcgaaattccaaagacgggtcttggtttatccagtcgttgtgtgccatgctgaagcaatatgccgataagctggagtttatgcatattctgaccagagtgaataggaaagtggctacagagtttgagagcttctccttcgatgcgacctttcatgcaaaaaaacagatcccctgtattgtctccatgctgacaaaggagctgtacttctaccatggctctcccatggaaaacaccgaaaacagcgtggccagcaagtcgattaagaaccttgagcccaaaatcatacacggatctgagagtatggctagcggcatatccctagacaattcctacaagatggactatcctgagatgggcctctgcattataattaacaataagaatttccataagagtactggtatgacctcacgctccggcaccgatgttgacgccgccaacctccgagaaacgttcaggaatctaaaatacgaggtgcgaaataagaatgacctgacaagggaggaaattgttgagcttatgcgcgatgtgagcaaggaggaccatagcaaacggagttcgtttgtgtgtgtgctgctcagtcacggagaggagggcatcattttcgggactaacggccctgttgacctcaaaaagatcactaacttttttcggggtgaccgttgtcggagcctgaccgggaagccaaagctctttataattcaggcatgtagaggtacggaactggactgtgggattgagaccgac

SEQ ID NO: 249756 - DNA, 855 bp, Artificial Sequence
  Description of Artificial Sequence: Synthetic coding sequence
atgatagaaaccgattcaggtgtcgatgatgatatggcgtgtcataagattccagtggaagccgatttcttgtacgcatactcgaccgcaccaggttactacagctggcggaacagcaaggatgggtcgtggtttattcaaagcctttgcgccatgctgaagcaatacgcagataagctggagtttatgcatattcttacccgcgtcaatagaaaggtcgcaaccgaatttgaatcgttttcattcgatgccaccttccacgcgaaaaagcagataccttgtattgttagcatgctgacgaaggaactttacttctaccatggttcgccaatggaaaacaccgaaaactcggtggcctccaaatctatcaaaaaccttgaacctaagattatccacggatcggaatcgatggcatcaggcatttcgcttgataactcttacaaaatggattaccctgaaatgggactctgtataatcattaacaataagaattttcataagtcaaccggaatgacttccaggtcaggtaccgatgtcgatgcagccaacctgcgggaaaccttcaggaatctgaagtacgaggttaggaacaagaatgacctcactagagaagaaatcgtggagctgatgcgggatgtgtcaaaggaggaccattcgaaaaggtcctccttcgtgtgtgtgttgctctcgcatggggaagaagggattatctttggtactaatggtcccgtggacctcaagaaaatcactaactttttccggggagatcgttgtcgcagccttaccgggaagccaaagctgttcatcatacaagcatgcagaggaaccgagttggactgcggaatagaaactgat

SEQ ID NO: 249757 - DNA, 855 bp, Artificial Sequence
  Description of Artificial Sequence: Synthetic coding sequence
atgatagaaaccgacagcggcgttgatgatgatatggcttgtcataagatcccagtggaagcggactttctgtacgcatattccaccgcccccggatactactcgtggcgtaatagcaaagatggaagctggtttatccagtcactttgtgccatgctcaagcaatacgcagataagctcgagttcatgcatattctcactcgtgtcaataggaaagtggcaactgaatttgagagcttctcctttgacgctacctttcatgccaagaaacagataccatgtatcgtctcgatgcttaccaaagagttgtacttttaccacggatctccgatggagaatacggaaaacagcgttgcctcaaaatccatcaagaatttggaaccgaagataattcatggttcagaatcgatggcttcgggaatctctctggacaactcctacaagatggattacccagaaatggggctttgcatcatcataaacaacaagaattttcataagagcaccggcatgacttcgcgctccggcactgatgtggatgcagccaacctgcgcgaaacctttagaaatcttaagtacgaggtgagaaacaaaaacgaccttactcgcgaagagatcgtggagcttatgcgtgacgtgtcaaaggaggatcactccaagcgctcgagcttcgtctgcgtgctgctctcgcacggtgaggaggggataatcttcggtactaacggcccagtcgatctgaagaagattactaacttctttcggggtgatagatgcaggtcgctgaccggtaagcctaaactgttcatcattcaagcgtgtcggggaacggaacttgattgtggcattgaaaccgac

SEQ ID NO: 249758 - DNA, 855 bp, Artificial Sequence
  Description of Artificial Sequence: Synthetic coding sequence
atgattgagactgactctggggtggatgacgatatggcctgtcataaaatcccagtggaagctgacttcctatatgcatatagtaccgctccggggtattacagttggagaaactcgaaggacggcagctggttcatccagtccctctgtgctatgcttaagcaatacgctgataagcttgaattcatgcacattttaactcgagtaaaccgcaaggttgccacagaatttgagagtttttcttttgacgcaacctttcatgctaagaagcagatcccatgcatcgtctccatgttgaccaaagaactatacttttatcatgggtccccgatggagaacacggaaaactctgttgcctcaaagtcaatcaagaatctagagccgaagatcatccacggctcagagtcgatggcttcagggatctcactggacaactcctataagatggattatcctgagatgggcctctgcattattataaacaataaaaactttcacaagtctacgggtatgactagtcgctctggaactgacgtcgatgccgccaacttgcgtgaaacctttaggaatttgaaatacgaagtgcgcaacaagaatgatctgactcgggaggagattgtcgagctcatgagggacgtttctaaggaagaccactccaagcgtagctcgttcgtctgcgttctcctctcacatggagaggagggtataatattcgggaccaacggccccgtcgatctgaaaaaaattaccaactttttccgaggcgatcggtgtcgttctctgaccggtaagcccaagctgtttataatccaagcatgccgcggcacggaactcgactgcggtatcgagacagat

SEQ ID NO: 249759 - DNA, 855 bp, Artificial Sequence
  Description of Artificial Sequence: Synthetic coding sequence
atgattgagactgactcaggagtggacgatgatatggcctgccacaagatccctgtggaggccgattttctctacgcttacagcaccgccccgggctactactcgtggcggaatagtaaggatgggtcttggttcatccagtcactgtgtgctatgttgaagcagtacgcagataagctggagttcatgcatatccttaccagagtgaatcgcaaggtcgccaccgaattcgaatccttttccttcgacgcgactttccacgcgaaaaagcagatcccttgcatcgtcagcatgcttaccaaggaactgtacttttaccacggatcaccaatggagaacacggaaaattccgtggcctcgaagtcgatcaagaacttggaaccgaaaatcattcatggatcagagtcgatggcaagcggaatctccctggacaactcgtacaaaatggactatccggagatggggctgtgtatcatcatcaacaacaagaacttccacaaatccaccggaatgacttccagaagcggaaccgacgtggatgccgcgaacctgcgcgaaaccttccggaacctgaaatacgaggtgaggaataagaatgacctcactcgcgaagaaatcgtggaactcatgcgggatgtttccaaggaggaccactcaaaaaggtcgagcttcgtctgcgtgctcctgtcgcatggtgaggaagggattatctttggcacgaacggtcccgtcgatctgaaaaagataaccaatttcttccgaggcgacagatgccgcagcctcactggaaagccaaagctcttcatcattcaagcatgccggggcactgaactggactgcggaatcgaaactgac

SEQ ID NO: 249760 - DNA, 855 bp, Artificial Sequence
  Description of Artificial Sequence: Synthetic coding sequence
atgatcgaaacagattctggagttgatgacgacatggcgtgccataaaattcccgtggaggcagattttctttatgcatattcaacagcgccgggttattattcttggcgtaatagcaaggatgggagttggtttattcaatctttgtgcgcaatgttaaaacaatatgcggataagcttgagttcatgcacattttaaccagagtgaatcgcaaagtggccaccgagtttgagtcattcagttttgacgccacctttcatgcgaagaaacaaattccatgcatagtgtcaatgctgacgaaggagttgtatttctatcatggctcacctatggaaaacacggagaacagtgtagcgtccaaatcaataaaaaacctagaacctaaaatcatacacggatctgagtccatggcctccggaatttcccttgataactcctataaaatggattatccggaaatggggttatgcatcatcattaataataagaattttcataagtcgacaggtatgacatcaagatctggtactgatgtcgatgcagccaatcttcgagagactttccggaacttaaaatatgaagttcggaataaaaacgatttgacacgggaggagatcgtcgagctgatgagggacgtaagcaaagaggatcatagtaaacgtagttcttttgtgtgcgtactgttaagccatggtgaagaaggaatcatcttcggcacgaatggaccggtcgatttgaaaaaaattacgaatttttttcgtggcgatcgttgcagatctcttacggggaagcctaaattgtttatcattcaggcatgcagaggcacggaattggattgtggtatagagaccgac

SEQ ID NO: 249761 - DNA, 855 bp, Artificial Sequence
  Description of Artificial Sequence: Synthetic coding sequence
atgatcgagactgactcaggagtggacgacgacatggcatgccacaaaattccggtcgaggccgactttctttatgcttattcgacggcccccgggtattactcgtggaggaactcaaaggatggatcttggttcatccagagcctgtgtgccatgcttaaacagtacgcagataagctggaattcatgcacatcctcaccagagtgaacagaaaagtggcgactgaattcgaatcattcagcttcgacgcaactttccatgccaaaaagcaaatcccatgtatcgtttccatgcttaccaaggaactgtacttctaccacggatccccaatggagaataccgagaactccgtcgcgtcaaagtcaatcaaaaacctggaacctaaaatcatccacggatccgaatcgatggcctcgggtatctcactggacaactcgtacaaaatggactacccggaaatgggactctgcatcattatcaacaataagaacttccacaaatccactggaatgacttcgcggtccggaactgacgtggatgcggccaaccttcgggagacgtttcgcaacctgaagtacgaggtgaggaataagaacgacctgacccgcgaagagattgtcgagcttatgagagacgtgagcaaagaggaccatagtaagaggtcgtcgtttgtgtgtgtgctcctgtcacacggtgaagaggggatcatcttcgggactaatggacctgtggacctcaagaaaatcaccaatttctttcgcggggatcgctgccgatcactgactggcaagccgaagctgttcatcatccaagcgtgccgcggtactgagctggactgcgggatcgaaaccgat

SEQ ID NO: 249762 - DNA, 855 bp, Artificial Sequence
  Description of Artificial Sequence: Synthetic coding sequence
atgatcgaaactgattctggtgttgacgacgacatggcttgtcataaaatcccagtggaggccgattttctctacgcttacagcactgcacctggatactactcatggagaaattccaaggatgggtcgtggttcattcaaagtctctgtgcgatgttgaaacagtatgcagataaattggaatttatgcatatactcactcgtgttaatagaaaggtagcaacggagttcgaatcattctcgtttgacgcaacttttcatgcaaagaagcagattccatgtatcgtcagtatgctcacgaaagaattgtatttctaccatggcagtccaatggagaacacagagaattcagttgcatccaagtctatcaagaatttggaaccaaaaattatccatggaagtgaatcaatggccagtggaatttctctcgataattcatataagatggattatccagagatgggactttgcatcatcatcaataataaaaatttccacaagtctactggaatgacctcccgctcagggacagatgttgatgcagcgaatttaagagaaacctttcgtaatttgaagtacgaagtgaggaataaaaatgatttgactcgagaagaaattgttgaactgatgagagacgtctcaaaagaagatcattcgaagaggtcatcttttgtttgtgtacttctttcacatggtgaagaaggaattattttcggtactaatggaccggttgatctgaaaaaaatcacgaattttttcagaggagatagatgccgaagcttgacgggcaaaccgaagctctttatcatacaagcttgtcgaggaactgagttggattgtggaattgagactgac

SEQ ID NO: 249763 - DNA, 855 bp, Artificial Sequence
  Description of Artificial Sequence: Synthetic coding sequence
atgatcgagactgatagcggcgtggacgatgacatggcctgccacaagataccagtggaggccgacttcctctatgcctactcgaccgctccggggtactattcctggaggaacagtaaggacggatcctggttcattcaaagtctgtgtgctatgctcaagcagtatgccgacaaacttgaattcatgcacatcctgacacgtgttaatcggaaggtagccacagagtttgagagtttttcattcgatgcaacattccacgcaaaaaagcaaattccatgtatagtttcaatgctgaccaaagagctctacttttaccatggtagtcccatggagaatactgagaatagcgtcgcatcaaaatccataaaaaacttggaaccgaaaatcatccacggatccgaaagtatggcctccgggatatctttggacaattcgtataaaatggactatccggaaatgggtctatgtattatcatcaacaataaaaatttccataagagcaccggtatgactagccgcagcggcacggatgtggacgccgctaacttgagggagacattccgaaatttgaaatacgaggttcggaataagaatgatctgacccgggaggagatcgttgaactgatgcgagatgtgagtaaggaggaccactcgaagcgcagcagcttcgtgtgcgttcttttgagccatggggaggaaggcattatattcggaacgaatggacctgtggatttgaaaaaaattactaatttctttcggggggacagatgtaggtccctgaccggcaagcccaagctgttcatcatacaagcctgcagaggcacagagctggattgtggaattgaaacagac

SEQ ID NO: 249764 - DNA, 855 bp, Artificial Sequence
  Description of Artificial Sequence: Synthetic coding sequence
atgatcgaaactgactccggagtggatgacgacatggcctgccataagatacccgtggaagctgattttctttatgcttattcgactgcgccaggatactacagttggcggaattccaaggacggaagttggttcattcaatccctgtgtgctatgcttaagcagtatgcggacaaattggaattcatgcatatcctcacccgcgtgaatcgtaaagtcgccacagaattcgagtccttctcttttgatgcaaccttccatgcaaaaaaacaaatcccctgcatagtcagcatgctcactaaggagttgtacttctaccacggatccccgatggaaaataccgaaaacagcgtggccagcaagtcgatcaagaatctggaacctaagattatccatggatctgaatcaatggctagcggcatcagcctggacaactcctacaagatggactaccctgagatgggtctgtgcataataattaataataagaattttcataagtcgaccggaatgactagtcgctccgggacagacgttgatgcggcgaacctcagagagactttccgtaacttgaagtacgaagtgcgcaacaagaacgacctcaccagggaagagattgtggaactgatgcgggatgttagtaaggaggatcactcaaagcggtcttctttcgtgtgcgtcttactctcccacggagaggaggggatcattttcggcactaacggccctgtcgacttaaagaagataacgaattttttcaggggggaccgttgcagatccttgactgggaagcctaagttgtttataatacaggcatgcaggggcaccgagctggactgcgggattgagaccgat

SEQ ID NO: 249765 - DNA, 855 bp, Artificial Sequence
  Description of Artificial Sequence: Synthetic coding sequence
atgatcgagacagatagcggagttgacgacgatatggcctgccacaaaatcccagtcgaggcagactttttatatgcatacagcaccgccccagggtactatagctggaggaattcaaaggacggctcctggtttatccagagtctttgtgcgatgctgaagcagtacgcagacaagctggagtttatgcacatcttgactcgagtcaataggaaggtggccaccgagtttgagtcgttcagcttcgatgctacatttcatgccaagaaacagatcccctgcatcgttagcatgctaacaaaggaactctacttttatcacgggtctcccatggaaaacaccgaaaattccgttgcctccaagtcgattaaaaacctggagccaaaaataattcacggctctgagagcatggcttcaggtatcagccttgacaattcctacaagatggactacccggaaatgggcttgtgtattatcatcaataacaagaacttccacaagagtaccgggatgacgagcaggagcggcactgatgtcgatgcagcaaacctgcgagagaccttccggaatctgaaatacgaagttaggaacaaaaacgatctgacccgcgaggaaattgttgagttgatgcgcgatgtctccaaggaggatcattccaagcggtcctcattcgtgtgtgtgttgctgagccatggcgaagaaggtattatttttggaactaatggccctgtagaccttaagaaaatcacaaatttctttagaggtgatcggtgccggtcccttaccggcaagcccaagctgttcatcattcaagcgtgtagaggaaccgaactcgactgcggtattgaaacggac

SEQ ID NO: 249766 - DNA, 855 bp, Artificial Sequence
  Description of Artificial Sequence: Synthetic coding sequence
atgatcgagactgactcaggagtggacgacgatatggcctgtcacaaaattccggtcgaggcagactttctttacgcttactcgaccgctccaggatactatagctggaggaacagcaaggacggatcgtggtttatccagtccctgtgtgccatgcttaaacagtacgccgacaaacttgaattcatgcatatcctcacccgggtcaatcggaaagtggctactgaattcgaatcattttcatttgacgcaactttccacgctaagaagcagattccctgcatcgtgagcatgttgacgaaggaactgtacttctaccacgggtcgccgatggagaacaccgaaaattccgtggcatccaagtcaattaagaacctggaaccaaagatcatccacgggtcagagtccatggctagcggaatctcgcttgataattcatacaaaatggactacccagagatgggcctgtgcattatcatcaacaacaaaaacttccataagtccacgggaatgacttccaggagcggcaccgacgtggatgcggccaatcttcgcgaaactttccggaacctgaagtatgaggtgcggaataagaacgacctgaccagggaagagatcgtggagctgatgcgggatgtcagcaaggaagatcatagcaagcgctcctcgttcgtttgcgtgctcctgtcccacggcgaagaggggatcatctttggaacgaacggaccggtggatctcaagaaaatcactaatttctttcggggagacagatgcaggtcgctgacgggcaaacctaaactctttatcatccaggcctgccggggaaccgagctggactgtggaatcgaaactgat

SEQ ID NO: 249767 - DNA, 855 bp, Artificial Sequence
  Description of Artificial Sequence: Synthetic coding sequence
atgattgagacagatagcggggtagatgatgacatggcttgtcacaagatcccagtggaagctgatttcttgtatgcctactccacagcacctgggtactatagctggcggaactccaaagacggctcttggttcattcagtctctgtgcgcaatgctgaaacagtatgccgataagcttgagttcatgcatatcctcacccgagtaaaccggaaagtggctacagaatttgagagtttcagtttcgacgctacattccacgcaaagaagcagatcccttgtatcgtctctatgctgacaaaggaactttacttttaccatggctcaccaatggaaaatacagagaatagtgtggcttccaagagcattaaaaacctggaacctaaaattatacacggatccgaatccatggcctctgggattagtttagataatagttataagatggattatcctgaaatgggcctgtgtatcatcatcaataacaagaactttcataagtcaactgggatgacctccaggtctggcacagatgtagatgccgccaatctccgtgaaacgtttagaaatttaaaatacgaagtacggaacaagaacgacctaacccgggaagaaatagtagagctgatgcgagacgtctccaaagaggatcattctaagagatccagttttgtgtgtgtactcctgagccatggcgaggaaggaattatttttggcaccaacggcccggtggatctgaagaagatcaccaactttttcaggggcgatcggtgtcgctccctgaccgggaaaccaaagcttttcattatccaggcctgtcgaggtacagagctggactgtggaattgagactgat

SEQ ID NO: 249768 - DNA, 855 bp, Artificial Sequence
  Description of Artificial Sequence: Synthetic coding sequence
atgatcgagacagacagtggagtggacgatgacatggcttgccataagattccagtggaagccgacttcttgtatgcttatagcactgcgcccggttattacagttggagaaattcaaaggacgggagttggtttatacagtccctgtgtgctatgcttaagcagtacgctgacaaattagagtttatgcacattctcaccagggtgaaccgcaaggtggctactgagttcgaatcattctcatttgacgctacattccacgccaaaaagcagattccttgtatagtatccatgctgactaaggagctgtatttctatcatggttctccaatggagaacaccgagaacagtgtggcctccaaaagcataaaaaacctggaaccaaagatcattcatggcagtgaatccatggcctcaggcatcagcttggataattcttacaaaatggattacccagaaatgggtctgtgcatcatcattaataataaaaatttccacaagagtactgggatgacctctcgaagcggcacggacgtggacgccgcaaacctgcgagaaacctttaggaatctaaagtacgaggtgaggaataagaatgacctcacacgcgaagagatcgtggagctgatgagggacgtctccaaggaggatcactctaagaggtcgtccttcgtctgcgtgcttttgtctcatggagaggaggggatcatattcggcaccaatggtccagttgacctcaaaaagatcacaaacttcttcaggggcgatcgttgcagaagtctaaccggaaagccgaagctcttcatcatccaggcctgtcgaggaacagaactggactgtggaatcgagaccgat

SEQ ID NO: 249769 - DNA, 855 bp, Artificial Sequence
  Description of Artificial Sequence: Synthetic coding sequence
atgatcgaaaccgactccggcgtggatgacgacatggcgtgccacaagattccggtggaggcggactttctctacgcctactcaactgcgccagggtattactcgtggaggaatagcaaggacggatcctggtttatccagtcgctgtgcgccatgctcaagcagtacgccgataaacttgagttcatgcacattcttactagagtgaatcggaaggtcgctaccgagtttgaatcgttctcattcgatgcgaccttccacgccaagaagcagatcccatgcattgtctccatgttgacgaaggagctctacttctatcacggctccccaatggagaacaccgaaaactccgtggcatcaaaatcgataaagaatctggaaccgaaaatcatccatggatcggagagcatggcctcagggatctcactggacaatagctacaagatggattacccagagatgggactgtgcataatcatcaacaacaagaacttccataagtccaccggaatgacttcgcggtcgggaaccgacgtcgatgccgctaacctgagggaaaccttccggaatctcaaatacgaggtccgcaacaagaatgacctcaccagggaggagatcgtcgagctgatgcgagatgttagcaaggaagatcactcgaaacggagctctttcgtctgcgtccttttgtctcacggggaggaaggaatcattttcggcaccaacggacctgtggacctgaaaaagatcacgaacttctttcgcggagatcgctgcagatcgctcactgggaaacccaaactgttcatcattcaggcctgccgcggaaccgaactggattgtgggatcgagactgac

SEQ ID NO: 249770 - DNA, 855 bp, Artificial Sequence
  Description of Artificial Sequence: Synthetic coding sequence
atgatcgaaactgacagcggggtcgacgacgacatggcctgccacaagatcccggtcgaagctgacttcctgtacgcctactcgactgcaccggggtactactcatggcggaactcgaaggacggctcctggttcatccaatccctgtgcgctatgctcaagcagtacgcagacaaactcgagttcatgcatattctgacgcgcgtgaatcgcaaggtcgcgactgagttcgagagcttctcgttcgatgcaactttccacgcgaagaagcagatcccatgcattgtgagcatgcttacgaaggagctgtacttctaccacggaagcccgatggagaacacggagaactcggttgcgtcgaagtctattaagaatctggaacctaagataatccacggatccgagagcatggcctcgggcatcagccttgataacagctataagatggactacccggagatggggctgtgtatcatcatcaataacaaaaacttccataagtccaccgggatgacctcaagatcaggcactgatgtggacgcggcaaatttgcgggaaacctttcggaatctgaagtacgaggtgaggaataagaacgacctgacgagagaagagattgtggagctcatgcgcgacgtctcgaaggaggaccactcaaagcggtcgagctttgtgtgtgtgctgctgtcacacggagaagaaggaatcattttcggaaccaacggaccggtcgacctcaaaaagatcaccaacttctttcggggtgaccgttgccgctccctgaccggaaagccaaaactgtttatcatccaggcttgccgcgggaccgaacttgactgcggcatcgaaaccgat

SEQ ID NO: 249771 - DNA, 855 bp, Artificial Sequence
  Description of Artificial Sequence: Synthetic coding sequence
atgattgagactgattcgggtgtggacgatgatatggcatgccacaagattcccgtggaagctgattttctttacgcatattccactgccccaggatactattcatggcgtaattccaaggacggctcgtggtttatccaatcattgtgtgcaatgctgaagcaatacgcagataaacttgaattcatgcatattctcactcgggtgaataggaaggtcgccacggaatttgaatcgttcagctttgacgcaacgtttcatgcaaagaagcaaatcccttgcatcgtctctatgcttactaaagagctgtacttttaccatggttcaccaatggagaataccgaaaattcagtggcatccaagtccattaagaatctcgaaccgaagattattcatggctcagagtcgatggcaagcggcatatccctggataactcctacaagatggactaccctgaaatgggactttgcattatcattaacaataagaacttccataaaagcacggggatgacgtcaaggtccggcactgatgtggatgcagccaacctgcgcgaaacctttagaaacttgaagtacgaagtgagaaacaaaaatgaccttaccagagaagaaatcgttgagctgatgagagacgtcagcaaggaagatcacagcaaacgcagctcattcgtgtgtgtgctgctgtcacacggggaggaaggtatcatctttggcaccaacggccctgttgatctcaagaagatcactaatttctttcgcggagacagatgccggagccttaccggaaagccaaagctgttcataattcaagcgtgccgcggaactgaactggactgtggaattgaaacggat

SEQ ID NO: 249772 - DNA, 855 bp, Artificial Sequence
  Description of Artificial Sequence: Synthetic coding sequence
atgatcgaaactgactcaggagtggatgacgatatggcttgtcacaagattccagtggaagccgatttcctctatgcttattcaaccgccccagggtactactcctggcgaaattccaaagacggaagttggttcatccagagtctgtgtgcaatgctgaagcagtacgctgacaaactcgagttcatgcacattctgacccgggtaaataggaaggttgctacggagtttgaaagcttcagcttcgatgccacttttcacgcaaagaagcagatcccatgtatagtatcaatgctgacaaaggagctgtacttttaccacggatccccgatggagaacacggaaaactccgtcgccagtaagtccatcaagaatttggagcccaagatcatccatggttctgagtcaatggcttctggcatcagcttggacaattcgtataaaatggactatcctgagatgggactttgcattataatcaataacaagaactttcataaatcaaccggcatgacatcaaggagcggaactgacgtcgacgccgctaacctccgcgagacctttcggaacctcaagtatgaagtgagaaataaaaatgatttgacacgtgaggagatagtggagttgatgagagacgtgtcaaaggaggaccattctaagcgcagttccttcgtgtgcgtgctcctctcccacggggaagaaggaataatttttggaacaaacggaccggtggacctgaagaaaatcaccaacttcttccgcggcgataggtgcagatcccttaccggcaagcctaagctgttcatcatacaggcttgccgcggcacagagctcgactgcggtattgagaccgat

SEQ ID NO: 249773 - DNA, 855 bp, Artificial Sequence
  Description of Artificial Sequence: Synthetic coding sequence
atgatcgagactgacagtggcgtggatgatgacatggcttgccataagatccctgttgaggcagactttctttacgcctatagcaccgcccccggatactactcctggcggaatagtaaagatggatcgtggtttattcaaagtctgtgcgctatgctaaagcaatatgccgataaacttgagttcatgcatattctcacacgagttaaccggaaagttgccaccgaatttgaaagcttttcgtttgacgccacgtttcacgctaaaaagcagatcccatgtattgttagcatgctgacgaaagagctgtatttctaccacggctctccaatggagaatacagagaactcagtcgcgtcaaagtctattaaaaacctcgagccaaagatcattcacgggtctgagtccatggcctccgggatctctttggacaacagctataagatggactatccagagatgggactgtgcattattatcaacaataagaattttcataagtcgactggaatgacaagcaggagcggaacggacgtggatgcagccaatcttcgggagacctttcggaacctgaagtacgaggtaaggaacaagaatgacctgactagggaagaaatcgtagaacttatgagagacgttagcaaggaggatcactctaagcgaagcagctttgtatgcgtcctactctcacacggagaggaggggataatattcgggaccaacgggcccgtcgatctgaagaagatcactaatttctttagaggcgataggtgcaggagcctgacgggcaagccaaaactttttataattcaggcatgtcggggtacggagcttgattgtggtatagagactgac

SEQ ID NO: 249774 - DNA, 855 bp, Artificial Sequence
  Description of Artificial Sequence: Synthetic coding sequence
atgatcgagacggattccggcgtcgatgatgacatggcctgccacaagatcccggtggaggctgactttctgtacgcttactcgactgctccggggtactactcctggcgcaattctaaggacggatcatggttcatccagtcgctgtgcgctatgctgaagcagtacgctgacaaacttgagtttatgcacattctcacgcgagtgaaccggaaagtggccactgaattcgagagcttctcatttgacgcgactttccatgcgaagaagcagattccgtgcatcgtgtccatgctgaccaaggagctctacttttaccacgggtcgccgatggaaaataccgaaaattcagttgcgtcaaaatccatcaagaacctggagcctaagatcatccacgggtcagaatccatggccagcgggatcagccttgataactcatacaagatggactacccggagatgggtctgtgcatcatcatcaacaacaagaactttcacaagtccaccggaatgacgtctcgctcgggcactgacgtggacgccgccaacctgcgggagactttcagaaatctgaaatacgaggtgcggaacaagaatgacttgactagagaagaaatcgtggagctgatgcgcgacgtgagcaaggaggaccactccaagcggtcatcgttcgtctgtgtgctgctgtcacatggggaagaaggtatcattttcgggaccaacggtcccgtggatcttaagaaaatcaccaacttcttccgaggagacagatgtcgctcgctgaccggaaaaccaaagctcttcattatccaggcgtgcaggggaacggagctggattgcggcatcgaaaccgac

SEQ ID NO: 249775 - DNA, 855 bp, Artificial Sequence
  Description of Artificial Sequence: Synthetic coding sequence
atgattgagacagattctggcgttgatgacgatatggcatgtcataagattcccgtggaggccgactttctgtacgcatattcaactgcaccagggtattattcttggcgcaatagcaaggatggttcctggtttatacagtcactgtgtgcgatgttgaagcagtacgccgacaagctggaatttatgcacatcctgaccagagtgaacagaaaggtggcgacagagtttgagagtttttccttcgacgccacttttcacgctaaaaaacagatcccatgcatcgtatctatgctcactaaggagctttacttttaccatggaagccctatggagaacaccgagaattcagtcgcgagcaagtccattaaaaaccttgagcccaagatcatccatggttccgaatctatggcctccggaatttctctcgataacagctacaaaatggattacccggaaatgggactttgtatcattatcaataacaaaaacttccacaagtcaactgggatgactagtcgcagcggcaccgatgtggacgctgccaatctgagagaaacgtttcggaatttaaagtatgaagtccgtaataaaaatgatttgaccagggaggagatcgtggagctaatgcgtgacgtgtcgaaggaggatcactccaaacggtcatccttcgtgtgcgttctgctctctcacggtgaggagggaatcatctttgggaccaatggtcccgtcgacctcaagaaaataacaaatttttttcggggagatagatgccgctcgctgactggtaaacccaaattgtttattatccaggcttgcaggggaactgaactggactgtgggatcgagacagac

SEQ ID NO: 249776 - DNA, 855 bp, Artificial Sequence
  Description of Artificial Sequence: Synthetic coding sequence
atgatcgaaaccgactcgggagtggatgacgacatggcatgccacaagatcccggttgaggcagattttctctacgcgtactcgacggcgccagggtactacagctggcggaactccaaggatggaagctggttcattcaatctctgtgtgctatgctcaagcaatacgccgacaagctggaattcatgcatatcctcactagggtgaatagaaaggtcgcaactgaatttgaatcgttctccttcgatgccaccttccacgctaaaaagcagatcccgtgcattgtgtccatgctgactaaggaattgtacttctatcatggatctccgatggagaacaccgaaaattcggtggcctccaaaagcatcaaaaatctggaaccaaagattattcacggctcggaaagcatggcctcagggatctcgctcgataactcctacaaaatggattacccggagatgggactgtgtattatcatcaataacaagaacttccacaagtcgaccggaatgacctcgcggtccggaactgatgtggatgccgcaaatcttcgcgaaactttccgcaacctgaagtacgaggtgcgcaataagaacgacctgacgcgagaagaaatcgtggagctgatgagagacgtgtcgaaggaggaccacagcaagagaagcagcttcgtttgcgtgctgctgtcacacggagaagagggaatcattttcgggaccaacggcccggtcgacctgaagaaaatcacgaatttcttccgcggagatcgctgccggtcgctgaccggaaagccgaaactgttcatcatccaggcctgcagggggactgagctggattgcggaatcgaaaccgat

SEQ ID NO: 249777 - DNA, 855 bp, Artificial Sequence
  Description of Artificial Sequence: Synthetic coding sequence
atgatcgaaactgactcgggagtcgacgatgatatggcctgtcataagatccctgtcgaagcagattttctgtacgcctactccaccgcaccgggttactactcctggagaaactcaaaagacgggagctggtttatccaatcgctgtgtgcaatgctcaaacagtacgccgacaagctcgaattcatgcacatacttactagagtcaatcgcaaggtcgctaccgaatttgaatccttttcatttgacgcgactttccatgcaaagaaacaaattccgtgcatagtgtcgatgctgacgaaggagctttacttctatcacggttcgcctatggaaaacactgaaaactcggtggcatccaaaagcattaagaatctggagcctaagattatccacggatctgaaagcatggcgtcaggcatttcacttgataacagctacaaaatggactatccggaaatgggtttgtgcattatcattaacaataagaacttccataagtcaacggggatgactagcaggtctggcaccgacgtcgatgcggcgaaccttcgggaaacctttaggaatctgaagtacgaggtgaggaacaaaaacgatcttacccgagaggaaattgtggaactgatgagagatgtgtctaaagaggatcattcaaagagatcatccttcgtgtgcgtgctcctctcgcatggtgaggaggggattatctttggtaccaacggaccggtggatctgaagaagattaccaactttttccgtggggaccggtgtaggagcctgactggcaaaccaaagctgtttatcattcaggcatgtcgcggaactgaactcgattgtgggattgagactgat

SEQ ID NO: 249778 - DNA, 855 bp, Artificial Sequence
  Description of Artificial Sequence: Synthetic coding sequence
atgatcgagactgattcgggtgtcgatgacgacatggcgtgtcacaaaatcccggtggaggccgacttcctgtacgcgtatagcaccgcgccgggatactactcgtggaggaactcgaaggacggctcgtggtttatccaatctctctgcgcaatgctcaagcagtacgcggataaactggagtttatgcatatcctgaccagggtcaaccgcaaggtcgctaccgaattcgaatcgttctcctttgatgcaactttccatgcaaagaagcagatcccgtgcattgtctccatgctgaccaaggagctgtacttttaccacggatcgccgatggaaaacaccgagaatagcgtggcctcgaagtcgatcaaaaacctggaacctaaaatcattcacgggtccgaatcaatggcctccggcatctctctggacaatagctacaagatggattacccggagatgggactgtgcatcattatcaacaataagaacttccacaagagcactggcatgacctcaagatcaggaactgatgtggacgcggcgaacctgcgggaaacttttcgcaacctgaaatacgaagtgaggaataagaacgatttgactcgcgaagaaatcgtcgaactgatgcgggacgtcagcaaggaggatcattcgaagcgctcctcgttcgtgtgcgtgctgctctcgcacggagaggaaggaattatcttcggaaccaacggacctgtggacctcaagaagatcacgaacttcttcagaggagacaggtgtaggtcactgaccggtaagccgaagctgttcattattcaggcctgtcggggcacggaactggattgcggcatcgagactgac

SEQ ID NO: 249779 - DNA, 855 bp, Artificial Sequence
  Description of Artificial Sequence: Synthetic coding sequence
atgatcgaaactgactcaggagtggatgacgacatggcttgccataagatcccggtggaagcggatttcctgtacgcttactcgaccgctcctggctactactcgtggcggaactcgaaggacggctcgtggttcatccagagcctgtgcgcgatgctgaagcagtacgctgacaagctggaattcatgcacatcctgacccgcgtgaaccggaaggtcgcaaccgagtttgagagcttctccttcgatgccactttccatgcaaaaaagcagatcccgtgcattgtgagcatgctgactaaggaactgtacttttatcacgggagcccgatggagaatactgagaacagcgtggcgtccaagtccatcaagaacctggaaccaaaaatcatccacggcagcgaatcaatggctagcggaatttccctcgacaacagctacaagatggactacccagaaatgggactctgcattatcatcaataacaaaaacttccacaagtccactggaatgacgtcgaggtcgggaaccgacgtcgatgctgctaacctccgcgaaaccttccgcaacctgaagtacgaggtgcgaaacaaaaacgacctcacccgcgaagagatcgtggagctgatgcgggatgtttcaaaggaagatcactccaagcggtcatcgttcgtgtgcgtcctgctgtctcatggagaggaaggtatcatttttggtacgaacggaccggtggatctcaaaaagattaccaacttcttccgcggagatcggtgcaggtccctgaccggtaagcccaaacttttcatcattcaggcctgtcggggcactgaattggactgcggaatagagactgat

SEQ ID NO: 249780 - DNA, 855 bp, Artificial Sequence
  Description of Artificial Sequence: Synthetic coding sequence
atgattgaaacggactcaggggtggacgacgacatggcgtgtcataaaatacctgtcgaagctgattttttgtacgcctattctacggcgcctggctactatagctggagaaattccaaagatggctcgtggtttatccagagtttgtgcgctatgctgaagcagtacgctgacaagctggagttcatgcacattcttacgagggtgaataggaaggttgcaactgaatttgaatccttttcctttgatgctacgtttcacgccaaaaagcagatcccctgtatagtatcaatgctgactaaagaactttatttttaccacgggagccccatggaaaacacagaaaattctgtagcctccaagagcattaaaaacttagaacctaagatcatccatgggtccgaaagcatggcctctggtatctctctggacaactcctataagatggattatccagagatgggattgtgcatcattatcaacaacaagaacttccacaaatctaccggaatgacaagccgcagcggcacagacgtagacgccgcaaacctccgggaaacatttcgcaacttgaagtatgaagtccgaaacaaaaatgatctgacaagagaagaaattgttgagcttatgcgggacgtcagtaaagaggaccatagcaagcgctcctctttcgtgtgtgtactgttatcccacggagaggagggaatcattttcggaacaaatggccctgtcgatcttaaaaaaatcacgaacttctttaggggagatcgttgtcgctcgttgaccggcaagcctaagctgttcattatacaggcctgccggggcactgaactggattgtggcattgagacagat

SEQ ID NO: 249781 - DNA, 855 bp, Artificial Sequence
  Description of Artificial Sequence: Synthetic coding sequence
atgatcgagacagacagtggcgtggacgatgacatggcatgtcataaaatccccgtggaggcagactttctatatgcctactccacagcccctggttactattcctggcgcaactcaaaagatgggtcctggttcatacagtctctctgtgctatgctgaagcaatatgcggacaagctggaattcatgcacattctgacgcgcgttaaccgcaaggttgctaccgagtttgagagcttttctttcgacgccaccttccacgcaaagaagcagatcccttgtatcgtcagcatgctgactaaggagctctatttctaccatggaagccccatggagaacacggagaatagcgtagctagtaagtcaatcaagaatctggaacccaagatcatccatggtagcgagagcatggcctcaggaatctcccttgacaactcatataaaatggactacccggagatgggactctgcattattattaataataagaattttcacaaaagcaccggtatgacgtcccgctcaggaaccgacgtggatgcagcaaacctgagagagacttttcgaaatcttaagtacgaggtccggaacaaaaacgatttaacccgggaggagattgtcgaactgatgcgggatgtgtccaaagaggatcattctaaacgaagtagtttcgtatgtgtgctgcttagccacggtgaagaagggatcatcttcggaactaacggtcctgtcgacctgaagaaaattaccaatttcttcagaggggatcggtgtcgtagcctgaccgggaagcccaagttgtttattatccaggcctgcagaggaacggaactagactgtggaattgaaaccgat

SEQ ID NO: 249782 - DNA, 1845 bp, Artificial Sequence
  Description of Artificial Sequence: Synthetic coding sequence
atgagagcccttctactccttggattcctccttgtgagtctggaatccactctctcgataccaccatgggaagccccaaaagaacacaaatataaagccgaggaacatactgtggtcctcacagttacaggggaaccatgtcactttccttttcagtatcaccggcagctctaccacaagtgtacacataaagggaggcccgggccccagccctggtgcgccactactcctaacttcgaccaggatcagaggtgggggtattgtctagaacctaaaaaagtgaaagatcactgttcaaaacactcgccttgtcagaaaggggggacatgcgtgaacatgccttctggacctcattgtttgtgtccccagcatctgactggaaaccactgtcagaaagaaaaatgctttgagccacagctcttgcgatttttccataaaaacgaaatttggtataggacagaacaggctgcggtggccaggtgtcaatgtaagggacctgatgctcactgccagcgccttgcttctcaagcctgtcggacaaacccctgcctacatggagggcggtgccttgaagtagaagggcaccggctctgtcattgcccagttggatatactggggctttctgtgatgtggatacaaaagcctcatgctatgatggacgcggactgtcataccggggactggcccggacaactctcagtggagcaccatgccagccctgggctagtgaagccacatacagaaatgttactgccgaacaggcgaggaattgggggttgggaggacatgcattttgccggaatccagataacgatatacgcccctggtgttttgtactgaatcgagatcggttgagttgggaatactgtgatttagctcaatgccagacacccactcaagccgcccccccaacaccagtctcccccagactccatgtgcccctgatgccagcacagcctgccccccccaaaccacagcctacaactcgcactccaccacagtctcagactccaggagctttacctgcaaagagagaacagccaccatctctaacacgcaatgggcccctttcttgcggacagcggctgcggaaaagtctatcctccatgactcgggttgtgggaggacttgttgcactacggggggcacatccctatatagcagctctgtattggggacactctttctgcgcgggatctctcattgctccctgctgggtcttaacagctgcacattgtctacaggaccgccccgcacctgaagatctcacagttgttctgggacaggagagaagaaaccactcctgcgaaccctgtcagacacttgctgtccgctcttatcggctacacgaagccttttccccagtttcctaccagcatgatctcgctcttctccgactccaggaagatgccgacgggtcctgtgctctcctttcaccctatgtccagcccgtgtgtcttccctccggagctgccaggccctcggaaactactctctgtcaggtcgcggggtggggacatcagtttgaaggagctgaagaatatgcttccttcctgcaggaagcccaggtgccttttctgtcactcgaaagatgttcagcccctgatgtgcatggatccagtatcttacccggaatgctctgtgccgggttcctcgaaggaggaacagatgcttgtcagggggattctgggggacctctggtatgtgaagatcaggctgcagaacgccggctcactctacaggggatcatttcttggggatccggatgtggagataggaataaacctggagtttacacggatgtcgcttattatcttgcctggatcagagaacacactgtttct

SEQ ID NO: 249783 - DNA, 1845 bp, Artificial Sequence
  Description of Artificial Sequence: Synthetic coding sequence
atgagggccctcttgctgcttgggttcctgctggtgagcctcgagagcaccctgtcgataccaccctgggaggcaccaaaagagcataaatacaaagcggaggagcatacagtcgtcctgacggttacaggggaaccatgccacttcccttttcaatatcataggcagttataccacaaatgtacacacaagggaaggcctggcccacagccatggtgtgcaacaacacccaattttgatcaggaccagaggtggggatactgccttgagcccaagaaagtgaaggatcactgttcaaagcactcaccttgccaaaaaggaggaacctgcgtcaatatgccttcaggcccacactgtctgtgcccgcaacacctgactggcaatcactgccaaaaggagaagtgtttcgagccccagctcttgagattctttcacaaaaatgagatttggtaccgcaccgagcaagccgctgtcgcccgctgtcaatgcaaaggaccagatgcacactgccagaggctcgcatcacaagcttgccgaacaaacccttgcttacatgggggcagatgcctcgaggtagagggccacagactgtgtcactgtccggtcggctacactggagcattttgcgatgttgatactaaggctagttgttatgatggacgggggctgtcgtaccgcggtctcgcaaggaccaccctgtcgggagctccatgtcagccttgggcaagcgaggcaacgtatagaaacgttaccgccgagcaggctcgcaactggggactgggcggccatgcattctgcaggaaccctgataacgatatcagaccttggtgtttcgttttgaatcgggatcggctgagctgggaatactgcgatttagctcaatgccagacgcccacacaggcagccccacctaccccagtttctccgagattgcatgtcccactgatgccagcacagcctgcccctccaaagccacagcccaccacccgcactcccccgcagagtcagaccccaggcgctctgcccgcaaagcgggaacagccaccaagcctaacgcggaacggccctctgtcttgcggtcagagactgaggaaaagtttaagttccatgacaagggtggtgggaggacttgtggcgttgcggggcgcccacccctacattgctgcactgtactggggacactccttctgtgcaggatcactcatcgcaccctgctgggttcttactgccgcccactgtctgcaggatcgccccgcaccagaagatctgaccgtggtactcggccaagagcggaggaaccattcttgtgaaccatgccagaccctcgccgtgcgctcctacaggctccacgaggccttttctccagtaagttaccaacacgatctcgcacttctgagactgcaagaggatgctgacggctcctgtgccctcttgtctccctatgtgcagccagtctgccttccaagtggggcagcccgcccaagcgaaacaaccctttgtcaggtggctggatgggggcaccagttcgaaggtgcggaagaatacgcatcctttctacaggaagctcaggtgccatttctgtccctggaaagatgcagcgcccccgatgtgcacggaagcagcattcttcccggtatgctttgcgcaggctttcttgaaggcggaaccgacgcttgccagggggacagtgggggcccactggtttgcgaggaccaggcagccgagaggaggctcactttgcagggtattatctcttggggctctggatgcggcgataggaataaacctggcgtgtatacagatgtggcatactatctagcatggataagagagcacacagtgtcc

SEQ ID NO: 249784 - DNA, 1845 bp, Artificial Sequence
  Description of Artificial Sequence: Synthetic coding sequence
atgagggcactgctcctgctcgggtttcttcttgtgtccctcgaatcgaccctgtcaattcctccttgggaggccccgaaagagcataagtacaaggcggaagaacacacggtggttctcactgtgaccggggaaccttgtcatttcccattccagtaccaccgacagctttatcataagtgcacccataaggggcgtcctggcccacagccgtggtgtgcaaccacgccaaacttcgaccaagatcagcgctggggatactgtcttgaaccaaaaaaggtgaaagatcattgctcgaagcattcaccttgccaaaagggtggaacttgcgtgaatatgccctccggtccacactgtctttgccctcagcatctcaccggcaatcattgccaaaaggagaagtgtttcgaacctcagctgctcaggtttttccacaaaaacgaaatttggtacaggaccgaacaggccgcagtcgcgcgctgtcaatgtaagggtccggatgcacattgccaacgcctggcgtcccaggcatgtcggaccaatccatgtctgcacggaggccgctgtcttgaggtggaagggcacagactctgtcactgtccagtggggtacactggtgccttttgtgatgtcgacactaaggccagctgctacgacggaagggggcttagctacagaggcctcgcaaggacgactctttccggtgcgccttgtcaaccttgggcatcggaggcaacctacagaaacgtgaccgcagagcaagcacgcaattgggggctcggagggcacgctttttgccgcaacccagacaacgatataagaccttggtgttttgtcctcaacagggataggctctcttgggagtactgtgatctggcacaatgtcaaacccctacccaagccgccccaccgactccagtgtccccacggctgcatgtgccacttatgcccgcacagccggcaccccccaaaccacagccgaccacccgtaccccaccacaatcacaaactcccggagcccttccagccaagagagaacaacccccttcccttacccgcaatggccccctcagctgcgggcaaagacttcgcaagtcacttagctcgatgacccgcgttgtcggagggttggttgctctgcggggtgcacatccatacatagcagcactgtattgggggcactctttttgtgccggtagccttatcgcaccctgttgggttctcaccgcggcacactgtttgcaagacagacctgccccggaggacctgaccgtcgtgctgggccaggaacggcgtaaccattcgtgtgaaccttgccagactttggctgtgcggtcgtaccgacttcacgaagcattttcgcctgtgtcatatcagcatgacctggcgttgctcaggcttcaggaagatgctgatggttcctgcgcacttctgtccccttatgtgcagcctgtgtgcttgccttccggcgcagcaagaccgtcggagactaccttgtgtcaggtggcaggttggggacatcagtttgagggtgcagaggaatacgcatcctttctgcaagaagcacaagtcccgttcctgtcccttgaaagatgttccgctccagacgtgcatggatcatcgattctgccaggtatgctttgtgcaggctttcttgagggaggtactgacgcctgtcaaggagattcgggcgggccccttgtgtgtgaagatcaagccgcggaacgaagattgacgctgcaggggattatctcgtggggatcaggctgtggggatcgaaacaagccaggagtctacactgatgtggcttactaccttgcttggatccgagaacatactgtcagc

SEQ ID NO: 249785 - DNA, 1845 bp, Artificial Sequence
  Description of Artificial Sequence: Synthetic coding sequence
atgagagcattactgctcttggggttcttgctggtgtctttggagtcgaccttgagcatcccgccgtgggaggcgcccaaggagcacaaatacaaagccgaggagcatacggtggtccttaccgttactggagagccttgtcactttcctttccagtaccacaggcaactctaccacaagtgcactcataagggccggcccggtccccagccgtggtgtgctacaactcccaactttgaccaggaccagcgttggggctattgcctggagccaaagaaagttaaggatcactgcagcaagcacagtccatgccagaaaggcggcacatgtgtgaatatgccttccgggccacactgcctttgtccccaacatctgacgggtaaccattgccagaaagagaaatgctttgagccacagctgctgagattctttcataagaatgagatctggtatcgcacggagcaggcggccgttgccaggtgccagtgcaagggtccggacgcacattgccagaggctagcatcgcaggcttgtaggaccaacccctgtctgcatggtgggaggtgtcttgaagtggaaggccatagactgtgccactgtcctgtcggatataccggtgccttttgtgacgtggatactaaggcatcttgttatgatggtcggggactcagctatcgtgggctagcccgcaccaccctgtctggtgctccgtgccagccatgggcttcagaggccacataccgcaacgtcacagccgaacaggcgcgcaattggggcctgggcggccatgcattttgcagaaatcctgataatgacattcggccatggtgtttcgtgttaaacagggaccggctctcgtgggagtattgtgatcttgcccagtgccagaccccaacgcaggccgcccctccgacccctgtgtctccaaggcttcatgtaccacttatgcccgcccagcccgcccctcccaaaccccagccgaccaccaggactcccccccagagccagactccgggagcgttaccagcgaagcgcgaacagcccccaagcctcacaaggaatgggcccctcagctgcgggcagaggctgagaaagagtctgagctctatgacacgggtcgttggtgggctggtggccctgcgtggggcacacccctatatcgccgctctgtactggggccactcattctgtgcgggatctctcattgcgccctgttgggttctcaccgcagcccattgcttgcaggataggcccgcacctgaggacctcacggtggtattggggcaggaacgtcgcaaccactcatgtgaaccctgccagactctcgccgtgaggtcttatcgactccacgaggctttctctcctgtcagctatcagcacgatctcgctcttctgcgtctgcaggaagacgcagatgggagctgtgcactgctatccccttatgtgcagcccgtatgcctgcccagcggcgctgctagaccttccgaaaccaccctgtgtcaggtggcaggctggggccatcagttcgagggagcagaggaatacgcctctttcttgcaggaggcacaggtgcctttcctgagcttggagaggtgttctgcaccagatgtccatgggtcctcaatcctcccaggaatgctctgtgcgggctttctggagggcggcaccgacgcctgccagggcgattctggcgggccactggtctgcgaggatcaggccgccgagcgccggctaaccctgcaggggatcatttcttggggaagtggctgcggggataggaacaagcccggtgtatatactgatgtcgcctactacctagcatggattcgcgaacatacagtctct

SEQ ID NO: 249786 - DNA, 1845 bp, Artificial Sequence
  Description of Artificial Sequence: Synthetic coding sequence
atgagagcgctgctgctgctggggtttctcttggtttcccttgaatccaccctttccattcctccatgggaagcacctaaagagcacaaatacaaggcagaagaacatactgttgtccttaccgtgactggagagccctgtcactttccattccaataccatcgtcagctttaccataagtgtactcacaaaggtagaccaggtccccagccttggtgtgcaactacccccaatttcgaccaagaccagaggtggggttactgtcttgaacctaagaaggtgaaagatcattgttcgaaacattcgccctgccaaaagggaggaacctgcgtgaacatgccttccgggccgcactgcctgtgtcctcaacacctgactggaaaccattgtcagaaggagaagtgttttgaacctcagcttcttcgattctttcacaagaacgaaatttggtacaggaccgaacaagcagcagtcgcgaggtgtcaatgtaagggacctgatgcacactgccaaaggttggcgtcgcaggcctgcagaaccaacccctgtctgcatggtggtagatgcctggaagtcgaaggacatcggttgtgccattgtcccgtgggatacactggcgcgttctgcgatgtggacactaaggcgtcttgttacgacgggcgcggactttcgtacaggggcctcgcacgaactacgcttagcggagcgccctgtcaaccctgggcatcggaagcaacgtacagaaacgtgactgcagaacaagcaagaaattggggtcttggaggccacgccttttgtagaaaccctgacaacgacattagaccttggtgttttgtgcttaatcgagatcggctgagctgggaatactgcgatcttgcgcagtgtcagaccccaacccaagccgcaccacccactccagtgtcacctaggctgcatgtcccactgatgccggcacagcctgccccaccaaagccacaacctaccacccgcaccccgcctcagtcccaaaccccaggagctctgccagcaaagcgcgagcagccaccttccctcaccagaaacggaccactcagctgtggacaaagactgagaaagtcgctttccagcatgacccgtgtggtgggagggctcgtggctctgagaggtgcacacccatacattgctgcactctactgggggcactccttctgtgccggatcccttattgctccttgttgggtgcttaccgcagcacattgtctgcaggataggcctgcacctgaggatcttacggtggtgctggggcaagagcggaggaatcattcatgtgaaccttgtcaaacccttgcagtcagatcataccgtctgcatgaggccttcagtcctgtgtcgtaccagcacgatctggcactgctgagactgcaagaggatgcagatggcagctgcgcgttgcttagcccttacgtgcaacccgtgtgtctgccatcgggggcagcccgaccatcagagactactctttgccaagtggcgggttggggtcatcaatttgaaggtgcggaggaatacgcatccttccttcaagaagcgcaggtccctttccttagccttgaaaggtgttcggccccagatgttcatggttcatccattctgcccgggatgctgtgcgctggttttctcgaaggcggaactgacgcgtgtcagggagactccggcgggcctctcgtgtgtgaagatcaggcagcagaaaggcgactgaccctccaaggaatcatttcgtggggatccggttgcggagatcgaaacaagcctggagtgtataccgacgtggcatactatctggcatggattcgtgagcatactgtgtcc

SEQ ID NO: 249787 - DNA, 1845 bp, Artificial Sequence
  Description of Artificial Sequence: Synthetic coding sequence
atgagagcgctccttctgcttggcttcctcctggtgtcactggaatcgactcttagcattccaccttgggaggcacctaaggagcacaagtacaaggctgaagagcataccgtagtactgactgtcaccggtgaaccttgtcattttccctttcagtaccacaggcaactgtaccacaagtgtacccataaagggcgtcctgggccacagccatggtgtgccacgacgcccaatttcgatcaggaccaacggtggggttactgtctcgaacccaaaaaggtcaaggaccattgctccaagcattctccatgtcaaaaaggaggcacttgtgtgaacatgccgtccggaccacattgcctctgtccacaacatctcactggaaaccattgtcaaaaggagaagtgctttgagcctcaactccttcggttttttcataagaacgaaatttggtacagaaccgagcaggcagcagtggcacggtgtcaatgtaaaggacctgacgcacactgtcagagattggcgagccaggcctgtcgaaccaacccatgcttgcatggtggtaggtgtctggaagtcgaagggcaccgtctgtgtcactgcccagtgggatacacgggggcattttgtgatgtcgacacgaaggcctcatgttacgatggtcggggccttagctacaggggactggcgagaacgaccctctccggtgcgccctgccagccctgggcatctgaggcaacgtatagaaatgtgactgcagaacaagcacgcaattggggcctgggcggccacgccttttgtagaaaccctgacaacgatattcgcccatggtgtttcgtcttgaaccgtgacaggctgtcatgggaatactgtgacctggcacagtgccaaaccccaacccaagccgcccctcctactccagtgtccccgcgtctgcacgtgccattgatgccagcccagcccgcacctccgaaaccgcagcctactaccaggactccacctcaatcccagaccccaggtgcactccctgcaaagagagaacaacccccatcgctgacccggaatggacctctgtcctgcggccaaagactgcgcaaatcgctttcaagcatgactagagtcgtgggaggactcgttgccctgcggggcgcgcatccgtacatcgcggcactttactggggacactcgttctgtgccggctcgctgatagcaccatgctgggtcctgaccgcagcacattgccttcaagatcgcccggcccctgaggaccttaccgttgtgctcggccaggaaagaaggaatcactcgtgcgagccttgtcaaactcttgcagtgagatcctaccgtttgcatgaggctttttcccctgtgtcctaccagcatgatctcgcactgcttaggctccaagaagatgcagatgggagctgtgcgcttctttcgccttacgtacaacccgtgtgccttccctcgggagcggctcgtccttcggaaactaccctttgccaagtggcagggtgggggcatcaattcgagggtgctgaagaatacgcctcgttcctccaagaggcacaggtgccttttctgtcgctcgaaagatgtagcgcaccagatgtgcatggatcctcgattcttccaggaatgctttgcgccggttttcttgaaggggggactgatgcttgccagggtgactcaggaggtccgctggtgtgcgaagatcaagcggctgaacgccggcttactcttcagggcattatctcctggggttcgggatgtggagatagaaacaagccaggtgtctacaccgatgtcgcgtactatcttgcctggataagagaacatactgtgtca

SEQ ID NO: 249788 - DNA, 1845 bp, Artificial Sequence
  Description of Artificial Sequence: Synthetic coding sequence
atgagagctttgctgttacttggattcctactcgtctcactggaatccacacttagtatacctccatgggaagcgccaaaagagcacaaatataaagccgaagaacacaccgtcgtcctgacagtcacaggagagccatgtcactttcccttccagtatcatcgacaactgtatcacaagtgcacccacaaaggtcggccaggccctcagccatggtgtgcaaccacgcccaactttgaccaagaccaacggtgggggtattgtttggaaccaaaaaaggtgaaggaccactgttctaagcacagcccttgccagaaaggggggacctgcgtgaacatgccctctggaccgcactgcttgtgtcctcagcacttgaccggcaatcattgtcagaaagaaaagtgctttgaaccacagcttcttcggttctttcacaagaatgagatttggtatcgcacagaacaggctgccgttgcccgctgccagtgcaaggggccagatgcacattgccaaagacttgcttctcaggcctgtcggactaacccgtgtctgcatggtggtcgctgccttgaggtcgaaggacacagactctgccactgccccgtgggatacacaggcgctttctgcgacgtggacactaaggcctcctgttacgacggcagagggctatcgtaccgcggcctggccagaacgacgttatctggagccccctgccagccctgggcgtcagaggctacatacagaaacgtaactgcagaacaggcaaggaattggggactcggagggcacgccttttgccgcaacccagacaacgatattcggccatggtgctttgtgctgaaccgcgaccggttgtcgtgggaatactgcgacttggctcaatgtcagacaccgacacaggccgcaccccccacaccagtctcccctagacttcacgtgcccctcatgcccgcacaacctgctccgcctaagcctcagccaaccacgagaacaccaccccagtcccagacccctggcgccctgccagcgaagcgcgaacagcccccatcacttacccgcaatgggcctttatcctgcggtcaacggttgcgtaagagtctgagctccatgacccgcgttgtggggggactcgtggcccttaggggcgctcatccttacatcgcggctctttattggggccattcattctgcgcagggagccttatcgccccttgctgggtactcacggcggcgcactgcctccaggaccgccccgctccggaagatttgaccgtagttttagggcaagagcggcgcaatcacagttgtgaaccatgccagacacttgctgtccgcagctatcggctgcatgaagccttctctccggttagttatcagcacgatcttgccctattgagactgcaggaggatgcagacggctcgtgtgcgttgttatcaccctacgtgcaaccagtctgcctcccaagtggtgccgcccggccaagcgagaccactctttgtcaggtggctggatggggtcatcaatttgaaggagctgaagagtatgccagcttcctacaagaggcgcaggtgccctttctttcgctggaacgctgttccgctcccgacgtgcacggttcatcaatattgccagggatgctgtgtgctggcttcctggaagggggaactgatgcatgccagggtgacagtggcggcccgctggtgtgcgaggatcaggcggcggaaaggcggctgaccctgcagggcataattagctgggggtccggctgcggcgatcgaaacaagccaggtgtgtataccgacgttgcttattacctggcctggattcgcgagcacactgtgtcc

SEQ ID NO: 249789 - DNA, 1845 bp, Artificial Sequence
  Description of Artificial Sequence: Synthetic coding sequence
atgcgcgccctcctcctgctgggttttctgctggtgtcactcgaatcaacgctctcgatccccccgtgggaagctccgaaggaacacaagtacaaggcggaagagcatactgtcgtgttgactgtgaccggcgaaccatgccacttcccctttcagtaccatcgccagctgtaccataaatgtacccacaagggccggccgggaccccagccttggtgtgcaactaccccgaacttcgaccaggaccaacggtggggctactgtctggaaccaaagaaggtgaaggaccattgcagcaagcattcgccctgccagaagggaggcacttgcgtcaatatgccaagcggaccacactgcctctgcccccagcacctcaccgggaatcattgccagaaagaaaaatgcttcgaaccacagctgctgcgcttcttccacaagaacgaaatctggtacaggacggaacaggcggctgtggcaaggtgccagtgcaagggcccagatgcgcactgccaacggctggcgtctcaggcgtgtagaaccaatccttgcctgcatggagggcgctgcttggaagtggaaggtcacaggctctgccactgcccggtgggatatactggggcgttctgcgacgtggatactaaggcgagctgctacgatggaagaggactctcctaccggggtctggctcgcaccaccctcagcggcgcgccttgccagccgtgggccagcgaggctacttatagaaatgtgaccgcggagcaggccaggaactggggactggggggacacgccttctgtagaaatccagataacgacatccgcccgtggtgcttcgtgctgaatcgggacagactctcctgggaatactgcgatcttgcccagtgtcagactccgactcaagcagcgccgccaactccagtgtcaccacggctgcatgtcccactgatgccggcgcaaccagctcccccgaagccccagccaacgaccaggaccccgccgcagtcacagacccccggagcgctccctgcaaagagagaacagccgccgtcgttgactcgcaacgggccgctgtcatgcgggcagagactgaggaagtcactgagctcgatgactagagtggtcggaggactggtggctcttcgaggcgcacatccgtacatcgcagcgctttactgggggcattccttctgtgccgggagcctgatcgctccgtgttgggtgctgactgccgcccattgcctgcaagaccgcccagccccggaagatctgactgtggtgcttggacaggaacgacgcaatcattcgtgtgaaccatgtcagactctcgccgtgcgctcgtaccgcctgcacgaagccttttccccagtatcataccagcatgacctggcgctgctcaggttgcaggaggacgcggacggatcttgcgccctcctgtcaccttacgtccaaccggtgtgcctgccgtccggagcagcacgcccgtccgagactactctctgccaggtggcgggctggggccaccagttcgagggtgccgaagagtacgcgtccttcttgcaggaggcccaggtgccgtttctttcacttgaaagatgcagcgcccctgacgtgcacggatcatccatcctgcccggcatgctctgcgccggattcttggagggtggcactgatgcctgccaaggagactcgggaggacctctcgtctgtgaggatcaggcagctgaacggcgcctcacgcttcaaggaatcatttcctggggatcgggatgcggcgatcgcaacaagcccggagtctacaccgacgtggcctactacttggcctggatccgcgaacataccgtctcc

SEQ ID NO: 249790 - DNA, 1845 bp, Artificial Sequence
  Description of Artificial Sequence: Synthetic coding sequence
atgagagctcttctgctgctgggattcctcctggtgtcactcgaatcgactctgtccatcccaccgtgggaagcaccaaaggagcataagtacaaggcagaagagcatactgtcgtgcttactgtgactggggaaccttgccacttcccgttccagtatcacaggcagctgtatcacaaatgcacccataagggtagacctggacctcagccctggtgtgcaaccacgccaaatttcgatcaggatcaaaggtgggggtattgcctcgagccgaagaaagtgaaagatcactgtagcaagcattcgccctgtcaaaaggggggaacctgtgtgaacatgccttcaggtccccattgcctgtgtccacagcatcttactggcaaccattgccaaaaggaaaagtgttttgaacctcaactgctgcgttttttccataagaatgaaatatggtatcgcaccgaacaagccgcggtggcccggtgtcaatgcaaaggaccggacgcccattgtcaacgactggcgtctcaagcatgtagaaccaatccttgtctgcacggtggaagatgtctcgaggtggaaggacatcgcctctgtcactgtcctgtgggatacactggtgccttttgcgacgtggatactaaggcttcatgctacgatgggcgaggcctgtcatacaggggtctggcacgcaccacgctctccggagcgccatgccagccttgggcgtcggaagcaacgtaccggaacgtgactgccgaacaggcgcgcaactggggccttggaggacatgcattttgcaggaacccagataacgacataagaccctggtgttttgtccttaatcgcgacagactcagctgggaatactgtgaccttgcacaatgtcaaacgcccacccaggcagcaccacctacgccagtctcccctcgcctgcatgtgccgcttatgcccgcacagcctgcacctccgaagcctcaaccaaccacccgtactcctcctcaatcgcagactccgggcgcacttcctgcaaaaagagagcagccaccaagcctcacccggaatggacctctttcgtgcgggcaacgattgagaaagtcgctgtcctccatgacccgagttgtcggggggttggtcgctctgcggggcgcgcacccatacatcgcagctctttactggggtcactcgttttgtgccggtagcctgattgcaccgtgctgggtgctgactgcagcacattgtctgcaagatagaccggcaccggaagatcttaccgtcgtgctgggacaggagaggaggaaccattcctgtgaaccgtgtcaaactcttgcagtacgctcgtaccgtctccacgaggcgttcagccctgtgtcctaccagcatgatcttgcactgctgcgcctgcaggaggacgcagatggctcgtgtgctctccttagcccatacgtccagccagtctgcctgccgtccggagcagcaagaccttctgaaactactctttgtcaagtcgccggctggggacatcaatttgaaggcgcagaggaatacgcctcgtttcttcaagaagctcaagttccttttctgtcgctcgaacgctgttcggctcccgacgtacacggttccagtattctccccggcatgctttgcgcgggttttcttgaagggggaaccgacgcctgccaaggagatagtgggggtccacttgtgtgcgaggatcaagcggcagaacggcgtctgactctccagggcattatctcttggggctccgggtgtggcgatcgtaacaaacccggagtgtacactgacgtggcctactacctcgcgtggattcgcgagcacaccgtctcc

SEQ ID NO: 249791 - DNA, 1845 bp, Artificial Sequence
  Description of Artificial Sequence: Synthetic coding sequence
atgagagcccttctcttgctgggttttctgctggtgagcctggagtccaccctgtccatacctccgtgggaagcgcctaaggagcataagtacaaggccgaagagcacactgttgtgctcactgtgaccggggaaccatgccatttcccttttcaataccaccggcagttgtaccacaagtgtactcacaagggtcggccaggtcctcagccatggtgtgcgaccacccctaacttcgatcaggatcaaaggtggggatactgccttgaacccaagaaggtgaaagatcattgttccaagcactctccttgccagaaaggaggtacttgcgtcaatatgccttccggccctcattgtctgtgccctcagcatctgaccggtaaccattgtcaaaaggagaagtgttttgagccacaacttctgcgcttttttcacaaaaacgaaatctggtatcggaccgaacaagcagcagtggcacgatgtcagtgcaagggaccagatgcacactgtcaaagacttgccagccaggcatgtaggactaacccttgccttcatggtggtagatgccttgaagtggaaggacatcggctgtgtcattgtccagtcggatacacgggtgccttctgcgatgtggataccaaagcctcctgttacgatggtaggggcctctcctaccgtgggcttgcgcgaaccaccctctccggagccccatgtcagccgtgggcgtcagaagccacgtaccgcaacgtcactgcggagcaagctcgcaactgggggcttggaggccacgcattttgtagaaacccagataatgatattagaccctggtgcttcgtcctgaatcgggacaggctgtcctgggagtactgcgatctggcacagtgccaaacccctactcaggccgctcctccaactccggtgtctccgagattgcacgtgcctctcatgccggcacagccagcaccacccaagcctcagccgaccactcggaccccgcctcaatcccagaccccaggagctctgccagcgaagagggagcaacctccttcgcttacgcgcaacggacctctgtcgtgtggtcaacggctccggaagtctctgagctcaatgactcgagtggtgggaggtcttgtggcactgaggggagcacatccttacatcgccgcattgtactggggccatagcttctgcgccggatcgctcattgccccttgttgggttctcactgcagcacattgtctccaagacagacccgcccccgaagatctgactgtggtccttgggcaggagagaaggaatcattcctgcgagccttgtcaaactctggctgtgcgctcatacagactgcatgaagcattttcccctgtctcctaccagcatgatctcgcactgcttcgcctccaggaggatgccgacggttcctgcgcactgctgtcaccctacgttcaacccgtgtgtctgccaagcggtgcagcgcgaccctccgaaaccaccctgtgtcaggtggccggctggggccatcagtttgaaggagctgaggagtacgcgagctttcttcaagaagcccaggtgcccttcctcagcctggaacgttgttcggcacctgatgtgcatggatcctcgattctgccgggaatgctgtgtgccgggtttctcgaaggaggcaccgacgcctgccagggagactcaggagggccgcttgtgtgtgaggatcaagctgctgagaggagacttaccctgcagggaatcatttcgtggggaagcggatgtggagacagaaacaagcccggagtgtacaccgatgtggcatactacctggcatggatccgagaacataccgtctcc

SEQ ID NO: 249792 - DNA, 1845 bp, Artificial Sequence
  Description of Artificial Sequence: Synthetic coding sequence
atgagggccctgctgctgctaggtttcctcctcgtctcactggagtctacactgagcatacccccttgggaagcccccaaggaacataaatataaggctgaagaacacacagttgtgcttactgtgacgggggaaccttgccattttccgttccagtatcaccgccagttgtatcacaagtgtacacacaaaggtagacctggcccccagccctggtgtgcaacaactcctaattttgaccaggatcagcggtggggctattgtttagagccaaagaaagtcaaggaccactgttctaagcattccccatgccagaagggaggtacttgcgttaatatgccaagtggtcctcattgcctctgccctcaacatcttaccgggaaccactgtcagaaagagaagtgtttcgagccgcagctgctgcggttcttccataagaacgaaatctggtaccggacagagcaagccgctgtggccagatgtcagtgtaagggtcccgatgcccactgccagcgcctggcaagccaggcatgtaggaccaatccttgtctgcacggggggagatgcttagaagtggaaggacaccgattgtgccactgcccagttggatacacaggtgcattttgcgatgtcgacactaaggcttcgtgttatgatggccggggtttgtcctacaggggtcttgcacgaactactctttcgggagctccttgccagccgtgggcatcggaagccacatatagaaacgtgacagccgaacaagctaggaattggggactgggaggccatgctttttgccgcaacccagacaacgatattagaccatggtgtttcgtgctgaaccgggaccgactcagctgggaatactgtgatcttgcgcagtgccaaacccccacgcaggcggcaccccctacccccgtgtctcctagactgcacgtgccattaatgccagcacaacctgccccccctaaaccccagcccactactaggactcctccgcagtcccagactcctggcgcccttcccgcaaagcgcgagcagccgccaagcctcaccaggaatggacctctgagttgtggacagcgactgcggaagagcctgtccagcatgacccgcgtggtcggaggcctcgtggccctgcggggggcacatccatatatcgccgccctgtattggggtcatagtttttgcgcaggttcgctaatcgccccctgttgggtgctcactgctgctcactgcctgcaggatagacctgcacctgaggacctgacagtagtgttgggccaggagcgccggaatcattcttgcgaaccctgtcaaactctagccgtgcgatcttaccggctgcatgaggccttcagccccgtgtcttatcaacacgatctggccttgttgcgcctacaggaggacgccgacggaagctgtgcccttctgtcaccttacgtccagccggtgtgcctgccatctggtgcggcacgaccgagcgaaacaactctttgtcaggtggccgggtggggacatcaattcgagggtgctgaagagtacgcatcctttctgcaggaggcacaagtgccattcctgtctcttgagcgatgctccgcacccgacgtgcatggatcttccattctaccaggcatgctctgtgcgggctttctggagggaggtaccgatgcctgccaaggagatagtggtggaccccttgtatgtgaagatcaggcagcggagcgccggctaacgcttcagggtatcatatcctgggggagcggctgcggggatcgaaataagccaggggtctacaccgatgtggcctactacctcgcgtggatccgtgaacatactgtttct

SEQ ID NO: 249793 - DNA, 1845 bp, Artificial Sequence
  Description of Artificial Sequence: Synthetic coding sequence
atgagggcgttattgctgctgggctttcttttggtgagcctcgagagtacactgagtatacctccgtgggaggcaccaaaggaacataaatacaaggcagaggaacacacggtcgtgctcactgtcacgggcgaaccatgtcacttcccatttcagtaccatcgccagctgtatcacaagtgtacgcataaaggtcggcccggccctcagccctggtgtgcaacaacccctaacttcgatcaagaccaaaggtggggttactgcctggaacctaagaaggtcaaagaccactgcagcaagcatagtccatgtcagaagggaggtacgtgcgttaacatgcccagcggaccgcattgtctctgtccccaacaccttaccggtaatcactgccagaaggagaagtgttttgaacctcaacttttgagattttttcacaaaaatgaaatttggtacagaacagaacaggcagccgtcgcacggtgtcaatgcaaagggcccgatgcccactgccaaagacttgcaagccaggcttgccgcaccaacccatgtctgcacggggggcgctgcctggaggttgagggccacaggttgtgtcactgccccgttggttatacaggggccttctgtgatgtggacacaaaagcatcttgttacgacggacgaggcctcagttaccgcggtctggcccgtaccacactgtctggagcaccctgtcagccctgggctagcgaagccacatatcggaatgtgaccgcagagcaagctaggaactggggacttggcgggcatgccttctgccgcaacccagacaatgatattcgtccttggtgctttgtgctgaatcgcgataggttgtcatgggaatactgcgatctcgctcagtgccagacacctactcaggcagccccccccactcctgtaagtccccggctacatgtaccactcatgcccgcacagcccgccccacccaagccccagccgactacgcggacccctccgcagtcccaaacccccggagcgttgcccgccaaaagagagcagcccccaagcttaacaaggaacggtccgttgagttgcggacagcggctaagaaaaagcttaagctccatgacacgcgtcgtgggcggattggtggcgcttaggggtgcccatccatacatcgcggctctctactggggtcatagcttctgtgctgggtccctgatcgctccttgttgggtcctgacagccgcacattgcctgcaggatcgccctgccccagaggacctgacagtggtactggggcaggaacggaggaaccatagctgtgagccgtgccaaaccctcgccgtgcggtcctatcgtctccatgaggcctttagccctgtgagttatcagcatgatctggcacttttgcgtctgcaggaggacgcagatggctcctgcgcattgctttccccatatgttcagcccgtgtgcctcccctccggggcagcacgcccatcggagaccaccctgtgtcaggtcgccggctggggccatcagtttgaaggagccgaggagtacgcaagcttcttgcaagaggcacaggtcccttttttatcactggaaagatgcagtgcacccgacgtccacggtagtagcattctgcccggcatgctgtgtgcaggcttcttagagggcggtaccgatgcatgtcagggcgattctggcgggccgctcgtgtgcgaggatcaggctgccgaaaggaggctaaccctgcagggcatcatctcctgggggtctgggtgtggggaccggaacaagccaggagtatacactgatgtggcgtactatttggcctggatacgggaacataccgtgtcc

SEQ ID NO: 249794 - DNA, 1845 bp, Artificial Sequence
  Description of Artificial Sequence: Synthetic coding sequence
atgagggcacttctgcttttaggatttctccttgtctcactggagtctaccctgtcaattccgccatgggaagccccgaaggaacacaagtataaagcggaggaacataccgtcgtgctgactgtaacaggggaaccttgccacttcccattccagtaccataggcaactctaccacaagtgtacgcacaagggccggcccggcccccagccatggtgtgcaactacccccaattttgaccaagaccagcgctggggatattgtctggaacccaaaaaagtgaaagaccattgttctaaacacagtccttgccagaaaggaggaacctgtgtgaatatgccaagcggaccgcactgcttatgtccgcagcatctgactggaaaccattgccagaaggagaagtgcttcgagccgcagcttctgcggttctttcataaaaacgaaatctggtataggacagagcaggctgccgtcgcccggtgtcagtgtaagggcccggacgcccattgccagcgattagcaagccaggcgtgtaggaccaacccgtgtttgcatggagggcggtgtctagaggtggagggccataggctctgccactgcccagtcggatacactggcgccttctgcgacgtagacaccaaagcatcttgctatgacggcagggggttgagttataggggactagcaagaactacactctctggagccccctgtcaaccctgggcatcagaagccacctacagaaacgtgacggctgagcaagcccgtaactgggggctgggagggcatgctttctgtaggaatccagataatgatatacggccctggtgcttcgtgctgaatagagatagattgtcatgggagtactgcgacctggcccagtgccagacccccacgcaggccgcaccacctacccccgtgtccccgagattgcacgtccctctcatgcccgcacaacctgctcctccaaaaccccagccgaccacacgcacgcccccgcaatctcagactcccggggccctgccagctaaacgagagcagcccccttcactcaccagaaatggcccattgagttgtggacagaggcttcggaagtccctctcttctatgactcgagtcgtcgggggccttgttgccctccggggggcacacccctatatcgccgcgttgtattggggtcactcattctgcgccgggagcctcattgctccctgttgggtcctgaccgcagcacactgtctacaggaccgaccggcaccagaagatctgacagttgtactaggccaagaacggcggaaccattcttgtgagccctgccaaacactggcagtgagatcttatcgcctccatgaggcattttcgcccgtgtcatatcagcatgacctggccttgttgcgtctccaagaggatgccgatgggagttgcgctctcctcagcccttacgttcagcccgtatgtcttccgagcggggccgcaagaccatccgaaaccaccctgtgccaagtggctggctgggggcatcagtttgagggagcagaggaatatgcttcattcctgcaggaggcacaggtacccttcctctctctggaacggtgctccgcccccgacgtgcatggctcctcaatcctcccaggcatgttatgcgctggatttttagagggtggaactgatgcatgccaaggagattcgggaggaccgttggtgtgcgaggatcaggccgcagagaggcgactcaccttgcagggcatcatctcatggggaagcgggtgcggagaccggaataaacctggggtgtatacagacgtagcgtactacctcgcctggattagagaacacacagtgagc

SEQ ID NO: 249795 - DNA, 1845 bp, Artificial Sequence
  Description of Artificial Sequence: Synthetic coding sequence
atgcgggctctcttgctgcttggcttcttactcgtgagtctggagtctaccctcagtatccctccttgggaagcccctaaggaacataaatacaaagccgaagaacacacagtagtacttacagttacaggcgagccctgccatttcccgttccagtatcaccggcagctgtatcacaagtgcacgcataaaggccgccccggcccacagccctggtgcgctaccacacctaatttcgatcaagaccaacgctggggctattgtcttgaaccgaagaaagtaaaggatcattgtagcaaacactcaccctgtcagaagggtggaacgtgtgtgaacatgccgagcgggcctcattgtctgtgtccgcagcatttgacaggaaatcactgccagaaagaaaagtgcttcgaacctcagcttctgcgctttttccacaaaaatgagatctggtatagaaccgagcaagcagccgttgcccgatgccagtgcaagggtcctgatgcacactgtcagagacttgcttcgcaggcctgtcggaccaacccctgcttacacgggggccgatgtcttgaagtggaggggcaccgcctctgccattgccctgtggggtacaccggcgccttctgcgatgttgatactaaagctagctgttacgacggtcggggtctgtcttacaggggcctggcgaggaccacactaagcggcgccccttgtcaaccctgggcctccgaggcaacctatcgaaatgtgaccgcggaacaggcccgaaactggggtctcggcggacacgcgttttgcagaaaccccgacaacgatatccgtccatggtgcttcgtgctaaatagagataggttgtcttgggagtattgcgatctggcgcagtgccagactcccactcaggccgccccaccaactccagtgagcccacgacttcacgtgccgctcatgccagctcagcctgccccccctaagccccaacccaccacccggacccccccacagagtcaaacaccaggggccctgccagccaagcgagaacagcccccctcgctgacacgaaacggtccactaagttgcggacagcgactccgcaagtccctgtcttccatgaccagggtggtcgggggtctggtggccctgaggggcgctcatccgtatatcgcagcactatattggggacactctttctgcgcagggtcccttatcgccccctgttgggtcttgacagccgcccattgcctgcaggaccggcccgcccccgaagatctgacagtggtactcggtcaagaacgccggaaccattcctgtgagccctgccaaactctcgctgtgcggtcttaccgcctccatgaggctttctcacccgtctcgtatcagcatgacctggctctcctgaggcttcaggaggatgccgacggcagttgtgccctcctctccccctacgtgcaacccgtgtgcctgccctctggggccgctagacccagcgaaactactctctgccaggtagcaggttggggccaccagtttgaaggcgctgaggagtatgcatcttttctccaggaggcgcaggtgccatttctgagccttgagcgctgttccgcaccggacgtgcatgggagcagcatcctaccaggcatgttgtgcgctggcttcctcgagggtggcacagatgcatgtcaaggggacagcgggggcccactggtgtgtgaagaccaagccgctgagcgacgactgacactgcaaggcattattagctgggggtcaggctgtggcgaccggaacaagccgggggtgtatacggacgtcgcttactatctggcttggattcgtgagcatacggtgtct

SEQ ID NO: 249796 - DNA, 1845 bp, Artificial Sequence
  Description of Artificial Sequence: Synthetic coding sequence
atgcgtgcgctactattattaggttttttactagtatcgctagaatcgacgctatcgataccgccgtgggaagcgccgaaagaacataaatataaagcggaagaacatacggtagtattaacggtaacgggtgaaccgtgtcattttccgtttcaatatcatcgtcaattatatcataaatgtacgcataaaggtcgtccgggtccgcaaccgtggtgtgcgacgacgccgaattttgatcaagatcaacgttggggttattgtttagaaccgaaaaaagtaaaagatcattgttcgaaacattcgccgtgtcaaaaaggtggtacgtgtgtaaatatgccgtcgggtccgcattgtttatgtccgcaacatttaacgggtaatcattgtcaaaaagaaaaatgttttgaaccgcaactattacgtttttttcataaaaatgaaatatggtatcgaacggaacaagcggcggttgcgcgatgtcaatgtaaaggtccggatgcgcattgtcaacgattagcgtcgcaagcgtgtcgaacgaatccgtgtctacatggtggtcgttgtctagaagtagaaggtcatcgtctatgtcattgtccggttggttatacgggtgcgttttgtgatgtagatacgaaagcgtcgtgttatgatggtcgtggtttatcgtatcgaggtttagcgcgaacgacgctatcgggtgcgccgtgtcaaccgtgggcgtcggaagcgacgtatcgtaatgttacggcggaacaagcgcgaaattggggtctaggtggtcatgcgttttgtcgtaatccggataatgatatacgaccgtggtgttttgttttaaatcgagatcgtttatcgtgggaatattgtgatctagcgcaatgtcaaacgccgacgcaagcggcgccgccgacgccggtatcgccgcgattacatgttccgttaatgccggcgcaaccggcgccgccgaaaccgcaaccgacgacgcgtacgccgccgcaatcgcaaacgccgggtgcgttaccggcgaaacgagaacaaccgccgtcgctaacgcgaaatggtccgttatcgtgtggtcaacgtttacgtaaatcgttatcgtcgatgacgcgtgtagtaggtggtttagttgcgctacgtggtgcgcatccgtatatagcggcgttatattggggtcattcgttttgtgcgggttcgttaatagcgccgtgttgggtattaacggcggcgcattgtttacaagatcgaccggcgccggaagatctaacggttgttctaggtcaagaacgtcgtaatcattcgtgtgaaccgtgtcaaacgttagcggttcgttcgtatcgtctacatgaagcgttttcgccggtttcgtatcaacatgatttagcgctattacgtttacaagaagatgcggatggttcgtgtgcgctactatcgccgtatgttcaaccggtatgtttaccgtcgggtgcggcgcgtccgtcggaaacgacgttatgtcaagtagcgggttggggtcatcaatttgaaggtgcggaagaatatgcgtcgtttctacaagaagcgcaagtaccgtttttatcgctagaacgttgttcggcgccggatgttcatggttcgtcgatactaccgggtatgttatgtgcgggttttttagaaggtggtacggatgcgtgtcaaggtgattcgggtggtccgctagtatgtgaagatcaagcggcggaacgacgtttaacgttacaaggtataatatcgtggggttcgggttgtggtgatcgaaataaaccgggtgtttatacggatgtagcgtattatttagcgtggatacgtgaacatacggtttcg

SEQ ID NO: 249797 - DNA, 1845 bp, Artificial Sequence
  Description of Artificial Sequence: Synthetic coding sequence
atgcgcgctctgcttctgctgggctttctgttggtatcgctcgagagcactctgtcgatcccgccgtgggaggctccaaaagaacacaaatacaaggcagaggagcatactgtggtactgactgtgaccggggagccgtgccacttcccgtttcaataccaccgccagctgtaccataagtgcacgcacaagggacggcctggtccccagccttggtgcgccacgaccccgaacttcgatcaggaccaaaggtggggttactgcctggagcctaagaaggtgaaagaccattgcagcaaacactcgccatgccagaagggaggaacctgtgtcaacatgccgtcaggcccgcactgcctttgcccacagcaccttactggaaatcactgccaaaaggagaaatgctttgaaccgcagctcctccggttcttccacaagaacgagatctggtataggactgaacaggccgctgtcgccagatgccagtgcaagggaccagacgcgcattgccagcgcctcgcgagccaggcatgccgcaccaatccttgcctgcatggagggcggtgcctggaggtggaaggccataggctctgccactgtcccgtgggttacactggagcgttttgcgacgtggacaccaaggcgtcgtgttacgatggaagaggcctgtcataccgcggcctcgcacggaccactctctcgggagcgccgtgtcaaccatgggcgtccgaagcaacctaccgcaacgtcactgccgaacaagcacgcaactggggactgggagggcacgctttttgtcgcaaccccgacaacgacatccgcccctggtgcttcgtgctcaacagggacagactgtcgtgggagtactgcgacctggcccagtgccaaaccccaacccaagcagcgccccctactcctgtctcgccgaggcttcacgtcccgttgatgccggcgcaaccggccccgccgaagccgcagccgaccactaggacgccgcctcagagccagaccccgggcgccctcccggctaagagggagcagccaccttcactcactcggaacggaccactgagctgtggacaacggcttcggaagtccctgagctccatgacgcgggtggtgggcggacttgtggccctccgcggggcgcacccttacattgccgccctctactggggccactcgttttgcgcggggagccttatcgctccttgttgggtgttgactgcagcccattgcctccaagaccggccggcgccggaagatctgactgtggtgcttggccaagaaagacgaaatcattcgtgtgaaccatgtcagaccctcgccgtgcgctcctatcgcctgcacgaagccttctccccagtttcctaccaacatgacttggctctgcttagactgcaggaggacgccgacgggtcctgcgcactgctgtccccgtacgtccaaccagtttgcctcccgtccggagcggccaggccgtccgagactactctgtgtcaggtcgccgggtgggggcatcagttcgaaggcgccgaggagtacgcgtcatttctccaggaagcacaggtccctttcctgagcctggaacgctgctcagcaccggacgtgcatggatcgagcatcctccctggaatgctttgcgccggcttcctcgaaggaggaactgacgcatgccagggcgattccgggggaccgctggtctgtgaggaccaagccgcggaacggcgcctgactctgcagggtattatcagctggggctccggatgtggggacagaaacaaaccaggggtgtacaccgacgtggcctactacctggcgtggatccgcgagcacaccgtgtcg

SEQ ID NO: 249798 - DNA, 1845 bp, Artificial Sequence
  Description of Artificial Sequence: Synthetic coding sequence
atgcgtgcactgctcttgctcggctttcttcttgtatctcttgagtctactttgagcattcccccctgggaggcgcccaaggagcacaagtacaaggccgaggagcatacggttgtgctgacagttacgggcgagccctgtcacttcccattccagtaccacaggcaactttatcacaagtgtacacacaaaggccgaccgggaccccagccctggtgtgccacaacccctaatttcgaccaggatcaaagatggggctactgcctggagccaaagaaggtcaaggaccattgctctaagcactctccctgtcagaagggcgggacttgcgtgaacatgccttctggcccccactgtctgtgcccccagcatttgactggaaaccactgccagaaagaaaagtgttttgaaccccagcttctgcgctttttccacaagaacgaaatttggtatcggaccgagcaggccgccgtggcccgctgccagtgtaagggcccggatgcccattgccaacggctagcctcccaggcttgtagaactaatccatgtcttcatggagggcgctgcctcgaggtggaggggcaccgtctatgccattgtcctgtgggatacaccggggccttttgtgatgtggacaccaaggcctcttgttatgatggccgaggactctcttaccgtgggctggctcgtacaactctaagtggcgcaccgtgccagccatgggcatctgaggccacatacagaaatgtcacagcagagcaggcacgtaattggggcctggggggacacgctttctgcagaaaccccgacaacgacattcgtccttggtgcttcgtccttaatagggaccggctttcatgggaatactgtgacctcgcccaatgtcaaacacctacacaggccgctcctcctaccccggtctccccccggctgcatgttccactgatgcccgcacagcctgcccctccaaagccacagcccacaacccgcacacccccccagtcacagactccgggcgctcttcccgctaagagagagcagccgcccagcctgacccgcaacggacctctaagctgcggacagcggctgcgcaagtcattatcatctatgacccgtgttgttggagggcttgtagccctgcgcggggcacacccctacattgcggcgctatattggggtcacagcttttgtgcaggtagcctgatcgcaccctgctgggttctaaccgcagcacactgcctgcaggatcgcccggccccagaggacctgactgtcgtcctgggacaagaaagacgcaaccactcctgtgagccctgccaaacgctggcggtccgaagctaccggctgcacgaggcattcagtcctgtcagttaccagcacgatctggccctcctcaggctacaggaagacgccgatggttcatgcgctcttctgagcccttatgtccagcccgtgtgcctgcctagtggggcagcaagacctagtgaaactacactatgccaggttgccgggtggggacaccagtttgagggagcggaagagtacgcatccttcttgcaggaggcacaggtgccgttcctgagcctggaaaggtgcagtgcgcccgatgtccatggtagttcaatccttccaggcatgctgtgcgctggtttcctggaaggcgggacggacgcgtgccagggagacagcggcgggccactggtgtgcgaagatcaggcggccgaacgaagattgacactgcagggtatcatatcatggggcagtggatgtggggacagaaacaagcccggggtctataccgatgttgcatactacttggcctggattcgcgaacacaccgtctct

SEQ ID NO: 249799 - DNA, 1845 bp, Artificial Sequence
  Description of Artificial Sequence: Synthetic coding sequence
atgcgggccttgctgctccttggatttctcctggtgtcactcgagtccacgctgtcaatccctccatgggaggctcctaaagaacataagtacaaggcggaggagcataccgtcgtgttgactgtgactggagaaccgtgccactttccttttcagtaccacaggcagctgtaccacaaatgtactcacaagggccgcccaggaccacagccatggtgcgcaaccacccccaactttgatcaagaccagcgctggggatactgtctcgaaccgaagaaagtcaaggaccactgctcaaagcactcgccgtgccagaaaggcgggacttgcgtgaacatgccgagcggaccgcactgtctctgcccccaacatctgaccgggaatcattgtcagaaggaaaagtgtttcgaaccgcagttgctcagatttttccataagaacgagatctggtatcggacggagcaggcagctgtcgctcggtgccaatgcaagggaccggacgctcactgccagcgcctggcatcccaggcatgccggaccaacccatgtctgcacggaggacggtgcctggaggtggaaggacacagactttgtcactgcccagtgggctataccggcgccttttgtgatgtggacacgaaggcctcgtgctacgatggacgcggactgtcttaccgaggcctggcacggactacgctctcgggcgctccatgccagccgtgggccagcgaagccacctacagaaacgtgactgccgaacaggctcggaattggggcctcggaggacacgccttttgtcggaacccggacaacgacatccggccgtggtgttttgttctgaaccgcgatagactgtcctgggagtactgcgacctggcccagtgccagaccccgactcaagccgcgcctcctaccccagtgtctccccgcctgcatgtgccactcatgccagctcaaccggcgccgcctaaacctcagcccaccactaggactccgccacagtcacaaacccccggagcgctgcccgcgaagcgggaacaaccaccttctctgacccggaacggccctctctcctgtggacagcggctgagaaaatccctgtcaagcatgactcgggtggtgggagggctggtcgcactgcggggcgcccacccgtacatcgcggccctgtactggggacattccttctgcgcgggatccctgatagccccatgctgggtgctcaccgccgcccattgcctgcaggacaggccggcccctgaggacttgacggttgtgctgggacaagaacgcagaaaccacagctgcgaaccctgccaaaccctggcggtgcgctcatatagactgcatgaggcgttctcgccagtgtcgtaccaacatgatttggcactcctgagacttcaggaagatgcggacggtagttgtgcactgctctcgccgtacgtgcagccggtgtgcctgccttccggggcggccagaccgtcagaaaccaccttgtgccaggtggccgggtggggtcaccagttcgaaggtgcggaggagtacgcgtcgttcctgcaagaggcgcaggttccattcctgagtttggaacgctgcagcgccccagatgtgcacggatcgagcatcttgccgggtatgctgtgcgctggatttctggaaggcggtactgacgcttgccagggggactcggggggcccgctggtctgcgaagatcaagcagcggagcgtaggctgacgctccagggaatcatttcgtggggaagcggctgtggcgatcggaacaagcctggcgtctacactgatgtggcctactacctggcttggatccgcgaacacaccgtgtct

SEQ ID NO: 249800 - DNA, 1845 bp, Artificial Sequence
  Description of Artificial Sequence: Synthetic coding sequence
atgagagcccttctcctgctgggattcttgctggtgtcactggagtccactctcagcatcccaccgtgggaagcgccgaaagaacacaaatacaaagctgaagaacatactgtggtcctgaccgtcaccggagagccgtgccacttcccgttccagtaccatcgccagctgtaccataagtgcactcataagggacgccctggtcctcaaccttggtgcgccacgactccgaacttcgatcaggaccagagatggggatactgcctggaaccgaagaaagtcaaggaccactgctcgaagcactcgccgtgccagaagggcggcacttgcgtgaacatgccttcggggccacattgcctgtgcccccagcaccttacgggaaaccactgccaaaaggagaagtgctttgagcctcaactgctcaggttcttccacaagaacgaaatctggtaccgcaccgaacaggccgcggtggcgaggtgccagtgcaagggccctgatgcccattgccagcggcttgcgtcacaggcatgtcggaccaatccttgcctgcacgggggacgctgccttgaagtggaaggacatcggttgtgtcactgtcctgtgggatacactggggcgttctgtgacgtggacactaaggctagctgctacgatggacgcggcctgtcctacagaggactggctcgcaccaccctgtccggagcaccgtgccagccttgggcttcggaagcaacttaccgcaatgtgaccgccgaacaagcgagaaattggggcctcggaggacacgcgttctgccgtaatccagataatgacatcagaccttggtgcttcgtgctgaatcgagacagactctcctgggaatactgcgacctcgcccagtgccagactcccactcaagccgcgccccctacgcctgtctcaccacgcttgcatgtcccgcttatgcctgcgcaacctgccccgccgaagccccagccgactacgcgcactccaccgcaatcgcaaaccccaggagcactgccagccaagagggaacaaccgccaagcctcacccgaaacggtccgctgtcctgcggccagcgcctccggaagagcctgtcctctatgactagggtggtcggaggactcgtagcgctccggggagcacatccatacatcgctgccctgtactggggccattctttctgcgctggatcactgatcgcaccgtgctgggtgttgaccgctgcccactgcctccaagatcggcctgcgcccgaggacttgaccgtggtgttgggacaggagagacgcaaccattcgtgcgagccatgccagacgctggccgtgcggtcctaccggctgcatgaagcattctctcctgtgtcgtaccagcatgacctcgccctgctgagactgcaagaggatgctgacggatcctgcgcgttgctgagcccatacgtccaacctgtctgcctgccgtccggggcggctcggccctccgaaactaccttgtgtcaagtcgcgggatggggacatcagttcgagggtgccgaggagtacgcctcgtttctgcaggaggcccaagtcccgtttttgagcctggagaggtgctccgcgcccgatgtccatggctcgtccatcctgccgggaatgctgtgtgcagggtttctggagggaggaaccgatgcctgccagggggactccgggggacccctggtctgcgaggaccaggcagctgaaaggcggctcaccttgcagggcatcatttcctggggatcgggctgcggtgaccggaacaagccaggggtgtacaccgacgtggcatattacctggcttggatccgggagcacactgtgtcg

SEQ ID NO: 249801 - DNA, 1845 bp, Artificial Sequence
  Description of Artificial Sequence: Synthetic coding sequence
atgcgggccctacttctgctgggctttcttctcgtgtcactggaatcaaccttgagcatcccaccctgggaagcccctaaagagcataaatacaaggcagaggagcacactgttgtcctgaccgtgaccggggaaccctgtcatttcccatttcagtaccaccgccagctctatcataagtgtacacacaaaggcaggcctggaccacagccttggtgtgccacaaccccaaatttcgatcaggaccaacgctgggggtattgcttggaacccaaaaaagtaaaggatcattgttccaaacacagtccctgccagaagggaggtacctgtgtgaacatgccttccgggccccactgcctgtgtcctcagcacttgaccgggaaccattgtcagaaggagaaatgcttcgaaccgcaactcctacggtttttccataaaaatgagatatggtataggacagagcaggccgcagtggcccggtgccagtgcaaaggaccggatgcgcactgtcagcggcttgcctctcaggcttgcagaaccaatccttgtctgcacggcgggcggtgcttggaagtggagggacaccggctctgccattgtcctgtcggctatacgggtgcattctgtgacgtggataccaaagcttcttgctatgatggtagaggcctgtcatacagagggttggccaggaccactttgagtggtgccccatgtcagccttgggcttctgaggccacttacaggaacgtgaccgcagagcaggcgcgaaactggggactgggcgggcacgcgttctgcagaaacccggataacgatatccgaccttggtgcttcgttctgaatagggacagattgtcttgggagtactgcgatctggcccagtgtcagactcccacacaggccgccccaccgacccccgtgagccctcgcctgcacgttccattgatgccagcacagccggctcccccgaagccccaacctacaacccgtacaccaccacagagtcaaacaccaggagctctcccagctaaaagggagcagccaccttcactcactaggaacggccccctgagctgtggacagcggctccggaagtcactcagtagcatgacaagagtggtcggaggactggttgccttgcgcggtgcacacccttacatagccgcactctattggggtcattctttctgtgcaggctctctaatcgctccctgctgggtgctcaccgctgcccactgcttgcaagaccggcctgctccggaagacctgacggtagtcttgggacaggagaggagaaaccactcttgtgagccttgtcagaccctcgcagtgcgatcttatcgcctccatgaggcgttctcgcccgtctcgtaccagcacgatcttgccctgctgcggctccaagaggatgcagatggatcatgcgctttgctgagtccgtatgtgcagccagtttgcctgcctagcggtgccgcacgaccatccgagacaactctatgtcaggtcgccggctgggggcatcagtttgagggtgccgaagagtacgctagcttcctgcaagaagctcaggtccccttcctgtcactggaacgatgctccgcccccgatgtgcatggttcatccatcctgcctggaatgttatgtgccggatttctggaaggcggcaccgatgcgtgccagggtgatagtggaggcccgctggtgtgcgaggatcaggccgccgagaggagactgacgcttcagggaattatctcttggggctcgggctgcggcgataggaacaagcccggtgtttacacagacgtcgcctactacctcgcttggatccgtgagcacacggtgtct

SEQ ID NO: 249802 - DNA, 1845 bp, Artificial Sequence
  Description of Artificial Sequence: Synthetic coding sequence
atgcgtgccctgttgctgttgggctttctgctggtgtcgcttgaatcaaccctgagtattccgccatgggaagctcctaaagaacataagtacaaagctgaggaacacactgtagtactgaccgtgactggcgagccctgccatttccccttccagtaccatcgacagctttaccataaatgcacacacaagggtcgtcccgggccccaaccttggtgcgccactacccccaacttcgaccaggatcagcggtgggggtactgtctcgaaccgaagaaagttaaagatcactgttctaaacatagcccttgtcagaagggcgggacatgtgtgaatatgccctccgggccgcactgcttgtgcccacagcatctgacagggaaccattgtcagaaagagaaatgctttgaaccacagttgctgcgtttttttcacaagaatgaaatctggtatcggacagaacaggcggcagttgccaggtgtcaatgcaagggtcctgacgctcactgtcagagactagcctctcaggcctgccgtaccaatccttgcctccatggagggcgatgcctggaggtggaaggacatcggctctgtcattgccctgtcggctacacaggcgccttctgcgatgtggatacaaaagctagttgctacgatggaagaggcctgtcttacagaggattggcaagaacaacactttccggcgccccatgccagccatgggcatcggaagccacttaccgaaacgtgaccgcagaacaggcccgaaattggggcctcgggggacacgctttctgcaggaatcccgacaacgatattcgtccttggtgttttgttctaaacagggaccgcctgtcttgggagtattgcgatctggctcagtgtcagactcctacacaggccgctccccccacccccgtgtccccacgactccacgtccctctgatgcccgcgcagcctgctcctccaaagccacagccaacaacccggacccctccacagagtcagactcccggagccctccctgcaaagagggaacagcccccttcactgacaaggaacggaccactgtcatgcggccagagacttcgcaaatcgctgtcaagcatgacgcgtgtggtgggcggtctcgtggcactgcgaggggcacatccttacatcgcggctctgtattggggacatagcttctgcgccgggtccctaatcgcaccttgttgggtgttaactgcagctcactgtttgcaagatcggccagccccagaagacctgacggtggtccttggccaagaacgacggaaccacagctgcgagccatgtcaaaccctggcggtgaggtcatacaggctgcacgaagcattcagtcccgtctcgtaccagcatgatctggccctcctgcgactgcaggaagacgccgatgggtcttgtgcgctgctcagcccctatgtgcagcccgtctgcctgccatctggtgccgcaaggccttccgagactacactctgtcaggtggctggatgggggcaccaattcgaaggcgccgaagaatatgcgagcttcctgcaggaagcgcaagtgccatttttgagccttgaaagatgcagcgctcctgatgtccacggcagctcaatcctcccaggtatgctttgcgcgggttttctggaaggcggaaccgacgcctgtcagggagactcaggtggcccactggtgtgcgaagaccaggcagctgagaggcgactgacccttcagggaatcatcagctggggtagcggctgtggtgacagaaataagcccggagtgtatactgacgtcgcttactatctggcttggatcagagaacacactgtatcc

SEQ ID NO: 249803 - DNA, 1845 bp, Artificial Sequence
  Description of Artificial Sequence: Synthetic coding sequence
atgcgcgcactgctgctcctgggtttcttgctggtgtccctggagtcgactttgagtatcccgccgtgggaggcaccgaaggagcacaaatacaaggcagaggaacacactgtggtcctgacggtgactggcgagccatgccacttcccatttcagtaccatcgccaactctaccataagtgcacccacaaagggcggcccggcccacaaccgtggtgcgccaccacgccgaactttgaccaggatcaacggtggggatactgcctcgaacctaaaaaggtcaaggatcactgtagcaaacattcaccgtgtcagaagggaggaacctgtgttaacatgccaagcggcccacattgcttgtgccctcaacatcttacgggcaaccattgccagaaagagaagtgctttgaaccacaactccttcggttcttccacaagaatgagatttggtaccgcactgaacaggctgctgtggccagatgccagtgtaaaggaccggacgcccactgtcagcggcttgcatcgcaggcgtgccggaccaacccatgccttcacggaggccgctgtttggaggtcgaagggcaccgcctgtgtcactgcccggtcgggtataccggagcgttctgtgatgtggacactaaggcctcgtgttacgacggccgaggactgtcctaccgcggactggcgcgaactaccctttcgggcgctccttgtcagccctgggcctcagaggccacttaccgaaacgtgaccgctgaacaggccagaaattggggtcttggaggacacgcgttttgccgcaatcctgataacgacatccgtccatggtgcttcgtgctcaacagggataggttgtcgtgggagtactgcgacctggcacagtgccagactcctactcaagctgccccgcctactccggtatctccaaggcttcatgtaccactgatgccggcacagccggcgccgccgaaaccgcaacccacgaccagaaccccgccgcaatcccaaactcctggcgccctgccggccaagcgggaacaacccccgtcactgactagaaatggccctctttcctgcgggcagaggctcaggaagagcctgtcctccatgacccgcgtggtgggcggcctcgttgccctgaggggggcgcacccctacattgctgctctgtactggggccacagcttttgcgccggatccctgatcgcaccatgctgggtgctcactgctgcccattgcctgcaggacagaccggcgcccgaagatcttaccgtggtcctcggacaagagcggagaaaccacagctgtgaaccgtgccagaccctggccgtccgatcgtatcgtctccacgaagcattctcacctgtttcgtaccaacatgacctggccctgctgagactgcaggaggacgctgacggaagctgcgctctgctctcaccatacgtgcaaccagtgtgtctgccaagcggagctgcgcgccccagtgaaaccactctgtgccaggtggccggctggggacaccagttcgagggcgccgaagaatacgcatcattcctccaggaggcccaggtcccgttcctgtcgcttgaaagatgctcagcaccggacgtccatgggagctcgatcttgccaggcatgctgtgcgcgggattcttggaagggggtaccgatgcgtgccagggcgactcgggaggaccgctggtgtgcgaagatcaagcggcagaacggcgactcactttgcagggcatcatcagctggggttccggatgcggggatcgcaataagccgggagtgtacacggacgtggcctactacctggcctggatccgggagcacactgtcagc

SEQ ID NO: 249804 - DNA, 1845 bp, Artificial Sequence
  Description of Artificial Sequence: Synthetic coding sequence
atgcgtgcactcctcctgctcgggtttctgcttgtgagcctggaatctaccctgtcaatccccccgtgggaggcgccgaaggaacataagtacaaggctgaagagcatacggttgtcctcactgtgaccggtgagccttgccacttccctttccagtaccacagacagctttaccacaagtgcacccacaagggcagaccgggaccacagccttggtgcgccaccacccccaacttcgatcaggaccagagatggggatactgtctcgaaccgaaaaaggtgaaagaccactgttcgaagcattcaccgtgccagaaaggcggtacctgtgttaacatgcctagcggaccgcattgcctctgcccacagcacctcacggggaatcattgtcagaaagagaaatgctttgaaccgcagcttctgcgctttttccataagaacgaaatttggtacagaactgaacaagccgcggtggcgcgatgccagtgcaaaggacctgacgcccactgccaaagactggcgtcccaggcttgccgcaccaatccatgcctgcacggaggacgctgcctggaggtcgaaggtcatagactctgccattgcccggtcgggtacacgggtgcattctgcgacgtggataccaaggcgagctgctatgacgggcggggactgagctaccgggggttggcccgcaccactctgtcaggagcaccttgccagccatgggctagcgaggctacttacagaaacgtgactgcagaacaagctcggaactggggattgggtggacatgctttctgccggaacccagataatgatatcagaccgtggtgctttgtcttgaaccgcgaccgcctgtcatgggagtactgcgacctggcccaatgccaaacgccgacccaagccgcaccgccgacgcctgtgtctccccgtctgcatgtgcccctgatgccggctcagccagcacccccaaagccccagccgaccactaggactcctccgcaaagccaaactcccggagcactgccggcaaagcgggagcagccgccgtccctgacccggaatggaccgctctcctgcggacaaagactgcggaagtccctgtcctcaatgactcgggtggttggaggtctggtggctctccgcggcgctcacccatacatcgccgctctgtactggggacactcattctgcgcgggttcacttatagcgccctgttgggtcctgaccgcggcccattgcctgcaggatcgccctgccccagaggatctcactgtggtgctcggccaggagcgccgcaatcactcctgtgaaccatgccagaccctggccgttcgcagttaccggctccatgaggctttctcccctgtctcttatcagcacgatctcgccctcctgagactgcaagaggacgccgacgggtcgtgtgctcttctgtcgccttacgtgcaacctgtgtgcctgccatcaggagctgcaagaccgagcgagactaccctgtgccaggtggccgggtggggacaccagtttgagggtgctgaagaatacgccagctttctccaggaagcccaagtgccgttcctttcactcgaacggtgttcggcgcccgatgtgcacggatcatccatcttgccaggcatgctctgcgcaggcttcctcgaaggaggaaccgacgcttgtcagggagactcaggcggaccgctggtctgtgaggatcaggccgctgaacggaggctcacgcttcagggcatcatcagctgggggtccggatgcggggataggaacaagccgggcgtgtatactgatgtggcatactaccttgcgtggattcgagagcataccgtgtca

SEQ ID NO: 249805 - DNA, 1845 bp, Artificial Sequence
  Description of Artificial Sequence: Synthetic coding sequence
atgcgcgctctgcttctgttgggattcctcttggtaagcttggaaagcacactgagtattcctccttgggaagcgcctaaagaacataagtataaggcagaagaacacacagtagttttgactgtgactggtgagccctgtcactttcccttccaataccatcgccagctgtatcataaatgtactcacaagggcagaccgggaccacaaccctggtgcgcaacgacacccaacttcgaccaggaccagaggtggggatattgtctcgagccgaaaaaggtgaaggatcactgctccaagcatagcccatgccaaaaaggaggcacatgcgtgaatatgcccagcggaccccattgtttgtgcccacagcacttgaccggcaaccattgtcaaaaggagaagtgcttcgagcctcagttgctgagatttttccacaagaatgagatttggtatagaaccgagcaggccgccgtagctaggtgtcaatgcaagggtcctgacgctcactgccagagattggcaagtcaggcatgtcgcaccaacccatgccttcacggcggccgctgtctggaggtggaaggccatcgcttgtgccactgccctgtgggttatactggtgccttctgtgacgttgataccaaagcttcctgctacgatggtaggggtctgtcttacagaggtttggcccgcacaaccctttccggtgccccttgccagccttgggcgtcagaagccacttaccgcaacgtcacggcagagcaggcgagaaactggggcctgggcggtcacgccttctgcaggaaccccgacaatgatatacgcccatggtgctttgtgctgaaccgcgacaggctgtcatgggagtattgcgacttggctcagtgccagactcctacccaagctgccccacctacacccgtgtcccctaggctgcacgtacctctgatgcctgcgcagccagctccacctaagcctcaaccgaccacaagaactcccccccagtctcagactcccggtgcattgcccgccaaaagggagcagcccccgtccctcactcgcaacggtccactttcatgcggtcagaggttgcgcaagagcctctctagtatgactagggtcgtgggtggtctggtggctctcaggggtgcccacccgtacatcgctgccctgtattggggacactccttctgtgccggctcactgatcgctccctgctgggtcctcacggctgctcactgtttgcaagataggccagcaccggaagatctgactgttgtgctgggtcaagagcgcaggaaccactcttgcgagccatgtcagactcttgccgttaggagctacaggctgcatgaagcattctcaccagtctcctatcagcacgacctcgcactcctgcgcctccaggaagacgccgatggatcttgcgccctgctgtccccgtatgtgcagcccgtgtgtttgccttccggcgcagccagaccaagcgaaaccaccctttgtcaggtcgcaggatggggtcaccagtttgagggagctgaggaatatgcatctttcctccaggaggcgcaggtgccattcctctccttggaaaggtgttctgccccggacgtccacggtagctctattttgccgggaatgctgtgtgctggcttcctggagggaggcactgacgcctgccaaggtgactctggaggtccactcgtgtgcgaggaccaggcagcggaacgcagactcaccctgcagggcatcatcagttggggtagtggctgcggagacaggaacaagcctggagtgtacacagacgtcgcctattacctggcatggatcagggagcacacagtttca

SEQ ID NO: 249806 - DNA, 1845 bp, Artificial Sequence
  Description of Artificial Sequence: Synthetic coding sequence
atgagagctctgctgctgctgggattccttctggtcagtctggaatcgactttgtccatcccaccgtgggaagcacccaaggaacacaagtacaaggccgaagagcataccgtggtgctgaccgtcactggagagccgtgtcacttcccattccagtaccatagacaactgtatcataagtgtactcataagggccgcccgggtcctcagccgtggtgcgccaccactccgaactttgaccaggatcagcggtggggatactgcctggaaccgaagaaggtgaaggaccattgttccaaacattccccttgtcaaaagggaggaacctgcgtgaatatgccttcgggaccgcattgcctgtgcccccagcatcttactggcaatcattgccagaaagaaaagtgcttcgaaccacagttgctccgcttctttcacaagaacgagatttggtaccggactgagcaggccgccgttgccaggtgtcagtgcaaaggaccggatgctcactgccagcgtcttgcgtctcaggcatgcagaaccaacccatgtttgcacggaggtcgctgcctggaggtggaggggcaccgcctgtgccactgcccggtgggatacaccggcgcgttctgtgatgtggacaccaaggcctcctgctacgatggacggggactgtcataccgaggactcgccagaactactctctccggagcaccctgtcaaccgtgggccagcgaagctacttaccgcaatgtcaccgccgaacaggcacgcaactgggggctgggcgggcatgccttttgccgcaacccggacaatgatatcagaccctggtgcttcgtgctgaacagggaccggcttagctgggagtactgcgacctcgcccagtgccagactccgactcaagccgcgcccccaaccccggtgtcgccgcggctgcatgtgccgcttatgcctgcccagccggctccaccgaagccgcagccaaccacccggaccccgcctcagagccagacgccaggtgcgctgccagccaagagagagcagcccccatcactgacccgcaacgggcccctctcctgcggacaacggctgcgcaaatcactctcatcaatgaccagagtggtgggtggactggtggcgctgcgtggagcccatccatacatcgccgcactgtactggggacattctttctgcgccggatccctgattgccccctgttgggtgctgactgctgcccattgcctgcaggacagacctgccccggaggacctgactgtcgttcttggccaggaaagacgcaatcattcatgtgagccgtgccagaccctggcagtgcggagctaccggctgcacgaagcattctcccccgtctcataccagcacgacctggcacttctgcgcctccaagaagatgccgacggatcgtgcgccctgctgtcaccgtatgtgcaacccgtgtgtctgccatccggcgccgcccgcccgtcggaaaccactctgtgccaagtcgcagggtggggacaccagttcgaaggcgcagaggagtacgccagctttctgcaagaagcccaggtaccattcctgtccctggagcgctgttcggcccctgatgtgcacggaagctcgatcctcccgggaatgctgtgtgctgggttcctggagggcggaacggacgcttgccagggagactctggagggccgctggtctgcgaggaccaggcggctgagcgccgcctgactctccagggtatcatctcgtgggggtcaggctgcggcgatcgcaacaagccgggagtgtacactgacgtggcgtactacttggcctggatccgagagcacaccgtctca

SEQ ID NO: 249807 - DNA, 1845 bp, Artificial Sequence
  Description of Artificial Sequence: Synthetic coding sequence
atgagggcccttctgctgcttggattcctcctggtgtcactggaatcaaccctgtcgatcccgccttgggaggcgccgaaggaacataagtataaggcggaggaacacactgtggtgctcaccgtgactggtgagccatgtcactttccattccaataccaccgccagctgtaccacaagtgcacccataagggccggccaggaccgcagccgtggtgtgcaaccactcctaacttcgaccaggatcaacgctggggctattgcctcgaaccgaagaaggtgaaggaccattgcagcaaacattcgccctgccaaaagggcggtacctgcgttaacatgccttccggtccacattgcctctgcccccagcaccttaccggcaatcattgccaaaaagaaaagtgcttcgagccgcagctcctgcgattcttccacaaaaatgagatttggtaccgcactgaacaagccgccgtcgcacgctgtcagtgcaagggacctgacgctcactgccagcgcctcgcgagccaagcgtgccggaccaatccttgcctgcatggaggacgctgcctcgaagtggaaggccatcgcctgtgccattgcccggtcggatacactggtgccttttgtgacgtcgataccaaagcaagctgctacgatggacgcggcctttcataccgcgggctggcccgcactacgctttcgggggctccctgccagccgtgggccagtgaggccacctaccggaacgtgacggccgaacaagcccggaactggggactgggaggacacgctttctgtagaaacccggacaacgatattagaccttggtgtttcgtgctgaatcgcgatagattgtcatgggagtactgcgacttggcacaatgccagactccaactcaggccgccccgccgactcctgtctcccctagactccatgtcccgttgatgccagcacagccggctccaccaaagccccagccgactacccggaccccgcctcagtcccaaactccgggagccctgccggcaaagagagaacagcctccatccctgaccagaaacggcccgctgtcctgtgggcaacgactgcgcaaatccctctcctcgatgacgagggtcgtcggcgggctggtggcgctgagaggagcgcacccatacatcgcggccctgtactggggacactcgttctgtgcgggatcacttatcgcgccttgctgggtgctgaccgccgcacactgcctccaagaccgtccggcaccggaggacctgaccgtggtgctgggccaggaaaggcggaaccactcttgcgaaccgtgccaaactctggcggtgcggagctacaggctgcacgaagcattctcgcccgtgtcctaccagcacgacctggctctgctcagattgcaggaagatgcagacggctcgtgcgccctcctgtccccctacgtccagcccgtctgtctgccgtcaggcgctgcacggccatcggaaaccacgttgtgtcaggtggcgggttggggacaccaattcgagggggctgaggaatacgccagctttctccaagaggcccaggtaccgtttcttagcctcgaacggtgttctgccccagacgtgcacggcagctcgatcctgccaggtatgctgtgcgctgggtttctcgagggaggaactgacgcctgccagggagatagcggaggaccgctggtgtgcgaggaccaggctgcggagcgcaggttgaccttgcaggggatcatctcatggggatccggatgcggagatcggaataaaccaggtgtttacaccgatgtggcctactacctcgcctggatccgggaacatactgtgtcg

SEQ ID NO: 249808 - DNA, 1845 bp, Artificial Sequence
  Description of Artificial Sequence: Synthetic coding sequence
atgagggccctactcctcttgggctttttgctggtgtccctggagagcaccctttctattccaccctgggaagccccaaaggaacataagtataaggcggaggaacatacagtggtccttacagtgaccggggagccatgtcatttccccttccagtatcacaggcaattgtaccacaagtgcacccataagggacgtccgggccctcagccatggtgcgcaactacgccaaactttgaccaggaccagagatgggggtactgcctggagccaaaaaaggttaaggaccactgtagcaagcactccccctgtcagaaaggtgggacctgtgttaatatgccttctgggccccattgtctttgcccacagcacctcaccggcaatcattgtcagaaagaaaaatgcttcgagccacaattgctgcgcttctttcataagaatgaaatatggtaccgcacggagcaggcagcagtggctagatgtcagtgcaaggggcctgacgcgcattgccagcgtctggcctcccaggcctgtcgcactaatccttgcctccatggggggcgatgcctggaagtggagggtcaccggctgtgccattgcccggtcgggtacactggggctttttgtgacgtggatacgaaggcaagttgttatgatggcagaggcctgtcttaccggggattagccaggactacactgtccggcgcgccatgtcagccttgggcctccgaggcgacctaccgcaatgtgactgccgaacaggcacgtaattgggggttgggcgggcacgccttttgtcgcaatcccgataatgatattcgcccctggtgctttgtgctcaaccgcgatagattgtcatgggaatattgtgatttagcacagtgtcaaaccccaacccaagctgcgcctcccacccctgtgagcccccgtctgcatgtgccactgatgcccgcccaacctgcacctcctaaaccgcagccaacaacacggacacctccacagtctcagacccctggggccctaccagcaaaaagagaacagcctccttccctcactagaaacggccctctgtcctgcgggcagcggcttaggaagagtctaagcagcatgacacgggttgttggcgggctcgtggctttgagaggcgcccacccatacatcgccgccctgtattggggtcacagtttttgcgctggttccctcattgccccatgttgggtcctgacggccgctcactgtctgcaggatagaccggcaccagaggatctcacggtggtccttggacaggagaggcgaaatcattcttgcgagccttgccaaacactcgccgtacggtcttataggctacacgaagccttttctccggtaagttatcaacatgatctagctctactacgtttgcaagaagatgctgacggaagctgtgctttgctttctccatatgtgcagccagtttgtctgccgtctggcgccgcacgcccctctgagacgacgttatgccaggtcgccgggtggggtcaccagtttgagggagccgaagagtacgccagctttctacaggaggcccaggtgcctttcttgtccctggagcggtgttcggcaccagacgtacatgggtcatcgatacttccaggcatgctgtgcgcaggattcctggaagggggcaccgacgcttgccaaggggactccggaggacccctcgtctgcgaggatcaagctgcagaaagacgcctcacactgcaaggaattatctcatgggggagtggttgtggggatcgaaataaacccggggtgtacactgacgtggcatactatctcgcctggatccgggagcacacagtttcc

SEQ ID NO: 249809 - DNA, 1845 bp, Artificial Sequence
  Description of Artificial Sequence: Synthetic coding sequence
atgcgagcgttgctgcttctcggtttccttttggtttcacttgaatcgacattgtcaattccaccatgggaagcacccaaagaacacaagtacaaagccgaagaacatacagtagtcttgacggtcaccggagaaccatgtcactttccattccagtaccatcgtcaattgtatcacaaatgtacacataaaggacgaccagggcctcagccatggtgtgcaacaacacctaactttgatcaggaccagagatggggatattgtctggaaccgaagaaggtaaaggatcattgctcgaaacattcaccgtgtcaaaaaggtggaacttgtgtgaatatgccgtccggaccgcattgtttgtgtccacagcatctgactggaaaccattgccaaaaagaaaaatgtttcgaaccacaactcttgcggttttttcataagaatgagatctggtaccgaactgaacaggcagcggttgcgcggtgccagtgtaagggaccagatgcccattgtcagagattggcttcgcaagcttgccgaaccaatccatgcctccatggcggccgttgtttggaggtggaaggacaccgactctgccactgcccagttgggtataccggtgcattttgcgatgtagatacaaaagcaagctgttatgatggcagaggattgagttataggggcttagcacggacgaccttgtcaggagccccatgccaaccatgggcaagtgaggctacttatcgaaacgtgacagcagagcaagcaagaaattggggattgggcggacacgcgttctgtagaaatccggataatgatatccgaccatggtgctttgtgctcaaccgtgatcgattatcttgggaatactgcgatcttgcacagtgtcagacacctacacaggcagcacccccaaccccagtaagcccgagattgcatgtccctcttatgccggctcagccagctccaccaaagcctcagcctactactaggactcctccacagtcacagacgccaggagctctgccagctaaaagggaacagcctcctagcttaacccggaacggaccactctcctgtggccaaagattgcgaaagagcctatcatcaatgactagagtggtggggggattggttgctctcagaggagctcatccgtacattgcagctctgtactggggacattctttttgtgcaggttcccttatcgctccgtgctgggttcttacagcagcacattgcctgcaagatcgaccagctccagaagatcttactgttgtcttggggcaagagaggcgtaatcattcatgtgaaccttgccaaacactggctgtaagatcttaccgtttgcatgaagcatttagtccggtctcttatcagcatgaccttgctttattgcggctccaagaagatgccgatggatcttgtgcactgttgtccccgtacgtacaaccggtgtgtctaccttcgggggcagctagaccatccgaaactactctatgccaagttgcaggatggggtcatcagttcgagggagcggaagaatacgcctcattcttgcaggaagctcaagttccatttctgagtctcgagagatgtagtgctccggatgtccacggctcatctatcttgcctggaatgctgtgcgctggatttttggaaggtggtaccgatgcttgtcaaggtgattccggaggcccacttgtatgtgaagatcaagctgctgaaagaagacttaccttacaagggattatcagttggggttcagggtgtggcgatcgtaacaaacccggggtgtacacagatgttgcatactaccttgcatggataagagaacacaccgtctct

SEQ ID NO: 249810 - DNA, 1845 bp, Artificial Sequence
  Description of Artificial Sequence: Synthetic coding sequence
atgcgagcacttttgttgctggggttccttctggttagcctggagagtaccctgtcaattcccccctgggaagcacctaaggaacacaagtataaagccgaggagcacacagtggttctcaccgtgacaggcgagccttgtcacttccccttccagtatcacaggcagctctatcacaagtgcactcataaggggcgccccgggccgcaaccctggtgcgccaccacgcctaactttgaccaggaccaacggtggggatattgcctggaacctaagaaggtcaaggaccattgtagtaagcattcaccctgccagaagggggggacttgcgtgaatatgccatctggcccgcactgtctttgcccccagcacttgacaggaaaccactgccaaaaggaaaagtgtttcgagccccaactcttgcgctttttccacaaaaatgagatatggtatcgcaccgagcaagccgctgtggccagatgccaatgcaaaggacctgacgcccactgccaacgtctcgcaagtcaagcttgtcggacgaacccttgtctgcatggaggccgttgtctggaggtggaaggacatcggctatgtcactgccctgtgggatacactggggccttctgcgatgtggatacaaaggccagttgctatgacggccgcggactgtcttaccgaggtctagcgagaaccaccctctcgggggcgccatgccagccgtgggcttctgaagctacatatcggaacgtaaccgccgaacaggctcgtaattggggtctgggcggacacgccttctgcagaaacccagataacgatatacgaccttggtgcttcgtgctgaaccgcgaccggcttagttgggagtactgcgacttggcccagtgtcagactccaacacaggcagctcctcctaccccggttagtccccgccttcatgtgcctctcatgcctgcccagcccgcccctcccaaaccacagccaaccacccggacccccccacagagccagacacccggtgccctgccagcgaaaagagaacaacctccctccctgaccagaaacgggccactctcttgtggacaacggctgaggaagtcactgtcttccatgactagggtggtgggagggctggttgcactaaggggagcgcacccttatatcgctgcactgtattggggccattccttctgtgcgggtagtctgatcgccccatgctgggtgctcacagctgctcattgcctgcaggacagacccgcccctgaggacctcacagttgtcttaggtcaggaacgtaggaatcactcatgcgagccctgccagactttggccgtgcggagctatagattgcacgaggcatttagccctgtcagctaccaacacgacctcgcactgcttcgattgcaagaggacgctgatggctcctgtgctctcctctctccttacgtgcagcccgtttgtcttccatcaggcgccgcccggccgtccgagaccaccctctgccaggtggcggggtggggacatcagttcgaaggcgcagaggagtacgcttcctttctgcaggaagcccaggtgccctttctgtcccttgagagatgctccgctcccgacgttcacggtagtagtatcttgcctggaatgctttgcgcggggttccttgagggtgggactgacgcctgccagggtgattccggaggccccttagtgtgcgaggaccaggccgcagagcgccgcctgactctgcagggaatcatcagttggggatcaggttgcggagatagaaataaacctggtgtatacaccgatgtggcttactatcttgcctggatccgcgagcataccgtgtct

SEQ ID NO: 249811 - DNA, 1845 bp, Artificial Sequence
  Description of Artificial Sequence: Synthetic coding sequence
atgcgtgccctgctcctgctcgggtttcttctggtatccctggagtcaaccctctctattccaccatgggaagcgccaaaagaacacaagtacaaggcagaggaacacaccgtggtgctcaccgtgaccggagagccgtgccattttccattccaataccataggcaactttaccataagtgcacccataaaggacgacccggacctcaaccttggtgtgcaactacccctaacttcgatcaagatcagcgttggggttactgccttgagcctaagaaggtgaaggatcactgtagcaaacattcgccttgccaaaagggcggtacgtgtgtgaatatgccctcaggaccacattgtctgtgtccgcaacaccttactggcaaccattgtcagaaggaaaagtgttttgaaccacaactgctgcggttttttcataagaatgaaatttggtacagaacggaacaggcagcagtggcacggtgtcagtgtaaaggtcctgacgcgcattgtcagagacttgcctcgcaggcctgtcggactaacccatgtctgcacggaggaagatgtcttgaagtggaagggcaccgactctgtcattgccctgtcgggtacacgggagctttctgtgacgtcgacactaaagcgagctgctatgatggtcggggtctgtcgtacagaggtcttgccagaactaccctgagcggtgctccttgtcaaccttgggcctcggaggccacctaccggaacgttactgcagagcaagcacgcaactggggcctggggggtcatgccttttgtaggaacccagataatgatattagaccttggtgttttgtccttaatcgcgatcgactttcctgggagtactgcgacctggcacaatgtcagactccgacccaggcagcaccacccactcctgtgtcccctaggcttcatgtgccactgatgccggcacagccagccccacccaaacctcagccaaccacccgaactccgccacagtcccagacgcccggtgccttgccggcaaagcgggaacaacctccatccctgacccgcaacggaccgctttcttgcggtcagcgcctgagaaagagccttagctcgatgacccgtgtcgtgggtgggcttgtcgcactgcgcggtgcccatccgtacattgctgctctttactggggtcactcattttgcgcaggatcactgattgcaccttgttgggtcctgactgccgcgcactgccttcaagatagacctgcccctgaagatctgaccgttgtgcttggacaggagagacgaaaccattcctgtgaaccttgtcaaaccctcgcagtgcgctcttaccgcctgcacgaagcatttagccccgtctcataccagcacgacctggcattgctgcgacttcaagaagatgcagatgggtcgtgcgcgctcctttccccttacgtgcagcctgtttgcctgcctagcggtgcagcacgaccttccgaaactactctctgtcaagttgcgggttggggtcaccaatttgagggcgccgaagagtacgcatccttcctccaggaagcacaggtccctttcttgtcccttgagcggtgttcggctcctgacgtgcatgggtcctcgattcttcctggaatgctttgtgcaggttttttggaagggggaaccgacgcatgtcagggagactcaggaggaccactggtgtgcgaggatcaagccgcggaaaggcgcctcacgcttcagggaattatctcttggggttcaggttgcggtgataggaataagcctggggtgtacactgatgttgcctactaccttgcatggatcagggaacatactgtgtcg

SEQ ID NO: 249812 - DNA, 1845 bp, Artificial Sequence
  Description of Artificial Sequence: Synthetic coding sequence
atgcgcgcccttctgttgttgggcttcttgctggtctcccttgagagcactctgtccattccgccgtgggaggcgcccaaagaacataagtataaagcagaggagcacaccgtggtactgacagttacaggcgaaccgtgccatttccccttccagtatcaccgacaactttaccacaagtgtacccacaagggtcggccgggtccgcagccgtggtgtgccactaccccgaactttgatcaggatcagcgctggggttattgtctggagcccaagaaagtcaaagatcactgctccaagcactccccctgtcagaagggcggtacttgtgtgaacatgccctctggcccccactgcctgtgcccccaacatctgactggaaaccattgccagaaggagaagtgcttcgagccccagctgctgcgcttctttcataagaacgagatttggtacagaacagagcaggccgccgtggctaggtgccagtgcaaaggcccagatgctcactgccagcgattagccagtcaggcctgccggactaacccgtgcttgcatggcggccgatgccttgaagttgagggccatcgactgtgtcattgcccagttggttacaccggagccttctgcgatgtcgatacgaaggcgagctgctacgatggacgtggcttgtcctaccgcggtctggctcgcacaacgttatccggcgccccctgccagccttgggcctccgaggccacgtataggaatgtgaccgcggagcaggcccgcaactggggcttaggcggacatgcattctgccgaaaccccgataatgatatccgtccttggtgtttcgtgcttaacagggatcgcttgagctgggagtattgtgatctggcgcagtgccagacgcccacccaagcggccccacccacccccgtctccccacgcctacatgttccacttatgcctgcgcagccagccccgccgaagccacagccgacaacacgaacaccaccacagtcgcaaacgcctggtgcgttgccagccaagcgggaacagccgccatcgctaactcgaaacggtccattgagctgcggacagcgcttgaggaaatccctgagcagcatgacgcgggtagtgggcggtctggttgccttgcgcggagcccacccgtacatcgctgctctttattggggacatagcttctgcgcaggctccttgattgcaccttgctgggttttgaccgccgcgcactgcctgcaggatcgacccgcaccggaggatctgactgtggtcctcggacaggagcggcgaaatcactcgtgtgagccatgtcagacgttagctgtccgctcgtatcgccttcacgaggccttctccccagtgtcgtaccaacacgaccttgccttgctgcgcctgcaggaggacgcagacggttcctgcgcccttctgtcaccttatgttcagcctgtgtgcctgccttccggcgccgctcgccccagcgagacaactctgtgccaggtcgcaggatggggccatcagttcgaaggcgctgaggagtacgcttcgtttcttcaggaagcccaagtcccgttcttgtccctggaacgttgctccgctccggatgttcacggatcctccatcctgccgggtatgctgtgcgcgggcttcctggaaggcggaacagacgcatgccagggtgattcgggcggaccgttggtttgcgaggatcaggccgccgaacgccggctgacgttgcaaggcatcatatcttggggctctggctgcggcgaccgtaacaagcccggcgtctacacagacgtagcttattatctggcatggatacgggagcacaccgtgtcc

SEQ ID NO: 249813 - DNA, 1845 bp, Artificial Sequence
  Description of Artificial Sequence: Synthetic coding sequence
atgcgcgcgctgctgttgctgggtttcctgctcgtgtccctggagtccaccctgtcaatcccaccctgggaggctcctaaggagcacaaatacaaggcggaagagcatacagtggtcctgactgtgaccggagagccctgccacttcccgttccagtaccatcgacagctctatcacaaatgcacccacaaaggccgcccgggcccccagccttggtgtgccaccacacctaatttcgatcaggatcagagatgggggtattgtttggagccgaagaaggtcaaggaccattgttcaaaacattccccatgtcagaaaggggggacatgtgtgaacatgcctagcgggcctcattgcctctgtccacagcatctgacaggaaatcactgccaaaaggaaaagtgcttcgaacctcaactgttgcggtttttccataaaaatgaaatatggtaccggaccgaacaggctgccgtggcacggtgtcaatgcaagggtcctgacgcccactgccaaagattggcaagccaggcgtgtcgcactaatccatgtctgcacggtgggcgatgcctcgaggtggaagggcatcgcctgtgtcactgtccggttgggtacaccggggccttttgcgatgtggacaccaaggcttcctgctatgacggtcgggggctttcttataggggattggcacggaccaccctgtccggagcaccttgccagccgtgggcctccgaagcaacctatagaaacgtgacagccgaacaggcccggaactgggggctcggtggacacgcgttttgccggaatccagacaacgatatcaggccatggtgttttgtcttgaatcgcgatagactgtcctgggagtactgtgacctggcgcagtgtcaaacacctacccaggcagccccacctactccagtgtccccccggttgcacgtccctcttatgcctgctcaacccgccccacccaagccgcagccgaccaccaggacacctccccagtctcagactcctggtgcactgcccgccaagcgggaacagccaccctccctcacgcgcaatggcccactctcctgtggccagaggttgcgcaaaagtctctcaagcatgacccgcgtggtcggaggactggtagccctgcgaggggctcacccttatatcgcggccctctattggggacacagtttctgcgctggttccctcatcgctccctgctgggtcctgacagcagcacactgtctgcaagaccgacccgcaccggaggacctgacggtagtcctgggccaagagaggagaaatcacagctgtgagccctgccagactctggcagtgcggtcctacagactgcacgaagcctttagccccgtgagctatcagcacgacctggcattgcttcggctgcaggaggatgctgacggtagctgcgccttgcttagtccttacgtgcagcccgtctgcctgccatccggggctgcaagaccgtccgagaccacattgtgtcaggtggccgggtggggccaccagttcgagggagccgaagaatacgccagctttctccaggaggctcaggtcccattcctgagcctggagcggtgttccgcgcccgatgtgcacggctcttctatccttcctgggatgctgtgcgctgggttccttgagggtggcacagacgcttgtcagggcgatagtggtggcccactggtgtgcgaggatcaggctgccgagcgcaggcttacactgcagggaatcatcagttggggctccggctgtggcgacagaaataaaccaggggtctacacagatgtcgcgtactatctggcttggatccgggagcacacagtttcc

SEQ ID NO: 249814 - DNA, 1845 bp, Artificial Sequence
  Description of Artificial Sequence: Synthetic coding sequence
atgcgcgccctcctgttgttagggtttttgctagtgtcattggaaagcaccctgagtatcccaccatgggaagcccccaaagagcacaaatacaaagcggaagagcatacggtggtgctgacagtcactggggagccttgccatttcccatttcaatatcataggcagctgtaccataagtgtacacataaaggccggccaggtccacaaccttggtgcgctactacacctaactttgaccaggaccaaaggtggggatactgcctggaaccaaagaaggtcaaggaccattgcagcaagcattctccctgtcagaaaggcggaacctgcgttaatatgccaagcggcccacattgtctgtgtccacagcacctcacaggcaatcattgtcagaaagagaagtgctttgagccacagttgctccgattctttcataagaacgaaatatggtacaggactgagcaagccgcggtggcacgatgtcagtgcaagggccctgatgctcattgtcagaggctggcatcacaggcatgccgtaccaacccgtgcctgcatggcgggagatgcctcgaggtagaggggcaccgcttatgccactgtcctgttgggtataccggcgcgttctgcgatgtcgacaccaaggcatcctgctatgatggtagagggctcagctacaggggcttggcaaggacaacgctcagtggtgcgccctgtcaaccttgggcttccgaagcaacttatcgtaatgtaacagcagaacaggccagaaactggggactgggaggccacgccttctgtcggaaccctgataatgacatcagaccatggtgtttcgtcctgaaccgcgatcgtctgtcctgggaatactgcgacttggcacagtgtcagaccccaacccaggcagcaccgccaacacccgtttcccctcgcctgcacgtgcctctgatgcctgcgcagcccgccccacctaaaccgcagcccactactcgtacacccccacagagtcaaacccctggcgcactgcccgccaaaagggaacagccacctagccttacgagaaatggacccctgagctgtggccagaggctccggaagtctttgtcttccatgactagggtggtggggggattagtggcactgcggggggctcatccttacattgccgccctgtactgggggcactccttttgtgccggatcccttattgccccatgctgggtcttaaccgctgcccattgcttgcaggatcgtcctgcaccagaggatctgacagtcgtgttgggccaagaaaggcgcaaccatagttgcgagccctgtcagaccctcgcggtcagatcataccggctccacgaggccttcagccctgtgtcgtatcagcatgacttggcgttgcttcgattacaagaggacgctgatggaagctgtgctctgctctctccctatgtacaacccgtgtgtcttccatctggcgccgctaggcccagtgaaaccaccctgtgccaggttgcagggtgggggcaccagttcgaaggcgccgaggagtacgcctcctttctgcaggaggcccaggtccccttcctaagcttagagaggtgttccgcgcccgatgtccacggttctagtatcttaccggggatgctgtgtgctggcttcctggagggaggaacagatgcatgccaaggtgactctggcggcccactagtatgcgaggatcaagccgctgaacggcgtctcaccctgcagggcatcatatcatggggtagcgggtgcggcgatcgtaacaaaccgggcgtgtacaccgatgttgcttattaccttgcatggatccgtgagcatactgttagc

SEQ ID NO: 249815 - DNA, 1845 bp, Artificial Sequence
  Description of Artificial Sequence: Synthetic coding sequence
atgagggccctcttgctgctcggctttcttctggtcagcctcgagagcaccctgagcatccccccctgggaagcgcctaaggagcataagtataaggccgaggaacacaccgtagtacttactgtgaccggcgaaccctgccacttcccatttcagtatcaccggcagctttaccacaaatgtacccacaaaggcagaccaggcccacaaccatggtgcgccacgactcctaactttgatcaggaccaaaggtgggggtactgcctcgaacccaaaaaagtgaaggatcattgctcaaaacacagtccatgccagaaaggagggacctgtgtgaacatgccatctggccctcactgtctgtgtccacagcacctgacaggtaatcactgtcagaaagaaaagtgttttgagccacagctgctgaggtttttccacaaaaatgagatttggtaccggaccgaacaggccgctgtggcccggtgccagtgcaaggggccagacgctcactgtcagcgcctggcgagccaggcatgccgcactaatccctgtctccacggcggaaggtgcttggaggtcgaaggacaccggctgtgtcactgcccggttggatacacaggagccttctgtgatgtagatacaaaagctagttgttatgacggtcggggcttgtcctatcgaggcctggcccggactaccctgtccggagcgccctgccagccatgggcaagcgaggccacgtaccggaacgtcacagctgagcaggctaggaactggggtctgggaggacatgccttctgccgaaaccccgacaacgatatcagaccatggtgcttcgttctgaacagagaccgcctttcttgggagtactgtgatctcgcacagtgccaaacccccacacaggctgcgcctccaactccggtcagtccccggcttcatgtgcccctgatgcctgcgcagccagccccaccgaaaccgcagccaacaacacggactcccccgcagagtcagacgccgggggctctccccgctaaaagggaacaaccaccaagcctgactcgcaacggccctctcagttgcggccagcgactgaggaaaagccttagcagtatgacccgagttgtggggggtctcgttgctcttaggggcgcccacccttatatcgcagctctgtactggggccactctttttgcgctggaagtctcattgccccttgctgggttctgacagctgcacactgtctgcaggatcggcctgcgccagaagacctcacagttgtgctggggcaggaacgaaggaaccatagctgtgaaccgtgtcagaccctggccgtgagatcttaccgactgcacgaggcgttctctcccgtaagctaccagcacgacctggctctgttgaggctccaggaggatgctgacggcagctgcgccctgctctctccttatgttcagcccgtgtgcttgccgtctggcgctgcacgccctagcgagacaacattgtgtcaggtggccggttggggtcatcagttcgagggcgctgaggagtatgcaagttttctgcaagaagcccaggtacctttcctgagcctggaaaggtgttcagcccctgatgttcacggttccagtatattgcccggaatgctgtgtgctggattccttgagggagggacagacgcctgtcagggcgactctggtggcccactggtatgtgaggatcaggcagctgaacggaggttgactctgcaggggataatcagctgggggtcaggctgcggggaccggaacaagccgggggtttacacagatgtggcatattacttggcatggataagggaacacactgtttcc

SEQ ID NO: 249816 - DNA, 1845 bp, Artificial Sequence
  Description of Artificial Sequence: Synthetic coding sequence
atgcgtgcacttttgcttcttggctttctcctggtgagcctggaatccacgctgtcaatccctccgtgggaagccccgaaagaacacaagtacaaggcagaggaacacaccgtggtgctcacggtaaccggcgagccctgtcactttccttttcaataccatcgtcagctgtaccacaaatgtactcataagggtagacctgggccccaaccttggtgtgctaccacccctaactttgatcaggaccagcgttggggctactgtctggagccgaaaaaggtgaaagaccactgcagcaagcattcaccatgtcaaaagggaggaacttgtgtgaatatgccttcggggcctcattgcctttgtccacagcatctcactggtaatcactgccaaaaggaaaaatgtttcgaaccacaacttcttcgcttttttcacaaaaacgagatctggtacagaactgaacaagcagccgttgcgcgctgccaatgcaaggggccagatgcacattgccagcgcctcgcttcgcaagcatgcaggacgaacccgtgccttcatggaggaagatgtcttgaggtggaaggacatcgactttgccattgcccagtgggttataccggtgccttttgtgatgtcgacaccaaggcatcctgttacgacgggcggggactcagctatcgggggcttgctcggaccaccctgagcggcgcaccttgccaaccttgggcgtccgaggctacctatcgcaatgtcactgcagagcaagcgcgaaattggggcctgggagggcacgcattttgcagaaacccagataatgatatccgtccatggtgttttgtcctgaacagggatcgtcttagctgggaatactgtgacctggcccaatgccagactcctactcaagctgcacctccaactcctgtctcgcctcgccttcatgtccctttgatgccagcacagccagcaccgccgaagccccagccgactacccgcactccacctcagagccaaacccctggggcactgcctgccaagcgagagcaacctccctcacttaccagaaacggcccgttgtcttgtggccaacggcttcgcaagtcgctcagcagcatgacccgcgttgtgggcggtcttgtcgcattgaggggggcacatccctacattgccgcactgtactggggccattccttctgtgccggttcgcttattgccccatgctgggtgctcaccgcagcacattgcctccaggatagaccagcacctgaagatctcactgtggtcctgggtcaggaaagacggaaccattcatgtgaaccatgtcagactcttgccgtgcggtcgtaccgccttcacgaggcattttcgcccgtttcctatcaacatgatctggcgcttctgcggcttcaagaagatgccgacgggtcgtgtgcactgctgtcaccttacgttcagcccgtgtgccttccttccggagcagcgcgtccatcggaaaccactctgtgtcaagtagctgggtggggtcatcagtttgaaggagcagaggaatacgcatccttccttcaagaagcacaagtgccattcctttcgctggaaagatgtagcgcacctgacgtgcacggaagctcgattcttccaggtatgctctgcgcgggatttctggaagggggcaccgatgcatgtcaaggcgacagcggaggtcccttggtgtgtgaagatcaagcagcggaacgcagattgactttgcagggaataatctcatggggatcgggatgtggggatcgaaacaagcccggagtgtacaccgatgtcgcatactaccttgcctggatccgcgagcatactgtgagc

SEQ ID NO: 249817 - DNA, 1845 bp, Artificial Sequence
  Description of Artificial Sequence: Synthetic coding sequence
atgcgggcgctacttttgctggggtttcttctggtttcactggaaagcaccctgtcaatacccccctgggaggctcccaaagaacacaagtacaaggcagaggagcacactgtcgtactcactgttacaggagaaccttgccatttcccgttccagtatcatcggcaactctaccataagtgtactcataaaggtaggcctgggccccagccgtggtgcgcaacgacccctaacttcgaccaggatcagcggtggggatactgcctcgagccaaagaaagtgaaagatcactgcagcaaacattcaccatgccagaagggtggcacatgcgtgaatatgcctagcgggccccactgcctatgcccccagcatttaacgggaaaccattgtcagaaagagaagtgcttcgaaccccaactgctcagatttttccataagaatgaaatctggtatcgaacagagcaagccgccgtggcgaggtgccaatgcaaaggccccgacgcgcactgccagcggctggccagtcaggcttgccgaaccaacccctgtctccacgggggtagatgtctagaagtagaaggacatcgcttatgccactgtcctgtgggctacacaggcgcattctgtgacgttgacaccaaggccagctgttacgacgggagaggactttcatacaggggcctcgcccgaacaacactcagcggggcgccatgtcagccttgggcatcggaggctacatacagaaatgtgacggcagaacaagcaagaaattggggcctgggaggccatgcattctgccggaatccggacaatgacatccggccgtggtgcttcgtgctaaatcgcgatagactctcatgggagtattgcgacctggcccagtgccagactccaacccaggcggcccccccaactccggtgagtccacggttgcatgtcccccttatgcctgcccagccagccccccccaagccgcagcctacgacgaggaccccgccccaaagccagaccccaggtgctctgccagcgaaacgagagcagcctcccagcctcactcgcaatgggcctcttagttgcggtcaaaggctgcgaaaatcactgagctcaatgacaagagtggtgggcggcctggtggccttgaggggcgcacacccttacatcgctgcattgtattggggacatagtttctgtgccggctctttaatcgcaccatgttgggtcttgactgcagcacactgtttgcaagaccggcctgctccagaggatttgaccgttgttctaggccaggagcgtcgtaaccactcttgtgagccctgccagacccttgcagtgcggagttaccggcttcacgaggcctttagtcctgtgagctaccagcacgacctagcgttgctacggctgcaagaggacgctgacggaagttgcgcactgctgtctccatacgtgcagccggtgtgcctgccttccggggcagctaggccttctgaaacgacattatgtcaggtggccgggtggggacatcagttcgagggtgctgaagagtacgcctcattcctgcaggaagcccaggtgccctttttgtcactcgaaagatgctcagcccccgatgtgcatggaagcagcatcctgccaggaatgttgtgtgcaggcttcttggaaggggggacagatgcctgtcagggcgattctggaggtccgctcgtgtgcgaggaccaggcagctgaaaggagactcaccctacaggggatcatttcttggggatccggctgtggcgatcgcaataaacctggtgtttataccgatgtcgcatattatctggcgtggatcagggagcataccgtgtcc

SEQ ID NO: 249818 - DNA, 1845 bp, Artificial Sequence
  Description of Artificial Sequence: Synthetic coding sequence
atgcgtgctcttcttctccttggattccttcttgtgagcctcgaatccactctgagcatacccccatgggaagcaccaaaagagcataagtacaaggccgaggagcacactgtagtgctcactgtcactggggaaccttgtcactttccgttccaataccaccgtcagctttaccataagtgtacgcataagggtcggcctggaccgcaaccctggtgtgcaaccactccaaatttcgaccaagatcagaggtggggctattgtctggagcctaagaaggtgaaggatcattgctccaaacactcaccctgtcaaaagggcggcacgtgtgtgaatatgccatcaggaccccattgtctttgtccacagcatctcactggcaatcactgccaaaaggagaaatgttttgaaccccagcttcttcgatttttccacaagaatgagatatggtaccgtaccgagcaggcagcagtcgcacgctgccagtgtaagggccctgacgcgcattgtcagagattggcaagccaagcatgtcgaaccaatccttgcctgcatggagggaggtgtcttgaagttgaaggtcacaggctgtgccattgtccagtgggctacaccggcgctttttgcgacgtggataccaaagcgtcatgttacgatggtcgtggcctctcatacagagggctcgcaagaaccactctttcgggcgcaccgtgtcaaccttgggcctcggaggcaacttaccgcaatgtgaccgcagaacaggcacggaattggggtttgggaggacacgccttttgccgtaatccagataacgatattcgtccttggtgttttgtgctgaatcgggaccgcctttcgtgggaatactgtgatttggcgcagtgtcaaacccccacccaagcggcaccaccaaccccagtgtcgccacggctccatgtgcctctcatgccagcgcaacctgcgccaccgaaacctcaacctacgacgcgcacgccaccccaatctcaaaccccgggggcactgccagctaagcgagaacaacctccttcgctgactcgcaacggcccactttcatgcggacagaggctccgtaaatcgttgtcgtcgatgacccgggtggtgggaggattggtggcccttcggggcgcacatccttacattgccgcactgtattgggggcactccttttgtgctggatcactgattgcaccatgctgggtgcttactgccgcacattgcctgcaagatagaccggcccccgaagatttgaccgtggtgctgggacaagaaagaagaaaccattcctgtgaaccgtgccaaaccctggcagtgagaagctacagactgcatgaggcattctccccagtgtcataccaacatgatcttgcactgcttaggctgcaggaggatgcagacggttcgtgtgcactgctttccccatacgtgcagcctgtgtgtctgccttcgggcgcagcacgtccatcggagacgactctctgtcaggtggcaggctggggtcatcaatttgaaggagcggaagagtacgcctcgtttctgcaagaagcgcaggtcccttttctttcccttgagcggtgctcggccccggacgtccacgggtcatccatcctgccaggaatgctgtgtgcagggttcctggagggtggtaccgacgcatgccagggtgattcgggtggaccactcgtgtgtgaggaccaggccgcagagcgccgcctgacgcttcaaggaatcattagctggggctccggatgcggggacagaaacaagccaggtgtgtacaccgatgtggcctactacctcgcatggatccgggaacacactgtcagc

SEQ ID NO: 249819 - DNA, 1845 bp, Artificial Sequence
  Description of Artificial Sequence: Synthetic coding sequence
atgcgggcattgctgctcttgggcttccttctggtgtcgctcgagagtacactgtccatacctccatgggaggcgcccaaagaacataagtacaaagccgaagagcatacagtcgtactgactgtcaccggagagccttgtcattttccattccagtaccacaggcagctgtaccacaagtgtacccacaagggacgccccggcccccagccgtggtgtgctaccacccccaactttgaccaggatcaacgctggggatactgtctggaacccaagaaagtcaaagaccactgctcaaaacattcaccgtgccagaagggcggaacttgtgtgaacatgcctagtggaccgcactgcctgtgtccccaacatttgaccggaaaccactgtcagaaggagaaatgttttgagccgcagctgttgagatttttccacaagaacgagatctggtaccggaccgaacaggccgccgtcgctcgctgccagtgtaaggggccagatgcacattgccagaggctcgcttcacaggcttgcaggaccaatccttgcctgcatggcggtcgttgtctcgaggtggaaggccatcggctctgccattgccccgtgggatataccggggctttttgcgatgttgataccaaggcatcttgttatgatggccgcggtttaagctatcggggcttagcaagaacaactttgtctggcgccccttgtcagccgtgggccagcgaagcgacctataggaatgtgacggcggagcaggcaaggaactggggactggggggccacgccttttgccgaaacccagataacgacattagaccctggtgtttcgtgctcaacagggataggctgtcatgggagtattgtgatctggcccaatgtcaaaccccaacgcaggccgcacctcccacgccggtgtccccaaggctccacgtcccactgatgcctgcacagcccgccccgcccaaaccacagcctacaacgagaacccccccacagtcccagacacccggagccttgccagccaaacgcgagcaacccccctcattgactagaaacggaccccttagctgcggtcagaggctgaggaagagcctgtcctcgatgacacgggtggtcggtggcttagtggcactccgtggtgcccacccttatattgccgcgctgtattggggccactcattttgtgccggctcactaatcgccccttgctgggtactgaccgccgctcactgtctccaagacaggcctgcccctgaggaccttacggtcgtgctcgggcaggagcgcaggaatcacagttgtgaaccttgccaaacactagccgtgcggtcatatcggttacatgaggcgtttagccctgtgtcctatcaacatgacctggcgctgctgagactgcaagaagacgctgacggttcttgcgcgttactgtccccctacgtacagcccgtttgcctaccctccggggctgctcggcctagtgagacaacactttgccaagtagcaggctggggccatcagtttgagggtgcggaggagtatgcctctttcctgcaagaagcacaggtgccattcctatctcttgagcgctgctccgcacctgacgtccacgggagttccatcctccccgggatgctctgtgcaggctttctggaggggggtacagatgcctgccagggggattctggcggacccttggtgtgtgaggaccaagccgctgagcgacgcctcacattgcaaggaataatctcgtggggtagcggctgtggagataggaacaagccaggtgtctacactgatgttgcctattacctggcttggatccgcgaacacaccgtgtcg

SEQ ID NO: 249820 - DNA, 1845 bp, Artificial Sequence
  Description of Artificial Sequence: Synthetic coding sequence
atgcgtgctcttctattgctgggctttctcctggtctccctggaatcgacactttcaatacccccatgggaagccccgaaggagcacaagtacaaggcggaggaacataccgtggtgctgactgttacgggtgagccctgccatttcccctttcagtatcatcgtcagctctaccacaagtgtacccacaagggtcggcctggaccgcaaccgtggtgcgccacgacgccaaacttcgaccaggaccagcgctggggttactgtttggagccgaaaaaggtgaaggaccattgtagcaagcacagtccctgccaaaagggaggcacttgcgtgaacatgccgtctggccctcattgcctttgccctcagcacctcaccggcaatcattgccagaaggagaaatgcttcgagcctcaactgctccgcttcttccacaagaacgagatttggtataggaccgagcaagctgccgttgctaggtgccagtgtaaaggtcccgatgcgcactgccaacgtctggcatcccaggcctgccggactaacccgtgtctgcacggtggacgttgcctcgaggttgagggccatagactgtgccattgccccgtcggttacactggcgctttctgtgacgttgataccaaggcttcgtgttacgatggccggggtctgtcctaccgcggattggctcgtacaaccttgtctggtgctccctgtcagccctgggcttccgaggcaacctatcgcaacgtcactgctgagcaggccagaaactggggtctgggtggccacgccttctgccgcaacccggacaacgatatccgtccttggtgtttcgtgctcaacagggatcgattgtcatgggagtactgtgacctggcacagtgccaaacgccgacccaagcagcgccaccgactcctgtctcgcctcgcttgcacgtgcctttgatgccagcacagcctgcccccccgaaaccccaacccactacccgtactccgcctcagtctcagactccaggcgctctccccgctaagcgcgaacagccccctagtctaacccgcaacggtccgctcagctgcggtcagcgtctccggaagtccctgtcgtctatgaccagggttgttggtggccttgtggctctcagaggagcccacccatatattgccgctctctactgggggcattctttttgtgcgggaagtttgatcgcaccttgctgggtcctcaccgcggcacattgcctgcaggaccgcccagctccggaggacttgaccgtcgtactgggccaagagcgccgtaaccatagctgtgagccctgccagaccctcgcggtccgatcttacagattacacgaggcctttagccctgtctcttaccagcacgacctcgccctgctccggcttcaggaggatgccgacggctcctgtgcgttgctttcgccttacgttcagcctgtctgcctccccagcggtgccgctaggccctccgagacaaccctgtgtcaggtggctggctggggtcaccagttcgaaggcgctgaggaatatgcttctttcctgcaggaggctcaggtcccattcctttccctggaaagatgctctgctcctgatgtgcacggctcgtcaattctgcccggcatgctctgcgctggattcctggagggcggtactgatgcgtgccaaggcgattccggcggtcctctggtctgtgaggatcaggccgcagagcgtcgtctgactctgcaaggaattatcagttggggttctggttgtggcgaccgaaacaaacccggtgtttatacggatgtggcctattatctggcttggatccgggagcatactgtctct

SEQ ID NO: 249821 - DNA, 1845 bp, Artificial Sequence
  Description of Artificial Sequence: Synthetic coding sequence
atgcgggcactactgctcttaggtttcctcctggtctctcttgagtctacgctgtcgatacctccttgggaagcacccaaggagcataaatacaaggctgaggagcacactgtggtgctgacagtgaccggtgaaccctgccacttcccctttcagtatcaccgccagctttatcacaagtgcacacacaaaggtcggccggggccgcagccctggtgtgccaccacccccaatttcgaccaggaccagaggtggggctattgcttggagccaaaaaaggtgaaagaccattgtagcaagcattccccgtgccagaagggcggcacctgcgttaatatgccgtccgggcctcattgcctgtgccctcagcacctgacggggaaccactgccagaaggagaaatgctttgaaccccagctattacgtttcttccataagaacgaaatttggtataggacagagcaggccgcagtcgcacggtgccagtgtaaagggcccgatgcccactgtcagcgtctggcgtcacaggcttgtagaaccaacccttgcttgcacggcggacggtgtctggaggttgagggacaccggttgtgtcactgtcctgtgggctacactggcgcattctgtgacgtggacactaaagcctcctgctatgatgggcggggtctcagttacagaggcctcgctaggacaaccctgtccggagccccctgtcagccctgggccagcgaagcaacctaccgcaatgtgaccgcagagcaggccagaaactggggcctaggcgggcacgctttttgtcgcaacccagataacgacataaggccatggtgtttcgttcttaaccgcgaccggctgtcttgggaatattgtgacctggcccaatgtcaaactcctacgcaggcagcccctcccactccagtgtctcctcgcctccacgtacctctgatgcccgctcagccggccccgcccaaaccacagcctactacaaggacacccccccagtcccagacgcccggggccctgccagctaagcgagagcagcctccctcattgacccgcaacggaccccttagttgcgggcagaggctacggaagtctttgagctccatgactagggttgtcggtgggctagtcgcactccggggagcgcacccatacatcgctgccctgtattggggacattctttctgtgcaggctccctgatagctccctgttgggtgcttacggcggcccattgcctgcaggatcgaccagctccggaggacctgaccgtagtgctgggtcaagagcggcggaatcattcttgcgagccatgccagacacttgccgtgaggtcctaccgactgcacgaagccttctcaccagtgtcatatcagcacgacctagctctgttgaggctgcaggaagacgccgacgggagctgtgccttgcttagtccctacgtgcagccggtctgtctcccgtctggcgctgcaaggccgagcgagacaacactgtgtcaggtggccggctggggtcatcagttcgaaggcgctgaagaatatgcttccttcctgcaggaagcgcaggttccttttctgtcattggagcggtgcagtgctcccgacgtgcacggtagttcaattttgccaggaatgctgtgtgctggcttcttggagggtggcaccgatgcttgtcagggggacagcggcggaccactcgtgtgcgaggaccaggccgccgaacggcgactgacgctccaggggattatctcttggggtagcggctgtggcgacagaaataaaccgggagtgtatacagacgtggcttactatctggcctggatccgtgagcatactgtaagc

SEQ ID NO: 249822 - DNA, 1845 bp, Artificial Sequence
  Description of Artificial Sequence: Synthetic coding sequence
atgcgggccttgctgctgctcgggttcctgctggtgtcgttggagtccactctgtcgatccccccttgggaggcacccaaggagcacaaatacaaggctgaagaacacactgtcgtgctcaccgtgactggtgagccttgccatttcccgttccaataccatcgacaactgtatcataagtgcacgcacaagggacggccgggaccccagccttggtgcgcgaccactcctaacttcgaccaggatcagcggtggggttactgcctcgagcccaagaaagtgaaagatcactgcagcaagcattcgccttgccagaagggaggaacctgcgtgaatatgccatcgggaccacactgtctctgcccacaacacctcactggcaaccattgtcagaaggaaaagtgcttcgaaccgcagctgctccggtttttccacaaaaatgaaatatggtaccgcactgaacaagcagctgtggctcggtgccagtgtaagggaccggacgctcactgccagagactggcgagccaagcatgccgcaccaacccgtgcttgcatgggggcagatgcctggaggtggaaggtcacagactgtgccactgcccggtcggctacactggggcattttgtgatgtggacacgaaagcatcatgctacgatggcagaggcctgtcctaccgcgggttggcccgcaccacgctgtcgggagccccatgccagccatgggcatcagaagctacctacaggaacgtgacggcagagcaggcgcgcaactggggcctcggtggacacgccttctgtcggaatcctgacaacgacatccgtccatggtgttttgtgttgaacagggatcgtctgtcgtgggaatattgcgacctggcacagtgtcagacgcctacccaggcggctccgcctactccggtgtctccgagactgcacgtgccgctcatgccggcccaaccggcgccgcctaagccccaaccgaccactagaacgccgccacaatcgcagactccaggagcactgcctgcgaagcgggaacaacccccgtcgctgacccggaatggcccgctgtcgtgtgggcagcggctgcgcaagtccctctcaagtatgactagggtcgtgggaggactggtggctctcagaggcgcacatccatacatcgccgccctttactggggacattcgttctgcgcgggatctctgatcgccccttgctgggtccttaccgcggcccattgcctgcaggaccgacctgcgcccgaggacctgaccgtggtgctgggacaagagcggaggaatcactcctgcgagccgtgtcaaaccctcgcagtccgctcctacagactgcatgaggcgttctccccggtgtcataccagcacgacctcgctctgctccggctgcaggaggacgcagacggatcatgcgctttgctgtcgccatacgtccaaccggtgtgcttgccttccggcgcagccagaccgtccgaaacgaccctctgccaagtggctggctgggggcatcagttcgagggagcggaagaatatgcttcgttcctccaggaggcacaagtccccttcctgtccctggagagatgctcggcccctgacgtccatggctcctcgatcctgccgggaatgctttgcgccggatttctggaaggaggaactgatgcatgtcagggagactcgggaggccccctggtctgtgaggatcaagcagcagaacggcggctcacgctgcagggcatcatctcctggggttcgggatgcggtgacaggaacaaaccgggagtgtacactgatgttgcatactacctcgcctggattcgcgaacacaccgtctca

SEQ ID NO: 249823 - DNA, 1845 bp, Artificial Sequence; identical to SEQ ID NO: 249814
  Description of Artificial Sequence: Synthetic coding sequence

SEQ ID NO: 249824 - DNA, 1845 bp, Artificial Sequence
  Description of Artificial Sequence: Synthetic coding sequence
atgagagcactgctccttctcggctttttgctcgtgtcccttgagtcaaccctctcgatacctccgtgggaagcaccgaaagagcacaaatacaaggcggaggagcataccgtcgtgcttactgtgactggagaaccttgtcattttccttttcaatatcatcgacagctgtaccataagtgtacccacaagggtcggccaggacctcaaccgtggtgtgcaaccacgccaaatttcgaccaagatcaaaggtggggctactgtctcgaacccaagaaggtgaaagatcattgcagcaagcacagcccctgtcagaaggggggaacgtgtgtgaacatgccatcaggtcctcattgcctttgtcctcagcatctcactggtaatcattgtcaaaaggaaaaatgtttcgagccccaacttctcagatttttccacaagaacgaaatttggtaccggactgaacaggcagcagtcgcacgctgtcagtgtaagggaccggacgcacactgtcaacgtcttgccagccaggcatgtagaaccaacccctgtctgcatggggggaggtgccttgaggtggaagggcatcgcttgtgtcactgtccggtgggttacaccggcgctttttgcgatgtggatactaaagcctcctgctacgatggccgcggactttcgtacaggggactcgcaagaactacccttagcggtgcgccatgtcaaccttgggcgtcggaggccacctatcgcaacgtcacggcagagcaggcacggaactggggtctgggaggacatgccttctgtagaaacccggataatgatattcggccttggtgctttgtgctgaaccgcgatagactttcatgggagtactgcgatcttgcgcagtgtcaaactcctacccaagcggcaccgcccaccccggtttccccacggctgcacgtgcccctgatgcctgcccagcctgctcctccgaaaccacaacctactacgcgtactcccccacagtcacagaccccaggtgcattgccagcaaagcgcgaacagcctccctcgctgactcggaatggcccgttgagctgcgggcagcggcttagaaagtcactctcgtcgatgactcgagtcgtgggcggacttgtggcactgcgtggcgcccatccttacatcgcagcactgtactggggtcacagcttttgtgcaggttcccttattgccccttgctgggtcctcaccgcggcacattgccttcaagataggcccgccccggaggacctcacggtggtgcttggacaggaacgcaggaaccattcttgtgaaccatgccagactcttgccgtgcggtcatataggctgcatgaagcattctcgccagtctcgtaccagcatgatctggcgctccttcgccttcaagaggatgcggatggttcatgtgcacttctgtcgccttacgtgcaacctgtctgtctgcctagcggagcagcaagaccatctgagactactctgtgccaagtcgcaggatggggacaccaatttgaaggagctgaagaatacgcgagctttcttcaagaagcgcaggtgcccttcctcagccttgaaagatgcagcgcacctgacgtccacggttcgtccattctgccgggcatgctttgtgcaggatttctggagggaggaaccgacgcatgccaaggcgattcaggagggcctctggtgtgcgaagatcaggcagccgagcggcgcctgacccttcaaggaatcatatcgtggggatctggatgcggtgatcgaaacaagcccggagtttacactgacgtggcctactaccttgcttggattcgggaacataccgtctcg

SEQ ID NO: 249825 - DNA, 1845 bp, Artificial Sequence
  Description of Artificial Sequence: Synthetic coding sequence
atgcgcgctctgctgcttttgggatttctgctggtcagtctcgaatctaccctcagcatcccaccatgggaagcccccaaagaacataaatacaaagccgaagaacatacagtggtcttgactgtgaccggagaaccttgtcacttcccgtttcagtatcacaggcaactctaccacaagtgcacccacaagggaagacctgggccccagccttggtgtgccacaactccaaactttgatcaggaccagcggtggggatactgcctcgagcctaaaaaggtcaaagatcattgcagcaagcactcaccgtgtcagaaaggaggaacttgtgtgaacatgccctcgggcccgcattgcctgtgcccccagcacttgacaggcaatcattgccaaaaagagaagtgcttcgagccccaactgctccgtttttttcacaagaacgaaatctggtatcgcactgaacaggccgctgtcgccaggtgtcagtgcaaagggcctgatgcgcactgccagcggttggcttctcaggcctgtaggacaaacccatgccttcacggaggacggtgcctggaggttgaggggcacagactgtgccactgcccagtggggtacactggcgcattctgcgacgttgataccaaagcaagttgttatgatggaagaggtttgtcttacaggggcttggctaggacaaccctgagcggcgcgccctgccagccatgggcgtccgaggctacttaccggaacgtgacagccgagcaagctaggaactggggactgggtggacacgctttttgtaggaatcccgacaacgatatcagaccttggtgtttcgtgctaaacagagatagactgtcatgggaatactgcgacttggcacaatgccaaacccccacacaggcggccccaccaaccccagtaagccctcggctccacgtcccattgatgccggcccaacccgcaccacccaagccacaacccaccacgaggaccccaccgcaaagccaaacacccggcgcccttccagcaaagcgtgagcagcctcccagccttacccgcaacggtcccctgtcgtgcgggcaacggctgcgcaagagcttgtcaagtatgacccgagtcgtggggggcctggtggcgctcaggggcgcccacccctatatagctgccctgtattggggccactccttctgcgcaggaagcctgatcgccccctgttgggtgctgactgcagcccattgcctccaagaccgcccggccccagaggacttaacggttgttctgggtcaagagagaaggaaccacagttgcgagccatgccagaccctcgctgtgagaagctaccgcctgcacgaggcgttctcacctgtgagctatcagcacgatctggctctcctgagacttcaggaagatgctgacggaagctgtgcactgctgtccccttatgtgcaacctgtgtgcctgccgagcggagccgctcgaccatctgagaccactctctgtcaggtggctggctggggccaccagttcgaaggggctgaagagtatgcgagctttttgcaggaggcccaagtgccgttcctcagcctagagcgctgctcagccccagacgtacacggcagcagcatcctacctggcatgctgtgcgcagggtttctggaggggggcactgatgcttgccagggcgatagtggaggaccgctggtctgcgaagaccaagcagccgaaaggcgactgacactccagggcataatatcttggggcagcggctgcggcgacagaaacaagccgggagtgtatacagatgtcgcctattacctggcttggatccgcgagcacactgtgtcc

SEQ ID NO: 249826 - DNA, 1845 bp, Artificial Sequence
  Description of Artificial Sequence: Synthetic coding sequence
atgcgcgcgctcttgctgctggggttcctccttgtgtcactggaatccaccctgtccattcctccttgggaggctccgaaggagcataagtataaggcggaagaacacactgtcgtcctgaccgtgactggcgaaccatgccactttccgttccagtaccatcggcaattgtaccataagtgcacccacaagggcagaccgggaccgcaaccctggtgtgccactacgccgaacttcgatcaagaccaacggtggggttactgccttgagccgaagaaggtgaaggaccactgcagcaaacactcgccgtgtcagaaaggaggaacttgcgtgaatatgccgtcgggccctcattgtctgtgtccacagcacctgactgggaaccattgtcagaaggaaaagtgttttgaacctcaactgcttcggttcttccataagaacgagatctggtatcggaccgaacaggctgccgtcgccagatgtcagtgcaagggcccggatgctcactgccaaagactcgcgtcgcaggcctgtagaactaacccatgccttcacggaggacgatgcctcgaagtggagggacacagactgtgccactgcccggtcggatacaccggagccttttgtgatgttgacaccaaggcctcctgctacgacggacgcggactgtcgtacaggggcctggcccgcactaccctcagcggggcgccgtgccagccctgggcaagcgaagcgacctaccgcaacgtgactgcggagcaagcccggaattggggtctgggaggtcacgcgttctgccgcaacccggacaatgatatacgcccttggtgcttcgtcctgaacagagatcgcctctcctgggaatactgcgaccttgcccagtgtcagaccccgacccaggcagcgccacccaccccggtcagtccacgcctgcatgtgcctctcatgccggcccaaccggcacctcctaagccgcagcccaccactcgaaccccgccgcaatcacagacccccggcgcccttccggccaaacgcgaacaaccaccttcgctcactcggaatggcccgctcagctgcggacaacgcctccgtaaaagcctgagctccatgactcgcgtggtcggagggctggtggccttgcgcggggcgcatccttacatcgctgccctgtactgggggcacagcttctgtgcaggaagcctgatcgcgccgtgctgggtgctcaccgctgcacactgtctgcaggaccgccccgcacctgaagatttgaccgtcgtgctcggccaggaaagaagaaaccactcgtgtgagccgtgccagaccctcgccgttagatcgtatagactgcacgaagccttttcccccgtcagctaccaacatgatctcgcgctccttaggctgcaggaagatgcggacggcagctgtgccctgctgagcccatacgtacaaccagtgtgcctgccgtccggagccgccaggccatctgaaactactctgtgccaggtggcgggatggggccatcagtttgagggtgccgaggaatacgcgtcatttctccaagaggcccaggtcccgttcctgtccctcgaacgctgttccgcaccggatgtgcacggctcctcaatcctgcctggaatgctctgcgccgggttcctcgaaggcggaaccgacgcctgtcaaggtgactcaggaggcccattggtgtgtgaagatcaggcggcagagagacgcctcaccctgcagggaatcatctcctggggatccggatgcggagatcgcaacaaaccgggagtgtacaccgatgtggcttactacctggcctggatcagagaacatactgtctcc

SEQ ID NO: 249827 - DNA, 1845 bp, Artificial Sequence
  Description of Artificial Sequence: Synthetic coding sequence
atgcgggcactgctgctcctcggattcttgctggtttcacttgagtcgaccctctcgattcctccatgggaggccccgaaagagcacaagtacaaggccgaggagcacaccgtcgtcctcactgtgactggcgagccctgccattttccgttccagtaccacagacaactgtaccataagtgcactcacaagggaagacctggcccgcagccttggtgcgcgactactccgaattttgaccaggatcagagatggggttactgcctggaaccgaagaaagttaaagaccactgctcaaagcattcaccttgccagaagggtggcacctgcgtcaatatgccctcagggcctcactgtctgtgtccacagcatttgactggaaatcactgtcagaaagaaaaatgcttcgagccgcagctgttgagatttttccataagaacgagatctggtacagaaccgaacaagcagccgtcgcacgctgtcaatgcaagggccccgacgcccactgccagagacttgcgagccaggcgtgcagaacgaacccttgcctgcacgggggacgatgtctcgaagtcgagggacatcggctctgccattgcccggtgggctacacgggagcgttctgcgatgttgataccaaggcttcgtgctacgatggtcggggactgagctacaggggactggcgagaacgaccctgtccggggccccgtgccaaccttgggcttccgaagcgacctatagaaacgtcaccgcagagcaagcgagaaattggggattgggtggtcatgccttttgcagaaacccggacaacgacatcagaccatggtgcttcgtgctgaacagggacaggcttagctgggagtactgcgacctggcgcaatgccaaactcctacccaggcggcaccgcctaccccagtgtcgcctcggctgcacgtgcccctgatgccggctcagccagcaccaccgaagcctcaaccgacgacccgcaccccgcctcagtcccaaaccccaggagcattgccggccaagcgcgagcaaccgccttcccttactcgcaacggccctctgtcatgtggccagagactccgtaagtcgctgtcttccatgactagggtggtaggcggactggtggcccttcgcggagctcacccgtacatcgccgcactgtactggggtcatagcttctgcgcggggagtctcatcgctccctgctgggtgctgactgctgcccattgtctccaggaccgacctgctcctgaagacttgaccgtggtcctgggacaagagcgccggaatcactcttgcgaaccgtgtcagacccttgccgtgcgctcctaccgccttcacgaggcctttagccccgtttcctaccaacatgacctggcgctcctcagactgcaggaagacgcggatggatcgtgcgcgctcctctcaccctacgtccagccggtgtgcctgccctccggcgccgcccggccatcggagactacgctgtgccaagtggcgggatggggccaccaattcgagggagcggaagagtacgcctcattcctccaggaggcccaggtcccattcctgtccctcgaacgctgctcagctccagatgtgcatggttcatccatcctcccgggcatgctctgcgcgggctttctggagggaggcaccgacgcctgccaaggggactcgggaggtcctctggtgtgcgaagatcaggccgctgaacggagactcacccttcagggaatcatcagctggggttcgggatgcggtgaccgcaataaaccaggcgtgtacaccgatgtggcgtactacctggcctggattagggagcataccgtctcg

SEQ ID NO: 249828 - DNA, 1845 bp, Artificial Sequence
  Description of Artificial Sequence: Synthetic coding sequence
atgagagcactattgctattgggcttccttctcgtgagtttggaaagtactttgagtataccaccttgggaagcccctaaggaacacaaatacaaggccgaggaacataccgtcgtccttaccgtgaccggagagccctgccacttcccttttcagtatcacaggcagttgtaccacaagtgtacacacaagggtagacctggcccccaaccatggtgcgcaacgacaccgaatttcgatcaagaccagcgctggggatactgtcttgagcctaagaaagtgaaagatcactgtagcaaacacagcccttgtcagaaagggggaacatgcgtgaatatgccttccggcccccattgtctgtgtcctcagcacctcacaggtaatcattgtcagaaggaaaagtgtttcgaaccacagctgctgcggttttttcacaagaacgagatttggtatcgcactgagcaagctgccgtcgcccgctgccagtgcaaaggccccgatgctcactgccagcgcctggccagccaggcctgtcgcaccaatccatgtctccacggggggcgctgcctggaggtggagggacaccggctatgccattgccccgtaggatatacaggcgccttttgcgacgtagatacaaaagcatcatgctacgacggacgggggctttcctaccgtggcttggccagaacgacactctcgggggccccttgccagccttgggcaagtgaagctacctataggaacgttactgcagagcaggctcgcaattgggggctaggcggccacgccttctgcaggaatccagataacgacattcgcccgtggtgttttgtccttaaccgagaccgtctctcctgggagtactgcgatttagctcaatgccagacccctacccaagccgcccctccaactcccgtgtcaccacgcctgcacgtccccctgatgcctgcccagcctgcccccccaaaaccccagcctactacccgtactccaccacaaagccagactcccggtgcactcccagcgaaacgggagcagcccccaagcctcacaagaaatggacccttgtcttgcggacaacggttacggaagtcgctttctagtatgacaagagtggtgggcggactcgtcgccttacggggtgcccatccatatattgccgccctttactggggccacagcttctgcgctggctcccttatagccccctgctgggtccttaccgctgctcactgcttgcaggacagacccgcccccgaggacctgaccgttgtgctgggtcaggaacggaggaaccacagctgcgagccttgtcagactctagctgtgcgatcctaccgactgcacgaagccttctcgcctgtgagttaccagcatgatctggccttactacgtctccaagaagacgcggatggctcctgcgccttactcagcccctatgtgcagcctgtctgccttcccagtggcgctgcacgtcctagcgaaactactctgtgccaggtcgctggttggggacatcagtttgaaggggccgaggaatacgcctccttcctgcaagaagcccaggtccctttcctcagtcttgaaaggtgctccgcacccgacgtgcacgggagttccattttgcctggaatgctctgcgccggatttctggaggggggtaccgatgcctgtcaaggcgacagcggcggtccgctcgtgtgtgaggaccaggccgcggagaggcggctgaccctgcagggtatcatctcttggggctcagggtgtggagatcggaataaacccggggtctatactgacgtggcatattacctcgcctggatacgggaacacacggtgagc

SEQ ID NO: 249829 - DNA, 1845 bp, Artificial Sequence
  Description of Artificial Sequence: Synthetic coding sequence
atgcgagctctcctgttactcggcttcctcttggtgagtttagaatccaccttatctattccaccctgggaagctcccaaagaacataagtataaggctgaagagcacacggtggtgttgaccgtgactggagagccttgtcacttccccttccagtaccatcgacagctctatcacaagtgtacccacaaaggacgacccggccctcagccatggtgtgccactacaccaaacttcgatcaggaccagcgatggggctattgtctagagcccaaaaaggtgaaagatcattgtagcaagcattccccctgtcagaaaggtggcacttgtgtcaacatgccttctggccctcattgcctgtgcccacaacatctgaccggaaatcactgtcagaaagaaaagtgcttcgaaccacagctcctcagattcttccataagaacgagatttggtacagaactgaacaggccgctgtggccagatgtcaatgcaaggggcccgacgcacattgccagcgactagcaagtcaggcttgccgaactaatccttgcctgcacggaggaagatgtttggaggtggagggccaccgcctatgtcactgtcccgtgggctacaccggcgctttttgtgatgttgacaccaaggcatcatgctatgacggccgagggctcagctacagaggcttggctaggacaacgctgtctggcgcaccatgtcagccgtgggcgagtgaggcaacatatagaaatgtgacagcggaacaggcccgaaattggggccttggaggacacgcattctgtaggaacccagataatgatatcaggccatggtgcttcgtgctcaaccgcgaccgtctatcttgggaatattgcgacctggctcagtgtcagacacccacacaggccgcaccacccacccctgtgagcccaagattgcacgttccgttgatgccggctcagcctgctccccctaaacctcagcccaccaccaggacaccacctcagtcacagacacctggcgcgctgcctgctaagagagaacagcctcccagcctgacgaggaatgggccactgagttgcggccagagactcaggaaatctctgtcatctatgacaagagtcgtcggaggactcgtcgcccttcgaggagcccacccctacattgccgctctgtactgggggcacagcttttgcgctggctcgctgatagcaccctgctgggtgctgaccgccgcacactgtctccaagaccgacccgccccggaagatctgaccgtcgtcctgggccaagagcgccgcaaccattcttgcgagccgtgccagaccttagctgtaagaagctacagattacacgaggcgttttccccagtctcctaccagcatgacttggctcttctcagactccaggaggacgcagacggctcatgcgcactgctttccccatatgtccaaccagtctgcctcccgtctggcgcagctcgtccttcagaaactactctctgtcaggtggctggctgggggcatcaatttgagggggccgaagaatatgcatctttcctgcaggaagcccaggtaccttttctaagcctcgaacggtgcagtgcaccagatgtgcacggaagctcaatccttcccgggatgctctgtgctggtttcctggagggaggcactgatgcttgccagggagactcaggtgggccacttgtttgcgaagatcaagctgccgagcgacggttgaccttacagggcataatctcctggggctcagggtgcggggatagaaataagcccggagtgtacacagacgtagcctattacctggcctggatcagggaacacaccgtaagc

SEQ ID NO: 249830 - DNA, 1845 bp, Artificial Sequence
  Description of Artificial Sequence: Synthetic coding sequence
atgcgagcgctcctcttgttgggcttcttgctcgtaagtctcgagtccacgctctcaattccaccctgggaggcaccaaaagagcataaatacaaagccgaggagcacacggtcgtcctcactgtcaccggggaaccgtgccatttcccatttcagtaccatcgtcagctctaccacaagtgcacccataagggtcgtccaggcccccagccctggtgtgcgacgacccctaattttgatcaagaccagcgatggggttactgtctggaacccaagaaggttaaggaccattgcagtaagcactcgccatgccagaagggcggcacttgtgtgaatatgccttcagggccacattgtctgtgtcctcagcacctcacaggtaatcactgtcagaaggaaaaatgctttgagccccaacttctacgatttttccacaagaacgaaatctggtacaggacggagcaagctgcagtggctcgatgtcaatgcaaagggcctgacgctcactgtcagaggcttgcaagccaggcttgcagaactaatccttgtcttcatggcggtcggtgcctggaggttgaagggcaccggctgtgccattgtcccgtgggctatacgggcgccttttgcgacgtcgatactaaagctagctgctatgatggacgcggcctcagttatcgtggcctagctaggactaccctgtctggagcaccctgtcaaccttgggcaagcgaagcaacatacagaaatgttactgccgaacaggctagaaattggggcttaggaggccacgccttttgcaggaaccctgacaatgatattagaccatggtgcttcgtcctaaacagggatagactcagctgggagtattgcgacctggcccagtgtcagactcctacccaggctgcccccccgacacctgtttcccccaggctacatgtcccgttgatgcccgcccagcccgctccgccaaagccccagcccacgacccgcaccccaccccagagccaaactccgggtgcactgcctgcaaagagagagcagccaccatcccttactaggaatgggcccctgtcctgcggacagagactgaggaagtctctgtcctccatgacccgtgtggttggagggctggttgctctgagaggcgcacatccatatattgcagcattgtattggggtcattcattttgtgctggtagcctgatcgctccctgttgggtcttgacggctgcccactgcctccaggatcggccggcccccgaggatctgaccgtggtcctagggcaggagcgcaggaaccacagctgtgaaccgtgccagacccttgcggtgaggagctatagactgcatgaagcattctctccagtatcgtatcaacacgatctggccctgcttcggcttcaggaagatgccgacgggagctgcgcactgctaagtccctacgttcagcccgtgtgcctgccctcgggcgcagcacggccatccgagactactctctgccaggtggccgggtgggggcaccagtttgaaggcgctgaggagtatgcatcatttttgcaggaggcccaggtaccctttctcagcctcgagcgctgtagcgcacccgacgtgcatgggtcaagtatcctaccaggaatgctctgtgcggggtttttagaaggcgggacggatgcttgccagggagacagcggagggcccttggtgtgcgaggatcaggccgcagaaaggcgtctgacactgcagggtataatctcctgggggagcgggtgcggtgatcggaataagccaggggtgtacacagatgtcgcgtactatcttgcttggattcgcgagcatacagtctct

SEQ ID NO: 249831 - DNA, 1845 bp, Artificial Sequence
  Description of Artificial Sequence: Synthetic coding sequence
atgcgcgctctgttactcctaggatttcttctcgtgtcactagagagcactctgtctatccccccttgggaagctccgaaggagcataagtacaaggcagaagagcataccgtggtgctgacagtgacaggagagccttgtcattttccatttcagtaccataggcagctgtaccataaatgcacacataagggacgccccggaccccagccctggtgcgcgactactccaaacttcgaccaggatcagaggtggggttattgtttggagccaaaaaaggtgaaagaccattgctcgaagcactcaccttgccagaagggtggcacctgtgtcaacatgccatctgggccacactgtctttgtccccagcacctgaccggcaatcactgccagaaggagaaatgtttcgaacctcagctacttcgattttttcacaaaaatgaaatttggtatagaacggagcaggctgcggtggcccgttgccaatgcaaaggtcctgacgcgcattgccagaggttggcctcccaggcctgcagaacaaacccctgtttacacggggggcgatgtctagaggtggaaggtcacagattgtgtcactgtccagtgggatacaccggtgccttttgtgacgtcgacactaaagccagctgttacgacggtcgcggcttgtcatacagaggcttggctagaaccacactatcgggggccccctgtcagccctgggcttctgaagctacctatcgcaatgtgacagccgaacaggcaaggaactggggccttgggggacacgccttctgcagaaaccccgataacgacatacgaccttggtgttttgtgctcaacagggaccggctgtcatgggaatactgcgatcttgcacagtgtcagacccccactcaggccgctccccccacaccggtgtcacccagactgcacgtccctctgatgcccgctcaaccggctcccccaaagccccagcccacgacacggacgcccccacaatcccagaccccaggagccttacccgcgaagagagaacagcccccgagcctgacgcggaacggaccactctcatgtgggcagcgattgaggaagtccctgagctcaatgacccgcgtggtgggaggactggtggccctgcggggagcgcacccctatatagccgctctgtactggggtcatagcttctgcgcaggctcactgattgctccttgctgggtactgacagcagcgcattgtcttcaagacaggcctgccccagaggacctgactgtggtgctgggccaggaacgacggaaccactcgtgcgaaccctgtcagaccctggccgttcgatcatacagactgcacgaggcattctcccctgttagctaccagcatgatctggccctcctgagattgcaggaggatgctgacggcagctgtgcattgctcagcccctatgtccaacccgtgtgcctaccttcaggagctgcccggccctcagagaccacactgtgtcaagtggccggctgggggcaccaatttgaaggtgctgaggaatatgcctcattcctgcaggaagcgcaggtaccattcctgtctctcgaaagatgctcagcaccggacgtgcatggcagcagcatcttgcccggcatgctgtgtgctggattcttggaaggcgggacggacgcatgtcagggagatagcggagggcctttagtgtgtgaggaccaggcggcagagcggcgtctgaccctccagggtatcatcagttgggggtcaggttgcggagacaggaacaaaccaggggtctacactgatgtggcttactatttggcttggattcgcgaacacacggtatca

SEQ ID NO: 249832 - DNA, 1845 bp, Artificial Sequence
  Description of Artificial Sequence: Synthetic coding sequence
atgcgggctttattactcctgggcttcctcctggttagcctagagagcaccttatctataccaccctgggaggccccaaaggagcacaagtataaggccgaggagcataccgtcgtcctgactgttacaggagagccctgtcattttccattccagtaccataggcaattgtaccacaagtgcacacacaagggcaggcctggacctcagccttggtgtgcaactacccccaatttcgatcaggaccagcgctggggttactgcctggagccaaaaaaggtgaaagaccactgctctaagcattccccctgccagaagggcgggacctgcgtcaacatgccatctggcccccactgtttatgtccacagcacctaactggtaatcactgtcagaaggagaagtgctttgagcctcagctgctgagatttttccataaaaacgagatatggtacagaaccgagcaggcagccgttgctcgctgtcagtgcaagggccccgacgcccactgtcagcgcctcgccagccaggcttgcaggactaacccttgcttgcacggcggcaggtgtctggaagtggagggtcacagactttgccactgccccgtcgggtacaccggcgctttctgcgatgtggatactaaggccagctgttacgatggccgcggcctctcttatcgcggtctagctagaactactctgagtggggctccttgccaaccctgggcttctgaggccacttatagaaacgttacagccgagcaggctaggaactgggggctaggaggtcatgctttttgccggaaccctgataatgatatacggccctggtgttttgtcctaaatcgggaccggctgtcatgggagtattgcgatctggcccaatgccagacccctacccaggctgcacccccaacaccagtgagcccaaggctgcacgtgccattaatgcccgcacagcccgctcctccaaagccccagcccactacacggacaccaccccagagtcagacacctggcgccctaccagctaaaagagagcagcctcctagcctgacacggaatggcccacttagttgtggccagaggctgcgtaaaagcctctccagcatgactcgggtggttggcgggctagtggccctcaggggggcccacccttatatagccgctctgtattggggccacagcttttgcgccggtagcttaatagccccttgttgggtacttaccgctgcccactgcctgcaggatcggcctgcccccgaagatttgacagttgttctgggacaggaaagacgcaaccattcatgtgaaccttgtcagacactggccgtgcggagttatagactgcatgaggcctttagtccagtgagctatcagcatgacctggccctgctgcgcctgcaggaggacgcagatgggtcatgtgctctcttatctccatatgtgcagccagtgtgtctgccttccggtgctgcccggcctagcgagaccacattatgccaggttgccgggtggggccaccagttcgagggcgcagaagaatacgcatcctttctgcaggaggcccaggtcccctttttatctctagaaaggtgctcagccccagacgtgcacggcagctccatcctccctgggatgctgtgtgctggttttctggagggagggacagatgcatgtcagggcgatagtggggggccattagtgtgcgaagatcaggctgccgagaggcggctgaccttgcaaggcataatctcatgggggagtggatgtggggacagaaataaaccgggggtgtacaccgacgtggcttactacctggcttggattcgagaacatacagtgtcc

SEQ ID NO: 249833 - DNA, 1845 bp, Artificial Sequence
  Description of Artificial Sequence: Synthetic coding sequence
atgcgagctctgcttctgctaggcttcctcctggtctcattagagagcaccctgagtatacccccctgggaagcccctaaggagcacaagtataaagcggaagagcacaccgtcgtgctgaccgtaacgggcgaaccctgtcacttccccttccaatatcaccggcagttgtaccataagtgtacgcacaaggggaggcccggcccacagccgtggtgtgctaccacaccaaacttcgatcaggaccaaaggtggggatactgcctggagcccaagaaggtgaaggaccattgtagtaagcattctccttgtcagaagggaggaacttgcgttaatatgccgtctggacctcattgtctctgtccacagcatctaacgggaaatcactgccaaaaggagaaatgcttcgagcctcagctcctgcggtttttccacaagaacgaaatctggtacagaaccgaacaagctgctgtagcccgatgtcagtgtaaagggcctgacgcccactgtcagagactcgcgagtcaggcgtgtaggacaaacccttgcctgcatggaggtcgttgcctggaggtcgagggccacaggctttgtcactgccctgtgggatatacaggggccttttgtgatgtggacacaaaggcttcctgttatgatggccggggtttgtcatatagaggcttagcgcggaccaccctcagcggtgccccctgccagccatgggcgagtgaagccacctacaggaacgtaacggcagaacaggcaagaaactggggtttggggggacacgcattttgtagaaatccagataacgacatcagaccatggtgctttgtgcttaatcgcgatagattatcgtgggagtactgcgatcttgcacagtgtcagactcctacacaggccgccccccccacaccggtgtctcctcgtttgcacgtgccgcttatgccggcacagcccgccccaccgaaaccccaaccaacaactaggacccccccccagagccagacccccggagctctaccagcgaaacgcgaacagcccccaagcctgactagaaatggaccgctgtcatgtggacaaagactgagaaaaagcttatcgtctatgacacgggtggtggggggactagttgctcttcggggggctcatccttacatagccgcgctgtattggggtcactccttctgtgccggaagtttaatcgctccatgctgggtcttgacggccgcccactgtcttcaggatcggcccgcaccagaggatttaaccgtggtacttgggcaggaaaggcggaatcactcttgcgagccatgccagactctcgcggtgaggagctatagattgcacgaagctttctcgcccgtgagttaccagcatgatttggctctcctgcgccttcaggaagatgccgacggctcttgcgcccttctgagcccctacgtccagcccgtctgtctgccaagtggagccgcgagaccatcggagacaactctctgtcaggtggcagggtggggacatcagtttgagggcgcagaagaatacgccagctttctccaagaggctcaagtgcccttcctttcacttgagcggtgtagtgcacctgacgtccacggatcttctatcctgcccgggatgctctgcgctggcttcctggagggagggacagacgcctgccagggggacagcggcggtcccctggtctgcgaagatcaggccgccgagcgtcgattgacccttcagggcattatctcttgggggtctggctgcggcgacaggaacaaacccggcgtgtacacagatgtggcttactatttagcatggatccgggaacatacggtctcc

SEQ ID NO: 249834 - DNA, 1845 bp, Artificial Sequence
  Description of Artificial Sequence: Synthetic coding sequence
atgagggctctgctgctgctggggtttcttctggtatcactggagtcgacactttccatccctccttgggaagcgcccaaggaacacaagtataaggcagaagaacacaccgtggtgctcacggtcactggcgaaccctgccacttccctttccaatatcacaggcagttgtatcacaagtgtacccacaaagggcggccagggcctcaaccctggtgtgccacaacccctaacttcgaccaggaccagagatggggctactgtttggagccgaagaaggtcaaagaccactgcagtaagcacagtccctgccagaaaggcggcacctgcgtcaacatgcccagcggtccgcactgcctgtgccctcagcatcttacgggcaaccattgccaaaaagagaaatgctttgagccgcaacttctccggttctttcacaaaaatgaaatttggtaccgtacagagcaggctgccgttgcacgctgccaatgtaaaggaccagatgcccactgccagaggcttgccagtcaggcatgcagaacgaacccttgcctgcacggcgggcgatgcctggaggtagagggacatcgcctgtgtcattgccctgttggctatacaggcgcgttctgcgacgtggacacaaaagcctcatgctacgatggtagaggcctctcatacagaggcctagcaaggactacccttagcggcgctccatgccagccttgggcctcagaggctacgtacagaaatgtcaccgccgagcaggccaggaactggggtctgggcgggcacgccttctgtcgcaatccagacaatgacatccgtccatggtgcttcgtgttgaatcgggacaggctatcctgggaatattgcgacttggcccagtgccaaactcctacacaggcagcccctcctacaccagtatccccccgcctgcatgtccctttgatgccagcccagcctgcgccccccaaacctcagccgaccactcgaaccccgccccaatcgcagacacccggtgccctgcccgccaaacgcgaacagcccccgagcctaacccgtaatggacccctgtcctgcggccagaggttgaggaaaagcctgtccagcatgacccgggttgtgggggggttagtggcacttaggggcgcccacccctacattgccgctctgtactggggtcatagcttctgcgcaggctctcttattgccccatgttgggtgctcacggcagcccattgtcttcaggaccggcccgcccccgaagacttgacagtcgttttgggtcaggaacgcagaaatcattcatgtgagccttgccagacactggcagttcggtcatacagactacatgaggctttctcacccgtctcatatcagcatgacttggcccttctgcgattacaagaggacgctgacggtagctgtgctctgctgtcgccctacgttcagccggtctgcctgcccagcggagcagcgcgaccttcggagacaacactatgccaggttgccggctggggccaccaattcgagggggctgaggagtacgctagctttttgcaagaggcgcaggtgccctttctgagtctcgagagatgcagtgctcccgacgtgcatggatccagtatcctgcctggaatgttatgtgctggtttcctggaggggggcactgacgcatgtcagggcgacagcggaggaccattggtgtgtgaagaccaggcggccgagcggaggcttaccctgcagggcattataagctggggttcaggatgtggcgaccggaacaagcccggcgtgtatacagacgtcgcatactatttagcatggatacgtgagcataccgtaagc

SEQ ID NO: 249835 - DNA, 1845 bp, Artificial Sequence
  Description of Artificial Sequence: Synthetic coding sequence
atgcgggcgctgctcctgctgggtttcctcctcgtgtctctggagagcacgctttcaatccctccctgggaagcccctaaggagcataagtacaaggcagaagaacataccgtcgtcctcaccgtgaccggggagccgtgccacttcccattccagtaccaccggcagctctaccataaatgcacccataagggccggccaggtccccagccgtggtgcgccactactccgaatttcgatcaggaccagcgctggggatactgcttggaaccgaagaaagtgaaagaccattgctcgaagcactccccttgccagaagggaggcacctgcgtgaacatgcccagcggaccgcattgcctttgcccacagcacctcaccggaaatcactgccaaaaggagaagtgtttcgaaccgcaactgcttcgcttctttcataagaacgagatctggtatagaacggagcaagccgctgtcgccagatgccagtgtaagggcccggacgcgcactgtcagaggttggcttcgcaggcctgtagaaccaatccgtgcctccacgggggacgttgcctcgaggtggaaggccatcggctgtgccactgcccagtgggatatactggagcgttctgcgatgtcgataccaaggcaagctgttacgacggccgcggactgagctaccgcggactggcccgcactaccctgagcggcgctccgtgccaaccctgggcatcagaagccacttaccggaacgtgactgccgaacaggcgagaaattggggactcggaggacatgcattctgtcggaaccccgataacgacatcaggccgtggtgctttgtcctcaatagagatcgcctgtcgtgggagtattgcgatctcgctcaatgccaaaccccgactcaggcggccccaccgactccggtgagcccacggttgcatgtgcctctgatgccggcccagcccgcccctccgaagccccaaccaaccacccggacgccgccgcaatcgcagactccaggggcactgccagccaagcgcgagcaacccccatccctgacccgcaacggccctttgtcctgcggacagagactgcgaaagtcgctgtcaagcatgaccagagtggttggaggcctggtggcgctgaggggagcccacccgtacatcgccgctctctactggggtcactcgttttgcgctggatcgctcatcgcgccttgctgggtcctgactgcagctcattgcctgcaggatcgtcccgcgccggaggatctgacggtggtgctggggcaggaacgccggaaccactcttgcgagccatgccaaaccctcgccgtgagatcctaccggctgcacgaggcgttcagccctgtgagctaccaacatgacctcgcgctgcttcgcctccaggaggatgccgacggatcttgcgccctgctgtcgccctacgtccagccagtgtgtctgccaagcggagcagcaagaccgtcggaaaccactctgtgccaagtcgccggatggggccatcaattcgaaggggctgaggagtacgcgtcgtttctccaggaggcccaggtcccgtttctcagcctcgaacggtgctcagcgccagatgtgcacggatcttcaatcttgcctggtatgctgtgcgcaggtttcctggagggaggcactgacgcttgccaaggcgactcgggcggacctcttgtgtgcgaagatcaggccgccgaaaggcgcctgactctgcagggaatcatctcatggggatccggttgcggagacagaaacaagcctggagtctacactgatgtggcctattacctcgcgtggattcgcgagcacaccgtctct

SEQ ID NO: 249836 - DNA, 1845 bp, Artificial Sequence
  Description of Artificial Sequence: Synthetic coding sequence
atgcgggcgctcttgctgctcggtttcctgcttgtgtccctggagtctaccctctcgatcccaccttgggaagctcccaaagaacataagtacaaggccgaagagcatactgtggtgctgactgtcaccggagaaccctgccattttccgttccagtaccaccggcagttgtaccacaaatgcacccataagggacgccccggaccgcagccgtggtgtgccactactcccaacttcgaccaggatcagagatggggttactgtcttgaaccaaaaaaggttaaggaccactgctccaaacattcaccctgccaaaagggcggtacttgcgtgaacatgccttcgggtccacactgcctttgccctcaacatctcaccggcaaccactgccagaaagagaagtgttttgagccgcaactcctgaggttcttccataagaacgagatttggtacagaaccgaacaagctgcagtggcgcggtgccagtgcaagggccctgacgcgcactgtcagcgcctcgcaagccaagcctgccgcactaatccgtgcctgcacggtggacgatgtctggaagtagaagggcaccgcctctgtcactgcccggtgggatacactggagcgttctgcgatgtcgacactaaggcgtcatgctacgacggccgcggactgtcatacagaggccttgcacggaccaccctctcaggcgctccgtgtcaaccgtgggccagtgaagcaacctaccggaacgtgactgccgaacaagcccgcaattggggactgggcggtcacgccttctgtagaaatcccgacaacgacatccgcccatggtgctttgtgctgaaccgcgacaggctgtcatgggagtactgcgatcttgcccagtgtcagacccccactcaagccgctccccccacgcctgtctcgccgcgcctccacgtgcctctcatgccagcccagccagccccgccaaaaccacagcccaccacccgcaccccgccgcaatcacagaccccgggtgccctccctgcaaagagagagcaaccgccctcgcttacccggaacggtcccctttcctgcggacagcgtcttagaaagagcctctcgtcgatgactcgcgtcgtcggcggcctggtggcgctgcgcggcgcccatccgtacattgccgcactgtattggggccattctttctgcgctggatccctgatcgctccgtgctgggttcttactgcagcacattgcctccaggaccgccccgccccagaagatctgaccgtcgtcttgggccaggaacggcggaaccattcctgcgagccgtgccagactctcgcagtgcgatcgtacaggctgcatgaagcatttagcccagtctcctaccagcacgatttggccctgttgcgcttgcaggaggatgccgacggaagctgtgcgctgctgtcaccgtacgtgcaacctgtgtgcctgccgtctggcgcggctcgcccttcagagacgaccctgtgccaagtcgcgggctggggtcaccaattcgagggagcggaagagtacgcatcgttccttcaggaggcacaagttccgtttctgtcactggagagatgctccgctccggacgtccacgggtcctctatcctgccaggaatgctttgcgccgggtttctggagggcggcaccgatgcttgccagggggacagcggcggccctctggtgtgcgaagatcaggcggccgaacgccggctcacgctccagggaatcataagctggggaagcggatgcggagacagaaacaagccgggtgtgtacaccgacgtggcctactatctggcctggatccgcgagcacacggtgtca

SEQ ID NO: 249837 - DNA, 1845 bp, Artificial Sequence
  Description of Artificial Sequence: Synthetic coding sequence
atgcgggccctgctgcttctgggattcctcctggtgtcccttgaatccacactgtccattcctccttgggaagcccctaaggaacacaagtacaaagccgaggaacacactgtggtgctcacggtgaccggtgagccttgtcactttccctttcagtatcacagacagctgtatcacaagtgtacacataaaggacgcccaggtccgcagccatggtgcgcgacaacacccaattttgaccaggatcagagatggggatactgtctggaaccaaagaaggtcaaggaccattgctcaaagcattcaccatgccagaagggcggcacctgtgtcaatatgcctagcgggccgcactgcctgtgtccccagcacctaactggtaaccactgtcagaaggaaaaatgcttcgagcctcagctgttgcgattttttcataaaaatgaaatctggtaccggacagagcaggcagctgtggctcgatgccaatgcaaaggcccagacgctcactgccagcggctggcgagccaggcctgtcgcacaaacccctgtcttcacggtggcaggtgtttggaagtggaagggcataggctgtgccactgcccagtcgggtataccggtgccttttgtgacgtggataccaaggccagctgttacgatgggagaggtctgagctatcgcggcctggctcgaacaaccctgtcaggtgcaccgtgtcaaccttgggcaagcgaagcaacctatcgaaacgtgacagcggagcaggcccggaactggggactggggggacacgctttttgcaggaatcctgacaatgatatccgaccctggtgcttcgttttgaatcgcgacagactgtcatgggaatactgcgacctggcacagtgccagacacctactcaagccgcccctcccactcccgtatctccgagacttcatgtcccacttatgcctgcgcagccagcgccccctaaaccccagccaactacccggacgccccctcagagtcagactcctggagcgcttcctgcaaagagggagcagcctccgtccctgactcgaaacggacccctgtcatgcggccagcggctcaggaaatcactgtctagtatgacacgtgtcgtgggcggcctcgtagcactacgcggggcccatccttatattgctgcactgtactggggccatagcttctgcgccggttcccttatagctccgtgctgggtacttaccgcagcccattgtctccaggatcgccccgcccctgaggatctgaccgtcgtattggggcaggaacgaaggaatcactcatgcgaaccctgtcagacgctggcagtacggtcgtatcgcctgcacgaggccttctccccagtgagctaccagcacgatctggcgctgctcaggctgcaggaagacgccgatgggagctgtgcgctcctgagcccgtacgtgcaacctgtatgcttgccatcaggtgcagccagaccttccgaaactacgctatgtcaggtggccggatggggccaccagtttgagggcgccgaggagtatgcaagctttctccaggaagcccaggtgccatttttgagtttagaaagatgctcagcacctgatgtacacggctctagcattctgcccgggatgctgtgtgcaggcttcctggagggggggaccgacgcatgccagggggatagcggcgggcccctggtgtgcgaagaccaggctgctgaaagaagactcaccttgcagggtatcattagttggggctcggggtgcggagaccgcaacaagccgggcgtctatacagatgtcgcttattatctcgcttggattagggagcatacggtgtct

SEQ ID NO: 249838 - DNA, 1845 bp, Artificial Sequence
  Description of Artificial Sequence: Synthetic coding sequence
atgagagccctccttctgctcggcttcctactcgtgtctctggaaagcactctatccattcccccctgggaagcaccaaaggaacacaaatacaaggccgaggagcacaccgttgtgctgacagtgaccggagagccctgtcactttcccttccagtaccatcgacaattgtatcacaagtgcactcacaaagggcgaccaggcccccagccttggtgtgcgaccacacctaatttcgaccaagatcaaaggtggggctactgcctggagcccaagaaggtgaaagaccattgtagcaaacactccccttgtcaaaagggagggacctgtgtgaatatgccgtccggtccacattgcctgtgcccacagcacctgaccgggaaccactgccagaaagagaagtgttttgagcctcaacttttacggttttttcacaaaaacgaaatctggtacagaactgaacaggccgctgtggcgcgctgtcagtgcaaaggaccagacgctcattgtcaaaggctcgcctcacaggcttgcagaacaaacccttgcctccacggcgggagatgcctcgaggtggagggccaccggttgtgccactgcccagtgggatacacaggcgcattttgcgacgtcgacactaaagcttcttgttacgatgggaggggactttcttataggggcctggcccggacaacattgtccggggcaccctgccagccttgggccagtgaggcaacttacaggaacgtcacagctgagcaagctaggaattggggattggggggacatgccttctgccggaacccagacaacgatatccgtccttggtgcttcgtccttaaccgggatcggttatcctgggaatattgcgaccttgctcagtgtcagacccctacccaggccgctccacccacacctgtgtcacccagactccacgtcccactgatgcctgctcagccagcccctcctaaaccccaacccactaccagaacccctccccagtcgcaaacaccaggtgcattaccggctaagcgcgagcagccacctagcttgacacgtaatggccctctgtcgtgcggacagcggttacgaaagtctctgtcttctatgactcgcgtggtgggggggctggtcgccctgcgaggagcacatccttatatagctgccctgtactgggggcattctttctgcgccggatctctcattgctccctgttgggtcctgacagcggcccactgtcttcaggaccgaccggcgcccgaagatctgacagtcgtactgggacaggaacgccgaaatcacagctgtgagccgtgccaaacactcgcagtgaggagttatcgactgcacgaagctttcagccctgtgtcgtatcagcatgatctggcccttctcaggctccaggaggatgccgacggatcgtgtgcccttttgtccccttatgtccagcctgtttgtctcccaagtggggccgctcggccttccgagacaaccctctgccaggtggctgggtgggggcatcagttcgagggagccgaagagtacgcaagtttcctgcaggaggctcaggtgccattcctgagcttagaacgatgcagcgcgcctgacgtgcatggcagttccatcttacccgggatgctctgtgccgggttcctggagggtggtactgatgcctgtcaaggagactcgggaggcccactcgtgtgcgaagaccaggccgctgagagacgtttaaccctgcagggtataatctcttgggggtccggttgcggggacagaaacaagccaggagtgtatactgacgtcgcgtactacctggcttggattagagaacatacggtgagc

SEQ ID NO: 249839 - DNA, 1845 bp, Artificial Sequence
  Description of Artificial Sequence: Synthetic coding sequence
atgcgcgctctgctgctgctcggattcttgctcgtgtcgctggaatccactctctcgatcccaccttgggaagccccgaaggagcacaagtacaaggccgaagaacatactgtggtgctgactgtgaccggcgaaccgtgccacttcccatttcaataccaccggcaactctaccacaagtgcacccacaagggacgcccaggaccccagccttggtgcgccactaccccgaatttcgaccaggatcaacggtgggggtactgtcttgaacctaaaaaggtgaaagaccactgctcgaagcactccccatgccagaagggaggaacctgcgtgaacatgccgtcgggaccacactgcctctgcccacaacatctgactggcaaccactgtcaaaaggagaaatgcttcgagccacaattgctccggttcttccacaagaacgaaatctggtaccgcactgaacaggccgcggttgcccgctgtcaatgcaaaggaccagatgcacattgtcagcgcctcgcgtcgcaggcctgccggactaatccgtgccttcatggtggtaggtgccttgaagtggaaggacatagactgtgccattgccccgtggggtacaccggagccttctgcgacgtcgacaccaaggcgtcctgctacgatggccggggcctctcgtaccgcggactcgcccggacgactctgtccggcgccccgtgccagccttgggcatcagaagcaacttatagaaacgtgactgcggagcaggcgcgcaactggggactcggaggccacgcattctgccggaacccggacaacgacattagaccttggtgttttgtgctgaatcgcgatagactttcgtgggaatattgtgatctggcgcagtgccagaccccgacccaggccgcgcccccgaccccggtcagcccaaggctgcacgtgcccctgatgcccgcgcagcccgctcctccgaaaccgcaaccaaccactcggacgccgcctcagtcccagacccctggggccctgcccgcaaagcgagaacaaccgccctcgctgacgcggaatggcccactgtcatgtggacagagactccggaagtcgctgtcctcgatgacccgcgtggtggggggactcgtggctctgagaggagcccatccgtacatcgctgcgctgtactggggacacagcttctgcgccggcagcctgatcgcgccttgctgggtgctgactgccgctcattgccttcaagatcggcctgctccagaagatctgaccgtggtgctgggtcaggagcggcgcaaccactcatgcgagccgtgccagaccctcgctgtgcgctcatacagactgcatgaagcgtttagccctgtgtcgtaccagcacgatctggctctgctgagactgcaggaagatgccgacggatcctgcgctctcctgagcccatacgtgcagccggtttgcctgccgtcgggggcagcccgcccaagcgaaacgactctgtgtcaggtggcgggatggggtcaccagttcgaaggcgccgaggagtacgcgtcctttctgcaagaagcccaggtcccgttcctctcactggaacgctgttcggccccggatgtccacggatcaagcatcctgccaggcatgctgtgtgctggattcttggaagggggcacggatgcctgccagggagatagcgggggtccactcgtgtgcgaagatcaggccgcggagagaaggttgaccttgcaagggatcatcagctgggggtcaggttgtggggacaggaataagccaggcgtgtacactgacgtggcatactacctggcctggatcagggagcatactgtgtcg

SEQ ID NO: 249840 - DNA, 1845 bp, Artificial Sequence
  Description of Artificial Sequence: Synthetic coding sequence
atgcgggcactgctgctcctcgggttccttctcgtgtcactggaatccaccctgagcattcccccatgggaagcgcctaaggaacataagtataaagcggaagaacacaccgtggtgctgaccgtgactggagagccgtgccatttcccgttccagtaccacagacagctgtaccacaagtgcactcacaagggcagacctggaccacaaccttggtgcgctaccactccaaatttcgatcaggaccaaaggtggggatactgcctggagccaaagaaggtgaaagatcactgctccaagcattccccttgccaaaagggagggacttgcgtgaacatgccctccggaccacactgtctgtgcccacagcacctgacgggcaatcactgccagaaggaaaagtgctttgagccacaattgctgcgctttttccataagaatgaaatctggtacaggaccgagcaagctgccgtggccaggtgccagtgtaagggtcccgacgctcattgccagcgcctggccagccaggcctgccgcactaatccctgcctgcacggaggccgctgcctcgaggttgagggacataggctgtgccactgcccggttggatacactggcgcgttctgtgatgtggatacgaaggcctcctgttacgacgggagaggcctgtcctaccgcggactggcgcgcaccactctgtccggggcaccatgccaaccgtgggcctcagaagcaacttacagaaacgtcactgcagaacaggcgcggaactggggactgggaggacacgccttctgtcgaaacccggacaatgatatcagaccgtggtgcttcgttctgaacagagacaggctgagctgggagtactgtgacttggctcaatgccagactcccacccaggctgccccaccaacccctgtctcgccgagactgcacgtcccgctgatgcccgctcaaccggcaccgccaaagccgcagccgactacccggacccctccacagagccagaccccaggtgcgctgccggcaaaacgcgaacaacctccatcgctcactcgcaatggaccactctcgtgcggacagcggctcagaaagtccctgtcaagcatgacccgcgtggtcggtggactggtcgctctgcgcggagcccatccgtacatcgccgcactgtattggggacactcgttctgcgccggatctctcatcgctccatgttgggtcctgaccgctgctcattgcctgcaggaccggccggcgccagaggaccttactgttgtcctgggacaggagcgccgcaatcattcgtgcgaaccatgccagactcttgcagtgcggtcctacaggctgcacgaggccttctcgccggtcagttaccaacatgatctggcgttgctccgcctccaggaggatgcggatggcagctgcgccctgctgtccccgtacgtgcaaccggtctgcctgccatccggggccgcccggccttcagaaaccaccctgtgccaggtcgctggatggggtcatcaattcgagggagcagaagagtacgcatcatttctgcaagaagcccaagtcccgttcctgagcctggagcggtgttcggcgcctgacgtgcacggatcatccattctccctggaatgctgtgcgccggcttcctcgagggcgggacggacgcctgtcaaggagactccgggggaccactcgtttgtgaggaccaagcggccgagcgcagactcactctgcaaggaatcattagctggggttcgggttgcggcgaccgaaacaagcctggagtgtatactgatgtggcctactatctcgcctggatcagagaacacactgtgtcc

SEQ ID NO: 249841 - DNA, 1845 bp, Artificial Sequence
  Description of Artificial Sequence: Synthetic coding sequence
atgcgagcactgctgcttcttggtttcctgctcgtatccctggagtctaccttgagtattcctccctgggaggctcccaaggagcataaatacaaggccgaagaacacaccgtcgtgcttaccgtgaccggcgagccctgtcactttccatttcagtaccacagacagctgtaccacaagtgtacacacaagggccggcctgggccccagccctggtgtgctacaacaccaaactttgatcaggaccagcgctggggctactgcctggaacctaagaaggtgaaagaccattgttctaaacactcgccctgccagaaaggtggtacgtgtgtcaatatgccatccggcccccactgtctctgtcctcagcacctcactggaaatcattgccaaaaggagaaatgcttcgaaccgcagctgctgagattcttccacaaaaacgagatttggtaccgtacagagcaagctgctgttgcacggtgccaatgtaaaggtcccgatgcccattgccagcgcctcgcatcgcaggcgtgtcgcacaaacccatgtctccacggcgggcgctgtttagaggtggagggacacaggctgtgccactgcccggttggatatactggcgccttctgcgacgtggacacgaaagctagctgttatgacgggcgtggactctcataccgtggactggcgcggaccaccctgtctggagctccttgccagccatgggccagcgaagcgacctaccgcaacgtcaccgctgagcaggcacgaaattggggattgggtggccacgccttctgccgtaatcctgacaatgatattcggccttggtgtttcgttttaaaccgagaccggcttagttgggagtactgtgacctggcccagtgccagacccccacgcaggcagcaccccccactcccgtgtcaccacgactgcatgtcccgctgatgccagcacagccggccccacctaaacctcaaccaactacgaggacccctccccagtcccagacccctggtgcgctgccagccaagagagagcaacccccctcattgacccgcaacggtcctctttcctgtggtcagagactgcgcaagtcactgagtagcatgactcgagtggtaggaggtctcgtagctctcaggggcgcccacccgtatatcgcagcgttatattgggggcatagcttttgtgccggcagtttgatcgccccctgttgggtcctgacagcagcacattgtctgcaagatcggcctgcgcctgaagatcttacagtcgtcctcggccaggagcgacggaatcactcctgcgagccctgtcaaaccttggccgtgcgaagttatcggctgcatgaggcctttagcccggtatcctatcagcatgacctggccctacttcgactgcaggaggacgcagatggttcctgtgcccttttgagcccgtacgtgcagccagtatgtctaccatccggtgccgcacgtccatctgagaccacattgtgtcaggttgctggctggggccaccagttcgaaggggctgaggaatacgcaagcttcctacaggaagcccaggtccccttcctcagtctggaaaggtgcagtgcccctgatgtgcatggtagttccatccttccaggtatgctgtgtgcaggctttctggaaggtggaactgatgcatgccagggagattctggagggcccctggtgtgtgaagatcaggccgccgaaaggaggctaactctccagggaataatcagctggggtagtggctgcggtgataggaacaaacctggggtgtataccgacgtagcttactacttggcatggatccgggagcatactgtctcc

SEQ ID NO: 249842 - DNA, 1845 bp, Artificial Sequence
  Description of Artificial Sequence: Synthetic coding sequence
atgagagccctgctattactaggatttctgctggtgtccttagaatccacattgtcaattcccccctgggaagccccaaaagagcataaatataaagcagaggaacatacggtcgtcctgacagtgactggggaaccatgtcattttccctttcagtatcaccgacagttgtatcacaaatgcacacacaaggggagacccggaccccagccttggtgtgctactacacctaatttcgatcaggatcagcgttggggatattgcttagaacctaagaaagtcaaggatcattgctccaaacactctccctgtcagaagggggggacttgtgtgaatatgccatctgggccccattgtctctgtccccagcacctaacagggaaccattgtcagaaggaaaaatgttttgaaccacagctgctccgctttttccataaaaacgagatatggtacagaactgagcaggccgctgtcgctcgatgtcagtgcaaagggcctgatgcccattgtcagagactagcatcgcaggcatgccggactaatccttgtctacacggagggcgctgtcttgaagttgaggggcaccggctttgccattgtcctgtagggtacactggggcattctgtgacgttgatacaaaagcttcctgctatgacgggagaggactgagttatcgggggctggcacggactactctctctggggcaccctgtcagccgtgggccagtgaagccacttatcgaaatgtgacagccgaacaggctcgcaactgggggctggggggacacgctttctgccgcaatcccgataacgatatccggccctggtgctttgtgctaaacagagatagactatcatgggagtactgcgatctcgcccaatgccaaacacccacacaggctgccccccccactccagtttctccccggctccacgtacccctcatgccagcccagcctgccccacctaaaccacagcccacaactcggacacccccccaatcacagacacccggagccttacctgcaaagagggaacagccaccgtcactcacaaggaacgggccattaagttgcggacagcgcttgaggaagtcattgtcctccatgactcgggtcgtgggaggactcgtagctctcaggggagcccacccctacatcgctgccctatactgggggcactctttttgtgcaggaagtctcatcgccccatgttgggtcctgacagccgcccattgtcttcaggataggccagcccctgaggatctcacagtggtgctcggacaggagaggagaaatcacagttgcgaaccatgtcagacattggcagttagatcatacaggctgcatgaagctttttcgccagtgtcctaccagcatgatctggcgcttctcagactacaagaagatgctgatggatcctgtgccttgctcagtccctatgtccagcccgtttgtctaccctcaggagccgcccgtccctcagaaacaactctctgtcaggtcgccggatggggacaccagtttgaaggagccgaggaatatgcgtccttcctccaggaagcacaggtgccattcctgtccctggaacggtgtagtgctccggatgttcatggatcatctatacttcctggaatgctgtgtgccgggtttctggaaggaggaacagatgcttgtcagggggattcaggagggccccttgtatgtgaagatcaggccgccgaacgacggttgacactgcagggaataatttcctggggaagtggatgcggagataggaataaaccaggggtgtatacagatgtggcatattatctggcttggatccgggaacatacagtctcg

SEQ ID NO: 249843 - DNA, 1845 bp, Artificial Sequence
  Description of Artificial Sequence: Synthetic coding sequence
atgagggctctcctcctcctaggatttttactggtctcactggagtcgactctgtccatacccccgtgggaagccccaaaggaacataagtacaaggccgaggaacacacagtcgttctcactgtcactggggagccttgccatttccctttccaatatcacagacaactctaccacaagtgtacacacaaaggtcgccctgggccccagccatggtgcgcaacgacacccaatttcgaccaggaccagcgctggggctactgcctcgaacctaaaaaggttaaagaccactgttctaagcatagcccttgtcaaaagggcggaacatgtgttaacatgcctagtggccctcactgtctgtgcccccagcacctcacgggaaaccactgtcagaaggaaaagtgtttcgagccacagcttttgaggttttttcacaaaaacgaaatctggtaccgcacagagcaagcggccgtggcccggtgtcagtgtaagggacctgacgctcactgccagcggctagctagtcaggcctgtaggacgaatccttgtttacacgggggtcggtgcttagaggtggagggccaccgtttgtgtcactgccccgtcgggtacaccggggcattctgtgatgttgataccaaggcttcttgctacgacggtcggggcctgtcctacagagggctggcgcggaccaccctctctggggcgccatgccagccttgggcttccgaggcaacctataggaacgtgacagccgagcaggctcgcaattggggcctgggcggacacgcgttctgcagaaatccagacaatgatatccgcccatggtgttttgtgctgaatcgggaccgcttatcttgggagtattgtgacctggcccagtgtcagacaccgacgcaggccgctcctccaacaccagtcagcccgcgtctgcacgtgcccctcatgccggctcagccagcacccccaaaaccccaacctactacccgtacacccccacagtctcagactccaggcgccctgcctgctaagcgggagcaacctccaagtctgactcgaaatggccccctttcctgtggacagaggctcaggaaatcactctctagcatgacacgtgtggtgggaggcctggttgcccttcgcggggctcatccctacatcgcagccttatactggggacactcattttgcgccggttccttaatcgcgccatgttgggtgctcactgctgcacactgccttcaggatcgccccgctccagaggacttgactgtcgttcttgggcaggaaaggcggaaccacagctgtgagccatgtcaaaccctggccgtaagatcttataggctgcacgaggccttctcccccgtttcttatcagcatgatctagccctgcttagactgcaggaagacgccgacggttcgtgcgctcttctctccccctatgtgcaacctgtctgtcttccatccggggctgccaggccgtcagaaacaactttgtgccaggtggccggctggggtcatcaatttgagggcgctgaggagtatgcctcttttctgcaggaggcccaagtgcccttcctttccttggagagatgttcggctcctgacgtgcacggctcttctatccttccagggatgctgtgcgctggatttctcgagggtggaacagatgcgtgccagggcgactcagggggtccacttgtgtgcgaggatcaagccgccgagcgacgcctaaccttacagggaatcatcagctggggatcaggctgcggagacaggaacaagcctggagtgtatacggatgtggcatattaccttgcctggatccgcgagcacactgtgagt

SEQ ID NO: 249844 - DNA, 1845 bp, Artificial Sequence
  Description of Artificial Sequence: Synthetic coding sequence
atgcgtgcattgctcctgcttggattcttgcttgtgtcactggagtcaactctgtcgatccctccttgggaagccccaaaagagcataagtacaaggctgaagaacatacggtggtgttgactgtaaccggagaaccgtgccatttccctttccaataccacagacaactgtaccataaatgtactcataaaggccgcccgggtccccaaccttggtgcgccactaccccaaactttgatcaggaccagaggtggggttactgtctggagcctaagaaagtcaaggaccactgttcgaaacacagcccgtgtcagaagggcggaacctgtgtgaacatgccctccgggccacattgtctctgtccccaacatcttactggaaaccactgccaaaaggaaaagtgctttgaaccacagttgttgcggttttttcataagaacgagatctggtacaggaccgaacaggcggcagtggcacgatgccaatgtaagggtcctgatgcacactgtcaacggcttgcgagccaagcatgcaggaccaatccttgtttgcatggcggaagatgccttgaagtggaggggcatcggctgtgtcactgcccggtcggctacaccggcgcattctgcgatgtcgatactaaggcatcatgttacgatggacgaggcctctcctatagaggtctggcacgcaccactctgtccggggcgccttgtcaaccttgggcctcagaggcaacctacagaaatgtgactgccgaacaagcacgcaattggggtcttggaggacatgccttttgtcgcaatccagacaacgatatccggccatggtgttttgtgttgaatcgcgacagacttagctgggagtactgcgacttggcacagtgccagacccctactcaagcagcgccccctacccctgttagtcctcgtctgcatgtgccacttatgcctgcgcaacctgcaccccccaagccgcagcctacgacgagaacccctccacaatcgcagacccctggggcactgcctgctaaacgagaacagccaccatcgcttacccggaacggacccctgagttgcggtcagcgtctcagaaagtcgcttagcagcatgactcgtgtggtgggcggtcttgttgcacttagaggagcacacccctacatcgccgcactctactgggggcactccttttgcgcggggagccttattgctccatgttgggtcctgactgcagctcactgtttgcaagacaggccagcgccggaggacctgactgtggtcttgggtcaggaacgaaggaaccattcctgtgaaccatgtcagaccctggccgtcaggtcatacagactgcacgaggctttttctccggtgtcttaccagcacgatctggccctgctgagactgcaggaagatgcagacggatcctgtgccctcctgagcccgtacgtccaacctgtgtgtctcccatccggtgcggccaggccgtcagaaactaccctctgtcaggtggcaggatggggacatcaatttgaaggagcagaagaatacgctagcttcttgcaagaggcacaagtgcctttcctgtccctcgagcggtgctcggcacctgatgtccatggctcctcgatactcccgggcatgttgtgtgcaggtttcctcgaaggaggaactgatgcatgccagggagattccggcgggccgctcgtttgtgaagatcaggcagcagagaggcggctgacgctgcaaggtattatctcctggggaagcggttgtggggatcgaaacaagcccggagtctacaccgatgtggcttactatcttgcctggatacgagagcatactgtgagc

SEQ ID NO: 249845 - DNA, 1845 bp, Artificial Sequence
  Description of Artificial Sequence: Synthetic coding sequence
atgagagctttattacttttaggatttttattagtttctttagaatctacattatctattccaccatgggaagcaccaaaggaacataagtataaagcagaagaacatacagttgttttaacagttacaggagaaccttgtcattttccatttcaatatcatagacaattatatcataaatgtacacataagggaagaccaggacctcaaccttggtgtgctacaactcctaattttgatcaagaccaaaggtggggatattgtcttgaaccaaaaaaagttaaagatcattgttcaaagcattcaccatgtcaaaaaggaggaacatgtgttaatatgcctagtggaccacattgtctttgcccacaacatttgactggaaatcattgtcaaaaagaaaagtgttttgagccacaacttttaagattttttcataaaaatgaaatatggtatagaactgaacaagcagcagtagcaagatgtcaatgtaaaggaccagatgcacattgtcaaagacttgcatctcaagcatgtagaactaatccttgccttcatggtgggcgttgtcttgaagtcgaaggtcataggttatgtcattgcccagttggatataccggtgctttttgtgatgttgatacaaaagcatcttgttatgatggaagaggtttatcatatagagggcttgctcgtactactttaagtggtgcaccttgtcaaccttgggcaagtgaagcaacttatagaaatgttactgcagaacaagcaagaaattggggacttggaggacacgcattttgtagaaatcctgataatgatatacgtccatggtgttttgttcttaatagagatagattatcatgggaatattgtgatcttgcacaatgtcaaacaccaactcaagccgctccacctacaccagtttctcctcgattacatgttcctttaatgccagcacaacctgctccaccaaagccacaaccaactactagaacacctccacaaagtcaaactccaggagcattaccagcaaagagagagcaaccaccatctttaacaagaaatggtccattatcttgtggacaaagacttagaaaatcattatccagtatgactagagtcgtaggtggtcttgttgctttaagaggagcacacccatatattgcagctttatattggggacattctttctgtgctggttcattaattgcaccttgttgggttttgacagctgcacactgtttacaagacagaccagctccagaagatttaactgtagttcttggacaagaaagaagaaatcattcatgtgaaccatgtcaaactttagcagttagatcatatagacttcatgaagctttttcaccagtttcataccaacatgatttagcacttttaagattacaagaagatgcagacggaagttgtgcacttttatctccatatgttcaaccagtttgccttccatctggtgcagcaagaccaagtgaaactacactttgtcaagtagcaggatggggacaccaatttgaaggtgctgaagaatatgcatcttttttacaagaagctcaagtaccatttttaagtcttgaacgttgttctgctccagatgttcatggatcatcaattttacctgggatgctttgcgctggatttttagaaggaggaaccgatgcttgtcaaggtgattcaggaggacctttagtttgtgaagatcaagctgctgaaagaaggttaacacttcaaggaatcatatcttggggatctggatgtggagataggaataaaccaggtgtttatactgatgttgcatactatttagcatggattcgtgaacatacagtttct

SEQ ID NO: 249846 - DNA, 1845 bp, Artificial Sequence
  Description of Artificial Sequence: Synthetic coding sequence
atgagagcacttctgctccttggtttcctgcttgtgtccctggagagcaccctgtcgattcccccctgggaagcgccaaaagaacataagtacaaagcagaggagcatactgtggtgttgaccgtgaccggcgaaccttgtcattttcccttccaataccacagacaattgtaccacaaatgtacccataaaggtagacctgggcctcagccatggtgtgcaactactcctaatttcgatcaagatcagcgctggggatattgtttggaacccaagaaggtgaaggatcattgctccaagcacagcccttgtcaaaagggaggtacttgtgtgaacatgccttcgggaccacattgtctgtgtccacagcatctcaccggaaaccattgtcaaaaggagaaatgttttgagccacagcttctccgtttctttcataagaacgaaatctggtacaggaccgaacaggcggcagtggcccgctgccaatgtaaaggcccggacgcacactgccagcgcctcgcaagccaggcatgtcgaaccaacccttgccttcacggaggacggtgtcttgaagtggagggccatcgcctgtgccactgccccgtaggctacactggagccttttgtgacgtggacactaaggcgagctgttacgatgggagagggctgagctaccgcgggctcgcgcggactactctgtccggtgcaccttgtcaaccctgggcttctgaagcgacttataggaacgtgactgcagaacaagcgagaaactggggtcttggagggcatgcattttgcagaaaccccgataacgatatccggccatggtgttttgtgctgaaccgcgaccgacttagctgggaatattgtgatctggcacaatgtcagactcccacgcaggcagctcctccgacgcctgtgtcgccgagactccatgtgccactgatgccagcacaacctgcaccccccaaaccacagccgaccactcggacccctcctcagtcccagaccccaggtgcgctccctgcaaagcgtgaacagcctcctagccttaccaggaacgggcctctgtcctgtggccaaagactcagaaagtcgttgagctccatgacccgcgtcgtgggcggtcttgtcgcccttcgcggcgcacatccgtacattgctgcactttactgggggcacagcttttgtgcaggaagccttattgcgccttgttgggtcctgaccgcagcacactgtctccaagatcgtccagcacccgaagatctcaccgtcgtgcttggacaggaaagaaggaatcactcgtgcgaaccatgtcagactcttgcagtgaggtcgtaccgactgcatgaagcatttagccctgtctcataccaacatgacctggccctgcttcgcctgcaggaggatgccgatggatcgtgtgccctgctgtcaccatacgtgcagcctgtgtgtctgccctccggtgcggctagacccagcgaaaccactctttgtcaagtcgcaggctgggggcatcaattcgaaggtgcagaagaatacgcttcgttccttcaagaggcccaggtgccttttttgtcccttgagagatgttcggcaccggatgtgcacggatcctccatcctccccggtatgctctgcgcaggttttcttgaagggggaaccgacgcttgtcagggtgacagcggaggaccgcttgtgtgcgaggaccaggcagcagaaagacgccttactttgcaggggataatctcttggggctcgggttgcggcgatcggaacaagcctggtgtctacaccgacgtggcgtactacttggcatggatacgcgaacatactgtgtct

SEQ ID NO: 249847 - DNA, 1845 bp, Artificial Sequence
  Description of Artificial Sequence: Synthetic coding sequence
atgcgcgctctcctcctcctgggttttctcctcgtcagcctggaaagcaccctttcaattcctccctgggaagcccccaaggagcacaaatataaggctgaggagcacaccgttgtcctgactgtgaccggtgaaccatgccacttcccatttcaataccaccgtcagctttaccacaagtgtacccataaaggaaggcccggtccacagccctggtgcgctactaccccaaactttgatcaggaccagcgttggggctattgcctggaacctaagaaagttaaggatcactgcagcaagcacagcccatgccagaagggcggtacctgtgtaaatatgcccagcggcccccattgcctgtgccctcagcacttgaccggtaaccactgccagaaggaaaagtgcttcgaaccacagcttctgcgtttcttccataagaatgagatttggtaccgtaccgaacaggccgcagttgctcgttgccagtgcaagggaccagacgctcactgtcagaggctggctagtcaggcttgtagaaccaatccctgtttgcacggtggtaggtgtctggaagtcgagggccatcgtctctgccactgtcccgttggttacactggcgctttctgcgatgtagacacaaaagctagctgctacgatggtcgtggtctgtcttatcgcggtttggctagaaccaccttgtccggagccccatgccagccctgggcctcagaggcaacctaccgtaacgtgacagccgagcaagcacgcaactggggtttgggcggccatgccttttgtcgcaatccagataatgacatccgcccttggtgttttgtgctgaaccgtgatcgcctctcttgggagtactgtgatctggctcagtgccagacccccactcaagccgccccacccaccccagtctccccaaggctgcatgttcctctgatgcctgcccagccagcaccccctaaacctcagcctacaacccgcactcctccccaatctcaaaccccaggagcactgcccgctaaaagagaacagccaccttcactcacaagaaacggtcctttgagctgtggccaacgcctgcgtaagagcctgtcaagtatgactcgcgtggtgggtggtctggtggcactgcgtggtgcccatccttacatagccgctctctactggggacactctttctgtgctggctcactcatcgccccatgctgggtccttaccgctgcacactgtctgcaggacaggcccgccccagaggacctgaccgttgttctgggtcaggagcgcaggaaccactcctgcgaaccttgccagactctggctgtaagatcatacagactgcacgaggcattctctcccgtctcttatcagcatgacctggctttgctgaggttgcaagaggatgcagacggctcctgtgctctgctcagtccctatgtgcagcccgtatgcctgcccagtggagccgctcgtccctctgagacaactttgtgccaggttgccggctggggacaccaattcgagggtgctgaagagtacgcttcttttctgcaggaagcacaagttccctttctgagtctggagagatgtagcgcccccgacgtgcatggatcatccatcctgcctggcatgctttgtgctggctttctggaaggcggaaccgacgcctgccaaggagatagcggtggacccctggtctgtgaggaccaggccgccgagcgtaggctgaccctccagggcataatctcttggggatccggatgtggcgaccgtaataagcccggtgtttacaccgacgttgcctactacctggcttggatcagggagcacaccgtctcc

SEQ ID NO: 249848 - DNA, 1845 bp, Artificial Sequence
  Description of Artificial Sequence: Synthetic coding sequence
atgagagctcttctgttgctgggctttttactggtgagcctcgaaagtactttgtcaattcctccatgggaggcccctaaagagcacaaatacaaggccgaggagcacaccgtggtcctcacagtcaccggagagccttgccattttcccttccaatatcaccggcagctgtaccacaagtgtactcataaaggccgacctggcccacaaccctggtgtgccacaactccaaattttgaccaagatcagcgctggggttattgccttgaaccaaagaaggttaaagaccattgtagtaagcatagcccatgtcagaagggtggaacgtgtgtcaacatgccctcaggtccacattgcctgtgcccgcagcatcttaccggtaatcattgccaaaaggaaaagtgtttcgaaccacaattactgcggttcttccacaagaatgaaatctggtatcgtacggaacaagctgcggtggcacggtgccagtgtaaggggccggatgctcattgccagagactggcttctcaagcctgccgtaccaatccctgtctgcacggaggccgttgtctggaagtggagggacaccggctttgccactgtccagttggatacactggcgcattctgtgacgttgacacgaaggccagctgctacgacggccgagggttgagctacagggggctcgctcggaccaccttgagcggcgccccctgtcagccgtgggcaagcgaggctacgtacagaaacgtcacagctgaacaagccaggaattggggcctgggaggccacgccttttgcagaaatcctgataatgacatcaggccttggtgtttcgtgctcaatagggaccggctgagttgggagtactgtgacctggcccagtgccagacgccaactcaggcagccccacccacacctgtcagcccgcgcttacatgttcctctgatgccggcccagcccgctccgccgaaaccgcagcccactacccgcacacctccccaatcacaaacccccggagccctgcctgcgaagcgcgaacagccgccgtctctcacaagaaacgggcccctgtcctgcggccaacgcttaagaaaaagtctttcatccatgacccgagtggtgggcggcttggtcgcgcttaggggggcccacccttacatcgccgccctctactgggggcatagcttctgtgccggctcgctgatcgccccttgttgggtgcttacagctgcccattgtctccaggacaggcctgcacccgaagacctgactgtggtgctggggcaagagcgcagaaatcattcttgtgaaccctgccagacgctggccgtcagatcttatcgcctgcacgaggcattctctccagtgtcataccaacacgacctagccctgttacggctgcaagaagacgcggatggctcctgtgcacttctctccccatacgtgcaaccagtgtgcctgccatctggcgctgcccgcccatccgagacaactctctgtcaggttgcagggtgggggcaccagtttgagggcgccgaagagtacgcttctttcctgcaagaggcccaagtaccattcctgtccctggaacgttgctcagcccccgatgtgcatggatcttccatcctacctggcatgctatgtgccgggtttttagaaggaggcaccgacgcctgtcagggggacagtggcggacccctcgtgtgcgaagaccaggcagcagagcgtaggttgacgcttcagggtatcatcagctgggggtccgggtgtggtgatcggaataagccgggggtgtacaccgatgtcgcgtattaccttgcatggattcgggaacatacagtgtct

SEQ ID NO: 249849 - DNA, 1845 bp, Artificial Sequence
  Description of Artificial Sequence: Synthetic coding sequence
atgagagcgcttctgttgctggggttcctcttggtttcactcgaatctaccctcagcatacctccatgggaggcaccaaaggagcacaagtacaaggccgaggagcacactgttgttctgacagtgaccggagagccttgtcatttcccctttcagtaccatcgacagctttaccacaagtgcacacacaaaggcaggcccggcccccagccgtggtgcgccacaacccctaatttcgaccaggatcaacgctggggatattgcctggaaccgaagaaggttaaggatcattgtagcaagcactcaccttgccagaagggaggtacatgcgtgaatatgccctccggaccccattgtctctgtcctcagcaccttaccgggaatcattgccaaaaggaaaagtgttttgaacctcagctgttgagattctttcataagaacgaaatctggtaccgaaccgagcaggcagcggtggcccgatgtcagtgtaaggggcctgacgcccactgtcaaaggttggccagtcaggcttgtagaaccaatccctgcctgcatgggggaaggtgcctggaggtagagggccaccgcctgtgtcattgcccagtggggtataccggtgcattctgcgacgttgacactaaagccagttgctatgacggcagagggctctcttatcggggcctcgctaggaccactctgtcaggtgctccctgtcaaccgtgggcttccgaagctacttacaggaatgtgaccgccgagcaggctcgcaactggggtctggggggacatgcattctgccgcaaccctgataacgacatccggccatggtgtttcgtgctcaatcgggatcggctgtcatgggagtattgcgaccttgcccaatgtcaaactccaacccaagccgctcctcccacacccgtgtcaccccggttgcacgtaccactgatgccggcccagccagcgccgccaaagccacaaccaacaacccgaacaccccctcagtctcaaaccccgggggccctgcccgccaaaagagaacaaccaccatccctgacgaggaacggtcccctgtcttgtggccagcggctgcgcaaatctctgtcctccatgacgcgggttgtgggtgggctggtggctctcaggggagctcacccttatatcgccgccctgtattgggggcactccttctgcgctggtagcttgatagccccctgttgggtcctcaccgccgcccattgcctgcaagacaggcctgctcccgaggatcttactgttgttttgggacaggaaagaagaaatcactcctgcgaaccatgtcaaacgctcgccgtaaggtcttatcgactgcacgaagccttttctccagttagctaccaacacgacctggccctcctgaggcttcaggaggacgccgacggaagctgtgccctcctttccccgtacgtgcaacctgtctgcctgccttcaggggcggcaaggccctctgagaccacactgtgtcaagtggccgggtggggccaccagttcgaaggggccgaagagtacgcttctttcctgcaggaagcccaagtcccgtttctgtccctggaaagatgtagcgcccccgatgtgcacggttcatctatactgccgggtatgctgtgtgccggcttcctcgaggggggaacagatgcctgccaaggtgacagtgggggcccccttgtttgcgaggatcaggctgcagagcgacggctgaccttgcagggcatcatctcctgggggagtggctgcggagaccggaacaagcccggtgtgtatactgacgtggcctattacctggcttggatccgcgaacatactgtcagt

SEQ ID NO: 249850 - DNA, 1845 bp, Artificial Sequence
  Description of Artificial Sequence: Synthetic coding sequence
atgagagctctgctgcttctgggttttctgttggtgagcctggagtcaacacttagcatcccaccgtgggaagcgccgaaagagcacaagtacaaggcggaagagcacaccgtcgtgttgacagtgaccggtgagccgtgccactttccattccaataccaccgccagctgtaccataaatgcacccacaaaggtcgtcccggtccgcagccatggtgtgcgaccactccgaattttgatcaggaccagcgttggggttactgtctggagccgaagaaggtcaaagaccactgcagtaaacacagcccttgtcagaaaggtggtacatgcgttaacatgccaagcgggccgcactgtctgtgtcctcaacacttgacaggcaatcactgccaaaaggaaaaatgctttgaaccgcagctgctgcgattttttcacaaaaacgaaatatggtaccgtaccgaacaagccgccgtggcccgctgtcaatgcaagggcccagatgcccactgtcaacgactggcctctcaagcatgccgcaccaacccgtgcctgcacggtgggcgctgtctcgaggtggagggccaccgcttgtgtcattgccctgtgggttatacaggcgcgttttgtgatgtcgataccaaggcgagctgctacgacgggcgcggtctcagctatcggggcctggcgcgcacaacgctgtctggcgcaccgtgccagccttgggcctccgaggcgacctaccgcaacgtaacagctgaacaagcaaggaactggggtctgggtgggcacgcgttctgccggaacccagacaatgatatcaggccatggtgcttcgtcctgaaccgcgacagactgagctgggaatactgtgacctggctcagtgtcagactccaacccaggctgcccccccaaccccagtgagcccgcgccttcacgttccgcttatgcccgcccagccagcaccgccaaagccacagccgactactcggactcccccacagagccagactcctggggctttgcctgccaagagggagcagcctccatccctgacacgcaacggtcctctgtcgtgcggccagcggctgaggaagtccttgtcctctatgacccgcgtggttggtggcctggtggcgcttcgcggtgcccatccttacatcgccgccctgtattggggtcatagcttctgtgcgggttctttgatcgccccgtgctgggtgctgaccgccgcgcattgcctccaggatcgaccagctccagaggatctgaccgtcgtgctgggccaggagcgtagaaatcacagctgtgaaccatgccagaccctggcggttcgctcatacaggttgcatgaggcattcagccctgtgagctaccagcatgacctggcgctgctgaggctgcaggaggatgccgacggatcttgtgctctgctgtcgccttacgttcagcctgtctgcctgccgtccggagctgcacgtccaagcgaaacgaccttatgccaagtggcaggttggggtcaccagttcgaaggagcggaagaatacgcgtcctttctccaggaggctcaagtgccgtttttgtctctggagcgttgtagcgctccagacgtgcatggcagcagcattctgcctgggatgctgtgcgcaggtttcctggagggcggtacggacgcttgtcagggtgattccggtgggcctctggtgtgcgaagaccaagctgcggaacgccgcctcactttgcaggggattatatcttggggtagcgggtgcggggatcgaaacaaaccaggcgtgtacactgacgtggcgtactacctggcgtggattcgggagcacaccgttagc

SEQ ID NO: 249851 - DNA, 1845 bp, Artificial Sequence
  Description of Artificial Sequence: Synthetic coding sequence
atgcgagcacttcttctcctgggctttctccttgtctccctggagagtacactgtcgatccccccttgggaggccccaaaggagcataaatataaagctgaagagcacactgtggttttgacagttactggagagccttgtcattttccttttcagtatcaccgccagctgtatcacaagtgcacacacaagggcaggcctggaccacaaccctggtgtgcgacaacccccaatttcgatcaggaccagaggtggggctactgtctcgaacccaaaaaggtgaaggaccactgctccaaacacagcccttgtcagaagggcggtacctgtgtcaatatgccttcagggccccactgcttgtgcccgcaacaccttacagggaatcactgtcagaaggagaagtgctttgagcctcaactcctgcgattctttcacaaaaatgaaatatggtaccgcactgaacaggctgctgtggcgcggtgtcagtgtaaggggcccgacgctcactgccagcggctcgcctctcaggcctgccgcacgaacccttgtctgcacgggggacgttgtctagaagtcgagggccacagactgtgtcattgtcctgtcggctataccggtgctttttgcgacgtcgacacgaaagcttcatgctacgacggccgcgggctgtcttacagaggtttggcccgaaccacacttagtggggccccttgtcagccttgggccagtgaagcaacatatagaaacgtgacggcagagcaggctcggaactggggcttgggagggcatgctttctgccgtaatcctgacaacgacataagaccttggtgcttcgtcctcaacagagacagactgtcttgggagtattgcgacttggcacaatgccagacccccactcaggccgcgccacctacacctgtctctcctagactccacgttcctctgatgccagctcaaccggcaccccccaagcctcaacctaccacaagaacaccaccccagtcccagacaccgggagccctgcccgcaaaacgagagcagcctcccagtctgacccgtaatggaccactctcttgtggccagcgcttgaggaaatccctgagttcaatgacacgcgtggtagggggactcgtcgcgctacgcggggctcacccatacattgccgccctgtattggggacactcgttttgcgctggatccctgatcgccccgtgctgggtcctcaccgctgcccattgtctgcaagatcgccccgccccagaggacctcactgtagttctgggccaggagcgcaggaaccactcttgtgagccatgccagacgctggctgtgcggagttaccgcttacacgaggccttctctcctgtgtcataccagcacgatttggcattactgagactacaggaggatgcagacggctcttgtgctctcctgtccccttacgtgcaacccgtctgcttgccgtccggagcagcccggccttccgagacgacactgtgccaggtcgcaggatggggccatcagtttgaaggtgctgaggaatacgccagctttttgcaggaggcgcaggtgccctttctatctttggaaagatgctctgcccccgacgttcatggaagttcaatcctccctgggatgctgtgtgccggttttctggagggggggaccgacgcctgtcagggggatagcggaggccccctggtgtgcgaggaccaggccgcagagcgacgactgaccctgcagggaataatctcatgggggagtggttgtggggaccgcaataaaccgggggtttatacagacgtggcatactatctggcctggatccgggagcatactgtttcc

SEQ ID NO: 249852 - DNA, 1845 bp, Artificial Sequence
  Description of Artificial Sequence: Synthetic coding sequence
atgcgagcattgctgcttttgggttttttgttggtttcattggagtccacattgtctatccctccttgggaggcccctaaagagcacaaatacaaggccgaggagcacaccgtagtattgactgtcacaggtgaaccatgccatttcccttttcagtatcacaggcaactttatcataagtgcactcataaaggtagacctggccctcaaccatggtgtgctaccactcccaacttcgaccaggaccagcgttggggttactgcctagaacctaagaaagttaaagaccactgtagcaaacatagtccttgccaaaagggtggaacttgtgtcaatatgccttccggacctcactgtttatgcccacaacatctcactgggaatcattgtcaaaaagagaaatgtttcgagccccagttacttaggtttttccacaaaaacgaaatttggtaccgcacagagcaggcagctgtggcaagatgccaatgcaagggaccagatgctcactgccagaggcttgcatcccaggcctgtagaacaaacccgtgtctccatgggggacgttgtctggaggtcgagggtcaccgactttgccattgtccagtcgggtacacgggtgcattctgtgatgttgataccaaagcttcatgctatgacgggagaggtttgtcatatcgtggactcgcacggactactctgtccggggctccctgccagccttgggcatcagaggctacatacagaaatgttaccgcagagcaggcgcgaaactggggcctgggtggccatgctttctgtaggaaccctgataacgacataaggccttggtgcttcgttttaaatcgggataggctgagttgggagtattgcgatctggcgcagtgtcaaactcctacccaagctgcaccacctacgccagttagcccacggctgcatgttccgcttatgccagctcaacctgctccacctaagccacagcctaccacccgaactccccctcaatcacaaaccccgggtgccttgccagccaaaagggagcaaccaccatccttgacgaggaacggccccctctcctgcggtcaacggttgagaaagtctctttccagtatgaccagggtcgtaggcggtctggtggctctaaggggggcccatccttacatcgcggcgctttattggggtcattcattttgtgctggaagccttattgctccgtgctgggtcctgaccgcggcacattgtcttcaagacaggcctgcaccagaagatctgacagttgttctaggtcaagaacgtcgtaatcactcgtgtgagccttgtcagacactggccgtcaggtcctatcgcctgcacgaagctttcagtccagtgagctatcagcatgacttggccttgcttcgtttacaagaggatgcagatggatcatgtgccctattgtccccttatgtccaacctgtttgtcttccaagtggagcagcaaggccttctgaaacaactttgtgtcaggtggccggatggggacatcaatttgagggggccgaagagtatgcttccttcttacaggaagcccaggtaccttttttgtccctggaaagatgcagcgcccccgatgtgcacggttcctcgattcttccagggatgctgtgcgctggatttttagaaggtggaactgacgcttgccaaggcgactctggaggacctttagtgtgcgaagatcaggcagctgagcgaaggcttacactccaaggtatcatttcgtggggtagtggttgcggagaccgaaataagcctggtgtgtacacagatgtcgcctattatctggcttggattagggaacacacggtctct

SEQ ID NO: 249853 - DNA, 1845 bp, Artificial Sequence
  Description of Artificial Sequence: Synthetic coding sequence
atgcgggctctgctactcctggggttcctactggtctcactggaatcgaccttgagcatccccccttgggaggcccctaaggaacataagtacaaagctgaggaacatacagtggtgctcaccgtgacaggagagccttgccatttccctttccagtaccaccggcagttgtatcacaagtgtacccacaagggccgacccggccctcagccatggtgcgcaactaccccaaatttcgaccaggaccaaagatggggctattgtctcgagccaaaaaaagtaaaggatcactgtagcaagcactccccctgtcagaagggcgggacttgcgttaacatgcctagcggcccgcactgtctatgccctcagcatctgactggtaaccattgtcagaaggagaagtgcttcgagccacagcttttacggtttttccacaaaaacgaaatttggtaccgcaccgaacaggccgcagttgcccgctgtcagtgtaaaggcccagatgctcattgccagagacttgcctcacaggcctgtcgcacaaatccctgtctgcacggcggtcggtgcttggaagtagaggggcatcggctttgccactgtcccgtaggatacaccggggctttctgcgacgtcgataccaaagccagctgttacgatggacgcgggctgtcctacagaggtctcgctcgtactaccctgtcaggcgcgccttgccagccctgggcctcggaggcaacctacaggaatgtgacagccgaacaggcccggaattgggggctgggcggacacgcgttctgtcgaaatcccgataacgacatcaggccttggtgctttgttctaaacagagatagattgtcgtgggagtattgcgatttggctcagtgtcagacacccacgcaggccgccccgcctaccccagtgtcacccaggctgcacgtccctctcatgccagctcagcctgctcccccaaagccacagccaacaacccgcacaccgcctcagtcccagacacccggcgctttacctgccaaacgtgaacagccgcctagtctgacaagaaacgggccactgtcctgcggccagaggttgcgaaagtccctaagctccatgacccgagtggtgggggggttggtggccttgagaggcgcacacccctacattgcagcactatattggggccatagcttttgcgctggatcactgatagctccctgttgggtcctgactgcagctcattgtttacaagataggccagccccggaggatctgacggtggtattgggtcaggagaggcgcaaccattcctgcgaaccttgtcagaccttggccgtccgatcttacaggctgcacgaggccttctcccccgtctcctatcagcacgatttggcactgctacgacttcaggaagatgctgatgggagttgtgctctgctcagtccatacgtacaaccggtgtgtcttccctccggggctgcccggccctctgaaacgactctctgccaggtggccggctggggacaccaattcgaaggagccgaggagtatgcatcctttctacaggaggctcaagtccctttcctctctctggagcgatgtagtgctccagatgtgcacggttcttcaattttacctggaatgctgtgcgccggctttttagagggcggaactgacgcttgccaaggggatagtggagggccactagtctgtgaggaccaagctgcagagaggcgtctgaccctgcagggcatcatttcctgggggtccggttgcggcgaccggaacaagcctggcgtctacacagacgtggcctattacctggcatggattcgggagcacaccgtctcc

SEQ ID NO: 249854 - DNA, 1845 bp, Artificial Sequence
  Description of Artificial Sequence: Synthetic coding sequence
atgagagctctgctgctgctgggattcctgctcgtttcccttgaatcgactctgagcattcctccctgggaagcacctaaagagcataagtacaaggccgaagagcatactgtcgtgcttaccgtcactggggagccttgtcatttcccattccagtaccaccgccagctctaccacaaatgtactcacaaaggcaggcctggaccacaaccgtggtgcgccaccactccaaacttcgaccaggaccagcggtgggggtattgcctcgagccgaagaaggtgaaggaccactgctccaagcactcgccatgccagaaaggaggaacctgcgtcaacatgccaagcggcccacactgcctctgcccgcagcacctcactggcaaccattgccagaaagaaaaatgcttcgaaccgcagctgctgcggtttttccataagaacgagatttggtatagaacggaacaggcagccgtcgcacggtgccagtgtaagggtccagatgcccactgtcagagattggcctcccaggcctgccggaccaatccgtgcctgcatggcggaaggtgcctggaggtggagggacatcgtctctgtcattgcccggtcggatacaccggagccttctgcgacgttgacaccaaggcctcctgctacgacggacggggactttcataccggggactggcgcgcaccaccttgtccggtgcgccgtgccaaccgtgggctagcgaagccacttaccgtaacgtcaccgcggaacaagcgaggaactggggacttggaggacacgccttttgtagaaatccagacaatgacattcgaccctggtgcttcgtgctgaacagggaccggctttcctgggagtactgcgacctggcccaatgccagactcctactcaggcagctcccccgacgccagtgtcgccgcggctgcacgtcccgctgatgcctgcccaaccagctccaccgaagccacagccaactacgagaactcctccacaatcacagaccccgggagctttgccagccaaacgggaacagccgcctagcctgactcggaacggccctctttcatgcggacaaaggctcagaaaatcgctttcatcaatgacccgagtcgtcggaggcctggtcgcgctccgcggcgcgcacccgtacattgccgccctctactggggtcactcattttgcgccggatccctgatcgccccgtgctgggtgctcaccgctgcacactgcctgcaggacagaccggcccctgaggacctgacggtggtgttgggacaggagaggcgcaaccactcgtgcgaaccgtgtcagaccctggccgtgcgcagctacagactgcacgaagcgtttagcccggtttcctaccagcatgacctggcgctgcttaggctgcaggaggatgcggacgggagctgcgccctgctgtctccttacgtgcagccggtctgcctgccgagcggcgccgcgaggccttcagaaaccactctttgccaagtggcaggttggggtcaccaattcgagggggcggaagagtacgcatcgttcctccaggaagcacaggtgcccttcctgtcccttgaaagatgctcggcaccggatgtccatgggtccagcatccttcctggaatgctgtgtgccggcttcctggaaggaggaaccgacgcctgccagggagattcgggcgggccgttggtgtgcgaggaccaggcggcggagcgccgcctgactctgcaaggaatcatctcgtggggctctggatgtggcgatcgcaacaagcccggggtgtacaccgacgtcgcgtactatctcgcctggatccgcgaacacaccgtctcg

SEQ ID NO: 249855 - DNA, 1845 bp, Artificial Sequence
  Description of Artificial Sequence: Synthetic coding sequence
atgagggctttgttgctcttaggattcctcctagtgagcctggagtccacactgagtatccccccgtgggaagcaccaaaggagcacaaatataaagccgaggagcacacagtggttctaacagtgactggcgagccttgccactttccgttccagtatcaccggcagttgtatcacaaatgcacgcacaagggacgacccggtcctcagccttggtgtgctaccacccccaatttcgatcaggaccagcggtggggatactgtctggagcccaagaaggtgaaggatcactgcagtaagcactcaccctgtcagaagggaggaacttgcgttaatatgcccagcggccctcactgtctctgtccccaacacctcacgggcaatcattgccagaaggagaaatgtttcgagccacagctgctccgtttctttcacaagaacgagatttggtatcgcactgagcaggcggcggtcgctagatgtcaatgcaaggggccagacgctcattgtcagagactggcgagccaggcatgtaggaccaacccttgcctgcacgggggcagatgtttggaggtggaagggcaccgcctgtgtcattgtcccgttgggtataccggcgcattttgtgacgtggatacaaaggcctcatgctatgacggtagaggtctctcctatcgagggttggctcggaccaccctctctggagctccttgtcagccctgggctagcgaggccacctacagaaatgtgacagctgagcaggccagaaattgggggttgggcgggcacgcgttctgccgcaaccccgataatgacattagaccctggtgttttgtattgaatagagacagacttagctgggagtactgtgacctagcccagtgtcagacgcctacccaggccgccccgccaacccctgtgagcccaagactgcatgtgcctctcatgcctgcacagccagccccgccaaagccacagcccactacaagaacgccccctcaaagccagacccccggggcccttccagccaaacgggagcagcccccaagcttgaccaggaacggccccctctcctgcggtcagagattgcggaaaagtctctcatctatgactcgggtagtgggagggcttgtggcactgaggggcgcacatccttatatagccgctctgtattggggacacagtttttgtgcagggtcactcatcgctccctgctgggtgctcaccgccgcccactgtttacaggacaggccggccccagaagatctaacagtggtgctggggcaggaacggagaaatcacagttgtgaaccctgccaaaccctagctgtgcgcagttatcgcctccatgaagcttttagccctgtttcttaccagcatgatcttgctctcctgcggcttcaggaagatgccgacgggagttgtgccctgctgtccccgtatgtgcagccggtttgtttgccaagtggcgccgcacgtccttccgaaaccacgctctgtcaggtagcgggatggggccatcaatttgagggcgcagaggagtatgcctcatttctacaagaggcccaggtaccattcctctcactagagcggtgctctgctccagacgtgcacgggtcctcaattcttcccgggatgctctgcgccggtttcctcgaaggtggaactgatgcttgtcagggtgatagcgggggacctctagtatgtgaggaccaggcagctgagagaaggctgactctgcaaggaataatttcctggggctccggatgtggagacagaaacaagcccggtgtgtacactgacgtcgcctattatctagcctggattagggagcatactgtatct

SEQ ID NO: 249856 - DNA, 1845 bp, Artificial Sequence
  Description of Artificial Sequence: Synthetic coding sequence
atgagagctctgctgctgctgggatttctgcttgtgtccctggagagcaccctctcgatcccgccatgggaggccccgaaggagcacaaatacaaagctgaagaacacactgtggtactcaccgtgactggcgaaccgtgtcacttcccattccagtaccaccggcaactgtaccacaagtgcactcataaggggcgcccgggaccgcagccatggtgcgcaactactccaaatttcgaccaggaccaacggtggggatactgcttggaacctaagaaggttaaagatcattgtagcaagcattcaccttgccaaaaaggtggaacctgcgtgaacatgccgtcgggaccccactgcctgtgtcctcagcacctgactggaaaccactgtcaaaaagagaagtgcttcgagccacagctgctgcgattcttccataagaatgaaatttggtaccgcacggagcaagctgcagtggccaggtgccagtgcaagggacctgatgcccattgccagagattggccagccaggcctgtcggacgaatccgtgcctccacggaggcagatgcctggaagtcgagggccacagactgtgccactgcccagtcgggtacaccggtgcgttttgcgacgtggacactaaggcgtcgtgttacgacgggcgcggtctgagctaccgcgggctcgcacggaccaccctgtcgggagcaccctgccagccgtgggcgtccgaagccacttaccggaatgtgactgcggaacaggccagaaattggggacttggagggcacgcgttctgccggaatccagataatgatatccggccgtggtgctttgttcttaatagggatcggctttcgtgggagtactgcgacctggcacaatgccaaaccccaacccaagcagcaccgcccactccggtgagccctagattgcacgtgcctctcatgccggcccagcctgcgccaccgaagccgcagcctacgactcgcaccccgccgcaatcgcaaacgccgggggccttgccggccaaacgcgagcagccgccttcgctgaccagaaatggacccctctcctgcggtcaaagactgaggaagagcctctcgtccatgacccgggttgtgggcggactcgtggccctgcggggagcgcacccctacatcgcagcgctgtactggggacattccttctgcgctggatcactgatcgcaccttgttgggtgcttaccgccgcacactgccttcaggaccgcccggccccggaggacctgaccgtggtgcttgggcaggaacgaagaaaccacagctgtgaaccatgtcaaaccctggctgtcagatcgtacaggctgcatgaagccttctcgcccgtctcgtaccagcatgatctcgcccttctgaggctgcaggaggatgcggatggttcatgtgccctgctttccccgtacgtccagcctgtgtgtctgccgtcaggagcagcccggcccagcgagactaccctgtgccaggtggcgggatggggacaccagttcgaaggcgccgaggagtacgcgtcattccttcaggaagcgcaggtcccattcctgtccttggagaggtgctctgcgcctgatgtccacggatcgtcgatcctcccggggatgctgtgtgctggattcctcgaaggtgggaccgacgcttgtcaaggagactcgggtggcccgctggtttgcgaggaccaggccgcagaaaggcgcctgactctgcagggaatcattagctggggatccgggtgcggagatcgcaataaaccgggagtgtacaccgacgtcgcctactacctggcgtggatccgcgaacataccgtgtct

SEQ ID NO: 249857 - DNA, 1845 bp, Artificial Sequence
  Description of Artificial Sequence: Synthetic coding sequence
atgagggcgctgctgctgctgggttttttgcttgtctccctcgaaagcaccctcagcattcccccctgggaagcaccaaaagaacataagtacaaggcggaagaacataccgtcgtgctgacggtgactggagaaccttgtcatttcccttttcagtaccatcgccagttgtaccacaagtgtacccataagggacgccccggacctcagccttggtgtgcaaccactcccaactttgatcaagaccaacggtggggttactgcctggaacctaagaaagtgaaggatcattgctccaagcattctccttgtcagaagggtggtacttgtgtgaatatgccaagcgggccacactgcctgtgtccgcagcaccttaccggaaatcactgtcagaaggaaaagtgttttgaacctcaactgctccgatttttccacaaaaatgagatatggtaccgcaccgagcaagcagccgtggccaggtgtcaatgtaagggacctgatgcacattgtcaaaggctggcatcccaagcctgtcgtaccaacccttgtctgcacggaggtagatgcctcgaagtggaggggcaccgcctttgtcattgcccggttggttacaccggagctttttgcgatgtggacactaaggcgagctgttacgatggaagaggattgtcataccggggtcttgcacggactaccctgtccggtgccccctgtcagccttgggcatcagaagcaacgtacaggaacgtcaccgcagagcaagcccggaactggggacttggaggccacgcattttgtaggaaccctgataatgatataaggccttggtgttttgtcctcaacagagatcgcctgtcctgggaatactgtgatcttgcccaatgccagacccctacccaggcagcgcctccgacgcccgtcagcccccgacttcacgtgcccctcatgccagcacaaccagcgccaccaaagcctcaaccaactacgaggaccccaccacaatcacagaccccaggagcactcccggcgaaacgggaacagcctccttcgctgaccagaaatggacctctttcatgtggtcaacgtctgagaaagtcactgagcagcatgactcgcgtggtcggtggtctggtggccctgcgcggggcccatccttacattgcggcactttattgggggcactcattttgcgcgggctccctcatagctccttgttgggtgctgaccgccgcacattgccttcaggataggcctgcacctgaagatctgaccgtggtgctcggacaagaacggcgaaaccattcctgtgagccctgtcagaccctcgccgtgcgtagctaccggcttcacgaagcattctccccagtatcataccaacacgatctggcattgcttaggttgcaagaggacgccgacggctcgtgcgccctgctttcgccatacgtgcaacctgtgtgtctcccgtcaggagccgccagaccctccgaaaccactctttgccaggtggcaggctggggacatcagttcgagggcgctgaagaatacgcgtcatttcttcaggaagcgcaggttcctttccttagccttgagagatgttctgctccagacgtgcatggctcctcaattcttcctggcatgctttgtgcagggtttctcgaaggtggaacggatgcttgccaaggagacagcgggggtccactcgtgtgcgaggaccaagccgcagaaagacgcttgacccttcagggaattatcagctggggaagcgggtgtggggacagaaacaaacctggcgtttacacggatgtcgcctactacctggcatggattcgggaacataccgtgtcg

SEQ ID NO: 249858 - DNA, 1845 bp, Artificial Sequence
  Description of Artificial Sequence: Synthetic coding sequence
atgcgggccttactgttgttagggtttctgttggttagtttagaatctacgctttcaataccaccgtgggaagcaccgaaggagcacaaatataaagctgaggagcatacggtggttcttacagtcacgggcgagccctgtcattttccgttccagtaccatcgacaactgtatcataaatgcacacacaaaggccgaccgggacctcaaccttggtgcgccacaacgcctaacttcgaccaagatcagagatggggttactgtctggagccgaaaaaagtcaaggatcattgtagcaagcattcaccgtgtcagaaaggcgggacctgtgtgaacatgccgagcgggccacattgcctgtgcccgcaacaccttacaggaaaccattgtcaaaaagaaaagtgttttgagccgcagttacttcggttttttcataaaaacgagatttggtatagaacggaacaggccgctgtcgctaggtgtcaatgcaaaggccctgatgctcattgccaacgactggcaagtcaagcatgcaggacaaacccgtgtttacatggcggccgttgcctggaagtagagggtcatagactgtgccattgtccggtggggtacacaggcgcattttgcgatgtggacaccaaggctagttgctatgatggacgcggtctttcttatcggggattggcgaggacgactctttcaggagctccgtgtcaaccgtgggctagtgaagcaacgtatagaaatgtgacagctgaacaggcccgcaattggggactgggtggccatgctttttgtcgtaatcctgacaacgacattcgcccttggtgctttgtgctcaatcgtgacaggttaagctgggaatattgtgatctggcgcagtgccaaacacctacacaagctgcacctccaacacctgtctcccctcgattgcatgtccctctcatgccggcccagccagcgcctccgaaacctcaacctacgacacggacaccgccacagtcacaaacaccgggagcgcttccagctaaacgcgaacaaccgccatccttaacgagaaacggcccgctttcatgtgggcaaagactaagaaaaagcctatcttcaatgactcgcgttgtagggggcttagtggctctgaggggtgcacatccttacatagcggccttgtattgggggcattctttttgtgcggggtcgctgatagcaccatgttgggtattaacagccgcccattgcctgcaggaccggccagcaccggaagatcttacagtggttctagggcaggaaagacgaaatcattcttgtgagccttgccagacccttgcggttcgttcttatcgcttacatgaagcattttcccccgtctcatatcagcatgacctggctttactgcgattacaagaagatgcagatggctcgtgtgcactgttaagtccgtacgtacagccagtttgcttaccttctggcgcggccagaccgtcagaaaccaccctgtgccaagttgccggatggggccatcagtttgagggagctgaagagtacgctagctttttacaggaagcacaggtgccgtttctttctcttgagaggtgctctgctcctgacgttcatggaagctctatactcccaggcatgctttgtgctgggtttctggaaggtggcacagatgcctgtcaaggcgattctggtggacctctcgtgtgcgaagatcaagcagcggagcgtaggctcacattacaggggattatctcttggggaagtgggtgcggcgatcgtaataaaccgggggtttatactgatgtagcctattatttggcctggattcgtgagcatactgtttca

SEQ ID NO: 249859 - DNA, 1845 bp, Artificial Sequence
  Description of Artificial Sequence: Synthetic coding sequence
atgagagcacttctccttctcggctttcttcttgtttcgcttgaatcgactctttcgattccgccctgggaagcaccaaaggaacataagtacaaggccgaagagcatactgtggtcttgaccgtgaccggagaaccgtgccactttccttttcaataccatcgtcaactgtaccacaaatgcactcataagggccggcctgggcctcaaccatggtgcgcaactacccctaacttcgatcaagatcagagatgggggtattgtcttgaaccgaaaaaagtgaaggatcactgcagcaaacattcaccttgtcagaagggcgggacctgcgtgaacatgccttcgggccctcactgcctgtgtccacagcacctgactggtaaccattgccaaaaggaaaaatgttttgaacctcagctgctccgcttctttcacaaaaatgaaatttggtaccggactgagcaggcagccgtggcaagatgtcagtgtaagggaccagacgcccactgtcaaagacttgcatcgcaggcatgtcgcaccaatccctgtctccacggaggccgctgtctggaggtcgagggtcatagattgtgtcattgccctgtcgggtacaccggcgccttctgtgacgtggacactaaggcctcgtgttacgatggaagaggattgagctatcggggtctggccagaaccactctgtcaggagccccgtgccagccctgggcctccgaagccacctaccgcaacgtcaccgccgaacaggcacgcaactggggccttggaggacatgcgttttgccggaaccctgacaacgatatacggccttggtgttttgtcctgaatagagacagactgagctgggaatactgcgaccttgcacaatgtcaaacgccaactcaggcggcaccgcctacccctgtgtctcctcgtttgcatgtgccccttatgccagcacagcccgcccctcctaaacctcagcctaccactcgcactcctccccaatcccaaacccctggagcactcccagcgaaacgggaacagccacccagcctgaccaggaatggcccgctctcctgtgggcagagactgcgcaagagcctgtcatcaatgactcgagtcgtgggcggtctggtggcgctgcgtggtgcgcatccctacattgcagccctctactggggtcatagcttctgtgctggatccctcatagcaccctgttgggtcctgaccgcggcccattgcttgcaagatagacccgcaccagaagatctgactgtggtgctgggacaagagcggaggaaccattcctgtgagccttgccaaaccctggccgtgaggagctacagactgcatgaagcctttagcccggtgagctatcagcatgatcttgcactgcttcgactccaggaagatgccgatggttcgtgtgcactcctttccccatacgtgcagcccgtttgcctcccttccggtgctgcgaggcctagcgaaaccactctgtgtcaagtggcagggtggggccaccagtttgaaggggcagaggaatacgcttcgtttctgcaagaagcccaggtgccttttctttctctggaacggtgctccgcaccagacgttcatgggtcaagcatcctgcccggaatgctttgcgcaggctttctggaaggaggaaccgacgcttgccagggagattcgggcggacctctcgtctgtgaggaccaagcagccgaacggaggctgacccttcaggggataatctcttgggggtcgggatgcggcgatcgcaacaaaccaggcgtctacactgatgtggcctactacctggcctggatcagagagcacacggtgtcc

SEQ ID NO: 249860 - DNA, 1845 bp, Artificial Sequence
  Description of Artificial Sequence: Synthetic coding sequence
atgcgcgctcttctgctcctcggattcctgctcgtatcacttgagtcaaccctgtctattccgccgtgggaagcgccgaaggagcacaagtacaaggcagaagaacatactgtggtactcaccgtcaccggcgaaccatgccacttcccgttccagtaccatcggcagctgtaccacaaatgcactcataaaggacgaccggggcctcagccgtggtgcgcgacgacccccaacttcgaccaggatcagcgctggggttactgtctggagcccaagaaggtgaaggaccactgctccaagcactcgccctgccagaagggcggcacgtgtgtcaacatgcctagcggaccacattgtctgtgcccgcaacacctgaccggaaaccactgtcagaaagaaaagtgctttgagccacagctcctgagattctttcacaaaaatgaaatatggtaccgaaccgagcaggccgcagtggcacgctgtcagtgtaaggggcctgatgcgcactgccaacgacttgcatcacaggcatgccgcaccaacccttgcctccacggaggccgctgcttggaagtggaaggtcatagactctgccactgcccggtcgggtacactggagccttctgtgatgtggacaccaaggcttcgtgttatgacggacgaggactttcttaccgtggactggcccgtacgactctctccggagccccatgtcagccctgggcctcggaagctacttacagaaatgtcaccgcagaacaagcacgcaattggggacttgggggtcatgccttctgccgcaatccggataacgatatccgtccttggtgcttcgttctgaacagggaccggctttcctgggaatactgcgacctcgcgcagtgtcagaccccaacgcaggctgcaccgcctactccggtgtccccgaggctgcacgtgcccctcatgccggcccagccggccccaccgaaacctcaaccaactacccggacgccgccgcagtcgcagaccccgggggctttgccggccaagcgggaacaaccaccatctctgacccgcaacggcccgctgtcgtgtggccaaaggcttcgcaagtcactgtcaagcatgactcgcgtcgtgggaggactggtggcgctgcggggcgctcacccctacatcgccgccctgtactggggacacagcttttgcgctgggtcactcatcgcgccttgctgggtcttgactgccgcacattgcctgcaagaccggccagccccagaggacctgaccgtggtcctggggcaggagcggagaaatcactcctgcgagccctgccaaactctggccgtgcgcagttaccgcctgcacgaggccttctctccagtctcataccaacatgaccttgcacttctcagactccaagaagatgccgatggatcttgcgctctgctgagcccatatgttcagccagtgtgcctcccttcgggcgccgcgcggccctcggaaactactctgtgccaagtcgcaggatgggggcaccaatttgagggcgctgaagaatatgcctcgttcctccaagaggcccaggtgccgtttctctccctcgaaaggtgctcggcaccggatgtgcatggctcctcgatcctgcctggaatgctctgcgcgggattccttgagggcggaactgacgcctgccagggtgattccggaggccctctcgtgtgcgaggaccaggctgccgagcggcggctgaccttgcagggtatcatctcctggggatccggatgtggtgacaggaacaaacctggagtgtacactgacgtggcttactacttggcgtggattagagaacataccgttagc

SEQ ID NO: 249861 - DNA, 1845 bp, Artificial Sequence
  Description of Artificial Sequence: Synthetic coding sequence
atgagggcgctgctcctgctcggttttctgttggtcagcctggaaagcactctgtcaattcccccctgggaggcgccaaaagaacataagtacaaagcagaagaacacactgtggtcctcaccgtgaccggagagccttgtcatttcccattccagtaccataggcagctctaccataagtgcactcataaaggaaggcctggcccacaaccatggtgtgccaccactcccaatttcgatcaagatcaacgttgggggtactgcctggaacccaagaaggtgaaggatcattgttccaagcattcaccatgtcaaaaggggggaacgtgtgttaacatgccttcgggtccccattgtctctgtccccagcatctcaccggtaaccactgtcagaaagagaagtgtttcgagccccaactgctgcgctttttccataagaacgagatttggtaccgtactgagcaagcggccgtggctcggtgccagtgtaagggtccggacgcacattgtcaaagactggcgagccaagcctgtagaacgaacccgtgcttgcatgggggccgctgtcttgaagtcgagggacatagattgtgtcactgcccagtggggtacaccggagcattctgtgacgtggacactaaggcaagctgctacgacggtcgagggctgtcttataggggtctggcccgcaccactctttccggggcaccatgtcagccatgggcgtccgaggccacctaccgtaacgtgaccgccgaacaggcgagaaactggggtcttggaggtcatgccttttgtagaaaccctgacaacgatatacgaccctggtgttttgttcttaacagggatcgattgtcgtgggaatactgcgatcttgctcagtgtcagaccccaacccaagccgcaccgcctaccccagttagccctagacttcacgtcccactgatgcccgcgcaacctgcaccgccaaagccgcaaccaaccacccgaacgcctccacaatcccagacgcctggggcacttccagcaaagcgggaacagcctcctagccttacccgcaatggacccctgtcatgtggtcagagactgagaaagagcctttcctccatgactagagtcgttggaggacttgtcgcgcttaggggagcacatccttacatagcagcactttattggggccacagcttttgtgcaggatccttgattgctccatgctgggtgctgactgccgcacattgtttgcaggacagacccgctcctgaagatcttaccgtggtgcttggccaggaacgaaggaatcattcctgtgagccatgccaaactctcgctgtgagatcatatagactgcacgaagcgttttcgcctgtgagctaccagcatgacctcgcccttcttaggctgcaggaagatgcagatggcagctgtgcccttctgtcaccatacgtgcagcccgtctgtctcccttcgggagcggcaagacccagcgaaactactctgtgccaagtggccggttggggacatcagtttgaaggagcagaagaatacgcatcctttctccaagaagcgcaagtgccatttctgtccctcgaaagatgctccgcacctgacgtccatggatcgtctatccttccagggatgctgtgtgctgggtttctcgaaggaggaactgacgcctgtcagggagattccggtggcccactggtctgtgaagatcaggcggcagaacgaaggctgactcttcagggaattatctcgtgggggagcggctgtggcgatcgcaataagcccggcgtgtacaccgacgtggcatactacctcgcatggattcgtgaacataccgtgtcg

SEQ ID NO: 249862 - DNA, 1845 bp, Artificial Sequence
  Description of Artificial Sequence: Synthetic coding sequence
atgagagcacttcttctgctgggattccttcttgtctcacttgaatcaaccttgtcgataccaccatgggaggcaccgaaggaacataagtacaaggctgaagagcatactgttgtgcttaccgtgaccggagaaccttgccattttccctttcaataccaccgacaactgtaccataagtgtactcataaggggcgccctggtccccaaccgtggtgtgcaaccacccctaactttgaccaagatcagagatggggatactgtctcgaaccaaaaaaggtgaaagaccattgctctaaacactccccctgtcagaagggaggaacttgtgtgaacatgccctccggacctcattgtctttgccctcagcatcttactggaaaccattgccaaaaagaaaagtgctttgagccacaactcctgcgctttttccacaaaaacgaaatttggtaccggacggagcaagcggccgtggcaagatgtcaatgcaaaggtcctgatgcacactgtcaacgcctggcatcacaggcatgtcgtacgaacccatgtctgcacggcgggcggtgcctcgaggtggaagggcatcgactttgtcattgtcccgtcggatacacgggagcattttgtgatgtggataccaaggcctcgtgttacgatggcagagggctgtcctataggggactggcccggaccaccctgtccggtgcaccctgccagccatgggcctcggaggcaacctacagaaatgtgactgcagaacaggcccggaattggggcctcggtggtcacgcattctgtaggaacccagacaatgatattcgcccttggtgtttcgtgttgaatagggatcgcctgtcatgggagtattgtgatcttgcgcaatgccagacccctacccaagcagcccctcctacccctgtcagccctagactccatgttccacttatgcctgcacaaccagcgcctccaaagcctcaacctaccactcggacgccccctcagtcacaaactccgggagctttgcctgcaaagagagaacagccccctagccttactcggaacggtcctctctcctgcggccaaaggctgcggaagtcactcagcagcatgactcgtgtcgtaggcggactggtggcgcttcgcggagcccatccatacatcgctgcactctactgggggcacagcttctgtgcagggagccttattgccccatgttgggtgctcaccgccgcacattgccttcaggatcgccccgcacctgaagatctcaccgtggtgctgggacaggaaaggcgaaatcactcctgtgaaccatgtcagacgctggcagtgagaagctacaggctgcatgaagcattctcgcctgtgagctatcagcatgaccttgcacttcttagattgcaagaagatgcagatggctcctgcgcactcctgtccccatacgtgcaacctgtctgccttccaagcggtgcagcacggccatccgaaaccactctgtgtcaggtggcggggtggggccaccagtttgagggagccgaggaatacgcctcctttctgcaggaggctcaagttccgtttctgtcactggaacgatgttcggccccagacgtacatggttcgtccattctgccgggtatgctctgcgccggatttcttgaggggggcactgacgcttgtcaaggggacagcggaggaccacttgtctgtgaagatcaagccgcagagcggagactcactcttcagggtattatctcttggggaagtggctgcggggaccggaacaagccgggagtatacactgatgttgcctactacctggcatggataagagagcacactgtgagc

SEQ ID NO: 249863 - DNA, 1845 bp, Artificial Sequence
  Description of Artificial Sequence: Synthetic coding sequence
atgcgcgcattgcttctgctcggattcttgctggtgtcccttgaatcgactctgagcatacccccgtgggaagccccaaaagagcataagtacaaggcagaagaacacactgtcgtcctgaccgttaccggagagccatgtcactttccattccagtaccatcggcagctgtaccacaaatgcacccacaagggccgcccgggccctcagccgtggtgcgctaccacgcccaatttcgatcaggaccagcggtggggttactgcctggagccaaagaaggttaaggaccattgctctaagcatagcccatgccagaagggagggacctgcgtgaatatgccgagcggaccccattgcctctgcccacaacacctcactggcaaccactgccagaaagaaaagtgcttcgagccacagctgctgagattcttccacaaaaatgagatctggtacaggaccgagcaagcggcggtcgcccgctgccaatgtaaaggtccggacgcccactgccagaggctggcctcacaagcctgccgcaccaacccttgcctccacggaggaagatgtctggaagtcgaggggcaccgtctttgccattgcccggtgggatataccggtgctttttgcgacgttgataccaaggcatcgtgttacgatggacggggactgagctacagaggcttggcgcggactaccctgtctggagcgccgtgtcagccgtgggcgtcagaagcaacctatcgcaacgtgactgcagagcaggctcgcaattggggccttggagggcacgccttctgtcggaacccggacaacgacatcagaccttggtgctttgtgctgaaccgcgaccgcttgagctgggagtactgcgatttggcccagtgccagacccctactcaggcggccccgccgactccggtgtcgccccgactccatgtgccattgatgccagctcagccggcgccaccaaagccgcaaccaaccacccgcactccgccgcaatcgcagactccgggggccctcccagctaaaagggagcagccgccgtccctgactagaaatggaccgctgtcgtgcggacagcgcctcagaaagtcactgagctcgatgactagagtggttggtggactggtggcccttcggggagcgcacccttacatcgcagccctgtactggggacattcgttttgtgccggatccctcatagcaccgtgttgggtgctgactgcagctcactgcctccaagaccgccctgcaccagaagatctgaccgtggtgctgggacaagaacggagaaaccacagctgtgaaccgtgccaaaccctcgccgttcggtcgtaccgcttgcacgaggcattttcacccgtgtcctatcagcacgatctcgctcttctgcggctccaggaggatgccgacggaagctgtgcgttgctgtcaccttacgtgcaaccggtctgcctcccatcgggggcggccaggccttccgaaacgaccctgtgccaggtcgcaggatggggtcaccaattcgagggagccgaagaatacgcctccttcctccaagaagctcaagtgccgtttttgtcgctggaacgctgctcggcgccagacgtgcatggatcgagcatcctgccaggaatgctctgtgcggggttcctcgaaggtggaacggatgcctgtcagggcgactccggtgggcccctggtgtgcgaagatcaggcggcggaacgccggttgacgctgcaaggtattatctcgtggggcagcggttgcggggacaggaacaagccaggcgtgtacacggacgtggcgtactacctcgcgtggatccgcgaacatacggtgtcc

SEQ ID NO: 249864 - DNA, 1845 bp, Artificial Sequence
  Description of Artificial Sequence: Synthetic coding sequence
atgcgcgcactccttcttctggggtttcttctggtgtcgctggaatcaactctctcgattcccccctgggaagcacctaaggaacacaagtacaaggcagaagaacacactgtggtcctcaccgtgaccggagaaccttgccacttcccatttcagtaccatcggcagctttaccataagtgtactcataagggtcgtccaggtccccaaccatggtgtgccaccaccccgaatttcgatcaggatcagcggtgggggtattgtctggaacctaagaaagtcaaggaccattgtagcaaacatagcccttgccaaaagggaggtacttgcgtgaacatgccatccggtccacattgcctgtgtccacaacatctcaccggaaaccattgtcagaaggaaaaatgttttgagccgcaactccttcggttctttcataagaacgagatatggtaccgcaccgaacaggcagcagttgcacggtgtcaatgcaaaggccctgatgcacactgtcaacgcctggcaagccaggcctgcagaaccaacccatgcctccatggcgggcgttgtctggaagtggaaggccatcggctttgtcattgtccagtgggttacaccggtgctttctgcgacgtggataccaaggcctcctgctatgacgggcgcggcctttcgtacagaggcctggcccgtactactctgtccggtgccccttgtcagccatgggcaagcgaagcgacgtatagaaatgtcaccgcagaacaggcacgaaactggggtcttggaggacacgcattttgccgtaaccctgataatgatattcggccttggtgtttcgtgctcaaccgcgacagattgtcatgggaatactgtgacttggcccagtgccagactcccacccaagcagccccgcctactccagtgtcgccccgtctccatgtgccgctgatgccagcacaacctgcgcctccaaagcctcagccaaccactaggacccctcctcagtcgcaaacccctggcgcactgcctgccaaaagagagcaaccaccgtcgttgaccagaaatggtccactttcgtgcggccaacgactgaggaaatccctctccagcatgacccgggtggtgggaggtcttgtagcactgcggggagcccacccctacatagcagcgttgtactggggacactccttctgcgctggtagcttgattgccccctgctgggtcctgaccgccgcacattgtttgcaagaccgccctgcccccgaggatcttaccgtagtgcttgggcaagagcgtaggaatcactcttgtgaaccgtgtcaaactctggcggtgagatcgtaccgcctccatgaggctttctccccggttagctaccaacacgatctcgctttgctgcgcctgcaagaagatgcagacggaagctgtgcactgctctctccatacgtccagcctgtgtgtctgccctcaggtgcggctcggccatcggaaactacgctgtgtcaggtggcaggatgggggcaccaattcgagggcgccgaggaatacgcatcgtttctccaagaggcccaagtcccctttctgtcacttgaaagatgttccgccccagatgtccacgggtcaagtattctccctggaatgctgtgcgctggctttcttgagggcggaaccgatgcgtgtcaaggagactccggtggtcctcttgtctgcgaagatcaggcggcagagcgacggcttaccctccagggaatcatttcgtggggttcaggttgtggcgaccgcaacaagcctggagtgtacacggatgtagcatactacttggcttggattagagagcatactgtgtcg

SEQ ID NO: 249865 - DNA, 1845 bp, Artificial Sequence
  Description of Artificial Sequence: Synthetic coding sequence
atgagggctctcctactgttgggattcctccttgtctccctggaatctacgctatcaatcccaccatgggaggccccaaaagaacataaatacaaagcggaggagcatacggtggtcttgactgtgacgggagaaccctgtcattttccgtttcaataccatcggcaattatatcataagtgtacccataaaggtcgaccaggcccccaaccttggtgtgctacgactccaaatttcgatcaggaccagcggtggggctattgtcttgagccaaagaaagtgaaagaccactgctccaagcatagcccatgccaaaagggtggtacgtgtgtaaatatgccctcgggtccacactgcttgtgcccgcaacatcttacgggtaaccattgccaaaaggagaagtgtttcgagccacagctgctacggttcttccacaaaaacgaaatatggtacaggacagagcaggcagccgttgcccgttgtcagtgcaaaggccccgatgcccactgccagcgtctcgcctctcaggcatgcagaactaacccttgcctgcatggtggtagatgtttggaagtcgaagggcaccgcctttgtcactgtccggtagggtacaccggtgccttctgtgacgtagataccaaagcgagttgctatgatggacgcggtctttcctatcgtggactcgctcgcaccacattatcaggagcaccttgccagccctgggcctctgaagcaacttaccgcaacgtcacagcagaacaagcacgtaattggggactgggaggtcatgccttctgtcgcaacccagacaatgatattagaccgtggtgttttgtgctaaatcgtgatagactgtcgtgggagtactgtgatctggctcagtgtcagaccccgacccaggctgcaccgcccaccccagtatcgccccgcttacacgtccctctcatgcccgcacaaccggccccgcccaagccacagccgaccacacgtacgcccccccagtcccagaccccgggtgcccttcctgccaaacgggagcagccgccttctctcacccgtaatggcccactcagttgtggacagcgcctcagaaaatcactcagctccatgacccgggtggttggcggcttggttgctttgaggggcgcacacccttatattgcagctctttactgggggcattcgttctgcgcaggatcgttgatcgcgccttgttgggtgttgacggccgcgcattgtctccaggacaggccggccccagaggatttgacggtggtgcttggtcaagaacgacgcaatcactcatgtgagccctgtcagacacttgctgtacgcagttaccgtctgcacgaagcattctcgccagtatcctatcagcacgatctggccttgttgagactgcaggaggatgcggacgggtcctgtgccttactctcaccttatgttcagccggtctgtctgccttcgggcgctgcaagaccaagcgaaaccacgctgtgtcaagttgctggttggggtcaccagttcgaaggcgcggaagagtacgcctcctttttgcaagaagcgcaggttcctttcctcagcctcgagcgctgctcagccccagatgttcatgggagctccatcctgcccggcatgttgtgcgccggcttcttggagggtggaacagatgcctgccagggggactctggaggacctctggtctgtgaggatcaggctgctgaacgtcgcctgactctacaggggatcatttcgtgggggagtggatgtggagatcggaataaaccgggcgtctacactgacgtggcttattacctcgcctggatccgtgagcatactgttagc

SEQ ID NO: 249866 - DNA, 1845 bp, Artificial Sequence
  Description of Artificial Sequence: Synthetic coding sequence
atgcgagctttgctgctgcttggctttctactcgtgagcctggagtccacattgtctatacctccgtgggaagcgcctaaagaacataaatacaaggccgaggagcacacagtggtcctcaccgtcactggggagccctgccactttccctttcaataccatagacagctctaccacaagtgcacacataagggcagacccggcccacagccatggtgcgcaactacacctaatttcgaccaggaccagcgctggggctactgcctggagccaaaaaaagtaaaagaccactgctcaaaacattctccgtgtcagaaagggggcacatgtgttaatatgccttccggaccacattgcctgtgtcctcagcacctgacaggcaaccactgtcaaaaggagaaatgttttgagccccagttgttgaggtttttccacaaaaacgagatctggtatcgcactgagcaggctgccgtcgctcgctgtcagtgtaaaggccccgacgctcactgccaacggctcgcctcacaggcctgtagaacaaacccttgtctgcacggggggcggtgccttgaggttgaaggacaccgcctctgccattgccccgtggggtatacgggcgccttttgcgatgtggacacaaaggcttcctgttacgatggccgcggactgtcgtatcgaggactggcccggactaccttgtcaggagccccctgccaaccgtgggcttctgaggcaacctacaggaatgttactgccgaacaggctaggaactggggcctgggtggccacgccttttgtcggaatcccgacaacgacatcagaccatggtgcttcgtgcttaatcgcgacaggttgtcatgggagtattgcgacctggcccagtgccagacccccacccaggccgcaccccctacccccgtgagtccgcgcctgcacgtgccattaatgccagcgcagccggctccacccaaaccgcagcccactactcgtacaccaccacagagtcagacccctggggcgctccccgctaagcgtgaacaacctccttcactcaccaggaacggcccactgtcttgtggtcagcggttgcggaagagcttgtcttcaatgacgcgggtcgttggaggacttgtcgcgctgagaggcgctcatccctatatagctgccctgtactggggccattctttctgtgcggggagtttgatcgccccttgctgggtcctgacagcagcgcactgtctgcaggatcggccagcccccgaggaccttaccgtagtcctgggacaagagaggaggaatcactcgtgtgagccatgtcagacactcgctgtgcgctcctaccggctccacgaggctttcagcccggttagttatcagcacgatctggcccttttgcgattacaggaagacgcagatggctcctgtgcattgctctctccgtacgtgcagccggtctgtctaccgtctggcgcagcccggccttccgagacgaccctttgccaggtggctgggtggggacaccagttcgaaggggccgaggaatacgccagctttttacaggaggcccaagtgccattcctaagtcttgagcgctgcagtgccccagacgtgcatggaagcagcattctacctggcatgctgtgtgctggatttctcgagggcggcactgacgcctgccagggagattcaggtggaccactggtatgtgaagatcaggctgcagagcgtagattgactctgcagggaatcatctcttggggcagtggctgcggggatcggaacaagccaggggtctacacagacgtcgcctactatctggcctggattcgggaacacacagtgtct

SEQ ID NO: 249867 - DNA, 1845 bp, Artificial Sequence
  Description of Artificial Sequence: Synthetic coding sequence
atgcgcgcacttctgcttctgggattcctgttggtgtcactggagtccactctttccataccaccttgggaagcccccaaggaacataagtataaggcagaggaacacaccgtcgtgctgacggtgacgggagaaccatgtcactttccctttcagtatcatcgccaactgtaccacaagtgtactcacaagggtaggcctggaccacagccatggtgcgcaaccactccaaactttgaccaagatcagagatgggggtattgtctggaacctaagaaagtgaaggatcactgttcgaagcatagcccttgccagaaaggtggaacctgtgtgaacatgccgtcgggacctcactgcctgtgtcctcaacatttgactggcaatcactgtcaaaaagaaaagtgtttcgaaccccagttgctgcggttcttccacaaaaatgagatttggtaccgaacggagcaggccgcagtggcaaggtgtcagtgtaagggacccgatgcacattgccagcggcttgcgtcgcaagcatgtaggaccaatccttgtctgcacggaggccggtgtctcgaagtcgaaggtcatcgcctttgtcactgccccgtgggttacactggagcgttttgtgatgtggataccaaagcctcatgttacgacggtcgtggactcagctacaggggcctggccaggaccaccctttccggggccccgtgccagccatgggcaagcgaagcaacttacaggaatgtcactgcagaacaagcccgaaattggggactgggcggccatgcgttttgccggaatccagataacgacatacggccttggtgttttgtcctgaacagagatcggctctcgtgggaatactgtgatctcgcccagtgccaaaccccaactcaagccgccccacccactcccgtgtcccccagacttcatgtgcctctcatgcctgcacagcctgccccacccaagcctcaacctaccactcgcacccctccccagtcccaaacccctggcgcactgcctgcgaagagagagcaaccaccttcgctgaccagaaacgggcctctgagctgtggacaaagactccgcaagtcgctctcgtccatgacccgtgtggtgggcggacttgtggcacttagaggtgcacatccctacattgcagccctgtactggggacatagcttctgcgccggctcccttatagcaccatgttgggtcctgactgccgcacactgcctgcaagatcgacctgcaccagaggaccttacggttgtgctcggacaggaaagacgtaatcattcgtgcgaaccatgccaaactctcgccgtccggtcctaccgtctgcatgaggccttttcaccggtaagttaccagcacgacctggcgctgcttcggctccaggaggacgccgacggttcgtgcgcactcctttccccttacgtccaaccagtgtgtctcccttcaggagccgccagacccagcgaaaccaccctttgccaagtggcaggttggggccatcaatttgagggagcagaggaatacgcgtcatttctccaagaggcgcaagtgcctttcctttcgctggaacgttgctcggcacctgacgtgcacgggtcgtcgatactgcccggtatgctttgtgcaggatttcttgaaggtggtaccgatgcatgtcaaggagacagcggggggcccctcgtctgtgaagatcaggcagcagagcgcagacttactctgcagggtatcatttcctggggtagcggatgtggagatagaaacaaaccgggagtgtacaccgatgtcgcatactacctcgcatggataagagaacatactgtgagc
